United States Patent 11,332,783 (SAMPLE ANALYSIS, PRESENCE DETERMINATION OF A TARGET SEQUENCE) - sequence listing, part 15

SEQ ID NO: 297768 - DNA, 75 bp, Artificial Sequence
  Synthetic
aaaaatttaatagactaattactgactcaccagtgctgtcagcaataattgattttaaaacattaaagaacttga

SEQ ID NO: 297769 - DNA, 75 bp, Artificial Sequence
  Synthetic
tacaatgtcattagaatttgtgactacgaattacatgtcacttatatctggtatgtggttgctaacagttatacc

SEQ ID NO: 297770 - DNA, 75 bp, Artificial Sequence
  Synthetic
caccaaatgcgtcagaaagctattatctaacaataaataacgataacagtaatgtgtcatgcgacgctgagtttt

SEQ ID NO: 297771 - DNA, 75 bp, Artificial Sequence
  Synthetic
gtttctacgacagttgatacagtatcaacgcaaactgctactattgctaagcggttacgattgaaagagattgca

SEQ ID NO: 297772 - DNA, 75 bp, Artificial Sequence
  Synthetic
tggaagcgttaatgcaactttctagacaacagtttccaactatgccagttgattataaaagatcaatacaaagag

SEQ ID NO: 297773 - DNA, 75 bp, Artificial Sequence
  Synthetic
tatggtatatgttagatcattatcggctaacttgaatgatgtaatctgtagtggtggtgattatagcttcgcgct

SEQ ID NO: 297774 - DNA, 75 bp, Artificial Sequence
  Synthetic
gcaatttattattactataatttatataaaagtaaaccaattatatatatgatcggatctgctccatcttattgg

SEQ ID NO: 297775 - DNA, 75 bp, Artificial Sequence
  Synthetic
atttagcaaatgctgtatcagacttaacaaacagcatgtcagacgctgcttcttcaattagtagatccacatcca

SEQ ID NO: 297776 - DNA, 75 bp, Artificial Sequence
  Synthetic
gtatggtattgaatataccacagttctaacctttctgatatcatttattttattgaattatattttaaaatcttt

SEQ ID NO: 297777 - DNA, 75 bp, Artificial Sequence
  Synthetic
ttttgtcaccattactaaaagctcaaaattatggaattaatctaccaattactggttcaatggacactgcatatg

SEQ ID NO: 297778 - DNA, 75 bp, Artificial Sequence
  Synthetic
tacctgtacaattagaaattgtaagaagttgggaccaagagaaaatgtagcgattatacaagtcggtggctcaga

SEQ ID NO: 297779 - DNA, 75 bp, Artificial Sequence
  Synthetic
aaattgcgctgaaaacatcaaagtgttcatatagggtagtaaaatactgcatagtgacaatctttaatacgctat

SEQ ID NO: 297780 - DNA, 75 bp, Artificial Sequence
  Synthetic
actttcacagttgtttttgaccaaaggatggccaactggttcagtttactttaaagaatatacggatattgcttc

SEQ ID NO: 297781 - DNA, 75 bp, Artificial Sequence
  Synthetic
atgacaattatggaataacgaaaacgcaggctatggaattgttgcagtcaaatccgagaactttgaaagaattta

SEQ ID NO: 297782 - DNA, 75 bp, Artificial Sequence
  Synthetic
aatccgagaactttgaaagaatttataaataacaataatcctataattagaaataggatagaaaatctaatagcg

SEQ ID NO: 297783 - DNA, 75 bp, Artificial Sequence
  Synthetic
gttacataaagcttcaattccaactatgaagattgctcttagaacatcaaggtgctcatataaagtaatcaagta

SEQ ID NO: 297784 - DNA, 75 bp, Artificial Sequence
  Synthetic
tagctcctaatgataagggtatagttgctgaattgacaaataacatagatatatggttagccattatcttgattg

SEQ ID NO: 297785 - DNA, 75 bp, Artificial Sequence
  Synthetic
aaagaaatgagacgtcagctggaaatgattgataagctaactactagagagattgaacaagttgaactgctcaaa

SEQ ID NO: 297786 - DNA, 75 bp, Artificial Sequence
  Synthetic
gtaattcaagttggaggttctgatgttctcgatataacggctgatccaactacagcgccacaaactgaacgaatg

SEQ ID NO: 297787 - DNA, 75 bp, Artificial Sequence
  Synthetic
ttgcaggatgacttaactgtattgagatattcaaacgaaatagagaattatattaatacagtatatagtataaca

SEQ ID NO: 297788 - DNA, 75 bp, Artificial Sequence
  Synthetic
ctatgtgaatcagataatccaagcaatgtctaagagatcacgatcgcttaactctgctgcattttattatagagt

SEQ ID NO: 297789 - DNA, 75 bp, Artificial Sequence
  Synthetic
ttaaaatcgttttgtgatttttatataataccacgcatgccacgagaagtgtgcagaaattatattaatcatggt

SEQ ID NO: 297790 - DNA, 75 bp, Artificial Sequence
  Synthetic
gtgcagaaattatattaatcatggtcttccaccaatgcagaacactagaaatgtggtatcagttgcattgtcagc

SEQ ID NO: 297791 - DNA, 75 bp, Artificial Sequence
  Synthetic
catctgattctgcttcaaacgatccactcaccagcttttcgattagatcgaatgcagttaagacaaatgcagatg

SEQ ID NO: 297792 - DNA, 75 bp, Artificial Sequence
  Synthetic
agatttaaattcgctaatcaaataatcaaatctggaggactaggatacaagtgggcagaaatctctttcagacca

SEQ ID NO: 297793 - DNA, 75 bp, Artificial Sequence
  Synthetic
ggcttttttttgaaaagtcttgtgttagccatggctacttttaaagatgcatgctttcattatcgtagattaact

SEQ ID NO: 297794 - DNA, 75 bp, Artificial Sequence
  Synthetic
ttggtgcaaattctatttggatgccagttcctgatgcgaaaattaaggggtggtgtttagaatgttgtcaaatag

SEQ ID NO: 297795 - DNA, 75 bp, Artificial Sequence
  Synthetic
agttcctgatgcgaaaattaaggggtggtgtttagaatgttgtcaaatagctgatttaacccattgttatggttg

SEQ ID NO: 297796 - DNA, 75 bp, Artificial Sequence
  Synthetic
tggtgtttagaatgttgtcaaatagctgatttaacccattgttatggttgctcattgccgcatgtttgcaaatgg

SEQ ID NO: 297797 - DNA, 75 bp, Artificial Sequence
  Synthetic
accaaagacaaattacagtgtatcatagacttgtacaatataatatttccaattaatgataaagtaattagaaaa

SEQ ID NO: 297798 - DNA, 75 bp, Artificial Sequence
  Synthetic
atagacagctactcactaattcatacacagttgaattatcagatgaaattaatacaattggatcagaaaaaagtc

SEQ ID NO: 297799 - DNA, 75 bp, Artificial Sequence
  Synthetic
agtttgatgaaaataatctttattatgtttttgggttatatgagaaatcagtcagtgatatatatgctccatata

SEQ ID NO: 297800 - DNA, 75 bp, Artificial Sequence
  Synthetic
aaagaaatacttccaattatcaagactgccatcatcaaaactaaagcaaatttacttttcagattttactaaaga

SEQ ID NO: 297801 - DNA, 75 bp, Artificial Sequence
  Synthetic
tgggtttatgaaattttataatagtgtttggactttccacggtgaaacgccgcatgctacaactgattactcgtc

SEQ ID NO: 297802 - DNA, 75 bp, Artificial Sequence
  Synthetic
ttaaaaaatgataagaataaattaattgctgcaatgatgacgagtaagtatactcggttctatgctcatgataat

SEQ ID NO: 297803 - DNA, 75 bp, Artificial Sequence
  Synthetic
tgaatctgcggtgtgtgaatctgtacttgctgatgcaagcgaaacaatgctagctaatgtgacgtctgttaggca

SEQ ID NO: 297804 - DNA, 75 bp, Artificial Sequence
  Synthetic
atgctacaaaaactcaattatcagagaaagtgttatctcagaaagaagaagtaattacagataaccaggaagaaa

SEQ ID NO: 297805 - DNA, 75 bp, Artificial Sequence
  Synthetic
atagcgacacagactgatggtatgaattttgacgacatttctgctgcagtattaaaaactaaaatagataaatca

SEQ ID NO: 297806 - DNA, 75 bp, Artificial Sequence
  Synthetic
attcgtgatatgtataatttattgatggaatttattaaggattgttataaaagtaatgttaacgttggacattgt

SEQ ID NO: 297807 - DNA, 75 bp, Artificial Sequence
  Synthetic
atggtcagaaatttcgtttaaagcggctaattatcagtacagttacttgcgagatggagagcaagttacggcaca

SEQ ID NO: 297808 - DNA, 75 bp, Artificial Sequence
  Synthetic
aataactttagttataatggaggatcactaccaactgattttagtgtatcaagatatgaagtgattaaagaaaat

SEQ ID NO: 297809 - DNA, 75 bp, Artificial Sequence
  Synthetic
tattggaaactaaaacgcgatactttgcctgatggagattatgatgtgagagaatattttttgaatttatacgat

SEQ ID NO: 297810 - DNA, 75 bp, Artificial Sequence
  Synthetic
agcgcactttgaatgtagatagcataccaatggtacttaatttaaatgaattcagtagtatagttaaatcaatta

SEQ ID NO: 297811 - DNA, 75 bp, Artificial Sequence
  Synthetic
agcatataatttattacgatcagacccgcgagtgttacgtgagtttatcgatcaggaaaatccaataatacgcaa

SEQ ID NO: 297812 - DNA, 75 bp, Artificial Sequence
  Synthetic
agctccttttaatgtatggtattgaatataccacaattctaatcgttctgatgacgatcattctactcagatata

SEQ ID NO: 297813 - DNA, 75 bp, Artificial Sequence
  Synthetic
accattaaataatgatataatatttaattatatacctgaaagaatacgaaatgacgttaattatatattaaacat

SEQ ID NO: 297814 - DNA, 75 bp, Artificial Sequence
  Synthetic
ctgagctagcttgcttttgttatccccatttggagaacgatagctatagatttattccatttaacagtttagcta

SEQ ID NO: 297815 - DNA, 75 bp, Artificial Sequence
  Synthetic
aatgtgttaatgatttacacttttcaattaatgtgttagagaacttacataatccaagtttcaaaatacagatta

SEQ ID NO: 297816 - DNA, 75 bp, Artificial Sequence
  Synthetic
tttatactcagaaagattaaagaaagaatgacaacgtcattaccaatagcaagactttcgaatcgtgtattcagg

SEQ ID NO: 297817 - DNA, 75 bp, Artificial Sequence
  Synthetic
ttactggatctatggatacagcatacgctaattcaacgcaaagtggcaattttttgtcatcaacgttatgtctgt

SEQ ID NO: 297818 - DNA, 75 bp, Artificial Sequence
  Synthetic
tttcaatgaatattcgaatgttctagaattctctattgatccaaaactttattgtgattataatgttgttttaat

SEQ ID NO: 297819 - DNA, 75 bp, Artificial Sequence
  Synthetic
tagaagcactaacaatccaatctgaaacacaattcttaacaggtatcaattcacaagccgctaatgattgtttta

SEQ ID NO: 297820 - DNA, 75 bp, Artificial Sequence
  Synthetic
tagctacatcaatctctgaattgactggatcattatcaaacgctgcttcatcagtttccagaagttcatctatta

SEQ ID NO: 297821 - DNA, 75 bp, Artificial Sequence
  Synthetic
agtactaatagctattggtcattcaaaagaaatcgagacaactgccactgctgaaggaggggaaattgtttttca

SEQ ID NO: 297822 - DNA, 75 bp, Artificial Sequence
  Synthetic
cagcaaactggagaagcgaacaagtggatatcgatgggatcatcatgtactattaaagtatgtccattgaataca

SEQ ID NO: 297823 - DNA, 75 bp, Artificial Sequence
  Synthetic
tagtaaaagattgcgactacgcgaaattactacacaaactgaaggtatgaattttgatgatatttcagcggcagt

SEQ ID NO: 297824 - DNA, 75 bp, Artificial Sequence
  Synthetic
cgacaaatgcaggtacttttgagatggtagctgagaatgaaaaattggcaatagtcgatgttgttgatagtgtga

SEQ ID NO: 297825 - DNA, 75 bp, Artificial Sequence
  Synthetic
attactacacaaactgaaggtatgaattttgatgatatttcagcggcagtccttaaaactaaaatagatagatca

SEQ ID NO: 297826 - DNA, 75 bp, Artificial Sequence
  Synthetic
tgatgcgtgtgaattggaaaagatggtggcaagtattttacactgtagttgattatattaatcaaatagtacagg

SEQ ID NO: 297827 - DNA, 75 bp, Artificial Sequence
  Synthetic
gtggcaagtattttacactgtagttgattatattaatcaaatagtacaggtcatgtccaaaagatcgagatctct

SEQ ID NO: 297828 - DNA, 75 bp, Artificial Sequence
  Synthetic
aactatgttgcaaaaaccagtgtcatttaaatcaaataaaattactattaatgatattttgcgtgacataaaacc

SEQ ID NO: 297829 - DNA, 75 bp, Artificial Sequence
  Synthetic
atgctagaactactattgaatactttattgattttatagataatgtatgtatggatgaaatagctagagaatcac

SEQ ID NO: 297830 - DNA, 75 bp, Artificial Sequence
  Synthetic
tctgcagttcaaattccaatatattactcttccaacagtgaattagaaaatagatgtattgaatttcattccaag

SEQ ID NO: 297831 - DNA, 75 bp, Artificial Sequence
  Synthetic
cttacgacaagtataacgctgttgaaagaaaattggtgaagtatgcgaaaggcaaaccattggaggcagacttaa

SEQ ID NO: 297832 - DNA, 75 bp, Artificial Sequence
  Synthetic
tacagttgtatttagtttcattaggagttccaccagttgacgcaggcacgtacgttgggtcaagaatatattcgc

SEQ ID NO: 297833 - DNA, 75 bp, Artificial Sequence
  Synthetic
ttcgctatcatcaaatttaaatgcagtcatgttctggttggaaaaacatgaaaatgatgtcgctgaaaaacttaa

SEQ ID NO: 297834 - DNA, 75 bp, Artificial Sequence
  Synthetic
gtaatgaaagataaaccatactacttagtgacatgggcaaattcttcaattgaaatgttaatgtcagttttctct

SEQ ID NO: 297835 - DNA, 75 bp, Artificial Sequence
  Synthetic
ccttggtggatattaatggaacatttattacaaatgaagaattagaattggaattttcaaataaatatgtacgag

SEQ ID NO: 297836 - DNA, 75 bp, Artificial Sequence
  Synthetic
tattacaaatgaagaattagaattggaattttcaaataaatatgtacgagcaatagttccggatcaaacatttga

SEQ ID NO: 297837 - DNA, 75 bp, Artificial Sequence
  Synthetic
aatagatactacaaaactacacatagattctatttatttaagaaaaataaaaggtgacacggtgtttgatatgac

SEQ ID NO: 297838 - DNA, 75 bp, Artificial Sequence
  Synthetic
gatcaattgaaaactgagtatacagaaaatgtggacgatgaaatgtatcgggaatatacaatgttaataagagat

SEQ ID NO: 297839 - DNA, 75 bp, Artificial Sequence
  Synthetic
cagttaaacatgatgatcacttgctacgagattctgagttagctggtttactatcaatgtcgtcagcatcgaatg

SEQ ID NO: 297840 - DNA, 75 bp, Artificial Sequence
  Synthetic
ttatcaatgtcatcagcttcaaatggtgaatcaaggcaacttaaatttggtcgtaaaacgatattttcaactaag

SEQ ID NO: 297841 - DNA, 75 bp, Artificial Sequence
  Synthetic
atggtgatgttacaagattcttatccagtaattctatggtattatacacagacgtttcacaatgggattcgtcac

SEQ ID NO: 297842 - DNA, 75 bp, Artificial Sequence
  Synthetic
tataataccaccagtgaatgttgataaaccaataccattaggaagaagagatgttccaggaagaaggactagaat

SEQ ID NO: 297843 - DNA, 75 bp, Artificial Sequence
  Synthetic
gagagtacttaatgcatgtttcagtgtgaaaagaattccaggtaaatcatcatcaataattaaatgtactagatt

SEQ ID NO: 297844 - DNA, 75 bp, Artificial Sequence
  Synthetic
gtgaaaagaattccaggtaaatcatcatcaataattaaatgtactagattaatgaaagataaaattgaacgtggt

SEQ ID NO: 297845 - DNA, 75 bp, Artificial Sequence
  Synthetic
aagctgctgaatttaatgaccgtgatcttttggacataacttgcacaatctgattaatataatctactaccgtat

SEQ ID NO: 297846 - DNA, 75 bp, Artificial Sequence
  Synthetic
gacttgtataatcgctacattttctcttggtcctaacttcttacaattcctaatagtgcaggtatttgtagtcac

SEQ ID NO: 297847 - DNA, 75 bp, Artificial Sequence
  Synthetic
atttcatgttcgaaacttgggatccacttgatactccatattcatcaatacatcataaagagttattttttgaga

SEQ ID NO: 297848 - DNA, 75 bp, Artificial Sequence
  Synthetic
attcctaaagtctgcgtattcaatggacatacttttatggtacaagactgtcccatagatatccatttattcgct

SEQ ID NO: 297849 - DNA, 75 bp, Artificial Sequence
  Synthetic
caaacgaaagcagcaaattcaatagcaaatttggcactgattaaaacggttttgtcacgtatttctaacaaacat

SEQ ID NO: 297850 - DNA, 75 bp, Artificial Sequence
  Synthetic
gcatatcaatacttagctagtggtaaatcaaaggtgtgctgtgttaaaatgacagccatggatttagagcttcct

SEQ ID NO: 297851 - DNA, 75 bp, Artificial Sequence
  Synthetic
aatatacgtatgaataatcacataatataactaaaattaccatcttcacatgaccctctatgagcacaatagtta

SEQ ID NO: 297852 - DNA, 75 bp, Artificial Sequence
  Synthetic
acgatgtaagagaaacttatgcacgcatgaatgctaaagttaaagctctggtatccacagtaggaatagaaattg

SEQ ID NO: 297853 - DNA, 75 bp, Artificial Sequence
  Synthetic
ttgaatcatacttcatcagtacaacattataatcacaataaagttgtggatcaattgagaatgaagcgatatcag

SEQ ID NO: 297854 - DNA, 75 bp, Artificial Sequence
  Synthetic
aatccgttcaaaggattgtcaactgatagaaaaatggatgaagtctcacatgttggaatttaattcgctttcgat

SEQ ID NO: 297855 - DNA, 75 bp, Artificial Sequence
  Synthetic
caaagggagtattgtattcatttataaataacgttactactgaaaatgtgttcatacaaccaccatttaaaatta

SEQ ID NO: 297856 - DNA, 75 bp, Artificial Sequence
  Synthetic
ctacttaataatgaaaagagagggcagagtacgcagtgggatcaagcagcaattttatattcaaattatattgta

SEQ ID NO: 297857 - DNA, 75 bp, Artificial Sequence
  Synthetic
ttctgtaggataatataagcatagcgttgaagtcaaaaatgtttcttgctgtgatgaatttacatatgctgtatc

SEQ ID NO: 297858 - DNA, 75 bp, Artificial Sequence
  Synthetic
gttgaagtcaaaaatgtttcttgctgtgatgaatttacatatgctgtatccatggagccagtgatcggtaaatta

SEQ ID NO: 297859 - DNA, 75 bp, Artificial Sequence
  Synthetic
gattttattatagagtacggaacgactgatgacgaagtatatatacaaagagcgttcatgtctttatcaagtcag

SEQ ID NO: 297860 - DNA, 75 bp, Artificial Sequence
  Synthetic
tatagttcaataaaattattgatatcagaaaggttagaattgtggtatattcaataccatacattaaaaggagct

SEQ ID NO: 297861 - DNA, 75 bp, Artificial Sequence
  Synthetic
gcagaaaccggtcactttcaaatcaagtaaaataacaataaatgacatactcagagatataaaaccattttttac

SEQ ID NO: 297862 - DNA, 75 bp, Artificial Sequence
  Synthetic
ttttccaaccattaagcaattttcaaacggtgcatacatcgtaaaacatactattaaattgaagcaggaaaaatg

SEQ ID NO: 297863 - DNA, 75 bp, Artificial Sequence
  Synthetic
agtaaagcttatgaaagatatgaaaaaggaattgtttggaatggatgtaacaactagttatacttatatgttatc

SEQ ID NO: 297864 - DNA, 75 bp, Artificial Sequence
  Synthetic
gctatcaattatttgatttcaattcaccggacttggagaagctgataagaataccatttaagggaaaaataccag

SEQ ID NO: 297865 - DNA, 75 bp, Artificial Sequence
  Synthetic
tagaaaaacaattttttcaactaaaaagaatatgcatgtgatggatgacatggctaatggaagatacacaccagg

SEQ ID NO: 297866 - DNA, 75 bp, Artificial Sequence
  Synthetic
aagaatatgcatgtgatggatgacatggctaatggaagatacacaccaggcataataccaccagtaaatgttgac

SEQ ID NO: 297867 - DNA, 75 bp, Artificial Sequence
  Synthetic
tacagtagatttatccgatgagatacaagagattggatcaactaaatcacaaaatgtcacaattaatcctggacc

SEQ ID NO: 297868 - DNA, 75 bp, Artificial Sequence
  Synthetic
tacaattcaataatttatggtattgcaccaccgccacaattcaaaaaacgttataacacaaatgataattcaaga

SEQ ID NO: 297869 - DNA, 75 bp, Artificial Sequence
  Synthetic
acattcaatccaccagtcgattattggatgttactggctccaacgacacctggcgtaattgttgaaggtacaaat

SEQ ID NO: 297870 - DNA, 75 bp, Artificial Sequence
  Synthetic
tctcaaaagtagtttctgtaagacatctagagaatttggtgttgagaagagagaatcatcaggacgtacttttcc

SEQ ID NO: 297871 - DNA, 75 bp, Artificial Sequence
  Synthetic
ccaatacttcacaagaccagtggaaatttattgatgtcgtaaaaacaactgcaaatggaagtataggacaatatg

SEQ ID NO: 297872 - DNA, 75 bp, Artificial Sequence
  Synthetic
aaagaaattgagacaactgccactgctgaaggaggagaaatcgtttttcaaaatgcagcttttacaatgtggaaa

SEQ ID NO: 297873 - DNA, 75 bp, Artificial Sequence
  Synthetic
tctatcacgcatatctaataaatactcatttgccacaaagataataagagttgatggtgatgacaactacgccgt

SEQ ID NO: 297874 - DNA, 75 bp, Artificial Sequence
  Synthetic
tcatttatttataataaatggaactgacaaatattataaactagatcagtatgcaaatcacatgggcatttctag

SEQ ID NO: 297875 - DNA, 75 bp, Artificial Sequence
  Synthetic
ttcaacaacgaattatgattctgttaacatgactgctttttgtgacttttatataattcctagatctgaagagtc

SEQ ID NO: 297876 - DNA, 75 bp, Artificial Sequence
  Synthetic
gctcaagctaatgaagatattgtgatatccaagacatcattatggaaagaaatgcaatataatagagatataact

SEQ ID NO: 297877 - DNA, 75 bp, Artificial Sequence
  Synthetic
aaattatggaattaatttaccgataacagggtcgctggatagtgcgtatactaacacaactgatgataaaccatt

SEQ ID NO: 297878 - DNA, 75 bp, Artificial Sequence
  Synthetic
ctcgtgatggtgaagaagttaccgcacatactacttgttcagtgaatggcgttaatgacttcagttttaatggag

SEQ ID NO: 297879 - DNA, 75 bp, Artificial Sequence
  Synthetic
ctgatgatgaagtgtatatacaaagagcatttatgtcattatcaagtcaaagatcgggaatagctgatgaaatag

SEQ ID NO: 297880 - DNA, 75 bp, Artificial Sequence
  Synthetic
agtacaatctaatcttgtcagaatatctatcatttatttataattcacaatccgctgtacaaattccaatttatt

SEQ ID NO: 297881 - DNA, 75 bp, Artificial Sequence
  Synthetic
ggttggcctatgggttcagtatactttaatgagtatgctaacatagctgaattttcaatcaatccgcaacttttt

SEQ ID NO: 297882 - DNA, 75 bp, Artificial Sequence
  Synthetic
cgtgatgtatgtccgatcgttagcagcaaacttgaattcagttatgtgtactggaggcagctataattttagtct

SEQ ID NO: 297883 - DNA, 75 bp, Artificial Sequence
  Synthetic
tggacataacactatattattatcaacagactgatgaagcaaataagtggatatcgatgggtacatcgtgcacaa

SEQ ID NO: 297884 - DNA, 75 bp, Artificial Sequence
  Synthetic
tcattaagatttagatttagactagctgtcgaagaaccacactttaaactgactagaactagattagatagattg

SEQ ID NO: 297885 - DNA, 75 bp, Artificial Sequence
  Synthetic
acatattacactgagttttagtaacaaacagacagttagaatagaaagtacaagactcaaaatcaattcaattta

SEQ ID NO: 297886 - DNA, 75 bp, Artificial Sequence
  Synthetic
tactgacgtggttgatggggtgaatcataaactggatattacaaatacgacgtgcacgatacgcaattgcaaaaa

SEQ ID NO: 297887 - DNA, 75 bp, Artificial Sequence
  Synthetic
agactcctatagcaaactcagttactgtacgacaagatttagaaaggcagttaggagaactaagagaagagttta

SEQ ID NO: 297888 - DNA, 75 bp, Artificial Sequence
  Synthetic
attacataaggcatcgattccaacaatgaaaatagcattaaaaacgtcaaaatgttcgtataaagtgattaaata

SEQ ID NO: 297889 - DNA, 75 bp, Artificial Sequence
  Synthetic
cataaactggatattacaaatacgacgtgcacgatacgcaattgcaaaaaactaggacctagagagaatgtagct

SEQ ID NO: 297890 - DNA, 75 bp, Artificial Sequence
  Synthetic
tgcaaagtatagatatgagtatgaggtaatgaaagataaaccatattatttagtaacatgggcaaattcgtcaat

SEQ ID NO: 297891 - DNA, 75 bp, Artificial Sequence
  Synthetic
tgctgcaaaatcaatggctactaatgttatgaaaaaattcaaaaagtcaggattagcgaattcagtttcaacact

SEQ ID NO: 297892 - DNA, 75 bp, Artificial Sequence
  Synthetic
ggcaagtattttatacaattgttgattatattaatcagattgttaaagttatgtcgaaaagatccagatcgttga

SEQ ID NO: 297893 - DNA, 75 bp, Artificial Sequence
  Synthetic
atgtcgaaaagatccagatcgttgaactcagcagctttttattatagagtatgagatgttaaatgaattagagtt

SEQ ID NO: 297894 - DNA, 75 bp, Artificial Sequence
  Synthetic
ttgattatgaaaataacaaaataacttctgaactgtttcagtcagccgaagaatacaccgattcattaatggatc

SEQ ID NO: 297895 - DNA, 75 bp, Artificial Sequence
  Synthetic
aactaataattctttcatattcgaatagatctactttagccaaactcgtttcgtcaccaatgtcaattctagttg

SEQ ID NO: 297896 - DNA, 75 bp, Artificial Sequence
  Synthetic
tagatctactttagccaaactcgtttcgtcaccaatgtcaattctagttgcgttagtagatataaatggtacttt

SEQ ID NO: 297897 - DNA, 75 bp, Artificial Sequence
  Synthetic
ataactgatatatcgtcatcagtaagttcagtttcgacacaaacgtcaactatcagtagaagattgagactaaag

SEQ ID NO: 297898 - DNA, 75 bp, Artificial Sequence
  Synthetic
tacctgacattgttactgaagcatcggaaaaattcataccaaatagggcttaccgcgttataaacaacgatgatg

SEQ ID NO: 297899 - DNA, 75 bp, Artificial Sequence
  Synthetic
ggtcttttcatgtaggattcagaaaacagaaaatgttagacgccgcattagatcagttaaagactgaatatactg

SEQ ID NO: 297900 - DNA, 75 bp, Artificial Sequence
  Synthetic
gatcagttaaagactgaatatactgaagatgttgatgatgagatgtatagagaatataccatgttaattagagac

SEQ ID NO: 297901 - DNA, 75 bp, Artificial Sequence
  Synthetic
agcaaaactagtttcatctccaatgtcaatattatttgcattaatagatatcaatggtacgtttattacgaatga

SEQ ID NO: 297902 - DNA, 75 bp, Artificial Sequence
  Synthetic
ttctccagtaatatccgctataattgattttaaaacacttaaaaatttgaacgataattacggcattactaagca

SEQ ID NO: 297903 - DNA, 75 bp, Artificial Sequence
  Synthetic
gacccaagagttttacgtgaattcattaatcaggacaatcctataattagaaatagaattgaacaactgattatg

SEQ ID NO: 297904 - DNA, 75 bp, Artificial Sequence
  Synthetic
aagaatatgcatgtaatggatgatatggctaatggaaaatatacgccaggagttattccaccagttaatatcgat

SEQ ID NO: 297905 - DNA, 75 bp, Artificial Sequence
  Synthetic
ttcaagaatggttagttgattgttcattagagaaatttacactgatgtcaaaaatttattcttggtcatttcatg

SEQ ID NO: 297906 - DNA, 75 bp, Artificial Sequence
  Synthetic
attgcacacaatacttgaggatccaggaatggcgtattttccttatatagcatctgtcttaacagttttgtttgc

SEQ ID NO: 297907 - DNA, 75 bp, Artificial Sequence
  Synthetic
tggtactggaagctgaaaaaagatacactgccagatggagattacgatgtacgagagtatttcttgaatttatat

SEQ ID NO: 297908 - DNA, 75 bp, Artificial Sequence
  Synthetic
aacataatacacaaccatttagaaaaggaataattatgggattagatatgctagctaatatgactaatgatgcta

SEQ ID NO: 297909 - DNA, 75 bp, Artificial Sequence
  Synthetic
cagcgagcatttgcgacgctatattccaagatgaagaaacagaaggagttattagaagatttatagcagacatga

SEQ ID NO: 297910 - DNA, 75 bp, Artificial Sequence
  Synthetic
tatagtaaattatccatcgattttgcatccaattgaccatgcatttaatgaatattttttaaatcaccagttggt

SEQ ID NO: 297911 - DNA, 75 bp, Artificial Sequence
  Synthetic
aatgaatgcaaaagtaaaagctttggtttcaacggttggaatagagattgctaaacgttacattgccggcgggaa

SEQ ID NO: 297912 - DNA, 75 bp, Artificial Sequence
  Synthetic
atggtgaaaaagaattacgtaacagatggtattggaaattgaagaaagatactttaccagatggagattatgacg

SEQ ID NO: 297913 - DNA, 75 bp, Artificial Sequence
  Synthetic
ttcaagatgaggaaacagaaggtgcagtgagaagatttattgcagagatgagacagcgcgtacaagctgacagaa

SEQ ID NO: 297914 - DNA, 75 bp, Artificial Sequence
  Synthetic
aacaaaataactattaatgacattttgcatgacattaaaccatactttgtaacaagtgaggctaatctgcccata

SEQ ID NO: 297915 - DNA, 75 bp, Artificial Sequence
  Synthetic
ttcaaaatgttatttcacagcaacaaaaccagatagcagatcttcaacagtattgtaacaaattggaaactgact

SEQ ID NO: 297916 - DNA, 75 bp, Artificial Sequence
  Synthetic
ataactatgaaactttaatggcttgtataactatgaatatgcaacatgtccaaactcttactactgaaaagttgc

SEQ ID NO: 297917 - DNA, 75 bp, Artificial Sequence
  Synthetic
aatgtaattgtatccaaaggtatagctgtaacagaaaaagcgaaattgaattcatatgcaccagtttatttagaa

SEQ ID NO: 297918 - DNA, 75 bp, Artificial Sequence
  Synthetic
tcattcaaattacaacgagcgaattaatgatgcagtagcaattattaccgcagccaacaggttaaatttatacca

SEQ ID NO: 297919 - DNA, 75 bp, Artificial Sequence
  Synthetic
gagtaataattgcttatagagatatgcagctggaaagagatgaaatgtatggatacgttaatatcgctagaaatc

SEQ ID NO: 297920 - DNA, 75 bp, Artificial Sequence
  Synthetic
aatgcccgttgattataaaaggtcaattcagcgtggaatattgttgctatcaaacagacttggtcaattagttga

SEQ ID NO: 297921 - DNA, 75 bp, Artificial Sequence
  Synthetic
taccgtaaatttatcagatgagatacaagagatcgggtctacgaaaactcaaaatactaccattaacccaggtcc

SEQ ID NO: 297922 - DNA, 75 bp, Artificial Sequence
  Synthetic
aaagaaaaggaacaggaagtaaaattgtcaaaagatcaacaggagcaagagaaagaaacgaagcaaaatgagaag

SEQ ID NO: 297923 - DNA, 75 bp, Artificial Sequence
  Synthetic
ttattggaaatgcaaccgtcatacccagtccacaaacgttattccactattataatgttaatgttaactttcact

SEQ ID NO: 297924 - DNA, 75 bp, Artificial Sequence
  Synthetic
tgaagttggataaacaaattattgagtctaagaaagaagattcaaaacagctagttgaagtactaaaaactaaaa

SEQ ID NO: 297925 - DNA, 75 bp, Artificial Sequence
  Synthetic
agatccaattaaaaaatcagaaaaactatttagattattcgaaccaaaacaattgccgatttatcgtgcgaatgg

SEQ ID NO: 297926 - DNA, 75 bp, Artificial Sequence
  Synthetic
ttcagctactaattatgactcagtaaacatgacgactttttgtgatttttatataataccacgatctgaagagtc

SEQ ID NO: 297927 - DNA, 75 bp, Artificial Sequence
  Synthetic
caagtattagaatatatgccagattatatgttgctgaaagaaatggccgtcgaaaataagaattcaagagatgct

SEQ ID NO: 297928 - DNA, 75 bp, Artificial Sequence
  Synthetic
aaagagttaatgctgaacgcaatactgtagattatccagctattctacatcaaatagactatgaatttaatcaat

SEQ ID NO: 297929 - DNA, 75 bp, Artificial Sequence
  Synthetic
ggatgttaatttgccacctactgccaggtatataagaccagttttactacaggataggctgaatttacatgataa

SEQ ID NO: 297930 - DNA, 75 bp, Artificial Sequence
  Synthetic
caggcagcagttttatactctaattatatcgtaaatagacttagggggtttgagactgatagagaatttatttta

SEQ ID NO: 297931 - DNA, 75 bp, Artificial Sequence
  Synthetic
aatcactcttatgaatgatacattgcatactataatggaggatcctggaatggcgtattttccatatatagcttc

SEQ ID NO: 297932 - DNA, 75 bp, Artificial Sequence
  Synthetic
cagaagatgtcacaagatttacaattggaagcgctaactattcaatcagagactcaatttctaactggcataaat

SEQ ID NO: 297933 - DNA, 75 bp, Artificial Sequence
  Synthetic
tggaccagtttttccaccaggtatgaattggactgatttgatcaccaactattcaccatctagagaggataactt

SEQ ID NO: 297934 - DNA, 75 bp, Artificial Sequence
  Synthetic
tatccagtatgtggttaatgtcagtagtacctactagtatgttcattagagagtcactcgttgcttgccagcttg

SEQ ID NO: 297935 - DNA, 75 bp, Artificial Sequence
  Synthetic
agtttcagtaagacatttggaaaacttggtattgaggagagaaaatcatcaagacgtactttttcattcaaaaga

SEQ ID NO: 297936 - DNA, 75 bp, Artificial Sequence
  Synthetic
taataattttcaagtccagaactggttgcattttgttaatcataacgcgtttaatcaagtagctattgatggagt

SEQ ID NO: 297937 - DNA, 75 bp, Artificial Sequence
  Synthetic
ccaatagattatagaaggtcggtgcaaagaggtatactattattggctaatagagttggtcaattagttgattta

SEQ ID NO: 297938 - DNA, 75 bp, Artificial Sequence
  Synthetic
cagttacttcattatgtatgttgattggaaatactactgtaattccggagccaagaacactatttcactattatc

SEQ ID NO: 297939 - DNA, 75 bp, Artificial Sequence
  Synthetic
tcaatccaaatttctccaaccacattaccagacattgttaccgaagcttcagagaaatttattcctaatagggca

SEQ ID NO: 297940 - DNA, 75 bp, Artificial Sequence
  Synthetic
atcgtcaattgaatggtacatgaaatcgatggaactgcctgacgaagttaaaactgatattgaacagcagttaaa

SEQ ID NO: 297941 - DNA, 75 bp, Artificial Sequence
  Synthetic
aacagattactactaaagatgaaatagaaaaacaaatggacagagtcgttaaagaaatgagacgtcaattagaga

SEQ ID NO: 297942 - DNA, 75 bp, Artificial Sequence
  Synthetic
gaagttaattgttgaggatttccttaagaaattgcacatttttgatgtatcaaaagtaccagacgatcaaatgta

SEQ ID NO: 297943 - DNA, 75 bp, Artificial Sequence
  Synthetic
tgatagaacatttttaatgtttaagggactaatgaggcaatgcaactatgaatatacgtatgaatagtcacataa

SEQ ID NO: 297944 - DNA, 75 bp, Artificial Sequence
  Synthetic
gacccaagagtgctacgcgaatttattaatcaaaataacccaataattcgaaatagaattgaacaattgataatg

SEQ ID NO: 297945 - DNA, 75 bp, Artificial Sequence
  Synthetic
gataaaatagctcaaggtgtaattattgcataccgtgaaatgcaactagactatgatgaactatatggattcgtg

SEQ ID NO: 297946 - DNA, 75 bp, Artificial Sequence
  Synthetic
aaccagtcgcactagtcggagctattccatttataactgattcagcagtcacttcgttaatagctaaattagacg

SEQ ID NO: 297947 - DNA, 75 bp, Artificial Sequence
  Synthetic
gactactattgatcaagctttaaatggtaaatttagttcggcaattagaaatagaaattggatgactgattctcg

SEQ ID NO: 297948 - DNA, 75 bp, Artificial Sequence
  Synthetic
aaattataattgggtgccgacttctacgacgaaggtatttaaacaagttccacaagtttttgactttagagccgc

SEQ ID NO: 297949 - DNA, 75 bp, Artificial Sequence
  Synthetic
cagatcatagcagagtagttaacgttggaccaaggaatgaatccatgtttacttttctagatcatccgtcaataa

SEQ ID NO: 297950 - DNA, 75 bp, Artificial Sequence
  Synthetic
aatgaaggataaattagagcgtggtgaagttgaagtggatgattcattcgttgaagaaaaaatggaaattgatac

SEQ ID NO: 297951 - DNA, 75 bp, Artificial Sequence
  Synthetic
taccatttgttaatgccgacactgttgagcccattaatgctgttgcatttgacaacattagaattatgcaagaac

SEQ ID NO: 297952 - DNA, 75 bp, Artificial Sequence
  Synthetic
taggaaacactacccaagaattgaagcagattctgattctgaagattatgttttggatgattcagatagtgatga

SEQ ID NO: 297953 - DNA, 75 bp, Artificial Sequence
  Synthetic
atgtttaataaagtggcggtgttaatttgtgaagcgttgaattcaattaaagttactcaatctgatgttgcgagt

SEQ ID NO: 297954 - DNA, 75 bp, Artificial Sequence
  Synthetic
attgattattttgttgattttgtagataatgtgtgcatggatgagatggcacgagaatctcaaaggaacggcatc

SEQ ID NO: 297955 - DNA, 75 bp, Artificial Sequence
  Synthetic
acagaagacaaagaacgggatttacgtttcataaaccaaatattttcccatattcattttcattcacattaaaca

SEQ ID NO: 297956 - DNA, 75 bp, Artificial Sequence
  Synthetic
cagagatatcataataagatttaaattcaataatagtatagtaaaactcggtgggctgggttataaatggtcaga

SEQ ID NO: 297957 - DNA, 75 bp, Artificial Sequence
  Synthetic
cccagctaatacccaacaattcgaacatattgttcaactgcgccgtgtgcttactacagctaccattactttact

SEQ ID NO: 297958 - DNA, 75 bp, Artificial Sequence
  Synthetic
gaagttgaatttcttttgaatggtcagattattaatacttatcaagcaagatttggaactattacagctagaaat

SEQ ID NO: 297959 - DNA, 75 bp, Artificial Sequence
  Synthetic
taaatctggtatagctgcaatagaaatacagaagatagatgagttattcacgttaattagatgtaactttacata

SEQ ID NO: 297960 - DNA, 75 bp, Artificial Sequence
  Synthetic
ttgcaagacgatttaacggtactaagatattcaaatgaaatagaaaactacattaataaagtgtacagtataaca

SEQ ID NO: 297961 - DNA, 75 bp, Artificial Sequence
  Synthetic
caacagttggcttaactcttcgaattgactccgcaatttgtgaatcagtactagcagatgctaacgaaactatgc

SEQ ID NO: 297962 - DNA, 75 bp, Artificial Sequence
  Synthetic
tcatttagatgtcaaaatgcagctacagatgatgatgcaataatagagtatatctattcagatgaattagacttc

SEQ ID NO: 297963 - DNA, 75 bp, Artificial Sequence
  Synthetic
aactttacaatgcattctataaagagcaaattacgtttggacaatcaagaatgtttattccacacataacattaa

SEQ ID NO: 297964 - DNA, 75 bp, Artificial Sequence
  Synthetic
caagtatgtagctgtatcaagctatgcagactctgcaagtaagggtgtgttctcatgctcgctacgtagagtaac

SEQ ID NO: 297965 - DNA, 75 bp, Artificial Sequence
  Synthetic
tccagcaaatattcagcaatttgaacatattgtccagctaaggcgtgcgctaactacagctactataactttatt

SEQ ID NO: 297966 - DNA, 75 bp, Artificial Sequence
  Synthetic
aaagattatcacagtttgatattggtcaatataagaatatgctaaacgtcttaacgactttgtatcaatattaca

SEQ ID NO: 297967 - DNA, 75 bp, Artificial Sequence
  Synthetic
tgatcgaatgcaagatgaatcagcaaaaccacaattatctgataaggtgttgtctcaaaaagaggaagtgataac

SEQ ID NO: 297968 - DNA, 75 bp, Artificial Sequence
  Synthetic
caaaaagaagtacagtatgagattttacagaagactattccaacttttgaacctaaagagtcaatattaaagaag

SEQ ID NO: 297969 - DNA, 75 bp, Artificial Sequence
  Synthetic
atatatagaccgaacggcgaaagagaattgcgaaacaggtggtattggaagttaaaacgtgatacgttaccagat

SEQ ID NO: 297970 - DNA, 75 bp, Artificial Sequence
  Synthetic
aaaactctagagatgcagggaaagtagtagactctgagactgcaagtatttgtgatgcaatttttcaagacgagg

SEQ ID NO: 297971 - DNA, 75 bp, Artificial Sequence
  Synthetic
atatataaacaatacaattactgaaaacgtattcatacaacaaccttttaagttgaaaacattgaaaaacgaata

SEQ ID NO: 297972 - DNA, 75 bp, Artificial Sequence
  Synthetic
tgttccgagagagcgcgtgcggaaagatggataagcttgccgacctcaactacacattgagtgtaatcactttaa

SEQ ID NO: 297973 - DNA, 75 bp, Artificial Sequence
  Synthetic
ttatgccttcaatgaatacttcttacaacaccaattagtcgaaccattaaataatgatataatattcaattacat

SEQ ID NO: 297974 - DNA, 75 bp, Artificial Sequence
  Synthetic
ctgaatttacatgataattttgagtcgatttgggacacaataaccacttccaattacattctagcgcgatcagtg

SEQ ID NO: 297975 - DNA, 75 bp, Artificial Sequence
  Synthetic
ttcttactggtattaactcacaggcagctaacgattgttttaaaacattaatagcagctatgttaagtcagagga

SEQ ID NO: 297976 - DNA, 75 bp, Artificial Sequence
  Synthetic
agttgcatgccagttagcaattgtaaatactatcatatatccagcgtttggtatgcagagaatgcattatcggaa

SEQ ID NO: 297977 - DNA, 75 bp, Artificial Sequence
  Synthetic
gtagtaattgatggagtgttgaatcaagtattaaatgacaatataaggaacggccaggtagtaaatcagctgatg

SEQ ID NO: 297978 - DNA, 75 bp, Artificial Sequence
  Synthetic
gtcaactagtggatttaactagattatttgcctacaattatgaaactattatggcttgtattacaatgaacatgc

SEQ ID NO: 297979 - DNA, 75 bp, Artificial Sequence
  Synthetic
tctatttcactattataatgttaatgttaattttcactctaattataatgagagaataaacgatgcagtggccat

SEQ ID NO: 297980 - DNA, 75 bp, Artificial Sequence
  Synthetic
ccagacgatcaaatgtatcgattaagagatagattgagaatgttaccagtagaaattagaagacttgatatcttt

SEQ ID NO: 297981 - DNA, 75 bp, Artificial Sequence
  Synthetic
agatgtatggttacgttaatatagctagaaatttggatggatttcaacagatcaatctagaggagttaatgcgat

SEQ ID NO: 297982 - DNA, 75 bp, Artificial Sequence
  Synthetic
aattgcaaaactggatgctacagtattcgctcaaatagtaaaattgagaaaagttgataccctaaaaccaattct

SEQ ID NO: 297983 - DNA, 75 bp, Artificial Sequence
  Synthetic
tgccaattcaatacagaaaatttatgccaacactacctaataatgtccaatatgttatacaatgtataggatcga

SEQ ID NO: 297984 - DNA, 75 bp, Artificial Sequence
  Synthetic
cgtaacaaatatttctgatgaagttagtgaaatcggagccaggaaaacagcgaatgttacagtcaatccaggacc

SEQ ID NO: 297985 - DNA, 75 bp, Artificial Sequence
  Synthetic
ttcgatttcagggcgtctatgcacatgttaacatcaaatctaacgtttaccgtctattcagatctacttgcattc

SEQ ID NO: 297986 - DNA, 75 bp, Artificial Sequence
  Synthetic
tgttaacatcaaatctaacgtttaccgtctattcagatctacttgcattcgtgtcagctgatacagttgaaccga

SEQ ID NO: 297987 - DNA, 75 bp, Artificial Sequence
  Synthetic
acgttcaacttaccaattgattattggatgttgattgcacctactcaagcaggtagagtggcggaaggtacaaat

SEQ ID NO: 297988 - DNA, 75 bp, Artificial Sequence
  Synthetic
atcatttttaattatataccagaaagaataaggaatgatgttaattatattttgaatatggatatgaatttgcca

SEQ ID NO: 297989 - DNA, 75 bp, Artificial Sequence
  Synthetic
acaaacctatatacatgatgatagcaaggattcgtatgaaaatgcttttctaatttcaaacttaactgctcataa

SEQ ID NO: 297990 - DNA, 75 bp, Artificial Sequence
  Synthetic
gattatattaaccagattgtacaggtaatgtccaaaaggtcaagatcattaaattctgcagctttttattataga

SEQ ID NO: 297991 - DNA, 75 bp, Artificial Sequence
  Synthetic
caaatgattcaagtacactttggaaatttatactatttattaaactagagaagaatggaaattattctcaatatt

SEQ ID NO: 297992 - DNA, 75 bp, Artificial Sequence
  Synthetic
attggttgtaactttacttataattatgaagataacatagtatttctgcacgactattcgtactatactaataat

SEQ ID NO: 297993 - DNA, 75 bp, Artificial Sequence
  Synthetic
tctaacaataaataatgataacagtaatgtgtcatgtgatgctgagttttatttaataccaaggtcacaaactga

SEQ ID NO: 297994 - DNA, 75 bp, Artificial Sequence
  Synthetic
cgcaaggacattataaatgttcattcatatgccagaatgcggccacggatgatgatattataatagaatacatat

SEQ ID NO: 297995 - DNA, 75 bp, Artificial Sequence
  Synthetic
gaaacgtagtgccagtgagactaacgtctagggaaataagacatacgcgagcacaaatgaatgaggatatagtgg

SEQ ID NO: 297996 - DNA, 75 bp, Artificial Sequence
  Synthetic
agaaaagagaatcatcaggatgtacttttccattcgaaagaactactattgagatctgttttaatagctattggt

SEQ ID NO: 297997 - DNA, 75 bp, Artificial Sequence
  Synthetic
ccacagctgaaggaggtgagatagtgtttcaaaatgctgcatttactatgtggaaattgacgtatttagatcaca

SEQ ID NO: 297998 - DNA, 75 bp, Artificial Sequence
  Synthetic
agataaactagttaaatcgattaagaataagtggaaaaaaccaatagtgaatgtgggacctagaaatgaatctat

SEQ ID NO: 297999 - DNA, 75 bp, Artificial Sequence
  Synthetic
cgaatttcccagtttgatatagggcaatttaagaacatgcttaatgttataacgtccatttactattattacagt

SEQ ID NO: 298000 - DNA, 75 bp, Artificial Sequence
  Synthetic
ttctcggtttgaagtaattaaagaaaactcatacgtatacatcgattactgggatgattcgcaggcatttaaaaa

SEQ ID NO: 298001 - DNA, 75 bp, Artificial Sequence
  Synthetic
acccattagaaactccattttcagataaacatcatcaatcattatttttccagtctgatgttaagaaattaactg

SEQ ID NO: 298002 - DNA, 75 bp, Artificial Sequence
  Synthetic
ccatttaaaggactgtcaactgatagaaagatggatgaagtgtcgcaaattggaatttaattcgctttcgattcg

SEQ ID NO: 298003 - DNA, 75 bp, Artificial Sequence
  Synthetic
tcactgagatttagatttagattagctgttagtgagccatctttttcaatttctagaactagattgagtggtata

SEQ ID NO: 298004 - DNA, 75 bp, Artificial Sequence
  Synthetic
tttatactcaaaaagattaaagaaagaatgacaacgtcattaccaatagcaagactttcaaatcgcgtgttcaga

SEQ ID NO: 298005 - DNA, 75 bp, Artificial Sequence
  Synthetic
gatcgcatacgattatttatcaactggaaaagctaaagtatgttgtgtcaaaatgacagcaatggatattgagtt

SEQ ID NO: 298006 - DNA, 75 bp, Artificial Sequence
  Synthetic
cattagacactccatattctacaatacatcataaggaattattttttgataaggatgtcaataaacttaaagata

SEQ ID NO: 298007 - DNA, 75 bp, Artificial Sequence
  Synthetic
agacaccaatagctaattctgtgacggtgcgacaggatttagaaaggcagcttggtgaactaagggaagaattca

SEQ ID NO: 298008 - DNA, 75 bp, Artificial Sequence
  Synthetic
attccgaagggtgtactctattcgtacataaataatgtgattactgataatgtgtttatacagccatcttttaaa

SEQ ID NO: 298009 - DNA, 75 bp, Artificial Sequence
  Synthetic
cttggtgaactaagggaagaattcaattcattatcgcaagaaattgcattgtcacaattaattgatttagcaaca

SEQ ID NO: 298010 - DNA, 75 bp, Artificial Sequence
  Synthetic
acttggcaaatgctatatcagatctaacaaatagcatgtcagatgcggcttcttcaattagtagatctgcgtcgg

SEQ ID NO: 298011 - DNA, 75 bp, Artificial Sequence
  Synthetic
attcgttgatcacagtcagattgaacaattcatttaaagatgaaccaaaagtaggatttaaagatatatatgatt

SEQ ID NO: 298012 - DNA, 75 bp, Artificial Sequence
  Synthetic
gatgcgaattagtactgttatacaaactggagaggacttaagaacggtggcagacgcatcaacacagatatcaaa

SEQ ID NO: 298013 - DNA, 75 bp, Artificial Sequence
  Synthetic
ttcaatactgtatatagatataagaacagacagaggaaatatggattggaaggaatggcgaagagtagtagaaga

SEQ ID NO: 298014 - DNA, 75 bp, Artificial Sequence
  Synthetic
ggctacaggtaataatcatatttttataatttcaggaactgatgattactttaaaattgatcaatttgcgaatca

SEQ ID NO: 298015 - DNA, 75 bp, Artificial Sequence
  Synthetic
aatgatagttactatgaatggaaatgattttcaaacaggaggaataggaaatttgccaatcagaaattggacatt

SEQ ID NO: 298016 - DNA, 75 bp, Artificial Sequence
  Synthetic
tcaacacaaatttcgcaaaacacaataccagacataatatctgagtcatcggaaagatttataccaatgcggact

SEQ ID NO: 298017 - DNA, 75 bp, Artificial Sequence
  Synthetic
ttaattagcacgagtacagagaattcggtttcaggacatgtatataatgcactaatatattatcgatataactat

SEQ ID NO: 298018 - DNA, 75 bp, Artificial Sequence
  Synthetic
aaataatataattactgagaatgtattcatacaacagccatttaaattaaaaacgttaaaaaatgaatatgtgac

SEQ ID NO: 298019 - DNA, 75 bp, Artificial Sequence
  Synthetic
aaaaatttaatagactaatcacagactcgccagtgctttcggctataatcgattttaaaacacttaagaacttaa

SEQ ID NO: 298020 - DNA, 75 bp, Artificial Sequence
  Synthetic
cctgctactcagcgaaggaatttggtagaatacagaacgatttgacagttatgagatacgcaagcgaaattgaaa

SEQ ID NO: 298021 - DNA, 75 bp, Artificial Sequence
  Synthetic
aactaatcaataatcagaaaaaagcgttgataacagtgagaattaataatacgtttaaagatgaaccaaaagtcg

SEQ ID NO: 298022 - DNA, 75 bp, Artificial Sequence
  Synthetic
aatccaagaactttgaaagaattcataaataataataatcccataattagaaatagaatagaaaacctaatagcg

SEQ ID NO: 298023 - DNA, 75 bp, Artificial Sequence
  Synthetic
tccccatctagcatttggtgtattatatatctctgacaatatggtcccagatgttattgatgtaattagtacgat

SEQ ID NO: 298024 - DNA, 75 bp, Artificial Sequence
  Synthetic
ttcttttgaagccgcagtcgttgctgccacttcaactcttgaacttatgggtattcaatatgattataatgaagt

SEQ ID NO: 298025 - DNA, 75 bp, Artificial Sequence
  Synthetic
atgctgaaagattcagttttccgagagtaattaattcagccgatggtactaccacatggtacttcaatccagtta

SEQ ID NO: 298026 - DNA, 75 bp, Artificial Sequence
  Synthetic
ttcaaattgtataatgcattctataaaaaatcaatcacttttggtcagtcacgtatgttcattcctcatatcact

SEQ ID NO: 298027 - DNA, 75 bp, Artificial Sequence
  Synthetic
ttgaaatttggaaatcacaaaagcataaggattgataatcataatttgattgttaaatcaatatatttacgtaaa

SEQ ID NO: 298028 - DNA, 75 bp, Artificial Sequence
  Synthetic
acattcaacaggcaagactatcattgagggtggcaaatattatgaacatgctccaatagaactgatttacgcatg

SEQ ID NO: 298029 - DNA, 75 bp, Artificial Sequence
  Synthetic
atcctcagttggagaatgatagctataaatttgttccgtttaatagtttagcaattaaatgtatgttggcagcaa

SEQ ID NO: 298030 - DNA, 75 bp, Artificial Sequence
  Synthetic
ttgaagaaaaaatggaagttgacacaattgattggaaatctagatatgaacagttggaaaaacgatttgaatcac

SEQ ID NO: 298031 - DNA, 75 bp, Artificial Sequence
  Synthetic
gcgtggcatgaattacgaatcatctatgtttactaaagtagcgatgctaatttgcgaagcacttgattctctaaa

SEQ ID NO: 298032 - DNA, 75 bp, Artificial Sequence
  Synthetic
tttctgaacaaatattaccggatgcgatagttattctgaagaaatttaagaatgagttgtttggaatggacataa

SEQ ID NO: 298033 - DNA, 75 bp, Artificial Sequence
  Synthetic
ttccattcgaaagaactgttaattaagtccactctaattgctattggtcagtcaaaagaaatcgagactactgca

SEQ ID NO: 298034 - DNA, 75 bp, Artificial Sequence
  Synthetic
ttgttgaatataaaattacagtgaatgacattaaaccagtagctgagtcacacgtgaaagaactggtagctgaat

SEQ ID NO: 298035 - DNA, 75 bp, Artificial Sequence
  Synthetic
tgccacgtttaaaagtaatgtcaaaacaggtactgtaaatgagtttgaattacttgatcagagaattatatggca

SEQ ID NO: 298036 - DNA, 75 bp, Artificial Sequence
  Synthetic
tttgtaagaaattgctatttcagaaaatgagacaagaaaagaatcactttaaaggattgtcaactgaaaggaaga

SEQ ID NO: 298037 - DNA, 75 bp, Artificial Sequence
  Synthetic
ttcacaatctgcagtacaaattccaatttattattcttccaattctgaattagaaaaaagatgcattgattttca

SEQ ID NO: 298038 - DNA, 75 bp, Artificial Sequence
  Synthetic
tgactattcatattatactaataatgaaatacgaactgaccaacattgggtaactaaaacaaatatagaggatta

SEQ ID NO: 298039 - DNA, 75 bp, Artificial Sequence
  Synthetic
tcatactcatatgataaatacaacgcagtcgaacggaaattggttaattacgcaaaaggaattccgttggaagcc

SEQ ID NO: 298040 - DNA, 75 bp, Artificial Sequence
  Synthetic
tgactacagctacgataactcttctaccagacgcagaaaggtttagttttccaagagtgatcaattcagctgacg

SEQ ID NO: 298041 - DNA, 75 bp, Artificial Sequence
  Synthetic
tattgacttctttatcatcaaatttaaatgctgtaatgttctggttagaaaagcattcgaatgacgtaggcgaca

SEQ ID NO: 298042 - DNA, 75 bp, Artificial Sequence
  Synthetic
gaagtagaatttctattgaatggacagataataaacacttatcaggcaagatttggaactatcgtagctagaaat

SEQ ID NO: 298043 - DNA, 75 bp, Artificial Sequence
  Synthetic
atatgaggttatgaaagataaaccctattacttggtaacatgggccaattcttcaattgaaatgttaatgtcagt

SEQ ID NO: 298044 - DNA, 75 bp, Artificial Sequence
  Synthetic
tgaaaaattagtaattactgacgtggttgatggcgtaaatcacaaactagatgttactactgcgacttgtactat

SEQ ID NO: 298045 - DNA, 75 bp, Artificial Sequence
  Synthetic
ttagtggcgttagtagatataaatggcactttcattacgaacgaagaactcgaattagagttctcaaacaagtat

SEQ ID NO: 298046 - DNA, 75 bp, Artificial Sequence
  Synthetic
attggttggtaacttgctctatagaaaagtttccactaatggctaaaatatattcatggtctttccacgtgggat

SEQ ID NO: 298047 - DNA, 75 bp, Artificial Sequence
  Synthetic
gttttcagtcgatccacaactgtattgtgattataatttggtattaatgaaatacgacgctacactgcaactgga

SEQ ID NO: 298048 - DNA, 75 bp, Artificial Sequence
  Synthetic
tgaaatgctaatgtcagtcttttctcatgaagattatttaattgcaagagaattgatagtattgtcatattctaa

SEQ ID NO: 298049 - DNA, 75 bp, Artificial Sequence
  Synthetic
aagagatgaagtggttaaaatgcttgaagagtcggtaaagcatgatgatcacctactacaagattctgagttagc

SEQ ID NO: 298050 - DNA, 75 bp, Artificial Sequence
  Synthetic
gatgatatgaataaaggtaaatatacacccggtgtcataccaccagttgatgttagaagaccaattccactagga

SEQ ID NO: 298051 - DNA, 75 bp, Artificial Sequence
  Synthetic
caatagaaagcaacaattatctgacaaagtgctatcacaaaaagaggaaataataactgatgcacaagatgacat

SEQ ID NO: 298052 - DNA, 75 bp, Artificial Sequence
  Synthetic
caaagcatacacgtgaatacgctgaattttattcacagtcaaaccaattactttcttatggtgatgtgactaggt

SEQ ID NO: 298053 - DNA, 75 bp, Artificial Sequence
  Synthetic
ggatatgttatcaaatatgactaacgatgctaaggtaattcaaacgctacaattatataaacaaactcagattaa

SEQ ID NO: 298054 - DNA, 75 bp, Artificial Sequence
  Synthetic
tacagttgatttatcagatgaaattgcatcaattggatcagaaaagactcaaagtacaactataaatccgggtcc

SEQ ID NO: 298055 - DNA, 75 bp, Artificial Sequence
  Synthetic
tcgatagcgaacctagccctcattaagactgtgttgtctagaatatcaaacaagtacgcgtttaccacaaaaata

SEQ ID NO: 298056 - DNA, 75 bp, Artificial Sequence
  Synthetic
aaagtacaactataaatccgggtccattcgctcaaaccagttacgcaccagtaaattggggacacggagaaataa

SEQ ID NO: 298057 - DNA, 75 bp, Artificial Sequence
  Synthetic
atgcacgaatgaacgctaaagttaaagccttagtctcaacagttggaatagaaatcgcaaagcggtatatagctg

SEQ ID NO: 298058 - DNA, 75 bp, Artificial Sequence
  Synthetic
tggtgtagtgcttgagggtactaataatacagatgtatgggtagctatcatatctattgaaccaaatgttaattc

SEQ ID NO: 298059 - DNA, 75 bp, Artificial Sequence
  Synthetic
ttatgttgagactgccagaactacgattgagtattttattgattttattgacaatgtatgtatggatgaaatggc

SEQ ID NO: 298060 - DNA, 75 bp, Artificial Sequence
  Synthetic
ttaatacctcaaataaatggaagttcatggaaatgtttagaaataatagtaatgccgaattccagcataagcgta

SEQ ID NO: 298061 - DNA, 75 bp, Artificial Sequence
  Synthetic
catagtcaatagattaagaggatttgaaactgatagagaatttattttaactaaaattatgcagatgacatctgt

SEQ ID NO: 298062 - DNA, 75 bp, Artificial Sequence
  Synthetic
aacgtcaaacttaaatgaaattagtgttacaacatatgctgaattttatattataccacgatctcaagaatctaa

SEQ ID NO: 298063 - DNA, 75 bp, Artificial Sequence
  Synthetic
ggaacgaccgatgatgaagtatacattcagcgagcctttatgtcgttatcaagtcaaaaatcaggaatagctgac

SEQ ID NO: 298064 - DNA, 75 bp, Artificial Sequence
  Synthetic
ttataccacgatctcaagaatctaagtgtactgaatatattaacactggattaccaccaatgcaaaatactagaa

SEQ ID NO: 298065 - DNA, 75 bp, Artificial Sequence
  Synthetic
cagaaaaagctaagttaaattcatacgctccaatatcgttagagaagagacgagctcaaatatcagccttgctag

SEQ ID NO: 298066 - DNA, 75 bp, Artificial Sequence
  Synthetic
gcagtataatagagatattataatcagatttaaatttaataacagtgttataaaattgggcggtttaggttataa

SEQ ID NO: 298067 - DNA, 75 bp, Artificial Sequence
  Synthetic
agatttaaatttaataacagtgttataaaattgggcggtttaggttataaatggtctgaagtttctttcaaagca

SEQ ID NO: 298068 - DNA, 75 bp, Artificial Sequence
  Synthetic
gccgattcaataccaaaaattcatgccaacactgcccgataatgtacagtacgttattcaatgtattggatcaag

SEQ ID NO: 298069 - DNA, 75 bp, Artificial Sequence
  Synthetic
tgttagtgatctaatacaacagtttaatcaaatgctggtaactatgaatggtaatgattttcagactggaggaat

SEQ ID NO: 298070 - DNA, 75 bp, Artificial Sequence
  Synthetic
ctttacccacagactttaatatatctagatatgaggtaattaaagaaaattcttacgtctatatagattattggg

SEQ ID NO: 298071 - DNA, 75 bp, Artificial Sequence
  Synthetic
atatcattacatgaatctgaaatacaattatatctagtatcacttggagttccaaagattgacgctgatacatat

SEQ ID NO: 298072 - DNA, 75 bp, Artificial Sequence
  Synthetic
taatagactaaatttatatcagaaaaaaatgaaatcaatagttgaggattttttgaaaagattgcaaatttttga

SEQ ID NO: 298073 - DNA, 75 bp, Artificial Sequence
  Synthetic
gaggaaattatgatttccaaataccggttggtccatggcctgttatgagtggtggtgcagtatcattacattttg

SEQ ID NO: 298074 - DNA, 75 bp, Artificial Sequence
  Synthetic
ttaattcagccgatctggaaaagctcattagaatcccttttaaaggaaagattcctgcagtcacatttatattac

SEQ ID NO: 298075 - DNA, 75 bp, Artificial Sequence
  Synthetic
tcgaacgagagtttctaatttatatggacttccagcagctaatccaaataatggtaatgattattacgaaatagc

SEQ ID NO: 298076 - DNA, 75 bp, Artificial Sequence
  Synthetic
ggacttccagcagctaatccaaataatggtaatgattattacgaaatagctggcagattttcattaatatcattg

SEQ ID NO: 298077 - DNA, 75 bp, Artificial Sequence
  Synthetic
tggataagcttattctgtaattatccaaaatctgaaatgattaggttgtggaagaagatgtggaatatcacttct

SEQ ID NO: 298078 - DNA, 75 bp, Artificial Sequence
  Synthetic
ttgactattcgtgtgcaataaatgctccagcaaatattcaacaatttgaacatattgtgccattaagacgtgcac

SEQ ID NO: 298079 - DNA, 75 bp, Artificial Sequence
  Synthetic
cgttatcgcaagaaattgcaatgtcacaattaatagatttagcattattgccattggatatgttttcaatgttct

SEQ ID NO: 298080 - DNA, 75 bp, Artificial Sequence
  Synthetic
agtcatctttaggccaagtaatgtagagatagaatttctattgaatggacaagtaataaatacatatcaagcacg

SEQ ID NO: 298081 - DNA, 75 bp, Artificial Sequence
  Synthetic
cgattcattatcaaatgcagcatcatcaatatctacaaattcatccattcgatctaatgtatcatcaatttcggt

SEQ ID NO: 298082 - DNA, 75 bp, Artificial Sequence
  Synthetic
aactagtacgtccaccaaacatgacaccagcagttactaatatactcccacaagcgccgccgttcatttttcatg

SEQ ID NO: 298083 - DNA, 75 bp, Artificial Sequence
  Synthetic
atgacaacgcaaactgaaggaatgaattttgatgatatttcagcagctgtattaaaaacgaaaatagatagatca

SEQ ID NO: 298084 - DNA, 75 bp, Artificial Sequence
  Synthetic
attaaaaacgaaaatagatagatcaactcaaataagtcccaatactttaccagatataataacggaggcatcaga

SEQ ID NO: 298085 - DNA, 75 bp, Artificial Sequence
  Synthetic
gaagaagtaccttttgatgttaataaattcgtagacttagtcacagattctccggtaatatctgctataatagat

SEQ ID NO: 298086 - DNA, 75 bp, Artificial Sequence
  Synthetic
ccaaaagtgttacgagattttattaatcaaaataatccaataatacggaacagaatagaacaattaatatcacag

SEQ ID NO: 298087 - DNA, 75 bp, Artificial Sequence
  Synthetic
gaatacacgaggtcactataatttttcatttatatgtcaaaatgcagctacagatgatgatataataattgaata

SEQ ID NO: 298088 - DNA, 75 bp, Artificial Sequence
  Synthetic
acaatagtcgactatgtgaatcagattgtgcaagcgatgtccaaaagatcgagatcactaaattccgctgcattt

SEQ ID NO: 298089 - DNA, 75 bp, Artificial Sequence
  Synthetic
ggaggttctgtactcattgtcaaaaactcttaaagatgctagggacaaaattgttgaaggtacattatattctaa

SEQ ID NO: 298090 - DNA, 75 bp, Artificial Sequence
  Synthetic
atgttcacattcctaaattttccaactattaagcaattttcaaatggtgcgtatattgtgaagcatactattaaa

SEQ ID NO: 298091 - DNA, 75 bp, Artificial Sequence
  Synthetic
aaactcttaaagatgctagagacaaaattgtcgaaggcacactatactctaatgttagtgatcttattcagcaat

SEQ ID NO: 298092 - DNA, 75 bp, Artificial Sequence
  Synthetic
ttcgtttctgcagacacggttgaacctattaacgcagttgcttttgacaatatgcgcattatgaacgaactgtaa

SEQ ID NO: 298093 - DNA, 75 bp, Artificial Sequence
  Synthetic
aacaacagaaaaattacaattaacgtcagttacatcattatgtatgcttattggaaatgcgactgttataccaag

SEQ ID NO: 298094 - DNA, 75 bp, Artificial Sequence
  Synthetic
gaaaaaatccatatgaaccatcagaagtgactgcatctatgtgagaggttgagttgccgtcgtctgtcttcggaa

SEQ ID NO: 298095 - DNA, 75 bp, Artificial Sequence
  Synthetic
ccattggacctgatggttgactgagaagccacagtcaaccatatcgcgtgtggctcagccttaatcccgtttaac

SEQ ID NO: 298096 - DNA, 75 bp, Artificial Sequence
  Synthetic
cattcaagtaggcggatcaaatattttagatattacagcggatccgacaacggcaccacagacagaaaggatgat

SEQ ID NO: 298097 - DNA, 75 bp, Artificial Sequence
  Synthetic
gttattaatcaattaatggaagcattaatgcagttatctagacaacaatttccgactatgccagttgattataaa

SEQ ID NO: 298098 - DNA, 75 bp, Artificial Sequence
  Synthetic
aattttccatctattaagcaattttcaaatggaccatatttagttaaggatactattaaattaaaacaggaaaga

SEQ ID NO: 298099 - DNA, 75 bp, Artificial Sequence
  Synthetic
cttttgatgtatggtattgaatataccacaatacctacgtgtctgcactcaatcattctattcaactatatatta

SEQ ID NO: 298100 - DNA, 75 bp, Artificial Sequence
  Synthetic
ttctgtagcattatttgccttgacaagagctcagaattatgggattaacttaccaataacaggatcaatggacgc

SEQ ID NO: 298101 - DNA, 75 bp, Artificial Sequence
  Synthetic
tgtgagaattaataatacatttaaagatgaaccaaaagtaggctttaaaaatatatatgattggacttttctacc

SEQ ID NO: 298102 - DNA, 75 bp, Artificial Sequence
  Synthetic
gctagatttggcactattgtcgcaagaaattttgatacaattcgtttgtcattccaattaatgcgtccaccaaac

SEQ ID NO: 298103 - DNA, 75 bp, Artificial Sequence
  Synthetic
ttagctatagtggatgtcgttgatgggataaatcataaaataaatttgacaactacgacatgtactattcgaaat

SEQ ID NO: 298104 - DNA, 75 bp, Artificial Sequence
  Synthetic
ttagcgacatattttaaaatgtataatttattttataagagccaaattacattcggtcaatctagaatgtttatt

SEQ ID NO: 298105 - DNA, 75 bp, Artificial Sequence
  Synthetic
ctattcgaaattgtaagaagttaggtccaagagagaatgtggctgtaatacaagttggtggcgctaatatattag

SEQ ID NO: 298106 - DNA, 75 bp, Artificial Sequence
  Synthetic
tagaaattggatgactgactctcgaactgtggctaagttggatgaggatgtaaataaactgagaatgatgctatc

SEQ ID NO: 298107 - DNA, 75 bp, Artificial Sequence
  Synthetic
agttgcaaatcatgctgatagagtctatgctacttttaaaagtaatagcaaaaatggtgttaacatggaatttaa

SEQ ID NO: 298108 - DNA, 75 bp, Artificial Sequence
  Synthetic
gggtggccaactggatcagtctattttaaagaatacaccgatatcgcttcattctcaattgatccacaactttat

SEQ ID NO: 298109 - DNA, 75 bp, Artificial Sequence
  Synthetic
tgtgattataacttagtactaatgaagtatgatcaaaatcttgaattagatatgtcagaattagctgatttgata

SEQ ID NO: 298110 - DNA, 75 bp, Artificial Sequence
  Synthetic
ggtggcaagtattttatacaatagttgactacgtgaatcaaattgtgcaagcgatgtccaaaagatcgagatcat

SEQ ID NO: 298111 - DNA, 75 bp, Artificial Sequence
  Synthetic
acaagcactaaatcttctaagatctgatccgcgagtattacgtgaatttattaatcaggataatccaataatacg

SEQ ID NO: 298112 - DNA, 75 bp, Artificial Sequence
  Synthetic
gcttctgtactaactgtattgtttactctacataaggcttcacttccaacaatgaagattgctcttaaaacatca

SEQ ID NO: 298113 - DNA, 75 bp, Artificial Sequence
  Synthetic
aaaagaaatgagacgtcaactggaaatgattgataaattgaccactagagaaatagaacaagtggaacttctaaa

SEQ ID NO: 298114 - DNA, 75 bp, Artificial Sequence
  Synthetic
aattattctaagaccaaacaatgtagaggtagaatttttactgaatggacaaattattaatacatatcaagctag

SEQ ID NO: 298115 - DNA, 75 bp, Artificial Sequence
  Synthetic
actctctcaactgtttttaactaagggatggcccactggatctgtttattttaaagaatataccgatattgcttc

SEQ ID NO: 298116 - DNA, 75 bp, Artificial Sequence
  Synthetic
acaaacagatgaagctaataaatggatttctatgggatcctcgtgtacaataaaagtatgtccacttaatacaca

SEQ ID NO: 298117 - DNA, 75 bp, Artificial Sequence
  Synthetic
atttctatgggatcctcgtgtacaataaaagtatgtccacttaatacacagactcttggaattggttgtttgact

SEQ ID NO: 298118 - DNA, 75 bp, Artificial Sequence
  Synthetic
cacgatcttttcaattattgttaacgcacaaaattacgggattaatttgcctataactgggtcgatggatatgtc

SEQ ID NO: 298119 - DNA, 75 bp, Artificial Sequence
  Synthetic
aaaagagttactactcaaatcagttttaatagctattggtcactcaaaggaaattgaaacgactgccactgctga

SEQ ID NO: 298120 - DNA, 75 bp, Artificial Sequence
  Synthetic
cgtacgttatcgcagttgttcttaacaaagggatggccaactggatccgtatactttaaagaatacgatgatata

SEQ ID NO: 298121 - DNA, 75 bp, Artificial Sequence
  Synthetic
caaagggatggccaactggatccgtatactttaaagaatacgatgatatagctgctttttcagtggatcctcaat

SEQ ID NO: 298122 - DNA, 75 bp, Artificial Sequence
  Synthetic
caaccttcaaggatgcttgttttcattatagaaggattacaaaattaaacagagaattactgagaattggagcaa

SEQ ID NO: 298123 - DNA, 75 bp, Artificial Sequence
  Synthetic
tagtcaagaagaagttaaaattgctgatgaggtaaaaaaatcaacgaaagaagaatcaaaacagctgcttgaagt

SEQ ID NO: 298124 - DNA, 75 bp, Artificial Sequence
  Synthetic
agagaattactgagaattggagcaaactcagtatggactccagtttcttcgaataaaattaaaggctggtgcatt

SEQ ID NO: 298125 - DNA, 75 bp, Artificial Sequence
  Synthetic
aaccacatcttttaaaactaagaacctttgaatcaccaataacaaaggaaaatttacaatgcattattgatttat

SEQ ID NO: 298126 - DNA, 75 bp, Artificial Sequence
  Synthetic
atacagaccatcaatagaagaattgtataaagtaatatcacttcatgaacaagaaattcaactttacttagtgtc

SEQ ID NO: 298127 - DNA, 75 bp, Artificial Sequence
  Synthetic
gttgattatgtaaatcaaattgtgcaagcaatgtctaaaaggtccagatcattgaattcggcggcattttattac

SEQ ID NO: 298128 - DNA, 75 bp, Artificial Sequence
  Synthetic
aatctatctatgcaaacaaatacttcaaattaagcagactcccttcaatgaagttaaaacaaatctattattcag

SEQ ID NO: 298129 - DNA, 75 bp, Artificial Sequence
  Synthetic
aatatgattacaatgaagtatttactagagttaaaagtaagtttgattacgtgatggatgactctggtgtaaaaa

SEQ ID NO: 298130 - DNA, 75 bp, Artificial Sequence
  Synthetic
tcatgatctaatcaataacaaagataaaatacttgctgcgttatcaacatcatcattaaaacagtttgaaacgca

SEQ ID NO: 298131 - DNA, 75 bp, Artificial Sequence
  Synthetic
catcattaaaacagtttgaaacgcatgatttgaatttggggagagtaaaaaccgatattttcgaacttggatatc

SEQ ID NO: 298132 - DNA, 75 bp, Artificial Sequence
  Synthetic
gtataactagaatgatggactacataatttacaaatttttgctcatagtcacaatcacctcgattcttgttagtg

SEQ ID NO: 298133 - DNA, 75 bp, Artificial Sequence
  Synthetic
ttggaagatggaatcaatgtacaacgaacttttgagctttatccaatcctgttataaaagtaatgttaatgtagg

SEQ ID NO: 298134 - DNA, 75 bp, Artificial Sequence
  Synthetic
atactatccaacagaggctagaacagaaataaatgataacgaatggacgagcacactatcacaattgtttctgac

SEQ ID NO: 298135 - DNA, 75 bp, Artificial Sequence
  Synthetic
gcaatgaatcctgtacaagtaaatgaacaacaggtaattgctttccgttggcaaatagatattgcattatatatg

SEQ ID NO: 298136 - DNA, 75 bp, Artificial Sequence
  Synthetic
taagagatcaatccaacgcggaatattgctgttatctaatagacttggtcagttagttgatttaaccagactgtt

SEQ ID NO: 298137 - DNA, 75 bp, Artificial Sequence
  Synthetic
atactgtgattataacatagttctgatgcgctataattcgagtttagaactggatatgtcagagttagcgaattt

SEQ ID NO: 298138 - DNA, 75 bp, Artificial Sequence
  Synthetic
ttactgaattagattatttgccattatgcactgaacagactgacacattgattaaactagaagaggaaggaaaac

SEQ ID NO: 298139 - DNA, 75 bp, Artificial Sequence
  Synthetic
atgcactgaacagactgacacattgattaaactagaagaggaaggaaaactatctgaagagtatgagcttctaat

SEQ ID NO: 298140 - DNA, 75 bp, Artificial Sequence
  Synthetic
acagaaaacgtggagcgcgtcgtgagacgactttaaaacaggatgatcgaatgcaagaaaaggaagagaataaaa

SEQ ID NO: 298141 - DNA, 75 bp, Artificial Sequence
  Synthetic
acaataaaagtgtgtccattgaacacccagacattggggataggatgccagactacaaatactgggacatttgaa

SEQ ID NO: 298142 - DNA, 75 bp, Artificial Sequence
  Synthetic
aggagaaatccaaaagtgatcataaaagtaggaaacactaccctaaaattgaagcagaatctgattcagatgact

SEQ ID NO: 298143 - DNA, 75 bp, Artificial Sequence
  Synthetic
aaatataaaaggaagtatttcgcactaagaatgagaatgaaacaagttgccatgcaattgatcgaagatttgtag

SEQ ID NO: 298144 - DNA, 75 bp, Artificial Sequence
  Synthetic
tggtggcaagtattctatactatagtagattacgtgaaccaaattgtacaggcaatgtctaaaaggtccagatca

SEQ ID NO: 298145 - DNA, 75 bp, Artificial Sequence
  Synthetic
attacacaaagcgtcaattccaacaatgaaaatagcattgaaaacgtcaaaatgttcgtataaagtagtaaagta

SEQ ID NO: 298146 - DNA, 75 bp, Artificial Sequence
  Synthetic
agaatctaaacaattgcttgaagttttgaaaacaaaagaagagcaccaaaaagaaatacaatacgaaattttaca

SEQ ID NO: 298147 - DNA, 75 bp, Artificial Sequence
  Synthetic
gcgtaatagatggtattggaagttgaagaaagatactttaccagatggagattatgatgttagagagtatttttt

SEQ ID NO: 298148 - DNA, 75 bp, Artificial Sequence
  Synthetic
atggcttcgctcatttacagacagttacttactaattcttatacagtagacttatctgacgaaattgaaagtatt

SEQ ID NO: 298149 - DNA, 75 bp, Artificial Sequence
  Synthetic
cttatctgacgaaattgaaagtattggatctaaaaatactcaaaatgtaacgataaatcccggaccattcgcaca

SEQ ID NO: 298150 - DNA, 75 bp, Artificial Sequence
  Synthetic
cgataaatcccggaccattcgcacaaaccggatatgcaccagttaattggggaccaggagaggtaaatgactcca

SEQ ID NO: 298151 - DNA, 75 bp, Artificial Sequence
  Synthetic
tgttgaagggactaacaataccaatcgttggctagctaccattttagtagaaccaggagtagcgtcgacaacgag

SEQ ID NO: 298152 - DNA, 75 bp, Artificial Sequence
  Synthetic
acatatactcaacactctccactattatcagagccaaaactctatggtataatgaagcacggtggtcagctctgg

SEQ ID NO: 298153 - DNA, 75 bp, Artificial Sequence
  Synthetic
caagacttacaattagaagccttaacaatacagtcagaaacacagtttttaacaggtataaactcacaagcagca

SEQ ID NO: 298154 - DNA, 75 bp, Artificial Sequence
  Synthetic
aatgaagcacggtggtcagctctggacttataatggagagactccaaatgcaatcacgaatggttatccgactac

SEQ ID NO: 298155 - DNA, 75 bp, Artificial Sequence
  Synthetic
aagaacatcagaaagaagttcaatatgaaatattacaaaaaacaatacctacttttgaaccaaaagaatctatac

SEQ ID NO: 298156 - DNA, 75 bp, Artificial Sequence
  Synthetic
tgaaatattacaaaaaacaatacctacttttgaaccaaaagaatctatactaaagaaattagaagatattaaacc

SEQ ID NO: 298157 - DNA, 75 bp, Artificial Sequence
  Synthetic
ccaatacaaaatactaggaacattgttccagtttcaatttcctcacgcagcattatacatcaaagagcacaggct

SEQ ID NO: 298158 - DNA, 75 bp, Artificial Sequence
  Synthetic
aattaccaatatatagagcaaacggagaaaaagaattacgtaatagatggtattggaaactaaagcgagacactt

SEQ ID NO: 298159 - DNA, 75 bp, Artificial Sequence
  Synthetic
caggtggattggggtataaatggtcagaaatttctttcaaaccagcgaattatcaatatacatatactagagatg

SEQ ID NO: 298160 - DNA, 75 bp, Artificial Sequence
  Synthetic
ttattgatggtgtattgaatcaggtgctgaatgataatattagaaatggacatgttattaatcaattgatggaag

SEQ ID NO: 298161 - DNA, 75 bp, Artificial Sequence
  Synthetic
tgaagtaataaaagagaattcctatgtttacgtagactattgggatgactcgcaagcatttagaaacatggttta

SEQ ID NO: 298162 - DNA, 75 bp, Artificial Sequence
  Synthetic
accattgaataatgatataatatttaactatatacctgaaagaatacggaatgacgtaaactatatactaaacat

SEQ ID NO: 298163 - DNA, 75 bp, Artificial Sequence
  Synthetic
aggtacattagaccaaatttacttcaagatagacttaatttacatgacaacttcgaatctttatgggatactata

SEQ ID NO: 298164 - DNA, 75 bp, Artificial Sequence
  Synthetic
gctgtttcattacattcagctggagttacattatcaacgcagtttactgactttgtttcgcttaactcacttaga

SEQ ID NO: 298165 - DNA, 75 bp, Artificial Sequence
  Synthetic
acgagtattatgaggtcgctggaaggttttcattgatatcgttagtaccatccaacgacgactatcagacgccga

SEQ ID NO: 298166 - DNA, 75 bp, Artificial Sequence
  Synthetic
gattgacttagcattacttccgctagatatgttttcaatgttttcaggtattaagagtacaatagacgcagcgaa

SEQ ID NO: 298167 - DNA, 75 bp, Artificial Sequence
  Synthetic
catccgtttctaccttaactgactcactgtcagatgcagcatcctcaatttctaggggttcgtcaattagatcta

SEQ ID NO: 298168 - DNA, 75 bp, Artificial Sequence
  Synthetic
acgtctgagactaaaagaaatcgctacacaaactgaaggtatgaattttgatgacatttccgctgccgttctaaa

SEQ ID NO: 298169 - DNA, 75 bp, Artificial Sequence
  Synthetic
tcaggactgatcggggtaacgttgactggaaagaatggaggaaaatagttgaattacagactattagtaatctta

SEQ ID NO: 298170 - DNA, 75 bp, Artificial Sequence
  Synthetic
aacatcaaatcttactttcactgtttactcagatctgcttgcattcgtatcagctgatacggtagaacctataaa

SEQ ID NO: 298171 - DNA, 75 bp, Artificial Sequence
  Synthetic
atggataataatgaagtattggaggctagtactgatggtagatttttcgcttatagagtagagacatttgaagaa

SEQ ID NO: 298172 - DNA, 75 bp, Artificial Sequence
  Synthetic
ttatagagtagagacatttgaagaaataccatttgatgtacaaaagtttgctgacttagtaactgattcaccagt

SEQ ID NO: 298173 - DNA, 75 bp, Artificial Sequence
  Synthetic
ataccatttgatgtacaaaagtttgctgacttagtaactgattcaccagtgatttcagctatcattgatttcaaa

SEQ ID NO: 298174 - DNA, 75 bp, Artificial Sequence
  Synthetic
acatagtgtggctcaggtgtatgcggacactcaaatatatactcatgatgaaactaaagatgactacgaaaatgc

SEQ ID NO: 298175 - DNA, 75 bp, Artificial Sequence
  Synthetic
cgagagttcattaaccaagacaatccaataattagaaataggattgaacaattgatactgcaatgtagattgtaa

SEQ ID NO: 298176 - DNA, 75 bp, Artificial Sequence
  Synthetic
ttgggtaactaagacgaatatagaagattatttattaccaggatggaagctgacgtacgttggatataacggaag

SEQ ID NO: 298177 - DNA, 75 bp, Artificial Sequence
  Synthetic
tagcctatagagatatgcagttagaaagagatgaaatgtacggctacgttaacatagctcgtaacttagatggtt

SEQ ID NO: 298178 - DNA, 75 bp, Artificial Sequence
  Synthetic
agagcttgttgctgaattgaggtggcagtataatagatttgctgtaataacacatggtaaaggtcactatagagt

SEQ ID NO: 298179 - DNA, 75 bp, Artificial Sequence
  Synthetic
cagtataatagatttgctgtaataacacatggtaaaggtcactatagagttgttaaatattcatcagttgctaat

SEQ ID NO: 298180 - DNA, 75 bp, Artificial Sequence
  Synthetic
aagaaaggatgacgacttcactgccaatagcgagactatcaaaccgtgtgttcagagacaaattatttaagatat

SEQ ID NO: 298181 - DNA, 75 bp, Artificial Sequence
  Synthetic
aattatattaataaagtatatagtataacgtacgcagacgatccgaactattttataggtattaaattcgacaac

SEQ ID NO: 298182 - DNA, 75 bp, Artificial Sequence
  Synthetic
tatgcacatgctaacgtctaatttgactttcactgtatattcagatcttcttgcattcgtttcagcagatactgt

SEQ ID NO: 298183 - DNA, 75 bp, Artificial Sequence
  Synthetic
tgtggctcaggtatatgcagacacccaagtctatactcatgatgatactaaagacagttacgaaaatgcatttct

SEQ ID NO: 298184 - DNA, 75 bp, Artificial Sequence
  Synthetic
ttttaatgtatggtattgaatataccacaattctaatctttctgatatcaatcattctactcaactatatattaa

SEQ ID NO: 298185 - DNA, 75 bp, Artificial Sequence
  Synthetic
caagtctatactcatgatgatactaaagacagttacgaaaatgcatttcttatatctaatcttacaacgcataac

SEQ ID NO: 298186 - DNA, 75 bp, Artificial Sequence
  Synthetic
aagaaccaaattacttttggtcaatcaagaatgttcattccgcacataacattaagttttagtaataataagaca

SEQ ID NO: 298187 - DNA, 75 bp, Artificial Sequence
  Synthetic
atcctatatttaaattacagtattaaaacgcttgaaatattaaataaatcaggaattgcagccgttgagattcaa

SEQ ID NO: 298188 - DNA, 75 bp, Artificial Sequence
  Synthetic
attaagttttagtaataataagacagtgagaatagagactactaaactgaaaattaaatcaatatacttaagaaa

SEQ ID NO: 298189 - DNA, 75 bp, Artificial Sequence
  Synthetic
tgaaaacaatataatttatttgcatgattactcgtactatactaataatgaaataagaaccgatcaacattgggt

SEQ ID NO: 298190 - DNA, 75 bp, Artificial Sequence
  Synthetic
actgtatattattattataacttatatcagaaaaagcctattatatatatggttggttcagctccttcatattgg

SEQ ID NO: 298191 - DNA, 75 bp, Artificial Sequence
  Synthetic
catcataaagaattatttttcgagaaggacataatcagattaaaggacgattcaatattgtatattgatattagg

SEQ ID NO: 298192 - DNA, 75 bp, Artificial Sequence
  Synthetic
attttattggaattaagttcaaaaatataccctatcaatatgatgttaaagtaccacatcttacatttggtgtat

SEQ ID NO: 298193 - DNA, 75 bp, Artificial Sequence
  Synthetic
gactgcaatggatttagagcttcccatatctgcaaagttattacatcatccaacaactgaaatccgatcagaatt

SEQ ID NO: 298194 - DNA, 75 bp, Artificial Sequence
  Synthetic
actgatgctataataacctcatacgatggatgtttaggtatattcggattatcaatatccttagcttcaaagcct

SEQ ID NO: 298195 - DNA, 75 bp, Artificial Sequence
  Synthetic
attttgaatcactgtgggatacaataactacatcaaattatattttggcgagatcggtagtaccagatttaaagg

SEQ ID NO: 298196 - DNA, 75 bp, Artificial Sequence
  Synthetic
tatgcagatgatccaaattactttataggtattagattcagacacattccctatgaatatgacgttaaaattcca

SEQ ID NO: 298197 - DNA, 75 bp, Artificial Sequence
  Synthetic
ggctttttttatgaaaagtcttgtggaagccatggctacttttaaagacgcttgctatcaatataaaaagttaaa

SEQ ID NO: 298198 - DNA, 75 bp, Artificial Sequence
  Synthetic
atgtatagagaatataccatgttaattagagatgaagttgtgaaaatgttagaagaagcagtcaagcatgatgat

SEQ ID NO: 298199 - DNA, 75 bp, Artificial Sequence
  Synthetic
actatagagttgttaagtattcatcagttgctaatcatgcagatagagtgttcgctacatataagaataatgcta

SEQ ID NO: 298200 - DNA, 75 bp, Artificial Sequence
  Synthetic
ctactagctacacatatatgttatctgatggaatatatgtagcaaatgtcagtggagttctagcaacatatttta

SEQ ID NO: 298201 - DNA, 75 bp, Artificial Sequence
  Synthetic
aaaatgaaacaagagaaaaatccgtttaaaggactgtcaactgatagaaaaatggatgaagtctcacatgttgga

SEQ ID NO: 298202 - DNA, 75 bp, Artificial Sequence
  Synthetic
tttagaaaaggaataattatgggattggatatattagctaatatgactaataatgctaaagtaatacaaacatta

SEQ ID NO: 298203 - DNA, 75 bp, Artificial Sequence
  Synthetic
ggaatgaactttgaaacacaaatgtttaccaaggtggcaatgttgatttgcgaagctctgaattcgctaaagatt

SEQ ID NO: 298204 - DNA, 75 bp, Artificial Sequence
  Synthetic
ttttacattacaagtgattagaaattgcagtaatatgtcagttgaatggaataaagcatgtaatcttattaaaaa

SEQ ID NO: 298205 - DNA, 75 bp, Artificial Sequence
  Synthetic
gaaaatcaccaagatgtactctttcattcaaaagatctattaattaaatcagtgctcatagctattggacagtcg

SEQ ID NO: 298206 - DNA, 75 bp, Artificial Sequence
  Synthetic
attcaaaagatctattaattaaatcagtgctcatagctattggacagtcgaaggagattgaaactacagctactg

SEQ ID NO: 298207 - DNA, 75 bp, Artificial Sequence
  Synthetic
aagagatgaaagtggaaatatatcaaattattggggttcgtctacatatggtgacttgagagttggaacatattt

SEQ ID NO: 298208 - DNA, 75 bp, Artificial Sequence
  Synthetic
aacctaaatgcggatttctacattataccagattcgcaacaagaaaaatgcacagaatacataaagggaggattg

SEQ ID NO: 298209 - DNA, 75 bp, Artificial Sequence
  Synthetic
attagggctttagtgaaatcaaatctttacgtgggacattgttcttcagaagaaaagatatatgaatctattaag

SEQ ID NO: 298210 - DNA, 75 bp, Artificial Sequence
  Synthetic
ataattgatgttgtagatagtgtgaatcataaattagacgttacgtccacaacgtgcacaatacgaaattgtaat

SEQ ID NO: 298211 - DNA, 75 bp, Artificial Sequence
  Synthetic
acattcaagaataataacaaatctggaatttcatctgactttaatcttcttgatcaaagaataatttggcaaaac

SEQ ID NO: 298212 - DNA, 75 bp, Artificial Sequence
  Synthetic
cactgtggaaagaggttcaatataatagagacattgtgataagatttgtatttgcaaataatataatcaaagcag

SEQ ID NO: 298213 - DNA, 75 bp, Artificial Sequence
  Synthetic
ttcagtgaacggtgttagtgtgtataattataacactggatcgttaccaactgatttcacgatacgaaattatga

SEQ ID NO: 298214 - DNA, 75 bp, Artificial Sequence
  Synthetic
caagtgcattgtgtaggaggtaattattcgttcgcattgcccgttggctcatggccagtgatgcaaggaggaagt

SEQ ID NO: 298215 - DNA, 75 bp, Artificial Sequence
  Synthetic
actctactgtcaatactatcatattcatttgacaaatataacgcagtagaaagaaaattggtacactatgcaaaa

SEQ ID NO: 298216 - DNA, 75 bp, Artificial Sequence
  Synthetic
gatatcaaatttgtatggccttccagccgctaacccaatgggagaccaacaatattatgaggcatcaggtaggtt

SEQ ID NO: 298217 - DNA, 75 bp, Artificial Sequence
  Synthetic
ctttaatggatccagcaatattaacatcactatcttcaaatttaaatgcagttatgttttggttggagaaacatg

SEQ ID NO: 298218 - DNA, 75 bp, Artificial Sequence
  Synthetic
tctcaccgcggttagactgattaaatgtatagtactgaatgtactatcctttcgattgagataatattctattgt

SEQ ID NO: 298219 - DNA, 75 bp, Artificial Sequence
  Synthetic
gaagtaccgttgaagcagcaaaaagcttcgcaacatcagtgatgaagaaatttagaaagtcgaatttggcaaaaa

SEQ ID NO: 298220 - DNA, 75 bp, Artificial Sequence
  Synthetic
caagagagatggcttggtaaaagattatcacagtttgatattggtcaatataaaaatatgctaaatgtattaacg

SEQ ID NO: 298221 - DNA, 75 bp, Artificial Sequence
  Synthetic
cagatccactttagctaaacttgtttcatcacctatgtcaattttggtcgcgttagtagacataaacggtacttt

SEQ ID NO: 298222 - DNA, 75 bp, Artificial Sequence
  Synthetic
gttacgctcaaaattatggcattaatgttccaatcacgggatctctggacgttacagtacaaaatcaaacaagtg

SEQ ID NO: 298223 - DNA, 75 bp, Artificial Sequence
  Synthetic
cataagtgacatagtagattcaacagacgatattgtggcagctacagcaacagccgctgcgaagaagtttagagt

SEQ ID NO: 298224 - DNA, 75 bp, Artificial Sequence
  Synthetic
tttgactaaaggttggccaacaacttcaatttatctaaatgaatacactgatttgcagacattttcgaataatcc

SEQ ID NO: 298225 - DNA, 75 bp, Artificial Sequence
  Synthetic
tgcatatagattaatagatggagagaaggtatatgaggttacaacggaagggaagtattttgcttatctaacaga

SEQ ID NO: 298226 - DNA, 75 bp, Artificial Sequence
  Synthetic
aagatgttgatgacgaaatgtatagagaatataccatgttaattagagacgaggttgtgaggatgttagaagagt

SEQ ID NO: 298227 - DNA, 75 bp, Artificial Sequence
  Synthetic
gcagagagatttactgaattagttactgattctccagtaatatcagcaattatagactttaaaacgataaagaat

SEQ ID NO: 298228 - DNA, 75 bp, Artificial Sequence
  Synthetic
tgtaacgaaatggatgttagtctttattattaccaacaagtatctgaagcgaataaatggattgctatggggact

SEQ ID NO: 298229 - DNA, 75 bp, Artificial Sequence
  Synthetic
gggagcaagcgttgaatatgttacgttcagatccgaaagtattaagaagctttattaaccaaaacaatcctataa

SEQ ID NO: 298230 - DNA, 75 bp, Artificial Sequence
  Synthetic
ttcagatccgaaagtattaagaagctttattaaccaaaacaatcctataattaaaaacagaatagagcaactaat

SEQ ID NO: 298231 - DNA, 75 bp, Artificial Sequence
  Synthetic
aattggctatagttgatgtagtggatggtgttaatcataaaatagattatacagtaactacctgcaacgttaaaa

SEQ ID NO: 298232 - DNA, 75 bp, Artificial Sequence
  Synthetic
ccacaattgattattttatcgattttgtagataatgtatgtatggatgaaatggcaagagagtctcaacgaaatg

SEQ ID NO: 298233 - DNA, 75 bp, Artificial Sequence
  Synthetic
tttattgctcaacacgcaattgttgaaaaaatgttaatttacgcaaagcatactagagaatacgctgaattctat

SEQ ID NO: 298234 - DNA, 75 bp, Artificial Sequence
  Synthetic
gcaacgtgtgactaggataaattggaaaaaatggtggcaagtgttttacacaattgtggattacattaatactat

SEQ ID NO: 298235 - DNA, 75 bp, Artificial Sequence
  Synthetic
caattgtggattacattaatactattatacaaacaatgtcaaaacgatcacgatcactaaacgctagtgcatatt

SEQ ID NO: 298236 - DNA, 75 bp, Artificial Sequence
  Synthetic
gatgtatcgcagtgggactcatctcaacataatacgcaaccatttagaaaaggaataattatgggactggatatg

SEQ ID NO: 298237 - DNA, 75 bp, Artificial Sequence
  Synthetic
ctgcaagatgatttaacggtattaagatattcaaatgagatagaaaactatatcaataaagtttatagtataaca

SEQ ID NO: 298238 - DNA, 75 bp, Artificial Sequence
  Synthetic
ttgggccgaggaatgaatctatgttcacattcctaaattttccaactattaaacaattttcaaacggcgcatata

SEQ ID NO: 298239 - DNA, 75 bp, Artificial Sequence
  Synthetic
aaacaaatggtgcaagatgtgtcaaatgatgtcagggatacttatgcgcgaatgaatgctaaagtaaaagctttg

SEQ ID NO: 298240 - DNA, 75 bp, Artificial Sequence
  Synthetic
aatgaatgctaaagtaaaagctttggtttcaacggttggaatagaaatcgctaagcgctatatagctggcgggaa

SEQ ID NO: 298241 - DNA, 75 bp, Artificial Sequence
  Synthetic
aacagattaagaggttttgaaactgatagagagtttatattaacgaaaatcatgcaaatgacgtcagtagctatc

SEQ ID NO: 298242 - DNA, 75 bp, Artificial Sequence
  Synthetic
aacagattaagaggttttgaaactgatagagagtttatattaacgaaaatcatgcatatgacgtcagtagctatc

SEQ ID NO: 298243 - DNA, 75 bp, Artificial Sequence
  Synthetic
aacagattaagaggttttgaaactgatagagagtttatattaacgaaaatcatgcacatgacgtcagtagctatc

SEQ ID NO: 298244 - DNA, 75 bp, Artificial Sequence
  Synthetic
aacagattaagaggttttgaaactgatagagagtttatattaacgaaaatcatgcagatgacgtcagtagctatc

SEQ ID NO: 298245 - DNA, 75 bp, Artificial Sequence
  Synthetic
atagagagtttatattaacgaaaatcatgcaaatgacgtcagtagctatcactggatcgcttaaattgtttccat

SEQ ID NO: 298246 - DNA, 75 bp, Artificial Sequence
  Synthetic
atagagagtttatattaacgaaaatcatgcaaatgacgtcagtagctatcactggatcgcttatattgtttccat

SEQ ID NO: 298247 - DNA, 75 bp, Artificial Sequence
  Synthetic
atagagagtttatattaacgaaaatcatgcaaatgacgtcagtagctatcactggatcgcttacattgtttccat

SEQ ID NO: 298248 - DNA, 75 bp, Artificial Sequence
  Synthetic
atagagagtttatattaacgaaaatcatgcaaatgacgtcagtagctatcactggatcgcttagattgtttccat

SEQ ID NO: 298249 - DNA, 75 bp, Artificial Sequence
  Synthetic
atagagagtttatattaacgaaaatcatgcatatgacgtcagtagctatcactggatcgcttaaattgtttccat

SEQ ID NO: 298250 - DNA, 75 bp, Artificial Sequence
  Synthetic
atagagagtttatattaacgaaaatcatgcatatgacgtcagtagctatcactggatcgcttatattgtttccat

SEQ ID NO: 298251 - DNA, 75 bp, Artificial Sequence
  Synthetic
atagagagtttatattaacgaaaatcatgcatatgacgtcagtagctatcactggatcgcttacattgtttccat

SEQ ID NO: 298252 - DNA, 75 bp, Artificial Sequence
  Synthetic
atagagagtttatattaacgaaaatcatgcatatgacgtcagtagctatcactggatcgcttagattgtttccat

SEQ ID NO: 298253 - DNA, 75 bp, Artificial Sequence
  Synthetic
atagagagtttatattaacgaaaatcatgcacatgacgtcagtagctatcactggatcgcttaaattgtttccat

SEQ ID NO: 298254 - DNA, 75 bp, Artificial Sequence
  Synthetic
atagagagtttatattaacgaaaatcatgcacatgacgtcagtagctatcactggatcgcttatattgtttccat

SEQ ID NO: 298255 - DNA, 75 bp, Artificial Sequence
  Synthetic
atagagagtttatattaacgaaaatcatgcacatgacgtcagtagctatcactggatcgcttacattgtttccat

SEQ ID NO: 298256 - DNA, 75 bp, Artificial Sequence
  Synthetic
atagagagtttatattaacgaaaatcatgcacatgacgtcagtagctatcactggatcgcttagattgtttccat

SEQ ID NO: 298257 - DNA, 75 bp, Artificial Sequence
  Synthetic
atagagagtttatattaacgaaaatcatgcagatgacgtcagtagctatcactggatcgcttaaattgtttccat

SEQ ID NO: 298258 - DNA, 75 bp, Artificial Sequence
  Synthetic
atagagagtttatattaacgaaaatcatgcagatgacgtcagtagctatcactggatcgcttatattgtttccat

SEQ ID NO: 298259 - DNA, 75 bp, Artificial Sequence
  Synthetic
atagagagtttatattaacgaaaatcatgcagatgacgtcagtagctatcactggatcgcttacattgtttccat

SEQ ID NO: 298260 - DNA, 75 bp, Artificial Sequence
  Synthetic
atagagagtttatattaacgaaaatcatgcagatgacgtcagtagctatcactggatcgcttagattgtttccat

SEQ ID NO: 298261 - DNA, 75 bp, Artificial Sequence
  Synthetic
atttctttagagaaacgtcgtgcgcaaatctctgctctgctaactatgctgcagaagccagtgacgtttaaatcg

SEQ ID NO: 298262 - DNA, 75 bp, Artificial Sequence
  Synthetic
tacatgatattaagccatattttgtaacaagtgaggctaatttacccattcagtatcaaaaattcatgccaactt

SEQ ID NO: 298263 - DNA, 75 bp, Artificial Sequence
  Synthetic
cattgatggatccagcaattctaacttccttgtcatcaaatttaaacgcagtcatgttttggttggaaaaacacg

SEQ ID NO: 298264 - DNA, 75 bp, Artificial Sequence
  Synthetic
tgtgttgattattcaaaaagaggcttatcactgaagtcattatttgaagaatataaagacgtaatagacgacgca

SEQ ID NO: 298265 - DNA, 75 bp, Artificial Sequence
  Synthetic
aatttgttatccataaactatggttgttatcaactttttgactttaattcaccagatttggagaaattgataaaa

SEQ ID NO: 298266 - DNA, 75 bp, Artificial Sequence
  Synthetic
ggctttaaaagagagaatttccgtttggctagcggatagctccttttaatgtatggtattgaatataccacagtt

SEQ ID NO: 298267 - DNA, 75 bp, Artificial Sequence
  Synthetic
attactgaattacatccttaaatcaatctcaagaattatggactacataatttatagatttctactaattattgt

SEQ ID NO: 298268 - DNA, 75 bp, Artificial Sequence
  Synthetic
tttctaacatcaacgctctgcttgtactatcctactgaagcgcaaactgaaattaatgataatagctggaaagac

SEQ ID NO: 298269 - DNA, 75 bp, Artificial Sequence
  Synthetic
tgagtatacaatgttaattagggatgagatagttaagatgttagaaataccggttaaacatgatgatcatttact

SEQ ID NO: 298270 - DNA, 75 bp, Artificial Sequence
  Synthetic
actgtgactacaacgttgtcctcatgaaatacgattctactttacaactagatatgtcagaattagctgatttga

SEQ ID NO: 298271 - DNA, 75 bp, Artificial Sequence
  Synthetic
catacattgcttctgtcctaactgtactatttacattacataaggcttcgattccaaccatgaagatcgctctta

SEQ ID NO: 298272 - DNA, 75 bp, Artificial Sequence
  Synthetic
atgtccaaaagatcgagatcgttagattcgtcatctttctattatagagtgtagatatatcctaaagtagaattg

SEQ ID NO: 298273 - DNA, 75 bp, Artificial Sequence
  Synthetic
aattaaagtgtgtccattgaatactcaaactttaggtataggatgtttaactacagatactgcaacgtttgaaga

SEQ ID NO: 298274 - DNA, 75 bp, Artificial Sequence
  Synthetic
agatgaaattgaaaagcaaatggacagagttgtaaaagaaatgagacgtcaactggaaatgattgataaactaac

SEQ ID NO: 298275 - DNA, 75 bp, Artificial Sequence
  Synthetic
agagttgtaaaagaaatgagacgtcaactggaaatgattgataaactaactactagagaaattgaacaagttgaa

SEQ ID NO: 298276 - DNA, 75 bp, Artificial Sequence
  Synthetic
atcataaattaaatgttactacagcaacttgtacgattagaaattgtaagaaactgggaccaagggaaaacgtcg

SEQ ID NO: 298277 - DNA, 75 bp, Artificial Sequence
  Synthetic
gaccagttgacgttatagatatgtcaaaggaattcaatcagaaaaacattaaaacgctagatgaatgggagagtg

SEQ ID NO: 298278 - DNA, 75 bp, Artificial Sequence
  Synthetic
caactctattaaacttggatgctaattacgtcgagacagctagaaccacaattgattattttgttgattttgtag

SEQ ID NO: 298279 - DNA, 75 bp, Artificial Sequence
  Synthetic
ctaaaggtatagcagtaacagaaaaagcaaaattgaattcgtacgcaccagtttacttagagaaacgtcgtgcac

SEQ ID NO: 298280 - DNA, 75 bp, Artificial Sequence
  Synthetic
ccaagagttgttaattctgcagatggtgcaacgacatggtactttaatcctgtagtattgcgaccaaataatgtt

SEQ ID NO: 298281 - DNA, 75 bp, Artificial Sequence
  Synthetic
tgactcagcgatttgcgaatctgttttggctgacgctaatgaaacaatgttagctaacgttacatcagttcggca

SEQ ID NO: 298282 - DNA, 75 bp, Artificial Sequence
  Synthetic
cagtagaacgaaaattagttaactatgccaagggtaaaccattagaggctgatttgacagcaaatgaacttgatt

SEQ ID NO: 298283 - DNA, 75 bp, Artificial Sequence
  Synthetic
gaacagcacattgcacacgatacttgaggatccagggatggcgtattttccttatatagcatctgtcctaacagt

SEQ ID NO: 298284 - DNA, 75 bp, Artificial Sequence
  Synthetic
ccggcatgtagctatatcaagctgttcagactctacaagtaaggatgtgatttcacattcgctacgtagagtaac

SEQ ID NO: 298285 - DNA, 75 bp, Artificial Sequence
  Synthetic
atgagagtgaattggaaaagatggtggcaagtattttatactatagtagattatattaatcagattgtacaggta

SEQ ID NO: 298286 - DNA, 75 bp, Artificial Sequence
  Synthetic
tttgagtaattacacattgaaaatggtgactaagacgatagattatataatatacaggtttctactgattgtagc

SEQ ID NO: 298287 - DNA, 75 bp, Artificial Sequence
  Synthetic
actcaaatagatcaacattagctaaattggtttcatctccgatgtcaatattagttgcattgatagatattaatg

SEQ ID NO: 298288 - DNA, 75 bp, Artificial Sequence
  Synthetic
tttatgaaatcaacgctttgtctttattatccaaacgaagtaatcagtcaaattaatgatgataagtggaaagat

SEQ ID NO: 298289 - DNA, 75 bp, Artificial Sequence
  Synthetic
aatgctttcgatgattttgagtctattcttcgtaatttaatatctgattatgatagaatttttattatgtttaaa

SEQ ID NO: 298290 - DNA, 75 bp, Artificial Sequence
  Synthetic
aaagtaaatgagaatatgtactctcttcaaaatgttatttcacaacagcaaaatcaaatagcagatcttcaacaa

SEQ ID NO: 298291 - DNA, 75 bp, Artificial Sequence
  Synthetic
attgtgattataacatcgtaataatgaaatatgctgattcagaatcgcttgacatgtcagaattggctgatctga

SEQ ID NO: 298292 - DNA, 75 bp, Artificial Sequence
  Synthetic
tatagatttttattaattatagttctactcgcaccaattattaaagctcagaattatggaatcaatttgccaata

SEQ ID NO: 298293 - DNA, 75 bp, Artificial Sequence
  Synthetic
agttaaagtttgtccgttgaatactcaaacggtaggaataggttgtgtgactacagatgttaatacttttgaaga

SEQ ID NO: 298294 - DNA, 75 bp, Artificial Sequence
  Synthetic
aagttaggtccaagagagaacgtcgcaataatccaagtaggtggttcagacgttattgatataacagcagatcca

SEQ ID NO: 298295 - DNA, 75 bp, Artificial Sequence
  Synthetic
tgcaagatagactaaatttacatgataatttcgaatcattatgggacacaataactacatcaaactacatattag

SEQ ID NO: 298296 - DNA, 75 bp, Artificial Sequence
  Synthetic
gattatattaatcaaattgtgaaagtgatgtcaaggagatctaggtcactcaattctgcagctttctactataga

SEQ ID NO: 298297 - DNA, 75 bp, Artificial Sequence
  Synthetic
atggcttctctaatttacagacaactactttcgaattcatatactacaaatatatctgatgaaataacagaatta

SEQ ID NO: 298298 - DNA, 75 bp, Artificial Sequence
  Synthetic
tatatctgatgaaataacagaattatcacaggagaaaacacaaaatgtaatagttaatccaggaccatttgctca

SEQ ID NO: 298299 - DNA, 75 bp, Artificial Sequence
  Synthetic
cctgataatggaaactggctactactgcaacctgaaagaccaggtgtgattatgaccggaacagataatgtaaac

SEQ ID NO: 298300 - DNA, 75 bp, Artificial Sequence
  Synthetic
ttatgttaatcaaattgtacaagttatgtccaagcgatcacgttccctaaattcagctgcattttattatcgagt

SEQ ID NO: 298301 - DNA, 75 bp, Artificial Sequence
  Synthetic
cacgaactaagtggaagatagtggatttatataaaactcaacagtcaggacaatatgtgagacagaattggcgca

SEQ ID NO: 298302 - DNA, 75 bp, Artificial Sequence
  Synthetic
attctagaatgaatgcgaaagttaaagcattagtgtctacagttggtattgaaatagcaaaaagatacatagctg

SEQ ID NO: 298303 - DNA, 75 bp, Artificial Sequence
  Synthetic
aacaaattactcaaatgttgaaataactacattatccaacttttttataatctcttcaaataacacagaaaaatg

SEQ ID NO: 298304 - DNA, 75 bp, Artificial Sequence
  Synthetic
ggaatggcgtactttccatatattgcttctgtcctaactgtactattcacgctacataaggcttcaattccaact

SEQ ID NO: 298305 - DNA, 75 bp, Artificial Sequence
  Synthetic
cagccgaatcaagatatagaagtgtcaaaaacgtcattatggaaagaaatgcagtacaatagagacataattatc

SEQ ID NO: 298306 - DNA, 75 bp, Artificial Sequence
  Synthetic
aaagaaatgcgacgtcagctggaaatgattgataagttaactactagagagattgaacaagttgaattgctcaaa

SEQ ID NO: 298307 - DNA, 75 bp, Artificial Sequence
  Synthetic
tagtcagaaatcaggaatagctgatgaaattgcctcgtcacaaacgtttaaaaactatgttagcaaattatccga

SEQ ID NO: 298308 - DNA, 75 bp, Artificial Sequence
  Synthetic
gagatggagaagagattatagctcatacaacgtgttcagtgaatggagtgaatgagtataattataatggtggat

SEQ ID NO: 298309 - DNA, 75 bp, Artificial Sequence
  Synthetic
ggtgtatgttagatcattagttgcagagttgaataatatatattgcgatggaggagattacagctttagagtgcc

SEQ ID NO: 298310 - DNA, 75 bp, Artificial Sequence
  Synthetic
gatattttacgtgatataaaaccattctttgatactactgaagctagcttaccgattcaatataggaaatttatg

SEQ ID NO: 298311 - DNA, 75 bp, Artificial Sequence
  Synthetic
ttaaggtttagattcaaagcatcagttgcagagccatcattcagaattattaggactagagtgaacagtttatat

SEQ ID NO: 298312 - DNA, 75 bp, Artificial Sequence
  Synthetic
tccaccagttgacgcaagcacatatgttggatcgaggatatattcacaggataaatataagatattagaatccta

SEQ ID NO: 298313 - DNA, 75 bp, Artificial Sequence
  Synthetic
taccaatagcaaactcagttacggtaagacaagacttggaaagacaacttggtgaactaagggaggagtttaata

SEQ ID NO: 298314 - DNA, 75 bp, Artificial Sequence
  Synthetic
tacaaaatcgatggcgacatcagtaatgaagagatttaaaaacacaaatatagctaaaacgataacatcaataac

SEQ ID NO: 298315 - DNA, 75 bp, Artificial Sequence
  Synthetic
acacctgttattgaaagtgtggacgtatcgacgcaagtatcaagattgtcgaataggctaaggttcaaagaaatg

SEQ ID NO: 298316 - DNA, 75 bp, Artificial Sequence
  Synthetic
aaagaaatgagacgtcgattacaaatgattgatcaactgactacacgtgagattgaacaagttgagctgcttaga

SEQ ID NO: 298317 - DNA, 75 bp, Artificial Sequence
  Synthetic
aaatagtgtcggaagcggctgacagtttcataccagcaagagcatatagagtcattgttgatgatgatgttttgg

SEQ ID NO: 298318 - DNA, 75 bp, Artificial Sequence
  Synthetic
ggtgatatctgcaataatagattttaaaactatcaagaacttgaatgacaattatggaattacgaaacaacaagc

SEQ ID NO: 298319 - DNA, 75 bp, Artificial Sequence
  Synthetic
aaaactttaagagatttcgtaaatcaaaataacccaataattaggaacagaatagagcaattgatattgcaatgt

SEQ ID NO: 298320 - DNA, 75 bp, Artificial Sequence
  Synthetic
gccgtgaggcgaatataaataataatgaccgaatgcaagagaaagatgacgagaaacaagatcaaaacaatagaa

SEQ ID NO: 298321 - DNA, 75 bp, Artificial Sequence
  Synthetic
cttgctgacgcgagcgaaacaatgctagctaatgtaacgtctgttagacaggaatacgcaataccagttggacca

SEQ ID NO: 298322 - DNA, 75 bp, Artificial Sequence
  Synthetic
aaaaacgataccaacatttgaaccaaaagagtcaatattgaagaaactggaagatatcaaaccggaacaagcgaa

SEQ ID NO: 298323 - DNA, 75 bp, Artificial Sequence
  Synthetic
gaagcagactaagctatttagaatatttgaaccgagacagctgccaatttatagagcgaatggtgaaaaagagtt

SEQ ID NO: 298324 - DNA, 75 bp, Artificial Sequence
  Synthetic
gattctgaaacggcaagtatatgtgatgctatatttcaagatgaggaaacagaaggtgcagtgagaagattcatt

SEQ ID NO: 298325 - DNA, 75 bp, Artificial Sequence
  Synthetic
gcggagatgagacaacgcgtacaagctgacagaaacgttgtcaattacccatcaatattgcatccaatagattac

SEQ ID NO: 298326 - DNA, 75 bp, Artificial Sequence
  Synthetic
tattgatgacattgtttaccttcatgactattcatattataccaacaatgaaataaggactgatcaacattgggt

SEQ ID NO: 298327 - DNA, 75 bp, Artificial Sequence
  Synthetic
tgttgcataaaccaaatattcttccatataacaattcatttactctaactaggtctcaaccagcacacgataatg

SEQ ID NO: 298328 - DNA, 75 bp, Artificial Sequence
  Synthetic
gaaaggataaggaatgacgttaactatatacttaacatggatagaaatctgccatcaacagctagatatataaga

SEQ ID NO: 298329 - DNA, 75 bp, Artificial Sequence
  Synthetic
cggatctgaaattgaaatcgctggatttgattctgaatgtgcgctaaatgctccgggaaatatccaagaatttga

SEQ ID NO: 298330 - DNA, 75 bp, Artificial Sequence
  Synthetic
ggcttgaacacgtggctgtttaacccaattatattgagaccaaacaacgtacaagtggaatttctgttgaatgga

SEQ ID NO: 298331 - DNA, 75 bp, Artificial Sequence
  Synthetic
cgcctggagtagcagcactctttcctatggcagctccatttccaaatcatgctacagttggtttaacgttgaaaa

SEQ ID NO: 298332 - DNA, 75 bp, Artificial Sequence
  Synthetic
tatatgtcattaatttcaggtatgtggttactaactgtagtgccaaatgatatgttcataagggaatcattagtt

SEQ ID NO: 298333 - DNA, 75 bp, Artificial Sequence
  Synthetic
tgtcgcaatttgatatcggacagtacaaaaatatgttaaacgtattgacgactttgtatcaatactacgatatgt

SEQ ID NO: 298334 - DNA, 75 bp, Artificial Sequence
  Synthetic
gatccacagacaccatttcagatagcagaacagcagatacaaaattttcaggtagcgaattggctgcattttgtt

SEQ ID NO: 298335 - DNA, 75 bp, Artificial Sequence
  Synthetic
agtatttccagcaggtatgaactggactgagttgcttaataattattcagcatctagagaagataacttgcaacg

SEQ ID NO: 298336 - DNA, 75 bp, Artificial Sequence
  Synthetic
attagatcgaatgcagttaagacaaatgcagacgctggcgtgtctatggattcatcaacacaatcacgaccttca

SEQ ID NO: 298337 - DNA, 75 bp, Artificial Sequence
  Synthetic
atttgaaatttgaaacgtgggacccattggatacaccttattccgattcacaccataaagaactattttacataa

SEQ ID NO: 298338 - DNA, 75 bp, Artificial Sequence
  Synthetic
gtacgtgagtattttttaaatttatatgatcaaatactgatagaaatgccagattatttattattaaaagatatg

SEQ ID NO: 298339 - DNA, 75 bp, Artificial Sequence
  Synthetic
atggtcatgtagctatactgaaggaaaattcgtagtggacgtaagcatttgcgcgacgtaagcatttgcgctacc

SEQ ID NO: 298340 - DNA, 75 bp, Artificial Sequence
  Synthetic
gtttccaacaatgcctgttgattataagaggtcaatccagcgtggaatattattgctatcaaataggcttggtca

SEQ ID NO: 298341 - DNA, 75 bp, Artificial Sequence
  Synthetic
attagttgatttaactaggttattagcttacaactacgaaacactaatggcatgtgttacgatgaatatgcaaca

SEQ ID NO: 298342 - DNA, 75 bp, Artificial Sequence
  Synthetic
gatgaaactaaagatgactacgaaaatgcatttttaatttctaatctcactacacataatatattatatctaaat

SEQ ID NO: 298343 - DNA, 75 bp, Artificial Sequence
  Synthetic
agacattaaagaatgaatatgtggttgcactatatgcgctgtctaacgacttcaataatagagaagatgtgataa

SEQ ID NO: 298344 - DNA, 75 bp, Artificial Sequence
  Synthetic
ctcttgaataaccaaccagtagcgctagttggagctcttccatttgttacagactcgtcagtcatatcgttgata

SEQ ID NO: 298345 - DNA, 75 bp, Artificial Sequence
  Synthetic
tataaacaagttccacagcaatttgatttcagaaattcgatgcatatgttaacatcaaatcttactttcactgtt

SEQ ID NO: 298346 - DNA, 75 bp, Artificial Sequence
  Synthetic
ttggaataaaatttaaaaatataccctataaatatgatgttaaagtaccacatcttacatttggtgtattaaata

SEQ ID NO: 298347 - DNA, 75 bp, Artificial Sequence
  Synthetic
catcttacatttggtgtattaaatatttcagattccatggtaccagatgtagtagcaattttgaagaagtttaaa

SEQ ID NO: 298348 - DNA, 75 bp, Artificial Sequence
  Synthetic
atttattatagatataactattcttttgacttaaaaagatggatatatttacattcaatagaaaaagctgatata

SEQ ID NO: 298349 - DNA, 75 bp, Artificial Sequence
  Synthetic
cagcgacttcgtactcaggttacatttttagagatttatcaaataataatttcaatttaataggtacgaatgttg

SEQ ID NO: 298350 - DNA, 75 bp, Artificial Sequence
  Synthetic
aagaatatgatgatatagctactttttcagtggatccacaactgtattgtgactataacatagttttgatgagat

SEQ ID NO: 298351 - DNA, 75 bp, Artificial Sequence
  Synthetic
gacggacgaggcgaacaaatggatagcaatgggacaatcatgtacaataaaagtgtgtccattgaatacccaaac

SEQ ID NO: 298352 - DNA, 75 bp, Artificial Sequence
  Synthetic
gcaatgggacaatcatgtacaataaaagtgtgtccattgaatacccaaacactaggaataggatgtcagactaca

SEQ ID NO: 298353 - DNA, 75 bp, Artificial Sequence
  Synthetic
gtttagaagcagtaatcaaaatgaattttataatagacgtacattaacttctgatactagacttgtaggaatatt

SEQ ID NO: 298354 - DNA, 75 bp, Artificial Sequence
  Synthetic
gagatcgctgatacggaatggaaaaacaccttgtcccaactatttttaacaaaaggatggcccacaggatcagta

SEQ ID NO: 298355 - DNA, 75 bp, Artificial Sequence
  Synthetic
atactgcgattacaatatagttctgatgaaatataattcagcgctagaattggatatgtcagaactagctgatct

SEQ ID NO: 298356 - DNA, 75 bp, Artificial Sequence
  Synthetic
ccgatggacataacattgtattattaccaacaaactgatgaagcaaataaatggatatcaatgggttcatcatgt

SEQ ID NO: 298357 - DNA, 75 bp, Artificial Sequence
  Synthetic
ctattactgacgttgtagacggtgtaaatcataagttaaacgtaacaattgagacatgtacaatacgcaactgca

SEQ ID NO: 298358 - DNA, 75 bp, Artificial Sequence
  Synthetic
atagaaatgttgttaattatccatcaatattacatccaatagattatgcatttaatgaatattttttacaacatc

SEQ ID NO: 298359 - DNA, 75 bp, Artificial Sequence
  Synthetic
agagtatactggtatcaaggagcgacaccgaacgcatcagagagctattacttgactataaacaatgataacagc

SEQ ID NO: 298360 - DNA, 75 bp, Artificial Sequence
  Synthetic
taaatgcagttgcatttgacaacatgcgcatcatgaacgaattgtagacgccaaccccactgtggagatatgacc

SEQ ID NO: 298361 - DNA, 75 bp, Artificial Sequence
  Synthetic
ttgatggtgtattgaatcaggtactgaacgacaatattagaaatggtcatattattaatcaactaatggaagctc

SEQ ID NO: 298362 - DNA, 75 bp, Artificial Sequence
  Synthetic
caaattagattctcagagtctgcgacatcatattcgggatatatttttagagatctttcaaataataatttcaat

SEQ ID NO: 298363 - DNA, 75 bp, Artificial Sequence
  Synthetic
aaatagttaaattacgaaaagttgatactttaaaaccaatattatacaagataaattcagactcaaatgactttt

SEQ ID NO: 298364 - DNA, 75 bp, Artificial Sequence
  Synthetic
atttatggaattgcgccacctccacaatttaaaaaacgttataatactagtgataattcaagaggtatgaattat

SEQ ID NO: 298365 - DNA, 75 bp, Artificial Sequence
  Synthetic
ttcgaatcttacttttacggtttattcagatcttctcgcgttcgtatcagctgacacagtagaacctataaatgc

SEQ ID NO: 298366 - DNA, 75 bp, Artificial Sequence
  Synthetic
tttaagacgctaaagaacttaaacgataattatggaataacgaagaaacaagccatggaactattacattcaaat

SEQ ID NO: 298367 - DNA, 75 bp, Artificial Sequence
  Synthetic
atgataataatccaataattagaaatagaatagaaaatttaatatcgcagtgtaggttgtaactgtctattttaa

SEQ ID NO: 298368 - DNA, 75 bp, Artificial Sequence
  Synthetic
atatccgatgttgaataatttcagagaaattatgttcgccaccatgagactctctgcactagagtagcgcctagg

SEQ ID NO: 298369 - DNA, 75 bp, Artificial Sequence
  Synthetic
ttggagaacgatagctataaatttattccgtttaacaatttggctataaaatgtatgttgacagcaaaagtagag

SEQ ID NO: 298370 - DNA, 75 bp, Artificial Sequence
  Synthetic
agaacttattgctgaattacggtggcaatataataaatttgcggtaattacgcatggtaaaggtcactatagagt

SEQ ID NO: 298371 - DNA, 75 bp, Artificial Sequence
  Synthetic
aaggtgaacgaaaatatgaactctcttcagaatgtgatttctcaacaacaagcacacattaatgaactacagatg

SEQ ID NO: 298372 - DNA, 75 bp, Artificial Sequence
  Synthetic
ttgcaacagctgaaaaattagtgattactgacgttgtagatggagtcaatcataaattgaacgtgacgacaaaca

SEQ ID NO: 298373 - DNA, 75 bp, Artificial Sequence
  Synthetic
ttcaatagaccagttaaatccagttaatgcaatagatgattttgaatcagtgcttcgcaatttgatttctgatta

SEQ ID NO: 298374 - DNA, 75 bp, Artificial Sequence
  Synthetic
tcacgatcacttaactctgctgcattctattatagaatataggtatagctttggttagaattgtatgatgtgacc

SEQ ID NO: 298375 - DNA, 75 bp, Artificial Sequence
  Synthetic
tgtaagtgatctaattcaacaatttaatcaaatgataattactatgaatggaaatgaatttcaaactggaggaat

SEQ ID NO: 298376 - DNA, 75 bp, Artificial Sequence
  Synthetic
ttgtcaaaaactttgaaggatgctagggataaaattgttgaaggtacattatactcaaatgtaagtgatttaatt

SEQ ID NO: 298377 - DNA, 75 bp, Artificial Sequence
  Synthetic
gtacaatcatttactaatgccaataacgttacaatccctgtcaattgaattagatggtgacatttattacgtatt

SEQ ID NO: 298378 - DNA, 75 bp, Artificial Sequence
  Synthetic
tttaattgtttagaaccagtagagcttgatgatgtcaaatatgttttatttaaccatgaaataaattgggatgtg

SEQ ID NO: 298379 - DNA, 75 bp, Artificial Sequence
  Synthetic
ttcaaaactttgattgcagcaatgttaagtcagagaactatgtcgcttgatttcgtaactacaaattatatgtca

SEQ ID NO: 298380 - DNA, 75 bp, Artificial Sequence
  Synthetic
atttcagttaatgcgtccaccaaatatgacaccagctgttaatgcattatttccgcaagcacaaccttttcaaca

SEQ ID NO: 298381 - DNA, 75 bp, Artificial Sequence
  Synthetic
attcatttgatcttaaacgatggatatacttacattcaacaggtaaagctagtattgaaggtggtaaatattatg

SEQ ID NO: 298382 - DNA, 75 bp, Artificial Sequence
  Synthetic
aatggggaagtataatctaatcttgtcagaatacttatcatttatatataattcacaatctgcagttcaaattcc

SEQ ID NO: 298383 - DNA, 75 bp, Artificial Sequence
  Synthetic
attcacaatctgcagttcaaattccaatttattactcttccaatagtgagttggaaagtagatgtatagaatttc

SEQ ID NO: 298384 - DNA, 75 bp, Artificial Sequence
  Synthetic
atcatactcctacgataaatataacgccgttgaacggaaattagtcaaatatgcgaaaggtaaaccacttgaggc

SEQ ID NO: 298385 - DNA, 75 bp, Artificial Sequence
  Synthetic
ttcatgttaaagaaaattaaagaaagaatgactacttctttaccgatagcacgtttatcaaatagagtttttaga

SEQ ID NO: 298386 - DNA, 75 bp, Artificial Sequence
  Synthetic
tgcatgccgatcagctaaagaatttgctatattacaagatgatttaacggtattgagatacgctaatgaaattga

SEQ ID NO: 298387 - DNA, 75 bp, Artificial Sequence
  Synthetic
cagcgttcggaatgcaacgaatgcattatagaaatggagatccacaaacaccatttcaaatagcagaacagcaga

SEQ ID NO: 298388 - DNA, 75 bp, Artificial Sequence
  Synthetic
aatgccagtggtgtgttatcaacttattttaaattatataatatgttctatagaaatcatatcacgtttggacaa

SEQ ID NO: 298389 - DNA, 75 bp, Artificial Sequence
  Synthetic
tattagaaatggacatgtcattaatcaattgatggaagctttaatgcaattgtcacgacaacagtttccaacaat

SEQ ID NO: 298390 - DNA, 75 bp, Artificial Sequence
  Synthetic
tgggatgactcacaagcatttaggaacatggtatatgtcaggtcattagcagcaaatttaaattcagtaaaatgt

SEQ ID NO: 298391 - DNA, 75 bp, Artificial Sequence
  Synthetic
acttgacactccatattcatcagtgcatcataaagaattattttttgagaaggacataactagattaaaggatga

SEQ ID NO: 298392 - DNA, 75 bp, Artificial Sequence
  Synthetic
tccgcagacgttgtttcactattataatgttaatgttaattttcattcaaattataatgaaagaattaatgatgc

SEQ ID NO: 298393 - DNA, 75 bp, Artificial Sequence
  Synthetic
tagctgggagattttctcttatttcattagtgccatctaatgacgattatcaaactccaatcatgaattcagtta

SEQ ID NO: 298394 - DNA, 75 bp, Artificial Sequence
  Synthetic
caactaaaaagaacatgcatgttatggatgatatggctaatggaaggtatacaccaggcataattccacctgtaa

SEQ ID NO: 298395 - DNA, 75 bp, Artificial Sequence
  Synthetic
ttgacttaaaaagatggatatacttacactcgatagaaaaagctgatatagaaggtggaaagtattatgaacatg

SEQ ID NO: 298396 - DNA, 75 bp, Artificial Sequence
  Synthetic
tagaacctataaatgcagttgcatttgataatatgcgcatcatgaacgagttgtaaacgccaaccccactgtgga

SEQ ID NO: 298397 - DNA, 75 bp, Artificial Sequence
  Synthetic
tatgcacgaatgaatgctaaagttaaagctctagtatccacagtaggaatagaaatagctaaaagatatattgca

SEQ ID NO: 298398 - DNA, 75 bp, Artificial Sequence
  Synthetic
agtactaatagctattggtcactcaaaagaaattgaaacaactgccactgctgaaggaggggaaatagtttttca

SEQ ID NO: 298399 - DNA, 75 bp, Artificial Sequence
  Synthetic
ctagaaaagagatgtatagattttcactctaaatgtttagagaactcaaaacgaggattatctttgaaaaacgtc

SEQ ID NO: 298400 - DNA, 75 bp, Artificial Sequence
  Synthetic
atcatattcatatgataaatataacgcagtggaaagaaagctagtgcattatgcaaaaggtaaacctttagaagc

SEQ ID NO: 298401 - DNA, 75 bp, Artificial Sequence
  Synthetic
attttaacgtcattatcttcaaatcttaacgcagttatgttttggctagaaaaacatagcaatgatactgcggaa

SEQ ID NO: 298402 - DNA, 75 bp, Artificial Sequence
  Synthetic
atagacaattgcttacaaattcatataccgttgacttatctgatgaaatacaagaaattggatctacaaaaacgc

SEQ ID NO: 298403 - DNA, 75 bp, Artificial Sequence
  Synthetic
atattatatctaaattatagcgttaagacattgcaaatattgaataaatctggtatagctgcgatagaaatacag

SEQ ID NO: 298404 - DNA, 75 bp, Artificial Sequence
  Synthetic
tgcgagggaactaatcatcctttcctattcaaacagatccactttagctaaacttgtctcatcaccaatgtcaat

SEQ ID NO: 298405 - DNA, 75 bp, Artificial Sequence
  Synthetic
aacaaagagttaatgagaaatacaatacttgggtacaaaaagcgaagaaagtaaatgaaaatatgtactctcttc

SEQ ID NO: 298406 - DNA, 75 bp, Artificial Sequence
  Synthetic
ggtacttttattactaatgaagagttggaactggaatattccaataagtatgttaaagcaattgttccagatcaa

SEQ ID NO: 298407 - DNA, 75 bp, Artificial Sequence
  Synthetic
ttagaaatttaattcaagattatgacagaacatttttaatgttaaaaggactgttgaagcaatgcaactatgaat

SEQ ID NO: 298408 - DNA, 75 bp, Artificial Sequence
  Synthetic
tcttatccagtaattctatggtattatatacagacgtttcacaatgggattcatcacaacataatacacagccat

SEQ ID NO: 298409 - DNA, 75 bp, Artificial Sequence
  Synthetic
ggatgatatggctaacggaaaatatacgcctggagtaattccaccagttaatattaataaaccaatcccattagg

SEQ ID NO: 298410 - DNA, 75 bp, Artificial Sequence
  Synthetic
atacatgatgttaaacaatactctaatttaaagtttgagacgtgggacccattggatacaccatactctgatttg

SEQ ID NO: 298411 - DNA, 75 bp, Artificial Sequence
  Synthetic
tgtcctgacagtcttgttcacgttgcacaaagcgtcaattcctacgatgaaaattgcgttgaagacatcaaaatg

SEQ ID NO: 298412 - DNA, 75 bp, Artificial Sequence
  Synthetic
ctccatagctaacttagccctgataaaaacagtattgtcgcgtatagcgaataaatattcgtttataactaagat

SEQ ID NO: 298413 - DNA, 75 bp, Artificial Sequence
  Synthetic
tatgcgcggatgaatgctaaagtgaaagctttagtttctactgttggaatagaaattgctaaacgatacatcgct

SEQ ID NO: 298414 - DNA, 75 bp, Artificial Sequence
  Synthetic
tattggaagttaaaacgagacaccttgcccgatggagattatgatgtgagagaatattttttaaatttgtatgat

SEQ ID NO: 298415 - DNA, 75 bp, Artificial Sequence
  Synthetic
tgcccgatggagattatgatgtgagagaatattttttaaatttgtatgatcaagtactaactgaaatgccagatt

SEQ ID NO: 298416 - DNA, 75 bp, Artificial Sequence
  Synthetic
atattgtgaatagactaagaggttttgaaactgatagggaatttatattaacaaagatcatgcaaatgacttcag

SEQ ID NO: 298417 - DNA, 75 bp, Artificial Sequence
  Synthetic
tggtacaacagatgatgaagtatatattcaaagagcgtttatgtcgctatcaagccaaaagtcaggaatagcaga

SEQ ID NO: 298418 - DNA, 75 bp, Artificial Sequence
  Synthetic
cagaatacatagaaaattggaacttacaaaatagaagacagcgcaccggatttgttttccataaacctaacatat

SEQ ID NO: 298419 - DNA, 75 bp, Artificial Sequence
  Synthetic
caaaatctgaaatgattaaattatggaagaaaatgtggaacataacagcattacgatctccctacactagtgcga

SEQ ID NO: 298420 - DNA, 75 bp, Artificial Sequence
  Synthetic
actgaaaaagcaaaattaaattcatacgctcctatctctttggagaaacgtcgcgcacaaatttccgctttacta

SEQ ID NO: 298421 - DNA, 75 bp, Artificial Sequence
  Synthetic
actacatcaaactacatcttagctagatcagttgtgccagaccttaaggaactagtgtccaccgaggctcaaata

SEQ ID NO: 298422 - DNA, 75 bp, Artificial Sequence
  Synthetic
tacctatacaatatcaaaaatttatgccgacattacctgtcaatgttcaatacataatacaatgcattgggtcaa

SEQ ID NO: 298423 - DNA, 75 bp, Artificial Sequence
  Synthetic
aagagaaaaatccatttaaaggattgtcaactgatagaaagatggatgaagtttcgcacgttggagtttaattcg

SEQ ID NO: 298424 - DNA, 75 bp, Artificial Sequence
  Synthetic
ataatgcaactttactatctatattatcatattcttatgacaaatataacgctgtagaacggaaactagtcgatt

SEQ ID NO: 298425 - DNA, 75 bp, Artificial Sequence
  Synthetic
agcctttggaatgcagagaatgcattacagaaatggtgacccccaaactccttttcagatcgctgaacaacaaat

SEQ ID NO: 298426 - DNA, 75 bp, Artificial Sequence
  Synthetic
acgtatataatttattgtctataaattatggttgttatcaactttttgattttaattcaccagatttagagaaat

SEQ ID NO: 298427 - DNA, 75 bp, Artificial Sequence
  Synthetic
actttactatcaatactatcatattcgtatgataagtataacgcagtagaaagaaagctagtatattatgcaaaa

SEQ ID NO: 298428 - DNA, 75 bp, Artificial Sequence
  Synthetic
ccagtagattataaaagatcaatacagagaggaatattacttctatcgaatagattaggacaattggttgaccta

SEQ ID NO: 298429 - DNA, 75 bp, Artificial Sequence
  Synthetic
tattgaattatatattaaaatcactaactagtgcgatggactttataatttatagatttcttttacttattgtta

SEQ ID NO: 298430 - DNA, 75 bp, Artificial Sequence
  Synthetic
cttaatgaatggctttgtaatccaatggatattactttatattattatcaacaaactgatgaaacgaataaatgg

SEQ ID NO: 298431 - DNA, 75 bp, Artificial Sequence
  Synthetic
attatggaataaatcttccgattactgggtcaatggatataccatatacaaactcaacgcaagaagaagtgtttc

SEQ ID NO: 298432 - DNA, 75 bp, Artificial Sequence
  Synthetic
ttctcgatataacggctgatccaactacggctccacagattgcgcgaatgatgcgcatgaattggaaaaaatggt

SEQ ID NO: 298433 - DNA, 75 bp, Artificial Sequence
  Synthetic
ggcaagtgttttatactgtagttgattacattaatcaaattgttcaagtaatgtccaaaagatcgcgatcattag

SEQ ID NO: 298434 - DNA, 75 bp, Artificial Sequence
  Synthetic
ttacattaatcaaattgttcaagtaatgtccaaaagatcgcgatcattagattctgctgcattctattatagaat

SEQ ID NO: 298435 - DNA, 75 bp, Artificial Sequence
  Synthetic
atggccaacaggatctgtctattttaaagactatgctgatattgcctcattttcagttgatccacaactgtactg

SEQ ID NO: 298436 - DNA, 75 bp, Artificial Sequence
  Synthetic
acatagtgtggctcaggtatatgcagacactcaagtatacactcacgatgagaccaaagatgactatgagaatgc

SEQ ID NO: 298437 - DNA, 75 bp, Artificial Sequence
  Synthetic
actttcactgtatattccgaccttcttgcattcgtttcagcagacactgttgaaccaattaatgctgttgcattt

SEQ ID NO: 298438 - DNA, 75 bp, Artificial Sequence
  Synthetic
gatattactttatattattatcaacaaaccgatgaggcgaataaatggatttcaatgggatcgtcttgtactata

SEQ ID NO: 298439 - DNA, 75 bp, Artificial Sequence
  Synthetic
atacaaaaaatggatgaattattcacactgattagatgtaattttacatatgactatgttgatgacgtcgtttat

SEQ ID NO: 298440 - DNA, 75 bp, Artificial Sequence
  Synthetic
ctacatgactattcgtattacactaacaacgaaataagaactgaccaacattgggtaaccaagacgaacatagag

SEQ ID NO: 298441 - DNA, 75 bp, Artificial Sequence
  Synthetic
atgatcgaatgcaagaggaaaaagataatgaaaaacaggattcaaataaaatgcaattgtctgataaggtacttt

SEQ ID NO: 298442 - DNA, 75 bp, Artificial Sequence
  Synthetic
caaacgaaagccgctaattctatagccaatttagcattaattaagacggtactgtcacgtatagcaaacaaatac

SEQ ID NO: 298443 - DNA, 75 bp, Artificial Sequence
  Synthetic
ttaaaagggctgttgaagcaatgcaactatgaatatgcatatgagtagtcacataattaaagaaaatattaacca

SEQ ID NO: 298444 - DNA, 75 bp, Artificial Sequence
  Synthetic
taatgttggaccaaggaatgagtctatgttcacttttttggattatccatcaataaaacaatattcaaacggacc

SEQ ID NO: 298445 - DNA, 75 bp, Artificial Sequence
  Synthetic
aactagatatgctccagtcaattggggtcatggagaaataaatgattcaaccacagtagaaccaattttagatgg

SEQ ID NO: 298446 - DNA, 75 bp, Artificial Sequence
  Synthetic
tacgtaatagatggtattggaaattgaaaaaagatactttgccagatggagactacgatgtgagagaatattttc

SEQ ID NO: 298447 - DNA, 75 bp, Artificial Sequence
  Synthetic
gtgcaatccaatggacataacgctgtattattatcaacagactgatgaagcaaataaatggatatcaatgggttc

SEQ ID NO: 298448 - DNA, 75 bp, Artificial Sequence
  Synthetic
tgaaatgccagactatctattactaaaagatatggctgttgaaaataagaattcaagagatgcaggtaaagttgt

SEQ ID NO: 298449 - DNA, 75 bp, Artificial Sequence
  Synthetic
ggaggaacagacaattagtaatttaactattgcatacaagtatttatccacggggaaagctaaagtatgttgtgt

SEQ ID NO: 298450 - DNA, 75 bp, Artificial Sequence
  Synthetic
acagtagtggattacgtcaaccaaataattcaaacgatgtccaaaagatctagatcacttaattcgtcagcgttc

SEQ ID NO: 298451 - DNA, 75 bp, Artificial Sequence
  Synthetic
tgagacgtcagctggagatgattgataaactaactactcgtgaaattgaacaggttgaattgcttaaaagtatac

SEQ ID NO: 298452 - DNA, 75 bp, Artificial Sequence
  Synthetic
atattcagtatatagaccatcaatagaggaactgtataaagtaatatcacttcacgaacaagaaatccaacttta

SEQ ID NO: 298453 - DNA, 75 bp, Artificial Sequence
  Synthetic
agttattaaagaaaattcctatgtatatgtagattattgggatgattcaaaagcatttagaaatatggtatatgt

SEQ ID NO: 298454 - DNA, 75 bp, Artificial Sequence
  Synthetic
aatttgttatctataaattatggttgctatcaactttttgattttaattcaccagatctagagaaattaataaga

SEQ ID NO: 298455 - DNA, 75 bp, Artificial Sequence
  Synthetic
catatgatggctgcttaggtatgtttggtttatcaatatcattagcttcaaaaccaactggaaacaatcatttat

SEQ ID NO: 298456 - DNA, 75 bp, Artificial Sequence
  Synthetic
ctttaaattggatcagtttgcaaatcatatgggcatatcacggcgatcgcatcaaatacgattttcagaatcagc

SEQ ID NO: 298457 - DNA, 75 bp, Artificial Sequence
  Synthetic
tgatatcaccatttgtaagaacacaaaattatggcatatatttaccaataacgggatcactagacgctgtatata

SEQ ID NO: 298458 - DNA, 75 bp, Artificial Sequence
  Synthetic
aagtggcgaattggttgcattttgttaataataatcagtttagacaggtagttattgatggtgtattaaaccagg

SEQ ID NO: 298459 - DNA, 75 bp, Artificial Sequence
  Synthetic
aagaaatagctatgtcacaattaattgatttagcgttattacctttagatatgttttctatgttttcaggaatta

SEQ ID NO: 298460 - DNA, 75 bp, Artificial Sequence
  Synthetic
ctaccagtaggaaattggatgttgctagcgccaacaggaccaggtgtggtagtggaaggaacggacaattctggc

SEQ ID NO: 298461 - DNA, 75 bp, Artificial Sequence
  Synthetic
aatgatgaagacggcggttgatggtgactatgcggaatggggaacattactatcggacaccaaactctatgggat

SEQ ID NO: 298462 - DNA, 75 bp, Artificial Sequence
  Synthetic
tatcagaaaaaaatgaaggcaattgttgaagattttttaaagagattatatatttttgatgtatctagagttccg

SEQ ID NO: 298463 - DNA, 75 bp, Artificial Sequence
  Synthetic
ggtgagaatagaaaatacgcgattaaacatagacttaatttatttaaggaaaataaaaggtgatacggtgtttga

SEQ ID NO: 298464 - DNA, 75 bp, Artificial Sequence
  Synthetic
gtgactatgcacaaataactaacatgcttttaaataatcaaccagtagcattagttggagcacttccattcatta

SEQ ID NO: 298465 - DNA, 75 bp, Artificial Sequence
  Synthetic
taaaataaattcagattcaaatgatttttacctggtagctaactatgattgggtgccaacttcaactacaaaagt

SEQ ID NO: 298466 - DNA, 75 bp, Artificial Sequence
  Synthetic
gacagacattgaacaacaactaaattccattgatgtaatcaatccaattaatgctatagatgattttgaatcact

SEQ ID NO: 298467 - DNA, 75 bp, Artificial Sequence
  Synthetic
cgtgcgatcattggcagcgaatttgaatgacgtaatgtgttctggcggagattatagcttcgcgctacctgctgg

SEQ ID NO: 298468 - DNA, 75 bp, Artificial Sequence
  Synthetic
gttttcgctgatatcattggtgccatcaaatgatgactatcaaacgccaattatgaactcagtaacagtaaggca

SEQ ID NO: 298469 - DNA, 75 bp, Artificial Sequence
  Synthetic
acgctaaaggtagaccattagaggcagatttgacggcgaatgaacttgattatgaaaataataaaataacttctg

SEQ ID NO: 298470 - DNA, 75 bp, Artificial Sequence
  Synthetic
acaaatacagctacttttgaaacagttgctgatagcgaaaaattggcaataattgatgttgttgacagcgtaaat

SEQ ID NO: 298471 - DNA, 75 bp, Artificial Sequence
  Synthetic
aggtaatacacttgatgtatgtaagaaactgctctttcaaaagatgaagcaggaaaagaatccgtttaaaggact

SEQ ID NO: 298472 - DNA, 75 bp, Artificial Sequence
  Synthetic
ttcttgctccaatcattaaaactcaaaattatggaattaatttaccaataactggatctatggatacaccatatg

SEQ ID NO: 298473 - DNA, 75 bp, Artificial Sequence
  Synthetic
gcgaataaaatttataaacgcagattagatttattcactatagtagcatctacagttaataaatacggagtacca

SEQ ID NO: 298474 - DNA, 75 bp, Artificial Sequence
  Synthetic
tttaacttctacattatgtttatattatccgaatgaagcggctactgaaattgcggataataagtggacggaaac

SEQ ID NO: 298475 - DNA, 75 bp, Artificial Sequence
  Synthetic
ttacattaatcagatagtgcaagtaatgtccaaaagatcgagatcgttagattcgtcggctttctattatagagt

SEQ ID NO: 298476 - DNA, 75 bp, Artificial Sequence
  Synthetic
ggatggccaacagggtcagttcatttcaaaggatatgcagacattgcatcgttttccatagaaccacagttatac

SEQ ID NO: 298477 - DNA, 75 bp, Artificial Sequence
  Synthetic
attacattccataattcaagatcctggaatggcgtattttccatatattgcatctgttctaacagttttgtttac

SEQ ID NO: 298478 - DNA, 75 bp, Artificial Sequence
  Synthetic
tagaacttgaattctcagataaatatgtgagagcaattgtgcctgaccagacttttgatgaattacaagaaatga

SEQ ID NO: 298479 - DNA, 75 bp, Artificial Sequence
  Synthetic
ttaaagtgtgtcctttaaatgctcagactcttgggataggatgcttaactacagacaccaattcatttgaaataa

SEQ ID NO: 298480 - DNA, 75 bp, Artificial Sequence
  Synthetic
tagctagtgcagagaaattagctataacggatgttgtcgatggagtcaaccataaactagacgtaacaacgaata

SEQ ID NO: 298481 - DNA, 75 bp, Artificial Sequence
  Synthetic
ctatgttaatcagattgtgcaagtcatgtccaagcgatcacgttccctaaattccgctgctttctataatcgagt

SEQ ID NO: 298482 - DNA, 75 bp, Artificial Sequence
  Synthetic
atgagtattttattgcgcaacacgctgtagtggaaaaaatgttatcatacgcaaaagataccagagaatatgcag

SEQ ID NO: 298483 - DNA, 75 bp, Artificial Sequence
  Synthetic
aatgaatggttatgtaatccaatggatataacattatattattatcaacaatcgggagaatcaaataagtggata

SEQ ID NO: 298484 - DNA, 75 bp, Artificial Sequence
  Synthetic
tagaagattatttattaccaggatggaagctgacgtatgttggatataacggaaatgacacaagagggcattata

SEQ ID NO: 298485 - DNA, 75 bp, Artificial Sequence
  Synthetic
taccaattcaatatagaaaattcatgcccacgttacctgataacgttcagtacgttatacagtgcataggatcaa

SEQ ID NO: 298486 - DNA, 75 bp, Artificial Sequence
  Synthetic
gaccagtatttccaccaggcatgaattggactgagctaattactaactattcaccatctagggaagataatttgc

SEQ ID NO: 298487 - DNA, 75 bp, Artificial Sequence
  Synthetic
atgtgtataacttattatctattaattatggatgttatcaattgtttgatttcaattctccggatttagagaagc

SEQ ID NO: 298488 - DNA, 75 bp, Artificial Sequence
  Synthetic
acgatttataccaaaaggcgtgttatattcatacataaacaatataattactgagaacgtgtttatacaacagcc

SEQ ID NO: 298489 - DNA, 75 bp, Artificial Sequence
  Synthetic
tagtttcaactgaagctcagatacagaaaatgtctcaagatttgcaacttgaagctttaacaatacaatctgaaa

SEQ ID NO: 298490 - DNA, 75 bp, Artificial Sequence
  Synthetic
aatgtttaacaaggtggcgatgctaatttgtgaagcattgaattcaattaaagtcacgcagtctgatgttgcgag

SEQ ID NO: 298491 - DNA, 75 bp, Artificial Sequence
  Synthetic
aaatcagttttaatagctattggtcattcaaaggagattgaaacgactgccactgctgaagggggagaaattgtt

SEQ ID NO: 298492 - DNA, 75 bp, Artificial Sequence
  Synthetic
tatatgttgtcagacgaaatctatgtagcaaacgtaagcggcgtgttatcaacatattttaaactttacaatgca

SEQ ID NO: 298493 - DNA, 75 bp, Artificial Sequence
  Synthetic
ttattacagcagctaatagactaaatttatatcaaaagaaaatgaaatcaatagttgaagactttctaaaaagac

SEQ ID NO: 298494 - DNA, 75 bp, Artificial Sequence
  Synthetic
tgttaatttgtgaggcactaaattcaataaaagttactcaatctgatgttgcaagtgtactatcaagagtagttt

SEQ ID NO: 298495 - DNA, 75 bp, Artificial Sequence
  Synthetic
cattgctagaaatctcgatggatatcaacaaattaatctggaggagttaatgagaactggagactatggacaaat

SEQ ID NO: 298496 - DNA, 75 bp, Artificial Sequence
  Synthetic
attgacactatagattggaaatccagatatgatcaacttgaaagacgatttgagtcgttaaaacagcgagttaat

SEQ ID NO: 298497 - DNA, 75 bp, Artificial Sequence
  Synthetic
tgattcaggtgttaaaaacaatctgttgggtaaagcggcaactattgatcaggcactaaatggaaaatttggttc

SEQ ID NO: 298498 - DNA, 75 bp, Artificial Sequence
  Synthetic
tgatcaggttcttactgaaatgccagattatttactattaaaagatatggcagttgaaaataaaaattcaagaga

SEQ ID NO: 298499 - DNA, 75 bp, Artificial Sequence
  Synthetic
cttgttattattataagagaattaacaagttgaatcacgtagtcttgaagttaggagttaatgatacatggagac

SEQ ID NO: 298500 - DNA, 75 bp, Artificial Sequence
  Synthetic
ctataaatcaaagaatagtagataaattcattaatagtacaagacaacataaatgtagaaatgaatgtatggcac

SEQ ID NO: 298501 - DNA, 75 bp, Artificial Sequence
  Synthetic
acaggatccatggatactacatacgcaaattcaacgcaaagtgaatcttttttaacatcaactctgtgtttgtat

SEQ ID NO: 298502 - DNA, 75 bp, Artificial Sequence
  Synthetic
cctaacgtcaacgttatgtttatattacccaacggaagctagaacagaaataaatgataatgagtggatgagtac

SEQ ID NO: 298503 - DNA, 75 bp, Artificial Sequence
  Synthetic
tttaacatcaactctgtgtttgtattatccagttgaagcatcaaatgaaatagctgataccgaatggaaaaatac

SEQ ID NO: 298504 - DNA, 75 bp, Artificial Sequence
  Synthetic
tttgtcacaactatttctgaccaaaggatggccaactgggtctgtatatttcaaagaatatactaacatagcagc

SEQ ID NO: 298505 - DNA, 75 bp, Artificial Sequence
  Synthetic
aaaacatcacatattgaattttatagtatttcaaccagatgtagagtgtttacgcagcataaacttaaaatagca

SEQ ID NO: 298506 - DNA, 75 bp, Artificial Sequence
  Synthetic
ttgaatgaatggctgtgcaatccaatggatataacgttgtattactaccaacaaactgacgaagcgaataaatgg

SEQ ID NO: 298507 - DNA, 75 bp, Artificial Sequence
  Synthetic
acaaactgacgaagcgaataaatggatatcaatgggctcgtcttgcacagtaaaagtatgtccattaaatacaca

SEQ ID NO: 298508 - DNA, 75 bp, Artificial Sequence
  Synthetic
cactgatgtggtcgacggcgtgaatcataaattggatgttactaccgcaacttgtactattagaaattgcaagaa

SEQ ID NO: 298509 - DNA, 75 bp, Artificial Sequence
  Synthetic
ttgcaacgactgaaaaattagtaattactgacgtcgtggatggcgttaaccataaattagatgttacaacgacaa

SEQ ID NO: 298510 - DNA, 75 bp, Artificial Sequence
  Synthetic
gaaatgagtttcaaactggaggaattggtaatctaccaattagaaattggaattttgattttggattacttggaa

SEQ ID NO: 298511 - DNA, 75 bp, Artificial Sequence
  Synthetic
tattacgaatgaagaattagaactggagttttcaaataaatatgtacgagcaatagttcctgaccaaacatttga

SEQ ID NO: 298512 - DNA, 75 bp, Artificial Sequence
  Synthetic
ctatgtcaatcagataattcaggcaatgtccaaaagatctaggtcgctaaactcatcagcattctactacagagt

SEQ ID NO: 298513 - DNA, 75 bp, Artificial Sequence
  Synthetic
tccagatcactagactctgcagcattctactatagagtgtaggtattacttagattagaattgtatgatgtgacc

SEQ ID NO: 298514 - DNA, 75 bp, Artificial Sequence
  Synthetic
gctaatagactaaatttatatcagaaaaagatgaaggcaatagttgaagattttttaaaaagattacatattttc

SEQ ID NO: 298515 - DNA, 75 bp, Artificial Sequence
  Synthetic
gcagaaaatgttggatgccgcactagatcaattgaaaactgagtatacagaagatgtagatgacgaaatgtatcg

SEQ ID NO: 298516 - DNA, 75 bp, Artificial Sequence
  Synthetic
atatctgacgttgaataatgaaatagaggtcacatttgccactacaagactccctgcactagagtagcgcctagg

SEQ ID NO: 298517 - DNA, 75 bp, Artificial Sequence
  Synthetic
tttatagcacaacatgctgtagttgaaaaaatgttaatttatgcgaaacatactagagaatatgctgaattctac

SEQ ID NO: 298518 - DNA, 75 bp, Artificial Sequence
  Synthetic
aaatgcagcatttacaatgtggaaactaacatacttggagcataagctaatgccaattttagatcaaaattttat

SEQ ID NO: 298519 - DNA, 75 bp, Artificial Sequence
  Synthetic
ccattagatatgttttctatgttctcaggtattaaaagcacaattgacgtagccaaatcaatggtcacaaaggtg

SEQ ID NO: 298520 - DNA, 75 bp, Artificial Sequence
  Synthetic
caaataaatggaagtttttagaaatgtttagaaacagtagtcaaaatgaattttataatagacgtacattaactt

SEQ ID NO: 298521 - DNA, 75 bp, Artificial Sequence
  Synthetic
tcaaatggtgaatcaaggcaacttaaatttggtcgtaaaacaatattttcaactaagaaaaacatgcatgttatg

SEQ ID NO: 298522 - DNA, 75 bp, Artificial Sequence
  Synthetic
aatttggtcgtaaaacaatattttcaactaagaaaaacatgcatgttatggatgatattgcacatggaaggtata

SEQ ID NO: 298523 - DNA, 75 bp, Artificial Sequence
  Synthetic
caatataattacttacgtgacggtgaacaagtaaccgcacacaccacttgttcagtaaatggagtgaacaatttt

SEQ ID NO: 298524 - DNA, 75 bp, Artificial Sequence
  Synthetic
aataacgacttcaaattatattttggcaagatcagtagtaccagatttaaaggaactagtttcaaccgaagcaca

SEQ ID NO: 298525 - DNA, 75 bp, Artificial Sequence
  Synthetic
caattagaagcgttgacaatacagtcagagacacagttcttaacaggtataaattcacaagcagctaatgactgt

SEQ ID NO: 298526 - DNA, 75 bp, Artificial Sequence
  Synthetic
agtattgtatcgtaacaattttcaatacgttattgaaattggcaggttataaagaacagattactactaaagacg

SEQ ID NO: 298527 - DNA, 75 bp, Artificial Sequence
  Synthetic
ttaatctcaggtatgtggttactaactgtagtgccaaacgatatgtttataagggagtcattagttgcatgtcaa

SEQ ID NO: 298528 - DNA, 75 bp, Artificial Sequence
  Synthetic
gtggcaatacaataaatttgcagtaattacacatggtaaaggtcactatagagttgtaaaatactcgtcagttgc

SEQ ID NO: 298529 - DNA, 75 bp, Artificial Sequence
  Synthetic
attacacatggtaaaggtcactatagagttgtaaaatactcgtcagttgcaaatcacgcagaccgagtttacgct

SEQ ID NO: 298530 - DNA, 75 bp, Artificial Sequence
  Synthetic
ttgatataacagctgatccaactacagcaccacagactgagaggatgatgcgtattaattggaagaagtggtggc

SEQ ID NO: 298531 - DNA, 75 bp, Artificial Sequence
  Synthetic
ttagccatggcaacctttaaagatgcttgctttcattatagaaagatcacaaaactaaacagggaattactgaga

SEQ ID NO: 298532 - DNA, 75 bp, Artificial Sequence
  Synthetic
gggaaaaatactttacctgacatagttacagaggcatctgagaaatttattccaaaacgatcatatcgaatatta

SEQ ID NO: 298533 - DNA, 75 bp, Artificial Sequence
  Synthetic
ttaaattaaggaaagttgacactctaaaaccaatattgtataaaataaattcagattcaaatgatttttacctgg

SEQ ID NO: 298534 - DNA, 75 bp, Artificial Sequence
  Synthetic
ttacttgcattcgtatcagctgatacggtagaacctataaatgcagttgcgtttgataatatgcgcatcatgaac

SEQ ID NO: 298535 - DNA, 75 bp, Artificial Sequence
  Synthetic
ctgtagtgccaaatgacatgttcataagggaatcattagttgcatgtcaactggctatagtgaatacaataatat

SEQ ID NO: 298536 - DNA, 75 bp, Artificial Sequence
  Synthetic
ggctttttttatgaaaagtcttgtgtgagccatggctactttcaaagatgcatgctatcattacaaaaaaatgaa

SEQ ID NO: 298537 - DNA, 75 bp, Artificial Sequence
  Synthetic
cagactaaacagttccattctaaaattaggagctaatgatgaatggagaccagcaccaataacaaaattcaaggg

SEQ ID NO: 298538 - DNA, 75 bp, Artificial Sequence
  Synthetic
ttaaaaggacttttgaagcaatgcaactatgaatatgcatatgagtagtcacataattaaaatattaaccatcta

SEQ ID NO: 298539 - DNA, 75 bp, Artificial Sequence
  Synthetic
ggatgagaacatttaaaaataatgtaaataaggaggatattgaaaatttacttaatatgtatgatactttatttc

SEQ ID NO: 298540 - DNA, 75 bp, Artificial Sequence
  Synthetic
taaccatctacacatgaccctctatgagcacaatagttaaaagctaacactgtcaaaaacctaaatggctatagg

SEQ ID NO: 298541 - DNA, 75 bp, Artificial Sequence
  Synthetic
aatggtataatcatctactatttccacttactttacaagcattggctataaaattggaaaataacacatattata

SEQ ID NO: 298542 - DNA, 75 bp, Artificial Sequence
  Synthetic
ctttaatagaatggcacatttaccaccaatattacaacaagaatatgcattgaggtatttttcaaaatcgagatt

SEQ ID NO: 298543 - DNA, 75 bp, Artificial Sequence
  Synthetic
aaagtaaatgctagtctagattcttccatttcagtatcaacactttctaataaggagaaatccaaatcggatcat

SEQ ID NO: 298544 - DNA, 75 bp, Artificial Sequence
  Synthetic
tgcgtcgctaaacatttagatgataatgaatggaataagtcttgcacacagattatgaatgctaaagattatatg

SEQ ID NO: 298545 - DNA, 75 bp, Artificial Sequence
  Synthetic
aaatagatctcaaccaatgcatgataatttgatgggaactatgtggcttaatgctggatcagaaattcaagtagc

SEQ ID NO: 298546 - DNA, 75 bp, Artificial Sequence
  Synthetic
caaattacattctttcaaatcatgaaacatgtgcattgaatgttcataattgtaaatggtgtcagattactagct

SEQ ID NO: 298547 - DNA, 75 bp, Artificial Sequence
  Synthetic
aattaagaagatatataataatatgttagattttattagggcattgtctaaatcaaatggaatggtaggacactg

SEQ ID NO: 298548 - DNA, 75 bp, Artificial Sequence
  Synthetic
atgatgaagaacaatggaccggatccatagataaattattcagatgtttagaacctgttgacataaatgaagtgg

SEQ ID NO: 298549 - DNA, 75 bp, Artificial Sequence
  Synthetic
ccagaaaatgtcacaagatttgcaattagaagcattaacaattcagtcagaaacgcaatttctaacaggtataaa

SEQ ID NO: 298550 - DNA, 75 bp, Artificial Sequence
  Synthetic
ttacactagagttaaaagtaagtttgattatgtgatggatgattctggtgttaaaaacaatttattgggcaaagc

SEQ ID NO: 298551 - DNA, 75 bp, Artificial Sequence
  Synthetic
ttagatgcaattttacatatgattatattgatgacattgtttatttgcatgactattcatactatactaacaatg

SEQ ID NO: 298552 - DNA, 75 bp, Artificial Sequence
  Synthetic
atgacgcaataatagagtatatctactcaaatgagttagacttccaaaattttatattaaaaaagattaaggaaa

SEQ ID NO: 298553 - DNA, 75 bp, Artificial Sequence
  Synthetic
accatgaaaaaccagtgatttacatggtgggatcagcaccttcgtattggatacacgacgtaaaacaatattcca

SEQ ID NO: 298554 - DNA, 75 bp, Artificial Sequence
  Synthetic
catgactatgatagaacatttttaatgcttaagggactattacggcaatgcaactatgaatatgcatatgaatag

SEQ ID NO: 298555 - DNA, 75 bp, Artificial Sequence
  Synthetic
atgatgtagcaaaacttaaagataattcaatactatacatagatataagaacggatagaggaaatgtagattgga

SEQ ID NO: 298556 - DNA, 75 bp, Artificial Sequence
  Synthetic
atatagcgatgttatggagaatgccacactgttgtcaatattatcgtactcttatgataaatataacgctgttga

SEQ ID NO: 298557 - DNA, 75 bp, Artificial Sequence
  Synthetic
aaataatataattactgagaacgtttttatacaacaaccatttaaactaaaaacattaaaaaatgaatatatagt

SEQ ID NO: 298558 - DNA, 75 bp, Artificial Sequence
  Synthetic
aataaattaggaccgagagaaaatgtagctataatacaggttggcggttctaatatattagatataacagctgat

SEQ ID NO: 298559 - DNA, 75 bp, Artificial Sequence
  Synthetic
ccaacagcagaggaatatactgattcattgatggatccagcaattttaacttcattatcatcaaatttaaatgca

SEQ ID NO: 298560 - DNA, 75 bp, Artificial Sequence
  Synthetic
tttatacaacaaccatttaaactaaaaacattaaaaaatgaatatatagtcgcgctgtacgcattgtctaatgat

SEQ ID NO: 298561 - DNA, 75 bp, Artificial Sequence
  Synthetic
atatggacagaaatctgccatcaacagcaagatacattaggcctaattttctgcacgacagactgaatttgcatg

SEQ ID NO: 298562 - DNA, 75 bp, Artificial Sequence
  Synthetic
attcttcatttgaagctgcagtagttgctgcaacttctactcttgaactgatgggtattcaatatgattataatg

SEQ ID NO: 298563 - DNA, 75 bp, Artificial Sequence
  Synthetic
tagatcgactctggcaaaactggtgtcatcaccaatgtcaattctggtagctttagtggatataaacggaacatt

SEQ ID NO: 298564 - DNA, 75 bp, Artificial Sequence
  Synthetic
atgagaaaagctgggttaactgacatacctaagatgatacaggactggttggtcgattgctctattgaaaaattt

SEQ ID NO: 298565 - DNA, 75 bp, Artificial Sequence
  Synthetic
gatcaattgaaaactgagtatacagaagatgtagatgacgaaatgtatcgagaatacacaatgctaataagagat

SEQ ID NO: 298566 - DNA, 75 bp, Artificial Sequence
  Synthetic
ggtattcaaatgagatagaaaaatacattaatgaagtatatagcataacatacgctgatgacccaaactatttta

SEQ ID NO: 298567 - DNA, 75 bp, Artificial Sequence
  Synthetic
cgtagcggttttgaagaaatttaaaaatgagttatttaaaatggatgtaactactagttatacatacatgctatc

SEQ ID NO: 298568 - DNA, 75 bp, Artificial Sequence
  Synthetic
tggctaatggaagatacacaccaggcataataccaccagtgaatgtcgataaaccgataccattaggaaggagag

SEQ ID NO: 298569 - DNA, 75 bp, Artificial Sequence
  Synthetic
agatgaaatttatgtagcgaatgtgagtggcgttttgtcaacgtacttcaagctttataatgcgttctataagga

SEQ ID NO: 298570 - DNA, 75 bp, Artificial Sequence
  Synthetic
cattatcacaagaaatagctatgtcacaattaattgatttagcgttattacctttagatatgttttctatgtttt

SEQ ID NO: 298571 - DNA, 75 bp, Artificial Sequence
  Synthetic
agggataattatgggattggacatgctagccaatatgactaatgatgctagagttatccagacgctgaacttata

SEQ ID NO: 298572 - DNA, 75 bp, Artificial Sequence
  Synthetic
ttaataaggtggcagtgttgatttgcgaagcattgaattcagttaaagttactcaatctgatgttgcaagtgtac

SEQ ID NO: 298573 - DNA, 75 bp, Artificial Sequence
  Synthetic
tggggctgtagcgtcaggagagaagcagacgaaagcagcgaattcaatagcaaatttagcactgattaaaacggt

SEQ ID NO: 298574 - DNA, 75 bp, Artificial Sequence
  Synthetic
gaaaatcatcaagacgtgctctttcattcaaaagaactactactaaaatcagtattaatagctattggtcactca

SEQ ID NO: 298575 - DNA, 75 bp, Artificial Sequence
  Synthetic
caaaattatggaataaatttgccaattactggatctatggacacagcctatgctaattcaacgcaaaatgaaaat

SEQ ID NO: 298576 - DNA, 75 bp, Artificial Sequence
  Synthetic
agtattaatagctattggtcactcaaaagagattgagacaactgccaccgctgaaggaggagaaatcgtttttca

SEQ ID NO: 298577 - DNA, 75 bp, Artificial Sequence
  Synthetic
gacaaaccaatctcagaatcacatgtgaaggaacttattgctgaattgcgatggcagtacaacaagtttgcagta

SEQ ID NO: 298578 - DNA, 75 bp, Artificial Sequence
  Synthetic
aatagacttcgaggatttgaaactgacagagagttcattttaactaaaataatgcaaatgacgtcagttgctatt

SEQ ID NO: 298579 - DNA, 75 bp, Artificial Sequence
  Synthetic
aatggacataacattatattattaccagcaaacaggagaggcaaataaatggatatcaatgggatcatcatgcac

SEQ ID NO: 298580 - DNA, 75 bp, Artificial Sequence
  Synthetic
ctgacgacgaagtatacatacaaagagcgttcatgtctttatctagtcagaagtcaggaatagctgatgagatag

SEQ ID NO: 298581 - DNA, 75 bp, Artificial Sequence
  Synthetic
atatcacttgagaaaagacgtgcgcaaatatcagctttgctgactatgctgcaaaaaccggttacttttaaatca

SEQ ID NO: 298582 - DNA, 75 bp, Artificial Sequence
  Synthetic
gcaaaaaccggttacttttaaatcaagtaaaataacaataaatgatatacttagagatataaagccatttttcac

SEQ ID NO: 298583 - DNA, 75 bp, Artificial Sequence
  Synthetic
atataacgacgttatagaaaatgctacgttgctatcaattctgtcatactcatatgataaatacaatgctgttga

SEQ ID NO: 298584 - DNA, 75 bp, Artificial Sequence
  Synthetic
ggatcatcaaaatcacaagatgttacaataaatccaggaccatttgctcaaactggatacgctccagttaactgg

SEQ ID NO: 298585 - DNA, 75 bp, Artificial Sequence
  Synthetic
gtattcagtttacaagccgtcaatcgaagagttatacaaagtaatttcactacacgagaatgaaatacaactata

SEQ ID NO: 298586 - DNA, 75 bp, Artificial Sequence
  Synthetic
taacaaaataacctctgagctatttccaacagcggaagagtacactgattcactaatggatccagcgattctaac

SEQ ID NO: 298587 - DNA, 75 bp, Artificial Sequence
  Synthetic
tcgctcccactgataaaggtatagttgctgaattgacaaataacacagatatatggttagtcattatcttaattg

SEQ ID NO: 298588 - DNA, 75 bp, Artificial Sequence
  Synthetic
ttttggtagaagaaaccaaaatgatgcttatatactttatggtacacttttatcagatacgaaactgcaggctac

SEQ ID NO: 298589 - DNA, 75 bp, Artificial Sequence
  Synthetic
gcttatatactttatggtacacttttatcagatacgaaactgcaggctacaatgaaatatggggcaaggttattt

SEQ ID NO: 298590 - DNA, 75 bp, Artificial Sequence
  Synthetic
agaaatgataaaattatggaagaaaatgtggaacattacatcactacgttcaccgtataccaatgcaaacttctt

SEQ ID NO: 298591 - DNA, 75 bp, Artificial Sequence
  Synthetic
agctaatagtattatcatattctaatagatcaactctggcgaaattagtttcatcaccaatgtcaattcttgtag

SEQ ID NO: 298592 - DNA, 75 bp, Artificial Sequence
  Synthetic
taataccacgtatgccacgagaagtgtgcagaaactatattaatcaaggtcttccaccaatgcagaacactagaa

SEQ ID NO: 298593 - DNA, 75 bp, Artificial Sequence
  Synthetic
agtgttaatgaagatatcattatatctaaaacttccttatggaaggaaatgcaatataacagagacattacaatt

SEQ ID NO: 298594 - DNA, 75 bp, Artificial Sequence
  Synthetic
gagatggagaagaggttacagcgcatactacatgttcagttaatggagtgaacaattttagttataatggaggat

SEQ ID NO: 298595 - DNA, 75 bp, Artificial Sequence
  Synthetic
aaggtacgaagttattaaagagaattcatttgtatatatagattattgggatgattcacaagcattcaggaatat

SEQ ID NO: 298596 - DNA, 75 bp, Artificial Sequence
  Synthetic
ggaggcgctgtgtcgttacatccttctggagtaacgttgtcaactcaatttacagattttgtatctctcaattca

SEQ ID NO: 298597 - DNA, 75 bp, Artificial Sequence
  Synthetic
agaaaatgttaatatacgcaaaacacactagagaatatgctgaattttattcacaatcaaatcaactactatcat

SEQ ID NO: 298598 - DNA, 75 bp, Artificial Sequence
  Synthetic
tacagattttgtatctctcaattcattaagatttagattcagattagcagtcgaagaacctccattttcaataat

SEQ ID NO: 298599 - DNA, 75 bp, Artificial Sequence
  Synthetic
tcacaatcaaatcaactactatcatacggtgatgtcacacgatttctatctaacaatgccatggtgctatacaca

SEQ ID NO: 298600 - DNA, 75 bp, Artificial Sequence
  Synthetic
tactggttcaatggatactgcatacgttaattctacacaagaagagactttcctcacgtcaactttgtgtctata

SEQ ID NO: 298601 - DNA, 75 bp, Artificial Sequence
  Synthetic
gtaccatcaaatgacgattatcaaacaccaataatgaattcagtaacggtcaggcaagatcttgaaaggcaactt

SEQ ID NO: 298602 - DNA, 75 bp, Artificial Sequence
  Synthetic
tttaaagaatatactgatatcgcttcattttcagttgatccgcaattgtattgtgattataatgtagtattaatg

SEQ ID NO: 298603 - DNA, 75 bp, Artificial Sequence
  Synthetic
caccaataatgaattcagtaacggtcaggcaagatcttgaaaggcaacttggagaattacgtaatgaattcaatg

SEQ ID NO: 298604 - DNA, 75 bp, Artificial Sequence
  Synthetic
cattatctcaacaaattgcaatgtctcagcttatagacctggcactactaccattagatatgttctcgatgtttt

SEQ ID NO: 298605 - DNA, 75 bp, Artificial Sequence
  Synthetic
agcgaaatctatggcaacaaacgtaatgaaaaaattcagaaaatcaaatttagctaattcagtttcaacgttaac

SEQ ID NO: 298606 - DNA, 75 bp, Artificial Sequence
  Synthetic
tagctaattcagtttcaacgttaactgactccttatcggacgcagcatcgtcaatatctagagggtcaaccatta

SEQ ID NO: 298607 - DNA, 75 bp, Artificial Sequence
  Synthetic
ttgatggtgatgacaactatgccgtactgcaatttaatacagaagtgactaaacagatggttcaagatgtatcaa

SEQ ID NO: 298608 - DNA, 75 bp, Artificial Sequence
  Synthetic
tagtaaacgattaagattgaaagaaatagcgacacagactgatggtatgaattttgacgacatttctgctgcagt

SEQ ID NO: 298609 - DNA, 75 bp, Artificial Sequence
  Synthetic
tgtaattcaagttggaggttctgatgttcttgatataacagctgatccaaccacagcaccacaaactgaacgaat

SEQ ID NO: 298610 - DNA, 75 bp, Artificial Sequence
  Synthetic
gttcttgatataacagctgatccaaccacagcaccacaaactgaacgaatgatgcgtattaattggaaaaaatgg

SEQ ID NO: 298611 - DNA, 75 bp, Artificial Sequence
  Synthetic
agagtacacaatgggatcaagcagcggttctatactcaaattatattgtaaatagacttcgaggttttgaaactg

SEQ ID NO: 298612 - DNA, 75 bp, Artificial Sequence
  Synthetic
gtgattttaacatttgatggtgtgacgttatcaacgcaatttactgactatgtgtcgttgaattcgctaaggttc

SEQ ID NO: 298613 - DNA, 75 bp, Artificial Sequence
  Synthetic
acagagagttcatactaaccaaaataatgcaaatgacgtcggtcgctattactgggtcattaagacttttccctt

SEQ ID NO: 298614 - DNA, 75 bp, Artificial Sequence
  Synthetic
tgttcgtatgaataacacctttaaagacgaacctaaagtaaattttaaaaatatttatgattggacgtttctgcc

SEQ ID NO: 298615 - DNA, 75 bp, Artificial Sequence
  Synthetic
ttgaagctggaacagatggaagattttttgcatatcgagttgagacgttcgaagagatacctttcgatgtgcaaa

SEQ ID NO: 298616 - DNA, 75 bp, Artificial Sequence
  Synthetic
agatcgggaatagctgatgaaatagctgcatcaacaacatttaaaaattacgtatcaaagctatcagagcagcta

SEQ ID NO: 298617 - DNA, 75 bp, Artificial Sequence
  Synthetic
agcatacaatttattgcgatccgatccgcgagtgttacgtgagtttatcaatcaggaaaatccaataatacgtaa

SEQ ID NO: 298618 - DNA, 75 bp, Artificial Sequence
  Synthetic
acagaaaccagttacattcaaatcgagtaaaataacaataaatgatatacttagagatataaaaccattttttac

SEQ ID NO: 298619 - DNA, 75 bp, Artificial Sequence
  Synthetic
tgtttataatgcattgatttactacaggtataattatgcatttgatcttaaaagatggatttatttacactcaat

SEQ ID NO: 298620 - DNA, 75 bp, Artificial Sequence
  Synthetic
gaaggagaaatccaaatcagaccataaaagtaggaaacactacccaagaattgaagcagactccgattcagatga

SEQ ID NO: 298621 - DNA, 75 bp, Artificial Sequence
  Synthetic
caaattgaagatgacggttcaaagtcagcaatatctcgtttaatatcaaaatattcagtttataaaccgtcgatt

SEQ ID NO: 298622 - DNA, 75 bp, Artificial Sequence
  Synthetic
gaagaactgtataaagtaatttcattgcatgaaaatgaaatacaattatatttaatttcactaggtataccaaaa

SEQ ID NO: 298623 - DNA, 75 bp, Artificial Sequence
  Synthetic
aatcgtcgaaggcacattatactcaaatgtcagtgatctaatacaacaatttaaccaaatgataattacaatgaa

SEQ ID NO: 298624 - DNA, 75 bp, Artificial Sequence
  Synthetic
accagatttggaaaagttaatcagaataccgtttaagggaaagataccagctgttaccttcatactgcatctata

SEQ ID NO: 298625 - DNA, 75 bp, Artificial Sequence
  Synthetic
aattatgttgaaactgctcgaaccacaattgaatatttcgttgactttgtagacaacgtttgtatggatgagatg

SEQ ID NO: 298626 - DNA, 75 bp, Artificial Sequence
  Synthetic
tagctcctcagtcagatgctttaagaaaattgtcaggaataaaatttaaaagaattaactttgataattcatcag

SEQ ID NO: 298627 - DNA, 75 bp, Artificial Sequence
  Synthetic
aaaagtattatctcaaaaagaagaagtgattacagataatcaagaagaaattaaaatagctgatgaagttaaaaa

SEQ ID NO: 298628 - DNA, 75 bp, Artificial Sequence
  Synthetic
atatcaaaatattcagtatatagaccatcaatagaagaattgtataaagtaatttcgcttcatgaacaagaaatt

SEQ ID NO: 298629 - DNA, 75 bp, Artificial Sequence
  Synthetic
ctgactcaacattagttcagccgacactagatggaccgtatcaacctactacgtttaacttaccaatcgactatt

SEQ ID NO: 298630 - DNA, 75 bp, Artificial Sequence
  Synthetic
cttccagatgcagaaagattcagtttcccaagagtagttaattccgctgatggcgctacaacgtggtatttcaat

SEQ ID NO: 298631 - DNA, 75 bp, Artificial Sequence
  Synthetic
tacacagagagaatatgttttggatggacagacagtacagctgcaagtttcgaacgattcaagtactctttggaa

SEQ ID NO: 298632 - DNA, 75 bp, Artificial Sequence
  Synthetic
atttcgatactattagactatcatttcaattgatgcggcctccaaacatgacaccagctgttgctgcattgtttc

SEQ ID NO: 298633 - DNA, 75 bp, Artificial Sequence
  Synthetic
agagtatattggtacgcgggaactacgccaaacgcatcagaaagttattatctaacaataaataatgataatagt

SEQ ID NO: 298634 - DNA, 75 bp, Artificial Sequence
  Synthetic
cgcaactgtcggattgactctccggattgaatcagccatttgtgaatctgtgctcgctgatgctaccgaaacaat

SEQ ID NO: 298635 - DNA, 75 bp, Artificial Sequence
  Synthetic
attttttacagcatcaattagttgaaccattgaataatgatataatatttaattatatacctgaaagaatacgga

SEQ ID NO: 298636 - DNA, 75 bp, Artificial Sequence
  Synthetic
ggaatgtagtaccagtgagcataacgtcaagggaaataaggcacacacgcgcacaaatgaatgaggacatagtag

SEQ ID NO: 298637 - DNA, 75 bp, Artificial Sequence
  Synthetic
tgtcaccattattaaaagcacaaaattatggaataaacctgccaatcactggttcaatggatactgcatacgcta

SEQ ID NO: 298638 - DNA, 75 bp, Artificial Sequence
  Synthetic
tatctatagttttattgaactatatattaaaatcactaactagtgcgatggactttataatttacagatttcttt

SEQ ID NO: 298639 - DNA, 75 bp, Artificial Sequence
  Synthetic
agacgttaattgctgctatgcttagccaacgtactatgtctttagatttcgtcactacaaattacatgtcattga

SEQ ID NO: 298640 - DNA, 75 bp, Artificial Sequence
  Synthetic
ttttataattcaataatctacggaattgcgccacctccacaatttaaaaaacgttataacactaatgataattca

SEQ ID NO: 298641 - DNA, 75 bp, Artificial Sequence
  Synthetic
aattcatatgtatacattgattattgggacgattcacaagcatttagaaacatggtgtatgttaggtcgttatca

SEQ ID NO: 298642 - DNA, 75 bp, Artificial Sequence
  Synthetic
tattatctcgtgttgtttcagttcgacatttagaaaacttggtactaagaaaagaaaatcatcaagatgtgctct

SEQ ID NO: 298643 - DNA, 75 bp, Artificial Sequence
  Synthetic
cggcgggagttacgttgtcgacgcaatttactgactatgtatcgcttaattcactgaggtttagatttaggttag

SEQ ID NO: 298644 - DNA, 75 bp, Artificial Sequence
  Synthetic
tattgaatataaagttacattgaatgaagacaaaccaatttcagatggacatgtaaaagaattagttgccgagct

SEQ ID NO: 298645 - DNA, 75 bp, Artificial Sequence
  Synthetic
ttcaataagtacgtgtactatacgtaattgtaataaactaggaccacgagaaaatgttgctataattcaagttgg

SEQ ID NO: 298646 - DNA, 75 bp, Artificial Sequence
  Synthetic
tgatggagtattaaatcaaacacttaatgacaacattagaaatggacaagttattaatcaattaatggaagcatt

SEQ ID NO: 298647 - DNA, 75 bp, Artificial Sequence
  Synthetic
gctacttttaagaataataataaatctggaatttcatctgactttaatcttctcgaccaaagaataatttggcaa

SEQ ID NO: 298648 - DNA, 75 bp, Artificial Sequence
  Synthetic
ctgccacttgacatgttttcaatgttttctgggattaaatcaacagtagaggcagtgaaatctatgactacaaat

SEQ ID NO: 298649 - DNA, 75 bp, Artificial Sequence
  Synthetic
taaagtcagtaagtagtaatacgacgatgcgaatcagcactgctatacaagctggagaagatttaagaacagtga

SEQ ID NO: 298650 - DNA, 75 bp, Artificial Sequence
  Synthetic
gatgcgaatcagcactgctatacaagctggagaagatttaagaacagtgactaatgcatcaacacagatatcaaa

SEQ ID NO: 298651 - DNA, 75 bp, Artificial Sequence
  Synthetic
tagcttatagagacatgcagttagagagagatgaaatgtatggctatgttaatatagctcgtaacttagatggtt

SEQ ID NO: 298652 - DNA, 75 bp, Artificial Sequence
  Synthetic
accattcataacagactcatcagttatatcattaatagctaaattagacgctactgtctttgcacaaatcgttaa

SEQ ID NO: 298653 - DNA, 75 bp, Artificial Sequence
  Synthetic
aaagatttaataaattaatcacggattcaccagtgctgtcagctataattgactttaaaacgctaaagaatttaa

SEQ ID NO: 298654 - DNA, 75 bp, Artificial Sequence
  Synthetic
aatcctaaaactttgaaagaatttataaataataataatccaataattagaaatagaatagaaaatttaattgcg

SEQ ID NO: 298655 - DNA, 75 bp, Artificial Sequence
  Synthetic
agaattctggaactttaactgaagaatttgagctactgatctccaactcagaagatgacaatgagtgaaattact

SEQ ID NO: 298656 - DNA, 75 bp, Artificial Sequence
  Synthetic
aatgtcactatctaattatacagtatttagccatcacaagaccgtccagactagagtagcgcctagctggcaaaa

SEQ ID NO: 298657 - DNA, 75 bp, Artificial Sequence
  Synthetic
aaatgaatcaatgtttaccttcttaaattttccatctattaaacaattttcaaatggaccatatttagttaagga

SEQ ID NO: 298658 - DNA, 75 bp, Artificial Sequence
  Synthetic
aattttccatctattaaacaattttcaaatggaccatatttagttaaggatactattaaattaaaacaagaacga

SEQ ID NO: 298659 - DNA, 75 bp, Artificial Sequence
  Synthetic
agcctactatatatatggttggttcagctccttcatattggatttacgacgtcaaacagtactctaatttcatgt

SEQ ID NO: 298660 - DNA, 75 bp, Artificial Sequence
  Synthetic
atatattgatatcagaactgatcgtggaaacacgaattggaaagagtggagaaagatagttgagacacaaaccat

SEQ ID NO: 298661 - DNA, 75 bp, Artificial Sequence
  Synthetic
ttgctgccaggatggaaattaacatatgtaggatacaatggaagcgatactaggggacattataatttttcattc

SEQ ID NO: 298662 - DNA, 75 bp, Artificial Sequence
  Synthetic
tttcaagagtagtttctgttagacatttggaaaatttggtattaagaaaagagaatcatcaagatgtacttttcc

SEQ ID NO: 298663 - DNA, 75 bp, Artificial Sequence
  Synthetic
aaactattacatcatccaacgactgagattcgatcagaattttatctgcttttagatatttgggacgttagtaat

SEQ ID NO: 298664 - DNA, 75 bp, Artificial Sequence
  Synthetic
tgttactgaaaacgtatttatacaaccaccatttaaaatcaaagcgtctaagaatgattacattgtagcgttata

SEQ ID NO: 298665 - DNA, 75 bp, Artificial Sequence
  Synthetic
gatgaaccaaaagtaggatttaaaaatatatatgattggacttttctaccgacggattttaacacaactaatgct

SEQ ID NO: 298666 - DNA, 75 bp, Artificial Sequence
  Synthetic
atcagaggaaacctactatatacatggttggttcagccccttcgtactggatttacgacgttaagcaatactctg

SEQ ID NO: 298667 - DNA, 75 bp, Artificial Sequence
  Synthetic
taggtatgtttggattgtcaatatctttagcttcaaaaccgacaggaaataatcatctatttattttgagtggaa

SEQ ID NO: 298668 - DNA, 75 bp, Artificial Sequence
  Synthetic
ttcaatattatatattgatattagaactgatcgtggaaatatagattggaaagagtggaggaaaatagttgaagc

SEQ ID NO: 298669 - DNA, 75 bp, Artificial Sequence
  Synthetic
cagaatccgctacatcgtattcaggctatatatttcgagatttatctaataataattttaatttaattggaacta

SEQ ID NO: 298670 - DNA, 75 bp, Artificial Sequence
  Synthetic
atatctgcaaaactattacatcatccaacaactgaaatcagatcagagttttacctgctcttagacatttgggac

SEQ ID NO: 298671 - DNA, 75 bp, Artificial Sequence
  Synthetic
aattgatttatgcatgcagatcagcgaaagagtttgcctcattgcaagatgaccttactgtattacgttatgcta

SEQ ID NO: 298672 - DNA, 75 bp, Artificial Sequence
  Synthetic
aaatagatctcaaccaatgcatgacaatttaatgggaactatgtggcttaatgctggatcagaaattcaagtagc

SEQ ID NO: 298673 - DNA, 75 bp, Artificial Sequence
  Synthetic
gagcgactacatggtacttcaacccagtgattcttagaccaaataacgttgaagtagaatttctactaaacggac

SEQ ID NO: 298674 - DNA, 75 bp, Artificial Sequence
  Synthetic
gtatggtattgaatataccacagttctaacttttttgatatcgcttgtatttgtcaattatatactgaaatcagt

SEQ ID NO: 298675 - DNA, 75 bp, Artificial Sequence
  Synthetic
ctaacttttttgatatcgcttgtatttgtcaattatatactgaaatcagttactagaacaatggactttatcatt

SEQ ID NO: 298676 - DNA, 75 bp, Artificial Sequence
  Synthetic
ggcatttcgagaagatcgcatcaaattaggttctcagaatccgcgacatcatattcgggatacatatttagagac

SEQ ID NO: 298677 - DNA, 75 bp, Artificial Sequence
  Synthetic
tgaattcaactacaagtgaaacatttttgacttcgacattatgtctatattatccaaatgaagcagctacagaaa

SEQ ID NO: 298678 - DNA, 75 bp, Artificial Sequence
  Synthetic
attgtcgcagttgtttttaacaaaaggatggccaacagggtcagtttattttaaaggatatgcagatattgcgtc

SEQ ID NO: 298679 - DNA, 75 bp, Artificial Sequence
  Synthetic
tcgatttaaagagatggatatatttgcattcaatagagaaagctgatatagaaggtggaaaatattatgagcacg

SEQ ID NO: 298680 - DNA, 75 bp, Artificial Sequence
  Synthetic
ggatggccaacagggtcagtttattttaaaggatatgcagatattgcgtcattttctgtagaaccgcagttatac

SEQ ID NO: 298681 - DNA, 75 bp, Artificial Sequence
  Synthetic
ggaaattaacgtatgtaggctataatggaaagaatacacgaggtcaatataatttttcatttatatgtcaaaatg

SEQ ID NO: 298682 - DNA, 75 bp, Artificial Sequence
  Synthetic
atataaggacgttattgagaatgcaactttattatctatactttcgtattcatatgataagtataatgcagttga

SEQ ID NO: 298683 - DNA, 75 bp, Artificial Sequence
  Synthetic
acgcaaacgagttagactatgagaataataagttaactagtgaattgttcccaacagctgaagaatatactgact

SEQ ID NO: 298684 - DNA, 75 bp, Artificial Sequence
  Synthetic
acagacataaattcatttgaaacagtggccaatgcagagaaattagctataactgatgttgtcgatggagtcaat

SEQ ID NO: 298685 - DNA, 75 bp, Artificial Sequence
  Synthetic
tctgatatcaatcattctactcaactatatattaaaatcagtgactcgaataatggactacattatatatagatt

SEQ ID NO: 298686 - DNA, 75 bp, Artificial Sequence
  Synthetic
aatttacaaaagaagattagatttgttcacgattgtggcttcaacggtaaacaaatatggagtacctagacacaa

SEQ ID NO: 298687 - DNA, 75 bp, Artificial Sequence
  Synthetic
cgcgaagtacaggtatgaatacgaagtgatgaaagacaaaccatattatttagtgacctgggctaactcatcgat

SEQ ID NO: 298688 - DNA, 75 bp, Artificial Sequence
  Synthetic
ttatgtcaatcaaattgtacaagtcatgtccaagcgatcacgctccttagattctgctgccttttattaccgagt

SEQ ID NO: 298689 - DNA, 75 bp, Artificial Sequence
  Synthetic
tataatatacatgcttggttcagctccatcttattggatttatgatattaaacagtattctgattttacatttga

SEQ ID NO: 298690 - DNA, 75 bp, Artificial Sequence
  Synthetic
taaacgataattcatggaaagatacgctttcccaactatttttaactaaaggatggccaacaggatctatctatt

SEQ ID NO: 298691 - DNA, 75 bp, Artificial Sequence
  Synthetic
tcgtcaccaatgtctattctagttgctctggtagacataaatggtacttttattactaatgaagaacttgaatta

SEQ ID NO: 298692 - DNA, 75 bp, Artificial Sequence
  Synthetic
atgaagaaagcgggactggttgatataccaaaaatgatacaggattggttgatggattgttcgattgaaaagttt

SEQ ID NO: 298693 - DNA, 75 bp, Artificial Sequence
  Synthetic
gatcaattaaaaacggagtatactgaagatgttgatgatgagatgtacagagaatatactatgttaattagagat

SEQ ID NO: 298694 - DNA, 75 bp, Artificial Sequence
  Synthetic
tgattatatagtggcattgtatgctttatctaatgacttcaattcaaggcaagatgttattaatttgattaataa

SEQ ID NO: 298695 - DNA, 75 bp, Artificial Sequence
  Synthetic
gagaatcaaggcagttaaaattcggtcgaaaaactatattctcgacaaagaaaaatatgcatgtgatggatgata

SEQ ID NO: 298696 - DNA, 75 bp, Artificial Sequence
  Synthetic
aattttcatattaccatatgaatatttcattgcccagcatgcaatagttgaaaagatgttaatttacgctaaaca

SEQ ID NO: 298697 - DNA, 75 bp, Artificial Sequence
  Synthetic
tggattcatcgacacaatcacgaccttcaagcaacgttggatgcgatcaattggatttctccttgaccaaaggta

SEQ ID NO: 298698 - DNA, 75 bp, Artificial Sequence
  Synthetic
agaattaattttgacaattcatctgattacattgagaattggaatttacaaaatagacgacagcgtactggattc

SEQ ID NO: 298699 - DNA, 75 bp, Artificial Sequence
  Synthetic
caaacaaacacaaattaatctaatggattcgtatgtccaaataccagatggtaatgtgattaaaaagatacaata

SEQ ID NO: 298700 - DNA, 75 bp, Artificial Sequence
  Synthetic
tctataagtaaggatgtgcagaggcattcgctacgtaaagaactggctcagatggtatagtgagaggatgtgacc

SEQ ID NO: 298701 - DNA, 75 bp, Artificial Sequence
  Synthetic
caaacgaaagctgctaattcaatagctaatttagcattgattaaaacggttttgtcacgtatagcgaataaatat

SEQ ID NO: 298702 - DNA, 75 bp, Artificial Sequence
  Synthetic
gtataaggacgtaattgaaaacgcaactttattatccatactatcatattcgtacgacaaatataatgcagtaga

SEQ ID NO: 298703 - DNA, 75 bp, Artificial Sequence
  Synthetic
actttattatccatactatcatattcgtacgacaaatataatgcagtagaaaggaagttggtacattatgcaaaa

SEQ ID NO: 298704 - DNA, 75 bp, Artificial Sequence
  Synthetic
tcccaagagtgattaattcagctgatggcgctactacatggtacttcaatccagttatcataagaccaagtaatg

SEQ ID NO: 298705 - DNA, 75 bp, Artificial Sequence
  Synthetic
tgaaaagcaaatggacagggttgtaagagaaatgagacgtcagctggaaatgattgataagctaaccactagaga

SEQ ID NO: 298706 - DNA, 75 bp, Artificial Sequence
  Synthetic
acgacgttcgagatacttatgcacgaatgaatgctaaagtgaaagctttggtttctaccgttggaattgaaattg

SEQ ID NO: 298707 - DNA, 75 bp, Artificial Sequence
  Synthetic
ctctaatggatccagcaatcttaacatcactgtcttcaaatttaaatgcagtcatgttttggttggagaagcatg

SEQ ID NO: 298708 - DNA, 75 bp, Artificial Sequence
  Synthetic
cgcaagcaccaccatttatatttcatgctacagttggactcacactacgaattgaatctgcagtttgtgaatctg

SEQ ID NO: 298709 - DNA, 75 bp, Artificial Sequence
  Synthetic
cgtattatattcaaattacatagttaatagattgcgaggatttgaaactgatagagaattcatcctaactaaaat

SEQ ID NO: 298710 - DNA, 75 bp, Artificial Sequence
  Synthetic
tgcaaaatacagatatgagtacgaggtaatgaaagacaaaccatattatttggtgacgtgggcaaattcggcaat

SEQ ID NO: 298711 - DNA, 75 bp, Artificial Sequence
  Synthetic
tagccatggcgaccttcaaagatgcttgttttcattacagaagaattacaaagttgaatagagaactactgagaa

SEQ ID NO: 298712 - DNA, 75 bp, Artificial Sequence
  Synthetic
ataatcagaaaaaagcgttaataacagtgagaattaataatacgtttaaagatgaaccaaaagtcggatttaaaa

SEQ ID NO: 298713 - DNA, 75 bp, Artificial Sequence
  Synthetic
cagaacgagttttaacgactaactctacatttaaggtatttgactctgaagattttataattgaatatggtacaa

SEQ ID NO: 298714 - DNA, 75 bp, Artificial Sequence
  Synthetic
tcatcacctatgtcaattctagtcgcattagtagacataaatggcacttttatcactaatgaagaattagaactg

SEQ ID NO: 298715 - DNA, 75 bp, Artificial Sequence
  Synthetic
ggcgaagttgaattcttatgcaccaatttccttagaaaaacgtcgtgcgcaaatttccgcattactaacaatgct

SEQ ID NO: 298716 - DNA, 75 bp, Artificial Sequence
  Synthetic
tttaaaaaggcagttaaacagaggaaatgtaggaatgaacttgataaatcgtggtacaatcaattattacttcca

SEQ ID NO: 298717 - DNA, 75 bp, Artificial Sequence
  Synthetic
atgaagaaagctggactagttgatataccaaaaatgatacaaaactggttaatagactgttcaattgaaaaattt

SEQ ID NO: 298718 - DNA, 75 bp, Artificial Sequence
  Synthetic
atttccttagaaaaacgtcgtgcgcaaatttccgcattactaacaatgctccaaaaaccagtgacttttaaatca

SEQ ID NO: 298719 - DNA, 75 bp, Artificial Sequence
  Synthetic
aaatttccgcattactaacaatgctccaaaaaccagtgacttttaaatcaaacaagattacgatcaatgacattt

SEQ ID NO: 298720 - DNA, 75 bp, Artificial Sequence
  Synthetic
acagtgcattggatcaaggacttatcaaattgaagatgatggatctaaatcagcaatttcaagattaatatcgaa

SEQ ID NO: 298721 - DNA, 75 bp, Artificial Sequence
  Synthetic
tcggaaaactattttttccacaaaaaagaacatgcacgtaatggatgatatggctaatggaagatacacgccagg

SEQ ID NO: 298722 - DNA, 75 bp, Artificial Sequence
  Synthetic
aagaacatgcacgtaatggatgatatggctaatggaagatacacgccaggagtaattccaccagttaatgttgat

SEQ ID NO: 298723 - DNA, 75 bp, Artificial Sequence
  Synthetic
attgatgctgatacatatattggatcaaaaatttattcgcaagataaatatcgtatattagagtcgtacgtatat

SEQ ID NO: 298724 - DNA, 75 bp, Artificial Sequence
  Synthetic
aagcttacattatgatctacttaataacaaagataaaatactcgctgctttatcaacatcatcattgaaacaatt

SEQ ID NO: 298725 - DNA, 75 bp, Artificial Sequence
  Synthetic
ataccttttaaaggaaaaataccagctgtgacatttatactacacttatatgcaaaattggaaataattaattac

SEQ ID NO: 298726 - DNA, 75 bp, Artificial Sequence
  Synthetic
gcgtattttgcaattatccaaaatctgagatgattaagctttggaagaaaatgtggaacattacttcactaagtt

SEQ ID NO: 298727 - DNA, 75 bp, Artificial Sequence
  Synthetic
ttggaagaaaatgtggaacattacttcactaagttcaccgtacactaatgcaaacttctttcaagattagagcgc

SEQ ID NO: 298728 - DNA, 75 bp, Artificial Sequence
  Synthetic
acattaagcaattttcaaacggtgcatacatcgtaaaacatactattaaattaaagcaggagaaatggctgggta

SEQ ID NO: 298729 - DNA, 75 bp, Artificial Sequence
  Synthetic
ttttcattggcagatagatattgcattatacacgcatatcaagatgatactaaaaattgaagctcttccattcag

SEQ ID NO: 298730 - DNA, 75 bp, Artificial Sequence
  Synthetic
actagacggaccgtaccagccaactacattcaatccaccagtagattattggatgctgttagcacctacaacagc

SEQ ID NO: 298731 - DNA, 75 bp, Artificial Sequence
  Synthetic
tcatttgtgactaaaataattcgggttgatggagacgacaattatgcagtcttacaatttaataccgaagtgact

SEQ ID NO: 298732 - DNA, 75 bp, Artificial Sequence
  Synthetic
ggaatacaagagcaaatcatagtagctaacacctctcaaacgcagtggaagttcatttacgttgttaaaactaca

SEQ ID NO: 298733 - DNA, 75 bp, Artificial Sequence
  Synthetic
gcttctgatctcagactctgaagatgacgattaatacttaattgaaccaactcagtttttgccatcacgagacct

SEQ ID NO: 298734 - DNA, 75 bp, Artificial Sequence
  Synthetic
ctaacacctctcaaacgcagtggaagttcatttacgttgttaaaactacacaaaatggaacatattcgcaatatg

SEQ ID NO: 298735 - DNA, 75 bp, Artificial Sequence
  Synthetic
ttcaactacaaattatgattcggtgaatatgacagcattctgtgatttttatattataccaagatcagaggaagc

SEQ ID NO: 298736 - DNA, 75 bp, Artificial Sequence
  Synthetic
atagagaattcatattaacgaaaatcatgcaaatgacatcagtagccattactgggtcacttagattgtttccat

SEQ ID NO: 298737 - DNA, 75 bp, Artificial Sequence
  Synthetic
agcgcgtgcggaaagatggaaaagtttaccgacctcaactacacattgagtgtgatcactttaatgaatagcaca

SEQ ID NO: 298738 - DNA, 75 bp, Artificial Sequence
  Synthetic
gctcaagcgaacgaagatattgtcgtatctaaaacatcgttgtggaaagaaatgcagtacaacagagatattata

SEQ ID NO: 298739 - DNA, 75 bp, Artificial Sequence
  Synthetic
ctcctttaataaggcagtaaaggtaaatgcgaatttagattcatcaatatctatatcaacaaatcaaaagcagga

SEQ ID NO: 298740 - DNA, 75 bp, Artificial Sequence
  Synthetic
taagtggtcggagatatcatttaaaccagcgaattatcagtatacatatacaagagatggagaagaggtgacagc

SEQ ID NO: 298741 - DNA, 75 bp, Artificial Sequence
  Synthetic
agcaaagttaaattcgtatgcacctatctccttggagaaacggcgtgcacaaatctctgctctattaacaatgtt

SEQ ID NO: 298742 - DNA, 75 bp, Artificial Sequence
  Synthetic
cagtatcagaaattcatgccaactttgcctaataatgttcagtatataatacaatgcattggatcaagaacttat

SEQ ID NO: 298743 - DNA, 75 bp, Artificial Sequence
  Synthetic
gggatggcgtattttccatacatagcatctgtgttgactgttctgttcactttacataaagcatcaattccaaca

SEQ ID NO: 298744 - DNA, 75 bp, Artificial Sequence
  Synthetic
tttacataaagcatcaattccaacaatgaaacttgcgttaaaaacatctagatgttcttacaaagttattaaata

SEQ ID NO: 298745 - DNA, 75 bp, Artificial Sequence
  Synthetic
cagccggagtcacactatccactcaattcacagattttgtttcattaaactctttaagatttagatttagattag

SEQ ID NO: 298746 - DNA, 75 bp, Artificial Sequence
  Synthetic
aatttattatctataaattacggttgttatcaactttttgactttaattcaccagatctagaaaagctaataaga

SEQ ID NO: 298747 - DNA, 75 bp, Artificial Sequence
  Synthetic
tatcagtattatcgaatgcacaaaattatggaataaatttgccaattactggatctatggatacagcatatgcta

SEQ ID NO: 298748 - DNA, 75 bp, Artificial Sequence
  Synthetic
ttagtaccatctaatgatgattaccagacaccaatagctaattcagtgacggtcagacaagatttagagcgacag

SEQ ID NO: 298749 - DNA, 75 bp, Artificial Sequence
  Synthetic
cgaaatgattaaactttggaagaaaatgtggaacataacttcattgagatctccttatactaacgcaaatttctt

SEQ ID NO: 298750 - DNA, 75 bp, Artificial Sequence
  Synthetic
tttctggtattaaaagtactatagacgcggcaaagtcaatggctactaatgtgatgaaaaagtttaagaggtcaa

SEQ ID NO: 298751 - DNA, 75 bp, Artificial Sequence
  Synthetic
tggctgagctagcttgcttttgttatcctcatttggagaacgatagctataaatttattccttttaatagtttgg

SEQ ID NO: 298752 - DNA, 75 bp, Artificial Sequence
  Synthetic
gcaagaaaaagatgacgagaagcgagatcaaagtaacaaaatgcaactatcagacaaagtgctttcaaagaggga

SEQ ID NO: 298753 - DNA, 75 bp, Artificial Sequence
  Synthetic
agcgtggacggatgtttcaacgcaaattactgatgtttcttcatctgttagcacaatttcaacgcagacttcaac

SEQ ID NO: 298754 - DNA, 75 bp, Artificial Sequence
  Synthetic
aactggagaggcaaacaaatggatatcaatgggatcatcatgtaccgttaaagtgtgtccattaaatactcagac

SEQ ID NO: 298755 - DNA, 75 bp, Artificial Sequence
  Synthetic
gcacaatttcaacgcagacttcaactattagtagaagattaagactaaaagaaatggctacacaaacggaaggaa

SEQ ID NO: 298756 - DNA, 75 bp, Artificial Sequence
  Synthetic
agaaaagtttattcctaacagagcatatagagtaataaataatgatgaagtttttgaagctggaatagatggtag

SEQ ID NO: 298757 - DNA, 75 bp, Artificial Sequence
  Synthetic
gactttaagacattaaagaatcttaatgataattatggcattagtaagcaacaagcgttcaatttactaagatct

SEQ ID NO: 298758 - DNA, 75 bp, Artificial Sequence
  Synthetic
acaagcgttcaatttactaagatctgatccaagggtattgcgtgaatttattaatcaagataatccaataattcg

SEQ ID NO: 298759 - DNA, 75 bp, Artificial Sequence
  Synthetic
acttaaaacttcaaaatgttcgtataaagtggtcaaatattgtattgtatcgattttcaacaccttactgaaatt

SEQ ID NO: 298760 - DNA, 75 bp, Artificial Sequence
  Synthetic
agctagatacataagacctaatttgctgcaagataggctaaatttacatgacaattttgaatctttatgggatac

SEQ ID NO: 298761 - DNA, 75 bp, Artificial Sequence
  Synthetic
atactctatcgcaattatttttaactaaaggatggccaactggatcagtttattttaaagactacaatgatatta

SEQ ID NO: 298762 - DNA, 75 bp, Artificial Sequence
  Synthetic
ttaatgttggaccaaggaatgaatctatgtttacttttctagatcatccatcaataaagcagttttcaaatggac

SEQ ID NO: 298763 - DNA, 75 bp, Artificial Sequence
  Synthetic
gtggagggcgtcgtgaggcgaatttaaaacaagatgatcgaatgcaagaaaaagaagaaagtaaaaatgcaaaca

SEQ ID NO: 298764 - DNA, 75 bp, Artificial Sequence
  Synthetic
acaccgtttcagatagccgaacagcaaatacaaaacttccaggtggctaattggctgcattttgtaaataataat

SEQ ID NO: 298765 - DNA, 75 bp, Artificial Sequence
  Synthetic
ggcttttttttgaaaagtcttgtgttagccatggcaactttcaaagatgcttgctttcattacagaagaatcaca

SEQ ID NO: 298766 - DNA, 75 bp, Artificial Sequence
  Synthetic
tgacgaagttaaaaaatctaataaagaagaatctaagcaattgttagaggtcttgaaaaccaaagaagagcatca

SEQ ID NO: 298767 - DNA, 75 bp, Artificial Sequence
  Synthetic
ctgaattaacattctgtcatggatgctcattagctcatgtatgtcagtggtgtatacaaaacaaacgttgttttt

SEQ ID NO: 298768 - DNA, 75 bp, Artificial Sequence
  Synthetic
gaatatcgcatacaaatacttatccacagggaaagctaaagtatgttgtgttaaaatgactgctatggatttaga

SEQ ID NO: 298769 - DNA, 75 bp, Artificial Sequence
  Synthetic
aaaaaacagactaaattatttagaatttttgaacccaaacagctaccaatatacagagcgaatggagaaaaagaa

SEQ ID NO: 298770 - DNA, 75 bp, Artificial Sequence
  Synthetic
tgaagcgagatactctacctgatggagattatgatgtaagagaatattttctaaatttatatgatcaagtattaa

SEQ ID NO: 298771 - DNA, 75 bp, Artificial Sequence
  Synthetic
caaatttgcaatccatttatgcgaataagtatttcaagttgagtagacttccttcaatgaaattgaaacaaattt

SEQ ID NO: 298772 - DNA, 75 bp, Artificial Sequence
  Synthetic
taataatacatttaaagatgaaccaaaagtagggtttaaagatatttatgattggacttttttgccaactgattt

SEQ ID NO: 298773 - DNA, 75 bp, Artificial Sequence
  Synthetic
ttgtgggatactataactacgtcaaattatattttggccagatcagttgtaccagatttaaaagaattggtgtct

SEQ ID NO: 298774 - DNA, 75 bp, Artificial Sequence
  Synthetic
ataccttgatcaaaccattgaaaagttgttcaatgcaatgaacccagtacaagtgaatgatcagaaagtaattag

SEQ ID NO: 298775 - DNA, 75 bp, Artificial Sequence
  Synthetic
tacaataaataaatacggagtacccagacataatgaaaaatacagatatgaatatgaagtgatgaaggataaacc

SEQ ID NO: 298776 - DNA, 75 bp, Artificial Sequence
  Synthetic
aacttgtaacaaattctccagttatatcagcgataatcgattttaaaacattaaaaaatttaaatgataattatg

SEQ ID NO: 298777 - DNA, 75 bp, Artificial Sequence
  Synthetic
gacacattggttagattagaagaagagggtaaactagctgaagaatatgagcttctgatctcagattctgaagat

SEQ ID NO: 298778 - DNA, 75 bp, Artificial Sequence
  Synthetic
atgcaaagaatgcattatagaaatggtgacccccaaactccttttcagatcgctgaacagcaaatccaaaacttt

SEQ ID NO: 298779 - DNA, 75 bp, Artificial Sequence
  Synthetic
gtcatgtagttaatcaattaatggaagctttaatgcagttgtctagacagcaatttccaactatgccggtagatt

SEQ ID NO: 298780 - DNA, 75 bp, Artificial Sequence
  Synthetic
ataaaaggtcgatacagagaggaattctacttctatctaatagattgggacagctagtcgatttaactagactat

SEQ ID NO: 298781 - DNA, 75 bp, Artificial Sequence
  Synthetic
aatgaaagacaaaattgaacgtggtgaagttgaagtggatgattcgttcgttgaagaaaagatggaagttgatac

SEQ ID NO: 298782 - DNA, 75 bp, Artificial Sequence
  Synthetic
tgaagcaaagagttaatgaaaaatatacgagttgggtgcagaaggcaaaaaaagcaaatgagaacatgtacttcc

SEQ ID NO: 298783 - DNA, 75 bp, Artificial Sequence
  Synthetic
gtcgaagatttcttaaagaggctgcaaatatttgatgtttcaagagttccggatgatcaaatgtataggctcaga

SEQ ID NO: 298784 - DNA, 75 bp, Artificial Sequence
  Synthetic
ctcagggagtgattatagcttatagggatatgcagttagaaagagatgaaatgtatggttatgttaatatagctc

SEQ ID NO: 298785 - DNA, 75 bp, Artificial Sequence
  Synthetic
aaatttagaagaattgatgagaacaggagattatgcacaaataactaacatgttactgaataaccagccagtcgc

SEQ ID NO: 298786 - DNA, 75 bp, Artificial Sequence
  Synthetic
cttaataaaacttacccaagagaagtgggttggaactgagaattcacaatttgatattggacagttcaaaaatat

SEQ ID NO: 298787 - DNA, 75 bp, Artificial Sequence
  Synthetic
actagttggcgcactaccattcataacggattcatcagttatctcattgatagctaagttagacgctactgtatt

SEQ ID NO: 298788 - DNA, 75 bp, Artificial Sequence
  Synthetic
tgggttccaacgtccacaacaaaagtttataagcaggtgccacagcaatttgattttagagcatccatgcatatg

SEQ ID NO: 298789 - DNA, 75 bp, Artificial Sequence
  Synthetic
atgaaagtattagctttaagacatagtgtggctcaggtatatgcagacactcaagtatacactcatgatgatact

SEQ ID NO: 298790 - DNA, 75 bp, Artificial Sequence
  Synthetic
aggaattgcggctattgagattcagtcccttgaagaattatttaccttaattagatgtaatttcacgtatgatta

SEQ ID NO: 298791 - DNA, 75 bp, Artificial Sequence
  Synthetic
gccatgtttacaatatctgatacagagaagctaagtgacaattcaatcctttatattgatataaggtcagataga

SEQ ID NO: 298792 - DNA, 75 bp, Artificial Sequence
  Synthetic
tgtactctgatcttcttgcattcgtttcagcagacactgttgaaccgattaacgctgttgcgttcgataacatgc

SEQ ID NO: 298793 - DNA, 75 bp, Artificial Sequence
  Synthetic
ttcagttgatgagaccaccaaatatgacaccagcggtagcggcgttatttccaaatgcgcagccatttgaacatc

SEQ ID NO: 298794 - DNA, 75 bp, Artificial Sequence
  Synthetic
ctattaccaggttggaaattaacgtacgtaggatataatggaaatgacacacgagggcattataatttttcattc

SEQ ID NO: 298795 - DNA, 75 bp, Artificial Sequence
  Synthetic
tgactattcgtattataccaataatgagataagaactgatcaacattgggtaaccaagacaaatatagaagatta

SEQ ID NO: 298796 - DNA, 75 bp, Artificial Sequence
  Synthetic
gaatgaccacatctctaccaatagcacgattgtcgaacagagtttttagagacaaattgtttcctttattagtca

SEQ ID NO: 298797 - DNA, 75 bp, Artificial Sequence
  Synthetic
actggatccatggacacgaactatcaaaacgtatcggctttagaaccatttttgacatcaacgctatgtctttat

SEQ ID NO: 298798 - DNA, 75 bp, Artificial Sequence
  Synthetic
caagagagatggttaggaaaaagagtatctcagtttgacattgggcaatataaaaatatgctaaatgttattacg

SEQ ID NO: 298799 - DNA, 75 bp, Artificial Sequence
  Synthetic
ttaaaagctacacagatattgcaactttttcgataaatcctcagttatattgtgattataatatagtactgatga

SEQ ID NO: 298800 - DNA, 75 bp, Artificial Sequence
  Synthetic
ttgtcgcaatttgatattggtcaatataaaaatatgttaaacgtaatgacaaccttatatcaatattatgacata

SEQ ID NO: 298801 - DNA, 75 bp, Artificial Sequence
  Synthetic
caccataaagaactattcttcgcaaaagacataggtaaattaaaagacaactctatattatatatcgacattcga

SEQ ID NO: 298802 - DNA, 75 bp, Artificial Sequence
  Synthetic
catgtttagagacataaccaatggaaaatttaacttaattaatacgaacgtagaaaatgcagtatctggacacgt

SEQ ID NO: 298803 - DNA, 75 bp, Artificial Sequence
  Synthetic
acaaacagatgaagcaaataaatggatctcgatgggagactcatgtactattaaagtatgtccactaaatacgca

SEQ ID NO: 298804 - DNA, 75 bp, Artificial Sequence
  Synthetic
ttgcgacaactgaaaagttagcaataacagatgtcgttgatggagtgaattataaggtaaatgtcactactacta

SEQ ID NO: 298805 - DNA, 75 bp, Artificial Sequence
  Synthetic
tattacgagcacgctccaccagaattgttatatgcatgtcattcggcattaacattcgcaaaatcgcaaaatgat

SEQ ID NO: 298806 - DNA, 75 bp, Artificial Sequence
  Synthetic
aactgatagagaagacatggattggaaaacgtggaggaaggttgtagaagagcagactactaataatttaaatat

SEQ ID NO: 298807 - DNA, 75 bp, Artificial Sequence
  Synthetic
ttatgtgaatcagataattcaagcaatgtccaaaagatcgcgatcgttagattcggcagcattttattacagaat

SEQ ID NO: 298808 - DNA, 75 bp, Artificial Sequence
  Synthetic
taaataatgtagtcaccgagaacgtattcatacaacagccgtttaaattaaagacgttgaagaatgaatacgtgg

SEQ ID NO: 298809 - DNA, 75 bp, Artificial Sequence
  Synthetic
tgaacgtctgcaagaaaaagaaattgaaaataatacagacgtaaccatggaaaataaaaataacaataaaaataa

SEQ ID NO: 298810 - DNA, 75 bp, Artificial Sequence
  Synthetic
tatcaatatcattagcttcaaagccaactggaaataaccatctgtttattttaagtggtactgataagtatttta

SEQ ID NO: 298811 - DNA, 75 bp, Artificial Sequence
  Synthetic
atttttccgttgacccacaattatattgtgattataatttagtactaatgaagtatgatcaaaatcttgaattag

SEQ ID NO: 298812 - DNA, 75 bp, Artificial Sequence
  Synthetic
atttattatagatataattattcttttgacctgaagagatggatatatctgcattcagtagaaaaggctaatatt

SEQ ID NO: 298813 - DNA, 75 bp, Artificial Sequence
  Synthetic
cgtattcaggctacatttttagagatttgtccaataataactttaatctaataggtacgaatgttgagaattcgg

SEQ ID NO: 298814 - DNA, 75 bp, Artificial Sequence
  Synthetic
cctaacttcgactttatgtttatattacccaactgaagcagcaactgaaataaatgatgattcatggaaggatac

SEQ ID NO: 298815 - DNA, 75 bp, Artificial Sequence
  Synthetic
tgaaggcggcagatattatgaacacgctccgatagagctgatttatgcatgcaggtcggcaaaggaatttgcgaa

SEQ ID NO: 298816 - DNA, 75 bp, Artificial Sequence
  Synthetic
aaagtaaatgaaaatatgtactctcttcagaatgttatatcacaacaacaaagccaaattgctgatctgcaacac

SEQ ID NO: 298817 - DNA, 75 bp, Artificial Sequence
  Synthetic
aatagaaactactaaattaagaattaagtcaatatacttacggaaaatcagaggggatactgtgtttgatatgcc

SEQ ID NO: 298818 - DNA, 75 bp, Artificial Sequence
  Synthetic
agttttagtaataaaaaagtagtgaggatagatagcacgcggctgaatatagagtttatatatttaaggaagata

SEQ ID NO: 298819 - DNA, 75 bp, Artificial Sequence
  Synthetic
taaattcattccatttaacagcttagctataaagtgtatgttgacagcaaaagtggacaaaaaggatcaggataa

SEQ ID NO: 298820 - DNA, 75 bp, Artificial Sequence
  Synthetic
gtactctcaaaagtagtttctgtaagacatctagaaaatttggtactgagaagagagaatcatcaggatgtactt

SEQ ID NO: 298821 - DNA, 75 bp, Artificial Sequence
  Synthetic
tcatcaccaatgtcaattctagtagctttagtggatatacatggaacatttattacaaatgaagaattagaacta

SEQ ID NO: 298822 - DNA, 75 bp, Artificial Sequence
  Synthetic
ctttcactatgtggaaattgacgtatttagatcataaattaatgcctattttggatcagaattttattgaatata

SEQ ID NO: 298823 - DNA, 75 bp, Artificial Sequence
  Synthetic
caagagagaatgtagctgtaatacaagttggtggctctaatgtgttagacataacagcagatccaacaactaatc

SEQ ID NO: 298824 - DNA, 75 bp, Artificial Sequence
  Synthetic
cttaatatgtatgacactttattcccaatacatgaaaagatagtgaataagtttattaataatgttaagcaacgt

SEQ ID NO: 298825 - DNA, 75 bp, Artificial Sequence
  Synthetic
gtcaattggggtcatggagagataaatgattcaaccacagtagaaccaattttagatggtccttatcaacctact

SEQ ID NO: 298826 - DNA, 75 bp, Artificial Sequence
  Synthetic
agacacaatgaaaagtatagatatgactatgaagtaatgaaagataaaccatattatttagtaacttgggcaaat

SEQ ID NO: 298827 - DNA, 75 bp, Artificial Sequence
  Synthetic
aatggtacaaccatctactacttccgcttaccttacaggcattagctataaagttagagaataacacatattata

SEQ ID NO: 298828 - DNA, 75 bp, Artificial Sequence
  Synthetic
tattcgaatagatcaacactagctaagttggtatcatctccaatgtcgatcttagttgcactaatcgatattaac

SEQ ID NO: 298829 - DNA, 75 bp, Artificial Sequence
  Synthetic
tgtattgctaaacattcagatgatgatgaatggaataaagcttgcacacaggttatgaacgctaaaggttacata

SEQ ID NO: 298830 - DNA, 75 bp, Artificial Sequence
  Synthetic
ggttatgaacgctaaaggttacatagagatagtaaattctgcatatactgaacactatagtgtctcacaaaggtg

SEQ ID NO: 298831 - DNA, 75 bp, Artificial Sequence
  Synthetic
ttattccaaggtctcaagaatctaagtgtaatgaatatattaacaatggtttgccaccaattcaaaatactagaa

SEQ ID NO: 298832 - DNA, 75 bp, Artificial Sequence
  Synthetic
gctataaaatatgggaagattttagaattaagaaaatatataataatgtgctagattttatcagagcattgtcta

SEQ ID NO: 298833 - DNA, 75 bp, Artificial Sequence
  Synthetic
attccaaaatactgcttttactatgtggaaactgacatatctagatcataaactaatgcctatcttagatcaaaa

SEQ ID NO: 298834 - DNA, 75 bp, Artificial Sequence
  Synthetic
catagataaactatttagatgtttagaacctgttgacataaatgaaatagaatatgtgctatttgatcacgagat

SEQ ID NO: 298835 - DNA, 75 bp, Artificial Sequence
  Synthetic
tcagatcttctcgcattcgtatcagctgatacagtagaacctataaatgcagttgcatttgacaatatgcgcatc

SEQ ID NO: 298836 - DNA, 75 bp, Artificial Sequence
  Synthetic
aatatgtgctatttgatcacgagattaattgggaagtaaggggtttgattttacaatgcatgaatggaaatattc

SEQ ID NO: 298837 - DNA, 75 bp, Artificial Sequence
  Synthetic
atgattcaaaagcatttagaaatatggtatatgtcagatcattagcagctaatctgaactcagtgaaatgtacgg

SEQ ID NO: 298838 - DNA, 75 bp, Artificial Sequence
  Synthetic
ctaagatttattctcaagataaatataggatattggagtcatacgtgtataacttgttgtctattaattatggat

SEQ ID NO: 298839 - DNA, 75 bp, Artificial Sequence
  Synthetic
ttcatcacagcataatacgcagccgtttagaaaaggaataattatgggtttagatatgctagctaatatgactaa

SEQ ID NO: 298840 - DNA, 75 bp, Artificial Sequence
  Synthetic
acctgatctagaaaagttgatcagaataccatttaaaggaaaaataccagctgttacctttatactacacttata

SEQ ID NO: 298841 - DNA, 75 bp, Artificial Sequence
  Synthetic
attcaaaagatgagtatgaaaatgcatttctcatttctaatctaactacacataatatattatatttgaattata

SEQ ID NO: 298842 - DNA, 75 bp, Artificial Sequence
  Synthetic
ccagtcaaaaatcaggaatagctgacgaaattgcttcttcgcaaacgtttaaaaactacgttagcaagttatctg

SEQ ID NO: 298843 - DNA, 75 bp, Artificial Sequence
  Synthetic
catcataaagaattattctacattaacgatgtgcaaaaacttaaagataattcgatactgtatatagatataaga

SEQ ID NO: 298844 - DNA, 75 bp, Artificial Sequence
  Synthetic
ggcttttaaaagttctgttccgagagagcgcgtgcggaaagatggataagcttgccgacctcaactatacattga

SEQ ID NO: 298845 - DNA, 75 bp, Artificial Sequence
  Synthetic
ctaatctacttaatatcaattatattgtttaattacatattaaaaagcataactagaatgatggactacataatt

SEQ ID NO: 298846 - DNA, 75 bp, Artificial Sequence
  Synthetic
tacaagtttttacttataattacgatcacctcgattttcgatagtgcccagaattatggaatcaacttgccaata

SEQ ID NO: 298847 - DNA, 75 bp, Artificial Sequence
  Synthetic
gaccgctatggatttagaactaccaatttctgcaaaactattacaccacccaactacagaaattagatcagagtt

SEQ ID NO: 298848 - DNA, 75 bp, Artificial Sequence
  Synthetic
taaatgataatgagtggacgagcacattgtcacagttgtttctgacaaaagggtggccaactggttcagtatact

SEQ ID NO: 298849 - DNA, 75 bp, Artificial Sequence
  Synthetic
cttctcagtagatccgcaactgtattgtgattataatatagttttaatgcggtacaattcaagtttaaagctaga

SEQ ID NO: 298850 - DNA, 75 bp, Artificial Sequence
  Synthetic
aagtgaggactaggctaactacctggtatccgatcttaatcagcatgtagctatgtcaagtcactcagactctac

SEQ ID NO: 298851 - DNA, 75 bp, Artificial Sequence
  Synthetic
acaaatactgggacatttgaagaggtagcaacagctgaaaaactggtaattactgacgtagttgacggtgtaaat

SEQ ID NO: 298852 - DNA, 75 bp, Artificial Sequence
  Synthetic
ggcaagtattttacactatagtagattacgtaaaccaaattgtacaaacaatgtccaaaaggtccagatcactag

SEQ ID NO: 298853 - DNA, 75 bp, Artificial Sequence
  Synthetic
aatccaaaaacattaaaagagtttataaataataataatccaataattaagaacagaatagaaaatttgatagcg

SEQ ID NO: 298854 - DNA, 75 bp, Artificial Sequence
  Synthetic
caacgagttatacgtatatgttatctgatgaggtgtatgtagcgaatgtaagcggtgtgctatcaacatacttta

SEQ ID NO: 298855 - DNA, 75 bp, Artificial Sequence
  Synthetic
aacgtgtctaatcctgaaccatttctaacatcaacactatgcctatattatccagtagaagcagagacagaaata

SEQ ID NO: 298856 - DNA, 75 bp, Artificial Sequence
  Synthetic
atgtaaatcaaataatccaagcaatgtccaagagatcacgatcactagattcagcagcgtttactacagaatcta

SEQ ID NO: 298857 - DNA, 75 bp, Artificial Sequence
  Synthetic
ctccctgactaaaggtattaatgttagtgctaatcttgattcatgtgtatcaatctcaactgataataaaaagga

SEQ ID NO: 298858 - DNA, 75 bp, Artificial Sequence
  Synthetic
catatgataaatataatgctgtcgaacgaaagctggttaagtacgcgaaaggtaaaccattagaggcggatctaa

SEQ ID NO: 298859 - DNA, 75 bp, Artificial Sequence
  Synthetic
acgaaagctggttaagtacgcgaaaggtaaaccattagaggcggatctaacggtgaatgaactagactatgaaaa

SEQ ID NO: 298860 - DNA, 75 bp, Artificial Sequence
  Synthetic
caatgcaattgatcgaagatttgtaatgtcaacctgagagcacactagggagctccccactcccgttttgtgacc

SEQ ID NO: 298861 - DNA, 75 bp, Artificial Sequence
  Synthetic
tgtttacattgcataaagcttcaattccaactatgaaaattgcacttaaaacatctaaatgttcatataaagtag

SEQ ID NO: 298862 - DNA, 75 bp, Artificial Sequence
  Synthetic
gaagaatgggagagtggaaaaaatccttatgaaccaaaggaagtgactgcagcaatgtgagaggttgagctgccg

SEQ ID NO: 298863 - DNA, 75 bp, Artificial Sequence
  Synthetic
atttactagagttaagagtaaatttgattatgtaatggatgattctggtgttaaaaacaaccttttaggcaaagc

SEQ ID NO: 298864 - DNA, 75 bp, Artificial Sequence
  Synthetic
gtaaataatctcagaatgattttatcttctaagggaattgaccaaaagatgagagtacttaatgcttgttttagc

SEQ ID NO: 298865 - DNA, 75 bp, Artificial Sequence
  Synthetic
acatgacaaaagaaattaaccagaagaacgttagaacgctagaagagtgggaagatggaaagaatccgtatgaac

SEQ ID NO: 298866 - DNA, 75 bp, Artificial Sequence
  Synthetic
tatgaaagataaaatagaacgaggagaggttgaagttgatgattcatttgttgatgaaaaaatggaaattgacac

SEQ ID NO: 298867 - DNA, 75 bp, Artificial Sequence
  Synthetic
ttgatgaaaaaatggaaattgacactattgactggaaggctcgttatgatcaattggaaaaaagatttgagtcat

SEQ ID NO: 298868 - DNA, 75 bp, Artificial Sequence
  Synthetic
gtaagccccatcggacctgatggctggctgagaagccacagtcagtcatatcgcgtgtggctcaagccttaatcc

SEQ ID NO: 298869 - DNA, 75 bp, Artificial Sequence
  Synthetic
agcgttatttgccttaactaccgctcagaattatggacttgatataccaatcaccggttcaatggatactgttta

SEQ ID NO: 298870 - DNA, 75 bp, Artificial Sequence
  Synthetic
tccttcaatttcttctagtatctttaaaaatgaatcgtcttctacaacgtcaactctttctggaaaatctattgg

SEQ ID NO: 298871 - DNA, 75 bp, Artificial Sequence
  Synthetic
tattgcaataaattggaagctgacctgcaaagcaaaattagttcattagtatcatcagttgagtggtatctgagg

SEQ ID NO: 298872 - DNA, 75 bp, Artificial Sequence
  Synthetic
ctcgattgatgctattaatcctattaatgctatagacgatcttgaatcattaatcagaaacttaatccaagatta

SEQ ID NO: 298873 - DNA, 75 bp, Artificial Sequence
  Synthetic
aatgctatagacgatcttgaatcattaatcagaaacttaatccaagattatgacagaacattcttgatgttgaaa

SEQ ID NO: 298874 - DNA, 75 bp, Artificial Sequence
  Synthetic
tattgaacgaatggatatgttatccaatgcaaataacattatattattatcagcaatcaggagaatcaaataagt

SEQ ID NO: 298875 - DNA, 75 bp, Artificial Sequence
  Synthetic
ttttgtttactctacataaagcgtcaattccaacaatgaaaatagcgttgagaacgtcgaagtgttcgtacaaag

SEQ ID NO: 298876 - DNA, 75 bp, Artificial Sequence
  Synthetic
tacatggttggctcagcaccttcatactggatgtacgatgtgaagcaatactctgattttatattcgaaacatgg

SEQ ID NO: 298877 - DNA, 75 bp, Artificial Sequence
  Synthetic
gattcgtatgttcaaataccagacggtaatgttattaagaaaatacagtacggagccgtggcatcaggagagaag

SEQ ID NO: 298878 - DNA, 75 bp, Artificial Sequence
  Synthetic
tatcccaaaaggagtattatattcatttataaataatgttattaccgataatgtatttatacaaccaccatttaa

SEQ ID NO: 298879 - DNA, 75 bp, Artificial Sequence
  Synthetic
tctaattggaactaatgtagaaaattcagtatcaggtcatgtgtataatgctttaatttattatagatataatta

SEQ ID NO: 298880 - DNA, 75 bp, Artificial Sequence
  Synthetic
ttccacatctgacatttggagttctatatatttcagacaacatgattccagatgtggtgaaaataatgaagaata

SEQ ID NO: 298881 - DNA, 75 bp, Artificial Sequence
  Synthetic
aaaaatatttcgcactaagaatgaggatgaagcgagtcgcaatgcaattgatcgaggatttgtaatgtcaacctg

SEQ ID NO: 298882 - DNA, 75 bp, Artificial Sequence
  Synthetic
caaaatcttgaattagatatgtcagagttagctgatttaatattgaatgaatggttatgtaatccaatggatata

SEQ ID NO: 298883 - DNA, 75 bp, Artificial Sequence
  Synthetic
aaaatcatcaaaagaagagtcaaaacagttacttgaaatattaaaaacgaaagaagatcatcagaaagaagtcca

SEQ ID NO: 298884 - DNA, 75 bp, Artificial Sequence
  Synthetic
atagctattggtcagtcaaaagaaatcgaaactactgctactgctgaaggaggagaaatagtatttcagaatgca

SEQ ID NO: 298885 - DNA, 75 bp, Artificial Sequence
  Synthetic
cgaacgttacagttaatccaggaccgtttgcacagactggatatgccccagttaactggggacatggtgagttat

SEQ ID NO: 298886 - DNA, 75 bp, Artificial Sequence
  Synthetic
taaagttggctggctataaagaacaggttactactaaagatgagattgaacaacagatggatagaattgttaaag

SEQ ID NO: 298887 - DNA, 75 bp, Artificial Sequence
  Synthetic
aaaaacggaacttattctcaatattcaacattatctacgtcaaataagttgtgtgcatggatgaaaagagaaggg

SEQ ID NO: 298888 - DNA, 75 bp, Artificial Sequence
  Synthetic
gtgtgcatggatgaaaagagaagggagagtatactggtatgcaggaactacaccgaatgcatcagaaagttatta

SEQ ID NO: 298889 - DNA, 75 bp, Artificial Sequence
  Synthetic
gaaattctacaaaaaacaataccgacttttgaaccaaaagaatcaattttgaaaaaattagaagacataagacca

SEQ ID NO: 298890 - DNA, 75 bp, Artificial Sequence
  Synthetic
tctaacgataaataatgatgatagcaatgtgtcatgtgatgctgagttttatttgatacctagatcacaaactga

SEQ ID NO: 298891 - DNA, 75 bp, Artificial Sequence
  Synthetic
atttattgattatatattaaaatcaattactagaacaatggactttataatttatagatttttattggttgtagt

SEQ ID NO: 298892 - DNA, 75 bp, Artificial Sequence
  Synthetic
tttttgacttcaacattatgtttatattatccaaacgaagcagctactgaaatcgcagatgacaaatggacagac

SEQ ID NO: 298893 - DNA, 75 bp, Artificial Sequence
  Synthetic
cagctggggttacgttgtcaacacaatttactgactatgtatcacttaattcactaagattcagatttaggttag

SEQ ID NO: 298894 - DNA, 75 bp, Artificial Sequence
  Synthetic
agggatggccaacgggttcagtttattttaaaggctacgcagatattgcatcattttccgtagaaccacagttat

SEQ ID NO: 298895 - DNA, 75 bp, Artificial Sequence
  Synthetic
aaattgtttagaatatttgaaccaaggcaattaccaatttatcgagcaaatggtgagaaagaattgagaaacaga

SEQ ID NO: 298896 - DNA, 75 bp, Artificial Sequence
  Synthetic
ctagtaccaactaatgatgactatcagacaccaatagctaattcagtgacagtgagacaagatttagagaggcag

SEQ ID NO: 298897 - DNA, 75 bp, Artificial Sequence
  Synthetic
gatatgtctgaattagctgatttaatattaaatgaatggttgtgtaatccaatggatataacattatattattat

SEQ ID NO: 298898 - DNA, 75 bp, Artificial Sequence
  Synthetic
ggatatctatgggttcttcatgtacgattaaagtatgtcctctgaatacacaaactcttggaataggatgtttaa

SEQ ID NO: 298899 - DNA, 75 bp, Artificial Sequence
  Synthetic
tttggagaacgatagctataaatttattccttttaataatttagcaataaaatgcatgttgacagcaaaagtaga

SEQ ID NO: 298900 - DNA, 75 bp, Artificial Sequence
  Synthetic
tttccggaattaaatcaacagtggaagcggtgaagtctatgactacaaatattatgaagaagtttaaaacatcga

SEQ ID NO: 298901 - DNA, 75 bp, Artificial Sequence
  Synthetic
gatgcgaatcagtactgccatacaaactggggaagatctaaggacagtggctgatgcatcaacgcagatatcaaa

SEQ ID NO: 298902 - DNA, 75 bp, Artificial Sequence
  Synthetic
gtggcaagtattttatacgatagtagactatgtcaatcaaattgtacaagtcatgtctaagcgatcacgttcttt

SEQ ID NO: 298903 - DNA, 75 bp, Artificial Sequence
  Synthetic
tgagaataatatagtttatttacatgattattcatactatactaataatgaaataagaactgatcagcattgggt

SEQ ID NO: 298904 - DNA, 75 bp, Artificial Sequence
  Synthetic
actttaaaaccaatattgtataaaataaattctgattctaatgatttctatttagttgcaaattatgattggata

SEQ ID NO: 298905 - DNA, 75 bp, Artificial Sequence
  Synthetic
aaaaatttaacaagttgatcacagactcaccagtactatcagctataattgactttaaaacactgaagaatttga

SEQ ID NO: 298906 - DNA, 75 bp, Artificial Sequence
  Synthetic
atcctataattagaaatagaatagaaaatttgatagcacaatgtagattgtaactgtctgtttcaagatgtgacc

SEQ ID NO: 298907 - DNA, 75 bp, Artificial Sequence
  Synthetic
aatggaaagtttggctcagctattagaaatagaaattggatgactgattctaaaacggttgctaaattagatgaa

SEQ ID NO: 298908 - DNA, 75 bp, Artificial Sequence
  Synthetic
agaaatcaacgaaagaagaatctaaacaattacttgaagtgttgaaaacaaaagaagagcaccaaaaagaaatac

SEQ ID NO: 298909 - DNA, 75 bp, Artificial Sequence
  Synthetic
aaccagaacaggcaaagaaacaaacaaagttattcagaatatttgaaccaaaacaattaccaatatatagggtga

SEQ ID NO: 298910 - DNA, 75 bp, Artificial Sequence
  Synthetic
agacaacgtgtgcaagctgatagaaatgttgttaattatccatcaatattgcatccaatagattatgctttcaat

SEQ ID NO: 298911 - DNA, 75 bp, Artificial Sequence
  Synthetic
acatggatagaaatttgccatcaacagccagatacataagaccaaatttactacaggatagattgaatttacatg

SEQ ID NO: 298912 - DNA, 75 bp, Artificial Sequence
  Synthetic
actaaatgataatatcagaaatggacatgtcattaatcaattgatggaggctttaatgcaattgtcacgacaaca

SEQ ID NO: 298913 - DNA, 75 bp, Artificial Sequence
  Synthetic
tgagtcaacgaaccatgtcacttgattttgtgactactaactacatgtcactaatctcaggcatgtggttattaa

SEQ ID NO: 298914 - DNA, 75 bp, Artificial Sequence
  Synthetic
ccatcaacagcaagatatattagaccaaatctattgcaagatagactaaatttacatgataattttgaatcatta

SEQ ID NO: 298915 - DNA, 75 bp, Artificial Sequence
  Synthetic
atcagagtcgatggtgatgataattatgcagtgctacaatttaacactgatgtcactaaacaaatggttcaagat

SEQ ID NO: 298916 - DNA, 75 bp, Artificial Sequence
  Synthetic
aatgccagttgattataagaggtcgattcagcgtggaatactgttgctatctaatagacttggacaattagttga

SEQ ID NO: 298917 - DNA, 75 bp, Artificial Sequence
  Synthetic
tatctgataatatgatacatgatgtaatcacagtgttgaagaaaatgaagacagagctatttaaaatggaaatta

SEQ ID NO: 298918 - DNA, 75 bp, Artificial Sequence
  Synthetic
caaacacttaacgataatattaggaatggacaagttattaatcagttaatggaagcattaatgcagttatctaga

SEQ ID NO: 298919 - DNA, 75 bp, Artificial Sequence
  Synthetic
gttttagcaacaaacagacggttagaatagaaagtacaaaactcagaatcaattcaatttacttaagaaagatta

SEQ ID NO: 298920 - DNA, 75 bp, Artificial Sequence
  Synthetic
tagctaaattagtttcatctccaatgtcaatattggtcgcactgatagatattaatggtacattcataacgaatg

SEQ ID NO: 298921 - DNA, 75 bp, Artificial Sequence
  Synthetic
tggtttagtagacataccaagaatgattcaagaatggctggttgattgttcattagaaaaatttacgttgatgtc

SEQ ID NO: 298922 - DNA, 75 bp, Artificial Sequence
  Synthetic
ttataatactagtgataattcaagaggcatgaattatgaaacaactatgtttaataaggtggctattttaatttg

SEQ ID NO: 298923 - DNA, 75 bp, Artificial Sequence
  Synthetic
ttacttgcattcgtgtcagctgatacagtagaacctataaatgcagttgcgtttgataacatgcgcatcatgaac

SEQ ID NO: 298924 - DNA, 75 bp, Artificial Sequence
  Synthetic
tgatgtatgcaagaaactactcttccaaaagatgaaacaagagaaaaatccatttaaaggattgtcaactgatag

SEQ ID NO: 298925 - DNA, 75 bp, Artificial Sequence
  Synthetic
gaaataagaacagatcagcattggataactaaaactgatataattaactatctattacctggatggaaattaaca

SEQ ID NO: 298926 - DNA, 75 bp, Artificial Sequence
  Synthetic
tggtgagagagaattaagaaatagatggtattggaagttgaaaagagacacactgccagatggagattatgatgt

SEQ ID NO: 298927 - DNA, 75 bp, Artificial Sequence
  Synthetic
aatttaaattcagtgaaatgtacaggtggaagttatgattttagtatacctgtgggtgcatggccagttatgaat

SEQ ID NO: 298928 - DNA, 75 bp, Artificial Sequence
  Synthetic
tactactgacactacgacttttgaagaagttgcaacagctgagaaattggcaataacggacgttgttgatggagt

SEQ ID NO: 298929 - DNA, 75 bp, Artificial Sequence
  Synthetic
ttgattatgtaaaccagataattcaagcaatgtccaaaagatctagatcattagattcagcggctttttactata

SEQ ID NO: 298930 - DNA, 75 bp, Artificial Sequence
  Synthetic
attcagttttatatatagacataagaactgatagaggaaatatggattggaaagagtggagaaaaatagtagaac

SEQ ID NO: 298931 - DNA, 75 bp, Artificial Sequence
  Synthetic
agaatgatattgaacagcagttaaattcaattgatttaattaatcccattaatgctatagatgatatcgaatcat

SEQ ID NO: 298932 - DNA, 75 bp, Artificial Sequence
  Synthetic
tttcttcgtgagtcgttagttgcatgtgagttggctataataaatactattgtttatccagcatttggaatgcaa

SEQ ID NO: 298933 - DNA, 75 bp, Artificial Sequence
  Synthetic
aagtattttatactatagtagattatattaaccagattgtacaggtaatgtccaaaagatcaagatcattaaatt

SEQ ID NO: 298934 - DNA, 75 bp, Artificial Sequence
  Synthetic
tagattatattaatcagattgtacaggtaatgtccaaaagatcaagatcattaaattctgcagctttttattata

SEQ ID NO: 298935 - DNA, 75 bp, Artificial Sequence
  Synthetic
aaactatggaataaatttgccgattactggatctatggatacggtatacgctaattcaacacaaaataataattt

SEQ ID NO: 298936 - DNA, 75 bp, Artificial Sequence
  Synthetic
ctaattcaacacaaaataataattttctatcatcaacgttatgcctttattacccagctgaagctagaacacaaa

SEQ ID NO: 298937 - DNA, 75 bp, Artificial Sequence
  Synthetic
gatggtgacgtttattacgtatttgggtattatgataacatgaataatattaatcaaactccattctcatttata

SEQ ID NO: 298938 - DNA, 75 bp, Artificial Sequence
  Synthetic
tagctgaaaatgaaaaactagcaatagttgacgttgttgatggtgtaaatcataaattaaatgtcacgtccacaa

SEQ ID NO: 298939 - DNA, 75 bp, Artificial Sequence
  Synthetic
ctaccagatgtagaatattcacacaatgtaaactcaaaatggcatctaaattaatcaaaccaaactatataacct

SEQ ID NO: 298940 - DNA, 75 bp, Artificial Sequence
  Synthetic
gttgagttgtcagatgaaattaaaacaattggatcagagaagagtcaaaatataacgattaatcctggaccgttc

SEQ ID NO: 298941 - DNA, 75 bp, Artificial Sequence
  Synthetic
ttaaaccaccaaatgattattggctactattaaacccaactaaccaacaaattgtattagaagctactaatcgaa

SEQ ID NO: 298942 - DNA, 75 bp, Artificial Sequence
  Synthetic
agaatgttattacaatcatgcaatctatcatatatgaatggtttgatataagatacatgaggaatacaccaatgg

SEQ ID NO: 298943 - DNA, 75 bp, Artificial Sequence
  Synthetic
tgcaccagtttatttagaaaaacgtcgtgcacaaatatcagcgctattaactatgttgcagaaaccagtgtcatt

SEQ ID NO: 298944 - DNA, 75 bp, Artificial Sequence
  Synthetic
taattcaaacagatggaagttttttgaaatgtttagaaataatattaacgcggagtttcaacataaacgcacttt

SEQ ID NO: 298945 - DNA, 75 bp, Artificial Sequence
  Synthetic
tcaaatttatctgatatagaagctataatacacaccgagttttatataataccaagatcacaggaggctaagtgt

SEQ ID NO: 298946 - DNA, 75 bp, Artificial Sequence
  Synthetic
taatacacaccgagttttatataataccaagatcacaggaggctaagtgtaaagaatacataaacactggattac

SEQ ID NO: 298947 - DNA, 75 bp, Artificial Sequence
  Synthetic
aacatcgttatggaaagaaatgcagtataatagagatattataataagatttaaatttaacaatagtataataaa

SEQ ID NO: 298948 - DNA, 75 bp, Artificial Sequence
  Synthetic
tataatagagatattataataagatttaaatttaacaatagtataataaaacttggtgggttgggctataaatgg

SEQ ID NO: 298949 - DNA, 75 bp, Artificial Sequence
  Synthetic
attatcaatacaattattcacgagacggagaacaagtgacagcacatactacatgctcagttaacggtgtgaata

SEQ ID NO: 298950 - DNA, 75 bp, Artificial Sequence
  Synthetic
ttccaccagttgacgcaggcacgtacgttggatcaagaatatattcgcaggataagtataaaatattagaatctt

SEQ ID NO: 298951 - DNA, 75 bp, Artificial Sequence
  Synthetic
ataacatacgctgatgaccctaattatttcattggaattaaatttaaaaatattccttataaatatagcgttaaa

SEQ ID NO: 298952 - DNA, 75 bp, Artificial Sequence
  Synthetic
gattttgtatcacttaattcattaagatttaggtttagtttgactgttgaagagccgtctttttcaatcttacgc

SEQ ID NO: 298953 - DNA, 75 bp, Artificial Sequence
  Synthetic
cattgatggatccagcaattctgacttccttgtcatcaaatttaaacgcagttatgttttggttggaaaaacacg

SEQ ID NO: 298954 - DNA, 75 bp, Artificial Sequence
  Synthetic
agattttctctcatatcattagtaccatccaacgatgactaccaaactccaattatgaattcagttactgtgcga

SEQ ID NO: 298955 - DNA, 75 bp, Artificial Sequence
  Synthetic
tagatatgttttccatgttctcaggtattaaaagtacaattgatgtagctaaatcaatggctacaaatgtaatga

SEQ ID NO: 298956 - DNA, 75 bp, Artificial Sequence
  Synthetic
aagcatatcgtctatttctgcatggacggatgtttccgggcaaatattagactcatcaaattccattagaaatat

SEQ ID NO: 298957 - DNA, 75 bp, Artificial Sequence
  Synthetic
tatgtagactattgggatgattcaaaagcatttagaaatatggtatatgttagatcattagcagctaatctgaat

SEQ ID NO: 298958 - DNA, 75 bp, Artificial Sequence
  Synthetic
gttaaattaactgctatggacctagaattaccaataacagcaaaattacttcatcatccaactactgaagttaga

SEQ ID NO: 298959 - DNA, 75 bp, Artificial Sequence
  Synthetic
aaaagattacggctacgtgaaattactacgcagactgagggtatgagttttgatgacatatcagcagcagtactt

SEQ ID NO: 298960 - DNA, 75 bp, Artificial Sequence
  Synthetic
ttctaaaagatgatgaagtaatggaggctgatgtagatgggaaattctttgcatataaggttggtactttcgaag

SEQ ID NO: 298961 - DNA, 75 bp, Artificial Sequence
  Synthetic
gagttttacgcgattttattaatcaaaataatccaattataaaaaatagaattgagcagcttatacttcagtgta

SEQ ID NO: 298962 - DNA, 75 bp, Artificial Sequence
  Synthetic
gttgaaggtacattatattcaaatgtaagtgatttgattcaacaatttaatcaaatgatagttactatgaatgga

SEQ ID NO: 298963 - DNA, 75 bp, Artificial Sequence
  Synthetic
accacaatctgaagcactaagaaagctgtcgggtattaaatttaagagaattaattttgataattcatctgatta

SEQ ID NO: 298964 - DNA, 75 bp, Artificial Sequence
  Synthetic
tacgcttagttttagcaacaaacagacggttagaatagaaagtacaaaactcagaatcaattcaatttacttaag

SEQ ID NO: 298965 - DNA, 75 bp, Artificial Sequence
  Synthetic
aggcgacagcgcactggatttgtatttcataaaccaaatatacttccatattcagcatcatttactctaaatcga

SEQ ID NO: 298966 - DNA, 75 bp, Artificial Sequence
  Synthetic
gacatggaggttctgtactcattgtcaaaaactcttaaagatgctagggataaaattgttgaaggtacactatac

SEQ ID NO: 298967 - DNA, 75 bp, Artificial Sequence
  Synthetic
gattgataaactgactacacgtgaaattgagcaagtagagctacttaaacgtatatatgataaattgatggtgca

SEQ ID NO: 298968 - DNA, 75 bp, Artificial Sequence
  Synthetic
tatgaaaataataaaataacatctgagttatttccaacagcggaagaatacactgactcattaatggatccagca

SEQ ID NO: 298969 - DNA, 75 bp, Artificial Sequence
  Synthetic
acatttgatgagttaaaacagatgctcgataacatgaggaaagctggattggttgatatacctaaaatgatccag

SEQ ID NO: 298970 - DNA, 75 bp, Artificial Sequence
  Synthetic
tttcttatctctaatcttactacacataatattttatatctaaattatagtatgaaaacgctagaaatcttaaat

SEQ ID NO: 298971 - DNA, 75 bp, Artificial Sequence
  Synthetic
tatgaaaacgctagaaatcttaaataaatctggaattgcggctattgagattcaatctcttgaagaattattcac

SEQ ID NO: 298972 - DNA, 75 bp, Artificial Sequence
  Synthetic
ttctattttatttgatatcattcgttcttgtgagttacattttgaaaacagtaacaaaaataatggactatatta

SEQ ID NO: 298973 - DNA, 75 bp, Artificial Sequence
  Synthetic
tttaatcagatgcaatttcacatatgattatgagaataacataatttatttgcacgactattcatattacacaaa

SEQ ID NO: 298974 - DNA, 75 bp, Artificial Sequence
  Synthetic
tgcacgactattcatattacacaaacaatgaaatacgaactgatcagcattggatcactaaaactaatattgagg

SEQ ID NO: 298975 - DNA, 75 bp, Artificial Sequence
  Synthetic
gacgtatgtaggatataatggaaacgacacacgaggacattataatttttcattcacatgtcaaaatgctgctac

SEQ ID NO: 298976 - DNA, 75 bp, Artificial Sequence
  Synthetic
aacgcgtctttacagtagcttccattagaagcatgttgattaagtgaggaccagactaaacatctggtatccaat

SEQ ID NO: 298977 - DNA, 75 bp, Artificial Sequence
  Synthetic
tagaagcatgttgattaagtgaggaccagactaaacatctggtatccaatcttagttgatatgtagctacatcaa

SEQ ID NO: 298978 - DNA, 75 bp, Artificial Sequence
  Synthetic
cagcagactggggaagctaataaatggatatcgatgggatcgtcatgtactatcaaagtgtgtccattgaatact

SEQ ID NO: 298979 - DNA, 75 bp, Artificial Sequence
  Synthetic
aacgttggacctagaaatgagtcaatgttcacgttcttaaattttccatctattaaacaattttcaaatggtccg

SEQ ID NO: 298980 - DNA, 75 bp, Artificial Sequence
  Synthetic
gatccacttgacactccatattcatccgtacatcataaagaattattcttcgaaaaagatatagataaattgaaa

SEQ ID NO: 298981 - DNA, 75 bp, Artificial Sequence
  Synthetic
atcttgcatatcagtacttagctactggtaaatcaaaagtatgttgtgttaaactaacagctatggatttagagc

SEQ ID NO: 298982 - DNA, 75 bp, Artificial Sequence
  Synthetic
ttataaatttttacttatagtcacaattacttcaatctttgtcaatgcacagaattatgggataaatttaccaat

SEQ ID NO: 298983 - DNA, 75 bp, Artificial Sequence
  Synthetic
tttataaataatgttatcaccgataatgtatttatacaaccaccatttaaaattaaaacatctatgaatgattat

SEQ ID NO: 298984 - DNA, 75 bp, Artificial Sequence
  Synthetic
atgcaccaatatcacttgaaaagagacgtgcgcagatatcagctttactaacaatgttacagaaaccagttactt

SEQ ID NO: 298985 - DNA, 75 bp, Artificial Sequence
  Synthetic
aacaaacagatgaagcaaataaatggatagcgatgggacaatcatgtacaataaaagtgtgtccattgaacactc

SEQ ID NO: 298986 - DNA, 75 bp, Artificial Sequence
  Synthetic
aaccgacaggaaacaatcatttattcattctaaatggaacagaaaaatattataaattggatcaatttgcaaatc

SEQ ID NO: 298987 - DNA, 75 bp, Artificial Sequence
  Synthetic
aacaaatactagaacatttgaagaagtggcaacagctgaaaaactagtaatcactgacgtagttgacggtgtgaa

SEQ ID NO: 298988 - DNA, 75 bp, Artificial Sequence
  Synthetic
aagaaagatggttaggcaagagagtatcacaatttgacattgggcaatataaaaatatgttaaatgtggttacta

SEQ ID NO: 298989 - DNA, 75 bp, Artificial Sequence
  Synthetic
gatgcgaataaactggaaaaaatggtggcaagtattttacactatagtcgattatgtgaaccaaattgtacaagc

SEQ ID NO: 298990 - DNA, 75 bp, Artificial Sequence
  Synthetic
atatcgaaggcggaaagtattatgaacatgctcctatagaattaatatacgcttgtagatcagcaaaggaattcg

SEQ ID NO: 298991 - DNA, 75 bp, Artificial Sequence
  Synthetic
tccagttatatcagcaataatcgattttaagacattaaaaaatttaaatgataattatggaattactcgaactga

SEQ ID NO: 298992 - DNA, 75 bp, Artificial Sequence
  Synthetic
tgttctaactgtactatttacattacataaggcttcaattccaaccatgaaaatcgctcttaaaacatcaagatg

SEQ ID NO: 298993 - DNA, 75 bp, Artificial Sequence
  Synthetic
cataaggcttcaattccaaccatgaaaatcgctcttaaaacatcaagatgttcgtataaagtaatcaaatattgc

SEQ ID NO: 298994 - DNA, 75 bp, Artificial Sequence
  Synthetic
tgaagttggctggatataaagagcagattactactaaagatgagattgaaaaacaaatggacagagttgtaaaag

SEQ ID NO: 298995 - DNA, 75 bp, Artificial Sequence
  Synthetic
tgaaacaagaactgtttacaatggatgttacaacaagctatacttatatgctatctgatggaatatatgtggcaa

SEQ ID NO: 298996 - DNA, 75 bp, Artificial Sequence
  Synthetic
aataatgtaatcacagagaatgtatttatacaacctccttttaagttaaaaacatcacctaatgattatatagtg

SEQ ID NO: 298997 - DNA, 75 bp, Artificial Sequence
  Synthetic
gtgagaatagagactactaaactgaaaattaaatcaatatacttaagaaaaattagaggagatacagtgtttgat

SEQ ID NO: 298998 - DNA, 75 bp, Artificial Sequence
  Synthetic
cgctgaatgagtgggctgagggtgaaaatccatatgaatctagagaagtgactgcatcattgtgagaggttgagc

SEQ ID NO: 298999 - DNA, 75 bp, Artificial Sequence
  Synthetic
ctaattactgttcgtataaataatacttttaaagatgaaccaaaagttaattttaaaaatatttatgattggaca

SEQ ID NO: 299000 - DNA, 75 bp, Artificial Sequence
  Synthetic
cgttataatactaatgacaattcaaggggtatgaactatgaaactccaatgtttaataaggtggcagctctaatt

SEQ ID NO: 299001 - DNA, 75 bp, Artificial Sequence
  Synthetic
aacttctccacaaacagaacgaatgatgcgcgtaaactggaaaaaatggtggcaagtattctatactgtagttga

SEQ ID NO: 299002 - DNA, 75 bp, Artificial Sequence
  Synthetic
agtggatgtcgttgatgggataaatcataaaataaatttgacaactacaacatgtactattcgaaattgtaagaa

SEQ ID NO: 299003 - DNA, 75 bp, Artificial Sequence
  Synthetic
tattgaattatatattaaaaactataactaatacgatggactatataatttttaggtttttactactcatcgctc

SEQ ID NO: 299004 - DNA, 75 bp, Artificial Sequence
  Synthetic
aatgcctattctggaccagaatttcattgaatataaaattactgtaaatgaagataaaccaatttcagatgtaca

SEQ ID NO: 299005 - DNA, 75 bp, Artificial Sequence
  Synthetic
tttactacagatataattatgcatttgatcttaaaagatggatttatctacattcaattggagaagtcactgtag

SEQ ID NO: 299006 - DNA, 75 bp, Artificial Sequence
  Synthetic
aacatggatgtccttttttcgttatcaaagactcttaaagatgccagagacaaaatcgtcgaaggcactctctac

SEQ ID NO: 299007 - DNA, 75 bp, Artificial Sequence
  Synthetic
cgggcagataataaatacttaccaagcaagatttggaacaatcatagctagaaattttgatacaatcagattgtc

SEQ ID NO: 299008 - DNA, 75 bp, Artificial Sequence
  Synthetic
tctatcgcaattatttttaactaaaggatggccgactggatcagtttattttaaagactacaatgatattactac

SEQ ID NO: 299009 - DNA, 75 bp, Artificial Sequence
  Synthetic
ccactattgatttctttgttgattttgttgataatgtgtgtatggacgaaatggtgcgggaatctcaaagaaacg

SEQ ID NO: 299010 - DNA, 75 bp, Artificial Sequence
  Synthetic
tggacaagttattaatcaattaatggaagcattaatgcagttatctagacaacaatttccaactatgccagttga

SEQ ID NO: 299011 - DNA, 75 bp, Artificial Sequence
  Synthetic
acaaaatagaaggcagagaacaggatttacatttcataaaccaaacattttcccatactcattttcgttcacatt

SEQ ID NO: 299012 - DNA, 75 bp, Artificial Sequence
  Synthetic
aacgctccagctaatactcaacaatttgaacatattgttcagttgcgtcgtgtgcttacaacagctactattact

SEQ ID NO: 299013 - DNA, 75 bp, Artificial Sequence
  Synthetic
gtgaataaacttagaatgatgctgtcttctaaagggattgatcaaaagatgagagtacttaatgcttgtttcagc

SEQ ID NO: 299014 - DNA, 75 bp, Artificial Sequence
  Synthetic
actaggaccacgagaaaatgttgctataattcaagttggtggaccgaacgcactagatatcactgctgatccaac

SEQ ID NO: 299015 - DNA, 75 bp, Artificial Sequence
  Synthetic
atgtagaagttgaattccttttaaatggtcaaattatcaatacttatcaagcaagatttggaactattactgcta

SEQ ID NO: 299016 - DNA, 75 bp, Artificial Sequence
  Synthetic
taacaggatcaatggataccgcatacgctaactctactcaagaagagacatttttaacatctacattatgtctat

SEQ ID NO: 299017 - DNA, 75 bp, Artificial Sequence
  Synthetic
tcaagatcattagacacagctgctttttattatagaatttagatatagcttagattagaattgtatgatgtgacc

SEQ ID NO: 299018 - DNA, 75 bp, Artificial Sequence
  Synthetic
ggctattaaaggctcaatggcgtacaggaaacgtggagcgcgccgtgaggcgaatataaataataatgaccgaat

SEQ ID NO: 299019 - DNA, 75 bp, Artificial Sequence
  Synthetic
aatcaatgatggtgaatggaaagatacactgtcacaaatgtttcttacgaaaggctggccaacaggatcggtcta

SEQ ID NO: 299020 - DNA, 75 bp, Artificial Sequence
  Synthetic
tcacgcaacagttggattaactctaagaatcgattcagcaatttgtgagtcagttctagcagacgccaatgaaac

SEQ ID NO: 299021 - DNA, 75 bp, Artificial Sequence
  Synthetic
ggaagtcgtaaccgacagtcaagaagaaattaaaattgctgatgaagtgaagaaatcgacgaaagaagaatctaa

SEQ ID NO: 299022 - DNA, 75 bp, Artificial Sequence
  Synthetic
aaagaagagcaccaaaaagagatacaatatgaaattttgcaaaaaacgataccaacatttgaaccaaaagagtca

SEQ ID NO: 299023 - DNA, 75 bp, Artificial Sequence
  Synthetic
caacaaatgttgattcttttgaaatcgtcgctgaaaatgaaaaattagccatagtagatgtcgtcgacggtataa

SEQ ID NO: 299024 - DNA, 75 bp, Artificial Sequence
  Synthetic
atagtagatgtcgtcgacggtataaatcataaaataaatttaacaaccaccacatgtacaattcgaaattgcaag

SEQ ID NO: 299025 - DNA, 75 bp, Artificial Sequence
  Synthetic
caaatgatgtcgctgatgcaaacaaaatttataaacgtagattagatctgttcactatagtagcatctacagtga

SEQ ID NO: 299026 - DNA, 75 bp, Artificial Sequence
  Synthetic
atggtattggaagctgaagaaagatactttaccagatggagattatgatgttagagaatactttctaaatttgta

SEQ ID NO: 299027 - DNA, 75 bp, Artificial Sequence
  Synthetic
acagcaagtatctgtgatgctatatttcaagatgaggaaacagaaggtgcagtgagacgattcattgcggagatg

SEQ ID NO: 299028 - DNA, 75 bp, Artificial Sequence
  Synthetic
cgccatatttcaagatgaggaaacagaaggagtcattagaagattcattgcagatatgaggcaacaagttcaagc

SEQ ID NO: 299029 - DNA, 75 bp, Artificial Sequence
  Synthetic
aggaatgacgttaactatatacttaatatggacagaaatctgccatcaacagctagatatataagacctaattta

SEQ ID NO: 299030 - DNA, 75 bp, Artificial Sequence
  Synthetic
tatgagacaacaagttcaagctgatagaaatattgtcaattatccatcaattttacatccaattgatcatgcatt

SEQ ID NO: 299031 - DNA, 75 bp, Artificial Sequence
  Synthetic
aaagaatgactacttccttgccgatagcacgtttatcaaatagagtttttagagataaattatttccatcactaa

SEQ ID NO: 299032 - DNA, 75 bp, Artificial Sequence
  Synthetic
ttggctgcattttgtcaataacaatcaatttagacaagtagttattgatggtgtattgaatcaggtgctgaatga

SEQ ID NO: 299033 - DNA, 75 bp, Artificial Sequence
  Synthetic
gatagcagaacagcagatacagaattttcaagtagctaattggctacactttatcaacaataatagatttagaca

SEQ ID NO: 299034 - DNA, 75 bp, Artificial Sequence
  Synthetic
caatattagaaatggacatgtcattaatcaattgatggaagctttaatgcaactatcacgacaacagtttccaac

SEQ ID NO: 299035 - DNA, 75 bp, Artificial Sequence
  Synthetic
gatgtgtcacaatgggattcgtcacagcataacacacagcctttcaggaaaggaataattatgggattagatatg

SEQ ID NO: 299036 - DNA, 75 bp, Artificial Sequence
  Synthetic
tgaagtaattaaagaaaattcatttgtttacattgattattgggatgattcacaagcattcagaaatatggtgta

SEQ ID NO: 299037 - DNA, 75 bp, Artificial Sequence
  Synthetic
ttacattatctacccaattcactgattttgtatctcttaattcattacgctttagattcaggttaactgtgggag

SEQ ID NO: 299038 - DNA, 75 bp, Artificial Sequence
  Synthetic
gtagctagagttccagatgatcaaatgtatagattaagggatagactacgactattgccagtagaagtaagacga

SEQ ID NO: 299039 - DNA, 75 bp, Artificial Sequence
  Synthetic
actattgccagtagaagtaagacgattggatatttttaatttgatactgatgaacatggatcagatagaacgcgc

SEQ ID NO: 299040 - DNA, 75 bp, Artificial Sequence
  Synthetic
actggtatttcgagaagatcacatcaaattagattttcagaatctgcgacatcatattcaggatatatatttaga

SEQ ID NO: 299041 - DNA, 75 bp, Artificial Sequence
  Synthetic
cacatttaaagtatttgattcagaagattttattatagaatatggaacaactgacgatgaggtgtatatacagag

SEQ ID NO: 299042 - DNA, 75 bp, Artificial Sequence
  Synthetic
agcattcatgtcattatccagtcagaaatcaggaatagctgatgagatcgcctcatcacaaacatttaaaaacta

SEQ ID NO: 299043 - DNA, 75 bp, Artificial Sequence
  Synthetic
gaaaccaatattgtataaaataaattcagattcgaatgacttttacctagttgccaactatgattgggtgcctac

SEQ ID NO: 299044 - DNA, 75 bp, Artificial Sequence
  Synthetic
atatataaataaagtatatagtataacatatgcagatgatccaaattattttataggtattaaatttagatacat

SEQ ID NO: 299045 - DNA, 75 bp, Artificial Sequence
  Synthetic
tgacttattacgatcagatccaaaagtattacgtgagtttatcaatcagaataatccaataatacggaatagaat

SEQ ID NO: 299046 - DNA, 75 bp, Artificial Sequence
  Synthetic
aagaatagaaactactaaactgaagattagttcaatatatttaagaaaaattaaaggagatacggtgtttgatat

SEQ ID NO: 299047 - DNA, 75 bp, Artificial Sequence
  Synthetic
gttgatgcgggtacatatgttggatcaagaatatattcacaggataaatataaaatattagaatcttatgtgtac

SEQ ID NO: 299048 - DNA, 75 bp, Artificial Sequence
  Synthetic
ctgtaacattcatattacatctttatgcgaaacttgaaataataaattacgctattaaaaatagagcttggatca

SEQ ID NO: 299049 - DNA, 75 bp, Artificial Sequence
  Synthetic
aacactaatgataattcaagaggtatgaattttgaaacacaaatgtttactaaggtagcattgttgatttgtgaa

SEQ ID NO: 299050 - DNA, 75 bp, Artificial Sequence
  Synthetic
taaggtagcattgttgatttgtgaagctctcaactcactaaagatcactcaggcagatgttgcaaatgtattgtc

SEQ ID NO: 299051 - DNA, 75 bp, Artificial Sequence
  Synthetic
cttatagctattggacaatcgaaagaaatcgaaactacagctacagctgaaggaggagaaattgtatttcaaaac

SEQ ID NO: 299052 - DNA, 75 bp, Artificial Sequence
  Synthetic
atatgaagtaatgaaagataaaccatattatttagtaacttgggcaaattcagctatagaaatgttaatgtcagt

SEQ ID NO: 299053 - DNA, 75 bp, Artificial Sequence
  Synthetic
aaatcgaaactacagctacagctgaaggaggagaaattgtatttcaaaacactgctttcactatgtggaaactga

SEQ ID NO: 299054 - DNA, 75 bp, Artificial Sequence
  Synthetic
cacaagcttgatgtaaccacagctacttgtactattagaaattgcaaaaaattgggaccacgagaaaatgtggct

SEQ ID NO: 299055 - DNA, 75 bp, Artificial Sequence
  Synthetic
ttatgtgaatcagataatccaattgatgtccaaaagatcgcgatcgttgaattccgctgcattttactatagagt

SEQ ID NO: 299056 - DNA, 75 bp, Artificial Sequence
  Synthetic
agttaaatactcatcagttgctaatcatgcagacagagtttacgctacttttaaaaataataataaatctggaat

SEQ ID NO: 299057 - DNA, 75 bp, Artificial Sequence
  Synthetic
ggcttttaatgcttttcagtggttgatgctcaagatggagtctacacagcagatggctagctcgattatcaacac

SEQ ID NO: 299058 - DNA, 75 bp, Artificial Sequence
  Synthetic
atgctcaagatggagtctacacagcagatggctagctcgattatcaacacttcttttgaagccgcagtcgttgct

SEQ ID NO: 299059 - DNA, 75 bp, Artificial Sequence
  Synthetic
cagagaataatttggcaaaactggtatgcattcacatcttcaatgaaacaaggaaatgctctcgatgtttgtaaa

SEQ ID NO: 299060 - DNA, 75 bp, Artificial Sequence
  Synthetic
tggattactatcaatgtcatcagcttcaaatggtgaatcaagacaattaaaatttggtcgtaaaacaatattttc

SEQ ID NO: 299061 - DNA, 75 bp, Artificial Sequence
  Synthetic
catctagaggaattgatcaaaagatgagagtacttaatgcgtgtttcagtgtgaagagaattccaggtaaatcat

SEQ ID NO: 299062 - DNA, 75 bp, Artificial Sequence
  Synthetic
aatagattgggtcagttagttgatttaacaagattattatcatataattatgaaactctaatggcctgtataact

SEQ ID NO: 299063 - DNA, 75 bp, Artificial Sequence
  Synthetic
aagcccgattgctgatttacaacattactgtaataaattggaagttgatctacaaaataaaattagttcacttgt

SEQ ID NO: 299064 - DNA, 75 bp, Artificial Sequence
  Synthetic
aatgattcacacttttcaattaatgtgttagagaacttacataatccaagtttcaaagtacagattacacgtaat

SEQ ID NO: 299065 - DNA, 75 bp, Artificial Sequence
  Synthetic
aatgatgcagtagcaattattacagcagccaatagattgaatttatatcagaaaaagatgaagtcaatagttgaa

SEQ ID NO: 299066 - DNA, 75 bp, Artificial Sequence
  Synthetic
tactgaggtacacaattgcaagtggtgttcagttaataatagttatactgtatggaatgattttagaattaagaa

SEQ ID NO: 299067 - DNA, 75 bp, Artificial Sequence
  Synthetic
tgattagaaatattatactcgattatgatggaatatttttaatgtttaaaggactaatgaggcaatgcaactatg

SEQ ID NO: 299068 - DNA, 75 bp, Artificial Sequence
  Synthetic
aatatacgtatgaatagtcacataatctaactaaattaccatcttcacatgaccctctatgagcacaatagttaa

SEQ ID NO: 299069 - DNA, 75 bp, Artificial Sequence
  Synthetic
atggcgtacaggaaacgtggagcgcgccgtgaggcaaatataaataataatgatcgaatgcaagagaaggatgat

SEQ ID NO: 299070 - DNA, 75 bp, Artificial Sequence
  Synthetic
acgtttgatgagctaaatgagatgcttgataatatgaagaaagctggactagtcgatataccaaaaatgatacaa

SEQ ID NO: 299071 - DNA, 75 bp, Artificial Sequence
  Synthetic
ttgataatatgaagaaagctggactagtcgatataccaaaaatgatacaagactggttaatagattgttcaattg

SEQ ID NO: 299072 - DNA, 75 bp, Artificial Sequence
  Synthetic
atacactgaagacgttgatgatgaaatgtatagagaatataccatgttaattagagacgaagttgtaaaaatgct

SEQ ID NO: 299073 - DNA, 75 bp, Artificial Sequence
  Synthetic
aaaaatcgacaaaagaggaatctaagcagttacttgaagtgttgaaaacgaaagaagagcaccaaaaagaaatac

SEQ ID NO: 299074 - DNA, 75 bp, Artificial Sequence
  Synthetic
gaagcaaactaaattatttagaatatttgaaccaagacagctaccaatttatagaacgaatggtgaaaaagagtt

SEQ ID NO: 299075 - DNA, 75 bp, Artificial Sequence
  Synthetic
atttttaatgttaaaaggactgttgaagcaatgcaactatgaatatgcatatgagtagtcacataattaaaaata

SEQ ID NO: 299076 - DNA, 75 bp, Artificial Sequence
  Synthetic
attgtttctaaaggaatagcagtaacagaaaaagcgaaactaaactcatacgcaccggtttatttagagaagcga

SEQ ID NO: 299077 - DNA, 75 bp, Artificial Sequence
  Synthetic
cagaaaaagcgaaactaaactcatacgcaccggtttatttagagaagcgacgggctcaaatttttgcgttgttaa

SEQ ID NO: 299078 - DNA, 75 bp, Artificial Sequence
  Synthetic
agttgttgagaaaatgttaatttatgcgaaacatactagagagtatgctgaattttattcacaatctaaccaact

SEQ ID NO: 299079 - DNA, 75 bp, Artificial Sequence
  Synthetic
atgttatacaatgtataggatcaagaacgtatcaaatagaagatagtggatctaaatcatccatttcaaaattga

SEQ ID NO: 299080 - DNA, 75 bp, Artificial Sequence
  Synthetic
gaatatttcctacaacatcagttagttgaaccactaaataatgatataatatttaactacattccagagaggata

SEQ ID NO: 299081 - DNA, 75 bp, Artificial Sequence
  Synthetic
aagccttggtttcaacggttggaatagagattgctaaacgctacattgccggcggaaaaatatttttcagagcag

SEQ ID NO: 299082 - DNA, 75 bp, Artificial Sequence
  Synthetic
acaattgtctgataaagtactatcacaaaaagaagaaataataactgatgcacaagatgatgttaaaatagctga

SEQ ID NO: 299083 - DNA, 75 bp, Artificial Sequence
  Synthetic
atattgttaatagactaagaggttttgaaactgatagagaattcatattaacgaaaatcatgcaaatgacatcag

SEQ ID NO: 299084 - DNA, 75 bp, Artificial Sequence
  Synthetic
acaccattccagatagcagaacaacaaatacagaactttcaggtagcgaattggctgcattttgttaataacaat

SEQ ID NO: 299085 - DNA, 75 bp, Artificial Sequence
  Synthetic
attcaaagagcattcatgtcattatcaagccagaaatcaggaatagcagatgaaatcgcagcatcacagacgttt

SEQ ID NO: 299086 - DNA, 75 bp, Artificial Sequence
  Synthetic
tatgctgacgatcctaattactttataggaattaaatttaatagtataccttatgaatatgatgttaaagttcca

SEQ ID NO: 299087 - DNA, 75 bp, Artificial Sequence
  Synthetic
actgaaaaagcaaagttaaattcatatgcacctatttccttagagaagcgtcgtgcccaaatctctgctctgcta

SEQ ID NO: 299088 - DNA, 75 bp, Artificial Sequence
  Synthetic
actgcagctaatagattaaatttgtaccagaaaaaaatgaaagcaatagttgaagattttctaaaaagattacac

SEQ ID NO: 299089 - DNA, 75 bp, Artificial Sequence
  Synthetic
agatgaaggcaatagttgaagattttttgaagagattacacattttcgacgtggctagagttccagacgatcaaa

SEQ ID NO: 299090 - DNA, 75 bp, Artificial Sequence
  Synthetic
tgatactaatgaatatggatcagattgaacgtgcctcagataaaattgcacagggtgttattatcgcatatcgtg

SEQ ID NO: 299091 - DNA, 75 bp, Artificial Sequence
  Synthetic
atatgcaattagaaagggatgaaatgtatggttatgtgaatatagctagaaatctagatgggttccagcaaataa

SEQ ID NO: 299092 - DNA, 75 bp, Artificial Sequence
  Synthetic
aatcagccagtggcgctggttggagctcttccatttattaccgattcatcagtcatatcattaatagcaaagctt

SEQ ID NO: 299093 - DNA, 75 bp, Artificial Sequence
  Synthetic
gcaaagcttgatgctacagtttttgcccaaatagttaaattacggaaagttgacactttaaaaccaatattgtat

SEQ ID NO: 299094 - DNA, 75 bp, Artificial Sequence
  Synthetic
aaatttgatttcgtcatggatgattctggtgttaaaaataatctaatgggtaaagcaactactattgatcaagct

SEQ ID NO: 299095 - DNA, 75 bp, Artificial Sequence
  Synthetic
tgttttacctctgatggtgtaaacatgaaagtactagctttaagacacagtgtggctcaggtatatgcagacact

SEQ ID NO: 299096 - DNA, 75 bp, Artificial Sequence
  Synthetic
ggatacgattgattggaaattaagatacgaacagttagaaaagagatttgagtcacttaaacatcgagttaatga

SEQ ID NO: 299097 - DNA, 75 bp, Artificial Sequence
  Synthetic
aggaattgcggctattgagattcagtctcttgaagaattgttcaccttaatcagatgcaatttcacgtatgatta

SEQ ID NO: 299098 - DNA, 75 bp, Artificial Sequence
  Synthetic
caaatgtacaataataaattggaacgtgatttacaatcgaagattggatcagttgtgtcatccatggaatggtac

SEQ ID NO: 299099 - DNA, 75 bp, Artificial Sequence
  Synthetic
ctactaccgggttggaagctaacgtacgtaggatacaatggaaatgacacacgagggcattataatttttcattt

SEQ ID NO: 299100 - DNA, 75 bp, Artificial Sequence
  Synthetic
tctatatcagaagaagatgaagtcaatagttgaagactttttgaaaagactgcagatttttgatgtgccacgagt

SEQ ID NO: 299101 - DNA, 75 bp, Artificial Sequence
  Synthetic
tcattgtcaaaaactcttaaagatgctagggacaaaattgttgaaggtacattatattctaatgttagcgatctc

SEQ ID NO: 299102 - DNA, 75 bp, Artificial Sequence
  Synthetic
agtcaatacttcgtaatttaatttcagattatgatagattgtttataatgttcaaaggtttgttgcagcaatgta

SEQ ID NO: 299103 - DNA, 75 bp, Artificial Sequence
  Synthetic
gtggcagtataatagatttgctgtgataacacatggtaaaggtcactatagagttgtcaaatattcatcagttgc

SEQ ID NO: 299104 - DNA, 75 bp, Artificial Sequence
  Synthetic
ttcaaaggtttgttgcagcaatgtaactatacttgtacttatgagtgattgaatggacaattaaataccattacc

SEQ ID NO: 299105 - DNA, 75 bp, Artificial Sequence
  Synthetic
gaatgactacatctttaccaatagcacgactatcgaacagagtttttagagacaaattatttcctttattagtca

SEQ ID NO: 299106 - DNA, 75 bp, Artificial Sequence
  Synthetic
atggcgtacagaaaacgtggagcgcgtcgtgagacaaatttaaaacaagatgatcgaatgcaagaaaaagaagaa

SEQ ID NO: 299107 - DNA, 75 bp, Artificial Sequence
  Synthetic
ttgactttattgataatgtatgtatggatgaaatggcaagagagtctcaaagaaatggagtagctccacaatctg

SEQ ID NO: 299108 - DNA, 75 bp, Artificial Sequence
  Synthetic
agttaaaaacactattaagttgaaacaagaaagatggttaggaaaaagagtatctcaatttgatatcggacaata

SEQ ID NO: 299109 - DNA, 75 bp, Artificial Sequence
  Synthetic
aaagaagaagtaattacagataatcaagaagaaattaaaatatctgatgaaatcaaaaaatctagcaaagaagaa

SEQ ID NO: 299110 - DNA, 75 bp, Artificial Sequence
  Synthetic
caagaaagatggttaggaaaaagagtatctcaatttgatatcggacaatacaaaaacatgatgaatgtcattaca

SEQ ID NO: 299111 - DNA, 75 bp, Artificial Sequence
  Synthetic
aggatataggtaaactaaaagataactctatgttgtatattgatattagaaccgatcggggtaacgttgattgga

SEQ ID NO: 299112 - DNA, 75 bp, Artificial Sequence
  Synthetic
aacctaaacaactaccaatatatcgagcgaatggggaaaaagagttgcgtaacagatggtattggaaattgaaac

SEQ ID NO: 299113 - DNA, 75 bp, Artificial Sequence
  Synthetic
ggtataaattcacaagcagcaaatgattgttttaaaacgctaatagcagccatgttaagccaacgtacaatgtca

SEQ ID NO: 299114 - DNA, 75 bp, Artificial Sequence
  Synthetic
aatcaaaagtgtgctgtgttaaattgaccgccatggatctggagcttccagtttccgcaaaattactacaccacc

SEQ ID NO: 299115 - DNA, 75 bp, Artificial Sequence
  Synthetic
catggctgttgaaaacaaaaattctagagatgcaggtaaagttgttgattctgaaactgcagccatttgtgacgc

SEQ ID NO: 299116 - DNA, 75 bp, Artificial Sequence
  Synthetic
atgtggaacattacatcgttgcgatcaccatatactaatgcgaatttctttcaagattagagcgcttagatgtga

SEQ ID NO: 299117 - DNA, 75 bp, Artificial Sequence
  Synthetic
tcgaaatgtggttaactatccatcaatattacatccaattgatcatgccttcaatgaatattttctacaacatca

SEQ ID NO: 299118 - DNA, 75 bp, Artificial Sequence
  Synthetic
cgacggagtgttgaatcaaacacttaatgataatattagaaatggacaagttattaatcagttgatggaagcgtt

SEQ ID NO: 299119 - DNA, 75 bp, Artificial Sequence
  Synthetic
tcaatgaatattttctacaacatcaattagttgaaccattaaataatgatataatatttaattatatacctgaaa

SEQ ID NO: 299120 - DNA, 75 bp, Artificial Sequence
  Synthetic
tttaataatagagcagatattattaatttaattaataatcaaaagcagtcactcattaccgttagaatcaataac

SEQ ID NO: 299121 - DNA, 75 bp, Artificial Sequence
  Synthetic
acatttaaagatgaaccaaaagtaggatttaaaaatatatatgattggacttttttaccaaccgacttcgataca

SEQ ID NO: 299122 - DNA, 75 bp, Artificial Sequence
  Synthetic
gatcaatacaaagaggaatattactattgtcaaacagattaggtcaattagttgacttaacaagactattatcat

SEQ ID NO: 299123 - DNA, 75 bp, Artificial Sequence
  Synthetic
gcatgataattttgagtctttatgggatactataaccacatcaaattatatcctagctagatcagttgtgccaga

SEQ ID NO: 299124 - DNA, 75 bp, Artificial Sequence
  Synthetic
gatttaaaaatatatatgattggacttttttaccaaccgacttcgatacaactaatgctatagtaacttcatatg

SEQ ID NO: 299125 - DNA, 75 bp, Artificial Sequence
  Synthetic
tatgttaattggaaatactacagttattccaagtccacaaacattgtttcactattacaatgtaaatgtaaattt

SEQ ID NO: 299126 - DNA, 75 bp, Artificial Sequence
  Synthetic
attgttttaaaacattaattgccgctatgcttagtcaacgtactatgtctttagatttcgttactacaaattata

SEQ ID NO: 299127 - DNA, 75 bp, Artificial Sequence
  Synthetic
gaagaagatgaagtcaatagttgaagaatttttgaagaggctgcaaattttcgatgtgccacgagtgcccgatga

SEQ ID NO: 299128 - DNA, 75 bp, Artificial Sequence
  Synthetic
gttaacggttatacctaatgatatgtttatacgtgaatctttagtggcatgtcaattagcaataattaataccat

SEQ ID NO: 299129 - DNA, 75 bp, Artificial Sequence
  Synthetic
atttattatagatacaattattcttttgacttgaagagatggatatatctgcattcaatagaaaaggtcgatatt

SEQ ID NO: 299130 - DNA, 75 bp, Artificial Sequence
  Synthetic
tggatggataccaacaaattaatttagaagaattaatgaggacaggagattatggtcaaattactaacatgctat

SEQ ID NO: 299131 - DNA, 75 bp, Artificial Sequence
  Synthetic
ttacacgtatgatgtaaaagttccacatttgacatttggtgtactatatatttcagataacatgattccagatgt

SEQ ID NO: 299132 - DNA, 75 bp, Artificial Sequence
  Synthetic
ccaactatgccagtagattataaaagatcaatacagagaggaattctacttctatctaatagattaggacaattg

SEQ ID NO: 299133 - DNA, 75 bp, Artificial Sequence
  Synthetic
aatgcagttgtcgagacaacaatttccaactatgccagtagattataaaagatcaatacagagaggaattctact

SEQ ID NO: 299134 - DNA, 75 bp, Artificial Sequence
  Synthetic
tgatggaatatacgtagcaaatgttagtggagttttagcaacatatttcaaaatgtataatttattttacaagaa

SEQ ID NO: 299135 - DNA, 75 bp, Artificial Sequence
  Synthetic
attcaactacatccctgagaggataagaaatgacgttaactatatacttaatatggatagaaatttgccatcaac

SEQ ID NO: 299136 - DNA, 75 bp, Artificial Sequence
  Synthetic
aacaggtaccgcaaccctttgactttagagcgtcaatgcatatgttaacatctaacctcacttttactgtttatt

SEQ ID NO: 299137 - DNA, 75 bp, Artificial Sequence
  Synthetic
atgtttataccgcatataacactaagctttagtaataataagacagtaagaatagaaactactaaattaagaatc

SEQ ID NO: 299138 - DNA, 75 bp, Artificial Sequence
  Synthetic
aatagaaactactaaattaagaatcaaatcaatatacttaagaaaaattagaggggacactatgtttgatatgtc

SEQ ID NO: 299139 - DNA, 75 bp, Artificial Sequence
  Synthetic
gattttttaaagagactgcaaatattcgacgtttcgagggttccagatgatcaaatgtataggctcagggacagg

SEQ ID NO: 299140 - DNA, 75 bp, Artificial Sequence
  Synthetic
gagttgtgaaatactcgtcagttgcaaatcacgcagaccgagtttacgctactttcaagagcaataacaaaaacg

SEQ ID NO: 299141 - DNA, 75 bp, Artificial Sequence
  Synthetic
aaactcacaagcagctaatgactgtttcaaaactatgatcgcagcaatgctaagtcagcgaactatgtcgcttga

SEQ ID NO: 299142 - DNA, 75 bp, Artificial Sequence
  Synthetic
ctcattagctcatgtatgtcagtggtgtatacaaaacaaacgttgtttcttggataatgaaccacatcttctgaa

SEQ ID NO: 299143 - DNA, 75 bp, Artificial Sequence
  Synthetic
tggataatgaaccacatcttctgaagttacgaacttttgaatcaccaataacaaaggaaaaattacaatgtatta

SEQ ID NO: 299144 - DNA, 75 bp, Artificial Sequence
  Synthetic
tggatgggtttcaacagataaatttagaagagttaatgagaacaggagattacgcacaaattactaatatgttac

SEQ ID NO: 299145 - DNA, 75 bp, Artificial Sequence
  Synthetic
aggagcgttgccattcataacggattcatcagtcatctcattaatagctaaactagatgccactgtctttgcaca

SEQ ID NO: 299146 - DNA, 75 bp, Artificial Sequence
  Synthetic
atggtataatcaattgctacttccaatcactctaaatgctgcagtgtttaagtttcattcaagggaagtttatat

SEQ ID NO: 299147 - DNA, 75 bp, Artificial Sequence
  Synthetic
atcactctaaatgctgcagtgtttaagtttcattcaagggaagtttatatttttgggttttacgaaggatcttca

SEQ ID NO: 299148 - DNA, 75 bp, Artificial Sequence
  Synthetic
tcttgtagcaaactatgattggattccaacgtctacaacgaaagtttataaacaagtaccacaacaattcgattt

SEQ ID NO: 299149 - DNA, 75 bp, Artificial Sequence
  Synthetic
caacttgcattatgacctacttaataataaagataaaatactcgctgcgttatcaacatcatcactaaagcaatt

SEQ ID NO: 299150 - DNA, 75 bp, Artificial Sequence
  Synthetic
cgcagtagctatcataactgcagctaatagactaaatttatatcagaaaaagatgaaggcaatagttgaagattt

SEQ ID NO: 299151 - DNA, 75 bp, Artificial Sequence
  Synthetic
gcgtcaacgatttctcagtgtaagtggtgtaatgtaaaatatgcatttagaaatatggattggaaaatggaatca

SEQ ID NO: 299152 - DNA, 75 bp, Artificial Sequence
  Synthetic
ggtgtaatgtaaaatatgcatttagaaatatggattggaaaatggaatcaatgtataatgaacttctgagcttca

SEQ ID NO: 299153 - DNA, 75 bp, Artificial Sequence
  Synthetic
aagtatttgtgatgctatatttcaagatgaagagacagagggagttattagaagatttatagcagatatgagaca

SEQ ID NO: 299154 - DNA, 75 bp, Artificial Sequence
  Synthetic
tagaaagagatgaaatgtatggttatgtgaacatagctagaaatctggatgggtttcagcagataaatttagaag

SEQ ID NO: 299155 - DNA, 75 bp, Artificial Sequence
  Synthetic
ctatatacgcacatcaaaatgatattgaaaactgaagcccttccattcacatttacgctacatcagttcagttct

SEQ ID NO: 299156 - DNA, 75 bp, Artificial Sequence
  Synthetic
agggtaaactagctgaagaatacgagcttctgatctcagattctgaagatgacgattaatacttaaataagctaa

SEQ ID NO: 299157 - DNA, 75 bp, Artificial Sequence
  Synthetic
gcttctgatctcagattctgaagatgacgattaatacttaaataagctaaactcagtttttgccatcacaagacc

SEQ ID NO: 299158 - DNA, 75 bp, Artificial Sequence
  Synthetic
taaatgcagttatgttctggttagaaaaacatgaaaatgatacagctgaaaagtttaagatttataaaagaagat

SEQ ID NO: 299159 - DNA, 75 bp, Artificial Sequence
  Synthetic
tagatttatttactatagttgcatcaacggtgaataaatacggtgtgccaagacataacgcaaaatatagatatg

SEQ ID NO: 299160 - DNA, 75 bp, Artificial Sequence
  Synthetic
ctggcatagctgcagtagagatacaaagaatggatgaattgttcacgttaattagatgcaattttacatatgatt

SEQ ID NO: 299161 - DNA, 75 bp, Artificial Sequence
  Synthetic
tgtggttgcgttatacgcgttgtctaacgaatttaataatagagaggatgtaataaaattggttaacaatcagaa

SEQ ID NO: 299162 - DNA, 75 bp, Artificial Sequence
  Synthetic
tattctaatagatcaaccctggcgaaattagtctcatcaccgatgtcaattcttgtagcattagtagatattaat

SEQ ID NO: 299163 - DNA, 75 bp, Artificial Sequence
  Synthetic
aagaatggatgaattgttcacgttaattagatgcaattttacatatgattatactgatgacatcgtttatttaca

SEQ ID NO: 299164 - DNA, 75 bp, Artificial Sequence
  Synthetic
aataacacatttaaagatgaaccaaaagtgggatttaaagatatttatgactggacttttttgccaactgatttc

SEQ ID NO: 299165 - DNA, 75 bp, Artificial Sequence
  Synthetic
ctgaaggaggggaaatcgtttttcaaaatgcagcttttacaatgtggaaactgacatatttggagcatgagctaa

SEQ ID NO: 299166 - DNA, 75 bp, Artificial Sequence
  Synthetic
agagatttatcaaataataattttaatttaataggtacgaatgttgagaattcggtgtctggacatgtgtataat

SEQ ID NO: 299167 - DNA, 75 bp, Artificial Sequence
  Synthetic
aaacagttctcgagtggaccatatctagttaaagacacaatcaaacttaaacaagaaagatggcttggtaaaaga

SEQ ID NO: 299168 - DNA, 75 bp, Artificial Sequence
  Synthetic
aacaaggtaatactcttgaaacatgtaagaaactactgttccaaaagatgaagcgtgaaagtaatccgttcaagg

SEQ ID NO: 299169 - DNA, 75 bp, Artificial Sequence
  Synthetic
gactgtcaactgataggaagatggatgaagtttctcaaataggaatttaattcgttatcgatttgagaatgggta

SEQ ID NO: 299170 - DNA, 75 bp, Artificial Sequence
  Synthetic
aacgatgtgcaaaagcttaaagataattcaatgttatatatagatataagaacagataggggaaacatggactgg

SEQ ID NO: 299171 - DNA, 75 bp, Artificial Sequence
  Synthetic
actatcatacggtgatgtcacgcgatttctatctaataatgctatggtgctatatacagatgtatctcaatggga

SEQ ID NO: 299172 - DNA, 75 bp, Artificial Sequence
  Synthetic
ggaatggcgtattttccatatattgcatctgttttaacagttttgttcacattacataaagcttcaattccaact

SEQ ID NO: 299173 - DNA, 75 bp, Artificial Sequence
  Synthetic
aatttatatgatcaaatattgatagaaatgccagattatttattgctaaaagatatggctgtagaaaataaaaac

SEQ ID NO: 299174 - DNA, 75 bp, Artificial Sequence
  Synthetic
agatatggctgtagaaaataaaaactctagagatgctggtaaagttgtagattctgagactgcaaatatttgtga

SEQ ID NO: 299175 - DNA, 75 bp, Artificial Sequence
  Synthetic
taaagtggcggtactaatttgtgaagcattgaattcaattaaagttactcaatctgatgttgcgagtgtactatc

SEQ ID NO: 299176 - DNA, 75 bp, Artificial Sequence
  Synthetic
tgatctgaaggaaaaagaattagtttcaactgaagctcagatacagaaaatgtctcaagatttgcaacttgaagc

SEQ ID NO: 299177 - DNA, 75 bp, Artificial Sequence
  Synthetic
ttaagaataatctattgggcaaagcagcaactattgatcaggcactgaacggaaaatttggatcggcagcaagga

SEQ ID NO: 299178 - DNA, 75 bp, Artificial Sequence
  Synthetic
caacactattgtaataaactagaggttgatttgcaaaataaaattagttcacttgtgtcttcagttgaatggtac

SEQ ID NO: 299179 - DNA, 75 bp, Artificial Sequence
  Synthetic
tcattcgtgacaaaaataataagagttgatggagatgacaactacgcagtactgcagtttaatacagaagtaacc

SEQ ID NO: 299180 - DNA, 75 bp, Artificial Sequence
  Synthetic
catcaataattaagtgtactagattaatgaaggataaaattgaacgtggtgaagtcgaagtggatgattcgttcg

SEQ ID NO: 299181 - DNA, 75 bp, Artificial Sequence
  Synthetic
cgctagatgaatgggagagtggaaaaaatccatatgaaccgtcagaagtgactgcatctatgtgagaggttgagt

SEQ ID NO: 299182 - DNA, 75 bp, Artificial Sequence
  Synthetic
caaattgaggatgacggttcaaaatcagccatatctcggctaatatcaaagtactcagtttacaaaccgtcaatt

SEQ ID NO: 299183 - DNA, 75 bp, Artificial Sequence
  Synthetic
aaccacatcaaattatatcttggcaagatcagtagtaccagatttaaaggaattagtgtcaacagaagcacaaat

SEQ ID NO: 299184 - DNA, 75 bp, Artificial Sequence
  Synthetic
gaatacacgaggtcactataatttttcatttatatgtcaaaatgcagctacagatgatgatgtaataattgaata

SEQ ID NO: 299185 - DNA, 75 bp, Artificial Sequence
  Synthetic
cacgttacataccataatggaggatcctggaatggcgtactttccatatattgcatctgtcctaactgtactgtt

SEQ ID NO: 299186 - DNA, 75 bp, Artificial Sequence
  Synthetic
ttcagtttcaggacatgtctataatgcattgatttactacagatataattatacgtttgatcttaaaagatggat

SEQ ID NO: 299187 - DNA, 75 bp, Artificial Sequence
  Synthetic
ataggtactaatgtagagaattccgtttcaggacatgtttataatgcattaatctactatagatataactatgca

SEQ ID NO: 299188 - DNA, 75 bp, Artificial Sequence
  Synthetic
gatcgcaaccagctcatgataacttgatgggtacgatgtggttaaatgctggatcagagattcaggttgctggat

SEQ ID NO: 299189 - DNA, 75 bp, Artificial Sequence
  Synthetic
ggatcagagattcaggttgctggatttgattattcatgcgcgattaatgcaccagctaatacacaacaatttgag

SEQ ID NO: 299190 - DNA, 75 bp, Artificial Sequence
  Synthetic
gagcaaccacctggtattttaacccagtaattctcagaccaaataatgtggaagtggagtttctactaaacggac

SEQ ID NO: 299191 - DNA, 75 bp, Artificial Sequence
  Synthetic
gagttaatgatacatggaggccgtcacctccaactaaatataaaggatggtgtttagattgctgtcaacatactg

SEQ ID NO: 299192 - DNA, 75 bp, Artificial Sequence
  Synthetic
atttggaacaattatagccagaaattttgatacaattaggttatcgtttcagttaatgagaccaccgaatatgac

SEQ ID NO: 299193 - DNA, 75 bp, Artificial Sequence
  Synthetic
gactctaaagatgactatgaaaatgcatttctaatttctaatctcactacacacaatatattgtatttaaactat

SEQ ID NO: 299194 - DNA, 75 bp, Artificial Sequence
  Synthetic
tgagtatgtagctacgtcgagctgcttgaactctataagtaaggatgcgtttacgcattcgctacatagagtaat

SEQ ID NO: 299195 - DNA, 75 bp, Artificial Sequence
  Synthetic
tgatgcgagtaaattggaagaaatggtggcaagtgttttatacaatagttgactacgtgaatcaaattgtgcaag

SEQ ID NO: 299196 - DNA, 75 bp, Artificial Sequence
  Synthetic
gcgatacgagaggacattataacttttcgtttaaatgccagaatgcagctacagatgacgatgcaataatagagt

SEQ ID NO: 299197 - DNA, 75 bp, Artificial Sequence
  Synthetic
tatgtttacttttttagaccatccatcaataaaacagttctcgaatggaccatacctagttaaagacacaattaa

SEQ ID NO: 299198 - DNA, 75 bp, Artificial Sequence
  Synthetic
tcaacaaaatagcgaatcaaataaatggatatcaatgggaacagactgcacagtaaaagtttgtccactcaatac

SEQ ID NO: 299199 - DNA, 75 bp, Artificial Sequence
  Synthetic
gttgacaactttatatcaatattatgacatgtatcatgagaaaccagttatatatatgataggatcagcgccctc

SEQ ID NO: 299200 - DNA, 75 bp, Artificial Sequence
  Synthetic
cgtcataccaagtccgcaaacattatttcattattataatgttaacgtcaactttcactcaaattataatgagag

SEQ ID NO: 299201 - DNA, 75 bp, Artificial Sequence
  Synthetic
tttcattattataatgttaacgtcaactttcactcaaattataatgagagaattaacgatgcagtggctataata

SEQ ID NO: 299202 - DNA, 75 bp, Artificial Sequence
  Synthetic
ctgttgaatatgattctggtatatctgatattgaatagtagaagaaagatcacgtttgccactacaagactccct

SEQ ID NO: 299203 - DNA, 75 bp, Artificial Sequence
  Synthetic
gtcagaagactagatatatttaatttaatactaatgaatatggagcaaatagagcgtgcctcagacaaaattgct

SEQ ID NO: 299204 - DNA, 75 bp, Artificial Sequence
  Synthetic
gaaggaatttaatcagaagaatataaaaacgctagatgaatgggagaacggaaaaaatccatatgaaccgataga

SEQ ID NO: 299205 - DNA, 75 bp, Artificial Sequence
  Synthetic
gagcatgctccaatagagctgatttatgcatgcaggtcagcaagagaatttgcgaaactacaagatgacttaaca

SEQ ID NO: 299206 - DNA, 75 bp, Artificial Sequence
  Synthetic
ataccttgttaaacatactattaaattaaagcaggagagatggttaggtaaaagagtatcacaatttgacattgg

SEQ ID NO: 299207 - DNA, 75 bp, Artificial Sequence
  Synthetic
ttaaagcaggagagatggttaggtaaaagagtatcacaatttgacattggacaatataaaaacatgttaaatgta

SEQ ID NO: 299208 - DNA, 75 bp, Artificial Sequence
  Synthetic
cttggttcagctccatcttattggatttatgatattaaacagtattctgattttacatttgaaacatgggatcca

SEQ ID NO: 299209 - DNA, 75 bp, Artificial Sequence
  Synthetic
cgaacgactcaagtactctttggaaattcatactatttattaaactagaaaaaaatggaacttattctcaatatt

SEQ ID NO: 299210 - DNA, 75 bp, Artificial Sequence
  Synthetic
gatataacaacgagttatacgtatatgttatctgatgaggtgtatgtagcgaatgtaagcggcgtgctatcaaca

SEQ ID NO: 299211 - DNA, 75 bp, Artificial Sequence
  Synthetic
aaagagtatcacaatttgacattggacaatataaaaacatgttaaatgtagttactaccatatattattattaca

SEQ ID NO: 299212 - DNA, 75 bp, Artificial Sequence
  Synthetic
acaacacatcataaggaattattttttgataaggatgttaataaacttaaggacaattcaattttgtatatagac

SEQ ID NO: 299213 - DNA, 75 bp, Artificial Sequence
  Synthetic
gcgcaaatgaatgaagatatagtggtatcaaaaacatcattgtggaaagagatgcaatataacagagatataaca

SEQ ID NO: 299214 - DNA, 75 bp, Artificial Sequence
  Synthetic
taaatggtcagagatatcatttaaaccaatgaattaccaatatacttatacaagagatggagaagagataacagc

SEQ ID NO: 299215 - DNA, 75 bp, Artificial Sequence
  Synthetic
tgggacgttggtaccatcaaaagatttgtgccaaaaggtgtattctatgcatttataaacaatgtaataacagag

SEQ ID NO: 299216 - DNA, 75 bp, Artificial Sequence
  Synthetic
tattttaaagaatacgcagatatagcagcattttcagttgatccacaactatactgtgattataatatagtttta

SEQ ID NO: 299217 - DNA, 75 bp, Artificial Sequence
  Synthetic
ttataagttagatcagtatgcaaatcatatgggtatttctaggagatcacatcaaattagattttcagagtctgc

SEQ ID NO: 299218 - DNA, 75 bp, Artificial Sequence
  Synthetic
tcaaataatccaagcaatgtccagaaggtctagatcactaaattcagctgcattttactatagagtgtaggtaca

SEQ ID NO: 299219 - DNA, 75 bp, Artificial Sequence
  Synthetic
atagagagtacaaaactcaaaattaattcaatttacttaagaaagattaaaggtgaaaccgtatttgatatgtct

SEQ ID NO: 299220 - DNA, 75 bp, Artificial Sequence
  Synthetic
atcaagcaatgttgggtgcgatcaagtggatttctcctttaataaagggattaaaatgaatgcaaacttagattc

SEQ ID NO: 299221 - DNA, 75 bp, Artificial Sequence
  Synthetic
gcaggctatggagttgttgcagtcaaatccgagaactttgaaagaatttataaacaacaataatcccataatcag

SEQ ID NO: 299222 - DNA, 75 bp, Artificial Sequence
  Synthetic
tcaaatcaaacaaaataacaataaacgacatacttaaagacataaaaccattttttacagtgagtgaagcacatt

SEQ ID NO: 299223 - DNA, 75 bp, Artificial Sequence
  Synthetic
aatgctcatataaggtggtgaaatattgtattgtgacaattttcaatacgctattgaagttggcaggttataaag

SEQ ID NO: 299224 - DNA, 75 bp, Artificial Sequence
  Synthetic
gaagatgtgaataaactcagaatgatgctgtcatccaaaggaattgatcaaaagatgagagtacttaatgcatgt

SEQ ID NO: 299225 - DNA, 75 bp, Artificial Sequence
  Synthetic
cgtggtgaagtcgaagtggatgattcgttcgttgaagagaagatggaagttgatacaattgattggaaatctaga

SEQ ID NO: 299226 - DNA, 75 bp, Artificial Sequence
  Synthetic
gcaaaaaaagtgaatgaaaacatgtactctcttcagaatgttatatcacaacaacaaaatcaaattgctgattta

SEQ ID NO: 299227 - DNA, 75 bp, Artificial Sequence
  Synthetic
tttaaaggattaatgaggcaatgcaactacgaatatacgtacgaatagtcacataatataactgactaaattacc

SEQ ID NO: 299228 - DNA, 75 bp, Artificial Sequence
  Synthetic
acagtaaataaatatggtgtaccaaggcataatgaaaaatatagatacgattatgatgtaatgaaagataaacca

SEQ ID NO: 299229 - DNA, 75 bp, Artificial Sequence
  Synthetic
gatcagaaattcaggtcgctggatttgactattcatgtgcaattaatgcaccagctaatacacaacaatttgagc

SEQ ID NO: 299230 - DNA, 75 bp, Artificial Sequence
  Synthetic
actcgaataaatctactttagcgaaactagtgtcatctccaatgtctatattagttgctttaatcgatattaatg

SEQ ID NO: 299231 - DNA, 75 bp, Artificial Sequence
  Synthetic
gcacgtttattacgaatgaagagttagaaattgagttttcagataaatatgtcaaggcaatagtacctgaccaaa

SEQ ID NO: 299232 - DNA, 75 bp, Artificial Sequence
  Synthetic
tgtgagtgatctaatccaacaatttaatcaaatgataattaccatgaatggaaatgagttccaaactggagggat

SEQ ID NO: 299233 - DNA, 75 bp, Artificial Sequence
  Synthetic
tttacagtttttatatacatcaaatgattttattcaaataccaatttattattcagcaaataatgaattagaaaa

SEQ ID NO: 299234 - DNA, 75 bp, Artificial Sequence
  Synthetic
tctttattatcagtattgtcttactcatatggaaaatatggtaacgttgagaataagcttaaagaatatgcaact

SEQ ID NO: 299235 - DNA, 75 bp, Artificial Sequence
  Synthetic
tggatccagcaatactgacatcattatcatcaaatttgaatgcagcaatgttttggtttcaccataacaaaggaa

SEQ ID NO: 299236 - DNA, 75 bp, Artificial Sequence
  Synthetic
tcaccatctagagaggataacttacagcgtgtatttacagtggcttccattagaagcatgcttgtcaaatgagga

SEQ ID NO: 299237 - DNA, 75 bp, Artificial Sequence
  Synthetic
tgatcaaaaatatagatacacatatgaagttatgaaagataagccatactatttagttacgtgggcaaactcttc

SEQ ID NO: 299238 - DNA, 75 bp, Artificial Sequence
  Synthetic
caacaatattgtaataaattagaagctgatttgcaaggcaaatttagttcattagtgtcatcagttgagtggtat

SEQ ID NO: 299239 - DNA, 75 bp, Artificial Sequence
  Synthetic
gtttcttcaccaatgtcaatactagtagcgttacttgatattaatggaacgtttataactactgaagaattggaa

SEQ ID NO: 299240 - DNA, 75 bp, Artificial Sequence
  Synthetic
atatccctaaattaataagagagtggattagtactccaactttaagtggctttaagttgatggcaaaaatatact

SEQ ID NO: 299241 - DNA, 75 bp, Artificial Sequence
  Synthetic
ccaggagtattccatgttaatcagagatgaagtagttaaaatgttacaggaatctgtaattcatgaagatcattt

SEQ ID NO: 299242 - DNA, 75 bp, Artificial Sequence
  Synthetic
atttgaaatttgagacgtgggacccattggacacaccatactctgatttacatcataaagaactgttttatataa

SEQ ID NO: 299243 - DNA, 75 bp, Artificial Sequence
  Synthetic
aaaaagaacatgcatgtaatggatgatatgtataatggtagatataatccctctattgttccgaaagtcgatcaa

SEQ ID NO: 299244 - DNA, 75 bp, Artificial Sequence
  Synthetic
atatgtataatggtagatataatccctctattgttccgaaagtcgatcaaactagcccaataccattgggtagac

SEQ ID NO: 299245 - DNA, 75 bp, Artificial Sequence
  Synthetic
acatgtatcatgagaagccaataatctacatgataggatcagcaccttcatattggatacacgatgttaaacaat

SEQ ID NO: 299246 - DNA, 75 bp, Artificial Sequence
  Synthetic
acatacacgagaatacgctgagttttattcgcaatctaatcaattactttcatatggtgacgttactcggttttt

SEQ ID NO: 299247 - DNA, 75 bp, Artificial Sequence
  Synthetic
ggacccactggatacgccatattctgatttacatcacaaagaactgttttatatgaatgacgtgaccaaacttaa

SEQ ID NO: 299248 - DNA, 75 bp, Artificial Sequence
  Synthetic
aaactaatgactatgacaaacaatgaagggattaagagtaccttacaaaaatataaacaaacacaaatcaatttg

SEQ ID NO: 299249 - DNA, 75 bp, Artificial Sequence
  Synthetic
atacgaacggatagagaaaatatagattggaagacgtggaggaagattgtagaggagcaaactgttaataactta

SEQ ID NO: 299250 - DNA, 75 bp, Artificial Sequence
  Synthetic
tagcaaatctagcattaattaaaacagtgttatctaggttggctaatcagcatgctttcaaaacaaaagttatta

SEQ ID NO: 299251 - DNA, 75 bp, Artificial Sequence
  Synthetic
acgaatgaatgcgaaagttaaagctttagtctcaactgttggaattgaaatagctaaaagatatattgcaggagg

SEQ ID NO: 299252 - DNA, 75 bp, Artificial Sequence
  Synthetic
aattgaaagtgttaaggaacgagtatgtggttgcactatatgcgctgtctaatgattttaacaatagagaggatg

SEQ ID NO: 299253 - DNA, 75 bp, Artificial Sequence
  Synthetic
gttaatcggttgagaggcttttatacggacagagattttattttaaccaagataatgcaaatgacttcagtagct

SEQ ID NO: 299254 - DNA, 75 bp, Artificial Sequence
  Synthetic
cctcagatgatgatgtttatcaacaacgtgcttttatgtctttatcatcccaatcatcatctattgctgacgaaa

SEQ ID NO: 299255 - DNA, 75 bp, Artificial Sequence
  Synthetic
aaaggctaaattaaatagctatgcaccaattgcacttgagaaaagacgtgcgcaactatcatcactgttgactat

SEQ ID NO: 299256 - DNA, 75 bp, Artificial Sequence
  Synthetic
agtattgaaggcggtagatattatgaacacgctccgatagagttgatttacgcatgcagatcagcaaaggaattt

SEQ ID NO: 299257 - DNA, 75 bp, Artificial Sequence
  Synthetic
ccaatatatccagaatttatgccgactttaccagcaaacgtgcaatatgtcttacgatgtataggttcacgtaca

SEQ ID NO: 299258 - DNA, 75 bp, Artificial Sequence
  Synthetic
taaatatttcagattccatgataccagacgtggtggcaattttaaagaaatttaaaaatgaattgtttagaatgg

SEQ ID NO: 299259 - DNA, 75 bp, Artificial Sequence
  Synthetic
cattgcaggaaaaagacattaagttatatttaatgtcactgggagtaccaaatattgactcgtcagcatatatag

SEQ ID NO: 299260 - DNA, 75 bp, Artificial Sequence
  Synthetic
ttctaaggatttagaatcgctcatacgaataccgtttaaaggaaagataccttctgtaacctttattttacatat

SEQ ID NO: 299261 - DNA, 75 bp, Artificial Sequence
  Synthetic
aatggacataacgttgtattattaccagcaaacagatgaaactaacaaatggatatcaatgggtacgtcatgtac

SEQ ID NO: 299262 - DNA, 75 bp, Artificial Sequence
  Synthetic
atcagagatggtcaaactatggaagaaaatgtggagtattacttcattaagatcgccatattcaaatgcgaactt

SEQ ID NO: 299263 - DNA, 75 bp, Artificial Sequence
  Synthetic
ataactgacgttgtcgatggagtcaatcataaactggacgtaacaacgaacacatgtactataagaaattgtaaa

SEQ ID NO: 299264 - DNA, 75 bp, Artificial Sequence
  Synthetic
gtggcaagtcttttatacaatagttgattatgttaatcagattgtgcaagttatgtctaaacgatcgcgctcctt

SEQ ID NO: 299265 - DNA, 75 bp, Artificial Sequence
  Synthetic
cacaaccgatctttctgatgagattgaagaaattggatcatcaaaatctcaagatgttacagttaatccaggacc

SEQ ID NO: 299266 - DNA, 75 bp, Artificial Sequence
  Synthetic
aaatcgagacaactgccactgctgaaggaggagagatcgtttttcaaaatgcagcctttacaatgtggagattaa

SEQ ID NO: 299267 - DNA, 75 bp, Artificial Sequence
  Synthetic
actttcaatccgccaataggatactgggtattgtttgctccaaccgttcaaggggtagtggctgaaggaacaaac

SEQ ID NO: 299268 - DNA, 75 bp, Artificial Sequence
  Synthetic
agaatgtttcacaaacgaaatggaaattcattgatgtgagtaagactagtcaaggcggtagttatacacagtaca

SEQ ID NO: 299269 - DNA, 75 bp, Artificial Sequence
  Synthetic
tatatctttaagagaacaagaaatacagttatatttagtttcattaggagttccgccagttgatgcaggcacgta

SEQ ID NO: 299270 - DNA, 75 bp, Artificial Sequence
  Synthetic
ttgttgaattatgaaataaattggaatgttatgaatgtattaattaatagtatcggtaaaataccaaaaatattg

SEQ ID NO: 299271 - DNA, 75 bp, Artificial Sequence
  Synthetic
ccaaaaggtgtattttatgcttttataaacaatgtaaccacagagaatgtgtttatacaacctccttttaaatta

SEQ ID NO: 299272 - DNA, 75 bp, Artificial Sequence
  Synthetic
gtcaactgatagaaaaatggatgaggtctctcaaataggaatttaattcgttatcgatttgagaatgggtatgac

SEQ ID NO: 299273 - DNA, 75 bp, Artificial Sequence
  Synthetic
cacaacaaccaactatgaagctatagtaatgactctattctgtgacttttatataattcctcgcacacaggagga

SEQ ID NO: 299274 - DNA, 75 bp, Artificial Sequence
  Synthetic
gcaagtgttaatgaagacattgttgtatcgaagacttctctatggaaagaaatgcaatataacagagatataaca

SEQ ID NO: 299275 - DNA, 75 bp, Artificial Sequence
  Synthetic
gctgttgaaaggaaattagtaaaatatgcaaaaggtaagccactagaagcagatttgacagtgaacgagttagat

SEQ ID NO: 299276 - DNA, 75 bp, Artificial Sequence
  Synthetic
ttagagatggagaagaggtcatagcgcataccacgtgttcagttaacggagtgaataatttcaattacaacgggg

SEQ ID NO: 299277 - DNA, 75 bp, Artificial Sequence
  Synthetic
ctactgtagaaccggtacttgatggtccttatcaaccaacaacgttcaatccaccagtagattattggatgctat

SEQ ID NO: 299278 - DNA, 75 bp, Artificial Sequence
  Synthetic
tatggtatacgtaagagcattagctgctgacttgaattcaattatttgtagtggcggcagttataatttcgcatt

SEQ ID NO: 299279 - DNA, 75 bp, Artificial Sequence
  Synthetic
aagttatacgctatttggaacgcaagagcaaattacaatagctaatgcttcccaaacacaatggaaatttattga

SEQ ID NO: 299280 - DNA, 75 bp, Artificial Sequence
  Synthetic
tcgttaagatttagatttagattagcagttgaagagccgtcattctcaatatcacgcacgcggataactagattg

SEQ ID NO: 299281 - DNA, 75 bp, Artificial Sequence
  Synthetic
acatataatggagaaactccgaatgtgaccactaagtactactcaactacaaattatgattcagtaaacatgaca

SEQ ID NO: 299282 - DNA, 75 bp, Artificial Sequence
  Synthetic
agacaccaataatgaattctgtaaccgttagacaagatcttgagagacagcttggagaattacgtaatgagttta

SEQ ID NO: 299283 - DNA, 75 bp, Artificial Sequence
  Synthetic
aaatttgacaactacaacatgtactattcgaaattgtaagaaatttggtccaagagagaatgtagctgtaataca

SEQ ID NO: 299284 - DNA, 75 bp, Artificial Sequence
  Synthetic
aaatttgacaactacaacatgtactattcgaaattgtaagaaatttggtccaagagagaatgttgctgtaataca

SEQ ID NO: 299285 - DNA, 75 bp, Artificial Sequence
  Synthetic
aaatttgacaactacaacatgtactattcgaaattgtaagaaatttggtccaagagagaatgtcgctgtaataca

SEQ ID NO: 299286 - DNA, 75 bp, Artificial Sequence
  Synthetic
aaatttgacaactacaacatgtactattcgaaattgtaagaaatttggtccaagagagaatgtggctgtaataca

SEQ ID NO: 299287 - DNA, 75 bp, Artificial Sequence
  Synthetic
aaatttgacaactacaacatgtactattcgaaattgtaagaattttggtccaagagagaatgtagctgtaataca

SEQ ID NO: 299288 - DNA, 75 bp, Artificial Sequence
  Synthetic
aaatttgacaactacaacatgtactattcgaaattgtaagaattttggtccaagagagaatgttgctgtaataca

SEQ ID NO: 299289 - DNA, 75 bp, Artificial Sequence
  Synthetic
aaatttgacaactacaacatgtactattcgaaattgtaagaattttggtccaagagagaatgtcgctgtaataca

SEQ ID NO: 299290 - DNA, 75 bp, Artificial Sequence
  Synthetic
aaatttgacaactacaacatgtactattcgaaattgtaagaattttggtccaagagagaatgtggctgtaataca

SEQ ID NO: 299291 - DNA, 75 bp, Artificial Sequence
  Synthetic
aaatttgacaactacaacatgtactattcgaaattgtaagaactttggtccaagagagaatgtagctgtaataca

SEQ ID NO: 299292 - DNA, 75 bp, Artificial Sequence
  Synthetic
aaatttgacaactacaacatgtactattcgaaattgtaagaactttggtccaagagagaatgttgctgtaataca

SEQ ID NO: 299293 - DNA, 75 bp, Artificial Sequence
  Synthetic
aaatttgacaactacaacatgtactattcgaaattgtaagaactttggtccaagagagaatgtcgctgtaataca

SEQ ID NO: 299294 - DNA, 75 bp, Artificial Sequence
  Synthetic
aaatttgacaactacaacatgtactattcgaaattgtaagaactttggtccaagagagaatgtggctgtaataca

SEQ ID NO: 299295 - DNA, 75 bp, Artificial Sequence
  Synthetic
aaatttgacaactacaacatgtactattcgaaattgtaagaagtttggtccaagagagaatgtagctgtaataca

SEQ ID NO: 299296 - DNA, 75 bp, Artificial Sequence
  Synthetic
aaatttgacaactacaacatgtactattcgaaattgtaagaagtttggtccaagagagaatgttgctgtaataca

SEQ ID NO: 299297 - DNA, 75 bp, Artificial Sequence
  Synthetic
aaatttgacaactacaacatgtactattcgaaattgtaagaagtttggtccaagagagaatgtcgctgtaataca

SEQ ID NO: 299298 - DNA, 75 bp, Artificial Sequence
  Synthetic
aaatttgacaactacaacatgtactattcgaaattgtaagaagtttggtccaagagagaatgtggctgtaataca

SEQ ID NO: 299299 - DNA, 75 bp, Artificial Sequence
  Synthetic
aaatttgacaactactacatgtactattcgaaattgtaagaaatttggtccaagagagaatgtagctgtaataca

SEQ ID NO: 299300 - DNA, 75 bp, Artificial Sequence
  Synthetic
aaatttgacaactactacatgtactattcgaaattgtaagaaatttggtccaagagagaatgttgctgtaataca

SEQ ID NO: 299301 - DNA, 75 bp, Artificial Sequence
  Synthetic
aaatttgacaactactacatgtactattcgaaattgtaagaaatttggtccaagagagaatgtcgctgtaataca

SEQ ID NO: 299302 - DNA, 75 bp, Artificial Sequence
  Synthetic
aaatttgacaactactacatgtactattcgaaattgtaagaaatttggtccaagagagaatgtggctgtaataca

SEQ ID NO: 299303 - DNA, 75 bp, Artificial Sequence
  Synthetic
aaatttgacaactactacatgtactattcgaaattgtaagaattttggtccaagagagaatgtagctgtaataca

SEQ ID NO: 299304 - DNA, 75 bp, Artificial Sequence
  Synthetic
aaatttgacaactactacatgtactattcgaaattgtaagaattttggtccaagagagaatgttgctgtaataca

SEQ ID NO: 299305 - DNA, 75 bp, Artificial Sequence
  Synthetic
aaatttgacaactactacatgtactattcgaaattgtaagaattttggtccaagagagaatgtcgctgtaataca

SEQ ID NO: 299306 - DNA, 75 bp, Artificial Sequence
  Synthetic
aaatttgacaactactacatgtactattcgaaattgtaagaattttggtccaagagagaatgtggctgtaataca

SEQ ID NO: 299307 - DNA, 75 bp, Artificial Sequence
  Synthetic
aaatttgacaactactacatgtactattcgaaattgtaagaactttggtccaagagagaatgtagctgtaataca

SEQ ID NO: 299308 - DNA, 75 bp, Artificial Sequence
  Synthetic
aaatttgacaactactacatgtactattcgaaattgtaagaactttggtccaagagagaatgttgctgtaataca

SEQ ID NO: 299309 - DNA, 75 bp, Artificial Sequence
  Synthetic
aaatttgacaactactacatgtactattcgaaattgtaagaactttggtccaagagagaatgtcgctgtaataca

SEQ ID NO: 299310 - DNA, 75 bp, Artificial Sequence
  Synthetic
aaatttgacaactactacatgtactattcgaaattgtaagaactttggtccaagagagaatgtggctgtaataca

SEQ ID NO: 299311 - DNA, 75 bp, Artificial Sequence
  Synthetic
aaatttgacaactactacatgtactattcgaaattgtaagaagtttggtccaagagagaatgtagctgtaataca

SEQ ID NO: 299312 - DNA, 75 bp, Artificial Sequence
  Synthetic
aaatttgacaactactacatgtactattcgaaattgtaagaagtttggtccaagagagaatgttgctgtaataca

SEQ ID NO: 299313 - DNA, 75 bp, Artificial Sequence
  Synthetic
aaatttgacaactactacatgtactattcgaaattgtaagaagtttggtccaagagagaatgtcgctgtaataca

SEQ ID NO: 299314 - DNA, 75 bp, Artificial Sequence
  Synthetic
aaatttgacaactactacatgtactattcgaaattgtaagaagtttggtccaagagagaatgtggctgtaataca

SEQ ID NO: 299315 - DNA, 75 bp, Artificial Sequence
  Synthetic
aaatttgacaactaccacatgtactattcgaaattgtaagaaatttggtccaagagagaatgtagctgtaataca

SEQ ID NO: 299316 - DNA, 75 bp, Artificial Sequence
  Synthetic
aaatttgacaactaccacatgtactattcgaaattgtaagaaatttggtccaagagagaatgttgctgtaataca

SEQ ID NO: 299317 - DNA, 75 bp, Artificial Sequence
  Synthetic
aaatttgacaactaccacatgtactattcgaaattgtaagaaatttggtccaagagagaatgtcgctgtaataca

SEQ ID NO: 299318 - DNA, 75 bp, Artificial Sequence
  Synthetic
aaatttgacaactaccacatgtactattcgaaattgtaagaaatttggtccaagagagaatgtggctgtaataca

SEQ ID NO: 299319 - DNA, 75 bp, Artificial Sequence
  Synthetic
aaatttgacaactaccacatgtactattcgaaattgtaagaattttggtccaagagagaatgtagctgtaataca

SEQ ID NO: 299320 - DNA, 75 bp, Artificial Sequence
  Synthetic
aaatttgacaactaccacatgtactattcgaaattgtaagaattttggtccaagagagaatgttgctgtaataca

SEQ ID NO: 299321 - DNA, 75 bp, Artificial Sequence
  Synthetic
aaatttgacaactaccacatgtactattcgaaattgtaagaattttggtccaagagagaatgtcgctgtaataca

SEQ ID NO: 299322 - DNA, 75 bp, Artificial Sequence
  Synthetic
aaatttgacaactaccacatgtactattcgaaattgtaagaattttggtccaagagagaatgtggctgtaataca

SEQ ID NO: 299323 - DNA, 75 bp, Artificial Sequence
  Synthetic
aaatttgacaactaccacatgtactattcgaaattgtaagaactttggtccaagagagaatgtagctgtaataca

SEQ ID NO: 299324 - DNA, 75 bp, Artificial Sequence
  Synthetic
aaatttgacaactaccacatgtactattcgaaattgtaagaactttggtccaagagagaatgttgctgtaataca

SEQ ID NO: 299325 - DNA, 75 bp, Artificial Sequence
  Synthetic
aaatttgacaactaccacatgtactattcgaaattgtaagaactttggtccaagagagaatgtcgctgtaataca

SEQ ID NO: 299326 - DNA, 75 bp, Artificial Sequence
  Synthetic
aaatttgacaactaccacatgtactattcgaaattgtaagaactttggtccaagagagaatgtggctgtaataca

SEQ ID NO: 299327 - DNA, 75 bp, Artificial Sequence
  Synthetic
aaatttgacaactaccacatgtactattcgaaattgtaagaagtttggtccaagagagaatgtagctgtaataca

SEQ ID NO: 299328 - DNA, 75 bp, Artificial Sequence
  Synthetic
aaatttgacaactaccacatgtactattcgaaattgtaagaagtttggtccaagagagaatgttgctgtaataca

SEQ ID NO: 299329 - DNA, 75 bp, Artificial Sequence
  Synthetic
aaatttgacaactaccacatgtactattcgaaattgtaagaagtttggtccaagagagaatgtcgctgtaataca

SEQ ID NO: 299330 - DNA, 75 bp, Artificial Sequence
  Synthetic
aaatttgacaactaccacatgtactattcgaaattgtaagaagtttggtccaagagagaatgtggctgtaataca

SEQ ID NO: 299331 - DNA, 75 bp, Artificial Sequence
  Synthetic
aaatttgacaactacgacatgtactattcgaaattgtaagaaatttggtccaagagagaatgtagctgtaataca

SEQ ID NO: 299332 - DNA, 75 bp, Artificial Sequence
  Synthetic
aaatttgacaactacgacatgtactattcgaaattgtaagaaatttggtccaagagagaatgttgctgtaataca

SEQ ID NO: 299333 - DNA, 75 bp, Artificial Sequence
  Synthetic
aaatttgacaactacgacatgtactattcgaaattgtaagaaatttggtccaagagagaatgtcgctgtaataca

SEQ ID NO: 299334 - DNA, 75 bp, Artificial Sequence
  Synthetic
aaatttgacaactacgacatgtactattcgaaattgtaagaaatttggtccaagagagaatgtggctgtaataca

SEQ ID NO: 299335 - DNA, 75 bp, Artificial Sequence
  Synthetic
aaatttgacaactacgacatgtactattcgaaattgtaagaattttggtccaagagagaatgtagctgtaataca

SEQ ID NO: 299336 - DNA, 75 bp, Artificial Sequence
  Synthetic
aaatttgacaactacgacatgtactattcgaaattgtaagaattttggtccaagagagaatgttgctgtaataca

SEQ ID NO: 299337 - DNA, 75 bp, Artificial Sequence
  Synthetic
aaatttgacaactacgacatgtactattcgaaattgtaagaattttggtccaagagagaatgtcgctgtaataca

SEQ ID NO: 299338 - DNA, 75 bp, Artificial Sequence
  Synthetic
aaatttgacaactacgacatgtactattcgaaattgtaagaattttggtccaagagagaatgtggctgtaataca

SEQ ID NO: 299339 - DNA, 75 bp, Artificial Sequence
  Synthetic
aaatttgacaactacgacatgtactattcgaaattgtaagaactttggtccaagagagaatgtagctgtaataca

SEQ ID NO: 299340 - DNA, 75 bp, Artificial Sequence
  Synthetic
aaatttgacaactacgacatgtactattcgaaattgtaagaactttggtccaagagagaatgttgctgtaataca

SEQ ID NO: 299341 - DNA, 75 bp, Artificial Sequence
  Synthetic
aaatttgacaactacgacatgtactattcgaaattgtaagaactttggtccaagagagaatgtcgctgtaataca

SEQ ID NO: 299342 - DNA, 75 bp, Artificial Sequence
  Synthetic
aaatttgacaactacgacatgtactattcgaaattgtaagaactttggtccaagagagaatgtggctgtaataca

SEQ ID NO: 299343 - DNA, 75 bp, Artificial Sequence
  Synthetic
aaatttgacaactacgacatgtactattcgaaattgtaagaagtttggtccaagagagaatgtagctgtaataca

SEQ ID NO: 299344 - DNA, 75 bp, Artificial Sequence
  Synthetic
aaatttgacaactacgacatgtactattcgaaattgtaagaagtttggtccaagagagaatgttgctgtaataca

SEQ ID NO: 299345 - DNA, 75 bp, Artificial Sequence
  Synthetic
aaatttgacaactacgacatgtactattcgaaattgtaagaagtttggtccaagagagaatgtcgctgtaataca

SEQ ID NO: 299346 - DNA, 75 bp, Artificial Sequence
  Synthetic
aaatttgacaactacgacatgtactattcgaaattgtaagaagtttggtccaagagagaatgtggctgtaataca

SEQ ID NO: 299347 - DNA, 75 bp, Artificial Sequence
  Synthetic
ttccattggcgctttcagctagaaatataatatcacatagagctcaagcgaatgaagatatcgttgtgtcaaaga

SEQ ID NO: 299348 - DNA, 75 bp, Artificial Sequence
  Synthetic
catagcaaaatccatggcaacaaacgttatgaaaaagtttagaaagtctgctttagcaaactcagtttctacgtt

SEQ ID NO: 299349 - DNA, 75 bp, Artificial Sequence
  Synthetic
ccggtgggctaggttataaatggtcagagatttcatttaaaccagcaaactatcaatatacgtatacacgagatg

SEQ ID NO: 299350 - DNA, 75 bp, Artificial Sequence
  Synthetic
gttatagatacaaccacagcaacgaatactatagctacacaaactgcaacgatcagtaaacggttaagattaaaa

SEQ ID NO: 299351 - DNA, 75 bp, Artificial Sequence
  Synthetic
ggatgacatggctaatggaagatacacgccaggcataataccaccagtgaatgtcgataaaccgataccattagg

SEQ ID NO: 299352 - DNA, 75 bp, Artificial Sequence
  Synthetic
tgaagtaattaaagagaattcttatgtttatgttgattactgggatgattcacaagccttcaggaacatggttta

SEQ ID NO: 299353 - DNA, 75 bp, Artificial Sequence
  Synthetic
tgccagatatagtcacagaagcatcagagaaattcataccgaatagagcatacagagttatgaataacgatgaag

SEQ ID NO: 299354 - DNA, 75 bp, Artificial Sequence
  Synthetic
gcagtgtcattgcattcagctggtgttacgctatccacacagttcacagattttgtatcattaaattctttaagg

SEQ ID NO: 299355 - DNA, 75 bp, Artificial Sequence
  Synthetic
ctctccagtcatatcagctataatagatttcaagaccttaaaaaatttaaatgataattatggaataactaaaca

SEQ ID NO: 299356 - DNA, 75 bp, Artificial Sequence
  Synthetic
tatatacagacgtatcccagtgggactcatctcaacacaatacgcagccatttaggaaagggataattatgggat

SEQ ID NO: 299357 - DNA, 75 bp, Artificial Sequence
  Synthetic
aagaatattatgaagtggctggcagattctcactaatatcattggtaccatctaatgacgattaccagacaccaa

SEQ ID NO: 299358 - DNA, 75 bp, Artificial Sequence
  Synthetic
gatccacgagtattacgtgagtttattaaccaagataatccaataatacgtaatagaattgaaaatttaataatg

SEQ ID NO: 299359 - DNA, 75 bp, Artificial Sequence
  Synthetic
gaagtagaatttttgttgaatggacaaattattaatacatatcaagctagatttggcactattattgcaagaaat

SEQ ID NO: 299360 - DNA, 75 bp, Artificial Sequence
  Synthetic
aattgatttggcattacttccattggatatgttttcgatgttttccggtattaagagcaccatagatgcagctaa

SEQ ID NO: 299361 - DNA, 75 bp, Artificial Sequence
  Synthetic
tatagagttgttaaatattcatcagttgctaatcacgcagatagagtatttgctacatataaaaataatgctaag

SEQ ID NO: 299362 - DNA, 75 bp, Artificial Sequence
  Synthetic
aagtaactaaacaaatggttcaagatgtatcaaatgatgtgagagaaacgtatgcgcgaatgaatgctaaagtta

SEQ ID NO: 299363 - DNA, 75 bp, Artificial Sequence
  Synthetic
tcaagaggagcatctattcgttcagttggatcatcagcatcagcatggacggatgtctcaacacaaatcactgat

SEQ ID NO: 299364 - DNA, 75 bp, Artificial Sequence
  Synthetic
tattcaccatctagggaagataacttgcaacgtgtttttacggtagcttccattagaagcatgttgattaagtga

SEQ ID NO: 299365 - DNA, 75 bp, Artificial Sequence
  Synthetic
atgatatatctgctgcagtattgaagactaaaattgatcgatccactcaaatatctccaaacacattaccagata

SEQ ID NO: 299366 - DNA, 75 bp, Artificial Sequence
  Synthetic
attgattgactacgttttaaagactatgaattacgtaatggactacattgtatatagattcttgttaatcataac

SEQ ID NO: 299367 - DNA, 75 bp, Artificial Sequence
  Synthetic
atattgtgaatagacttcgaggattcgaaactgacagagaattcattttaactaaaataatgcaaatgacgtcag

SEQ ID NO: 299368 - DNA, 75 bp, Artificial Sequence
  Synthetic
ctaataataaaaagcaacaattatctgataaagtattatcacaaaaagaagagataataactgacgcacaagatg

SEQ ID NO: 299369 - DNA, 75 bp, Artificial Sequence
  Synthetic
ggacataaaaccagagcaggcaaagaagcaaactaaactgtttagaatatttgaaccaagacaattaccaatata

SEQ ID NO: 299370 - DNA, 75 bp, Artificial Sequence
  Synthetic
gtatcgtgttgaaacgttcgatgaaataccttttgatgtgcaaaagtttgcagatctagtaactgactctccggt

SEQ ID NO: 299371 - DNA, 75 bp, Artificial Sequence
  Synthetic
aaaccatttttgacttcaacattgtgtatctattacccaaatgatgtcctaactgaaattcaagatgataaatgg

SEQ ID NO: 299372 - DNA, 75 bp, Artificial Sequence
  Synthetic
ttttgaaaaaattagaagacataaaaccagaacaggccaaaaagcaaactaaattgtttagaatatttgaaccaa

SEQ ID NO: 299373 - DNA, 75 bp, Artificial Sequence
  Synthetic
gtattacgtgaatttatcaatcaagacaatccaataattcgtaacagaattgaacagttaataatgcagtgtaga

SEQ ID NO: 299374 - DNA, 75 bp, Artificial Sequence
  Synthetic
aattgtattgtgattataatataattataatgcgttattatgagaatatgacattagatatgtcagaattagctg

SEQ ID NO: 299375 - DNA, 75 bp, Artificial Sequence
  Synthetic
tgccgatgcaatatcagaaatttatgccaactttaccagacaatgtgcagtacataattcagtgtataggatcta

SEQ ID NO: 299376 - DNA, 75 bp, Artificial Sequence
  Synthetic
atgtactgtaaaggtgtgcccactggatacacaaactttaggtataggatgtactacgacggacgttaacacatt

SEQ ID NO: 299377 - DNA, 75 bp, Artificial Sequence
  Synthetic
tgtaataaattaggaccaagagagaatgtagccgtaatacaagtgggaggaccggagatactagatatcacagct

SEQ ID NO: 299378 - DNA, 75 bp, Artificial Sequence
  Synthetic
aaaatggtggcaagtattttacacaattgttgactatattaaccaaattgtcagagtgatgtccaaacgatcaag

SEQ ID NO: 299379 - DNA, 75 bp, Artificial Sequence
  Synthetic
tagacgtacactaacttctgatactaaactcgtgggaatattaaaatatggtggaagaatatggacatttcatgg

SEQ ID NO: 299380 - DNA, 75 bp, Artificial Sequence
  Synthetic
catttcagatgaaatacaggaagttggatcggaaaagactcagaatgtgacaataaatccaggaccgtttgccca

SEQ ID NO: 299381 - DNA, 75 bp, Artificial Sequence
  Synthetic
ccaccaatagattattggatcctaatgtcaccagattcacatggagtggtagcggaagcaacgaataacgaaaat

SEQ ID NO: 299382 - DNA, 75 bp, Artificial Sequence
  Synthetic
acaatggtctaccaccaattcaaaatactagaaatgtagtaccattatcattatcatctagatctatacagtata

SEQ ID NO: 299383 - DNA, 75 bp, Artificial Sequence
  Synthetic
catacaatactagaagatccagggatggcgtattttccttatattgcatctgtcctaacagttttgttcacattg

SEQ ID NO: 299384 - DNA, 75 bp, Artificial Sequence
  Synthetic
cgagtacgcaatggaaattcgttgatgcaattaagacctcggaagatggaagttacaatcaacatggacaacttt

SEQ ID NO: 299385 - DNA, 75 bp, Artificial Sequence
  Synthetic
ctaaccatctggtatccaatcttagttggcatgtagctacatcaagtcattcagactcttcaagtaaggacatga

SEQ ID NO: 299386 - DNA, 75 bp, Artificial Sequence
  Synthetic
tcagactcttcaagtaaggacatgatttcatgttcgctacgtagagtaactgtttgaatgatgtagtgagaggat

SEQ ID NO: 299387 - DNA, 75 bp, Artificial Sequence
  Synthetic
atctttgtgtatgttaattggaaatactacagttattccaagtccacaaacattatttcactattataatgtaaa

SEQ ID NO: 299388 - DNA, 75 bp, Artificial Sequence
  Synthetic
gaaattaatcaaaagaacgtgagaacgctagaagagtgggagagtggaaaaaatccttatgaaccaagagaagtg

SEQ ID NO: 299389 - DNA, 75 bp, Artificial Sequence
  Synthetic
taattatagtacagttaaggttaatgtactctgtgatttttacatcataccactagcgcaagaatctaaatgcac

SEQ ID NO: 299390 - DNA, 75 bp, Artificial Sequence
  Synthetic
tcaatattgagaacacgtacggtaaatttatatggattaccagccgctaatccaaataatggaaatgaatattac

SEQ ID NO: 299391 - DNA, 75 bp, Artificial Sequence
  Synthetic
aatgaggacattataatttcaaagtcgtcattatggaaagagatgcagtataatagggatattgtgataaggttt

SEQ ID NO: 299392 - DNA, 75 bp, Artificial Sequence
  Synthetic
atggcgtacagaaaacgtggagcgcgccgtgaggcaaatataagtagtaatgatcgaatgcaagaaaaggatgat

SEQ ID NO: 299393 - DNA, 75 bp, Artificial Sequence
  Synthetic
gagagatagtaactgcgcatacgacatgttcagtaaatggagtgaatgatttcagctataatggaggttcattgc

SEQ ID NO: 299394 - DNA, 75 bp, Artificial Sequence
  Synthetic
attagatggaccataccaaccaacttcatttaatccaccagtaggttattggatgttactttcacctactgcacc

SEQ ID NO: 299395 - DNA, 75 bp, Artificial Sequence
  Synthetic
cgttcgttcattagcagcaaatttgaatacagtgaaatgtgccggcgggcacttcagctttcagctaccagttgg

SEQ ID NO: 299396 - DNA, 75 bp, Artificial Sequence
  Synthetic
gaaaacgataccaacatttgaaccaaaagagtcaatactgaaaaaattagaagatattaaaccagaacaagcaaa

SEQ ID NO: 299397 - DNA, 75 bp, Artificial Sequence
  Synthetic
gatagtcaaacttaggaaagtagatactttaaaaccgatattgtataaaataaactctgattctaatgatttcta

SEQ ID NO: 299398 - DNA, 75 bp, Artificial Sequence
  Synthetic
aaaaaagacactttaccagatggagactatgatgtgagagagtattttctcaatttgtatgaccaagtgctaact

SEQ ID NO: 299399 - DNA, 75 bp, Artificial Sequence
  Synthetic
agaatccatacatacagtggccaaacgccaaacgcaaccactggctattattcagctaccaattatgactcagtg

SEQ ID NO: 299400 - DNA, 75 bp, Artificial Sequence
  Synthetic
ttcagattcaatttgtctgtggaagagccaccgttttcaatatcgcgaacacgagtgaacggactgtatgggtta

SEQ ID NO: 299401 - DNA, 75 bp, Artificial Sequence
  Synthetic
atataataccacgatctgaagagtccaaatgtactgaatatattaataatgggttaccaccgattcaaaatacaa

SEQ ID NO: 299402 - DNA, 75 bp, Artificial Sequence
  Synthetic
taatgaattcagtgacggtgagacaggatttagacaggcagttaggagaacttagggaagaatttaacacattat

SEQ ID NO: 299403 - DNA, 75 bp, Artificial Sequence
  Synthetic
gcagagatgagacaacgtgtgcaagctgatagaaatgttgttaactatccatcaatattgcatccaatagactac

SEQ ID NO: 299404 - DNA, 75 bp, Artificial Sequence
  Synthetic
aatgcaatataacagggatataacaataagatttaaatttgcaaattcaattgttaaatctggtggattaggtta

SEQ ID NO: 299405 - DNA, 75 bp, Artificial Sequence
  Synthetic
atctatggctactaatgtaatgaaaagatttaagagatcaaagttagctgaatcggtgtcagaattaacagattc

SEQ ID NO: 299406 - DNA, 75 bp, Artificial Sequence
  Synthetic
gccatcgactgccagatatataagaccaaatttacttcaggacaggctgaatttacatgataatttcgaatcact

SEQ ID NO: 299407 - DNA, 75 bp, Artificial Sequence
  Synthetic
gattattcatattatactaataatgaaataagaacggatcagcattgggtaactaaaactgatataattgattat

SEQ ID NO: 299408 - DNA, 75 bp, Artificial Sequence
  Synthetic
gaagtttctaatacaatttcaactcaaacgtcgatcattagtagacgtttgagattgaaagaaatgacgacacag

SEQ ID NO: 299409 - DNA, 75 bp, Artificial Sequence
  Synthetic
aattcttatgtgtacattgattattgggatgattctcaagcttttagaaatatggtttatgtaagatctttagct

SEQ ID NO: 299410 - DNA, 75 bp, Artificial Sequence
  Synthetic
caagatctgcaattagaagcgctaacgatccaatcagaaacacagtttcttacaggtataaattcgcaagcagct

SEQ ID NO: 299411 - DNA, 75 bp, Artificial Sequence
  Synthetic
cagaagcttcagaaaagttcattccaaacagatcgtatcgagtaattgataacgatagtgtgtttgaagctggaa

SEQ ID NO: 299412 - DNA, 75 bp, Artificial Sequence
  Synthetic
cagcaatgttaagtcaacgcactatgtcattagactttgtgactaccaattatatgtcattgatttcaggaatgt

SEQ ID NO: 299413 - DNA, 75 bp, Artificial Sequence
  Synthetic
tatgagaactagagttagtgggctatatggactgcctgcagctaatccaaataacgggagagaatattatgagat

SEQ ID NO: 299414 - DNA, 75 bp, Artificial Sequence
  Synthetic
ataaatattcttttataaccaaaataatcagagttgatggtgatgataattatgcagtattacaatttaacaccg

SEQ ID NO: 299415 - DNA, 75 bp, Artificial Sequence
  Synthetic
ggcaataatagattttaaaactattaaaaatttaaatgataattatgggattacaaaacagcaggcttttaattt

SEQ ID NO: 299416 - DNA, 75 bp, Artificial Sequence
  Synthetic
ttacaaaacagcaggcttttaatttgttgcggtcagatcctagagtgttaagagaatttataaatcaggaaaatc

SEQ ID NO: 299417 - DNA, 75 bp, Artificial Sequence
  Synthetic
ttaggtgagcttagagaagaatttaatgctttgtcacaggaaatagcaatgtctcaactaatcgatctagcacta

SEQ ID NO: 299418 - DNA, 75 bp, Artificial Sequence
  Synthetic
gatgctacaatggattcttcaatatcaatatctactacatcaaagaaggagaaatctaaacaagagaacaaaaat

SEQ ID NO: 299419 - DNA, 75 bp, Artificial Sequence
  Synthetic
tattagtagacggttacgactgaaggaaatggcaacacaaactgaaggaatgaattttgatgatatatctgctgc

SEQ ID NO: 299420 - DNA, 75 bp, Artificial Sequence
  Synthetic
actttcattcaaattataatgagagaattaacgatgcagtggctataataactgcagccaatagattaaatttgt

SEQ ID NO: 299421 - DNA, 75 bp, Artificial Sequence
  Synthetic
actgcagccaatagattaaatttgtatcagaaaaagatgaaggcaattgttgaagatttcttaaaaagactacat

SEQ ID NO: 299422 - DNA, 75 bp, Artificial Sequence
  Synthetic
aaacaatgtaaccacagagaatgtatttatacaacctccttttaaattaaaaacgtcacctaatgattatatagt

SEQ ID NO: 299423 - DNA, 75 bp, Artificial Sequence
  Synthetic
tcaatccagatttctccaaacacattaccagacattgttactgaagcttcagagaaatttattcctaatagggca

SEQ ID NO: 299424 - DNA, 75 bp, Artificial Sequence
  Synthetic
ggaaattaacgtatgtaggatataatggaaaaaatacacgtggtcactataatttctcatttttatgtcaaaatg

SEQ ID NO: 299425 - DNA, 75 bp, Artificial Sequence
  Synthetic
gatataattatgcatttgatcttaaacgatggatttatttacactcaattggaaaggccgctgtagaaggtggaa

SEQ ID NO: 299426 - DNA, 75 bp, Artificial Sequence
  Synthetic
gttttttgcgtatcgcgttgatacgtttgaagaaataccatttgatgttcaaaaattcgcagacttagtgactga

SEQ ID NO: 299427 - DNA, 75 bp, Artificial Sequence
  Synthetic
cccaaatagttaagctgagaaaagttgatactttaaggccaatactatataaaataaattctgactcaaacgatt

SEQ ID NO: 299428 - DNA, 75 bp, Artificial Sequence
  Synthetic
atgatacatggaaaccttcacctccaactaagtataaaggatggtgtttagattgttgtcagcatactgacttaa

SEQ ID NO: 299429 - DNA, 75 bp, Artificial Sequence
  Synthetic
aaaataaattctgactcaaacgatttttacttggtcgctaactatgattgggtaccaacttcgactacaaaagtg

SEQ ID NO: 299430 - DNA, 75 bp, Artificial Sequence
  Synthetic
tattcagatttacttgcattcgtgtcagccgatacagtagaaccaataaatgcggtcgcattcgataatatgcgc

SEQ ID NO: 299431 - DNA, 75 bp, Artificial Sequence
  Synthetic
gatttaaagaatttaattgatatgtatgaaacgctatttcctataaaccagaaaatagtgtatagattcattaat

SEQ ID NO: 299432 - DNA, 75 bp, Artificial Sequence
  Synthetic
gatatgctaatgaaattgaaggatatataaataaagtatatagtataacctatgctgatgacccaaattacttta

SEQ ID NO: 299433 - DNA, 75 bp, Artificial Sequence
  Synthetic
gaaaaagaactagtttcaactgaagctcagatacagaaaatgtctcaagatttgcagcttgaagctttaacaata

SEQ ID NO: 299434 - DNA, 75 bp, Artificial Sequence
  Synthetic
agaacaacaaatacaaaattttcaagtagctaattggttacattttattaataataatagatttagacaagttgt

SEQ ID NO: 299435 - DNA, 75 bp, Artificial Sequence
  Synthetic
aaagaaattgaaaccactgccacagctgaaggaggtgaaatagtgtttcaaaatgctgcattcactatgtggaag

SEQ ID NO: 299436 - DNA, 75 bp, Artificial Sequence
  Synthetic
ccaatgactacgttcacagttaataaattgaagcaattatatgaaaaggatagaactgcagaatatgattcaggt

SEQ ID NO: 299437 - DNA, 75 bp, Artificial Sequence
  Synthetic
acacaatgtaaactaaaaatggcatctaaattaattaaaccaaattatgtaacttcgaatcataaaacgtcagct

SEQ ID NO: 299438 - DNA, 75 bp, Artificial Sequence
  Synthetic
ctcatcacaggaaaagatatatgaatatgttgaagatgttctgaatgtgtgtgacgccgaaaaatggaaaacgtc

SEQ ID NO: 299439 - DNA, 75 bp, Artificial Sequence
  Synthetic
ctcatcacaggaaaagatatatgaatatgttgaagatgttctgaatgtgtgtgacgccgaaatatggaaaacgtc

SEQ ID NO: 299440 - DNA, 75 bp, Artificial Sequence
  Synthetic
ctcatcacaggaaaagatatatgaatatgttgaagatgttctgaatgtgtgtgacgccgaaacatggaaaacgtc

SEQ ID NO: 299441 - DNA, 75 bp, Artificial Sequence
  Synthetic
ctcatcacaggaaaagatatatgaatatgttgaagatgttctgaatgtgtgtgacgccgaaagatggaaaacgtc

SEQ ID NO: 299442 - DNA, 75 bp, Artificial Sequence
  Synthetic
ataacacatggtaaaggtcactacagagttgttaaatattcatcagttgctaatcacgctgatagagtatttgct

SEQ ID NO: 299443 - DNA, 75 bp, Artificial Sequence
  Synthetic
gttatgaaagataaaccgtactatttagtaacttgggcaaattcagctatagaaatgcttatgtcagtgttttct

SEQ ID NO: 299444 - DNA, 75 bp, Artificial Sequence
  Synthetic
cattatctacgcaattcacagatttcgtatcattgaattcattacgatttagatttagtttgacagtggatgaac

SEQ ID NO: 299445 - DNA, 75 bp, Artificial Sequence
  Synthetic
ttcgctcatttctttagttccaactaatgatgattatcagactccaattatgaattcagtaacagtaagacaaga

SEQ ID NO: 299446 - DNA, 75 bp, Artificial Sequence
  Synthetic
tgagttacaagaaatgattgataatatgaaaaaagctggtttagtagatataccaagaatgattcaagaatggtt

SEQ ID NO: 299447 - DNA, 75 bp, Artificial Sequence
  Synthetic
aagatgtagataatgaaatgtacagtgaatatacaatgttaattagagatgaaatagtaaagatgttagaagtac

SEQ ID NO: 299448 - DNA, 75 bp, Artificial Sequence
  Synthetic
tcacaatcgaatcagttgttgtcatacggtgatgttacaagatttttatcaagtaattctatggtattgtataca

SEQ ID NO: 299449 - DNA, 75 bp, Artificial Sequence
  Synthetic
tgacagaatatttttaatgtttaaaggattaatgaggcaatgcaactatgaatatacgtatgaatagtcacataa

SEQ ID NO: 299450 - DNA, 75 bp, Artificial Sequence
  Synthetic
tttaattaaatcgaatccaaatgtattacgtaatttcattaaccaaaataatccaattataaggaatagaattga

SEQ ID NO: 299451 - DNA, 75 bp, Artificial Sequence
  Synthetic
aaaaatgaaatcaatagttgaggattttttaaaaagattgcaaatttttgatgtaccacgagtaccagatgatca

SEQ ID NO: 299452 - DNA, 75 bp, Artificial Sequence
  Synthetic
aatgactgtttcaagaccttgatcgcagcaatgttaagtcaacgaaccatgtcgcttgatttcgtgactacaaat

SEQ ID NO: 299453 - DNA, 75 bp, Artificial Sequence
  Synthetic
aataagctacgagggtttgagacagatagggaatttatactaactaagattatccaaatgacatctgtagccatt

SEQ ID NO: 299454 - DNA, 75 bp, Artificial Sequence
  Synthetic
aatgcaaatgacgtcagttgctattactggatcattaagacttttcccttcggaacgtgtattaaccacaaattc

SEQ ID NO: 299455 - DNA, 75 bp, Artificial Sequence
  Synthetic
tgttattaatttgattaataaacaaaaacaatcactaattactgttcgtataaataacacttttaaagacgaacc

SEQ ID NO: 299456 - DNA, 75 bp, Artificial Sequence
  Synthetic
aatataagagaaagtatttcgcacttagaatgagaatgaaacaagtcgcaatgcaactgattgaagatttgtaag

SEQ ID NO: 299457 - DNA, 75 bp, Artificial Sequence
  Synthetic
tgatagaacattcttgatgttgaaaggacttgtaaggcaatgcaactatgaatgtacatatgaatagtcacataa

SEQ ID NO: 299458 - DNA, 75 bp, Artificial Sequence
  Synthetic
aagtcgcaatgcaattgattaaagatttgtgaaaattttctgattactcttatcattaactattaaatatttact

SEQ ID NO: 299459 - DNA, 75 bp, Artificial Sequence
  Synthetic
taattatattatacaatagtattattatatcgcgttattgaatttaacaactttctaatgatagaagattaatgc

SEQ ID NO: 299460 - DNA, 75 bp, Artificial Sequence
  Synthetic
taatgggtattcaatatgattataatgaagtatatactagagttaaaagtaagtttgattttgtaatggatgatt

SEQ ID NO: 299461 - DNA, 75 bp, Artificial Sequence
  Synthetic
aatatgaagtaatgaaagataaaccatattatttagtaacttgggcaaattcgtcaattgaaatgttaatgtctg

SEQ ID NO: 299462 - DNA, 75 bp, Artificial Sequence
  Synthetic
tattgtcatcgaaaggaattgatcaaaaaatgagagttcttaatgcatgctttagtgttaagagagtacctggaa

SEQ ID NO: 299463 - DNA, 75 bp, Artificial Sequence
  Synthetic
aaacaagagaaaaatccgtttaaaggattgtcaactgatagaaagatggatgaagtctcacatgttggaatttaa

SEQ ID NO: 299464 - DNA, 75 bp, Artificial Sequence
  Synthetic
taggttatcaaatcgtgtatttagagataaattatttccatctattgtaaacatacataaaaaagtgataaatgt

SEQ ID NO: 299465 - DNA, 75 bp, Artificial Sequence
  Synthetic
aaaggattaggaacgatgtcaattacattctaaacatggatatgaatttaccatcaacggcgagatacattagac

SEQ ID NO: 299466 - DNA, 75 bp, Artificial Sequence
  Synthetic
cactaacgtgatagaaaatttgcataatccaagttttaaaatacagattacacgtaattgtagtgatttttcttc

SEQ ID NO: 299467 - DNA, 75 bp, Artificial Sequence
  Synthetic
ttgggatgtcattaatttattagttcagagtgttgataaagtaccgcaaatactgactctaaatgatattgtcat

SEQ ID NO: 299468 - DNA, 75 bp, Artificial Sequence
  Synthetic
attacacttatacctatgagtaaacatagcatattaccatcttcacgtaaccctctatgagcacaatagttaaaa

SEQ ID NO: 299469 - DNA, 75 bp, Artificial Sequence
  Synthetic
ggatggccaactggttctgtctatcttaaaagttacacagatattgcaactttttcaataaatccgcaattatat

SEQ ID NO: 299470 - DNA, 75 bp, Artificial Sequence
  Synthetic
aaaacaaaggaagaacatcagaaagaaatacagtatgaaatattacagaaaactataccaacattcgaacctaaa

SEQ ID NO: 299471 - DNA, 75 bp, Artificial Sequence
  Synthetic
agtatacctgtaggtgcatggccagttatgaatggaggtgctgtttcgttgcattttgctggtgttacattatct

SEQ ID NO: 299472 - DNA, 75 bp, Artificial Sequence
  Synthetic
agttgatttaactagattattagcttacaattatgagacgttaatggcatgcattacaatgaacatgcagcacgt

SEQ ID NO: 299473 - DNA, 75 bp, Artificial Sequence
  Synthetic
aaatttggtcgtaaaacgatattttcaactaagaaaaatatgcacgtcatggatgatattgcacatggaagatat

SEQ ID NO: 299474 - DNA, 75 bp, Artificial Sequence
  Synthetic
tctgtctaataataattttaacttaataggtacaaatatagaaaattcagtatctggacatgtgtataatgcatt

SEQ ID NO: 299475 - DNA, 75 bp, Artificial Sequence
  Synthetic
gaataaatactacaaagttacatatagattccatttatttaaggaaaataaaaggtgacacggtgtttgatatga

SEQ ID NO: 299476 - DNA, 75 bp, Artificial Sequence
  Synthetic
ttcattcgaagctgcagttgtcgctgctacttctactcttgagttaatggggatagaatatgactacaatgaagt

SEQ ID NO: 299477 - DNA, 75 bp, Artificial Sequence
  Synthetic
atgtatggtattgaatataccacagttctattttatttgatatcgtttgttcttgtgagttatattctgaaaact

SEQ ID NO: 299478 - DNA, 75 bp, Artificial Sequence
  Synthetic
ggcagatttagttcagctatcagaaacaggaattggatgtctgattctagaacggtagctaaacttgatgaggac

SEQ ID NO: 299479 - DNA, 75 bp, Artificial Sequence
  Synthetic
catcaataataaagtgtactaaattaatgaaggataaattggaacgtggagaagtagaagtggatgattcttttg

SEQ ID NO: 299480 - DNA, 75 bp, Artificial Sequence
  Synthetic
taacaattgggtttataaagcaaaaaaagtaaatgaaaatatgcattctttacaggacgtgatagcgagacaaca

SEQ ID NO: 299481 - DNA, 75 bp, Artificial Sequence
  Synthetic
agatttagtttgacagtggatgaaccatctttttcaatattgagaacacgtacagtgaatttgtacggattacca

SEQ ID NO: 299482 - DNA, 75 bp, Artificial Sequence
  Synthetic
tcaatggagttgcctgaagagataaagtctgacatagagcagcaaattaattctatagacttaataaatccagta

SEQ ID NO: 299483 - DNA, 75 bp, Artificial Sequence
  Synthetic
aatgctatcgatgatctagagcaaataataagaaatttaatttctgattatgataagatatttttgatgttcaaa

SEQ ID NO: 299484 - DNA, 75 bp, Artificial Sequence
  Synthetic
cggaactcttcatcgcaagccccattggacctgatgattgactgagaagccacagtcaatcatatcgcgtgtggc

SEQ ID NO: 299485 - DNA, 75 bp, Artificial Sequence
  Synthetic
agaaaacgtggagcgcgccgtgaggcgaatataagtaataatgatcgaatgcaagaaaaggatgatgaaaaacaa

SEQ ID NO: 299486 - DNA, 75 bp, Artificial Sequence
  Synthetic
agtatgaaatactacagaaaacgataccaacatttgaaccaaaagagtcaatattgaaaaaattggaagatatta

SEQ ID NO: 299487 - DNA, 75 bp, Artificial Sequence
  Synthetic
ttttaaattggatcaatttgcaaatcatatgagcatatcacgacgatcacatcagatacgattttcggagtcagc

SEQ ID NO: 299488 - DNA, 75 bp, Artificial Sequence
  Synthetic
gtgtcacaatttgacattggacaatataaaaatatgttaaatgtagttactactatctattactactataatttg

SEQ ID NO: 299489 - DNA, 75 bp, Artificial Sequence
  Synthetic
agaaatgacgttaattacatacttaatatggataggaacttgccatcgactgctagatatataagaccaaattta

SEQ ID NO: 299490 - DNA, 75 bp, Artificial Sequence
  Synthetic
aagagagatggctcggtaagagactatcgcaatttgacatcggtcagtataaaaatatgttaaatgtattaacaa

SEQ ID NO: 299491 - DNA, 75 bp, Artificial Sequence
  Synthetic
atccagcgtttggaatgcagcggatgcattacaggaatggagacccacagacaccatttcaaatagcagaacaac

SEQ ID NO: 299492 - DNA, 75 bp, Artificial Sequence
  Synthetic
cttgaccagactgttagcctacaattacgaaacactaatggcatgtatcacaatgaacatgcagcatgttcaaac

SEQ ID NO: 299493 - DNA, 75 bp, Artificial Sequence
  Synthetic
catttaaggatgaaccaaaagtggggtttaaagatatttacgattggacttttttgccaactgattttgaaacga

SEQ ID NO: 299494 - DNA, 75 bp, Artificial Sequence
  Synthetic
tagaattagagttttcaaataaatacgtgcatgccatagtaccagatcaaacatttgatgaattaaaacagatgc

SEQ ID NO: 299495 - DNA, 75 bp, Artificial Sequence
  Synthetic
gtatacagaagatgtagatgacgaaatgtatcgtgaatacacaatgctaataagagatgaagttgttaaaatgct

SEQ ID NO: 299496 - DNA, 75 bp, Artificial Sequence
  Synthetic
ggatttcaacaaataaatttagaagaattgatgagaacaggtgattatgcgcaaataactaacatgcttctgaat

SEQ ID NO: 299497 - DNA, 75 bp, Artificial Sequence
  Synthetic
tatattgaactatatacttaaatcagttgcaagaactatggactatataatttatcgatttctattaattattct

SEQ ID NO: 299498 - DNA, 75 bp, Artificial Sequence
  Synthetic
aaatgtcaaaatgcagctacagacgatgacgcaataatagaatatatctactcaaatgaattagatttccagaat

SEQ ID NO: 299499 - DNA, 75 bp, Artificial Sequence
  Synthetic
tttcttacttcgactctttgtctctactatcctgctgaagcagccacagaaattagtgacacaaattggaaagat

SEQ ID NO: 299500 - DNA, 75 bp, Artificial Sequence
  Synthetic
aatttaatcaaatgatagtaactatgaatggaaatgaatttcaaactggaggaattggaaatttaccaattagaa

SEQ ID NO: 299501 - DNA, 75 bp, Artificial Sequence
  Synthetic
aatttaatcaaatgatagtaactatgaatggaaatgaatttcaaactggaggaattggtaatttaccaattagaa

SEQ ID NO: 299502 - DNA, 75 bp, Artificial Sequence
  Synthetic
aatttaatcaaatgatagtaactatgaatggaaatgaatttcaaactggaggaattggcaatttaccaattagaa

SEQ ID NO: 299503 - DNA, 75 bp, Artificial Sequence
  Synthetic
aatttaatcaaatgatagtaactatgaatggaaatgaatttcaaactggaggaattgggaatttaccaattagaa

SEQ ID NO: 299504 - DNA, 75 bp, Artificial Sequence
  Synthetic
aatttaatcaaatgatagtaactatgaatggaaatgattttcaaactggaggaattggaaatttaccaattagaa

SEQ ID NO: 299505 - DNA, 75 bp, Artificial Sequence
  Synthetic
aatttaatcaaatgatagtaactatgaatggaaatgattttcaaactggaggaattggtaatttaccaattagaa

SEQ ID NO: 299506 - DNA, 75 bp, Artificial Sequence
  Synthetic
aatttaatcaaatgatagtaactatgaatggaaatgattttcaaactggaggaattggcaatttaccaattagaa

SEQ ID NO: 299507 - DNA, 75 bp, Artificial Sequence
  Synthetic
aatttaatcaaatgatagtaactatgaatggaaatgattttcaaactggaggaattgggaatttaccaattagaa

SEQ ID NO: 299508 - DNA, 75 bp, Artificial Sequence
  Synthetic
aatttaatcaaatgatagtaactatgaatggaaatgactttcaaactggaggaattggaaatttaccaattagaa

SEQ ID NO: 299509 - DNA, 75 bp, Artificial Sequence
  Synthetic
aatttaatcaaatgatagtaactatgaatggaaatgactttcaaactggaggaattggtaatttaccaattagaa

SEQ ID NO: 299510 - DNA, 75 bp, Artificial Sequence
  Synthetic
aatttaatcaaatgatagtaactatgaatggaaatgactttcaaactggaggaattggcaatttaccaattagaa

SEQ ID NO: 299511 - DNA, 75 bp, Artificial Sequence
  Synthetic
aatttaatcaaatgatagtaactatgaatggaaatgactttcaaactggaggaattgggaatttaccaattagaa

SEQ ID NO: 299512 - DNA, 75 bp, Artificial Sequence
  Synthetic
aatttaatcaaatgatagtaactatgaatggaaatgagtttcaaactggaggaattggaaatttaccaattagaa

SEQ ID NO: 299513 - DNA, 75 bp, Artificial Sequence
  Synthetic
aatttaatcaaatgatagtaactatgaatggaaatgagtttcaaactggaggaattggtaatttaccaattagaa

SEQ ID NO: 299514 - DNA, 75 bp, Artificial Sequence
  Synthetic
aatttaatcaaatgatagtaactatgaatggaaatgagtttcaaactggaggaattggcaatttaccaattagaa

SEQ ID NO: 299515 - DNA, 75 bp, Artificial Sequence
  Synthetic
aatttaatcaaatgatagtaactatgaatggaaatgagtttcaaactggaggaattgggaatttaccaattagaa

SEQ ID NO: 299516 - DNA, 75 bp, Artificial Sequence
  Synthetic
aatttaatcaaatgatagttactatgaatggaaatgaatttcaaactggaggaattggaaatttaccaattagaa

SEQ ID NO: 299517 - DNA, 75 bp, Artificial Sequence
  Synthetic
aatttaatcaaatgatagttactatgaatggaaatgaatttcaaactggaggaattggtaatttaccaattagaa

SEQ ID NO: 299518 - DNA, 75 bp, Artificial Sequence
  Synthetic
aatttaatcaaatgatagttactatgaatggaaatgaatttcaaactggaggaattggcaatttaccaattagaa

SEQ ID NO: 299519 - DNA, 75 bp, Artificial Sequence
  Synthetic
aatttaatcaaatgatagttactatgaatggaaatgaatttcaaactggaggaattgggaatttaccaattagaa

SEQ ID NO: 299520 - DNA, 75 bp, Artificial Sequence
  Synthetic
aatttaatcaaatgatagttactatgaatggaaatgattttcaaactggaggaattggaaatttaccaattagaa

SEQ ID NO: 299521 - DNA, 75 bp, Artificial Sequence
  Synthetic
aatttaatcaaatgatagttactatgaatggaaatgattttcaaactggaggaattggtaatttaccaattagaa

SEQ ID NO: 299522 - DNA, 75 bp, Artificial Sequence
  Synthetic
aatttaatcaaatgatagttactatgaatggaaatgattttcaaactggaggaattggcaatttaccaattagaa

SEQ ID NO: 299523 - DNA, 75 bp, Artificial Sequence
  Synthetic
aatttaatcaaatgatagttactatgaatggaaatgattttcaaactggaggaattgggaatttaccaattagaa

SEQ ID NO: 299524 - DNA, 75 bp, Artificial Sequence
  Synthetic
aatttaatcaaatgatagttactatgaatggaaatgactttcaaactggaggaattggaaatttaccaattagaa

SEQ ID NO: 299525 - DNA, 75 bp, Artificial Sequence
  Synthetic
aatttaatcaaatgatagttactatgaatggaaatgactttcaaactggaggaattggtaatttaccaattagaa

SEQ ID NO: 299526 - DNA, 75 bp, Artificial Sequence
  Synthetic
aatttaatcaaatgatagttactatgaatggaaatgactttcaaactggaggaattggcaatttaccaattagaa

SEQ ID NO: 299527 - DNA, 75 bp, Artificial Sequence
  Synthetic
aatttaatcaaatgatagttactatgaatggaaatgactttcaaactggaggaattgggaatttaccaattagaa

SEQ ID NO: 299528 - DNA, 75 bp, Artificial Sequence
  Synthetic
aatttaatcaaatgatagttactatgaatggaaatgagtttcaaactggaggaattggaaatttaccaattagaa

SEQ ID NO: 299529 - DNA, 75 bp, Artificial Sequence
  Synthetic
aatttaatcaaatgatagttactatgaatggaaatgagtttcaaactggaggaattggtaatttaccaattagaa

SEQ ID NO: 299530 - DNA, 75 bp, Artificial Sequence
  Synthetic
aatttaatcaaatgatagttactatgaatggaaatgagtttcaaactggaggaattggcaatttaccaattagaa

SEQ ID NO: 299531 - DNA, 75 bp, Artificial Sequence
  Synthetic
aatttaatcaaatgatagttactatgaatggaaatgagtttcaaactggaggaattgggaatttaccaattagaa

SEQ ID NO: 299532 - DNA, 75 bp, Artificial Sequence
  Synthetic
aatttaatcaaatgatagtcactatgaatggaaatgaatttcaaactggaggaattggaaatttaccaattagaa

SEQ ID NO: 299533 - DNA, 75 bp, Artificial Sequence
  Synthetic
aatttaatcaaatgatagtcactatgaatggaaatgaatttcaaactggaggaattggtaatttaccaattagaa

SEQ ID NO: 299534 - DNA, 75 bp, Artificial Sequence
  Synthetic
aatttaatcaaatgatagtcactatgaatggaaatgaatttcaaactggaggaattggcaatttaccaattagaa

SEQ ID NO: 299535 - DNA, 75 bp, Artificial Sequence
  Synthetic
aatttaatcaaatgatagtcactatgaatggaaatgaatttcaaactggaggaattgggaatttaccaattagaa

SEQ ID NO: 299536 - DNA, 75 bp, Artificial Sequence
  Synthetic
aatttaatcaaatgatagtcactatgaatggaaatgattttcaaactggaggaattggaaatttaccaattagaa

SEQ ID NO: 299537 - DNA, 75 bp, Artificial Sequence
  Synthetic
aatttaatcaaatgatagtcactatgaatggaaatgattttcaaactggaggaattggtaatttaccaattagaa

SEQ ID NO: 299538 - DNA, 75 bp, Artificial Sequence
  Synthetic
aatttaatcaaatgatagtcactatgaatggaaatgattttcaaactggaggaattggcaatttaccaattagaa

SEQ ID NO: 299539 - DNA, 75 bp, Artificial Sequence
  Synthetic
aatttaatcaaatgatagtcactatgaatggaaatgattttcaaactggaggaattgggaatttaccaattagaa

SEQ ID NO: 299540 - DNA, 75 bp, Artificial Sequence
  Synthetic
aatttaatcaaatgatagtcactatgaatggaaatgactttcaaactggaggaattggaaatttaccaattagaa

SEQ ID NO: 299541 - DNA, 75 bp, Artificial Sequence
  Synthetic
aatttaatcaaatgatagtcactatgaatggaaatgactttcaaactggaggaattggtaatttaccaattagaa

SEQ ID NO: 299542 - DNA, 75 bp, Artificial Sequence
  Synthetic
aatttaatcaaatgatagtcactatgaatggaaatgactttcaaactggaggaattggcaatttaccaattagaa

SEQ ID NO: 299543 - DNA, 75 bp, Artificial Sequence
  Synthetic
aatttaatcaaatgatagtcactatgaatggaaatgactttcaaactggaggaattgggaatttaccaattagaa

SEQ ID NO: 299544 - DNA, 75 bp, Artificial Sequence
  Synthetic
aatttaatcaaatgatagtcactatgaatggaaatgagtttcaaactggaggaattggaaatttaccaattagaa

SEQ ID NO: 299545 - DNA, 75 bp, Artificial Sequence
  Synthetic
aatttaatcaaatgatagtcactatgaatggaaatgagtttcaaactggaggaattggtaatttaccaattagaa

SEQ ID NO: 299546 - DNA, 75 bp, Artificial Sequence
  Synthetic
aatttaatcaaatgatagtcactatgaatggaaatgagtttcaaactggaggaattggcaatttaccaattagaa

SEQ ID NO: 299547 - DNA, 75 bp, Artificial Sequence
  Synthetic
aatttaatcaaatgatagtcactatgaatggaaatgagtttcaaactggaggaattgggaatttaccaattagaa

SEQ ID NO: 299548 - DNA, 75 bp, Artificial Sequence
  Synthetic
aatttaatcaaatgatagtgactatgaatggaaatgaatttcaaactggaggaattggaaatttaccaattagaa

SEQ ID NO: 299549 - DNA, 75 bp, Artificial Sequence
  Synthetic
aatttaatcaaatgatagtgactatgaatggaaatgaatttcaaactggaggaattggtaatttaccaattagaa

SEQ ID NO: 299550 - DNA, 75 bp, Artificial Sequence
  Synthetic
aatttaatcaaatgatagtgactatgaatggaaatgaatttcaaactggaggaattggcaatttaccaattagaa

SEQ ID NO: 299551 - DNA, 75 bp, Artificial Sequence
  Synthetic
aatttaatcaaatgatagtgactatgaatggaaatgaatttcaaactggaggaattgggaatttaccaattagaa

SEQ ID NO: 299552 - DNA, 75 bp, Artificial Sequence
  Synthetic
aatttaatcaaatgatagtgactatgaatggaaatgattttcaaactggaggaattggaaatttaccaattagaa

SEQ ID NO: 299553 - DNA, 75 bp, Artificial Sequence
  Synthetic
aatttaatcaaatgatagtgactatgaatggaaatgattttcaaactggaggaattggtaatttaccaattagaa

SEQ ID NO: 299554 - DNA, 75 bp, Artificial Sequence
  Synthetic
aatttaatcaaatgatagtgactatgaatggaaatgattttcaaactggaggaattggcaatttaccaattagaa

SEQ ID NO: 299555 - DNA, 75 bp, Artificial Sequence
  Synthetic
aatttaatcaaatgatagtgactatgaatggaaatgattttcaaactggaggaattgggaatttaccaattagaa

SEQ ID NO: 299556 - DNA, 75 bp, Artificial Sequence
  Synthetic
aatttaatcaaatgatagtgactatgaatggaaatgactttcaaactggaggaattggaaatttaccaattagaa

SEQ ID NO: 299557 - DNA, 75 bp, Artificial Sequence
  Synthetic
aatttaatcaaatgatagtgactatgaatggaaatgactttcaaactggaggaattggtaatttaccaattagaa

SEQ ID NO: 299558 - DNA, 75 bp, Artificial Sequence
  Synthetic
aatttaatcaaatgatagtgactatgaatggaaatgactttcaaactggaggaattggcaatttaccaattagaa

SEQ ID NO: 299559 - DNA, 75 bp, Artificial Sequence
  Synthetic
aatttaatcaaatgatagtgactatgaatggaaatgactttcaaactggaggaattgggaatttaccaattagaa

SEQ ID NO: 299560 - DNA, 75 bp, Artificial Sequence
  Synthetic
aatttaatcaaatgatagtgactatgaatggaaatgagtttcaaactggaggaattggaaatttaccaattagaa

SEQ ID NO: 299561 - DNA, 75 bp, Artificial Sequence
  Synthetic
aatttaatcaaatgatagtgactatgaatggaaatgagtttcaaactggaggaattggtaatttaccaattagaa

SEQ ID NO: 299562 - DNA, 75 bp, Artificial Sequence
  Synthetic
aatttaatcaaatgatagtgactatgaatggaaatgagtttcaaactggaggaattggcaatttaccaattagaa

SEQ ID NO: 299563 - DNA, 75 bp, Artificial Sequence
  Synthetic
aatttaatcaaatgatagtgactatgaatggaaatgagtttcaaactggaggaattgggaatttaccaattagaa

SEQ ID NO: 299564 - DNA, 75 bp, Artificial Sequence
  Synthetic
ttaaaaataatctgttgggtaaagcagcaactattgatcaggcactgaatggaaaatttggttcagcagcaagaa

SEQ ID NO: 299565 - DNA, 75 bp, Artificial Sequence
  Synthetic
attgtgattacaatgttgtattaatgaaatatgacgcaaatttacaattagatatgtcggaactggctgatttga

SEQ ID NO: 299566 - DNA, 75 bp, Artificial Sequence
  Synthetic
gtgaataaacttagaatgatgctatcatctaaaggaattgatcaaaaaatgagagtacttaatgcatgtttcagt

SEQ ID NO: 299567 - DNA, 75 bp, Artificial Sequence
  Synthetic
aattaaagtgtgtccattgaatacgcaaactcttggcattgggtgcttaacgacagatgcgaatacatttgaaga

SEQ ID NO: 299568 - DNA, 75 bp, Artificial Sequence
  Synthetic
tgaaacaaagggtgaatgaaaaatatacaagttgggtgcaaaaggcaaaaaaagtaaatgaaaatatgtactctc

SEQ ID NO: 299569 - DNA, 75 bp, Artificial Sequence
  Synthetic
aaattgggtccaagagaaaacgtcgcagttattcaagttggtggtgctgatattcttgacattacagctgatcct

SEQ ID NO: 299570 - DNA, 75 bp, Artificial Sequence
  Synthetic
gtggcaagttttttacactattgttgactatgttaatcaaattgtacaagcaatgtccaaaagatctagatcact

SEQ ID NO: 299571 - DNA, 75 bp, Artificial Sequence
  Synthetic
tttatctgatgaaattgaaagtataggagcagagaaaaaccaaaatgttactattaatccaggaccatttgcaca

SEQ ID NO: 299572 - DNA, 75 bp, Artificial Sequence
  Synthetic
ccaccagttgactattggatgctgttagcaccgacatcatcaggtgtagttgtggagggtactaatgatactgat

SEQ ID NO: 299573 - DNA, 75 bp, Artificial Sequence
  Synthetic
ttttataaacaatgtaaccacagataatgtgtttatacaacctccttttaaaattaaaacatcagctacttatta

SEQ ID NO: 299574 - DNA, 75 bp, Artificial Sequence
  Synthetic
ttttataaacaatgtaaccacagataatgtgtttatacaacctccttttaaaattaaaacttcagctacttatta

SEQ ID NO: 299575 - DNA, 75 bp, Artificial Sequence
  Synthetic
ttttataaacaatgtaaccacagataatgtgtttatacaacctccttttaaaattaaaacctcagctacttatta

SEQ ID NO: 299576 - DNA, 75 bp, Artificial Sequence
  Synthetic
ttttataaacaatgtaaccacagataatgtgtttatacaacctccttttaaaattaaaacgtcagctacttatta

SEQ ID NO: 299577 - DNA, 75 bp, Artificial Sequence
  Synthetic
ttttataaacaatgtaaccacagataatgtgtttatacaacctccttttaaaattaaatcatcagctacttatta

SEQ ID NO: 299578 - DNA, 75 bp, Artificial Sequence
  Synthetic
ttttataaacaatgtaaccacagataatgtgtttatacaacctccttttaaaattaaatcttcagctacttatta

SEQ ID NO: 299579 - DNA, 75 bp, Artificial Sequence
  Synthetic
ttttataaacaatgtaaccacagataatgtgtttatacaacctccttttaaaattaaatcctcagctacttatta

SEQ ID NO: 299580 - DNA, 75 bp, Artificial Sequence
  Synthetic
ttttataaacaatgtaaccacagataatgtgtttatacaacctccttttaaaattaaatcgtcagctacttatta

SEQ ID NO: 299581 - DNA, 75 bp, Artificial Sequence
  Synthetic
ttttataaacaatgtaaccacagataatgtgtttatacaacctccttttaaaattaaaccatcagctacttatta

SEQ ID NO: 299582 - DNA, 75 bp, Artificial Sequence
  Synthetic
ttttataaacaatgtaaccacagataatgtgtttatacaacctccttttaaaattaaaccttcagctacttatta

SEQ ID NO: 299583 - DNA, 75 bp, Artificial Sequence
  Synthetic
ttttataaacaatgtaaccacagataatgtgtttatacaacctccttttaaaattaaaccctcagctacttatta

SEQ ID NO: 299584 - DNA, 75 bp, Artificial Sequence
  Synthetic
ttttataaacaatgtaaccacagataatgtgtttatacaacctccttttaaaattaaaccgtcagctacttatta

SEQ ID NO: 299585 - DNA, 75 bp, Artificial Sequence
  Synthetic
ttttataaacaatgtaaccacagataatgtgtttatacaacctccttttaaaattaaagcatcagctacttatta

SEQ ID NO: 299586 - DNA, 75 bp, Artificial Sequence
  Synthetic
ttttataaacaatgtaaccacagataatgtgtttatacaacctccttttaaaattaaagcttcagctacttatta

SEQ ID NO: 299587 - DNA, 75 bp, Artificial Sequence
  Synthetic
ttttataaacaatgtaaccacagataatgtgtttatacaacctccttttaaaattaaagcctcagctacttatta

SEQ ID NO: 299588 - DNA, 75 bp, Artificial Sequence
  Synthetic
ttttataaacaatgtaaccacagataatgtgtttatacaacctccttttaaaattaaagcgtcagctacttatta

SEQ ID NO: 299589 - DNA, 75 bp, Artificial Sequence
  Synthetic
ttttataaacaatgtaaccacagataatgtgtttatacaacctccttttaaatttaaaacatcagctacttatta

SEQ ID NO: 299590 - DNA, 75 bp, Artificial Sequence
  Synthetic
ttttataaacaatgtaaccacagataatgtgtttatacaacctccttttaaatttaaaacttcagctacttatta

SEQ ID NO: 299591 - DNA, 75 bp, Artificial Sequence
  Synthetic
ttttataaacaatgtaaccacagataatgtgtttatacaacctccttttaaatttaaaacctcagctacttatta

SEQ ID NO: 299592 - DNA, 75 bp, Artificial Sequence
  Synthetic
ttttataaacaatgtaaccacagataatgtgtttatacaacctccttttaaatttaaaacgtcagctacttatta

SEQ ID NO: 299593 - DNA, 75 bp, Artificial Sequence
  Synthetic
ttttataaacaatgtaaccacagataatgtgtttatacaacctccttttaaatttaaatcatcagctacttatta

SEQ ID NO: 299594 - DNA, 75 bp, Artificial Sequence
  Synthetic
ttttataaacaatgtaaccacagataatgtgtttatacaacctccttttaaatttaaatcttcagctacttatta

SEQ ID NO: 299595 - DNA, 75 bp, Artificial Sequence
  Synthetic
ttttataaacaatgtaaccacagataatgtgtttatacaacctccttttaaatttaaatcctcagctacttatta

SEQ ID NO: 299596 - DNA, 75 bp, Artificial Sequence
  Synthetic
ttttataaacaatgtaaccacagataatgtgtttatacaacctccttttaaatttaaatcgtcagctacttatta

SEQ ID NO: 299597 - DNA, 75 bp, Artificial Sequence
  Synthetic
ttttataaacaatgtaaccacagataatgtgtttatacaacctccttttaaatttaaaccatcagctacttatta

SEQ ID NO: 299598 - DNA, 75 bp, Artificial Sequence
  Synthetic
ttttataaacaatgtaaccacagataatgtgtttatacaacctccttttaaatttaaaccttcagctacttatta

SEQ ID NO: 299599 - DNA, 75 bp, Artificial Sequence
  Synthetic
ttttataaacaatgtaaccacagataatgtgtttatacaacctccttttaaatttaaaccctcagctacttatta

SEQ ID NO: 299600 - DNA, 75 bp, Artificial Sequence
  Synthetic
ttttataaacaatgtaaccacagataatgtgtttatacaacctccttttaaatttaaaccgtcagctacttatta

SEQ ID NO: 299601 - DNA, 75 bp, Artificial Sequence
  Synthetic
ttttataaacaatgtaaccacagataatgtgtttatacaacctccttttaaatttaaagcatcagctacttatta

SEQ ID NO: 299602 - DNA, 75 bp, Artificial Sequence
  Synthetic
ttttataaacaatgtaaccacagataatgtgtttatacaacctccttttaaatttaaagcttcagctacttatta

SEQ ID NO: 299603 - DNA, 75 bp, Artificial Sequence
  Synthetic
ttttataaacaatgtaaccacagataatgtgtttatacaacctccttttaaatttaaagcctcagctacttatta

SEQ ID NO: 299604 - DNA, 75 bp, Artificial Sequence
  Synthetic
ttttataaacaatgtaaccacagataatgtgtttatacaacctccttttaaatttaaagcgtcagctacttatta

SEQ ID NO: 299605 - DNA, 75 bp, Artificial Sequence
  Synthetic
ttttataaacaatgtaaccacagataatgtgtttatacaacctccttttaaacttaaaacatcagctacttatta

SEQ ID NO: 299606 - DNA, 75 bp, Artificial Sequence
  Synthetic
ttttataaacaatgtaaccacagataatgtgtttatacaacctccttttaaacttaaaacttcagctacttatta

SEQ ID NO: 299607 - DNA, 75 bp, Artificial Sequence
  Synthetic
ttttataaacaatgtaaccacagataatgtgtttatacaacctccttttaaacttaaaacctcagctacttatta

SEQ ID NO: 299608 - DNA, 75 bp, Artificial Sequence
  Synthetic
ttttataaacaatgtaaccacagataatgtgtttatacaacctccttttaaacttaaaacgtcagctacttatta

SEQ ID NO: 299609 - DNA, 75 bp, Artificial Sequence
  Synthetic
ttttataaacaatgtaaccacagataatgtgtttatacaacctccttttaaacttaaatcatcagctacttatta

SEQ ID NO: 299610 - DNA, 75 bp, Artificial Sequence
  Synthetic
ttttataaacaatgtaaccacagataatgtgtttatacaacctccttttaaacttaaatcttcagctacttatta

SEQ ID NO: 299611 - DNA, 75 bp, Artificial Sequence
  Synthetic
ttttataaacaatgtaaccacagataatgtgtttatacaacctccttttaaacttaaatcctcagctacttatta

SEQ ID NO: 299612 - DNA, 75 bp, Artificial Sequence
  Synthetic
ttttataaacaatgtaaccacagataatgtgtttatacaacctccttttaaacttaaatcgtcagctacttatta

SEQ ID NO: 299613 - DNA, 75 bp, Artificial Sequence
  Synthetic
ttttataaacaatgtaaccacagataatgtgtttatacaacctccttttaaacttaaaccatcagctacttatta

SEQ ID NO: 299614 - DNA, 75 bp, Artificial Sequence
  Synthetic
ttttataaacaatgtaaccacagataatgtgtttatacaacctccttttaaacttaaaccttcagctacttatta

SEQ ID NO: 299615 - DNA, 75 bp, Artificial Sequence
  Synthetic
ttttataaacaatgtaaccacagataatgtgtttatacaacctccttttaaacttaaaccctcagctacttatta

SEQ ID NO: 299616 - DNA, 75 bp, Artificial Sequence
  Synthetic
ttttataaacaatgtaaccacagataatgtgtttatacaacctccttttaaacttaaaccgtcagctacttatta

SEQ ID NO: 299617 - DNA, 75 bp, Artificial Sequence
  Synthetic
ttttataaacaatgtaaccacagataatgtgtttatacaacctccttttaaacttaaagcatcagctacttatta

SEQ ID NO: 299618 - DNA, 75 bp, Artificial Sequence
  Synthetic
ttttataaacaatgtaaccacagataatgtgtttatacaacctccttttaaacttaaagcttcagctacttatta

SEQ ID NO: 299619 - DNA, 75 bp, Artificial Sequence
  Synthetic
ttttataaacaatgtaaccacagataatgtgtttatacaacctccttttaaacttaaagcctcagctacttatta

SEQ ID NO: 299620 - DNA, 75 bp, Artificial Sequence
  Synthetic
ttttataaacaatgtaaccacagataatgtgtttatacaacctccttttaaacttaaagcgtcagctacttatta

SEQ ID NO: 299621 - DNA, 75 bp, Artificial Sequence
  Synthetic
ttttataaacaatgtaaccacagataatgtgtttatacaacctccttttaaagttaaaacatcagctacttatta

SEQ ID NO: 299622 - DNA, 75 bp, Artificial Sequence
  Synthetic
ttttataaacaatgtaaccacagataatgtgtttatacaacctccttttaaagttaaaacttcagctacttatta

SEQ ID NO: 299623 - DNA, 75 bp, Artificial Sequence
  Synthetic
ttttataaacaatgtaaccacagataatgtgtttatacaacctccttttaaagttaaaacctcagctacttatta

SEQ ID NO: 299624 - DNA, 75 bp, Artificial Sequence
  Synthetic
ttttataaacaatgtaaccacagataatgtgtttatacaacctccttttaaagttaaaacgtcagctacttatta

SEQ ID NO: 299625 - DNA, 75 bp, Artificial Sequence
  Synthetic
ttttataaacaatgtaaccacagataatgtgtttatacaacctccttttaaagttaaatcatcagctacttatta

SEQ ID NO: 299626 - DNA, 75 bp, Artificial Sequence
  Synthetic
ttttataaacaatgtaaccacagataatgtgtttatacaacctccttttaaagttaaatcttcagctacttatta

SEQ ID NO: 299627 - DNA, 75 bp, Artificial Sequence
  Synthetic
ttttataaacaatgtaaccacagataatgtgtttatacaacctccttttaaagttaaatcctcagctacttatta

SEQ ID NO: 299628 - DNA, 75 bp, Artificial Sequence
  Synthetic
ttttataaacaatgtaaccacagataatgtgtttatacaacctccttttaaagttaaatcgtcagctacttatta

SEQ ID NO: 299629 - DNA, 75 bp, Artificial Sequence
  Synthetic
ttttataaacaatgtaaccacagataatgtgtttatacaacctccttttaaagttaaaccatcagctacttatta

SEQ ID NO: 299630 - DNA, 75 bp, Artificial Sequence
  Synthetic
ttttataaacaatgtaaccacagataatgtgtttatacaacctccttttaaagttaaaccttcagctacttatta

SEQ ID NO: 299631 - DNA, 75 bp, Artificial Sequence
  Synthetic
ttttataaacaatgtaaccacagataatgtgtttatacaacctccttttaaagttaaaccctcagctacttatta

SEQ ID NO: 299632 - DNA, 75 bp, Artificial Sequence
  Synthetic
ttttataaacaatgtaaccacagataatgtgtttatacaacctccttttaaagttaaaccgtcagctacttatta

SEQ ID NO: 299633 - DNA, 75 bp, Artificial Sequence
  Synthetic
ttttataaacaatgtaaccacagataatgtgtttatacaacctccttttaaagttaaagcatcagctacttatta

SEQ ID NO: 299634 - DNA, 75 bp, Artificial Sequence
  Synthetic
ttttataaacaatgtaaccacagataatgtgtttatacaacctccttttaaagttaaagcttcagctacttatta

SEQ ID NO: 299635 - DNA, 75 bp, Artificial Sequence
  Synthetic
ttttataaacaatgtaaccacagataatgtgtttatacaacctccttttaaagttaaagcctcagctacttatta

SEQ ID NO: 299636 - DNA, 75 bp, Artificial Sequence
  Synthetic
ttttataaacaatgtaaccacagataatgtgtttatacaacctccttttaaagttaaagcgtcagctacttatta

SEQ ID NO: 299637 - DNA, 75 bp, Artificial Sequence
  Synthetic
cgacaactaaatggaaatttatagatgtagtcaaaactactgttgatggaagttattctcaacatgggccgttac

SEQ ID NO: 299638 - DNA, 75 bp, Artificial Sequence
  Synthetic
aaattacgattccgtaaatatgacaacattttgcgacttttatataattccgcgtgatcaagaagctaaatgtac

SEQ ID NO: 299639 - DNA, 75 bp, Artificial Sequence
  Synthetic
aatgaagacattgtagtatcaaagacttcattatggagggagatgcaatataacagagatataacaataagattc

SEQ ID NO: 299640 - DNA, 75 bp, Artificial Sequence
  Synthetic
taacagagatataacaataagattcaaattcgctactagtattataaaatcgggtggattaggttataaatggtc

SEQ ID NO: 299641 - DNA, 75 bp, Artificial Sequence
  Synthetic
aaacacttgaaattttaaacaaatcaggtatagcagctgttgaagtacaaggaattgaagaattacttgcattaa

SEQ ID NO: 299642 - DNA, 75 bp, Artificial Sequence
  Synthetic
ttcaatttcaatggtggatcgttaccaactgactttgtagtgtctagatatgaagttattaaggaaaattcatat

SEQ ID NO: 299643 - DNA, 75 bp, Artificial Sequence
  Synthetic
ccaaaatcagaaatgataaagttatggaagaaaatgtggaatattacgtcgttacgttcgccatataccaatgca

SEQ ID NO: 299644 - DNA, 75 bp, Artificial Sequence
  Synthetic
aacaaagactgatatagaaaactacctactaccaggttggaaactaacttacgttggttataatggaaaaagtac

SEQ ID NO: 299645 - DNA, 75 bp, Artificial Sequence
  Synthetic
agttagaatagaaagtacaatactcaaaattaaatcaatttacttaaaaaagattaaaggggaaaccgtatttga

SEQ ID NO: 299646 - DNA, 75 bp, Artificial Sequence
  Synthetic
agttagaatagaaagtacaatactcaaaattaaatcaatttacttaaaaaagattaaaggggataccgtatttga

SEQ ID NO: 299647 - DNA, 75 bp, Artificial Sequence
  Synthetic
agttagaatagaaagtacaatactcaaaattaaatcaatttacttaaaaaagattaaaggggacaccgtatttga

SEQ ID NO: 299648 - DNA, 75 bp, Artificial Sequence
  Synthetic
agttagaatagaaagtacaatactcaaaattaaatcaatttacttaaaaaagattaaaggggagaccgtatttga

SEQ ID NO: 299649 - DNA, 75 bp, Artificial Sequence
  Synthetic
agttagaatagaaagtacaatactcaaaattaaatcaatttacttaaaaaagattataggggaaaccgtatttga

SEQ ID NO: 299650 - DNA, 75 bp, Artificial Sequence
  Synthetic
agttagaatagaaagtacaatactcaaaattaaatcaatttacttaaaaaagattataggggataccgtatttga

SEQ ID NO: 299651 - DNA, 75 bp, Artificial Sequence
  Synthetic
agttagaatagaaagtacaatactcaaaattaaatcaatttacttaaaaaagattataggggacaccgtatttga

SEQ ID NO: 299652 - DNA, 75 bp, Artificial Sequence
  Synthetic
agttagaatagaaagtacaatactcaaaattaaatcaatttacttaaaaaagattataggggagaccgtatttga

SEQ ID NO: 299653 - DNA, 75 bp, Artificial Sequence
  Synthetic
agttagaatagaaagtacaatactcaaaattaaatcaatttacttaaaaaagattacaggggaaaccgtatttga

SEQ ID NO: 299654 - DNA, 75 bp, Artificial Sequence
  Synthetic
agttagaatagaaagtacaatactcaaaattaaatcaatttacttaaaaaagattacaggggataccgtatttga

SEQ ID NO: 299655 - DNA, 75 bp, Artificial Sequence
  Synthetic
agttagaatagaaagtacaatactcaaaattaaatcaatttacttaaaaaagattacaggggacaccgtatttga

SEQ ID NO: 299656 - DNA, 75 bp, Artificial Sequence
  Synthetic
agttagaatagaaagtacaatactcaaaattaaatcaatttacttaaaaaagattacaggggagaccgtatttga

SEQ ID NO: 299657 - DNA, 75 bp, Artificial Sequence
  Synthetic
agttagaatagaaagtacaatactcaaaattaaatcaatttacttaaaaaagattagaggggaaaccgtatttga

SEQ ID NO: 299658 - DNA, 75 bp, Artificial Sequence
  Synthetic
agttagaatagaaagtacaatactcaaaattaaatcaatttacttaaaaaagattagaggggataccgtatttga

SEQ ID NO: 299659 - DNA, 75 bp, Artificial Sequence
  Synthetic
agttagaatagaaagtacaatactcaaaattaaatcaatttacttaaaaaagattagaggggacaccgtatttga

SEQ ID NO: 299660 - DNA, 75 bp, Artificial Sequence
  Synthetic
agttagaatagaaagtacaatactcaaaattaaatcaatttacttaaaaaagattagaggggagaccgtatttga

SEQ ID NO: 299661 - DNA, 75 bp, Artificial Sequence
  Synthetic
agttagaatagaaagtacaatactcaaaattaattcaatttacttaaaaaagattaaaggggaaaccgtatttga

SEQ ID NO: 299662 - DNA, 75 bp, Artificial Sequence
  Synthetic
agttagaatagaaagtacaatactcaaaattaattcaatttacttaaaaaagattaaaggggataccgtatttga

SEQ ID NO: 299663 - DNA, 75 bp, Artificial Sequence
  Synthetic
agttagaatagaaagtacaatactcaaaattaattcaatttacttaaaaaagattaaaggggacaccgtatttga

SEQ ID NO: 299664 - DNA, 75 bp, Artificial Sequence
  Synthetic
agttagaatagaaagtacaatactcaaaattaattcaatttacttaaaaaagattaaaggggagaccgtatttga

SEQ ID NO: 299665 - DNA, 75 bp, Artificial Sequence
  Synthetic
agttagaatagaaagtacaatactcaaaattaattcaatttacttaaaaaagattataggggaaaccgtatttga

SEQ ID NO: 299666 - DNA, 75 bp, Artificial Sequence
  Synthetic
agttagaatagaaagtacaatactcaaaattaattcaatttacttaaaaaagattataggggataccgtatttga

SEQ ID NO: 299667 - DNA, 75 bp, Artificial Sequence
  Synthetic
agttagaatagaaagtacaatactcaaaattaattcaatttacttaaaaaagattataggggacaccgtatttga

SEQ ID NO: 299668 - DNA, 75 bp, Artificial Sequence
  Synthetic
agttagaatagaaagtacaatactcaaaattaattcaatttacttaaaaaagattataggggagaccgtatttga

SEQ ID NO: 299669 - DNA, 75 bp, Artificial Sequence
  Synthetic
agttagaatagaaagtacaatactcaaaattaattcaatttacttaaaaaagattacaggggaaaccgtatttga

SEQ ID NO: 299670 - DNA, 75 bp, Artificial Sequence
  Synthetic
agttagaatagaaagtacaatactcaaaattaattcaatttacttaaaaaagattacaggggataccgtatttga

SEQ ID NO: 299671 - DNA, 75 bp, Artificial Sequence
  Synthetic
agttagaatagaaagtacaatactcaaaattaattcaatttacttaaaaaagattacaggggacaccgtatttga

SEQ ID NO: 299672 - DNA, 75 bp, Artificial Sequence
  Synthetic
agttagaatagaaagtacaatactcaaaattaattcaatttacttaaaaaagattacaggggagaccgtatttga

SEQ ID NO: 299673 - DNA, 75 bp, Artificial Sequence
  Synthetic
agttagaatagaaagtacaatactcaaaattaattcaatttacttaaaaaagattagaggggaaaccgtatttga

SEQ ID NO: 299674 - DNA, 75 bp, Artificial Sequence
  Synthetic
agttagaatagaaagtacaatactcaaaattaattcaatttacttaaaaaagattagaggggataccgtatttga

SEQ ID NO: 299675 - DNA, 75 bp, Artificial Sequence
  Synthetic
agttagaatagaaagtacaatactcaaaattaattcaatttacttaaaaaagattagaggggacaccgtatttga

SEQ ID NO: 299676 - DNA, 75 bp, Artificial Sequence
  Synthetic
agttagaatagaaagtacaatactcaaaattaattcaatttacttaaaaaagattagaggggagaccgtatttga

SEQ ID NO: 299677 - DNA, 75 bp, Artificial Sequence
  Synthetic
agttagaatagaaagtacaatactcaaaattaactcaatttacttaaaaaagattaaaggggaaaccgtatttga

SEQ ID NO: 299678 - DNA, 75 bp, Artificial Sequence
  Synthetic
agttagaatagaaagtacaatactcaaaattaactcaatttacttaaaaaagattaaaggggataccgtatttga

SEQ ID NO: 299679 - DNA, 75 bp, Artificial Sequence
  Synthetic
agttagaatagaaagtacaatactcaaaattaactcaatttacttaaaaaagattaaaggggacaccgtatttga

SEQ ID NO: 299680 - DNA, 75 bp, Artificial Sequence
  Synthetic
agttagaatagaaagtacaatactcaaaattaactcaatttacttaaaaaagattaaaggggagaccgtatttga

SEQ ID NO: 299681 - DNA, 75 bp, Artificial Sequence
  Synthetic
agttagaatagaaagtacaatactcaaaattaactcaatttacttaaaaaagattataggggaaaccgtatttga

SEQ ID NO: 299682 - DNA, 75 bp, Artificial Sequence
  Synthetic
agttagaatagaaagtacaatactcaaaattaactcaatttacttaaaaaagattataggggataccgtatttga

SEQ ID NO: 299683 - DNA, 75 bp, Artificial Sequence
  Synthetic
agttagaatagaaagtacaatactcaaaattaactcaatttacttaaaaaagattataggggacaccgtatttga

SEQ ID NO: 299684 - DNA, 75 bp, Artificial Sequence
  Synthetic
agttagaatagaaagtacaatactcaaaattaactcaatttacttaaaaaagattataggggagaccgtatttga

SEQ ID NO: 299685 - DNA, 75 bp, Artificial Sequence
  Synthetic
agttagaatagaaagtacaatactcaaaattaactcaatttacttaaaaaagattacaggggaaaccgtatttga

SEQ ID NO: 299686 - DNA, 75 bp, Artificial Sequence
  Synthetic
agttagaatagaaagtacaatactcaaaattaactcaatttacttaaaaaagattacaggggataccgtatttga

SEQ ID NO: 299687 - DNA, 75 bp, Artificial Sequence
  Synthetic
agttagaatagaaagtacaatactcaaaattaactcaatttacttaaaaaagattacaggggacaccgtatttga

SEQ ID NO: 299688 - DNA, 75 bp, Artificial Sequence
  Synthetic
agttagaatagaaagtacaatactcaaaattaactcaatttacttaaaaaagattacaggggagaccgtatttga

SEQ ID NO: 299689 - DNA, 75 bp, Artificial Sequence
  Synthetic
agttagaatagaaagtacaatactcaaaattaactcaatttacttaaaaaagattagaggggaaaccgtatttga

SEQ ID NO: 299690 - DNA, 75 bp, Artificial Sequence
  Synthetic
agttagaatagaaagtacaatactcaaaattaactcaatttacttaaaaaagattagaggggataccgtatttga

SEQ ID NO: 299691 - DNA, 75 bp, Artificial Sequence
  Synthetic
agttagaatagaaagtacaatactcaaaattaactcaatttacttaaaaaagattagaggggacaccgtatttga

SEQ ID NO: 299692 - DNA, 75 bp, Artificial Sequence
  Synthetic
agttagaatagaaagtacaatactcaaaattaactcaatttacttaaaaaagattagaggggagaccgtatttga

SEQ ID NO: 299693 - DNA, 75 bp, Artificial Sequence
  Synthetic
agttagaatagaaagtacaatactcaaaattaagtcaatttacttaaaaaagattaaaggggaaaccgtatttga

SEQ ID NO: 299694 - DNA, 75 bp, Artificial Sequence
  Synthetic
agttagaatagaaagtacaatactcaaaattaagtcaatttacttaaaaaagattaaaggggataccgtatttga

SEQ ID NO: 299695 - DNA, 75 bp, Artificial Sequence
  Synthetic
agttagaatagaaagtacaatactcaaaattaagtcaatttacttaaaaaagattaaaggggacaccgtatttga

SEQ ID NO: 299696 - DNA, 75 bp, Artificial Sequence
  Synthetic
agttagaatagaaagtacaatactcaaaattaagtcaatttacttaaaaaagattaaaggggagaccgtatttga

SEQ ID NO: 299697 - DNA, 75 bp, Artificial Sequence
  Synthetic
agttagaatagaaagtacaatactcaaaattaagtcaatttacttaaaaaagattataggggaaaccgtatttga

SEQ ID NO: 299698 - DNA, 75 bp, Artificial Sequence
  Synthetic
agttagaatagaaagtacaatactcaaaattaagtcaatttacttaaaaaagattataggggataccgtatttga

SEQ ID NO: 299699 - DNA, 75 bp, Artificial Sequence
  Synthetic
agttagaatagaaagtacaatactcaaaattaagtcaatttacttaaaaaagattataggggacaccgtatttga

SEQ ID NO: 299700 - DNA, 75 bp, Artificial Sequence
  Synthetic
agttagaatagaaagtacaatactcaaaattaagtcaatttacttaaaaaagattataggggagaccgtatttga

SEQ ID NO: 299701 - DNA, 75 bp, Artificial Sequence
  Synthetic
agttagaatagaaagtacaatactcaaaattaagtcaatttacttaaaaaagattacaggggaaaccgtatttga

SEQ ID NO: 299702 - DNA, 75 bp, Artificial Sequence
  Synthetic
agttagaatagaaagtacaatactcaaaattaagtcaatttacttaaaaaagattacaggggataccgtatttga

SEQ ID NO: 299703 - DNA, 75 bp, Artificial Sequence
  Synthetic
agttagaatagaaagtacaatactcaaaattaagtcaatttacttaaaaaagattacaggggacaccgtatttga

SEQ ID NO: 299704 - DNA, 75 bp, Artificial Sequence
  Synthetic
agttagaatagaaagtacaatactcaaaattaagtcaatttacttaaaaaagattacaggggagaccgtatttga

SEQ ID NO: 299705 - DNA, 75 bp, Artificial Sequence
  Synthetic
agttagaatagaaagtacaatactcaaaattaagtcaatttacttaaaaaagattagaggggaaaccgtatttga

SEQ ID NO: 299706 - DNA, 75 bp, Artificial Sequence
  Synthetic
agttagaatagaaagtacaatactcaaaattaagtcaatttacttaaaaaagattagaggggataccgtatttga

SEQ ID NO: 299707 - DNA, 75 bp, Artificial Sequence
  Synthetic
agttagaatagaaagtacaatactcaaaattaagtcaatttacttaaaaaagattagaggggacaccgtatttga

SEQ ID NO: 299708 - DNA, 75 bp, Artificial Sequence
  Synthetic
agttagaatagaaagtacaatactcaaaattaagtcaatttacttaaaaaagattagaggggagaccgtatttga

SEQ ID NO: 299709 - DNA, 75 bp, Artificial Sequence
  Synthetic
attacggtttctctttaccagcaggtcagtggcctgtaatgacaggaggtgcagtgtccctacattcagccggcg

SEQ ID NO: 299710 - DNA, 75 bp, Artificial Sequence
  Synthetic
tttatgttaagcaaaattaaagagagaatgacaacagctcttcctatagctagactatccaatagagtttttaga

SEQ ID NO: 299711 - DNA, 75 bp, Artificial Sequence
  Synthetic
ttatactagagttaagagcaaatttgattacataatggatgattcaggtgttaaaaataacttgttgggtaaagc

SEQ ID NO: 299712 - DNA, 75 bp, Artificial Sequence
  Synthetic
tccttatcaaccaactacattcaaaccacccaatgattattggttgcttattagttcaaatacagatggagtagt

SEQ ID NO: 299713 - DNA, 75 bp, Artificial Sequence
  Synthetic
aagagtatccgggctttatggacttccggcagctaatcctaacaatgggaaagagttctacgaggtagcaggtag

SEQ ID NO: 299714 - DNA, 75 bp, Artificial Sequence
  Synthetic
aacaattttcagatggtccatatttagttaaagatacaattaagttaaagcaggaaagatggcttggtaaaagag

SEQ ID NO: 299715 - DNA, 75 bp, Artificial Sequence
  Synthetic
cttagagaagaatttaattcgctgtcacaagaaatagcaatgtcacaattaatagacttagcattgttaccactg

SEQ ID NO: 299716 - DNA, 75 bp, Artificial Sequence
  Synthetic
gttgggatcagccccatcttattggatatatgatattaaacagtattcggaatttgtgtttgaaacttgggatcc

SEQ ID NO: 299717 - DNA, 75 bp, Artificial Sequence
  Synthetic
atggcgtacaggaagcgcggaactaaacgtgaagatttaccacaacaaaatgaacgtctgcaagaaaaagaaatt

SEQ ID NO: 299718 - DNA, 75 bp, Artificial Sequence
  Synthetic
tttaaataatatatcaattataattcattcagagttttatattattccaagatcccaagaatctaaatgtaatga

SEQ ID NO: 299719 - DNA, 75 bp, Artificial Sequence
  Synthetic
catcagtatctacgctcactgactctctctctgatgctgcatcgtcgatatcacgcgggtcctcaattagatcac

SEQ ID NO: 299720 - DNA, 75 bp, Artificial Sequence
  Synthetic
acagacagaggtgatatagattggaaagaatggagaaaaattgtaaaagaacaaacattaagcaatttaaacatt

SEQ ID NO: 299721 - DNA, 75 bp, Artificial Sequence
  Synthetic
gagactaagactaaaagaaatggctactcagacagagggaatgaatttcgatgatatttcagcggcagtgctgaa

SEQ ID NO: 299722 - DNA, 75 bp, Artificial Sequence
  Synthetic
caacaacagaaattcggtcagaattttatatgatagtagatttatccgattttaaaaacataaaaagatttgtcc

SEQ ID NO: 299723 - DNA, 75 bp, Artificial Sequence
  Synthetic
tttggtaatagtgtcataaaattaggaggattgggatataaatggtctgaaatatcatacaaatcagcgaattat

SEQ ID NO: 299724 - DNA, 75 bp, Artificial Sequence
  Synthetic
attaagaatggcgaggtgttcgaagctggtactgatggcagattttttgcttatagagtagatacatttgacgaa

SEQ ID NO: 299725 - DNA, 75 bp, Artificial Sequence
  Synthetic
tgcactatatgcattatcaaatgattttaataatagggaaaatgttattaaactaatcaatgaacaggaaaaatc

SEQ ID NO: 299726 - DNA, 75 bp, Artificial Sequence
  Synthetic
atggcgtaaccaaagaaagtgcattcaatttgttaagatctgacccacgcgcgctcagagaatttattaatcaag

SEQ ID NO: 299727 - DNA, 75 bp, Artificial Sequence
  Synthetic
cgtaactcaattataacatcatatgatggctgtataggtatgttcggattatcaatatctttatcatcgaagccg

SEQ ID NO: 299728 - DNA, 75 bp, Artificial Sequence
  Synthetic
atcaatatctttatcatcgaagccgacaggaaacaatcatatatttatactaaatggtacggataaatatgaaat

SEQ ID NO: 299729 - DNA, 75 bp, Artificial Sequence
  Synthetic
caatttgttaagatctgacccacgcgcgctcagagaatttattaatcaagataaccctataattagaaacagaat

SEQ ID NO: 299730 - DNA, 75 bp, Artificial Sequence
  Synthetic
tgtatcattgaattcgctacgatttagattcagtttaacagtagatgaaccatctttctcaataatacgaacacg

SEQ ID NO: 299731 - DNA, 75 bp, Artificial Sequence
  Synthetic
aatgatgattatcaaactccaattatgaattcagtaacagtaaggcaagatttagaacgccagcttaatgattta

SEQ ID NO: 299732 - DNA, 75 bp, Artificial Sequence
  Synthetic
taggtattaagttcgttagtataccatataaatacgacgttaaagtaccacatttaacgtttggtgtattacaca

SEQ ID NO: 299733 - DNA, 75 bp, Artificial Sequence
  Synthetic
agatggtattcacgtagccaatgtgagtggtgttctattaacatatttcaagatatataatgtgttctataaaaa

SEQ ID NO: 299734 - DNA, 75 bp, Artificial Sequence
  Synthetic
caaactgaaggaattagttttgacgatatttcagcagccgtattgaaaacgaaaatagatatgtccacacaaatt

SEQ ID NO: 299735 - DNA, 75 bp, Artificial Sequence
  Synthetic
aataaatatcacaaaattgaaaatagaatcaatatatctaaggaaaattaaaggcgaaaccgtgtttgctatgac

SEQ ID NO: 299736 - DNA, 75 bp, Artificial Sequence
  Synthetic
acaccgaagggaagttttttgcttataaagtggatacacttaatgagatcccatttgatataaataaattcgctg

SEQ ID NO: 299737 - DNA, 75 bp, Artificial Sequence
  Synthetic
ccatttgatataaataaattcgctgaacttgtgacggattctccagttatatcagcgataatagattttaaaacg

SEQ ID NO: 299738 - DNA, 75 bp, Artificial Sequence
  Synthetic
ctttagtagatataaatggaacatttattacaaatgaagaattagaactagagttttcaaacaaatatgtacggg

SEQ ID NO: 299739 - DNA, 75 bp, Artificial Sequence
  Synthetic
cgcagtagacttgtcagatgaaacacaagaaattggagcatcaagaaaccaaaatgtaaccgttaatccaggccc

SEQ ID NO: 299740 - DNA, 75 bp, Artificial Sequence
  Synthetic
acatttaacccaccagtagattactggatgctgttagcaccaacagatcgtggagtagtagtagaaggaacaaat

SEQ ID NO: 299741 - DNA, 75 bp, Artificial Sequence
  Synthetic
caaatgattcacaattaaaatggaaatttatagttgtcagtaagcaaacattagatggtgcatacgcacaatatg

SEQ ID NO: 299742 - DNA, 75 bp, Artificial Sequence
  Synthetic
ttcaacaacaaattatgatactgttaacatgaaagcatattgtgatttttacattataccaagaacacaagagtc

SEQ ID NO: 299743 - DNA, 75 bp, Artificial Sequence
  Synthetic
gcacaggtaaatgaagatattcttatttctaaagcgtcattatggaaggaaatgcagtataatagagatattata

SEQ ID NO: 299744 - DNA, 75 bp, Artificial Sequence
  Synthetic
cattgataagatgtaattttacatatgattatgagaataacatagtttatttacacgattattcatattatacta

SEQ ID NO: 299745 - DNA, 75 bp, Artificial Sequence
  Synthetic
taagagatgatgaagaagtaacagcgcacactacgtgctcagttaatggggttaacgaattcagctacagtggtg

SEQ ID NO: 299746 - DNA, 75 bp, Artificial Sequence
  Synthetic
taacatatgtgggctataatggaaaggacacgcgaggtcactataatttctcatttacatgtcaaaatgcagcta

SEQ ID NO: 299747 - DNA, 75 bp, Artificial Sequence
  Synthetic
tcatttacatgtcaaaatgcagctacagatgatgatataataattgaatatatatattccaatgaattagatttt

SEQ ID NO: 299748 - DNA, 75 bp, Artificial Sequence
  Synthetic
catggtatatgtacgatctttagctgcaaatttaaattcagtaatgtgtacaggtggagatttcagttttgcttt

SEQ ID NO: 299749 - DNA, 75 bp, Artificial Sequence
  Synthetic
tcactaagatttagatttagcttatcagttgaagaaccgccattttctattatcaggacaagagtaagtggatta

SEQ ID NO: 299750 - DNA, 75 bp, Artificial Sequence
  Synthetic
aaacacctataatgaattcagtaacagttagacaagatctggagcggcaattgagcgaattgagagatgagttca

SEQ ID NO: 299751 - DNA, 75 bp, Artificial Sequence
  Synthetic
tgccgcgaaatcaatggttaccaatgtgatgaaaaagtttaagaaatcaagcttagctagttcagtatcaacact

SEQ ID NO: 299752 - DNA, 75 bp, Artificial Sequence
  Synthetic
gcatcaggtgtaagcacggcaacaaattcaatagcgacacaaacgtcaacaataagcaaaaggttacggttaaaa

SEQ ID NO: 299753 - DNA, 75 bp, Artificial Sequence
  Synthetic
tgccagagatgattacggaagcgtcagagaaatttattccaaataggacatatagaataattaacaatgatgaag

SEQ ID NO: 299754 - DNA, 75 bp, Artificial Sequence
  Synthetic
cgaacgtgtccgatacgaaatggaaatttgtcgaaatgatgaagacggcagttgatggtgattatgcggaatggg

SEQ ID NO: 299755 - DNA, 75 bp, Artificial Sequence
  Synthetic
ctctccagtaatatcagcaataattgattttaaaactttaaaaaatttgaatgataattatggaattaccaaaca

SEQ ID NO: 299756 - DNA, 75 bp, Artificial Sequence
  Synthetic
tttcaaattggactaatgtttcaaatgatgtatcaaatgtaactaattcagtaaatgatatttcaacacaaacgt

SEQ ID NO: 299757 - DNA, 75 bp, Artificial Sequence
  Synthetic
tttcaaattggactaatgtttcaaatgatgtatcaaatgtaactaattcagttaatgatatttcaacacaaacgt

SEQ ID NO: 299758 - DNA, 75 bp, Artificial Sequence
  Synthetic
tttcaaattggactaatgtttcaaatgatgtatcaaatgtaactaattcagtcaatgatatttcaacacaaacgt

SEQ ID NO: 299759 - DNA, 75 bp, Artificial Sequence
  Synthetic
tttcaaattggactaatgtttcaaatgatgtatcaaatgtaactaattcagtgaatgatatttcaacacaaacgt

SEQ ID NO: 299760 - DNA, 75 bp, Artificial Sequence
  Synthetic
tttcaaattggactaatgtttcaaatgatgtatcaaatgttactaattcagtaaatgatatttcaacacaaacgt

SEQ ID NO: 299761 - DNA, 75 bp, Artificial Sequence
  Synthetic
tttcaaattggactaatgtttcaaatgatgtatcaaatgttactaattcagttaatgatatttcaacacaaacgt

SEQ ID NO: 299762 - DNA, 75 bp, Artificial Sequence
  Synthetic
tttcaaattggactaatgtttcaaatgatgtatcaaatgttactaattcagtcaatgatatttcaacacaaacgt

SEQ ID NO: 299763 - DNA, 75 bp, Artificial Sequence
  Synthetic
tttcaaattggactaatgtttcaaatgatgtatcaaatgttactaattcagtgaatgatatttcaacacaaacgt

SEQ ID NO: 299764 - DNA, 75 bp, Artificial Sequence
  Synthetic
tttcaaattggactaatgtttcaaatgatgtatcaaatgtcactaattcagtaaatgatatttcaacacaaacgt

SEQ ID NO: 299765 - DNA, 75 bp, Artificial Sequence
  Synthetic
tttcaaattggactaatgtttcaaatgatgtatcaaatgtcactaattcagttaatgatatttcaacacaaacgt

SEQ ID NO: 299766 - DNA, 75 bp, Artificial Sequence
  Synthetic
tttcaaattggactaatgtttcaaatgatgtatcaaatgtcactaattcagtcaatgatatttcaacacaaacgt

SEQ ID NO: 299767 - DNA, 75 bp, Artificial Sequence
  Synthetic
tttcaaattggactaatgtttcaaatgatgtatcaaatgtcactaattcagtgaatgatatttcaacacaaacgt

SEQ ID NO: 299768 - DNA, 75 bp, Artificial Sequence
  Synthetic
tttcaaattggactaatgtttcaaatgatgtatcaaatgtgactaattcagtaaatgatatttcaacacaaacgt

SEQ ID NO: 299769 - DNA, 75 bp, Artificial Sequence
  Synthetic
tttcaaattggactaatgtttcaaatgatgtatcaaatgtgactaattcagttaatgatatttcaacacaaacgt

SEQ ID NO: 299770 - DNA, 75 bp, Artificial Sequence
  Synthetic
tttcaaattggactaatgtttcaaatgatgtatcaaatgtgactaattcagtcaatgatatttcaacacaaacgt

SEQ ID NO: 299771 - DNA, 75 bp, Artificial Sequence
  Synthetic
tttcaaattggactaatgtttcaaatgatgtatcaaatgtgactaattcagtgaatgatatttcaacacaaacgt

SEQ ID NO: 299772 - DNA, 75 bp, Artificial Sequence
  Synthetic
tttcaaattggactaatgtttcaaatgatgtttcaaatgtaactaattcagtaaatgatatttcaacacaaacgt

SEQ ID NO: 299773 - DNA, 75 bp, Artificial Sequence
  Synthetic
tttcaaattggactaatgtttcaaatgatgtttcaaatgtaactaattcagttaatgatatttcaacacaaacgt

SEQ ID NO: 299774 - DNA, 75 bp, Artificial Sequence
  Synthetic
tttcaaattggactaatgtttcaaatgatgtttcaaatgtaactaattcagtcaatgatatttcaacacaaacgt

SEQ ID NO: 299775 - DNA, 75 bp, Artificial Sequence
  Synthetic
tttcaaattggactaatgtttcaaatgatgtttcaaatgtaactaattcagtgaatgatatttcaacacaaacgt

SEQ ID NO: 299776 - DNA, 75 bp, Artificial Sequence
  Synthetic
tttcaaattggactaatgtttcaaatgatgtttcaaatgttactaattcagtaaatgatatttcaacacaaacgt

SEQ ID NO: 299777 - DNA, 75 bp, Artificial Sequence
  Synthetic
tttcaaattggactaatgtttcaaatgatgtttcaaatgttactaattcagttaatgatatttcaacacaaacgt

SEQ ID NO: 299778 - DNA, 75 bp, Artificial Sequence
  Synthetic
tttcaaattggactaatgtttcaaatgatgtttcaaatgttactaattcagtcaatgatatttcaacacaaacgt

SEQ ID NO: 299779 - DNA, 75 bp, Artificial Sequence
  Synthetic
tttcaaattggactaatgtttcaaatgatgtttcaaatgttactaattcagtgaatgatatttcaacacaaacgt

SEQ ID NO: 299780 - DNA, 75 bp, Artificial Sequence
  Synthetic
tttcaaattggactaatgtttcaaatgatgtttcaaatgtcactaattcagtaaatgatatttcaacacaaacgt

SEQ ID NO: 299781 - DNA, 75 bp, Artificial Sequence
  Synthetic
tttcaaattggactaatgtttcaaatgatgtttcaaatgtcactaattcagttaatgatatttcaacacaaacgt

SEQ ID NO: 299782 - DNA, 75 bp, Artificial Sequence
  Synthetic
tttcaaattggactaatgtttcaaatgatgtttcaaatgtcactaattcagtcaatgatatttcaacacaaacgt

SEQ ID NO: 299783 - DNA, 75 bp, Artificial Sequence
  Synthetic
tttcaaattggactaatgtttcaaatgatgtttcaaatgtcactaattcagtgaatgatatttcaacacaaacgt

SEQ ID NO: 299784 - DNA, 75 bp, Artificial Sequence
  Synthetic
tttcaaattggactaatgtttcaaatgatgtttcaaatgtgactaattcagtaaatgatatttcaacacaaacgt

SEQ ID NO: 299785 - DNA, 75 bp, Artificial Sequence
  Synthetic
tttcaaattggactaatgtttcaaatgatgtttcaaatgtgactaattcagttaatgatatttcaacacaaacgt

SEQ ID NO: 299786 - DNA, 75 bp, Artificial Sequence
  Synthetic
tttcaaattggactaatgtttcaaatgatgtttcaaatgtgactaattcagtcaatgatatttcaacacaaacgt

SEQ ID NO: 299787 - DNA, 75 bp, Artificial Sequence
  Synthetic
tttcaaattggactaatgtttcaaatgatgtttcaaatgtgactaattcagtgaatgatatttcaacacaaacgt

SEQ ID NO: 299788 - DNA, 75 bp, Artificial Sequence
  Synthetic
tttcaaattggactaatgtttcaaatgatgtctcaaatgtaactaattcagtaaatgatatttcaacacaaacgt

SEQ ID NO: 299789 - DNA, 75 bp, Artificial Sequence
  Synthetic
tttcaaattggactaatgtttcaaatgatgtctcaaatgtaactaattcagttaatgatatttcaacacaaacgt

SEQ ID NO: 299790 - DNA, 75 bp, Artificial Sequence
  Synthetic
tttcaaattggactaatgtttcaaatgatgtctcaaatgtaactaattcagtcaatgatatttcaacacaaacgt

SEQ ID NO: 299791 - DNA, 75 bp, Artificial Sequence
  Synthetic
tttcaaattggactaatgtttcaaatgatgtctcaaatgtaactaattcagtgaatgatatttcaacacaaacgt

SEQ ID NO: 299792 - DNA, 75 bp, Artificial Sequence
  Synthetic
tttcaaattggactaatgtttcaaatgatgtctcaaatgttactaattcagtaaatgatatttcaacacaaacgt

SEQ ID NO: 299793 - DNA, 75 bp, Artificial Sequence
  Synthetic
tttcaaattggactaatgtttcaaatgatgtctcaaatgttactaattcagttaatgatatttcaacacaaacgt

SEQ ID NO: 299794 - DNA, 75 bp, Artificial Sequence
  Synthetic
tttcaaattggactaatgtttcaaatgatgtctcaaatgttactaattcagtcaatgatatttcaacacaaacgt

SEQ ID NO: 299795 - DNA, 75 bp, Artificial Sequence
  Synthetic
tttcaaattggactaatgtttcaaatgatgtctcaaatgttactaattcagtgaatgatatttcaacacaaacgt

SEQ ID NO: 299796 - DNA, 75 bp, Artificial Sequence
  Synthetic
tttcaaattggactaatgtttcaaatgatgtctcaaatgtcactaattcagtaaatgatatttcaacacaaacgt

SEQ ID NO: 299797 - DNA, 75 bp, Artificial Sequence
  Synthetic
tttcaaattggactaatgtttcaaatgatgtctcaaatgtcactaattcagttaatgatatttcaacacaaacgt

SEQ ID NO: 299798 - DNA, 75 bp, Artificial Sequence
  Synthetic
tttcaaattggactaatgtttcaaatgatgtctcaaatgtcactaattcagtcaatgatatttcaacacaaacgt

SEQ ID NO: 299799 - DNA, 75 bp, Artificial Sequence
  Synthetic
tttcaaattggactaatgtttcaaatgatgtctcaaatgtcactaattcagtgaatgatatttcaacacaaacgt

SEQ ID NO: 299800 - DNA, 75 bp, Artificial Sequence
  Synthetic
tttcaaattggactaatgtttcaaatgatgtctcaaatgtgactaattcagtaaatgatatttcaacacaaacgt

SEQ ID NO: 299801 - DNA, 75 bp, Artificial Sequence
  Synthetic
tttcaaattggactaatgtttcaaatgatgtctcaaatgtgactaattcagttaatgatatttcaacacaaacgt

SEQ ID NO: 299802 - DNA, 75 bp, Artificial Sequence
  Synthetic
tttcaaattggactaatgtttcaaatgatgtctcaaatgtgactaattcagtcaatgatatttcaacacaaacgt

SEQ ID NO: 299803 - DNA, 75 bp, Artificial Sequence
  Synthetic
tttcaaattggactaatgtttcaaatgatgtctcaaatgtgactaattcagtgaatgatatttcaacacaaacgt

SEQ ID NO: 299804 - DNA, 75 bp, Artificial Sequence
  Synthetic
tttcaaattggactaatgtttcaaatgatgtgtcaaatgtaactaattcagtaaatgatatttcaacacaaacgt

SEQ ID NO: 299805 - DNA, 75 bp, Artificial Sequence
  Synthetic
tttcaaattggactaatgtttcaaatgatgtgtcaaatgtaactaattcagttaatgatatttcaacacaaacgt

SEQ ID NO: 299806 - DNA, 75 bp, Artificial Sequence
  Synthetic
tttcaaattggactaatgtttcaaatgatgtgtcaaatgtaactaattcagtcaatgatatttcaacacaaacgt

SEQ ID NO: 299807 - DNA, 75 bp, Artificial Sequence
  Synthetic
tttcaaattggactaatgtttcaaatgatgtgtcaaatgtaactaattcagtgaatgatatttcaacacaaacgt

SEQ ID NO: 299808 - DNA, 75 bp, Artificial Sequence
  Synthetic
tttcaaattggactaatgtttcaaatgatgtgtcaaatgttactaattcagtaaatgatatttcaacacaaacgt

SEQ ID NO: 299809 - DNA, 75 bp, Artificial Sequence
  Synthetic
tttcaaattggactaatgtttcaaatgatgtgtcaaatgttactaattcagttaatgatatttcaacacaaacgt

SEQ ID NO: 299810 - DNA, 75 bp, Artificial Sequence
  Synthetic
tttcaaattggactaatgtttcaaatgatgtgtcaaatgttactaattcagtcaatgatatttcaacacaaacgt

SEQ ID NO: 299811 - DNA, 75 bp, Artificial Sequence
  Synthetic
tttcaaattggactaatgtttcaaatgatgtgtcaaatgttactaattcagtgaatgatatttcaacacaaacgt

SEQ ID NO: 299812 - DNA, 75 bp, Artificial Sequence
  Synthetic
tttcaaattggactaatgtttcaaatgatgtgtcaaatgtcactaattcagtaaatgatatttcaacacaaacgt

SEQ ID NO: 299813 - DNA, 75 bp, Artificial Sequence
  Synthetic
tttcaaattggactaatgtttcaaatgatgtgtcaaatgtcactaattcagttaatgatatttcaacacaaacgt

SEQ ID NO: 299814 - DNA, 75 bp, Artificial Sequence
  Synthetic
tttcaaattggactaatgtttcaaatgatgtgtcaaatgtcactaattcagtcaatgatatttcaacacaaacgt

SEQ ID NO: 299815 - DNA, 75 bp, Artificial Sequence
  Synthetic
tttcaaattggactaatgtttcaaatgatgtgtcaaatgtcactaattcagtgaatgatatttcaacacaaacgt

SEQ ID NO: 299816 - DNA, 75 bp, Artificial Sequence
  Synthetic
tttcaaattggactaatgtttcaaatgatgtgtcaaatgtgactaattcagtaaatgatatttcaacacaaacgt

SEQ ID NO: 299817 - DNA, 75 bp, Artificial Sequence
  Synthetic
tttcaaattggactaatgtttcaaatgatgtgtcaaatgtgactaattcagttaatgatatttcaacacaaacgt

SEQ ID NO: 299818 - DNA, 75 bp, Artificial Sequence
  Synthetic
tttcaaattggactaatgtttcaaatgatgtgtcaaatgtgactaattcagtcaatgatatttcaacacaaacgt

SEQ ID NO: 299819 - DNA, 75 bp, Artificial Sequence
  Synthetic
tttcaaattggactaatgtttcaaatgatgtgtcaaatgtgactaattcagtgaatgatatttcaacacaaacgt

SEQ ID NO: 299820 - DNA, 75 bp, Artificial Sequence
  Synthetic
gatccaaaagtattacgagaatttgtcaatcaaaataatccaataattaagaacagaatagagaatttaattatg

SEQ ID NO: 299821 - DNA, 75 bp, Artificial Sequence
  Synthetic
ataccatttaaagggaagataccagctgttacttttatactgcatttatatgctaaactagaagttataaattat

SEQ ID NO: 299822 - DNA, 75 bp, Artificial Sequence
  Synthetic
tggaaggatactctgtcccaattattcttgactaaaggatggccaactggatcagtctattttaaagaatacact

SEQ ID NO: 299823 - DNA, 75 bp, Artificial Sequence
  Synthetic
ggatgctaattgcgcctactcaaataggtagagtagcagagggtacgaacacaactgatagatggttcgcttgtg

SEQ ID NO: 299824 - DNA, 75 bp, Artificial Sequence
  Synthetic
gcgaatttaaatgacgtaatgtgttctggcggagattatagtttcaagctgcctgccggacaatggccagtgatg

SEQ ID NO: 299825 - DNA, 75 bp, Artificial Sequence
  Synthetic
atggataaacttaccgacctcaattacacattgagtgtgatcactttaatgaacagtaccttgcatgcaatattg

SEQ ID NO: 299826 - DNA, 75 bp, Artificial Sequence
  Synthetic
cagcgggagtgacattatctacacaattcaccgactttgtatcgctgaactcactaagatttagatttagactgg

SEQ ID NO: 299827 - DNA, 75 bp, Artificial Sequence
  Synthetic
tttaatacattgttgaaattagctggatataaagagcagataactactaaagatgagattgaaaaacagatggac

SEQ ID NO: 299828 - DNA, 75 bp, Artificial Sequence
  Synthetic
ggaacgtagtgccagtaagtatatcgtccagagagattagacatacacgagcacaaatgaatgaagatatagtag

SEQ ID NO: 299829 - DNA, 75 bp, Artificial Sequence
  Synthetic
agatatgtcgaaggaaatcaatcagaaaaatacactaacgctgcatgaatgggaaaatggaaagaatccatatga

SEQ ID NO: 299830 - DNA, 75 bp, Artificial Sequence
  Synthetic
ttccagatttgaagtaattaaagagaattcatacgtatacattgattattgggatgattcgcaagcgtttagaaa

SEQ ID NO: 299831 - DNA, 75 bp, Artificial Sequence
  Synthetic
tcactaaggttcagatttaggttagccgttagcgagccatctttttcaatctctcgaactagattgagtggtata

SEQ ID NO: 299832 - DNA, 75 bp, Artificial Sequence
  Synthetic
ctctcgaactagattgagtggtatatatggattaccggcagcgaatccaaataacaatgtagaatattacgaaat

SEQ ID NO: 299833 - DNA, 75 bp, Artificial Sequence
  Synthetic
tcaattagttgaaccattgaataacgaaattatttttaattatataccagaaagaataaggaatgatgtcaacta

SEQ ID NO: 299834 - DNA, 75 bp, Artificial Sequence
  Synthetic
ctccttttaatgtatggtattgaatataccgcaattctaaccgatctgatcgctcgcgttttattgaactatata

SEQ ID NO: 299835 - DNA, 75 bp, Artificial Sequence
  Synthetic
gatagcagctatgttaagtcaacgtacaatgtcattagattttgtaactacgaattatatgtcacttatatctgg

SEQ ID NO: 299836 - DNA, 75 bp, Artificial Sequence
  Synthetic
cgttagtagaagtttacgattgcgtgaatttactacacaaaccgacaatttaagctttgatgacatatcagccgc

SEQ ID NO: 299837 - DNA, 75 bp, Artificial Sequence
  Synthetic
gaatagtcacataatttaaaatatattaaccatctacacatgaccctctatgagcacaatagttaaaagctaaca

SEQ ID NO: 299838 - DNA, 75 bp, Artificial Sequence
  Synthetic
tgtagtcaatatgatagatgctttcttgataatcaaccacatctattgagaatgagaactttcaagaatgaagtg

SEQ ID NO: 299839 - DNA, 75 bp, Artificial Sequence
  Synthetic
agttgtcaggcattaaatttaaaagaataaattttgataactcatcggaatacatagagaactggaatttgcaaa

SEQ ID NO: 299840 - DNA, 75 bp, Artificial Sequence
  Synthetic
ctcagaattatggacttaacttaccaataacaggatcaatggacgctatttatgctaactctacccaagaaggaa

SEQ ID NO: 299841 - DNA, 75 bp, Artificial Sequence
  Synthetic
gtattcaatatgactacaatgaggtatatactagagtaaagagtaaatttgatttagttatggatgattctggtg

SEQ ID NO: 299842 - DNA, 75 bp, Artificial Sequence
  Synthetic
ggaaaatttagttcagcgattaggaatagaaattggatgactgactctcgaactgtagctaaattagatgaggat

SEQ ID NO: 299843 - DNA, 75 bp, Artificial Sequence
  Synthetic
gtaaataaactaagaattatgctatcatcaaaaggaatcgatcagaaaatgagagtgcttaatgcttgttttagt

SEQ ID NO: 299844 - DNA, 75 bp, Artificial Sequence
  Synthetic
agaccagcgaataatatggcagaattggtatgcatttacgtcttcaatgaaacaaggtaatactcttgatgtatg

SEQ ID NO: 299845 - DNA, 75 bp, Artificial Sequence
  Synthetic
agcacacattaatgaactacaaatgtataataataaattagaacgtgatttgcaatccaaaattggatctgttgt

SEQ ID NO: 299846 - DNA, 75 bp, Artificial Sequence
  Synthetic
atcatcaagatgtacttttccattcaaaagagctactcttaaaatctgtgttgatagctattggtcagtcaaaag

SEQ ID NO: 299847 - DNA, 75 bp, Artificial Sequence
  Synthetic
aatcagacattgaacaacagctgaattcaatagatcaattaaatccagttaatgcaatagatgattttgaatcaa

SEQ ID NO: 299848 - DNA, 75 bp, Artificial Sequence
  Synthetic
ttcaatagatcaattaaatccagttaatgcaatagatgattttgaatcaatacttcgcaatttaatttctgatta

SEQ ID NO: 299849 - DNA, 75 bp, Artificial Sequence
  Synthetic
acagacgtcgcaacgtttgaagaagtagcaaatgcggaaaagttagtaataactgatgttgtagacggagtaaat

SEQ ID NO: 299850 - DNA, 75 bp, Artificial Sequence
  Synthetic
atatgaaagtacaaataatagtgacttttggactgcagttgttgctattgaaccgcacgttaacccagtagatag

SEQ ID NO: 299851 - DNA, 75 bp, Artificial Sequence
  Synthetic
aactgatgttgtagacggagtaaatcataaaattaatatcacggtgaatacatgcactatacgaaattgtaaaaa

SEQ ID NO: 299852 - DNA, 75 bp, Artificial Sequence
  Synthetic
atgacgacttcactgccaatagcgagactatcaaaccgtgtgtttagagataaattatttaagatattagtatca

SEQ ID NO: 299853 - DNA, 75 bp, Artificial Sequence
  Synthetic
gatgacggtaaatgtaagaattgtaaatataagaaaaagtatttcgcattaagaatgaggatgaagcaagtcgca

SEQ ID NO: 299854 - DNA, 75 bp, Artificial Sequence
  Synthetic
tgaaaaaattagaggatataaaaccagagcaggctaagaagcagatgaaattatttagaatctttgaaccaagac

SEQ ID NO: 299855 - DNA, 75 bp, Artificial Sequence
  Synthetic
tttagaaaatcaaaattagctacatcaatttcagaaatgactaattcattgtcagatgctgcttcatcagcatca

SEQ ID NO: 299856 - DNA, 75 bp, Artificial Sequence
  Synthetic
cacaaacgtctacaattagtaagaaacttagattaaaagaaatgattactcaaactgaaggaatgagttttgacg

SEQ ID NO: 299857 - DNA, 75 bp, Artificial Sequence
  Synthetic
gtatggtattgaatataccacaattctaacttttttgatatcacttgtatttgtcaattacatattgaaatcagt

SEQ ID NO: 299858 - DNA, 75 bp, Artificial Sequence
  Synthetic
tgtggattaatgctggatcagaaattcaagtagctggatttgattattcatgtgcttttaatgcaccagcgaata

SEQ ID NO: 299859 - DNA, 75 bp, Artificial Sequence
  Synthetic
caacagatggatagaattgttaaagagatgagacgtcaactggaaatgattgacaaattgacaactcgtgaaatt

SEQ ID NO: 299860 - DNA, 75 bp, Artificial Sequence
  Synthetic
attatcgcagttgtttctgactaagggatggccaacagggtcagtatatttcaaaggatacgcagacattgcgtc

SEQ ID NO: 299861 - DNA, 75 bp, Artificial Sequence
  Synthetic
gaggatatcattatatctaagacatcgttgtggaaagaaatgcaatataatagagacattataataaggtttaaa

SEQ ID NO: 299862 - DNA, 75 bp, Artificial Sequence
  Synthetic
tttaataatagtatagtaaaacttggtgggctaggttataaatggtcagaaatttcatttaaagcggctaattat

SEQ ID NO: 299863 - DNA, 75 bp, Artificial Sequence
  Synthetic
tagctagtgcagaaaagttggctataactgatgttgtggatggagttgatcacaagttagatgtaacaacgagta

SEQ ID NO: 299864 - DNA, 75 bp, Artificial Sequence
  Synthetic
aatgtataggttgagagacagacttagattattgccagttgaaagacgaagacttgatatatttaacttaatatt

SEQ ID NO: 299865 - DNA, 75 bp, Artificial Sequence
  Synthetic
aaatgccagattatttattattgaaagatatggctgtggaaaataaaaattctagagatgctggtaaagttgtgg

SEQ ID NO: 299866 - DNA, 75 bp, Artificial Sequence
  Synthetic
cattcaatgaatatttcttaaatcatcaattggttgaaccgttaaacaatgaaatcatctttaattacataccag

SEQ ID NO: 299867 - DNA, 75 bp, Artificial Sequence
  Synthetic
tgatgtatgtaagaaactgctctttcaaaagatgaaacaagagaaaaatccgtttaaaggactgtcaactgatag

SEQ ID NO: 299868 - DNA, 75 bp, Artificial Sequence
  Synthetic
atggacaagttattaatcagttaatggaagcattaatgcagctatctagacaacaatttccgactatgccagttg

SEQ ID NO: 299869 - DNA, 75 bp, Artificial Sequence
  Synthetic
attataaaagatcaatacaaagaggaatattactactatctaacagactgggtcaattggttgatttaacacgat

SEQ ID NO: 299870 - DNA, 75 bp, Artificial Sequence
  Synthetic
aaagaattatttggcaaaattggtatgcattcacatcttcaatgaaacaaggtaatacaattgatgtatgtaaga

SEQ ID NO: 299871 - DNA, 75 bp, Artificial Sequence
  Synthetic
tttatatcagaaaaaaatgaaatcaatagttgaggattttttgaaaagattgcaaatttttgatgtaccacgagt

SEQ ID NO: 299872 - DNA, 75 bp, Artificial Sequence
  Synthetic
taatttaatattaatgaatatggagcagatcgaacgagcttcagataaaattgctcaaggagtaataattgctta

SEQ ID NO: 299873 - DNA, 75 bp, Artificial Sequence
  Synthetic
acgaggtcactacaatttctcatttacatgtcaaaatgcagctacagatgatgatataataattgaatatatata

SEQ ID NO: 299874 - DNA, 75 bp, Artificial Sequence
  Synthetic
tgtataagataaattctgattctaatgatttctacttagttgcaaattatgattggataccaacttcaaccacaa

SEQ ID NO: 299875 - DNA, 75 bp, Artificial Sequence
  Synthetic
taagcatgaaagtattagctttaagacacagtgtggctcaggtgtatgcagatactcaaacctatttacatgatg

SEQ ID NO: 299876 - DNA, 75 bp, Artificial Sequence
  Synthetic
gataacaacctcaaactatattttggcaagatcagtagtaccagatttaaaggaattagtttcaactgaagcgca

SEQ ID NO: 299877 - DNA, 75 bp, Artificial Sequence
  Synthetic
atggttgtttaggcatatttggattatcaatatctttatcatccaaaccaactggaaataatcatttatttataa

SEQ ID NO: 299878 - DNA, 75 bp, Artificial Sequence
  Synthetic
gattctaaagatgagtatgaaaatgcattcttaatttctaatctcactacacataatatattatatttaaattat

SEQ ID NO: 299879 - DNA, 75 bp, Artificial Sequence
  Synthetic
gtgatacacgaggacattataatttttcgtttagatgtcagaatgcagctacagatgatgatgcaataatagagt

SEQ ID NO: 299880 - DNA, 75 bp, Artificial Sequence
  Synthetic
tttattccttttaataatttagctataaaatgtatgttgacagcaaaagtagataaaaaagatcaggataaattt

SEQ ID NO: 299881 - DNA, 75 bp, Artificial Sequence
  Synthetic
tacttaatgagtggttatgtaatcctatggatattactttatattattatcaacaaactgatgaggcaaataaat

SEQ ID NO: 299882 - DNA, 75 bp, Artificial Sequence
  Synthetic
atgggactccaaaaatattaaaagattcataccaaaaggtgtattatactcatatataaacaatacaattactga

SEQ ID NO: 299883 - DNA, 75 bp, Artificial Sequence
  Synthetic
ttgatagctattggtcaatcaaaagaaattgaaactactgctactgctgaaggaggagaaatagtatttcaaaat

SEQ ID NO: 299884 - DNA, 75 bp, Artificial Sequence
  Synthetic
aaattgaaactactgctactgctgaaggaggagaaatagtatttcaaaatgctgcttttactatgtggaaattga

SEQ ID NO: 299885 - DNA, 75 bp, Artificial Sequence
  Synthetic
aaactactctttcaaaagatgaaacaagagaaaaatccatttaaaggattgtcaactgatagaaagatggatgaa

SEQ ID NO: 299886 - DNA, 75 bp, Artificial Sequence
  Synthetic
tacattcaaagtatttgactcagaagatttcattatagaatatggaacaactgacgatgaagtatatatacaaag

SEQ ID NO: 299887 - DNA, 75 bp, Artificial Sequence
  Synthetic
taccgtataaagtcccatatgttatacaatgcacaatctcgagaacgtatcatatagaagatagtgggtcaaaat

SEQ ID NO: 299888 - DNA, 75 bp, Artificial Sequence
  Synthetic
gattcatatgttcaaatacctgacggtaatgtaattaaaaagattcagtatggtgctgttgcttcaggagaaaaa

SEQ ID NO: 299889 - DNA, 75 bp, Artificial Sequence
  Synthetic
tagaacttgaattttcagataaatatgttaaggcaattgtacctgatcaaattttcgatgaattacaggaaatga

SEQ ID NO: 299890 - DNA, 75 bp, Artificial Sequence
  Synthetic
gtgtatttacagtggcttccattagaagcatgcttatcaaatgaggaccaagctaaccacttggtatccgacttt

SEQ ID NO: 299891 - DNA, 75 bp, Artificial Sequence
  Synthetic
agcatttatgtcattgtctagtcagaaatcaggaatagctgatgaaatcgcttcttcacaaacgtttaaaaatta

SEQ ID NO: 299892 - DNA, 75 bp, Artificial Sequence
  Synthetic
tataacagctgatccaaccacagcaccacaaactgagcgaatgatgcgtattaattggaaaaaatggtggcaagt

SEQ ID NO: 299893 - DNA, 75 bp, Artificial Sequence
  Synthetic
ttgttgaaggtacattatattctaatgttagcgatctcattcaacaatttaatcaaatgatagtaaccatgaatg

SEQ ID NO: 299894 - DNA, 75 bp, Artificial Sequence
  Synthetic
aggaaggttttcacttatttctttagttccaaccaatgatgactatcaaactccaattatgaattcagtaacagt

SEQ ID NO: 299895 - DNA, 75 bp, Artificial Sequence
  Synthetic
ttggattagtttgttttgtaactacccaaaatctgaaatgattaaattatggaagaaaatgtggaacataacagc

SEQ ID NO: 299896 - DNA, 75 bp, Artificial Sequence
  Synthetic
atgtttcaacacaaacatctacaattagtaaaaaacttagattaaaagagatgattactcaaactgaaggaatga

SEQ ID NO: 299897 - DNA, 75 bp, Artificial Sequence
  Synthetic
attcgcacaaacaggttatgcaccagttaattggggagcaggtgagactaatgactccacaactgtcgagccgtt

SEQ ID NO: 299898 - DNA, 75 bp, Artificial Sequence
  Synthetic
tactatagtagattatattaatcagattgtacaggtaatgtccaaaagatcaagatcattaaattccgctgcgtt

SEQ ID NO: 299899 - DNA, 75 bp, Artificial Sequence
  Synthetic
atgactccacaactgtcgagccgttattagatggtccataccaaccaaccactttcaatccaccaacaagctatt

SEQ ID NO: 299900 - DNA, 75 bp, Artificial Sequence
  Synthetic
atttggcactattattgcaagaaattttgatacaattcgtctatcattccaattaatgcgtccaccaaacatgac

SEQ ID NO: 299901 - DNA, 75 bp, Artificial Sequence
  Synthetic
tacttgttgaaccgaacacaaccaatcaaagcagacaatatacactatttggagaaacgaaacaaattactatag

SEQ ID NO: 299902 - DNA, 75 bp, Artificial Sequence
  Synthetic
atggcctattatgaatggcggtgctgtatcattacattttgctggagttacattatctacacagttcactgattt

SEQ ID NO: 299903 - DNA, 75 bp, Artificial Sequence
  Synthetic
gaggaaattatgattttcaaataccagttggtgcgtggccagtgatgagtggaggtgcagtgtctttacattttg

SEQ ID NO: 299904 - DNA, 75 bp, Artificial Sequence
  Synthetic
aagcggtaggttttcattaatatcattagtgccatcaaatgatgattatcaaacaccaattatgaattcagttac

SEQ ID NO: 299905 - DNA, 75 bp, Artificial Sequence
  Synthetic
ttgccattagatatgttttcaatgttctcaggaattaaaagtacaatagatgctgcgaaatccatggcaacgaac

SEQ ID NO: 299906 - DNA, 75 bp, Artificial Sequence
  Synthetic
tagctacatcaatttccgaattaactggatcattatcaagtgctgcctcatcagtctccagaagctcatctatca

SEQ ID NO: 299907 - DNA, 75 bp, Artificial Sequence
  Synthetic
atcaagtcattcagactcttcaagtaaggacatgatttcatgttcgctacgtagagtaactgtctgaatgatgta

SEQ ID NO: 299908 - DNA, 75 bp, Artificial Sequence
  Synthetic
tcagaaacggctagtatatgcgatgcaatatttcaagatgaagaaacggaaggtgccgttagaagattcattgca

SEQ ID NO: 299909 - DNA, 75 bp, Artificial Sequence
  Synthetic
ttatacgaattccttttaaaggcaaaataccagctgtaacatttatattgcatctttatgctaaacttgaaataa

SEQ ID NO: 299910 - DNA, 75 bp, Artificial Sequence
  Synthetic
tagtgaaactaattaataatcagaaaaaagcgttaataacagtgagaattaataatacgtttaaagatgaaccaa

SEQ ID NO: 299911 - DNA, 75 bp, Artificial Sequence
  Synthetic
cagaactttatactcaaaaagattaaagaaagaatgacaacgtcattaccaatagcaagactttcaaatcgcgtg

SEQ ID NO: 299912 - DNA, 75 bp, Artificial Sequence
  Synthetic
gcgcgatttggaactatcgtagctagaaattttgatactattcgtttatcatttcaattagtacgtccaccgaat

SEQ ID NO: 299913 - DNA, 75 bp, Artificial Sequence
  Synthetic
gaaggtggaagatattatgaacatgcaccaatcgaattaatatatgcatgccgatcagctaaagaatttgctata

SEQ ID NO: 299914 - DNA, 75 bp, Artificial Sequence
  Synthetic
ggtatttctagaagatcacatcaaattagattttcagagtctgcaacatcatattcaggatatatttttagagat

SEQ ID NO: 299915 - DNA, 75 bp, Artificial Sequence
  Synthetic
attggagcaaattcagtgtggattccagtttcttcaaataaaattaaagggtggtgtattgaatgttgtcaactt

SEQ ID NO: 299916 - DNA, 75 bp, Artificial Sequence
  Synthetic
actgaattgaccttttgtcacggatgctcactagctcatgtttgtcagtggtgtatacaaaataaacgatgtttt

SEQ ID NO: 299917 - DNA, 75 bp, Artificial Sequence
  Synthetic
atagatttgtataatctgcttttcccagttaatcctggtatcattaataggtttaagaagatagttaaccaaaga

SEQ ID NO: 299918 - DNA, 75 bp, Artificial Sequence
  Synthetic
tctttggtctctatgaaggatcatcatcgtgcattgatttaccatataggattgtaaattgcattgatttgtatg

SEQ ID NO: 299919 - DNA, 75 bp, Artificial Sequence
  Synthetic
ataaatatttcaaattgagtagacttccttcaatgaaattgaagcaaatttattattcagatttctctaaacaga

SEQ ID NO: 299920 - DNA, 75 bp, Artificial Sequence
  Synthetic
atttaattaataaatataagattaagagtcgcatagttcttagaaatctcactgagtttacttgggattcacaag

SEQ ID NO: 299921 - DNA, 75 bp, Artificial Sequence
  Synthetic
aagggtaaaagctgatatttttgagcttggacatcactgtaagccaaattatatttcgtcaaatcattggcagcc

SEQ ID NO: 299922 - DNA, 75 bp, Artificial Sequence
  Synthetic
tggtgtaatgtaaaatatgtttttagaaatatggattggaaaatggaatcaatgtataatgagcttttgagcttc

SEQ ID NO: 299923 - DNA, 75 bp, Artificial Sequence
  Synthetic
gaaatatggattggaaaatggaatcaatgtataatgagcttttgagcttcatccaagcttgttataaaagtaatg

SEQ ID NO: 299924 - DNA, 75 bp, Artificial Sequence
  Synthetic
acctaatggactcatacgttcaaataccagatggtaatgttattaagaaaatacagtatggagctgtagcatcag

SEQ ID NO: 299925 - DNA, 75 bp, Artificial Sequence
  Synthetic
gttttcattggcagatagatgttgcgttatatattcacattaaaatgatacttaaagttgaaactcttccatttg

SEQ ID NO: 299926 - DNA, 75 bp, Artificial Sequence
  Synthetic
ggcttttaaaagttctgttccgagaaagcgcatgcggaaagatggagaagcttgcagacctcaactataccctga

SEQ ID NO: 299927 - DNA, 75 bp, Artificial Sequence
  Synthetic
tgataaactggtcaaacttgaagaagaaggtaagatatctgaagaatatgagctcctaatctcagattctgaaga

SEQ ID NO: 299928 - DNA, 75 bp, Artificial Sequence
  Synthetic
aagatgatgattaatggttaaataaaatactgacgcagttcttgccatcacaagaccttctggactagagtagcg

SEQ ID NO: 299929 - DNA, 75 bp, Artificial Sequence
  Synthetic
aagcagcaattatctgacaaagtgctatcacaaaaagaggaaataataactgatgtacaagatgacattaaaata

SEQ ID NO: 299930 - DNA, 75 bp, Artificial Sequence
  Synthetic
agaaaaacaaatggacagagttgttaaagaaatgaggcgtcagctggaaatgattgataaactaaccacaaggga

SEQ ID NO: 299931 - DNA, 75 bp, Artificial Sequence
  Synthetic
aaaacactaaacgagtgggcagagggtgaaaatccatacgaaccgagagaagtaactgcatctttatgagaggtt

SEQ ID NO: 299932 - DNA, 75 bp, Artificial Sequence
  Synthetic
agttcaggctgacaggaatattgttaattatccatcaattttacatccaattgatcatgcatttaacgaatattt

SEQ ID NO: 299933 - DNA, 75 bp, Artificial Sequence
  Synthetic
tcatcgaacttgatgaatggtagagaaacctcattcagtaatttcgcgggtgacttagtcttattcacgttttac

SEQ ID NO: 299934 - DNA, 75 bp, Artificial Sequence
  Synthetic
aacaattaccgatttatagagcaaatggagaaagagaattgcgtaatagatggtattggaaattaaaaaaagata

SEQ ID NO: 299935 - DNA, 75 bp, Artificial Sequence
  Synthetic
cattagattttgtaactacgaattatatgtcacttatatctggtatgtggctattgactgttataccaaatgata

SEQ ID NO: 299936 - DNA, 75 bp, Artificial Sequence
  Synthetic
cttttaaagcgctacagtgatgtctctcagtattgacgtgacgagtcttccttctatttcttctagtatttataa

SEQ ID NO: 299937 - DNA, 75 bp, Artificial Sequence
  Synthetic
aaagccaaagtgtgttgtgttaaattaacagctatggatctagaattgccaatcacagcaaaattacttcatcat

SEQ ID NO: 299938 - DNA, 75 bp, Artificial Sequence
  Synthetic
attaagtgaggaccagactaaccatctggtatccaatcttagttagcatgtagctatatcaagtcattcagactc

SEQ ID NO: 299939 - DNA, 75 bp, Artificial Sequence
  Synthetic
cattattataacgttaacgttaattttcactcaaattacaatgagagaattaatgacgcagtagctataataact

SEQ ID NO: 299940 - DNA, 75 bp, Artificial Sequence
  Synthetic
agttttttatactgttgttgattatgtaaatcagataattcaagcaatgtccaaaagatctagatcgttagattc

SEQ ID NO: 299941 - DNA, 75 bp, Artificial Sequence
  Synthetic
tcttactttcactgtttactcagatctgcttgcattcgtatcagctgatacggtagaacctataaatgcagttgc

SEQ ID NO: 299942 - DNA, 75 bp, Artificial Sequence
  Synthetic
atgattatgaaaatgcatttttaatctctaatctcactacgcacaatatactgtatctgaattatagtgttaaga

SEQ ID NO: 299943 - DNA, 75 bp, Artificial Sequence
  Synthetic
ttagagaaaagatgtattgatttccatgctaagtgtgtcgataattcaaagaagggtttatcattgaaatctctg

SEQ ID NO: 299944 - DNA, 75 bp, Artificial Sequence
  Synthetic
tgtacaatgagtatacaatgttaattagagatgaaatagttaaaatgctagaagtaccagttaaacatgatgatc

SEQ ID NO: 299945 - DNA, 75 bp, Artificial Sequence
  Synthetic
cacaatttgacattggtcaatataaaaacatgttgaatgtattaacaactttgtatcaatactatgacatgtacc

SEQ ID NO: 299946 - DNA, 75 bp, Artificial Sequence
  Synthetic
caaagcatactagagagtatgcggaattttactcacagtcaaatcaattgttatcatacggtgatgttacaagat

SEQ ID NO: 299947 - DNA, 75 bp, Artificial Sequence
  Synthetic
agatacaccatattctgacttacatcataaagaacttttctatatgagtgatgtaaccaaacttaaagacaactc

SEQ ID NO: 299948 - DNA, 75 bp, Artificial Sequence
  Synthetic
atttatataaacaaacacaaattaatctcatggattcatatgttcaaatacctgatggtaatgtaatcaaaaaga

SEQ ID NO: 299949 - DNA, 75 bp, Artificial Sequence
  Synthetic
caagatgatttaacagtattgagatattcaaatgaaatagaaaattatattaataaagtgtatagtataacatat

SEQ ID NO: 299950 - DNA, 75 bp, Artificial Sequence
  Synthetic
taataaagtgtatagtataacatatgctgacgatccaaactattttattggcattaagtttaagaatatacctta

SEQ ID NO: 299951 - DNA, 75 bp, Artificial Sequence
  Synthetic
gctgacgatccaaactattttattggcattaagtttaagaatataccttatagatatgatgttaagataccgcac

SEQ ID NO: 299952 - DNA, 75 bp, Artificial Sequence
  Synthetic
atttccatcagaacgagtactgacaaccaattctacatttaaagtttttgactccgaagattttatcatagagta

SEQ ID NO: 299953 - DNA, 75 bp, Artificial Sequence
  Synthetic
atgacaccagccgtaaatgcattatttccacaagcacaaccttttcaacatcatgcaacagttggacttacgtta

SEQ ID NO: 299954 - DNA, 75 bp, Artificial Sequence
  Synthetic
aaattatggaagaaaatgtggaatataacagcattacgatcaccttatactagtgctaatttctttcaagattag

SEQ ID NO: 299955 - DNA, 75 bp, Artificial Sequence
  Synthetic
ggagtattaaatcaaacacttaacgacaacattagaaatgggcaagttattaatcaattaatggaagcattaatg

SEQ ID NO: 299956 - DNA, 75 bp, Artificial Sequence
  Synthetic
agactactctttcaaaaaatgaagcgagagagtaatccctttaaaggactgtcaactgatagaaagatggatgaa

SEQ ID NO: 299957 - DNA, 75 bp, Artificial Sequence
  Synthetic
ctattgaaactggcaggttataaagaacaaattactactaaagatgaaatagaaaagcagatggacagagtcgtc

SEQ ID NO: 299958 - DNA, 75 bp, Artificial Sequence
  Synthetic
gatttcattatagagtatggaacaactgatgatgaagtatatatacagagagcatttatgtccttgtcaagtcag

SEQ ID NO: 299959 - DNA, 75 bp, Artificial Sequence
  Synthetic
tacagttggactttcggatgaaatacaagagattggaacgacgagaacacagaatgtcacaataaacccaggacc

SEQ ID NO: 299960 - DNA, 75 bp, Artificial Sequence
  Synthetic
actttcaatccaccagttagttactggatgctactagcgccaacgaatccaggagtggtagttgaaggaacaaat

SEQ ID NO: 299961 - DNA, 75 bp, Artificial Sequence
  Synthetic
aaaacaattcgcagacaaaatggagatttatagatgttagtaagcagtcaccggatgctaactattctcaacatg

SEQ ID NO: 299962 - DNA, 75 bp, Artificial Sequence
  Synthetic
agaaatgcttatgtcagtgttttcacatgaagattatttaatagcaaaagagttaataatcttatcatattcaaa

SEQ ID NO: 299963 - DNA, 75 bp, Artificial Sequence
  Synthetic
actttggtgagtatgtagctacgtcaagctgtttgaactctgtaagtaaggatgcgtctacgtattcgctacaca

SEQ ID NO: 299964 - DNA, 75 bp, Artificial Sequence
  Synthetic
agttaataatcttatcatattcaaatagatcaacattagcaaaactagtttcatctccaatgtcaatattagttg

SEQ ID NO: 299965 - DNA, 75 bp, Artificial Sequence
  Synthetic
ttcaacaacaaactatgatactgtgaatatgacagcacattgtgatttttacataataccactagcacaagaagc

SEQ ID NO: 299966 - DNA, 75 bp, Artificial Sequence
  Synthetic
gcacaagcaaacgaagacattgttgtatcgaaaacatcattgtggaaagaaatgcagtataacagggacataata

SEQ ID NO: 299967 - DNA, 75 bp, Artificial Sequence
  Synthetic
ctgaatgagtggttatgtaatccaatggatataacattatattattatcaacaaactggagaggcaaataaatgg

SEQ ID NO: 299968 - DNA, 75 bp, Artificial Sequence
  Synthetic
tagtgaaatcaggaggattgggatataagtggtcagaagtatcctttaaaccagcaaattaccagtatacataca

SEQ ID NO: 299969 - DNA, 75 bp, Artificial Sequence
  Synthetic
ttcagaatgcagcttttactatgtggaaattgacgtatttagatcataaattaatgcctattttggatcagaatt

SEQ ID NO: 299970 - DNA, 75 bp, Artificial Sequence
  Synthetic
attgcataaagcgtcaattccgacgatgaaaattgcgctgaagacgtcaaaatgctcgtataaggtagtgaagta

SEQ ID NO: 299971 - DNA, 75 bp, Artificial Sequence
  Synthetic
ttacattaatcagatagtgcaagtaatgttctatagattgagattgttagatttgtcgggtcctctttttagagt

SEQ ID NO: 299972 - DNA, 75 bp, Artificial Sequence
  Synthetic
aaagaaatgaggcgtcagttggaaatgattgataagttgaccacacgtgagattgagcaagttgaactacttaaa

SEQ ID NO: 299973 - DNA, 75 bp, Artificial Sequence
  Synthetic
actggaggtgcagtgtcattgcactcagctggagtaacattgtctactcaatttacggatttcgtatctttaaac

SEQ ID NO: 299974 - DNA, 75 bp, Artificial Sequence
  Synthetic
ctattaaaggctcaatggcgtacagaagacgtggagcgcgccgtgaggcaaatataaataataataatgatcgaa

SEQ ID NO: 299975 - DNA, 75 bp, Artificial Sequence
  Synthetic
aatataaataataataatgatcgaatgcaagaaaaggatgatgaaaagcaagataaaactaataaaacgcaatta

SEQ ID NO: 299976 - DNA, 75 bp, Artificial Sequence
  Synthetic
acaattcacaagaatattacgaggtagctggaaggttttcacttatttcacttgtaccatctaacgatgactacc

SEQ ID NO: 299977 - DNA, 75 bp, Artificial Sequence
  Synthetic
tctgataaagtactttcaaagaaagaggatgttataactgataatcaagaagaggtgaaaattgctgatgaggta

SEQ ID NO: 299978 - DNA, 75 bp, Artificial Sequence
  Synthetic
ggcaagttttttatactgttgttgactatgtaaatcaaataattcaagcaatgtccaaaagatcgcggtcattag

SEQ ID NO: 299979 - DNA, 75 bp, Artificial Sequence
  Synthetic
atgtccaaaagatcgcggtcattagattcagcatcattttattatagaatttgaatattattgaagttatagttg

SEQ ID NO: 299980 - DNA, 75 bp, Artificial Sequence
  Synthetic
gtcacaattaattgatctagcattattgccacttgacatgttctcgatgttttcaggtattaaaagtacagttga

SEQ ID NO: 299981 - DNA, 75 bp, Artificial Sequence
  Synthetic
tcgtcagtgtcaagaaactcatcaataaggtctataggaacagcaacgtcggcttggacagaggtggcatcagtg

SEQ ID NO: 299982 - DNA, 75 bp, Artificial Sequence
  Synthetic
tgaactttgatgacatatcagcggctgtattaaagacgaaaatagataaatcaacacaaataaccacaaacacgc

SEQ ID NO: 299983 - DNA, 75 bp, Artificial Sequence
  Synthetic
atttttcgcttatagagtcgacacgtttgaggaaataccctttgatgtacagaaattcgcggatttagtgactga

SEQ ID NO: 299984 - DNA, 75 bp, Artificial Sequence
  Synthetic
aacatggatagaaacttaccgtcaacagctagatacataagaccaaatttattacaggacagactaaatttgcat

SEQ ID NO: 299985 - DNA, 75 bp, Artificial Sequence
  Synthetic
attttgcagataatttaatggaagatagacacagtccaacttcattaatgcaagtaactcgtaattgcatcgctg

SEQ ID NO: 299986 - DNA, 75 bp, Artificial Sequence
  Synthetic
gatccaagggtgctacgtgagtttataaatcagaataacccaataatacggaatagaatagaaagtttaattatg

SEQ ID NO: 299987 - DNA, 75 bp, Artificial Sequence
  Synthetic
cgataacgacttcaaattacatactagcacgatcagtagtgccagatttaaaagagctagtttcaacagaagcgc

SEQ ID NO: 299988 - DNA, 75 bp, Artificial Sequence
  Synthetic
cgtatcacagagatgcaagctttataccaagagtaagctcgacatattagctcgactaactaaaccaaactacat

SEQ ID NO: 299989 - DNA, 75 bp, Artificial Sequence
  Synthetic
ctgagtcaacgaactatgtcgcttgattttgtaactactaattacatgtcattaatttcgggtatgtggctatta

SEQ ID NO: 299990 - DNA, 75 bp, Artificial Sequence
  Synthetic
ttctatttcagtatcaacagtttcaaaaaaggagaaatccaaatcagattacagaagtaggaaacactacccaag

SEQ ID NO: 299991 - DNA, 75 bp, Artificial Sequence
  Synthetic
gtttattttgtaattacccaaaatctgagatgattaaactatggaagaaaatgtggaatataacagcattacggt

SEQ ID NO: 299992 - DNA, 75 bp, Artificial Sequence
  Synthetic
cgatgccagttgattataaaaggtcaattcaacgtggaatattgttattatctaataggcttggtcaattagttg

SEQ ID NO: 299993 - DNA, 75 bp, Artificial Sequence
  Synthetic
ggaactatcagacgttgaataagcagtcatacatggtcacaatttagccaacacaagaccgtctgcactggagta

SEQ ID NO: 299994 - DNA, 75 bp, Artificial Sequence
  Synthetic
aacttcagttacatcattgtgtatgcttattggaaatgcaaccgttataccaagtccgcaaacattgtttcacta

SEQ ID NO: 299995 - DNA, 75 bp, Artificial Sequence
  Synthetic
accagatgcagaaagatttagttttccaagagttattaattcagcagatggcgcaactacatggttctttaatcc

SEQ ID NO: 299996 - DNA, 75 bp, Artificial Sequence
  Synthetic
taatagattaaatttataccaaaagaaaatgaaggcaatcgttgaggactttttgaagagattacatatctttga

SEQ ID NO: 299997 - DNA, 75 bp, Artificial Sequence
  Synthetic
aagatgactatgaaaatgcatttttaatttctaatctcactacacataatatattatatctaaattatagcgtta

SEQ ID NO: 299998 - DNA, 75 bp, Artificial Sequence
  Synthetic
agtggaagggacggacaattctggcagatggttatctgtaattctaattgagccaggtgtcacatcagagacaag

SEQ ID NO: 299999 - DNA, 75 bp, Artificial Sequence
  Synthetic
taaaaccaatattgtataaaataaattcagattcaaatgatttttacttagtcgcaaactatgattgggtaccaa

SEQ ID NO: 300000 - DNA, 75 bp, Artificial Sequence
  Synthetic
tttattaccaggatggaaactgacgtatgttggatataacggaaatgacacaagagggcattataacttctcttt

SEQ ID NO: 300001 - DNA, 75 bp, Artificial Sequence
  Synthetic
ccacgaccaaaggatacattgtaacgaattatgcatcagttgaggtaaggccatatagtgatttttatataattt

SEQ ID NO: 300002 - DNA, 75 bp, Artificial Sequence
  Synthetic
aggatgacaacatcactgccaatagcgagactatcaaatcgtgtgttcagagacaaattatttaagacattagta

SEQ ID NO: 300003 - DNA, 75 bp, Artificial Sequence
  Synthetic
accttatatcaatactatgacatgtatcatgagaagccaataatctacatgttaggatcagcaccttcatattgg

SEQ ID NO: 300004 - DNA, 75 bp, Artificial Sequence
  Synthetic
tgaagtaattaaagaaaattcgtatgtatacgttgactactgggacgattcacaggcattcaggaacatggtcta

SEQ ID NO: 300005 - DNA, 75 bp, Artificial Sequence
  Synthetic
cgtgcgatcgttggcggcgaatttaaatgatgtaatgtgttctggcggagactatagcttcgcgctacctgccgg

SEQ ID NO: 300006 - DNA, 75 bp, Artificial Sequence
  Synthetic
agcagaccgttaacaatttgaatatcgcatacaaatacttatccacagggaaagctaaagtatgttgtgttaaaa

SEQ ID NO: 300007 - DNA, 75 bp, Artificial Sequence
  Synthetic
tttaggtttagacttgcggtcgaggaaccctcattcacgataactagaacacgtgtatcaaaactgtatggttta

SEQ ID NO: 300008 - DNA, 75 bp, Artificial Sequence
  Synthetic
ttatcattataaaagaattaataaattaaataatacagtcttaaaattaggagttaatgatacatggaggccgtc

SEQ ID NO: 300009 - DNA, 75 bp, Artificial Sequence
  Synthetic
tgaagataaaccaatttcagaatcacatgtgaaggaacttattgctgagttgcggtggcaatacaataaatttgc

SEQ ID NO: 300010 - DNA, 75 bp, Artificial Sequence
  Synthetic
gtttatacaacaaccgtttaaattgaaaacgttaaggaatgagtatgtggttgcattgtacgcgctgtctaacga

SEQ ID NO: 300011 - DNA, 75 bp, Artificial Sequence
  Synthetic
tatgcaagaaactactatttcaaaagatgaaacgagaaagtaatccatttaaaggactgtcaactgatagaaaga

SEQ ID NO: 300012 - DNA, 75 bp, Artificial Sequence
  Synthetic
tgaagcgttgaattcaatcaaagttactcaatctgatgttgcgaatgtactctcaaaagtagtttctgtaagaca

SEQ ID NO: 300013 - DNA, 75 bp, Artificial Sequence
  Synthetic
tgaaggcggcagatattatgaacacgctccgatagagttgatttacgcatgtagatcggcaagggaattcgcaaa

SEQ ID NO: 300014 - DNA, 75 bp, Artificial Sequence
  Synthetic
tgatcaaagaataatatggcagaactggtatgcgtttacatcctcaatgaaacaaggcaatactcttgaaatatg

SEQ ID NO: 300015 - DNA, 75 bp, Artificial Sequence
  Synthetic
agtacgcgattgaacatagactttatatatttgaggaaaataaaaggcgatacagtgttcgatatggctgagtga

SEQ ID NO: 300016 - DNA, 75 bp, Artificial Sequence
  Synthetic
attctcttcagaatgttatttcacaacaacagaaccaaattgcagaccttcagcaatattgcaataaattagaag

SEQ ID NO: 300017 - DNA, 75 bp, Artificial Sequence
  Synthetic
gttgaattcaattgacgcaattaatcctattaatgctattgatgatctcgaatcattgatcagaaacttaattca

SEQ ID NO: 300018 - DNA, 75 bp, Artificial Sequence
  Synthetic
ggctattaaaggctcaatggcgtacaggaagcgcggaactaaacgtgaggacttaccacaacaaaatgaacgtct

SEQ ID NO: 300019 - DNA, 75 bp, Artificial Sequence
  Synthetic
ttaatgaatatagtgatgtcattaagaatgctacgttattatcaatattatcatactcctacgacaaatataacg

SEQ ID NO: 300020 - DNA, 75 bp, Artificial Sequence
  Synthetic
cacttaacgacaatattaggaatggacaagttattaatcaattaatggaagcattaatgcagttatctagacaac

SEQ ID NO: 300021 - DNA, 75 bp, Artificial Sequence
  Synthetic
gctatctaattatattgtatgataattattacaatatatactgtgttattgaatttaatgatatcctaatgatag

SEQ ID NO: 300022 - DNA, 75 bp, Artificial Sequence
  Synthetic
tcaactgaagctcaaatacagaagatgtctcaagatttgcaacttgaagcactaactatacaatctgaaacacag

SEQ ID NO: 300023 - DNA, 75 bp, Artificial Sequence
  Synthetic
attgaatactttattgatttcattgataatgtgtgtatggatgagatggcgagagaatcacagcgaaatggaatt

SEQ ID NO: 300024 - DNA, 75 bp, Artificial Sequence
  Synthetic
actttctcagctatttttaactaaagggtggccaacaggatctgtctattttaaagattacacagatatcgcctc

SEQ ID NO: 300025 - DNA, 75 bp, Artificial Sequence
  Synthetic
ggtgtttgattcagaggattttatcatagagtatggaacaactgatgatgaagtatatatacagagagcatttat

SEQ ID NO: 300026 - DNA, 75 bp, Artificial Sequence
  Synthetic
agtcattcttagaccaagtaatgtagaagtagaatttctattaaatggacaaataattaatacatatcaggcacg

SEQ ID NO: 300027 - DNA, 75 bp, Artificial Sequence
  Synthetic
cattatttcactattacaatgtaaatgtaaattttcactcaaactataacgaacggatcaatgatgcagtagcaa

SEQ ID NO: 300028 - DNA, 75 bp, Artificial Sequence
  Synthetic
tctcaagatgagttgtttgcattaataagatgtaatttcacatatgattacgagaataatatagtttacttgcat

SEQ ID NO: 300029 - DNA, 75 bp, Artificial Sequence
  Synthetic
ttgcccaaggtgtaataattgcttatagagatatgcaactagaaagagatgaaatgtatggatacgttaatattg

SEQ ID NO: 300030 - DNA, 75 bp, Artificial Sequence
  Synthetic
aaaattatgttaataaattatctgaccaattattagtatcaaaaaatgtaattgtatccaaaggtatagctgtaa

SEQ ID NO: 300031 - DNA, 75 bp, Artificial Sequence
  Synthetic
gaaatgtatggatacgttaatattgctagaaacttagatggataccaacaaattaatttagaagaattgatgaga

SEQ ID NO: 300032 - DNA, 75 bp, Artificial Sequence
  Synthetic
aattggttgaaccattgaataatgatataatatttaattacataccagaaaggataaggaatgatgttaattata

SEQ ID NO: 300033 - DNA, 75 bp, Artificial Sequence
  Synthetic
aactaaaactgatatagttgattatctattacctggatggaaattaacgtatgtaggatataacggaaaagatac

SEQ ID NO: 300034 - DNA, 75 bp, Artificial Sequence
  Synthetic
gtatggtattgaatataccacaattctaacctttctgatatcaataattttattgaactatatattaaaatcact

SEQ ID NO: 300035 - DNA, 75 bp, Artificial Sequence
  Synthetic
tattgaactatatattaaaatcactaactagtgcgatggactttataatttacagatttcttttatttattgtta

SEQ ID NO: 300036 - DNA, 75 bp, Artificial Sequence
  Synthetic
cagttaaacatgatgatcatttacttcgtgattcagaattagctggattgttatcaatgtcatcagcttcaaatg

SEQ ID NO: 300037 - DNA, 75 bp, Artificial Sequence
  Synthetic
atatataaatactggattgccaccaatgcagaatacaaggaatatagttccagttgcgctatcatctagatcagt

SEQ ID NO: 300038 - DNA, 75 bp, Artificial Sequence
  Synthetic
acttaccacaacaaaatgaacgtctgcaagaaaaagaaattgaaaataatacagacgtaacaatggaaaataaaa

SEQ ID NO: 300039 - DNA, 75 bp, Artificial Sequence
  Synthetic
aggccagatacattaccagacataataactgagtcatctgaaaaatttataccaaaacgagcttatagagttcta

SEQ ID NO: 300040 - DNA, 75 bp, Artificial Sequence
  Synthetic
ataagtatggagttccaagacataatgaaaagtataggtatgaatatgaagtaatgaaagataaaccatattatc

SEQ ID NO: 300041 - DNA, 75 bp, Artificial Sequence
  Synthetic
tcatctcctatgtcaatattagttgcattaattgatataaatggtacatttattacaaatgaagagttagaactt

SEQ ID NO: 300042 - DNA, 75 bp, Artificial Sequence
  Synthetic
ggttgactgttcattagaaaaattcacattaatgtcgaagatctattcttggtcgttccatgttggattcaggaa

SEQ ID NO: 300043 - DNA, 75 bp, Artificial Sequence
  Synthetic
acattaatgtcgaagatctattcttggtcgttccatgttggattcaggaaacaaaagatgatagatgcggcactg

SEQ ID NO: 300044 - DNA, 75 bp, Artificial Sequence
  Synthetic
gactataatgatattactacattttctatgaatccacaactgtattgtgattataatgtagtattgatgcgatat

SEQ ID NO: 300045 - DNA, 75 bp, Artificial Sequence
  Synthetic
cattattataacgttaacgttaattttcattcaaattacaatgaaagaattaatgatgcagtagctataataact

SEQ ID NO: 300046 - DNA, 75 bp, Artificial Sequence
  Synthetic
cacgtttgagcaagttacagcatctgaacagttagcaattatagacgttgttgatggcgttaatcataagattga

SEQ ID NO: 300047 - DNA, 75 bp, Artificial Sequence
  Synthetic
ccgatgatgaagtatacattcagagagcatttatgtcgttatctagtcagaaatcaggcatagctgatgaaattg

SEQ ID NO: 300048 - DNA, 75 bp, Artificial Sequence
  Synthetic
tatactattgtagattatataaataatatagttaatgcgatgtctaaacgtacaacatcattagatgcatcttcc

SEQ ID NO: 300049 - DNA, 75 bp, Artificial Sequence
  Synthetic
ctagtgtcaaaaaatgcaattgtatctaaaggtatagcagtgacagagaaagcaaaactgaattcgtacgcacca

SEQ ID NO: 300050 - DNA, 75 bp, Artificial Sequence
  Synthetic
agactgccagaactacgattgaatattttattgattttattgataatgtatgtatggatgaaatggcaagagagt

SEQ ID NO: 300051 - DNA, 75 bp, Artificial Sequence
  Synthetic
tttctaacatctacattatgtttgtattatccaactgaagcaagtactcaaattaatgatggtgaatggaaagac

SEQ ID NO: 300052 - DNA, 75 bp, Artificial Sequence
  Synthetic
aaattggaatttacaaaatagaagacaacgtactggatttgtttttcataaacctaatatatttccatactcagc

SEQ ID NO: 300053 - DNA, 75 bp, Artificial Sequence
  Synthetic
ccaatgcatgataatttaatgggaactatgtggcttaatgctggatcagaaattcaagtggctggatttgactat

SEQ ID NO: 300054 - DNA, 75 bp, Artificial Sequence
  Synthetic
actatctcagctgtttttaaccaaaggatggccgacaggttcagtttattttaatgaatattcaaacgttttaga

SEQ ID NO: 300055 - DNA, 75 bp, Artificial Sequence
  Synthetic
agactgatattgaacaacagttgaattcaattgatgcaattaatcctattaatgctatagatgatcttgaatcat

SEQ ID NO: 300056 - DNA, 75 bp, Artificial Sequence
  Synthetic
ctggtatccaatcttagttagcatgtagctatatcaagtcattcagactctacaagtaaggacatggctccatgt

SEQ ID NO: 300057 - DNA, 75 bp, Artificial Sequence
  Synthetic
taataagtggatttccatgggatcttcatgtacaatcaaagtatgtccacttaatacacaaactctaggaattgg

SEQ ID NO: 300058 - DNA, 75 bp, Artificial Sequence
  Synthetic
tttaacttcaacgttatgtttatattatcctactgaagcatcaactcaaattggagatacagaatggaaggatac

SEQ ID NO: 300059 - DNA, 75 bp, Artificial Sequence
  Synthetic
cttctgtcctaactgtactatttacattacataaggcctcggttccaaccatgaagattgctcttaaaacgtcaa

SEQ ID NO: 300060 - DNA, 75 bp, Artificial Sequence
  Synthetic
tccttcaatctcatctagtatctataaacatgactcatctccaacaacgtcgactctttctggaaaatctattag

SEQ ID NO: 300061 - DNA, 75 bp, Artificial Sequence
  Synthetic
cgaattcatgatatgttgataattaaaccagttgacaaaattgatatgtcacaagaatttaatcagaaatatttc

SEQ ID NO: 300062 - DNA, 75 bp, Artificial Sequence
  Synthetic
atgttattaatttattagttcagagcgttggtaaagtaccacaaatactgactttaaatgatattgtcataatca

SEQ ID NO: 300063 - DNA, 75 bp, Artificial Sequence
  Synthetic
actaatgtaatagaaaatttacacaatccaagttttaaaatacaaattacacgtaattgtagtgaattatcttct

SEQ ID NO: 300064 - DNA, 75 bp, Artificial Sequence
  Synthetic
gtgaaaatccatatgaaccaaaagaggtgactgcatcattgtgagaggttgagctgccgtcgtctgtctgcggaa

SEQ ID NO: 300065 - DNA, 75 bp, Artificial Sequence
  Synthetic
ccatcggacctgatgactggttgagaagccacaaccagtcatatcgcgtgtgactcagtcttaatcccgtttaac

SEQ ID NO: 300066 - DNA, 75 bp, Artificial Sequence
  Synthetic
aaagaagagcaccagaaagagatacaatatgaaattttacaaaaaacaataccaacatttgaaccaaaagggtca

SEQ ID NO: 300067 - DNA, 75 bp, Artificial Sequence
  Synthetic
agaccaattccattaggtcgtagagatgttcctggacgaagaacaagaattatattcatattaccatatgaatac

SEQ ID NO: 300068 - DNA, 75 bp, Artificial Sequence
  Synthetic
gactattcatgtgcaattaatgcgccagctaatacacaacaatttgagcacattgtacagctccgaagagtacta

SEQ ID NO: 300069 - DNA, 75 bp, Artificial Sequence
  Synthetic
gtgcggaaagatggataagcttgccgacctcaactacacattgagtgtaatcactttaatgaatgacacattgca

SEQ ID NO: 300070 - DNA, 75 bp, Artificial Sequence
  Synthetic
taagtcaacgaactatgtcacttgattttgtgactactaattatatgtcattaatttcaggtatgtggctgctaa

SEQ ID NO: 300071 - DNA, 75 bp, Artificial Sequence
  Synthetic
gtgtattgaatcaagtgttgaatgataatatcaggaatggacatgtcattaaccaattgatggaggctctgatgc

SEQ ID NO: 300072 - DNA, 75 bp, Artificial Sequence
  Synthetic
ataactgaatatctactacctggatggaaattaacgtatgtaggatataatggaaaaaacacacgtggtcattat

SEQ ID NO: 300073 - DNA, 75 bp, Artificial Sequence
  Synthetic
ttcagtagatttatatgatgaaatagagcaaattggatcagaaaaaactcaaaatgtaactgtaaatccaggtcc

SEQ ID NO: 300074 - DNA, 75 bp, Artificial Sequence
  Synthetic
ggatatctatgggttcttcatgtacaattaaagtatgtcctctaaatacgcagactctcggaataggatgttcga

SEQ ID NO: 300075 - DNA, 75 bp, Artificial Sequence
  Synthetic
ttatctaatgattttaattcaagacaagatgttattaatttgattaataaacaaaaacaatcactcattactgtt

SEQ ID NO: 300076 - DNA, 75 bp, Artificial Sequence
  Synthetic
gtgatggtgaacaagtaactgcacatactacctgttcagtaaatggagtaaataattttagctataacggaggat

SEQ ID NO: 300077 - DNA, 75 bp, Artificial Sequence
  Synthetic
cttctaaacctactggtaataatcatttatttataataaatggaactgacaaatattataaactagatcagtatg

SEQ ID NO: 300078 - DNA, 75 bp, Artificial Sequence
  Synthetic
aattcgattaaagttacacaatctgaagttgcaaatgttctttcaagagtagtttccgttagacatttggaaaat

SEQ ID NO: 300079 - DNA, 75 bp, Artificial Sequence
  Synthetic
aaatccatatgaaccggcagaagtgactgcatctatgtgagaggttgagttgccgtcgtctgtcttcggaagcgg

SEQ ID NO: 300080 - DNA, 75 bp, Artificial Sequence
  Synthetic
tcaaatgtgactaattcagtaaatgatatttcaacacaaacatctacgatcagtaaaaaccttagattaaaagaa

SEQ ID NO: 300081 - DNA, 75 bp, Artificial Sequence
  Synthetic
ctatactatagttgattatgtaaatcaaattgtgcaagcaatgtccaaaaggtccagatcactgaattcggcggc

SEQ ID NO: 300082 - DNA, 75 bp, Artificial Sequence
  Synthetic
atactggatttacgatgttagacagtactctgattttatatttgaaacttgggatccacttgatactccatattc

SEQ ID NO: 300083 - DNA, 75 bp, Artificial Sequence
  Synthetic
aagaacaagttactactaaagatgaaattgagcaacagatggatagaattgtaaaagagatgaggcgtcagctgg

SEQ ID NO: 300084 - DNA, 75 bp, Artificial Sequence
  Synthetic
tcatatgatggttgtttaggtatatttggtttatcaatatctttatcgtcaaaaccaacaggaaataatcattta

SEQ ID NO: 300085 - DNA, 75 bp, Artificial Sequence
  Synthetic
cggatgtgataaaaatattaaaagacatgagagctgaactttttagaatgaatataactacaagctatacctaca

SEQ ID NO: 300086 - DNA, 75 bp, Artificial Sequence
  Synthetic
tcgttaaacatactattaaattgaagcaggaaagatggttaggcaaaagagtatcacaattcgacattggacaat

SEQ ID NO: 300087 - DNA, 75 bp, Artificial Sequence
  Synthetic
tactatatactattactataatttacactcctcaaagcctgtaatatacatgcttggttcagctccatcttattg

SEQ ID NO: 300088 - DNA, 75 bp, Artificial Sequence
  Synthetic
ggtaggatcagcaccttcatattggatacatgacgtaaaacaatactctaatttaaaatttgagacgtgggatcc

SEQ ID NO: 300089 - DNA, 75 bp, Artificial Sequence
  Synthetic
taactgctatggatttagaattaccaataacagcgaaactacttcatcatccaactactgaaatcagatcagaat

SEQ ID NO: 300090 - DNA, 75 bp, Artificial Sequence
  Synthetic
tcagttgatgagaccaccaaatatgacaccagcggtagcagcgttatttccaaatgcgcaaccatttgaacatca

SEQ ID NO: 300091 - DNA, 75 bp, Artificial Sequence
  Synthetic
tatatagattcttactagtatttgttatcgtactgccatttattaaagctcaaaactatggaataaatcttccaa

SEQ ID NO: 300092 - DNA, 75 bp, Artificial Sequence
  Synthetic
aataactgaccccgattggacgcatacactatcacaactttttctgactaaaggatggccaacaaattctgttta

SEQ ID NO: 300093 - DNA, 75 bp, Artificial Sequence
  Synthetic
gaatagaaagtacaagactaaaaattaattcaatttatttaagaaagattaaaggtgaaaccgtatttgatatgt

SEQ ID NO: 300094 - DNA, 75 bp, Artificial Sequence
  Synthetic
gccaccacaatttaaaaaacgctataatacaaatgacaactcaagaggaatgaattatgagactgcaatgtttaa

SEQ ID NO: 300095 - DNA, 75 bp, Artificial Sequence
  Synthetic
agttaatatacctaatatgatacaagactggttaattaactgctctattgaaaaatttccattaatggctaagat

SEQ ID NO: 300096 - DNA, 75 bp, Artificial Sequence
  Synthetic
aggaagaagggatgtaccaggaagacggactagaataatatttatcttaccatacgaatattttatagcccaaca

SEQ ID NO: 300097 - DNA, 75 bp, Artificial Sequence
  Synthetic
ctggtttactatctatgtcttcagcgtcgaacggtgaatccagacaacttaaattcggtagaaaaacaattttct

SEQ ID NO: 300098 - DNA, 75 bp, Artificial Sequence
  Synthetic
ttcaatagcaaatttagcattgattaagacagttttatcacgcatttctaataaatattcattcgtaacaaaaat

SEQ ID NO: 300099 - DNA, 75 bp, Artificial Sequence
  Synthetic
tttatccgatgaaattgaaattattggatctaagaaaaatcaaaacgtaacggtaaaccctggaccatttgcaca

SEQ ID NO: 300100 - DNA, 75 bp, Artificial Sequence
  Synthetic
cggtaaaccctggaccatttgcacaaaccgggtatgcaccagttaactggggaccaggagaagtgaatgattcta

SEQ ID NO: 300101 - DNA, 75 bp, Artificial Sequence
  Synthetic
agagatctttcaaataataattttaacttgataggtactaatgtagaaaattcagtttcaggacatgtttataat

SEQ ID NO: 300102 - DNA, 75 bp, Artificial Sequence
  Synthetic
actatgaatatgtatatgagtaatcacgtaattaaaaatattaaccatctacacatgaccctctatgagcacaat

SEQ ID NO: 300103 - DNA, 75 bp, Artificial Sequence
  Synthetic
aagaatggaagttgacactatagattggaaatccagatatgaccaacttgaaagacgatttgagtcgttaaaaca

SEQ ID NO: 300104 - DNA, 75 bp, Artificial Sequence
  Synthetic
tgaagtaataaaagaaaattcctatgtttatgtagactattgggatgactcgcaggcgtttaggaacatggtata

SEQ ID NO: 300105 - DNA, 75 bp, Artificial Sequence
  Synthetic
atggataagtttattctgtaattatccaaaatcagagatgataaaattatggaagaagatgtggaatattacgtc

SEQ ID NO: 300106 - DNA, 75 bp, Artificial Sequence
  Synthetic
catctgtttctaccttaactgactcattatcagatgcagcatcctcaatttccaggggttcgtcaattagatctg

SEQ ID NO: 300107 - DNA, 75 bp, Artificial Sequence
  Synthetic
atatcaatgggatcatcatgtactgtgaaagtgtgtccactgaatacacaaacgttaggaataggttgtcaaaca

SEQ ID NO: 300108 - DNA, 75 bp, Artificial Sequence
  Synthetic
agaaaagcaaatggacagagtagtcaaagagatgagacgtcagctagaaatgattgataagttgactacacgtga

SEQ ID NO: 300109 - DNA, 75 bp, Artificial Sequence
  Synthetic
ataccattcgatgtacaaaagttcgctgatttagtgactgattcgccagtgatctcagctattattgatttcaaa

SEQ ID NO: 300110 - DNA, 75 bp, Artificial Sequence
  Synthetic
tccttcaatttcttcaagtgtttataaaaatgaatcgtcttcaacaacgtcaactatttctggaaaatctattgg

SEQ ID NO: 300111 - DNA, 75 bp, Artificial Sequence
  Synthetic
agcggtgtgctatcaacatattttaaaatttacaacgcgttttataaagaacagatcacatttggacagtcaaga

SEQ ID NO: 300112 - DNA, 75 bp, Artificial Sequence
  Synthetic
tctactcaactatatattaaaatcagtgactcgaatgatggactacattatatatagatctttgttgatttctgt

SEQ ID NO: 300113 - DNA, 75 bp, Artificial Sequence
  Synthetic
gatgctacagtggactcttcaatatcaatatctaccacatcaaagaaggagaaatctaaacaagaaaacaaaaat

SEQ ID NO: 300114 - DNA, 75 bp, Artificial Sequence
  Synthetic
aatataaaaagaaatattttgcacttcgtttaagaatgaaacaagttgcaatgcaattaattaaagatttatgaa

SEQ ID NO: 300115 - DNA, 75 bp, Artificial Sequence
  Synthetic
cacaacaatttgaacatatagttcaacttagacgggcactaacaactgcaacaataactatattaccagatgcag

SEQ ID NO: 300116 - DNA, 75 bp, Artificial Sequence
  Synthetic
ttgtatgataattattacaatatatactgtgttattgaatttaatgatatcctaatgatagaagattgatgcgtc

SEQ ID NO: 300117 - DNA, 75 bp, Artificial Sequence
  Synthetic
agttgctgagaatgaaaaattagctatagtggatgtcgttgatgggataaataataaaataaatttgacaactac

SEQ ID NO: 300118 - DNA, 75 bp, Artificial Sequence
  Synthetic
agttgctgagaatgaaaaattagctatagtggatgtcgttgatgggataaattataaaataaatttgacaactac

SEQ ID NO: 300119 - DNA, 75 bp, Artificial Sequence
  Synthetic
agttgctgagaatgaaaaattagctatagtggatgtcgttgatgggataaatcataaaataaatttgacaactac

SEQ ID NO: 300120 - DNA, 75 bp, Artificial Sequence
  Synthetic
agttgctgagaatgaaaaattagctatagtggatgtcgttgatgggataaatgataaaataaatttgacaactac

SEQ ID NO: 300121 - DNA, 75 bp, Artificial Sequence
  Synthetic
tgttgctgagaatgaaaaattagctatagtggatgtcgttgatgggataaataataaaataaatttgacaactac

SEQ ID NO: 300122 - DNA, 75 bp, Artificial Sequence
  Synthetic
tgttgctgagaatgaaaaattagctatagtggatgtcgttgatgggataaattataaaataaatttgacaactac

SEQ ID NO: 300123 - DNA, 75 bp, Artificial Sequence
  Synthetic
tgttgctgagaatgaaaaattagctatagtggatgtcgttgatgggataaatcataaaataaatttgacaactac

SEQ ID NO: 300124 - DNA, 75 bp, Artificial Sequence
  Synthetic
tgttgctgagaatgaaaaattagctatagtggatgtcgttgatgggataaatgataaaataaatttgacaactac

SEQ ID NO: 300125 - DNA, 75 bp, Artificial Sequence
  Synthetic
cgttgctgagaatgaaaaattagctatagtggatgtcgttgatgggataaataataaaataaatttgacaactac

SEQ ID NO: 300126 - DNA, 75 bp, Artificial Sequence
  Synthetic
cgttgctgagaatgaaaaattagctatagtggatgtcgttgatgggataaattataaaataaatttgacaactac

SEQ ID NO: 300127 - DNA, 75 bp, Artificial Sequence
  Synthetic
cgttgctgagaatgaaaaattagctatagtggatgtcgttgatgggataaatcataaaataaatttgacaactac

SEQ ID NO: 300128 - DNA, 75 bp, Artificial Sequence
  Synthetic
cgttgctgagaatgaaaaattagctatagtggatgtcgttgatgggataaatgataaaataaatttgacaactac

SEQ ID NO: 300129 - DNA, 75 bp, Artificial Sequence
  Synthetic
ggttgctgagaatgaaaaattagctatagtggatgtcgttgatgggataaataataaaataaatttgacaactac

SEQ ID NO: 300130 - DNA, 75 bp, Artificial Sequence
  Synthetic
ggttgctgagaatgaaaaattagctatagtggatgtcgttgatgggataaattataaaataaatttgacaactac

SEQ ID NO: 300131 - DNA, 75 bp, Artificial Sequence
  Synthetic
ggttgctgagaatgaaaaattagctatagtggatgtcgttgatgggataaatcataaaataaatttgacaactac

SEQ ID NO: 300132 - DNA, 75 bp, Artificial Sequence
  Synthetic
ggttgctgagaatgaaaaattagctatagtggatgtcgttgatgggataaatgataaaataaatttgacaactac

SEQ ID NO: 300133 - DNA, 75 bp, Artificial Sequence
  Synthetic
caggttgtcgtttcaattaatgcgtccaccaaatatgacgccagcagttaatgccttatttccacaagcacaacc

SEQ ID NO: 300134 - DNA, 75 bp, Artificial Sequence
  Synthetic
tttactatagtagcttcaacagtaaataaatatggtgtaccaaggcataatgcgaaatatagatatgaatatgaa

SEQ ID NO: 300135 - DNA, 75 bp, Artificial Sequence
  Synthetic
taccagttggaccagtatttccaccaggaatgaattggactgaattaattactaattattctccatcaagagaag

SEQ ID NO: 300136 - DNA, 75 bp, Artificial Sequence
  Synthetic
attaatgctatagatgatatcgaatcattgattagaaatttaattcaagattatgacagaacatttttaatgtta

SEQ ID NO: 300137 - DNA, 75 bp, Artificial Sequence
  Synthetic
attgattattttgttgattttgtagataatgtatgtatggatgagatggttagagaatcacagagaaacggaatt

SEQ ID NO: 300138 - DNA, 75 bp, Artificial Sequence
  Synthetic
gattgaacaagttgaactactcaaacgaattcatgatatgttgataattaaaccagttgataaaattgatatgtc

SEQ ID NO: 300139 - DNA, 75 bp, Artificial Sequence
  Synthetic
gcgtgcgctaactacagctactataactttgttacctgatgcagaaagatttagttttccaagagttattaattc

SEQ ID NO: 300140 - DNA, 75 bp, Artificial Sequence
  Synthetic
taagcagacacaaataaacctgatggattcatacgttcaaataccagatggtaatgttattaaaaagatacagta

SEQ ID NO: 300141 - DNA, 75 bp, Artificial Sequence
  Synthetic
cccatcagtcgcagcacttttccctaacgcgcagccatttgaacatcatgctactgtaggactaacattacgaat

SEQ ID NO: 300142 - DNA, 75 bp, Artificial Sequence
  Synthetic
gggatggcgtattttccttacattgcctccgtccttactgttttgtttacactgcataaggcatcaattccaaca

SEQ ID NO: 300143 - DNA, 75 bp, Artificial Sequence
  Synthetic
atcattacaaaagaattaacaaattgaatcatacagtcttaaaattaggagttaatgatacatggagaccgtcac

SEQ ID NO: 300144 - DNA, 75 bp, Artificial Sequence
  Synthetic
cagagatattataattaggtttaaatttggtaatagtattattaaattagggggattaggttataaatggtccga

SEQ ID NO: 300145 - DNA, 75 bp, Artificial Sequence
  Synthetic
aatgcaggagaaaattgatgaaaaacaagattcaaataaaacacaattatctgataaggtactttcgaagaaaga

SEQ ID NO: 300146 - DNA, 75 bp, Artificial Sequence
  Synthetic
caatataattatctacgtgatggtgaacaagtaactgcacatactacctgttcagtaaatggagtaaataatttt

SEQ ID NO: 300147 - DNA, 75 bp, Artificial Sequence
  Synthetic
accagaaaatagtatgtagattcattaacaatacgagacaacataaatgtagaaacgaatgtatgacacagtggt

SEQ ID NO: 300148 - DNA, 75 bp, Artificial Sequence
  Synthetic
atctattgcttaaagacatggctgttgaaaacaagaattctagagatgcaggtaaagttgttgattctgaaactg

SEQ ID NO: 300149 - DNA, 75 bp, Artificial Sequence
  Synthetic
atttttctaaatcaagatttataagcgaacaaaggaaatgtgttaatgattcacacttttcaattaatgtattag

SEQ ID NO: 300150 - DNA, 75 bp, Artificial Sequence
  Synthetic
tgcgtattttgatatgctaaaaacatcacatattgaattttatagtgtttctaccagatgtagaatattcacaca

SEQ ID NO: 300151 - DNA, 75 bp, Artificial Sequence
  Synthetic
aattattaagactcaaaattatggaattaatttaccgataactgggtctatggacacgccatatgcaaattctac

SEQ ID NO: 300152 - DNA, 75 bp, Artificial Sequence
  Synthetic
ctgaatgtatgcgacgacgaaagatggaaaacgtcagtaatggaaatctttaattgcctagaaccagtagagctt

SEQ ID NO: 300153 - DNA, 75 bp, Artificial Sequence
  Synthetic
ggttatgtaatccaatggacataacattgtattattatcagcaaacagatgaggcaaacaaatggatatctatgg

SEQ ID NO: 300154 - DNA, 75 bp, Artificial Sequence
  Synthetic
acgattacatacaggattaaagactgttgaatatgattctggcatatctgatattgaataggaaaaggaagatta

SEQ ID NO: 300155 - DNA, 75 bp, Artificial Sequence
  Synthetic
acgtaacaacaaacacatgtactataagaaattgtaaaaaacttggaccaagagaaaatgttgccgtaattcagg

SEQ ID NO: 300156 - DNA, 75 bp, Artificial Sequence
  Synthetic
tacagagttgttaaatattcatcagttgctaatcacgctgatagagtattcgctacatttaaaagtaatgctaag

SEQ ID NO: 300157 - DNA, 75 bp, Artificial Sequence
  Synthetic
aacagctgatccaactactgcaccacaaactgaaagaatgatgcgtataaattggaaaagatggtggcaagtctt

SEQ ID NO: 300158 - DNA, 75 bp, Artificial Sequence
  Synthetic
caaactgaaagaatgatgcgtataaattggaaaagatggtggcaagtcttttatacaatagtagattatgttaac

SEQ ID NO: 300159 - DNA, 75 bp, Artificial Sequence
  Synthetic
caaattgtacaggtcatgtccaagcgatcgcgctccctaaactctgctgctttctattatcgagtttagatatat

SEQ ID NO: 300160 - DNA, 75 bp, Artificial Sequence
  Synthetic
tatgtaagagactactcttccaaaaaatgaaacaagagaaaaatccatttaaaggattgtcaactgatagaaaaa

SEQ ID NO: 300161 - DNA, 75 bp, Artificial Sequence
  Synthetic
tgtggctcaggtgtatgcagacactcaagtctacattcatgacgacactaaagacagctatgaaaatgcattcct

SEQ ID NO: 300162 - DNA, 75 bp, Artificial Sequence
  Synthetic
tctctcgaagagttatttactctaattagatgtaatttcacttatgattatgaaaacaatataatttacttgcat

SEQ ID NO: 300163 - DNA, 75 bp, Artificial Sequence
  Synthetic
aaataagaactgatcaacattgggttacaaaaactgacattgaagaatatttgttgccaggatggaaattaacat

SEQ ID NO: 300164 - DNA, 75 bp, Artificial Sequence
  Synthetic
taaattcacaagcagcaaatgattgttttaaaacactgatagcagctatgttaagtcaacgtacaatgtcattag

SEQ ID NO: 300165 - DNA, 75 bp, Artificial Sequence
  Synthetic
acgatttgataatagaatatatatattctgaagcattagatttccagaatttcatgttaaggagaattaaagaga

SEQ ID NO: 300166 - DNA, 75 bp, Artificial Sequence
  Synthetic
tggaccaagaaacgaatcaatgtttaccttcttaaattttccatctatcaaacaattttcaaatggaccgtattt

SEQ ID NO: 300167 - DNA, 75 bp, Artificial Sequence
  Synthetic
atttacgatgtcaaacagtattctgattttatatttgaaacttgggatccacttgatactccatattcatcgata

SEQ ID NO: 300168 - DNA, 75 bp, Artificial Sequence
  Synthetic
aaatgagacgtcaattagagatgattgataaactaactacacgtgaaattgagcaagttgaattacttaaacgta

SEQ ID NO: 300169 - DNA, 75 bp, Artificial Sequence
  Synthetic
cgtaacaaacatctctgatgaagttagtgagattggagctagaaagacgacaaacgttacggttaatcccggacc

SEQ ID NO: 300170 - DNA, 75 bp, Artificial Sequence
  Synthetic
aagaatggagaaaaatagtcgaggcacaaaccatcagtaaccttaaaatcgcataccaatatttagctagtggta

SEQ ID NO: 300171 - DNA, 75 bp, Artificial Sequence
  Synthetic
ttatcttcttttagacatttgggatattagtaacatcaaaagattcattccaaaaggagtgttatattcatttat

SEQ ID NO: 300172 - DNA, 75 bp, Artificial Sequence
  Synthetic
attagtaacatcaaaagattcattccaaaaggagtgttatattcatttataaacaacgtgactactgaaaatgtg

SEQ ID NO: 300173 - DNA, 75 bp, Artificial Sequence
  Synthetic
atttatattatttattaaacttgaaaaaaatggaacatattcacaatattcaacgctgtctacgtcaaataaatt

SEQ ID NO: 300174 - DNA, 75 bp, Artificial Sequence
  Synthetic
agacaagaatacgcaataccagttggaccagtttttccaccaggtatgaattggactgatttgatcactaactat

SEQ ID NO: 300175 - DNA, 75 bp, Artificial Sequence
  Synthetic
acatttaaagatgaaccaaaagtagggtttaaaaatacgtacgattggacttttctaccaacagacttcaataca

SEQ ID NO: 300176 - DNA, 75 bp, Artificial Sequence
  Synthetic
catgtatcatgcgacgcagagttttatttattaccaagatcgcaaactgatttatgcgaccagtacataaataac

SEQ ID NO: 300177 - DNA, 75 bp, Artificial Sequence
  Synthetic
ggacttcctccagtacaaaatactagaaatgtagtaccagtgagcattacatccagagaaatacggtatacgaaa

SEQ ID NO: 300178 - DNA, 75 bp, Artificial Sequence
  Synthetic
gtataatcacctattgatgccaataacattacaatctctatcaattgaattagatggtgatgtttattacgtatt

SEQ ID NO: 300179 - DNA, 75 bp, Artificial Sequence
  Synthetic
ggcatttcgagaagatcgcatcaaattagattttcagaatccgcaacatcgtattcaggatacatatttagggat

SEQ ID NO: 300180 - DNA, 75 bp, Artificial Sequence
  Synthetic
caaatttaatagatatgtatgataagttgctacttgataatgtaaattttaatcgaatgtcattcttaccagtag

SEQ ID NO: 300181 - DNA, 75 bp, Artificial Sequence
  Synthetic
tcgttaagtcaggaggtcttggatataaatggtcagaaatatcatttaaaccaatgaattatcaatatacttata

SEQ ID NO: 300182 - DNA, 75 bp, Artificial Sequence
  Synthetic
aatcgaatgtcattcttaccagtagcattacaacaagaatatgcactcagatatttttcaaaatcaaggtttatt

SEQ ID NO: 300183 - DNA, 75 bp, Artificial Sequence
  Synthetic
gtaaatgattttagttataatggcgggacgctacctaccgatttttcaatatctagatttgaagtgattaaagag

SEQ ID NO: 300184 - DNA, 75 bp, Artificial Sequence
  Synthetic
caatataattatttacgtgatggcgaacaagtaactgcacatactacttgttcagtaaatggagtaaataatttt

SEQ ID NO: 300185 - DNA, 75 bp, Artificial Sequence
  Synthetic
tttcagataatatgattccagatgtggtgaagattatgaaaggtatgaagaaagagttatttgaaatggacgtga

SEQ ID NO: 300186 - DNA, 75 bp, Artificial Sequence
  Synthetic
atttaccgattatgtgtcacttaattcattaagattcaggtttaggttaactgtgagtgaaccttcattttccat

SEQ ID NO: 300187 - DNA, 75 bp, Artificial Sequence
  Synthetic
ttaaaaatatttatgattggacgtttctgccaacagatttcgaacttaaagattcgataattacatcatatgatg

SEQ ID NO: 300188 - DNA, 75 bp, Artificial Sequence
  Synthetic
gcggttagctccttttaatgtatggtattgaatataccacagttctaacctttttgatatcaattattttattga

SEQ ID NO: 300189 - DNA, 75 bp, Artificial Sequence
  Synthetic
ttggtaccaacgaatgacgattatcaaacaccaatagctaattctgtaacggttagacaagatttggaaagacag

SEQ ID NO: 300190 - DNA, 75 bp, Artificial Sequence
  Synthetic
taatcagaaatttaattcatgactatgatagaacatttttaatgtttaagggactattacggcaatgcaactatg

SEQ ID NO: 300191 - DNA, 75 bp, Artificial Sequence
  Synthetic
aaacaccaatagctaattctgtaacggttagacaagatttggaaagacagttgggtgagttaagagaagagttta

SEQ ID NO: 300192 - DNA, 75 bp, Artificial Sequence
  Synthetic
taatcatgaggtaaattgggatgttattaatttattagttcagagcgttggtaaagtaccacaaatactgacttt

SEQ ID NO: 300193 - DNA, 75 bp, Artificial Sequence
  Synthetic
tcagatatatgaggaatacaccaatgactacatttacagttgacaaattaagacagttatgtacaggagtgaaga

SEQ ID NO: 300194 - DNA, 75 bp, Artificial Sequence
  Synthetic
gtactaatgtggagaattcagtttcaggacatgtctataatgcgttgatttactacagatataattatacgtttg

SEQ ID NO: 300195 - DNA, 75 bp, Artificial Sequence
  Synthetic
ctgttgattatgattccggcatatctgacgttgaataatgaaatagagatcacatttgccaccataagactccct

SEQ ID NO: 300196 - DNA, 75 bp, Artificial Sequence
  Synthetic
ttagatcaattagcagtaatgcagcatcgcggattagtacagccattcaagctagtgatgatctgagaacagtag

SEQ ID NO: 300197 - DNA, 75 bp, Artificial Sequence
  Synthetic
agtactaaagacaaaactagataaatcaacacaaatttcacaaagtaccataccagacataatatctgaatcatc

SEQ ID NO: 300198 - DNA, 75 bp, Artificial Sequence
  Synthetic
aatccaaaaacattaaaagaatttataaataataataatccaataattagaaacagaatagaaaatttgatagcg

SEQ ID NO: 300199 - DNA, 75 bp, Artificial Sequence
  Synthetic
tacttgttgaaccaaacgtaaccaatcaaagtagacaatacacattatttggagaaacgaaacaaattactgtgg

SEQ ID NO: 300200 - DNA, 75 bp, Artificial Sequence
  Synthetic
tgttttatactgtagttgactatgtaaatcagataattcaagcaatgtccaaaagatcacgatcattaaattctg

SEQ ID NO: 300201 - DNA, 75 bp, Artificial Sequence
  Synthetic
tgtttagacaattcaaagaaaggactatctttaaaaagtgtttttctagaatacaaagatgtcatcgagaacgca

SEQ ID NO: 300202 - DNA, 75 bp, Artificial Sequence
  Synthetic
ctttaatggacccagccattttaacatcactctcttcaaatctgaatgcggtcatgttttggctagaaaaacata

SEQ ID NO: 300203 - DNA, 75 bp, Artificial Sequence
  Synthetic
gaatacaccaatggttacatttacaattgataaattaagacgattatatacaggattaaaagactgttgaatatg

SEQ ID NO: 300204 - DNA, 75 bp, Artificial Sequence
  Synthetic
aattaatgtgttagagaacttacataatccaagtttcaaaatacagattacacgtaattgtagcgaactgtcttt

SEQ ID NO: 300205 - DNA, 75 bp, Artificial Sequence
  Synthetic
aactaataattctttcatattcaaacagatctactttagctaaacttgtttcatcaccaatgtcaattttagttg

SEQ ID NO: 300206 - DNA, 75 bp, Artificial Sequence
  Synthetic
acaaattattaatacatatcaagctagatttggcactattatcgcaagaaattttgatacaattcgtttatcatt

SEQ ID NO: 300207 - DNA, 75 bp, Artificial Sequence
  Synthetic
tgagttaaaagaaatgctgaataacatgaagaaggccggtctagttgacataccaaagatgatacaagattggct

SEQ ID NO: 300208 - DNA, 75 bp, Artificial Sequence
  Synthetic
gatcagttaaagactgagtatactgaagatatcgatgatgaaatgtatagagaatacaccatgttgattagggat

SEQ ID NO: 300209 - DNA, 75 bp, Artificial Sequence
  Synthetic
agaatacaccatgttgattagggatgaaatcgtgaaaatgctccaagaggttgttaaacatgatgatcatcttct

SEQ ID NO: 300210 - DNA, 75 bp, Artificial Sequence
  Synthetic
aaaaaatgctaatttatgcaaaacatactagagaatatgccgagttttattcacaatctaatcaacttctttcat

SEQ ID NO: 300211 - DNA, 75 bp, Artificial Sequence
  Synthetic
aggaataattatgggactagacatgttagccaatatgactaacgatgccaaagtaatacaaacgctgaatttgta

SEQ ID NO: 300212 - DNA, 75 bp, Artificial Sequence
  Synthetic
caaacaaaagctgctaattctatagctaatttagcattaattaaaacggttctgtcacgtgttgcaaacaaatat

SEQ ID NO: 300213 - DNA, 75 bp, Artificial Sequence
  Synthetic
atgacgttagagacacttacgcacgaatgaatgctaaagtgaaggcactagtctctacagttggaatagaaattg

SEQ ID NO: 300214 - DNA, 75 bp, Artificial Sequence
  Synthetic
ggtcttatattcaaattacattgttaacagattgaggggtttcgagactgatagagagtttatactgacaaaaat

SEQ ID NO: 300215 - DNA, 75 bp, Artificial Sequence
  Synthetic
catgcaaatgacatcagtagctattactggatcgcttagattatttccgtcggaaagagttttaacaaccaactc

SEQ ID NO: 300216 - DNA, 75 bp, Artificial Sequence
  Synthetic
aaatcagggatagcagatgagattgcggcatcacaaacatttaagaactatgtgtctaaactttcagatcagctg

SEQ ID NO: 300217 - DNA, 75 bp, Artificial Sequence
  Synthetic
caatgtaaattaaaaatggcatctaaattaattaaaccaaattatgtaacttcgaatcataaagcgtcagctact

SEQ ID NO: 300218 - DNA, 75 bp, Artificial Sequence
  Synthetic
aaatttctgctttactaacaatgttacagaagccagtgacgtttaaatcgaataagataacaattaatgacattt

SEQ ID NO: 300219 - DNA, 75 bp, Artificial Sequence
  Synthetic
acagtgtattggatcaagaacttatcagatagaagatgacggatctaagtcggccatttcaagactaatatcgaa

SEQ ID NO: 300220 - DNA, 75 bp, Artificial Sequence
  Synthetic
tcactattataacgtaaatgtaaattttcattcaaattataacgaacgaattaacgatgctgtggctattattac

SEQ ID NO: 300221 - DNA, 75 bp, Artificial Sequence
  Synthetic
gctcatattaatgaattacaaatatataataataaactagagcgtgatttacaatcaaaaataggatcagttatt

SEQ ID NO: 300222 - DNA, 75 bp, Artificial Sequence
  Synthetic
tggctgagctagcttgcttctgttatcctcatttggagaacgatagctataaatttattccttttaataatttag

SEQ ID NO: 300223 - DNA, 75 bp, Artificial Sequence
  Synthetic
tatgcacgaatgaatgctaaagtcaaagctctagtatccacagtaggaatagaaatagctaaaagatatattgca

SEQ ID NO: 300224 - DNA, 75 bp, Artificial Sequence
  Synthetic
tggcttagccttaatcccgtttaaccaacctggcgagcgctgggcgttaatggaaggaatggtcctcatgtgacc

SEQ ID NO: 300225 - DNA, 75 bp, Artificial Sequence
  Synthetic
aaaagaataaactttaataattcatcagagtatatagaaaattggaatttacagaatagaagacaacgtactgga

SEQ ID NO: 300226 - DNA, 75 bp, Artificial Sequence
  Synthetic
atggcgtacaggaaacgtggagcgcgccgtgaggcgaacttaaataataatgatcgaatacagcaggagaaaatt

SEQ ID NO: 300227 - DNA, 75 bp, Artificial Sequence
  Synthetic
tttatcagatgaaatacaaactattggttctgagaaaacacgaaacgtgacaataaatccaggaccatttgcaca

SEQ ID NO: 300228 - DNA, 75 bp, Artificial Sequence
  Synthetic
aactggatacgcaccagtgaactggggacctggagaaacaaatgattcaacaacagtcgaaccagtacttgacgg

SEQ ID NO: 300229 - DNA, 75 bp, Artificial Sequence
  Synthetic
agatggttagctactatactaatcgaaccaaatgtcacgtcacaaagcagaacatacactctatttggacggcaa

SEQ ID NO: 300230 - DNA, 75 bp, Artificial Sequence
  Synthetic
tgtcagatacaaagctctatggagtgatgaagtttagtggtagattgtatacgtacaatggtgagacaccgaacg

SEQ ID NO: 300231 - DNA, 75 bp, Artificial Sequence
  Synthetic
gatgaagtttagtggtagattgtatacgtacaatggtgagacaccgaacgcaactactggttattacactacaac

SEQ ID NO: 300232 - DNA, 75 bp, Artificial Sequence
  Synthetic
aataaatactattgtttatccagcatttggaatgcaaagaatgcattatagaaatggcgatcctcagactccatt

SEQ ID NO: 300233 - DNA, 75 bp, Artificial Sequence
  Synthetic
tgattgataaactaactactcgtgaaattgaacaggttgaattgcttaaacgtatacatgacaacctggtaacta

SEQ ID NO: 300234 - DNA, 75 bp, Artificial Sequence
  Synthetic
gaaaaaatccatatgaaccgtcagaagtgactgcatccatgtgagaggttgagttaccgtcgtctgtcttcggaa

SEQ ID NO: 300235 - DNA, 75 bp, Artificial Sequence
  Synthetic
taatagagatataatcatacgtttcaagtttgcgaacgccataatcaaatctggaggtctaggatataagtggtc

SEQ ID NO: 300236 - DNA, 75 bp, Artificial Sequence
  Synthetic
tgaagtaattaaagaaaattcatacgtctatgtagactattgggatgattctcaagcttttagaaatatggtata

SEQ ID NO: 300237 - DNA, 75 bp, Artificial Sequence
  Synthetic
gctgtgtcattacgactcgcgggggtaacgctatcaacacagttcactgactacgtgtcgttaaattcactaaga

SEQ ID NO: 300238 - DNA, 75 bp, Artificial Sequence
  Synthetic
atcagaagattggatatcttcaatctaatactaatgaatatggatcaaattgaacgtgcctcagataaaattgct

SEQ ID NO: 300239 - DNA, 75 bp, Artificial Sequence
  Synthetic
gagattattatgaaatattaggaagattctcgcttatatcattagtgccgtcgaatgatgattaccaaacgccaa

SEQ ID NO: 300240 - DNA, 75 bp, Artificial Sequence
  Synthetic
attctcgcttatatcattagtgccgtcgaatgatgattaccaaacgccaattatgaattcagtaacagtcaggca

SEQ ID NO: 300241 - DNA, 75 bp, Artificial Sequence
  Synthetic
atatctgatacggtatcaacacaaacatctacgataagtagacggttaagattgaaagaaatcacaactcagacg

SEQ ID NO: 300242 - DNA, 75 bp, Artificial Sequence
  Synthetic
tgttagcgatctcattcagcaatttaatcaaatgatagtaaccatgaatggaaatgattttcaaactggaggaat

SEQ ID NO: 300243 - DNA, 75 bp, Artificial Sequence
  Synthetic
tcgagcttatagagttataaaagatgatgaagtgttagaagcagggacggatggacggttttttgcatatagagt

SEQ ID NO: 300244 - DNA, 75 bp, Artificial Sequence
  Synthetic
agtgttttatacagtagttgactatattaaccaaattatacaagttatgtccaaacggtcaagatcattagacac

SEQ ID NO: 300245 - DNA, 75 bp, Artificial Sequence
  Synthetic
aagatcagatcctagagtattacgggaatttataaatcaagataatccaataattcgtaataggatagaacaact

SEQ ID NO: 300246 - DNA, 75 bp, Artificial Sequence
  Synthetic
atataacaacgagttatacgtatatgttatctgatgaggtgtatgtagcaaatgtaagcggtgtactatcaacat

SEQ ID NO: 300247 - DNA, 75 bp, Artificial Sequence
  Synthetic
ttttggatgattcagatagtgatgacggtaaatgtaagaattgtaaatataaaaagaaatattttgcactaagaa

SEQ ID NO: 300248 - DNA, 75 bp, Artificial Sequence
  Synthetic
atggctacttttaaagatgcttgctattattataagagaattaacaaactaaatcatacagtcttgaaattggga

SEQ ID NO: 300249 - DNA, 75 bp, Artificial Sequence
  Synthetic
caaagacctcattatggaaagaaatgcaatataacagagatattataattagatttaaatttggtaatagtattg

SEQ ID NO: 300250 - DNA, 75 bp, Artificial Sequence
  Synthetic
agaaatgaatgtatgacacagtggtataatcatttgctaatgccaataacattgcaatctctgtcaattgaattg

SEQ ID NO: 300251 - DNA, 75 bp, Artificial Sequence
  Synthetic
tgctacttgatgatgtaaattttactagaatgtcattcttaccaataactttgcagcaagagtatgcacttagat

SEQ ID NO: 300252 - DNA, 75 bp, Artificial Sequence
  Synthetic
ggtgtatgttagatcattagcagctaatttaaattcagtgaaatgtacaggtggaagttacgactttagtatacc

SEQ ID NO: 300253 - DNA, 75 bp, Artificial Sequence
  Synthetic
aatacagatcacgcgcaattgcagtgagctgtcttccgattggaatggagcatgtaaacttgttaaagatacaag

SEQ ID NO: 300254 - DNA, 75 bp, Artificial Sequence
  Synthetic
tcacatgttgagttctatagcgtttccactagatgcagaatgttcacgcaacgtaaacttcaaatagcatctaaa

SEQ ID NO: 300255 - DNA, 75 bp, Artificial Sequence
  Synthetic
aatgctattaactatgttttatttaatcatgaggtaaattgggatgttattaatatattagttcagagtattggt

SEQ ID NO: 300256 - DNA, 75 bp, Artificial Sequence
  Synthetic
ctacatttacagtcgataaactaagacggttgtgtacagaaccaaagactgtcgactatgattctggcatatctg

SEQ ID NO: 300257 - DNA, 75 bp, Artificial Sequence
  Synthetic
acggttgtgtacagaaccaaagactgtcgactatgattctggcatatctgatgttgaataatgaaagaaaggtca

SEQ ID NO: 300258 - DNA, 75 bp, Artificial Sequence
  Synthetic
gaaatgagacagcgtgtgcaagctgatagaaatgttgttaattatccatcaatattacatccaatagattatgca

SEQ ID NO: 300259 - DNA, 75 bp, Artificial Sequence
  Synthetic
aattagtttcaacggaagcacaaattcagaaaatgtcacaagatttgcaattggaagcattaacaattcagtcag

SEQ ID NO: 300260 - DNA, 75 bp, Artificial Sequence
  Synthetic
gacgtttcacaatgggattcgtcacaacataacacacagccatttaggaaaggaataattatgggtttagatatg

SEQ ID NO: 300261 - DNA, 75 bp, Artificial Sequence
  Synthetic
cgaaacctataatatacatgcttggttcagctccatcttattggatttatgatattaaacagtattctgatttta

SEQ ID NO: 300262 - DNA, 75 bp, Artificial Sequence
  Synthetic
ggagaaaaatagtagaacaacaaactgttagcaatctaaatattgcatataaatatctatcaacaggaaaagcaa

SEQ ID NO: 300263 - DNA, 75 bp, Artificial Sequence
  Synthetic
tactgttcgtataaataacacttttaaagacgaaccaaaagtaaattttaaaaatatttatgattggacgtttct

SEQ ID NO: 300264 - DNA, 75 bp, Artificial Sequence
  Synthetic
tacagatttttgttgtttgttgtaattattacgccatttgtaaattcacagaactatggcgtaaatttaccaatt

SEQ ID NO: 300265 - DNA, 75 bp, Artificial Sequence
  Synthetic
ttgctgacaattcatggaaagatacgctatcacagttattcttaacaaaagggtggccaactggttctgtttatc

SEQ ID NO: 300266 - DNA, 75 bp, Artificial Sequence
  Synthetic
ttgcgacagcagaaaaattagcaataacagatgttgttgatggggtgaactacaaaataaatgtcaccactacta

SEQ ID NO: 300267 - DNA, 75 bp, Artificial Sequence
  Synthetic
atacgatgttaaaattccacatttgacgctaggagtattatttatatctgataacatgatacatgatgtaatcac

SEQ ID NO: 300268 - DNA, 75 bp, Artificial Sequence
  Synthetic
tacaaaataaatgtcaccactactacatgtacaattagaaactgtaaaaaactgggacctagagagaatgttgca

SEQ ID NO: 300269 - DNA, 75 bp, Artificial Sequence
  Synthetic
cacgcagatagagtgtttgctacatataagaacattgctaagagtggtaatgttattgattttaacctgttagac

SEQ ID NO: 300270 - DNA, 75 bp, Artificial Sequence
  Synthetic
cacttcttttgaagctgcagttgttgctgccacttcaacattagaattaatgggtattcaatatgattataatga

SEQ ID NO: 300271 - DNA, 75 bp, Artificial Sequence
  Synthetic
actatgaatatgcatatgaatagtcacataattcactaattatttaccatctacacatgaccctctatgagcaca

SEQ ID NO: 300272 - DNA, 75 bp, Artificial Sequence
  Synthetic
gaaacagaaattggatgactgattctaaaacagtggctaaattggatgaagatgtgaataaactcagaatgatgt

SEQ ID NO: 300273 - DNA, 75 bp, Artificial Sequence
  Synthetic
aattgtttagaatatttgaaccaagacaattaccaatctatcgagcaaatggtgagaaagaattaaggaatagat

SEQ ID NO: 300274 - DNA, 75 bp, Artificial Sequence
  Synthetic
gatgtgaataaactcagaatgatgttatcttctaaaggaattgaccagaggatgagagtgctaaacgcttgtttt

SEQ ID NO: 300275 - DNA, 75 bp, Artificial Sequence
  Synthetic
cccttcagaacgttatttcacagcagcaaaatcaaatagcagacctccaacaatactgcaataaattagaaactg

SEQ ID NO: 300276 - DNA, 75 bp, Artificial Sequence
  Synthetic
ttatgacagaacattcttaatgttaaaaggacttgtaaggcaatgcaactatgaatatacttacgaatagtcaca

SEQ ID NO: 300277 - DNA, 75 bp, Artificial Sequence
  Synthetic
aaacaaatggacagagtcgttaaagagatgagacgtcagttggaaatgattgataagttgaccacacgtgagatt

SEQ ID NO: 300278 - DNA, 75 bp, Artificial Sequence
  Synthetic
cgctagaagaatgggaaagcggaaaaaatccttatgaaccaaaagaagtgactgcagcaatgtaagaggttgagc

SEQ ID NO: 300279 - DNA, 75 bp, Artificial Sequence
  Synthetic
tcgacaatatgaaaaaagctggtttagtagatataccaagaatgattcaagaatggttagttgattgttcattag

SEQ ID NO: 300280 - DNA, 75 bp, Artificial Sequence
  Synthetic
ataatgtatgtatggatgaaatggcaagagagtctcaaagaaatggagtagctccgcaatctgaagcattgagaa

SEQ ID NO: 300281 - DNA, 75 bp, Artificial Sequence
  Synthetic
ttggagttaagtttaaaaatattccttataagtataacgttaaagtaccacatctcacatttggcgtattaaata

SEQ ID NO: 300282 - DNA, 75 bp, Artificial Sequence
  Synthetic
ggcttttaaggcgaagtctccaccatggatgtgctttattcgcttgctaagacgttgaaggatgccagagccaga

SEQ ID NO: 300283 - DNA, 75 bp, Artificial Sequence
  Synthetic
atatatagaaaactggaatctgcagaatagaaggcagcgaactggctatttgttgcataaaccaaacattcttcc

SEQ ID NO: 300284 - DNA, 75 bp, Artificial Sequence
  Synthetic
aatgaagataaaccaatttcagatgtatgtgttaaagaacttgttgctgaattgagatggcagtataacagattt

SEQ ID NO: 300285 - DNA, 75 bp, Artificial Sequence
  Synthetic
acttattactgttcgtatgaataacacctttaaagatgaaccgaaagtaaattttaagaatatttatgattggac

SEQ ID NO: 300286 - DNA, 75 bp, Artificial Sequence
  Synthetic
cacctggagtagcagcactctttcctctggcagcgccatttccaaatcatgcaacagtcggtttgactttaaaaa

SEQ ID NO: 300287 - DNA, 75 bp, Artificial Sequence
  Synthetic
attcaaaagcatttagaaatatggtatatgtcagatcattagcagctaatttaaactcagtgaaatgtacaggtg

SEQ ID NO: 300288 - DNA, 75 bp, Artificial Sequence
  Synthetic
tatgaaaataataaaataacttctgaattgtttcagtcagctgaagaatatactgattcattaatggatcctgct

SEQ ID NO: 300289 - DNA, 75 bp, Artificial Sequence
  Synthetic
atgttactaaacaaatggttcaagatgtgtcaaatgatgtaagatatatatattctagaatgaatgctaaagtta

SEQ ID NO: 300290 - DNA, 75 bp, Artificial Sequence
  Synthetic
atggcttcgctcatttatagacagctactcactaattcatacacagttgaattatcagatgaaattaatacaatt

SEQ ID NO: 300291 - DNA, 75 bp, Artificial Sequence
  Synthetic
aatctgttttaatagctattggtcaatcaaaagaaattgaaactactgctactgccgaaggaggagaaatagtat

SEQ ID NO: 300292 - DNA, 75 bp, Artificial Sequence
  Synthetic
gaaatatggtggaagagtatggacatttcatggtgaaacaccaagagctactactgacagctcaaatactgcaaa

SEQ ID NO: 300293 - DNA, 75 bp, Artificial Sequence
  Synthetic
tcgcaacattcgaagaagtagctacatctgaaaaattagtaattacggacgtggtagatggagtagatcataaaa

SEQ ID NO: 300294 - DNA, 75 bp, Artificial Sequence
  Synthetic
ctttatccactcaatttactgacttcgtatcacttaattcgttaagatttagattcagtttaaccgttgaagagc

SEQ ID NO: 300295 - DNA, 75 bp, Artificial Sequence
  Synthetic
ctgaatgaatggctgtgcaatccaatggatattgctctatattattatcaacaaacagacgaagctaacaaatgg

SEQ ID NO: 300296 - DNA, 75 bp, Artificial Sequence
  Synthetic
aagaaatagcaatgacgcaattgatagatttagcattattgccattagatatgttttctatgttttcaggtatta

SEQ ID NO: 300297 - DNA, 75 bp, Artificial Sequence
  Synthetic
tttaacttaatattaatgaatatggaacagatcgaacgagcttcagataaaattgctcaaggagtaataattgct

SEQ ID NO: 300298 - DNA, 75 bp, Artificial Sequence
  Synthetic
aacagatcgaacgagcttcagataaaattgctcaaggagtaataattgcttatagagatatgcagctagaaagag

SEQ ID NO: 300299 - DNA, 75 bp, Artificial Sequence
  Synthetic
tttaagaaatcaggattagctacatcaatctctgaattgactggatcattatcaaacgctgcttcatcagtttcc

SEQ ID NO: 300300 - DNA, 75 bp, Artificial Sequence
  Synthetic
ttttgattttggattacttggaacaactctattaaacctagatgctaattatgttgagaccgcccgtaatacgat

SEQ ID NO: 300301 - DNA, 75 bp, Artificial Sequence
  Synthetic
cgctaggaacctcgatggatatcaacaaatcaatttagaagagttaatgagaactggggactatggtcaaattac

SEQ ID NO: 300302 - DNA, 75 bp, Artificial Sequence
  Synthetic
cacagcaccacaaactgaacgaatgatgcgcattaattggaagaaatggtggcaagttttttataccgtagtaga

SEQ ID NO: 300303 - DNA, 75 bp, Artificial Sequence
  Synthetic
ttatcaggtattaaatttaagagaataaattttgataattcatctgaatatatagagaattggaatttgcagaat

SEQ ID NO: 300304 - DNA, 75 bp, Artificial Sequence
  Synthetic
tgtataaaataaattctgattctaatgatttctacttagttgcaaattatgattggataccaacttcaaccacaa

SEQ ID NO: 300305 - DNA, 75 bp, Artificial Sequence
  Synthetic
ttgataagtatgtagctatgttaagctgcttgaactctgcaagtaagaatacgctcacgtgttcactacgcagag

SEQ ID NO: 300306 - DNA, 75 bp, Artificial Sequence
  Synthetic
ccaacaggatcagtctattttaaagagtattcaaatattgttgatttatccgttgacccacaattatattgtgat

SEQ ID NO: 300307 - DNA, 75 bp, Artificial Sequence
  Synthetic
ccaacaggatcagtctattttaaagagtattcaaatattgttgatttttccgttgacccacaattatattgtgat

SEQ ID NO: 300308 - DNA, 75 bp, Artificial Sequence
  Synthetic
ccaacaggatcagtctattttaaagagtattcaaatattgttgatttctccgttgacccacaattatattgtgat

SEQ ID NO: 300309 - DNA, 75 bp, Artificial Sequence
  Synthetic
ccaacaggatcagtctattttaaagagtattcaaatattgttgatttgtccgttgacccacaattatattgtgat

SEQ ID NO: 300310 - DNA, 75 bp, Artificial Sequence
  Synthetic
ccaacaggttcagtctattttaaagagtattcaaatattgttgatttatccgttgacccacaattatattgtgat

SEQ ID NO: 300311 - DNA, 75 bp, Artificial Sequence
  Synthetic
ccaacaggttcagtctattttaaagagtattcaaatattgttgatttttccgttgacccacaattatattgtgat

SEQ ID NO: 300312 - DNA, 75 bp, Artificial Sequence
  Synthetic
ccaacaggttcagtctattttaaagagtattcaaatattgttgatttctccgttgacccacaattatattgtgat

SEQ ID NO: 300313 - DNA, 75 bp, Artificial Sequence
  Synthetic
ccaacaggttcagtctattttaaagagtattcaaatattgttgatttgtccgttgacccacaattatattgtgat

SEQ ID NO: 300314 - DNA, 75 bp, Artificial Sequence
  Synthetic
ccaacaggctcagtctattttaaagagtattcaaatattgttgatttatccgttgacccacaattatattgtgat

SEQ ID NO: 300315 - DNA, 75 bp, Artificial Sequence
  Synthetic
ccaacaggctcagtctattttaaagagtattcaaatattgttgatttttccgttgacccacaattatattgtgat

SEQ ID NO: 300316 - DNA, 75 bp, Artificial Sequence
  Synthetic
ccaacaggctcagtctattttaaagagtattcaaatattgttgatttctccgttgacccacaattatattgtgat

SEQ ID NO: 300317 - DNA, 75 bp, Artificial Sequence
  Synthetic
ccaacaggctcagtctattttaaagagtattcaaatattgttgatttgtccgttgacccacaattatattgtgat

SEQ ID NO: 300318 - DNA, 75 bp, Artificial Sequence
  Synthetic
ccaacagggtcagtctattttaaagagtattcaaatattgttgatttatccgttgacccacaattatattgtgat

SEQ ID NO: 300319 - DNA, 75 bp, Artificial Sequence
  Synthetic
ccaacagggtcagtctattttaaagagtattcaaatattgttgatttttccgttgacccacaattatattgtgat

SEQ ID NO: 300320 - DNA, 75 bp, Artificial Sequence
  Synthetic
ccaacagggtcagtctattttaaagagtattcaaatattgttgatttctccgttgacccacaattatattgtgat

SEQ ID NO: 300321 - DNA, 75 bp, Artificial Sequence
  Synthetic
ccaacagggtcagtctattttaaagagtattcaaatattgttgatttgtccgttgacccacaattatattgtgat

SEQ ID NO: 300322 - DNA, 75 bp, Artificial Sequence
  Synthetic
attttccatatattgcatctgttctaacagttttgttcacattacataaagcttcaattccaaccatgaaaatag

SEQ ID NO: 300323 - DNA, 75 bp, Artificial Sequence
  Synthetic
gctaattatgttgagaatgcgagaactacaattgaatattttattgactttattgataatgtatgtatggatgaa

SEQ ID NO: 300324 - DNA, 75 bp, Artificial Sequence
  Synthetic
gtcaccattattaaatgctcaaaattacggaattaatctgccaatcactggttcaatggacactgcatatgctaa

SEQ ID NO: 300325 - DNA, 75 bp, Artificial Sequence
  Synthetic
cgcactgactacagctactataactttgttacctgatgcagaaagatttagttttccaagagtcattaattcagc

SEQ ID NO: 300326 - DNA, 75 bp, Artificial Sequence
  Synthetic
tgttcaaataccagatggtaatattattaagaaaatacaatatggagctgtagcgtcaggagagaagcagactaa

SEQ ID NO: 300327 - DNA, 75 bp, Artificial Sequence
  Synthetic
gcaccacaaactgagaggatgatgcgtattaattggaagaaatggtggcaagtgttctacactgtagttgattat

SEQ ID NO: 300328 - DNA, 75 bp, Artificial Sequence
  Synthetic
gtattaattggaagaaatggtggcaagtgttctacactgtagttgattatgtgaatcagataattcaagcaatgt

SEQ ID NO: 300329 - DNA, 75 bp, Artificial Sequence
  Synthetic
tattctcaagataagtataggatattagaatcatacgtatataatttattgtctattaattatggatgttatcaa

SEQ ID NO: 300330 - DNA, 75 bp, Artificial Sequence
  Synthetic
agattcggattcagataattacgtacttgatgactctgatagtgatgacggaaaatgtaaaaattgtaaatataa

SEQ ID NO: 300331 - DNA, 75 bp, Artificial Sequence
  Synthetic
tttagaggtctgtcaactgatagaaagatggatgaagtctctcaagtaggcgtttaattcgctttcaattcaaag

SEQ ID NO: 300332 - DNA, 75 bp, Artificial Sequence
  Synthetic
atctatagtaaaatgcactaaattaatgaagaataaattagaacgaggtgaagtagaagtagatgattctttcat

SEQ ID NO: 300333 - DNA, 75 bp, Artificial Sequence
  Synthetic
aatacctgggtaattaaagctagaaaagtgaatgaaaatatgaattctcttcaaaatataatctctcaacagcaa

SEQ ID NO: 300334 - DNA, 75 bp, Artificial Sequence
  Synthetic
ctatggaactatctgatgacgttaaatcagatattgagcaacagcttaattcaatagaccaattgaatcctgtta

SEQ ID NO: 300335 - DNA, 75 bp, Artificial Sequence
  Synthetic
tcaatagaccaattgaatcctgttaacgcattagatgattttgagtctatactccgtaatttaatttctgattat

SEQ ID NO: 300336 - DNA, 75 bp, Artificial Sequence
  Synthetic
aatcattaaaacagagagtgaatgaaaagtatgcgacttgggtacagaaggcaaaaaaagttaatgaaaatatgt

SEQ ID NO: 300337 - DNA, 75 bp, Artificial Sequence
  Synthetic
ggtaataacagatgatccgcagcaagataagaaggatacactgccagatgacaccctcaaactggataaacaagt

SEQ ID NO: 300338 - DNA, 75 bp, Artificial Sequence
  Synthetic
cgcacaaacgggatatgcgcctgttaattggggacatggtgaattacctgattctacattagtgcaaccaactct

SEQ ID NO: 300339 - DNA, 75 bp, Artificial Sequence
  Synthetic
cttaaatcaatggaattgccagatgaagtcaaaactgatatagaacaacaattgaattcaatagatactattagt

SEQ ID NO: 300340 - DNA, 75 bp, Artificial Sequence
  Synthetic
caacattgttaaatctagatgctaattatgttgaaactgcaagaacaacaatagaatattttattgacttcatag

SEQ ID NO: 300341 - DNA, 75 bp, Artificial Sequence
  Synthetic
attccatcatttcaacctaatgagacagtactaaagaagctcatagatataaaaccagatccagccaaaaaatca

SEQ ID NO: 300342 - DNA, 75 bp, Artificial Sequence
  Synthetic
aatacctggtaagtcatcatctatagtaaaatgcactaaattaatgaagaataaattggaacgaggtgaagtaga

SEQ ID NO: 300343 - DNA, 75 bp, Artificial Sequence
  Synthetic
atagaagacaacgtactggatttgtgttccataaaccaaacatatttccatattctgcttcttttactttaaaca

SEQ ID NO: 300344 - DNA, 75 bp, Artificial Sequence
  Synthetic
atgatttaccggaaggagactatgatgttagagagtatttcttgcatctttattcacaagtacttgaatacatgc

SEQ ID NO: 300345 - DNA, 75 bp, Artificial Sequence
  Synthetic
tattcacaagtacttgaatacatgccggactacatgcttctaaaagagatggcagtagaaaataagaattctcgt

SEQ ID NO: 300346 - DNA, 75 bp, Artificial Sequence
  Synthetic
tacatgtcaaaacgcagctacagatgatgatataataattgaatatatatattccagtgagttggattttcaaac

SEQ ID NO: 300347 - DNA, 75 bp, Artificial Sequence
  Synthetic
taagacaaagagcgaacacagagcgcaacacagtagattatccagctatacttcacccgatagactatgaattta

SEQ ID NO: 300348 - DNA, 75 bp, Artificial Sequence
  Synthetic
gtgtacacaatatataaacaatggtttaccaccaattcagaatacgaggaatattgtaccagtgaatattacatc

SEQ ID NO: 300349 - DNA, 75 bp, Artificial Sequence
  Synthetic
ttggtccgagaaatgaatccatgttcacgtttttaaactttccaactattaaacagttttcaaatggtgcatatc

SEQ ID NO: 300350 - DNA, 75 bp, Artificial Sequence
  Synthetic
aaacatggatgtgaacttgccaccaaccgctagatacataagaccagttctgcttcaggatagactcaatctgca

SEQ ID NO: 300351 - DNA, 75 bp, Artificial Sequence
  Synthetic
caaatccagaagatgtcgcaggacttacagctagaagcattaacagtccagtcagaaacacaatttttgacaggt

SEQ ID NO: 300352 - DNA, 75 bp, Artificial Sequence
  Synthetic
cactaatttcaagtatgtggctgatgtccatagtaccaacaactatgttcatacgagaatcattagtggcatgtc

SEQ ID NO: 300353 - DNA, 75 bp, Artificial Sequence
  Synthetic
attcagtcttatatatagacataaggactgatagagaaaatatggattggaaagagtggagaaaagtagtagagc

SEQ ID NO: 300354 - DNA, 75 bp, Artificial Sequence
  Synthetic
tttgcataaagcatcaattccaacaatgaaaattgcgttaaaaacatccagatgttcttacaaagttattaagta

SEQ ID NO: 300355 - DNA, 75 bp, Artificial Sequence
  Synthetic
gcaaataaacaactttcaagttcagaactggctccactttgtcaatcacaacacgtttaaccaggtcatcattga

SEQ ID NO: 300356 - DNA, 75 bp, Artificial Sequence
  Synthetic
tggtagattctcactcatatcactagtaccaacaaatgatgactatcaaacgccaatcgctaattcagttacagt

SEQ ID NO: 300357 - DNA, 75 bp, Artificial Sequence
  Synthetic
tatggtattgaatacgtcacaatactagctgttgggctatcacttgtatttattaattatatactgaaatcaata

SEQ ID NO: 300358 - DNA, 75 bp, Artificial Sequence
  Synthetic
tggagttattaatcagacgttgaatgatcaaataagacgtggcttaattataaatcaacttatggaggcactgaa

SEQ ID NO: 300359 - DNA, 75 bp, Artificial Sequence
  Synthetic
gacctgacccgccttatgtgctataactatgaaacactaatgtcatgtatcactatgaatatgcaaaatgtccaa

SEQ ID NO: 300360 - DNA, 75 bp, Artificial Sequence
  Synthetic
gctaattggaaatactaccgttattccagagccacgcacactattccattattaccagaccaatgtgaacttcca

SEQ ID NO: 300361 - DNA, 75 bp, Artificial Sequence
  Synthetic
gatgccgtcgctatcatcgccgcagcgaaccatctggacctgtatcgtaagaaaatgaaatcaatagttgaagat

SEQ ID NO: 300362 - DNA, 75 bp, Artificial Sequence
  Synthetic
ttcttgaaaaaattacacatcttcgacgtagcaaaagtacctgatgaccagatgtacagattgcgtgacaggctc

SEQ ID NO: 300363 - DNA, 75 bp, Artificial Sequence
  Synthetic
tgattattgcatatagagaaatgcgcttagattacgatgagctgtatggattcgtcaacttggcacgcgacgtta

SEQ ID NO: 300364 - DNA, 75 bp, Artificial Sequence
  Synthetic
gtgtacaataagaaactgtaaaaaacttggaccaagagaaaatgttgcggtaattcaagtaggaggttcaaatat

SEQ ID NO: 300365 - DNA, 75 bp, Artificial Sequence
  Synthetic
attatggaataacaaagaaacaagccatggaactattacattcaaatccaaagacattaaaagagtttataaatg

SEQ ID NO: 300366 - DNA, 75 bp, Artificial Sequence
  Synthetic
tgctattccattcgccactgattcagctgtaacgtcattgatagcgaaattagacgccacagtctttgcgcaaat

SEQ ID NO: 300367 - DNA, 75 bp, Artificial Sequence
  Synthetic
ttatgctgatgaccctaattacttcataggaattaaatttagtaacataccttatgaatacgatgttaaagttcc

SEQ ID NO: 300368 - DNA, 75 bp, Artificial Sequence
  Synthetic
tgcttagagaactcaaagaatggactatcactgaaaaaactttttactgaatacagcgatgttatagagaatgct

SEQ ID NO: 300369 - DNA, 75 bp, Artificial Sequence
  Synthetic
actctgactcaaatgatttctatctcgtcgttaactacaattggataccgacatcgacgacaaaagtgtttaagc

SEQ ID NO: 300370 - DNA, 75 bp, Artificial Sequence
  Synthetic
cacagtcgaaccgattaatgctgttgcattcgacaatgtgaggattatgcaagaactgtaagccattaccgtaaa

SEQ ID NO: 300371 - DNA, 75 bp, Artificial Sequence
  Synthetic
gaatagagagcacaaaactcaaaattagttcgatttatttaagaaaaattaaaggtgaaaccgtatttgatatgt

SEQ ID NO: 300372 - DNA, 75 bp, Artificial Sequence
  Synthetic
acttgattaacaaccagaaacattcattaatcactgttagaattaacaatacttttaaagatgaaccaaaagtgg

SEQ ID NO: 300373 - DNA, 75 bp, Artificial Sequence
  Synthetic
tagtgacatgggcgaattcttcaattgaaatgctaatgtcagttttttctcatgaggattacctaattgcgagag

SEQ ID NO: 300374 - DNA, 75 bp, Artificial Sequence
  Synthetic
actcttaaagatgctagagacaaaattgtcgaaggcacattatactctaatgtgagtgatctaattcaacaattt

SEQ ID NO: 300375 - DNA, 75 bp, Artificial Sequence
  Synthetic
tacttgaccaaagaataatttggcaaaattggtatgcgtttacatcttctatgaaacaaggtaatactcttgatg

SEQ ID NO: 300376 - DNA, 75 bp, Artificial Sequence
  Synthetic
gtaataatcttgatgtgtgtaagaaattactctttcagaaaatgaaacaagagaagagtccatttaaaggattgt

SEQ ID NO: 300377 - DNA, 75 bp, Artificial Sequence
  Synthetic
ttacttcaatctttgtcaatgcacagaattacggtattaacttaccaataactggatcaatggatgtatcatatg

SEQ ID NO: 300378 - DNA, 75 bp, Artificial Sequence
  Synthetic
aataaaacagttctcgaatggaccatatctagttaaagacacaattaaactcaaacaagagagatggcttggtaa

SEQ ID NO: 300379 - DNA, 75 bp, Artificial Sequence
  Synthetic
gttttagtaataataaaacagtaagaatagagactacaaaattaagtattgagtcaatatatttacggaaaatta

SEQ ID NO: 300380 - DNA, 75 bp, Artificial Sequence
  Synthetic
agtgaccataaaagtaggaaacactaccctaaaatagaagcagaatctgattcagatgactacgtacttgatgat

SEQ ID NO: 300381 - DNA, 75 bp, Artificial Sequence
  Synthetic
tacattcaaagtgtttgattcggaggactttattatagaatatgggacaactgacgacgaagtatacatccaaag

SEQ ID NO: 300382 - DNA, 75 bp, Artificial Sequence
  Synthetic
tgccaattcaacgcagaatgacaactttttatcttcaacattatgtttgtattatccagccgaagctagaacgca

SEQ ID NO: 300383 - DNA, 75 bp, Artificial Sequence
  Synthetic
ctagggatgctggtaaagttgtagattccgagactgcaagtatttgtgatgctatatttcaagatgaggagacag

SEQ ID NO: 300384 - DNA, 75 bp, Artificial Sequence
  Synthetic
gaattttccgttgatcccaaattgtattgtgattataatattgttttaattagattcatcgctggggaagaatta

SEQ ID NO: 300385 - DNA, 75 bp, Artificial Sequence
  Synthetic
tcagatgatgtgaagactgatattgaacaacaggtggattcaatcgatgcaattaatcctaatcatgctatagat

SEQ ID NO: 300386 - DNA, 75 bp, Artificial Sequence
  Synthetic
aacttgatgtctattaattatggatgctatcaactattcgactttaattcaccagatctagaaaagttgatcaga

SEQ ID NO: 300387 - DNA, 75 bp, Artificial Sequence
  Synthetic
ccaacggcagaggaatatactgattcattaatggatccagcaattctaacttccttgtcatcaaatttaaatgca

SEQ ID NO: 300388 - DNA, 75 bp, Artificial Sequence
  Synthetic
atgtggaacattacgtcattgcgttcaccgtataccaacgcgaacttctttcaagattagagcgcttagatgtga

SEQ ID NO: 300389 - DNA, 75 bp, Artificial Sequence
  Synthetic
atagttgatgttgtagatagtgtgaatcacaaattagacgtcacatccacaacgtgcacaatacgaaattgtaac

SEQ ID NO: 300390 - DNA, 75 bp, Artificial Sequence
  Synthetic
gtggcaagtgttttacactgtagttgattacattaatcagatagtgcaggtcatgtctaaaagatcaagatcgtt

SEQ ID NO: 300391 - DNA, 75 bp, Artificial Sequence
  Synthetic
accaacatttgaaccgaaagaatcaatattgaagaagttggaagacattaaaccagagcaagcaaaaaaacaaac

SEQ ID NO: 300392 - DNA, 75 bp, Artificial Sequence
  Synthetic
acatagattctatttatctaagaaaaataaaaggtgacacggtgtttgatatgactgagtgagctaaaaacttaa

SEQ ID NO: 300393 - DNA, 75 bp, Artificial Sequence
  Synthetic
agacaactgccaatttacagagcaaatggagaaaaagaactacgcaacagatggtactggaagttgaagaaggat

SEQ ID NO: 300394 - DNA, 75 bp, Artificial Sequence
  Synthetic
ttactggatctatggatgtaacatatattaattcaacgcaaaatgataactttttagcctcaactctatgtctat

SEQ ID NO: 300395 - DNA, 75 bp, Artificial Sequence
  Synthetic
attctgactctgaggattacgttttagatgattcagatagtgatgacggtaaatgtaagaattgtaaatacaaaa

SEQ ID NO: 300396 - DNA, 75 bp, Artificial Sequence
  Synthetic
tttcaatgagtattcgaatgttctagaattctctgttgatccaaaattgtattgtgattataatgttgtcttgat

SEQ ID NO: 300397 - DNA, 75 bp, Artificial Sequence
  Synthetic
gaattctctgttgatccaaaattgtattgtgattataatgttgtcttgattagatttatttccggagaagaatta

SEQ ID NO: 300398 - DNA, 75 bp, Artificial Sequence
  Synthetic
acacccaattgattatgcctttaacgaatattttttgcaacatcaattagtcgaaccattgaataatgatataat

SEQ ID NO: 300399 - DNA, 75 bp, Artificial Sequence
  Synthetic
tcgaaccattgaataatgatataatttttaactatataccagaaagaataaggaatgatgtaaattacatactta

SEQ ID NO: 300400 - DNA, 75 bp, Artificial Sequence
  Synthetic
ggatatcaatgggatcatcatgtactgttaaagtatgtccattaaatacacagactttgggaattggatgtcaaa

SEQ ID NO: 300401 - DNA, 75 bp, Artificial Sequence
  Synthetic
aatcacaacttcaaattatattttggcgagatcagtagtaccagatttgaaggaactagtttcaacagaagcgca

SEQ ID NO: 300402 - DNA, 75 bp, Artificial Sequence
  Synthetic
attatttttaattatataccagaaagaataagaaatgatgttaactatattttgaatatggatatgaatttgcca

SEQ ID NO: 300403 - DNA, 75 bp, Artificial Sequence
  Synthetic
aacgtgcacaatccgaaattgtaataaattaggaccaagggaaaatgtagctataatacaagttggtggttctga

SEQ ID NO: 300404 - DNA, 75 bp, Artificial Sequence
  Synthetic
gtggcaagtattttataccgtagtcgactatataaatcagataatacaagtcatgtccaaaagacggaggtcgtt

SEQ ID NO: 300405 - DNA, 75 bp, Artificial Sequence
  Synthetic
ctagctatagtaaatacaatagtgtatccggcgttcgggatgcagcggatgcattacaggaatggagatccgcag

SEQ ID NO: 300406 - DNA, 75 bp, Artificial Sequence
  Synthetic
gcgtattgaaccaggtactaaatgataatattagaaatggacatgttattaatcaattgatggaagcactaatgc

SEQ ID NO: 300407 - DNA, 75 bp, Artificial Sequence
  Synthetic
agcagagcaacaaatacaaaattttcaagtagctaattggttacattttattaataataatagatttagacaagt

SEQ ID NO: 300408 - DNA, 75 bp, Artificial Sequence
  Synthetic
tttaactaggctgttagcctacaattacgagacattgatggcatgtatcacaatgaatatgcagcatgttcaaac

SEQ ID NO: 300409 - DNA, 75 bp, Artificial Sequence
  Synthetic
tgtataggttgagggataggttgcgtttgctgccagtggagatcagaagactggacatctttaacttaatattaa

SEQ ID NO: 300410 - DNA, 75 bp, Artificial Sequence
  Synthetic
atatcagaaaaaaatgaaatcaatagttgaggactttttaaaaagattgcaaatttttgatgtaccacgagtacc

SEQ ID NO: 300411 - DNA, 75 bp, Artificial Sequence
  Synthetic
ttgaagaatataaagatgtgatagacaatgcaactttattatctatattatcatattcttatgataaatataatg

SEQ ID NO: 300412 - DNA, 75 bp, Artificial Sequence
  Synthetic
tcaagctaagaaaagttgatactctaaaaccaatactatataaaataaattcagattcgaacgatttttacttgg

SEQ ID NO: 300413 - DNA, 75 bp, Artificial Sequence
  Synthetic
tcgctaactacgattggataccaacttcaactacaaaggtatataagcaggtaccacagcaattcgatttcagaa

SEQ ID NO: 300414 - DNA, 75 bp, Artificial Sequence
  Synthetic
acagacagttactcgctaattcttatacagttgatctatctgatgaaattgaaaatattggatacgcaaaaagta

SEQ ID NO: 300415 - DNA, 75 bp, Artificial Sequence
  Synthetic
agacactgcaaatattgaataaatctggtatagctgcggtagaaatacagaagatagatgaattgttcacgctga

SEQ ID NO: 300416 - DNA, 75 bp, Artificial Sequence
  Synthetic
atgactcaacaacagttgaaccagttctagatggtccataccaaccaactaattttaatccgccagtgaattatt

SEQ ID NO: 300417 - DNA, 75 bp, Artificial Sequence
  Synthetic
ggatgttactatctcctttaaatgctggtgttgtggttgaaggaacaaatagtattgatcgttggttagcgactg

SEQ ID NO: 300418 - DNA, 75 bp, Artificial Sequence
  Synthetic
cttttaatgaattacaggaaatgattgataacatgaaaaaagctggtttagtagatataccgagaatgattcaag

SEQ ID NO: 300419 - DNA, 75 bp, Artificial Sequence
  Synthetic
ggagtgcaagagcagatatcagtagaaaacaattcaactacaaaatggaaatttataaatttaattaaaaccact

SEQ ID NO: 300420 - DNA, 75 bp, Artificial Sequence
  Synthetic
cagctatgggtttataatggagaaactccaaacgctactactacaggctacgtaacttcaaattatgattcactt

SEQ ID NO: 300421 - DNA, 75 bp, Artificial Sequence
  Synthetic
gtttcataaacctaatatacttccatattcagcatcattcactctgaatagatcacagccagcacatgataattt

SEQ ID NO: 300422 - DNA, 75 bp, Artificial Sequence
  Synthetic
atataattcctagaaatcaagagtcaacatgtacagaatatattaataatggattacctccaatacaaaatacta

SEQ ID NO: 300423 - DNA, 75 bp, Artificial Sequence
  Synthetic
gatcacagccagcacatgataatttgatggggactatgtggattaatgccggatcagaaattcaggtagctgggt

SEQ ID NO: 300424 - DNA, 75 bp, Artificial Sequence
  Synthetic
ggattacctccaatacaaaatactagaaacgtggtttcagtatctatttcatctcgtaatataatacacaatcga

SEQ ID NO: 300425 - DNA, 75 bp, Artificial Sequence
  Synthetic
gaagtgccagttaaacacggtgaccatctattacgtgattctgagttagctggattactatcgatgtcatcagcc

SEQ ID NO: 300426 - DNA, 75 bp, Artificial Sequence
  Synthetic
gatggggactatgtggattaatgccggatcagaaattcaggtagctgggtttgattactcgtgtgctttcaatgc

SEQ ID NO: 300427 - DNA, 75 bp, Artificial Sequence
  Synthetic
ataagatttagatttgcaaatgcaattataaaatcaggtggactgggctataaatggtctgaaatttcatttaaa

SEQ ID NO: 300428 - DNA, 75 bp, Artificial Sequence
  Synthetic
tgttgatagaccaattccactggggcgcagagatgttcctggacgaagaacaagaattatattcatattaccgta

SEQ ID NO: 300429 - DNA, 75 bp, Artificial Sequence
  Synthetic
aaataattaacacatatcaagcacgatttggaactatcatagccagaaattttgatactatccgtttatcgtttc

SEQ ID NO: 300430 - DNA, 75 bp, Artificial Sequence
  Synthetic
gtaaacgatttcagctttaatggaggttcattacctactgattttgtaatttcacgttatgaagttattaaagag

SEQ ID NO: 300431 - DNA, 75 bp, Artificial Sequence
  Synthetic
gggacgattcacaagcatttagaaatatggtatatgttagatcattagcagctaatttaaatgatgtattatgta

SEQ ID NO: 300432 - DNA, 75 bp, Artificial Sequence
  Synthetic
gctacagtgttcgctcaaatagttaaattacgaaaagttgatactttaaaaccaatattatacaaaataaattca

SEQ ID NO: 300433 - DNA, 75 bp, Artificial Sequence
  Synthetic
ctaataatgaaatacggactgaccaacattgggtaaccaagacaaatatagaagattatttattaccaggatgga

SEQ ID NO: 300434 - DNA, 75 bp, Artificial Sequence
  Synthetic
atttactgactttgtttcattaaattcattaagatttagatttagtctttcagtagaagaaccatatttctcaat

SEQ ID NO: 300435 - DNA, 75 bp, Artificial Sequence
  Synthetic
acgctttatctcaagaaatagctatatcacaattaattgacttagcgttacttccgttagatatgttctcaatgt

SEQ ID NO: 300436 - DNA, 75 bp, Artificial Sequence
  Synthetic
tctcaggaattaaaagcaccattgatgcagcaaaatcaatggctactaatgtaatgaaaaaatttaaaaaatcaa

SEQ ID NO: 300437 - DNA, 75 bp, Artificial Sequence
  Synthetic
gatattcaaatgaaatagaaaactatattaataaagtgtatagtataacatatgctgacgatccaaactatttta

SEQ ID NO: 300438 - DNA, 75 bp, Artificial Sequence
  Synthetic
ttagatcagtaagttcttctgtatcggcatggactgatgtttcaaatcaattaacagatatttcaaattcagtaa

SEQ ID NO: 300439 - DNA, 75 bp, Artificial Sequence
  Synthetic
agtggcgtgttatcaacatattttaaactttataacgcattctataaagagcaaattacgttcgggcaatcgaga

SEQ ID NO: 300440 - DNA, 75 bp, Artificial Sequence
  Synthetic
ttcaaaatgtcatctcacaacagcaaaatcaaatagcagaccttcagcaatactgtaacaaattggaaacagact

SEQ ID NO: 300441 - DNA, 75 bp, Artificial Sequence
  Synthetic
tatcaaaatattcagtttataaaccatcaattgaagaattatataaggtaatatctctgcgagaacaggaaatac

SEQ ID NO: 300442 - DNA, 75 bp, Artificial Sequence
  Synthetic
gaaggagatcaatcagaaaaatatacgaacgctagatgaatgggagaatggaaaaaatccatatgaaccaagcga

SEQ ID NO: 300443 - DNA, 75 bp, Artificial Sequence
  Synthetic
gtaaaggtcactacagagttgtaaaatattcatcagttgcaaatcatgcagatagagtttatgctactttcaaga

SEQ ID NO: 300444 - DNA, 75 bp, Artificial Sequence
  Synthetic
gtgtatacaaaacaaacgttgttttttagataatgaaccacatcttctaaagttgaggacttttgaatcaccaat

SEQ ID NO: 300445 - DNA, 75 bp, Artificial Sequence
  Synthetic
aagtgcagaaatgaatttgataagttgtggtataatcaattgctacttccaatcactctaaacgctgcagtattc

SEQ ID NO: 300446 - DNA, 75 bp, Artificial Sequence
  Synthetic
gtaatccttttaaaggactgtcaactgatagaaagatggatgaagtctcacaagtaggaatttaattcgttatcg

SEQ ID NO: 300447 - DNA, 75 bp, Artificial Sequence
  Synthetic
acaaattgttgttggatcaggtaaattttgaaagaatgagttctcttccaagtaatttacaatccatttatgcga

SEQ ID NO: 300448 - DNA, 75 bp, Artificial Sequence
  Synthetic
ttttgaaagaatgagttctcttccaagtaatttacaatccatttatgcgaataagtattttaaattaagtagaat

SEQ ID NO: 300449 - DNA, 75 bp, Artificial Sequence
  Synthetic
tgaagtttcacatattggaatttaattcgcttcgattcaagaatgagatacgaagcaagaatagaaagcgcttat

SEQ ID NO: 300450 - DNA, 75 bp, Artificial Sequence
  Synthetic
ttatcaacatcatcattaaaacaattcgaaacgcatgatttaaatttaggaagagtaaaagctgacgttttcgaa

SEQ ID NO: 300451 - DNA, 75 bp, Artificial Sequence
  Synthetic
acatttcatcaaatcattggcagccagcttcaacaatatctcagtgtaagtggtgtaacgtaaaatatgcattta

SEQ ID NO: 300452 - DNA, 75 bp, Artificial Sequence
  Synthetic
accttaccggatggagattacgacgtcagagaatattttcttaatttatatgatcaagttcttactgagatgcca

SEQ ID NO: 300453 - DNA, 75 bp, Artificial Sequence
  Synthetic
cttctaaagttggctggttataaagaacaggttactactaaggatgaaattgagcaacagatggacagaattgtt

SEQ ID NO: 300454 - DNA, 75 bp, Artificial Sequence
  Synthetic
tgattgacaaattgacaactcgtgaaattgaacaggttgaattacttaaacgtatacatgataagttagctgcaa

SEQ ID NO: 300455 - DNA, 75 bp, Artificial Sequence
  Synthetic
attatatacacatattaagatgatattaaaaaccgaaagacttccgtttacatttacgctagatcagttcaattc

SEQ ID NO: 300456 - DNA, 75 bp, Artificial Sequence
  Synthetic
ttgaaccaaagcaattaccaatctatcgagcaaatggtgagaaagaattgagaaatagatggtattggaaattga

SEQ ID NO: 300457 - DNA, 75 bp, Artificial Sequence
  Synthetic
actaggacctagagagaatgtagctgtagtgcaaataggaggcgcgaacatactagatataacggctgatccaac

SEQ ID NO: 300458 - DNA, 75 bp, Artificial Sequence
  Synthetic
atggcgtacaggaagcgcggaactaaacgtgaagacttactacaacaaatgaacgtctgcaagaaaaaagaaatt

SEQ ID NO: 300459 - DNA, 75 bp, Artificial Sequence
  Synthetic
ttgaaagacgaagacttgatatatttaatttgatattaatgaatatggagcagatcgaacgagcttcagataaaa

SEQ ID NO: 300460 - DNA, 75 bp, Artificial Sequence
  Synthetic
aatccaaaaatgaccataaaagtaggaaacactaccctaaaatagaagcagaatctgattcagatgattatgtac

SEQ ID NO: 300461 - DNA, 75 bp, Artificial Sequence
  Synthetic
gacgccgtatacgcaaactcaactattggagaatcttttctgacttccacgttatgcttatattatccaagtgaa

SEQ ID NO: 300462 - DNA, 75 bp, Artificial Sequence
  Synthetic
atggcttcgctcatttatagacaacttctcactaattcatattcagtagatttacatgatgaaatagagcaaatt

SEQ ID NO: 300463 - DNA, 75 bp, Artificial Sequence
  Synthetic
tctaaaaagattatacattttcgatgtagctagagttccagatgaccaactgtatagattgagagacagactacg

SEQ ID NO: 300464 - DNA, 75 bp, Artificial Sequence
  Synthetic
tagattcaaaagaataaattttgataattcgtcggaatatatagaaaactggaatttgcaaaatagaagacagag

SEQ ID NO: 300465 - DNA, 75 bp, Artificial Sequence
  Synthetic
tggctagcggttagctccttttaatgtatggtattgaatataccacaattctaacttttttgatatcaattattc

SEQ ID NO: 300466 - DNA, 75 bp, Artificial Sequence
  Synthetic
gtatggtattgaatataccacaattctaacttttttgatatcaattattctattaaattatatattaaaatcaat

SEQ ID NO: 300467 - DNA, 75 bp, Artificial Sequence
  Synthetic
atccgtcaggcaagagtacgcaataccagttggaccagtatttccaccaggtatgaactggactgatttgatcac

SEQ ID NO: 300468 - DNA, 75 bp, Artificial Sequence
  Synthetic
cttccattagaagcatgcttatcaaatgaagaccaagctaacaccttggtatccgactttggtaagtatgtaact

SEQ ID NO: 300469 - DNA, 75 bp, Artificial Sequence
  Synthetic
ccatttggagaacgatagctataaattcattccatttaatagtttagctataaaatgtatgttgacagcaaaagt

SEQ ID NO: 300470 - DNA, 75 bp, Artificial Sequence
  Synthetic
tgatcaggctctgaatggtaaatttagttcatctattagaaacagaaattggatgactgattccaaaactgtagc

SEQ ID NO: 300471 - DNA, 75 bp, Artificial Sequence
  Synthetic
atacctggaaaatcatcatctgtcattagatgtactagattgatgaaagagaagatagaacgcggagaagttgaa

SEQ ID NO: 300472 - DNA, 75 bp, Artificial Sequence
  Synthetic
aaatggaagttgacactatagattggaaatctagatatgaacaacttgagaaacgatttgagtcattgaaacagc

SEQ ID NO: 300473 - DNA, 75 bp, Artificial Sequence
  Synthetic
agctttagcaacaaacggacggttagaatagaaaatacaagactcataatcaactcaatttatttaagaaaaatt

SEQ ID NO: 300474 - DNA, 75 bp, Artificial Sequence
  Synthetic
aacacttggtattggatgtctaataactaatccagacacatttgaaacagttgcgacaacggagaagttagtgat

SEQ ID NO: 300475 - DNA, 75 bp, Artificial Sequence
  Synthetic
tcatctatcgcaaggagcacatcaatacgatcaataggatcgacggcatcagcttgggctaatatttcagaacag

SEQ ID NO: 300476 - DNA, 75 bp, Artificial Sequence
  Synthetic
aatgtatggtattgaatataccacaattctaacttttttgacagatattgtgctattgaattatccaccaaaatc

SEQ ID NO: 300477 - DNA, 75 bp, Artificial Sequence
  Synthetic
gtcatacaggtaggcggcgcgaacattttagacatcacagctgacccaacgactgcgccacagatagagagaatg

SEQ ID NO: 300478 - DNA, 75 bp, Artificial Sequence
  Synthetic
aaagatgagtatgaaaatgcatttctcatttctaatctaactacacataatatactatatttaaattatagtatt

SEQ ID NO: 300479 - DNA, 75 bp, Artificial Sequence
  Synthetic
atttaatatctgattatgatagaatgttcattatgtttaaaggattgttgcagcaaagtaattacatttatactt

SEQ ID NO: 300480 - DNA, 75 bp, Artificial Sequence
  Synthetic
aaccccaaagttttgcgtggatttattgaccaaaataatccaattataaaaaacaggatagaacaattgatcatg

SEQ ID NO: 300481 - DNA, 75 bp, Artificial Sequence
  Synthetic
caaaaactcttaaagatgctagggacaaaattgttgaaggtacactatattctaatgttagcgatctcattcaac

SEQ ID NO: 300482 - DNA, 75 bp, Artificial Sequence
  Synthetic
acgcatttacgtcttcaatgaaacaaggtaatactcttgatgtatgcaaaaaactactcttccaaaaaatgaagc

SEQ ID NO: 300483 - DNA, 75 bp, Artificial Sequence
  Synthetic
aattagtatcatctccaatgtcaattttagttgctttagtggatattaatggaacgtttattacgaatgaagagt

SEQ ID NO: 300484 - DNA, 75 bp, Artificial Sequence
  Synthetic
caaatgacgttgctgatgcaaacaaaatttacaaacgtagattggatctatttaccatagtggcatctacaataa

SEQ ID NO: 300485 - DNA, 75 bp, Artificial Sequence
  Synthetic
accaaaaggtgtattttatgcttttataaataatataaccacagagaatgtgtttatacaaccttcttttaaatt

SEQ ID NO: 300486 - DNA, 75 bp, Artificial Sequence
  Synthetic
attagagggtaccaataaaactgatgtttgggtcgctttattacttgttgaaccaaacgtaaccaatcaaagtag

SEQ ID NO: 300487 - DNA, 75 bp, Artificial Sequence
  Synthetic
cgctagaagaatgggagagtggaaaaaatccctatgaaccaaaggaagtgactgcagcaatgtgagaggttgagc

SEQ ID NO: 300488 - DNA, 75 bp, Artificial Sequence
  Synthetic
tggattcgactattcgtgtgcaattaatgcgccagctaacacacaacaatttgagcatattgtacagctccgaag

SEQ ID NO: 300489 - DNA, 75 bp, Artificial Sequence
  Synthetic
atgaatgtacgtacgaatagtcacataatatagactatattaaccatctacacatgaccctctatgagcacaata

SEQ ID NO: 300490 - DNA, 75 bp, Artificial Sequence
  Synthetic
cagatttgctgtaataacacatggtaaaggtcactatagagttgttaaatattcatcagtcgctaatcatgcaga

SEQ ID NO: 300491 - DNA, 75 bp, Artificial Sequence
  Synthetic
ttacatgattattcatactatactaacaatgaaataaggacggatcagcattgggtgactaaaactgatataatt

SEQ ID NO: 300492 - DNA, 75 bp, Artificial Sequence
  Synthetic
aagatatgaagtgattaaagagaattcttatgtttatgttgattattgggatgactcacaagcatttaggaacat

SEQ ID NO: 300493 - DNA, 75 bp, Artificial Sequence
  Synthetic
gaagttgcaacagctgaaaaactagtgattactgacgttgtagatggggtcaatcataaattgaacgtgacgaca

SEQ ID NO: 300494 - DNA, 75 bp, Artificial Sequence
  Synthetic
ttgaagcaggagagatggctaggcaagagagtatcacaattcgatattgggcaatataaaaacatgttaaacgtg

SEQ ID NO: 300495 - DNA, 75 bp, Artificial Sequence
  Synthetic
aaattatggaataaatcttccgattactggatcaatggatacaccatatgcaaactcaacgcaagaaggggtatt

SEQ ID NO: 300496 - DNA, 75 bp, Artificial Sequence
  Synthetic
aaccaaatgataattactatgaatggaaatgagtttcaaactggaggaattggtaatttaccaattagaaattgg

SEQ ID NO: 300497 - DNA, 75 bp, Artificial Sequence
  Synthetic
gaccggtatttccaccaggcatgaattggactgaattgattactaactattcgccatctagagaagataacttac

SEQ ID NO: 300498 - DNA, 75 bp, Artificial Sequence
  Synthetic
ttcgctcatttctttagttccaactaatgatgattatcaaactccaattatgaattcagtaacagtaagacaaga

SEQ ID NO: 300499 - DNA, 75 bp, Artificial Sequence
  Synthetic
cgcatgtcgatcagccagagaatttgctgcgttacaagatgatctgacagtgttaagatacgctaatgaaattga

SEQ ID NO: 300500 - DNA, 75 bp, Artificial Sequence
  Synthetic
acattaaaaatattaaataaatcaggtatagcagcagttgaagtacaatctccagatgaattatttgcgttaata

SEQ ID NO: 300501 - DNA, 75 bp, Artificial Sequence
  Synthetic
actttaggaattggatgtacaacaaccgacgtcacaacatttgaagaggtagcaaacgcggaaaaattagtaata

SEQ ID NO: 300502 - DNA, 75 bp, Artificial Sequence
  Synthetic
tttagaggtctgtcaactgataggaaaatggatgaagtctctcaagtaggtgtttaattcgctttcaattcgaag

SEQ ID NO: 300503 - DNA, 75 bp, Artificial Sequence
  Synthetic
aaactgttagcaatctaaatattgcatataaatatctatcaacaggaaaagcaaaggtgtgttgtgttaaattaa

SEQ ID NO: 300504 - DNA, 75 bp, Artificial Sequence
  Synthetic
aaattcaattgacgcaatcaatcctatcaacgctatagacgattttgaatcattgattagaaatttgatccaaga

SEQ ID NO: 300505 - DNA, 75 bp, Artificial Sequence
  Synthetic
ttatgacaaaacatttttaatgttgaaaggacttgcgaggcaatgcaactatgaatgtacgtacgaatagtcaca

SEQ ID NO: 300506 - DNA, 75 bp, Artificial Sequence
  Synthetic
ctgatgaggttaagaaatcatcaaaagaggaatctaaacagctactagaaatattgaaaactaaagaaaatcatc

SEQ ID NO: 300507 - DNA, 75 bp, Artificial Sequence
  Synthetic
ggcttttaatgcttttcagtggttgatgctcaagatggagtctactcagcagatggccagttctattattaacac

SEQ ID NO: 300508 - DNA, 75 bp, Artificial Sequence
  Synthetic
tagatatgtctgaattggccgatcttatactgaacgaatggctgtgcaatccaatggacataacgctgtattatt

SEQ ID NO: 300509 - DNA, 75 bp, Artificial Sequence
  Synthetic
aagctgatagaaatgttgttaactatccatcaattttacacccaatcgatcatgcatttaatgaatactttttaa

SEQ ID NO: 300510 - DNA, 75 bp, Artificial Sequence
  Synthetic
ggtcccaagagtctaagtgtaatgaatatattaataatggtttaccaccaattcaaaatactagaaatgtagtac

SEQ ID NO: 300511 - DNA, 75 bp, Artificial Sequence
  Synthetic
atttggaatgcaaaggatgcattatagaaatggtgatccacagactccatttcaaatagcagaacaacagataca

SEQ ID NO: 300512 - DNA, 75 bp, Artificial Sequence
  Synthetic
cacatgccagaatgctgcaaccgatgatgacttaataatagaatacatttattccgaagcattggactttcagaa

SEQ ID NO: 300513 - DNA, 75 bp, Artificial Sequence
  Synthetic
acaagaacatgatgaacgtcataacaactgtatattattattataacttatatcagaaaaaacctattatatata

SEQ ID NO: 300514 - DNA, 75 bp, Artificial Sequence
  Synthetic
ttagcatgtagctacatcaagtcattcagactcttcttgaaaggatttgatttcatgttcgctacgaagagtaac

SEQ ID NO: 300515 - DNA, 75 bp, Artificial Sequence
  Synthetic
tgttgaattatatattaaaatcaataacaagaataatggactatataatctacagatttctattcatggtagtaa

SEQ ID NO: 300516 - DNA, 75 bp, Artificial Sequence
  Synthetic
aacaagaataatggactatataatctacagatttctattcatggtagtaatactggccataatagtaaatgcaca

SEQ ID NO: 300517 - DNA, 75 bp, Artificial Sequence
  Synthetic
attcaatattgtatattgatatcaggactgatcgtggaaacacggattggaaagaatggaggaaaatagttgagg

SEQ ID NO: 300518 - DNA, 75 bp, Artificial Sequence
  Synthetic
aaattatggggttaatttgccaataacaggatcgatggatactacgtatgcaaattcaacgcagagtgaatcatt

SEQ ID NO: 300519 - DNA, 75 bp, Artificial Sequence
  Synthetic
acaggatcgatggatactacgtatgcaaattcaacgcagagtgaatcattcttaacgtcaactttatgcctgtac

SEQ ID NO: 300520 - DNA, 75 bp, Artificial Sequence
  Synthetic
aaagaatggaggaaaatagttgaggcgcaaactattagtaaccttaaacttgcataccgatacttatctggtggt

SEQ ID NO: 300521 - DNA, 75 bp, Artificial Sequence
  Synthetic
aagtcgaaggtatgttgtgttaaaatgactgctatggatttagagcttcccatatctgcaaagttattgcatcat

SEQ ID NO: 300522 - DNA, 75 bp, Artificial Sequence
  Synthetic
catttgttgatgagaaaatggaaattgatactattgattggaaatctagatatgaccaattggaaaaaagatttg

SEQ ID NO: 300523 - DNA, 75 bp, Artificial Sequence
  Synthetic
tttatcttcttctggacatctgggacattagtaatgtcaaaagatttattccaaagggagtattatattcattca

SEQ ID NO: 300524 - DNA, 75 bp, Artificial Sequence
  Synthetic
ttaaggaatatactgacatagcagctttttcagtcgatcctcagttgtattgtgattacaacctggtactaatga

SEQ ID NO: 300525 - DNA, 75 bp, Artificial Sequence
  Synthetic
tcactcattgctaagttggatgctacagtctttgctcagatagttaaacttaggaaagtagatactttaaaaccg

SEQ ID NO: 300526 - DNA, 75 bp, Artificial Sequence
  Synthetic
actgatccgaatacatttgaaacagttgcgacaactgaaaagttggtaatcactgatgttgtagatggcgttaat

SEQ ID NO: 300527 - DNA, 75 bp, Artificial Sequence
  Synthetic
gcattatagaaatggagatccacagacaccatttcagatagcagaacagcagatacaaaattttcaggtagcgaa

SEQ ID NO: 300528 - DNA, 75 bp, Artificial Sequence
  Synthetic
cttttgtttctgcagacacagttgaaccgatcaacgcagttgcttttgacaatatgcgcattatgaacgaactgt

SEQ ID NO: 300529 - DNA, 75 bp, Artificial Sequence
  Synthetic
tgcgattacaatatagttctaatgaagtataatgctaattcagaattagatatgtcagagttagctgacttgata

SEQ ID NO: 300530 - DNA, 75 bp, Artificial Sequence
  Synthetic
atgcgagtgaactggaaaaaatggtggcaggtattttatacggttgtagattacgttaaccagataattcaagcg

SEQ ID NO: 300531 - DNA, 75 bp, Artificial Sequence
  Synthetic
ggcaggtattttatacggttgtagattacgttaaccagataattcaagcgatgtccaagagatctagatcactaa

SEQ ID NO: 300532 - DNA, 75 bp, Artificial Sequence
  Synthetic
agttttagtaataataaaacagtaagaatagaaagtactaggttaaagattagctcaatatatttaagaaagatt

SEQ ID NO: 300533 - DNA, 75 bp, Artificial Sequence
  Synthetic
caagtcatgtccaaacgatcaagatcattagacgcagctgctttttattatagaatttagatatagatttggtca

SEQ ID NO: 300534 - DNA, 75 bp, Artificial Sequence
  Synthetic
tttattccatttaataatttagctataaaatgtatgttgacagcaaaagtggataaaaaagatcaagataaattt

SEQ ID NO: 300535 - DNA, 75 bp, Artificial Sequence
  Synthetic
aatattcaattgtctagaaccagtagaacttaatgctattaactatgttttatttaatcatgaggtaaattggga

SEQ ID NO: 300536 - DNA, 75 bp, Artificial Sequence
  Synthetic
agagactatcgcaatttgacattggtcagtataaaaatatgttaaatgtgttaacaactttatatcaatactatg

SEQ ID NO: 300537 - DNA, 75 bp, Artificial Sequence
  Synthetic
gtgtaccaaggcataatgcaaaatatagatatgaatatgatgtgatgaaagataaaccatattacttagtaacat

SEQ ID NO: 300538 - DNA, 75 bp, Artificial Sequence
  Synthetic
acattattatcaatattatcgtactcctatgacaagtacaacgccgttgaacggaaattagttaaatatgcaaaa

SEQ ID NO: 300539 - DNA, 75 bp, Artificial Sequence
  Synthetic
aagcttaccgacctcaattatacattgagtgtaatcactctaatgaacagcacattgcatacaatacttgaagat

SEQ ID NO: 300540 - DNA, 75 bp, Artificial Sequence
  Synthetic
gttaaagagatgaggcgtcagttggaaatgattgataagttgactacacgtgaaattgagcaagttgaactactt

SEQ ID NO: 300541 - DNA, 75 bp, Artificial Sequence
  Synthetic
tattacgaatgaggagttagaattagaattttcaaataaatatgtacgagccatagtgcccgatcaaacatttga

SEQ ID NO: 300542 - DNA, 75 bp, Artificial Sequence
  Synthetic
ctgatttcagtatttcgagatatgaagttattaaagaaaattcttatgtgtatatagactactgggatgattcaa

SEQ ID NO: 300543 - DNA, 75 bp, Artificial Sequence
  Synthetic
aacatagattttatatatttgaggaaaataaaaggtgatacagtgttcgatatgactgagtgagctaaaaactta

SEQ ID NO: 300544 - DNA, 75 bp, Artificial Sequence
  Synthetic
tgactacagctacaataactcttttaccagatgcagaaagatttagttttccaagagtaattaattcagctgatg

SEQ ID NO: 300545 - DNA, 75 bp, Artificial Sequence
  Synthetic
tactagagaatatgctgaattttattcacaatcaaaccagctcttatcatatggtgatgtcacacgtttcctttc

SEQ ID NO: 300546 - DNA, 75 bp, Artificial Sequence
  Synthetic
catttgttgatgaaaagatggaaattgatactattgattggaaatctagatatgatcaattagagaaaagattcg

SEQ ID NO: 300547 - DNA, 75 bp, Artificial Sequence
  Synthetic
caaactgaaggaatgagttttgatgatatttcagcagctgtactgaaaacgaaaatagatatgtccacacaaatt

SEQ ID NO: 300548 - DNA, 75 bp, Artificial Sequence
  Synthetic
gatatacttagagatataaagccattttttacgataagcgaagcacatttgccgatacaatatcagaaatttatg

SEQ ID NO: 300549 - DNA, 75 bp, Artificial Sequence
  Synthetic
caaatctagcattaattaagactgtcttatcacgtatctctaacaaatactcattcatcacaaaaataataagag

SEQ ID NO: 300550 - DNA, 75 bp, Artificial Sequence
  Synthetic
atggcgtacaggaaacgtggagcgcgccgtgaggcaaacttaaataataatgatcgaatgcaggagaaaaatgat

SEQ ID NO: 300551 - DNA, 75 bp, Artificial Sequence
  Synthetic
ctctacagatataactgatacagtcgcaaacattgctgctgagaagagtgaaaacgtgactattaatccaggtcc

SEQ ID NO: 300552 - DNA, 75 bp, Artificial Sequence
  Synthetic
gagttcaacccaccaatcgacttttggttgttaatagatgcaaagtctgaaggtgttgttactgagggcacagat

SEQ ID NO: 300553 - DNA, 75 bp, Artificial Sequence
  Synthetic
ctaatgattcatcgactcattggaaatttcagagtctgactaaagcctcattggatggaagtctaagtttaagta

SEQ ID NO: 300554 - DNA, 75 bp, Artificial Sequence
  Synthetic
taatacgcaagcttatgaccaagttacattcaaattatattatgacttttacattataccacgttcgaatgaaag

SEQ ID NO: 300555 - DNA, 75 bp, Artificial Sequence
  Synthetic
cctaatgaagatatagttatatcaaaaacatctttgtggaaagaagtacaatataatagagatataactattaga

SEQ ID NO: 300556 - DNA, 75 bp, Artificial Sequence
  Synthetic
atggcgaaatagtgaccgcacatactacatgttcagtgaacggggtgaatgattttagttatataggaggttcat

SEQ ID NO: 300557 - DNA, 75 bp, Artificial Sequence
  Synthetic
gtatgtaagatcattatcagctgaatttaaccaagttatgtgtactggtggagattacagctttcaacttccagt

SEQ ID NO: 300558 - DNA, 75 bp, Artificial Sequence
  Synthetic
tttagcaataaaatgcatgttgacagcaaaagtagacaaaaaagatcaagataaattttataattcaattgttta

SEQ ID NO: 300559 - DNA, 75 bp, Artificial Sequence
  Synthetic
agattcagatttaagccatctatagaagaaccatcatttggtataactcgaacaagggagcaaaaactttacggg

SEQ ID NO: 300560 - DNA, 75 bp, Artificial Sequence
  Synthetic
tccaaccatgccagttgattataagagatcaattcaacgtggaatattactgttatctaacagacttggtcagtt

SEQ ID NO: 300561 - DNA, 75 bp, Artificial Sequence
  Synthetic
caatacagaattcaacaaccgttaggactgatcttgaaaggcaattgagcgatttgcgtgaagaatttaatgcat

SEQ ID NO: 300562 - DNA, 75 bp, Artificial Sequence
  Synthetic
caaaaatatggcaactaacataatgaagaagttcaaagtatcaaacattgctaaagctgttacaaatgtcacaga

SEQ ID NO: 300563 - DNA, 75 bp, Artificial Sequence
  Synthetic
cattattataacgttaatgttaattttcattcaaattataatgagagaattaatgatgcagtagctataataact

SEQ ID NO: 300564 - DNA, 75 bp, Artificial Sequence
  Synthetic
gtggcaactactatgtcacagaaatttagagtgagagaaatgactacacaaacggacaacttaacgtttgacgac

SEQ ID NO: 300565 - DNA, 75 bp, Artificial Sequence
  Synthetic
caaatagaacttacagaattctagatcaagatattgcatttgaagtagatacaagcggtcgtttctttgcgtatc

SEQ ID NO: 300566 - DNA, 75 bp, Artificial Sequence
  Synthetic
cggatatgtaaatatagctagaaatttagacggattccaacagataaatttagaggagctgatgagatcaggtga

SEQ ID NO: 300567 - DNA, 75 bp, Artificial Sequence
  Synthetic
aaaaaatctaaatgataactttggcattacaaaacaacaagcttttaacttactaagatcagatccaagagtact

SEQ ID NO: 300568 - DNA, 75 bp, Artificial Sequence
  Synthetic
tagatttatcagatgaaataactaatataggtgcagaaaagaaagagaatgtgactgtgcagattggtgaattcg

SEQ ID NO: 300569 - DNA, 75 bp, Artificial Sequence
  Synthetic
ttggagcacttccatttattactgattcatcagtcatatcactaatagcaaaactcgacgctacagtgttcgctc

SEQ ID NO: 300570 - DNA, 75 bp, Artificial Sequence
  Synthetic
taaagatttcattaatcaaaataatccaataatacgtaatagaattaatcaattactactgcaatgtaagttata

SEQ ID NO: 300571 - DNA, 75 bp, Artificial Sequence
  Synthetic
aactggaaatgattgacaaattaacaactcgtgaaattgaacaggtcgaattacttaaacgtatacatgataaat

SEQ ID NO: 300572 - DNA, 75 bp, Artificial Sequence
  Synthetic
tcagatcttctcgcattcgtgtcagctgatacagtagaacccataaatgcggttgcatttgacaacatgcgcatc

SEQ ID NO: 300573 - DNA, 75 bp, Artificial Sequence
  Synthetic
ttcgaatctcacttttacagtttattcagatcttctcgcattcgtgtcagctgatacagtagaacccataaatgc

SEQ ID NO: 300574 - DNA, 75 bp, Artificial Sequence
  Synthetic
atgcagacgctggcgtgtctatggattcatcaacgcaatcacgaccttcaagcaacgttgggtgcgatcaagtgg

SEQ ID NO: 300575 - DNA, 75 bp, Artificial Sequence
  Synthetic
taaggtggcagcattaatttgtgaagcattaaattcaaccaaagttactcaatctgatattgctagtgtgctctc

SEQ ID NO: 300576 - DNA, 75 bp, Artificial Sequence
  Synthetic
gaagcagaccaaattatttagaatatttgaaccaagacagctacctatttatagggcgaatggtgaaaaagaatt

SEQ ID NO: 300577 - DNA, 75 bp, Artificial Sequence
  Synthetic
ctaatagctattggtcattcgaaagaaattgaaacgaccgctactgctgagggaggggaaattgttttccaaaat

SEQ ID NO: 300578 - DNA, 75 bp, Artificial Sequence
  Synthetic
gctcatgataatttgatgggaactatgtggattaacgctggatcagaaattcaagtagctggaattgattattca

SEQ ID NO: 300579 - DNA, 75 bp, Artificial Sequence
  Synthetic
cagtacaataaatttgcggtgattactcatggtaaaggtcactacagagttgtaaagtattcatcagttgcaaat

SEQ ID NO: 300580 - DNA, 75 bp, Artificial Sequence
  Synthetic
taattcagctgacggtactaccacatggtactttaatccagttgttctaagaccaagtaatgtagaggttgaatt

SEQ ID NO: 300581 - DNA, 75 bp, Artificial Sequence
  Synthetic
tcttccatcattttctcagttttcgaataatgaatcatcaagtgatgtatcaaataactcaagtaaatctgttag

SEQ ID NO: 300582 - DNA, 75 bp, Artificial Sequence
  Synthetic
gatttgccaactaaattcgccattaaagctaatgcagttaagtcaaacgcaaacgtaggagtatctcttgacact

SEQ ID NO: 300583 - DNA, 75 bp, Artificial Sequence
  Synthetic
ggaaatactaccacaaataataactgaggcgtcggagaagttcataccgaatcgtgcatatagattaatagatgg

SEQ ID NO: 300584 - DNA, 75 bp, Artificial Sequence
  Synthetic
acacttcttttgaagccgcagttgttgctgccacttcaacattagaattgatgggtattcaatatgattataatg

SEQ ID NO: 300585 - DNA, 75 bp, Artificial Sequence
  Synthetic
cgattgatacgcataagccgaaatcttcattatcagactcagccgtgcaatttaatagaaaggctaaacaaggaa

SEQ ID NO: 300586 - DNA, 75 bp, Artificial Sequence
  Synthetic
ctataagaagaagtattttgaattacggaagcgcatgaaacaagttgcaatccagttaattgaagatatgtaagt

SEQ ID NO: 300587 - DNA, 75 bp, Artificial Sequence
  Synthetic
actggaaggaatggcgaaaagtggtggaaaggcaaactgctgacaatttacatattgcatacaaatatctatcta

SEQ ID NO: 300588 - DNA, 75 bp, Artificial Sequence
  Synthetic
gaggttaaaattgctgatgaagtgaaaaaatcgacaaaagaggaatctaagcagttacttgaagtgttgaaaacg

SEQ ID NO: 300589 - DNA, 75 bp, Artificial Sequence
  Synthetic
tgctggcaaagttgtcgattctgaaacggcaagtatttgtgatgccatatttcaagatgaagaaacagaaggtgc

SEQ ID NO: 300590 - DNA, 75 bp, Artificial Sequence
  Synthetic
tagtgtcatcagttgaatggtatctaagatctatggaattgtcagatgatgtgaaaactgacattgaacaacaat

SEQ ID NO: 300591 - DNA, 75 bp, Artificial Sequence
  Synthetic
taatattaggaatgggcatgttattaatcaattaatggaggccttaatgcagctatcacgacaacagtttccaac

SEQ ID NO: 300592 - DNA, 75 bp, Artificial Sequence
  Synthetic
actacaaaactgcacatagattctatttacttaagaaaaataaaaggtgacacggtgtttgatatgactgggtga

SEQ ID NO: 300593 - DNA, 75 bp, Artificial Sequence
  Synthetic
acgagaatatttcttaaatttatatgatcaaatattggtagaaatgccagattatttattattaaaagatatggc

SEQ ID NO: 300594 - DNA, 75 bp, Artificial Sequence
  Synthetic
ataacaacatcaaactatatattagctagatcagttgtgcctgatctgaaggaaaaagaattagtctcaaccgaa

SEQ ID NO: 300595 - DNA, 75 bp, Artificial Sequence
  Synthetic
gcacaagatgatattaaaatagctggtgagattaaaaaatcatcaaaagaagaatcaaaacagttgctcgaaata

SEQ ID NO: 300596 - DNA, 75 bp, Artificial Sequence
  Synthetic
ctaaaataatgcaaatgacgtcagttgctattaccggatcgctaagactctttccttctgaacgcgtgttaacca

SEQ ID NO: 300597 - DNA, 75 bp, Artificial Sequence
  Synthetic
gacttcgaatcttactttcacagtttattcagatttacttgcattcgtgtcagctgatacagtagaaccaataaa

SEQ ID NO: 300598 - DNA, 75 bp, Artificial Sequence
  Synthetic
gccgatacaatatcaaaaatttatgccaactttaccagacaatgtgcagtatataattcagtgtataggatccag

SEQ ID NO: 300599 - DNA, 75 bp, Artificial Sequence
  Synthetic
atttcactacacgagaatgaaatacaactatatttgatctcactaggcataccgaaaatagacgctgatacgtac

SEQ ID NO: 300600 - DNA, 75 bp, Artificial Sequence
  Synthetic
ctgctttagaccaattaaaaactgagtacacagaaaatgtagatgatgaaatgtatcgtgaatatactatgttga

SEQ ID NO: 300601 - DNA, 75 bp, Artificial Sequence
  Synthetic
ttacatgattattcatattatactaataatgaaataagaacagatcagcattgggtaactaaaactgatataatt

SEQ ID NO: 300602 - DNA, 75 bp, Artificial Sequence
  Synthetic
atcagaaaaacatcaaaacgctagatgaatgggagagtggaaaaaatccatatgaaccgtcagaagtgactgcat

SEQ ID NO: 300603 - DNA, 75 bp, Artificial Sequence
  Synthetic
ttcatctcaacataatacgcaaccatttaggaaaggaataataatggggttagacatattagctaacatgactaa

SEQ ID NO: 300604 - DNA, 75 bp, Artificial Sequence
  Synthetic
agttggatgctacagtttttgctcagatagttaaacttaggaaagtagatactttaaaaccaatattgtataaaa

SEQ ID NO: 300605 - DNA, 75 bp, Artificial Sequence
  Synthetic
tatgctgtattacagtttaacacggaagtgaccaaacaaatggttcaagatgtatcaaatgacgtgagagaaact

SEQ ID NO: 300606 - DNA, 75 bp, Artificial Sequence
  Synthetic
ctgaaggaggggaaatcgttttccaaaatgcagcttttacgatgtggaaactgacatacttggagcatcagctaa

SEQ ID NO: 300607 - DNA, 75 bp, Artificial Sequence
  Synthetic
ttcaaaatcagcaatctcccggcttatatcaaagtattcagtttataaaccatcaattgaggaactgtataaagt

SEQ ID NO: 300608 - DNA, 75 bp, Artificial Sequence
  Synthetic
taccaaaaatagatgctgatacatacgtcgggtcaaagatttattctcaagataaatataggatactggaatcat

SEQ ID NO: 300609 - DNA, 75 bp, Artificial Sequence
  Synthetic
atgaaagcagaactatttaaaatggaaattaatactagttacacttatatgctatctgataatatatatgtagca

SEQ ID NO: 300610 - DNA, 75 bp, Artificial Sequence
  Synthetic
acttttgaaatacatactcagatcaattgcaagagctatggactttgtcatctatagatttctattgattgtatt

SEQ ID NO: 300611 - DNA, 75 bp, Artificial Sequence
  Synthetic
tttctaacttcaacattgtgcctttattatccaacagaagccgcaactgaaattaatgataattcatggaaagat

SEQ ID NO: 300612 - DNA, 75 bp, Artificial Sequence
  Synthetic
gatcagtacgcaaatcatatgggtatttctagaagatcgcatcagattagattctcagagtctgctacatcgtac

SEQ ID NO: 300613 - DNA, 75 bp, Artificial Sequence
  Synthetic
attgcgattataatattgtattgatgaaatatgatgctaatttgcaattagatatgtcagagttagcagacctaa

SEQ ID NO: 300614 - DNA, 75 bp, Artificial Sequence
  Synthetic
ccggttacttttaaatcaagtaaaataacaataaatgacatactcagagacataaaaccatttttttcggtaagt

SEQ ID NO: 300615 - DNA, 75 bp, Artificial Sequence
  Synthetic
tattaaagtatgtccgctgaatactcaaacgttaggaattggatgtctgacaaatgacactaccacctttgaaga

SEQ ID NO: 300616 - DNA, 75 bp, Artificial Sequence
  Synthetic
aaactagggccaagagaaaatgtagcagttatacagattggtggttctgatatattggatataactgctgatcct

SEQ ID NO: 300617 - DNA, 75 bp, Artificial Sequence
  Synthetic
gtggcaagtgttttatactgtcgtagattatgtgaatcaaattattcaggcaatgtcaaaaagatctagatcact

SEQ ID NO: 300618 - DNA, 75 bp, Artificial Sequence
  Synthetic
agtaaacgcaaatttagattcatctatttcagtatcaacaatgtctaaaaaggagaaatccaaatcagatcataa

SEQ ID NO: 300619 - DNA, 75 bp, Artificial Sequence
  Synthetic
gtatactagagtgaagagtaaatttgactttgttatggatgattctggcgtaaaaaataacttaatgggtaaagc

SEQ ID NO: 300620 - DNA, 75 bp, Artificial Sequence
  Synthetic
atcaacaaactgacgaagctaacaaatggatatccatgggttcttcatgcacaattaaagtgtgtcctctaaaca

SEQ ID NO: 300621 - DNA, 75 bp, Artificial Sequence
  Synthetic
tttgacaagtatgtagctacgttaagctgtttgaactctacaagtaaggatacgtttacgtattcgctacgtaga

SEQ ID NO: 300622 - DNA, 75 bp, Artificial Sequence
  Synthetic
tggtacgcattcacatcttcaatgaaacaaggtaatacacttgacgtatgtaagaaactgctctttcaaaagatg

SEQ ID NO: 300623 - DNA, 75 bp, Artificial Sequence
  Synthetic
atggtgaaaaagaactacgtaatagatggtattggaaactaaagaaagacaccttaccggatggagattacgacg

SEQ ID NO: 300624 - DNA, 75 bp, Artificial Sequence
  Synthetic
tttatcatttgtttataattcacaatctgcagttcaaataccaatttattattcttccaattctgaattagagaa

SEQ ID NO: 300625 - DNA, 75 bp, Artificial Sequence
  Synthetic
aggtatagctgcagtcgaaatacaatctccagatgaattgtttgcattaataagatgtaattttacatatgatta

SEQ ID NO: 300626 - DNA, 75 bp, Artificial Sequence
  Synthetic
acaattttgaatctttatgggacacaataacaacttcaaattatattttggcaagatcagtagtacctgatttaa

SEQ ID NO: 300627 - DNA, 75 bp, Artificial Sequence
  Synthetic
gaagatccagggatggcgtattttccctacatagcatctgtcctgacagttctattcacattacataaagcgtca

SEQ ID NO: 300628 - DNA, 75 bp, Artificial Sequence
  Synthetic
gtcccttgaagaactatttactttaattagatgtaattttacctacgactatgaaaacaacataatctatttgca

SEQ ID NO: 300629 - DNA, 75 bp, Artificial Sequence
  Synthetic
cttgctaccaggatggaaattaacgtacgtaggatataatggaagtgatactaggggacattacaacttttcttt

SEQ ID NO: 300630 - DNA, 75 bp, Artificial Sequence
  Synthetic
taccgagaatgattcaagaatggttagttgactgctcactagaaaaatttacattaatgtcaaaaatttattctt

SEQ ID NO: 300631 - DNA, 75 bp, Artificial Sequence
  Synthetic
aaaaagtatcaacatatagtgaatgttggaccaaggaatgaatcaatgtttactttcttgaattttccatctatc

SEQ ID NO: 300632 - DNA, 75 bp, Artificial Sequence
  Synthetic
gaaatagtcaagatgctggaaggaccagtcaaacacgatgaccatttactacgtgattcagagttagctggattg

SEQ ID NO: 300633 - DNA, 75 bp, Artificial Sequence
  Synthetic
aacatggaggttctgtaatcattgtcaaaaactcttaaagatgctagcgacaaaattgttgaaggtacaatttat

SEQ ID NO: 300634 - DNA, 75 bp, Artificial Sequence
  Synthetic
aacatggaggttctgtaatcattgtcaaaaactcttaaagatgctagcgacaaaattgttgaaggtacattttat

SEQ ID NO: 300635 - DNA, 75 bp, Artificial Sequence
  Synthetic
aacatggaggttctgtaatcattgtcaaaaactcttaaagatgctagcgacaaaattgttgaaggtacactttat

SEQ ID NO: 300636 - DNA, 75 bp, Artificial Sequence
  Synthetic
aacatggaggttctgtaatcattgtcaaaaactcttaaagatgctagcgacaaaattgttgaaggtacagtttat

SEQ ID NO: 300637 - DNA, 75 bp, Artificial Sequence
  Synthetic
aacatggaggttctgtaatcattgtcaaaaactcttaaagatgctagcgacaatattgttgaaggtacaatttat

SEQ ID NO: 300638 - DNA, 75 bp, Artificial Sequence
  Synthetic
aacatggaggttctgtaatcattgtcaaaaactcttaaagatgctagcgacaatattgttgaaggtacattttat

SEQ ID NO: 300639 - DNA, 75 bp, Artificial Sequence
  Synthetic
aacatggaggttctgtaatcattgtcaaaaactcttaaagatgctagcgacaatattgttgaaggtacactttat

SEQ ID NO: 300640 - DNA, 75 bp, Artificial Sequence
  Synthetic
aacatggaggttctgtaatcattgtcaaaaactcttaaagatgctagcgacaatattgttgaaggtacagtttat

SEQ ID NO: 300641 - DNA, 75 bp, Artificial Sequence
  Synthetic
aacatggaggttctgtaatcattgtcaaaaactcttaaagatgctagcgacaacattgttgaaggtacaatttat

SEQ ID NO: 300642 - DNA, 75 bp, Artificial Sequence
  Synthetic
aacatggaggttctgtaatcattgtcaaaaactcttaaagatgctagcgacaacattgttgaaggtacattttat

SEQ ID NO: 300643 - DNA, 75 bp, Artificial Sequence
  Synthetic
aacatggaggttctgtaatcattgtcaaaaactcttaaagatgctagcgacaacattgttgaaggtacactttat

SEQ ID NO: 300644 - DNA, 75 bp, Artificial Sequence
  Synthetic
aacatggaggttctgtaatcattgtcaaaaactcttaaagatgctagcgacaacattgttgaaggtacagtttat

SEQ ID NO: 300645 - DNA, 75 bp, Artificial Sequence
  Synthetic
aacatggaggttctgtaatcattgtcaaaaactcttaaagatgctagcgacaagattgttgaaggtacaatttat

SEQ ID NO: 300646 - DNA, 75 bp, Artificial Sequence
  Synthetic
aacatggaggttctgtaatcattgtcaaaaactcttaaagatgctagcgacaagattgttgaaggtacattttat

SEQ ID NO: 300647 - DNA, 75 bp, Artificial Sequence
  Synthetic
aacatggaggttctgtaatcattgtcaaaaactcttaaagatgctagcgacaagattgttgaaggtacactttat

SEQ ID NO: 300648 - DNA, 75 bp, Artificial Sequence
  Synthetic
aacatggaggttctgtaatcattgtcaaaaactcttaaagatgctagcgacaagattgttgaaggtacagtttat

SEQ ID NO: 300649 - DNA, 75 bp, Artificial Sequence
  Synthetic
aacatggaggttctgtattcattgtcaaaaactcttaaagatgctagcgacaaaattgttgaaggtacaatttat

SEQ ID NO: 300650 - DNA, 75 bp, Artificial Sequence
  Synthetic
aacatggaggttctgtattcattgtcaaaaactcttaaagatgctagcgacaaaattgttgaaggtacattttat

SEQ ID NO: 300651 - DNA, 75 bp, Artificial Sequence
  Synthetic
aacatggaggttctgtattcattgtcaaaaactcttaaagatgctagcgacaaaattgttgaaggtacactttat

SEQ ID NO: 300652 - DNA, 75 bp, Artificial Sequence
  Synthetic
aacatggaggttctgtattcattgtcaaaaactcttaaagatgctagcgacaaaattgttgaaggtacagtttat

SEQ ID NO: 300653 - DNA, 75 bp, Artificial Sequence
  Synthetic
aacatggaggttctgtattcattgtcaaaaactcttaaagatgctagcgacaatattgttgaaggtacaatttat

SEQ ID NO: 300654 - DNA, 75 bp, Artificial Sequence
  Synthetic
aacatggaggttctgtattcattgtcaaaaactcttaaagatgctagcgacaatattgttgaaggtacattttat

SEQ ID NO: 300655 - DNA, 75 bp, Artificial Sequence
  Synthetic
aacatggaggttctgtattcattgtcaaaaactcttaaagatgctagcgacaatattgttgaaggtacactttat

SEQ ID NO: 300656 - DNA, 75 bp, Artificial Sequence
  Synthetic
aacatggaggttctgtattcattgtcaaaaactcttaaagatgctagcgacaatattgttgaaggtacagtttat

SEQ ID NO: 300657 - DNA, 75 bp, Artificial Sequence
  Synthetic
aacatggaggttctgtattcattgtcaaaaactcttaaagatgctagcgacaacattgttgaaggtacaatttat

SEQ ID NO: 300658 - DNA, 75 bp, Artificial Sequence
  Synthetic
aacatggaggttctgtattcattgtcaaaaactcttaaagatgctagcgacaacattgttgaaggtacattttat

SEQ ID NO: 300659 - DNA, 75 bp, Artificial Sequence
  Synthetic
aacatggaggttctgtattcattgtcaaaaactcttaaagatgctagcgacaacattgttgaaggtacactttat

SEQ ID NO: 300660 - DNA, 75 bp, Artificial Sequence
  Synthetic
aacatggaggttctgtattcattgtcaaaaactcttaaagatgctagcgacaacattgttgaaggtacagtttat

SEQ ID NO: 300661 - DNA, 75 bp, Artificial Sequence
  Synthetic
aacatggaggttctgtattcattgtcaaaaactcttaaagatgctagcgacaagattgttgaaggtacaatttat

SEQ ID NO: 300662 - DNA, 75 bp, Artificial Sequence
  Synthetic
aacatggaggttctgtattcattgtcaaaaactcttaaagatgctagcgacaagattgttgaaggtacattttat

SEQ ID NO: 300663 - DNA, 75 bp, Artificial Sequence
  Synthetic
aacatggaggttctgtattcattgtcaaaaactcttaaagatgctagcgacaagattgttgaaggtacactttat

SEQ ID NO: 300664 - DNA, 75 bp, Artificial Sequence
  Synthetic
aacatggaggttctgtattcattgtcaaaaactcttaaagatgctagcgacaagattgttgaaggtacagtttat

SEQ ID NO: 300665 - DNA, 75 bp, Artificial Sequence
  Synthetic
aacatggaggttctgtactcattgtcaaaaactcttaaagatgctagcgacaaaattgttgaaggtacaatttat

SEQ ID NO: 300666 - DNA, 75 bp, Artificial Sequence
  Synthetic
aacatggaggttctgtactcattgtcaaaaactcttaaagatgctagcgacaaaattgttgaaggtacattttat

SEQ ID NO: 300667 - DNA, 75 bp, Artificial Sequence
  Synthetic
aacatggaggttctgtactcattgtcaaaaactcttaaagatgctagcgacaaaattgttgaaggtacactttat

SEQ ID NO: 300668 - DNA, 75 bp, Artificial Sequence
  Synthetic
aacatggaggttctgtactcattgtcaaaaactcttaaagatgctagcgacaaaattgttgaaggtacagtttat

SEQ ID NO: 300669 - DNA, 75 bp, Artificial Sequence
  Synthetic
aacatggaggttctgtactcattgtcaaaaactcttaaagatgctagcgacaatattgttgaaggtacaatttat

SEQ ID NO: 300670 - DNA, 75 bp, Artificial Sequence
  Synthetic
aacatggaggttctgtactcattgtcaaaaactcttaaagatgctagcgacaatattgttgaaggtacattttat

SEQ ID NO: 300671 - DNA, 75 bp, Artificial Sequence
  Synthetic
aacatggaggttctgtactcattgtcaaaaactcttaaagatgctagcgacaatattgttgaaggtacactttat

SEQ ID NO: 300672 - DNA, 75 bp, Artificial Sequence
  Synthetic
aacatggaggttctgtactcattgtcaaaaactcttaaagatgctagcgacaatattgttgaaggtacagtttat

SEQ ID NO: 300673 - DNA, 75 bp, Artificial Sequence
  Synthetic
aacatggaggttctgtactcattgtcaaaaactcttaaagatgctagcgacaacattgttgaaggtacaatttat

SEQ ID NO: 300674 - DNA, 75 bp, Artificial Sequence
  Synthetic
aacatggaggttctgtactcattgtcaaaaactcttaaagatgctagcgacaacattgttgaaggtacattttat

SEQ ID NO: 300675 - DNA, 75 bp, Artificial Sequence
  Synthetic
aacatggaggttctgtactcattgtcaaaaactcttaaagatgctagcgacaacattgttgaaggtacactttat

SEQ ID NO: 300676 - DNA, 75 bp, Artificial Sequence
  Synthetic
aacatggaggttctgtactcattgtcaaaaactcttaaagatgctagcgacaacattgttgaaggtacagtttat

SEQ ID NO: 300677 - DNA, 75 bp, Artificial Sequence
  Synthetic
aacatggaggttctgtactcattgtcaaaaactcttaaagatgctagcgacaagattgttgaaggtacaatttat

SEQ ID NO: 300678 - DNA, 75 bp, Artificial Sequence
  Synthetic
aacatggaggttctgtactcattgtcaaaaactcttaaagatgctagcgacaagattgttgaaggtacattttat

SEQ ID NO: 300679 - DNA, 75 bp, Artificial Sequence
  Synthetic
aacatggaggttctgtactcattgtcaaaaactcttaaagatgctagcgacaagattgttgaaggtacactttat

SEQ ID NO: 300680 - DNA, 75 bp, Artificial Sequence
  Synthetic
aacatggaggttctgtactcattgtcaaaaactcttaaagatgctagcgacaagattgttgaaggtacagtttat

SEQ ID NO: 300681 - DNA, 75 bp, Artificial Sequence
  Synthetic
aacatggaggttctgtagtcattgtcaaaaactcttaaagatgctagcgacaaaattgttgaaggtacaatttat

SEQ ID NO: 300682 - DNA, 75 bp, Artificial Sequence
  Synthetic
aacatggaggttctgtagtcattgtcaaaaactcttaaagatgctagcgacaaaattgttgaaggtacattttat

SEQ ID NO: 300683 - DNA, 75 bp, Artificial Sequence
  Synthetic
aacatggaggttctgtagtcattgtcaaaaactcttaaagatgctagcgacaaaattgttgaaggtacactttat

SEQ ID NO: 300684 - DNA, 75 bp, Artificial Sequence
  Synthetic
aacatggaggttctgtagtcattgtcaaaaactcttaaagatgctagcgacaaaattgttgaaggtacagtttat

SEQ ID NO: 300685 - DNA, 75 bp, Artificial Sequence
  Synthetic
aacatggaggttctgtagtcattgtcaaaaactcttaaagatgctagcgacaatattgttgaaggtacaatttat

SEQ ID NO: 300686 - DNA, 75 bp, Artificial Sequence
  Synthetic
aacatggaggttctgtagtcattgtcaaaaactcttaaagatgctagcgacaatattgttgaaggtacattttat

SEQ ID NO: 300687 - DNA, 75 bp, Artificial Sequence
  Synthetic
aacatggaggttctgtagtcattgtcaaaaactcttaaagatgctagcgacaatattgttgaaggtacactttat

SEQ ID NO: 300688 - DNA, 75 bp, Artificial Sequence
  Synthetic
aacatggaggttctgtagtcattgtcaaaaactcttaaagatgctagcgacaatattgttgaaggtacagtttat

SEQ ID NO: 300689 - DNA, 75 bp, Artificial Sequence
  Synthetic
aacatggaggttctgtagtcattgtcaaaaactcttaaagatgctagcgacaacattgttgaaggtacaatttat

SEQ ID NO: 300690 - DNA, 75 bp, Artificial Sequence
  Synthetic
aacatggaggttctgtagtcattgtcaaaaactcttaaagatgctagcgacaacattgttgaaggtacattttat

SEQ ID NO: 300691 - DNA, 75 bp, Artificial Sequence
  Synthetic
aacatggaggttctgtagtcattgtcaaaaactcttaaagatgctagcgacaacattgttgaaggtacactttat

SEQ ID NO: 300692 - DNA, 75 bp, Artificial Sequence
  Synthetic
aacatggaggttctgtagtcattgtcaaaaactcttaaagatgctagcgacaacattgttgaaggtacagtttat

SEQ ID NO: 300693 - DNA, 75 bp, Artificial Sequence
  Synthetic
aacatggaggttctgtagtcattgtcaaaaactcttaaagatgctagcgacaagattgttgaaggtacaatttat

SEQ ID NO: 300694 - DNA, 75 bp, Artificial Sequence
  Synthetic
aacatggaggttctgtagtcattgtcaaaaactcttaaagatgctagcgacaagattgttgaaggtacattttat

SEQ ID NO: 300695 - DNA, 75 bp, Artificial Sequence
  Synthetic
aacatggaggttctgtagtcattgtcaaaaactcttaaagatgctagcgacaagattgttgaaggtacactttat

SEQ ID NO: 300696 - DNA, 75 bp, Artificial Sequence
  Synthetic
aacatggaggttctgtagtcattgtcaaaaactcttaaagatgctagcgacaagattgttgaaggtacagtttat

SEQ ID NO: 300697 - DNA, 75 bp, Artificial Sequence
  Synthetic
atggggaagtataatctaatcttgtcagaatatttatcatttgtttataattcacaatctgcagttcaaatacca

SEQ ID NO: 300698 - DNA, 75 bp, Artificial Sequence
  Synthetic
ttacattaatcagatagtacaagttatgtccaaaagatcgagatcgtcagattcgtcctatttctattatagagt

SEQ ID NO: 300699 - DNA, 75 bp, Artificial Sequence
  Synthetic
ttgcacatggaagatatactccaggagtcattcctccagtaaatgtggatagaccaattccattaggacgcaggg

SEQ ID NO: 300700 - DNA, 75 bp, Artificial Sequence
  Synthetic
taggtacaaacgtagagaattctgtttctggacacgtctataatgcattaatttactacagatataattatgcat

SEQ ID NO: 300701 - DNA, 75 bp, Artificial Sequence
  Synthetic
actttactatctatattatcatattcttatgacaaatacaacgctgtagaacgaaagctagtcaattatgctaaa

SEQ ID NO: 300702 - DNA, 75 bp, Artificial Sequence
  Synthetic
acgttcctggacgaagaacaagaattatatttatattaccatacgaatatttcattgcacaacacgctgtagtag

SEQ ID NO: 300703 - DNA, 75 bp, Artificial Sequence
  Synthetic
attccatattatacattgacattagaactgaccgtagaaatgcggattggagagagtggagaaagacagttgaag

SEQ ID NO: 300704 - DNA, 75 bp, Artificial Sequence
  Synthetic
gaaggtggaaaatattatgaacatgcaccaattgaattaatatatgcgtgtcgatcagctaaagaatttgctata

SEQ ID NO: 300705 - DNA, 75 bp, Artificial Sequence
  Synthetic
actgattcattaatggatcctgctatattaacttcgttatcttcaaatttaaatgcagttatgttttggttagaa

SEQ ID NO: 300706 - DNA, 75 bp, Artificial Sequence
  Synthetic
aatatctgcaaaattattacatcatccaacaactgaaatccgatcagaattctatctactcttagacatttggga

SEQ ID NO: 300707 - DNA, 75 bp, Artificial Sequence
  Synthetic
ttcgttatcttcaaatttaaatgcagtcatgttttggttagaacgacattcaaatgacgttgctgatgcaaacaa

SEQ ID NO: 300708 - DNA, 75 bp, Artificial Sequence
  Synthetic
tagtaattctatggtattatatacggatgtctcacaatgggattcatcacagcataacacacagccttttaggaa

SEQ ID NO: 300709 - DNA, 75 bp, Artificial Sequence
  Synthetic
aaaacatctaagaatgagtacattgtagcgttatatgcattatcaaacgattttaatgatagaatgaatgtaatt

SEQ ID NO: 300710 - DNA, 75 bp, Artificial Sequence
  Synthetic
gattcgtacgtccaaatacccgatggtaatgtaatcaagaagattcaatatggagccgttgcctcaggagaaaaa

SEQ ID NO: 300711 - DNA, 75 bp, Artificial Sequence
  Synthetic
cttttttgccaacagattttaacacaactgattccataataacttcatatgatggatgtttaggtatatttggct

SEQ ID NO: 300712 - DNA, 75 bp, Artificial Sequence
  Synthetic
ttgacggtgatgacaattatgcagttttgcagtttaatactgatgttactaaacagatggttcaagaagtatcaa

SEQ ID NO: 300713 - DNA, 75 bp, Artificial Sequence
  Synthetic
atgagaaaagctggtttagtagatataccaagaatgattcaagaatggttagttgattgttcattagagaaattt

SEQ ID NO: 300714 - DNA, 75 bp, Artificial Sequence
  Synthetic
tcgcgattcagaattagccggattgttatcaatgtcatcagcttcaaatggtgaatcaaggcagcttaaatttgg

SEQ ID NO: 300715 - DNA, 75 bp, Artificial Sequence
  Synthetic
agaaggtggaaaatattatgagcatgctccaatagaattaatttatgcttgtagatcagcaaaagaattcgccct

SEQ ID NO: 300716 - DNA, 75 bp, Artificial Sequence
  Synthetic
atttcagataacatgattccagatgtaacacgaattatcaaagacatgaagaaagagctgtttgaaatggatgta

SEQ ID NO: 300717 - DNA, 75 bp, Artificial Sequence
  Synthetic
tacgtgacataaaaccattctttgtgactacagaagctaatttaccaattcaatatagaaaatttatgcctacgt

SEQ ID NO: 300718 - DNA, 75 bp, Artificial Sequence
  Synthetic
agttttagtagtaggaaaacggtaagaatagaaactgttaagttaaaaattgattcaatatacttgagaaaaatt

SEQ ID NO: 300719 - DNA, 75 bp, Artificial Sequence
  Synthetic
gcaaactcagtatggactccagtttcttcaaataaaattagaggatggtgcattgagtgttgtcaattgactgaa

SEQ ID NO: 300720 - DNA, 75 bp, Artificial Sequence
  Synthetic
actttcacaactatttctaactaaaggatggccgactgggtccgtttatttcaaagagtacacagacatagcatc

SEQ ID NO: 300721 - DNA, 75 bp, Artificial Sequence
  Synthetic
gaacctttgaatctccaataacaaaggaaaaattgcagtgcattattgatttatataatctactatttccaatca

SEQ ID NO: 300722 - DNA, 75 bp, Artificial Sequence
  Synthetic
tctaaatgccgcagtttttaaatttcattcgagggaaatttacatttttggattttatgaaggatcatcagcatg

SEQ ID NO: 300723 - DNA, 75 bp, Artificial Sequence
  Synthetic
ttacaatctatctatgcaaataattattttaaattgagcagacttccttcaatgaagttgaaacaagtttattat

SEQ ID NO: 300724 - DNA, 75 bp, Artificial Sequence
  Synthetic
aatgaagttgaaacaagtttattattcagacttctccaaacaaaatttgattaataagtataaaactaagagtcg

SEQ ID NO: 300725 - DNA, 75 bp, Artificial Sequence
  Synthetic
aattcagatagatggttagctactatactaattgaaccaaacgtcacatcacaaagcagaacatatactttattt

SEQ ID NO: 300726 - DNA, 75 bp, Artificial Sequence
  Synthetic
ttatgtaaatcagataattcaggcaatgtccaaaagatcacgatcattaaattctgctgcgttttactatagagt

SEQ ID NO: 300727 - DNA, 75 bp, Artificial Sequence
  Synthetic
taatgaactcttaagttttctacagtcctgttacaaaagtaatgttaatgtagggcattgtagttcaattgaaag

SEQ ID NO: 300728 - DNA, 75 bp, Artificial Sequence
  Synthetic
aaagagtgtcacaatttgatattgggcaatataaaaatatgttaaatgtagttactaccatatattactactata

SEQ ID NO: 300729 - DNA, 75 bp, Artificial Sequence
  Synthetic
aatgagcaacttgtaattaacttctattggcaaatagatatcgctctgtacactcacatcaaaatgatactaaaa

SEQ ID NO: 300730 - DNA, 75 bp, Artificial Sequence
  Synthetic
cgttatgcactgaacaaaccgacaaattggttaaactgaaagaagaagggaaactgtctgaagagtatgagctcc

SEQ ID NO: 300731 - DNA, 75 bp, Artificial Sequence
  Synthetic
attggttacattttattaataataatagatttagacaagttgttattgatggagtgttaaatcaaacgcttaatg

SEQ ID NO: 300732 - DNA, 75 bp, Artificial Sequence
  Synthetic
tggaaagactcattatcgcaaatgtttcttacaaagggttggccaacaggatcagtctattttaaagagtactca

SEQ ID NO: 300733 - DNA, 75 bp, Artificial Sequence
  Synthetic
gtgatgtagctaaattgaaagatgattcgatattatatgtagatatacgaacagatagagaaaatatagattgga

SEQ ID NO: 300734 - DNA, 75 bp, Artificial Sequence
  Synthetic
atggggaagtacaatctaatcttgtcagaatatttatcatttatttataattcacaatctgctgtgcaaattcca

SEQ ID NO: 300735 - DNA, 75 bp, Artificial Sequence
  Synthetic
cagaatatttatcatttatttataattcacaatctgctgtgcaaattccaatttattattcttctaattcagatt

SEQ ID NO: 300736 - DNA, 75 bp, Artificial Sequence
  Synthetic
ttcacaatctgctgtgcaaattccaatttattattcttctaattcagatttagaaaaaagatgtatagaattcca

SEQ ID NO: 300737 - DNA, 75 bp, Artificial Sequence
  Synthetic
tgtgactataatttagttttaatgaaatatgattctacacaggaactagatatgtctgaattggccgatcttata

SEQ ID NO: 300738 - DNA, 75 bp, Artificial Sequence
  Synthetic
gaatgcagttatgttttggttggagaaacatgcgaatgatactgcagaaaaagctaaaatttataagagaaggct

SEQ ID NO: 300739 - DNA, 75 bp, Artificial Sequence
  Synthetic
tactatttagtgacgtgggcaaattcatcaattgaaatgctaatgtcagtgttttcgcatgaagattatctaatt

SEQ ID NO: 300740 - DNA, 75 bp, Artificial Sequence
  Synthetic
ttagttgcgttagtagatataaatggtactttcattactaatgaagaactagagttagaattttctaataaatac

SEQ ID NO: 300741 - DNA, 75 bp, Artificial Sequence
  Synthetic
ttacgtcaatcaaataattcaaaagatgtccaaaagatctagatcgcttaattcgtcagcgttttattacagggt

SEQ ID NO: 300742 - DNA, 75 bp, Artificial Sequence
  Synthetic
actggttagtggattgttcaattgagaaatttcctttgatggcaaaaatttactcttggtcttttcatgtggggt

SEQ ID NO: 300743 - DNA, 75 bp, Artificial Sequence
  Synthetic
cgagaataatttttatattaccatatgaatatttcattgcccaacacgcagtcgtcgaaaagatgttactttatg

SEQ ID NO: 300744 - DNA, 75 bp, Artificial Sequence
  Synthetic
atatactgatgtatcgcaatgggactcatcgcagcataatacgcagccatttagaaaaggaataattatgggatt

SEQ ID NO: 300745 - DNA, 75 bp, Artificial Sequence
  Synthetic
gaaacatcgttccattagcgctctcagctagaaatgtggtatcattaaaagctcaatcaaatgaggatatcgttg

SEQ ID NO: 300746 - DNA, 75 bp, Artificial Sequence
  Synthetic
gctcaatcaaatgaggatatcgttgtctcaaagacatcactgtggaaggaaatgcaatataatagggatataaca

SEQ ID NO: 300747 - DNA, 75 bp, Artificial Sequence
  Synthetic
tgaatctgcagtttgtgaatctgtgcttgcggatgcttcagaaactttattggcaaatgtgacatcagttcgtca

SEQ ID NO: 300748 - DNA, 75 bp, Artificial Sequence
  Synthetic
agctttggtctcgacggttggaatagaaatcgctaaacgctacatcgctggcggaaaaatattttttagagctgg

SEQ ID NO: 300749 - DNA, 75 bp, Artificial Sequence
  Synthetic
tggctagcagatagctccttttaatgtatggtattgaatataccacagttctattttatttgatatcgttcgttc

SEQ ID NO: 300750 - DNA, 75 bp, Artificial Sequence
  Synthetic
atgaacgatttcagttttaatggagggtcgttgccaacagatttcgttatttctagatatgaagtgataaaagag

SEQ ID NO: 300751 - DNA, 75 bp, Artificial Sequence
  Synthetic
gagactgatagagaattcatattaacgaaaattatgcaaatgacatcagtagccataactggatctcttagattg

SEQ ID NO: 300752 - DNA, 75 bp, Artificial Sequence
  Synthetic
gtatggtattgaatataccacagttctaacctttctgatatcaatagttttattgaactatatattaaaatcact

SEQ ID NO: 300753 - DNA, 75 bp, Artificial Sequence
  Synthetic
tatccatcagaagctccaactcaaattagtgacactgaatggaaagatacactatctcagctgtttttaaccaaa

SEQ ID NO: 300754 - DNA, 75 bp, Artificial Sequence
  Synthetic
ctaattctacgtttaaagtttttgactcagaagactttataattgaatatggtactacagatgatgaggtgtata

SEQ ID NO: 300755 - DNA, 75 bp, Artificial Sequence
  Synthetic
accagttggtcaatggccatacatgacaggtggagcagtgtcactacattcagcaggtgttacattatctacaca

SEQ ID NO: 300756 - DNA, 75 bp, Artificial Sequence
  Synthetic
aaaattatgtatctaagctttcagaccaactattggtatcgaaaaatacaattgtttcaaggggtatagcactaa

SEQ ID NO: 300757 - DNA, 75 bp, Artificial Sequence
  Synthetic
tattcagtatgattataatgaagtatttactagagttaaaagtaagtttgactatgtgatggatgactctggtgt

SEQ ID NO: 300758 - DNA, 75 bp, Artificial Sequence
  Synthetic
caatgttgcaaaaaccagtgacattcaaatcgaataaaataactattaatgatattttacatgacattaaaccat

SEQ ID NO: 300759 - DNA, 75 bp, Artificial Sequence
  Synthetic
ttaatgtgtgtccattaaatactcagacattaggaattggatgtcaaacgacaaatacagctacttttgaaacag

SEQ ID NO: 300760 - DNA, 75 bp, Artificial Sequence
  Synthetic
tatcgaaatattcagtatatagaccatcaatagaagaactgtataaagtaatatcacttcatgaacaagaaatcc

SEQ ID NO: 300761 - DNA, 75 bp, Artificial Sequence
  Synthetic
gtttagccagttcagtttctacactaacggactcattgtctgatgccgcctcttcagtatcaagaggatcatcta

SEQ ID NO: 300762 - DNA, 75 bp, Artificial Sequence
  Synthetic
ggcaagtattctatactgtagttgattacattaatcagatagtacaagtaatgtccaaaagatcgagatcgttag

SEQ ID NO: 300763 - DNA, 75 bp, Artificial Sequence
  Synthetic
ttacattaatcagatagtacaagtaatgtccaaaagatcgagatcgttagattcgtcatctttctattatagagt

SEQ ID NO: 300764 - DNA, 75 bp, Artificial Sequence
  Synthetic
gaggatccagggatggcgtattttccttatatagcatctgtcctaacagttttgttcacgttgcacaaagcatct

SEQ ID NO: 300765 - DNA, 75 bp, Artificial Sequence
  Synthetic
ttaattcaccagatctagagaaactaataagaattccgtttaaaggaaaaataccagctgtaacgttcattctac

SEQ ID NO: 300766 - DNA, 75 bp, Artificial Sequence
  Synthetic
ttcaatacgttgttgaaattggcaggttataaagaacagattactactaaagatgagatagaaaagcaaatggac

SEQ ID NO: 300767 - DNA, 75 bp, Artificial Sequence
  Synthetic
actctaaaagaagctagagcaaaaattgttgaaggtactctttacactaatgtggctgatattgtgcagcaaata

SEQ ID NO: 300768 - DNA, 75 bp, Artificial Sequence
  Synthetic
caaaatctgaaatgattaaactttggaagaaaatgtggaacataacttcattgagatctccgtataccaatgcaa

SEQ ID NO: 300769 - DNA, 75 bp, Artificial Sequence
  Synthetic
ctacactgctaaatttggacgcaaattatgttgaaaatgcgagagcaactattgattacttcattgattttgttg

SEQ ID NO: 300770 - DNA, 75 bp, Artificial Sequence
  Synthetic
agatatgacgaaggaaattaaccaaaagaacgtgagaacgctagaagaatgggaaaatggaaaaaatccttatga

SEQ ID NO: 300771 - DNA, 75 bp, Artificial Sequence
  Synthetic
atggaaaaacttgccgacctcaattatacattaggtgtaattactttaatgaatgacacattacataccataatg

SEQ ID NO: 300772 - DNA, 75 bp, Artificial Sequence
  Synthetic
aataaattatgataatgactcagagtatatagaaaattggaatttgcagaacagaagacaacgtacaggttatct

SEQ ID NO: 300773 - DNA, 75 bp, Artificial Sequence
  Synthetic
agcatttatgtctttatcaagtcaaaaatcaggaatagctgatgaaatagctgcatcatcaacgtttaaaaatta

SEQ ID NO: 300774 - DNA, 75 bp, Artificial Sequence
  Synthetic
ggtataaagaacagataacaactaaggatgagattgaaaaacaaatggacagagtcgtaaaagaaatgcgacgtc

SEQ ID NO: 300775 - DNA, 75 bp, Artificial Sequence
  Synthetic
ggttcggaaatagagattataggttttgattcagaatgtgcattaaatgcgcaagcgaacgttcaagcgtttcaa

SEQ ID NO: 300776 - DNA, 75 bp, Artificial Sequence
  Synthetic
cattgccggatggagattatgatgtccgagaatacttcttaaatttatatgatcagatattgatagaaatgccag

SEQ ID NO: 300777 - DNA, 75 bp, Artificial Sequence
  Synthetic
agatatgtcaaaggaatttaatcaaaagaattttaaaacgctaagtgaatgggctgatggtgaaaatccttatga

SEQ ID NO: 300778 - DNA, 75 bp, Artificial Sequence
  Synthetic
gtcagaatacatggctattcgatccagttatgctaagaccgcataatccacaaattgaatttctattaaatgggc

SEQ ID NO: 300779 - DNA, 75 bp, Artificial Sequence
  Synthetic
tgatcggatgcaagaaaaagaggagaataaaaatataaccaatagtattgaaaataagagtactgcaaaaactca

SEQ ID NO: 300780 - DNA, 75 bp, Artificial Sequence
  Synthetic
tctttctgatgaaattgatataattggatctgaaaagacgcaaaacgttactattaatccaggtccatttgcaca

SEQ ID NO: 300781 - DNA, 75 bp, Artificial Sequence
  Synthetic
accagccgtagcagcacttttcccagtggcagcaccatttcctaatcatgcagcagttggacttactcttaatat

SEQ ID NO: 300782 - DNA, 75 bp, Artificial Sequence
  Synthetic
ccacctacaggttattggatgcttttatcacctttggaggcaggcgtagtggtagaagggactaataatagtgat

SEQ ID NO: 300783 - DNA, 75 bp, Artificial Sequence
  Synthetic
cgaggatttgaaactgatagagaatttatattaactaaaattatacaaatgacatctgtagccattactggatca

SEQ ID NO: 300784 - DNA, 75 bp, Artificial Sequence
  Synthetic
gtatttcctgctggtatgaattggaccgaattgcttaacaattattcagcctcgagggaagataatctgcaacgt

SEQ ID NO: 300785 - DNA, 75 bp, Artificial Sequence
  Synthetic
aacctaaacaattgccaatatatagagcaaatggagagagggaattgcgtaatagatggtattggaaactgaaac

SEQ ID NO: 300786 - DNA, 75 bp, Artificial Sequence
  Synthetic
cttcaactaaatggaaatttgtagacttggttaaaacgtcgttaactggtacttattcacagtatggaccactat

SEQ ID NO: 300787 - DNA, 75 bp, Artificial Sequence
  Synthetic
ggtaacagctcataccaaagcttaatggtcatgtagctatactgacgaatagtccgtagcggacgtaagcattgc

SEQ ID NO: 300788 - DNA, 75 bp, Artificial Sequence
  Synthetic
aaactatgattcagtaaatatgactgcattctgcgatttttatattatacccaggtctcaagaatcgacatgtac

SEQ ID NO: 300789 - DNA, 75 bp, Artificial Sequence
  Synthetic
aatgaagacatcattgtttcgcaaacgtcattatggaaagaaatgcaatacaatcgagatataacgataagattt

SEQ ID NO: 300790 - DNA, 75 bp, Artificial Sequence
  Synthetic
tcaacagctaggtatattagaccaaacttacttcaagacagacttaatttgcatgataattttgagtctttgtgg

SEQ ID NO: 300791 - DNA, 75 bp, Artificial Sequence
  Synthetic
gagaggaagtcacagcacacacaacatgttccgtgaatggaattaatgattttagttataatggtggatcacttc

SEQ ID NO: 300792 - DNA, 75 bp, Artificial Sequence
  Synthetic
tgttcgatctttagctgctgacttaaattcagtgatgtgtacgggaggtagttataacttcgcattaccagttgg

SEQ ID NO: 300793 - DNA, 75 bp, Artificial Sequence
  Synthetic
tttatacgcgaatccttagtggcatgtcagttagcaataattaatactattatatacccagcttttgggatgcaa

SEQ ID NO: 300794 - DNA, 75 bp, Artificial Sequence
  Synthetic
ttcagattccgattatcggttgaagaaccaccattctccattgtacgaacaagaatatcaggattatatggatta

SEQ ID NO: 300795 - DNA, 75 bp, Artificial Sequence
  Synthetic
ataatcaatttaggcaagtagtaattgatggagtattgaatcaagttctaaatgataacataaggaacggtcatg

SEQ ID NO: 300796 - DNA, 75 bp, Artificial Sequence
  Synthetic
taatgaattcagttactgtcagacaagacttggaaagacaactcggagaactacgagaagaattcaacgcattat

SEQ ID NO: 300797 - DNA, 75 bp, Artificial Sequence
  Synthetic
tttgtctaatagattaggacaattggttgacctaactagattgctagcatacaattacgaaactttgatggcgtg

SEQ ID NO: 300798 - DNA, 75 bp, Artificial Sequence
  Synthetic
atcaatggctaccaatgtaatgaaaaagttcaaaaagtcaagtttggcttcttcagtatcaacgttaacagattc

SEQ ID NO: 300799 - DNA, 75 bp, Artificial Sequence
  Synthetic
ataccaagcccacaaacattatttcattattacaacgttaatgttaatttccattcaaattataatgaaagaata

SEQ ID NO: 300800 - DNA, 75 bp, Artificial Sequence
  Synthetic
gcctcagcatcaacgagtactatcgcaacacaaactgctactataagccgtagacttaggttaaaggagatagcg

SEQ ID NO: 300801 - DNA, 75 bp, Artificial Sequence
  Synthetic
tcgacgtttcgagagttccagatgaccagatgtatagacttagagacagattgaggttacttccagttgagatta

SEQ ID NO: 300802 - DNA, 75 bp, Artificial Sequence
  Synthetic
tagtgacagaagcttctgagaagtttataccgaatagagcttatagagtaattaacaacgatgaagtatttgaag

SEQ ID NO: 300803 - DNA, 75 bp, Artificial Sequence
  Synthetic
tgcggtggcaatacaataaatttgcagtaattacacatggtaaaggtcactacagagttgtaaaatattcatcag

SEQ ID NO: 300804 - DNA, 75 bp, Artificial Sequence
  Synthetic
gggtgatcatagcttatagagacatgcagttagaaagagacgaaatgtatggctatgttaatatagctcgaaatt

SEQ ID NO: 300805 - DNA, 75 bp, Artificial Sequence
  Synthetic
aatatcagcaattattgattttaaaacgcttaaaaatttaaatgacaattatggaattactcgcgatcaagcatt

SEQ ID NO: 300806 - DNA, 75 bp, Artificial Sequence
  Synthetic
taatttgttacgatctgatccaagggtattaagagaatttataaatcaagataatccaattataagaaatagaat

SEQ ID NO: 300807 - DNA, 75 bp, Artificial Sequence
  Synthetic
atggatgtcctattttcattgtcaaaaactttgaaagatgccagagacaaaattgttgaaggtactttatattct

SEQ ID NO: 300808 - DNA, 75 bp, Artificial Sequence
  Synthetic
tggaaatgagtttcaaaccggaggaattggtaatttaccaattagaaattggcaatttgatttcggtttgctagg

SEQ ID NO: 300809 - DNA, 75 bp, Artificial Sequence
  Synthetic
ttcgtttcagcagatactgttgaaccaattaatgctgttgcgtttgataacatgcgcatcatgaacgaactgtaa

SEQ ID NO: 300810 - DNA, 75 bp, Artificial Sequence
  Synthetic
gttagagagtctcagcgtaatggaattgcaccacagtctgatgctctaaggaagttgtctgggattaaatttaaa

SEQ ID NO: 300811 - DNA, 75 bp, Artificial Sequence
  Synthetic
cgtattcagcatcatttactcttaatagatctcagcctcagcatgataatttgatgggcactatgtggttaaacg

SEQ ID NO: 300812 - DNA, 75 bp, Artificial Sequence
  Synthetic
tttgacaacagctaccattacacttcttccggacgctgagagatttagttttcccagagtcatcaactcagctga

SEQ ID NO: 300813 - DNA, 75 bp, Artificial Sequence
  Synthetic
agattcggaacaattattgctagaaatttcgacactattagattgtctttccaattgttgcgcccaccaaatatg

SEQ ID NO: 300814 - DNA, 75 bp, Artificial Sequence
  Synthetic
tacttgctgatgctaatgaaacaatgctcgcaaatgttactgcagttcgtcaagagtacgctattccagttggac

SEQ ID NO: 300815 - DNA, 75 bp, Artificial Sequence
  Synthetic
ctgtttttccaccgggtatgaattggacagatcttatcactaactactcaccttctagagaagataatttgcaac

SEQ ID NO: 300816 - DNA, 75 bp, Artificial Sequence
  Synthetic
ttgatcttaaaagatggatttatttacattcaattggagaagtaactgtagaaggtggaaaatattatgaacatg

SEQ ID NO: 300817 - DNA, 75 bp, Artificial Sequence
  Synthetic
cctatcacgtatttccaacaaatattcattcgcgacgaagataataagagttgacggagatgacaattacgcagt

SEQ ID NO: 300818 - DNA, 75 bp, Artificial Sequence
  Synthetic
gaatttactacgcaaactgataatttaagctttgatgacatatcagccgctgtattgaagacgaaattggacaag

SEQ ID NO: 300819 - DNA, 75 bp, Artificial Sequence
  Synthetic
tatgctgatgacccaaattattttataggagttaaatttgatagcataccttatgaatatgatgttaaaattcca

SEQ ID NO: 300820 - DNA, 75 bp, Artificial Sequence
  Synthetic
aaattacgggattaatctacccattacaggttcaatggatacagcatatgctaattcaacccaagaagaaaattt

SEQ ID NO: 300821 - DNA, 75 bp, Artificial Sequence
  Synthetic
actggatcgctaagactctttccttctgaacgcgtgttaaccacgaactctacatttaaagtatttgactcggag

SEQ ID NO: 300822 - DNA, 75 bp, Artificial Sequence
  Synthetic
ggttggccaactggatccgtatatttcaatgaatacagtgacatagcatcattctcaataaatccacagttatat

SEQ ID NO: 300823 - DNA, 75 bp, Artificial Sequence
  Synthetic
taaacaacaataaccctataatcagaaataggatagaaaatctaatagcgcaatgtagattgtaactgtctgctc

SEQ ID NO: 300824 - DNA, 75 bp, Artificial Sequence
  Synthetic
ttgttttcaaagaataacatagtgtctagaggaatagcattgactgaaaaggcaaagttgaactcatacgcacca

SEQ ID NO: 300825 - DNA, 75 bp, Artificial Sequence
  Synthetic
tggacataacattatactattatcaacaaactgatgaaactaataaatggatatcaacaggaacatcttgtacag

SEQ ID NO: 300826 - DNA, 75 bp, Artificial Sequence
  Synthetic
aacagatgttgttgatggagtaaatcacaaaataaatctcacaacagctacttgtactatacgaaactgtaaaaa

SEQ ID NO: 300827 - DNA, 75 bp, Artificial Sequence
  Synthetic
gttatcagctattcgactttaattcaccagatctagaaaagctgatcagaataccgtttaaaggaaagataccag

SEQ ID NO: 300828 - DNA, 75 bp, Artificial Sequence
  Synthetic
ggttgatatacctaagatgatacaagactggttagttgattgttccatcgaaaaatttccattaatggctaaaat

SEQ ID NO: 300829 - DNA, 75 bp, Artificial Sequence
  Synthetic
ctacgtaaatcagataatacaggttatgtctaaaagatcaagatcattagatgctgcagcattttactatagagt

SEQ ID NO: 300830 - DNA, 75 bp, Artificial Sequence
  Synthetic
tccttctatttcatcaagtgtatataaaaatgaatcaaattcagcaacgtcaactctttctggaaaatctattgg

SEQ ID NO: 300831 - DNA, 75 bp, Artificial Sequence
  Synthetic
caaataggcttggtcaattagttgatttaactaggttattagcttacaactatgaaacactaatggcatgcgtta

SEQ ID NO: 300832 - DNA, 75 bp, Artificial Sequence
  Synthetic
caatagcaacaaaaaataagaaagacaaatcgaaaaaagattctaaaagtaggaaacactacccaaaaattgaag

SEQ ID NO: 300833 - DNA, 75 bp, Artificial Sequence
  Synthetic
agaaaaaatattttatactaagaggaagaatgaaacaagttgcaatgcaattaattgaagatttgtaaaataagt

SEQ ID NO: 300834 - DNA, 75 bp, Artificial Sequence
  Synthetic
ggaatgataagcagaatgaatacatgcaagaagaaaaggctgataagaaaaataacgatatgaacgaaataaaag

SEQ ID NO: 300835 - DNA, 75 bp, Artificial Sequence
  Synthetic
ggaatcaaaacagttaattgaagtgttaaagacaaaagaagagcatcaaaaagaaatacaatatgagatactaca

SEQ ID NO: 300836 - DNA, 75 bp, Artificial Sequence
  Synthetic
gatataacattatattattatcagcaaacagatgaagcgaataaatggatatcgatgggacagtcttgtaccata

SEQ ID NO: 300837 - DNA, 75 bp, Artificial Sequence
  Synthetic
aatatgagcttctgatctcggactctgaagatgacgactaagattgaattaactatcaccacagttttgccatca

SEQ ID NO: 300838 - DNA, 75 bp, Artificial Sequence
  Synthetic
ttaaagacaaaagaagagcatcaaaaagaaatacaatatgagatactacaaaaaactataccaacatttgaacca

SEQ ID NO: 300839 - DNA, 75 bp, Artificial Sequence
  Synthetic
atagagcaaatggagaaagagaattgcgtaatagatggtattggaaacttaagaaagacacactacctgatggag

SEQ ID NO: 300840 - DNA, 75 bp, Artificial Sequence
  Synthetic
acaactatctgacaaagtgctatcacaaaaagaagaaataataactgatgcacaagatgatgttaaaatagctga

SEQ ID NO: 300841 - DNA, 75 bp, Artificial Sequence
  Synthetic
ctcacgtgatgctggtaaagttgttgattcagaaacagcagcaatatgtgatgcaatatttcaggatgaagaaac

SEQ ID NO: 300842 - DNA, 75 bp, Artificial Sequence
  Synthetic
gcttttaatgaatattttttacaacaccaattggttgaacctttaaataacgatattatctttaattatatacca

SEQ ID NO: 300843 - DNA, 75 bp, Artificial Sequence
  Synthetic
taccaagaatgattcaagagtggttagttgactgttcgctagaaaaatttacattaatgtcaaaaatctattcct

SEQ ID NO: 300844 - DNA, 75 bp, Artificial Sequence
  Synthetic
atttacatgataactttgaatctttatgggatacaattaccacatcgaattatatactagcccgatcagtagtgc

SEQ ID NO: 300845 - DNA, 75 bp, Artificial Sequence
  Synthetic
gactggcatcaattcacaagcagctaatgattgctttaagacgctaatagcagcaatgttaagtcagagaacgat

SEQ ID NO: 300846 - DNA, 75 bp, Artificial Sequence
  Synthetic
gcttgtcaattggcaataattaatacaatagtatatccggcattcggaatgcagcggatgcattatagaaacggc

SEQ ID NO: 300847 - DNA, 75 bp, Artificial Sequence
  Synthetic
aaatagcttagtacttaaactaggagcaaatgatgaatggagaccagcaccagtgacaaaatacgaagggtggtg

SEQ ID NO: 300848 - DNA, 75 bp, Artificial Sequence
  Synthetic
ttatagacggtgtattaaatcaagtattaaatgataacataagaaatggtcacgtagttaatcagctaatggaag

SEQ ID NO: 300849 - DNA, 75 bp, Artificial Sequence
  Synthetic
gaagaacctcacttgttaagaatgcgaacattcaaggatgtaataacgaaagaggatatagaaggattgctgacc

SEQ ID NO: 300850 - DNA, 75 bp, Artificial Sequence
  Synthetic
actagttgatttaactagactattagcatataactatgaaacactaatgtcatgtattacaatgaacatgcaaca

SEQ ID NO: 300851 - DNA, 75 bp, Artificial Sequence
  Synthetic
ataatcatctactgatgccaataacattacaagcattaactataaaacttgaagatagcacatactatatatttg

SEQ ID NO: 300852 - DNA, 75 bp, Artificial Sequence
  Synthetic
gaagatagcacatactatatatttggatactatgactgtatggaacatgagaaccagacaccattccagtttatt

SEQ ID NO: 300853 - DNA, 75 bp, Artificial Sequence
  Synthetic
atttttcaaaatcaagatttttaagtaaaggaaagaaaagattgaataggaacgatttttcagataatcttgtgg

SEQ ID NO: 300854 - DNA, 75 bp, Artificial Sequence
  Synthetic
atatttgatgttgcaagagtgccagatgatcaaatgtatagattaagagatagattaagactgttgccagttgaa

SEQ ID NO: 300855 - DNA, 75 bp, Artificial Sequence
  Synthetic
atgatcaaatgtatagattaagagatagattaagactgttgccagttgaaatcagaagacttgatatatttaact

SEQ ID NO: 300856 - DNA, 75 bp, Artificial Sequence
  Synthetic
agtacacatccaaatgattatgaatggaataaggcatgtacgtttgtggttgatgctagaaattatattaacatt

SEQ ID NO: 300857 - DNA, 75 bp, Artificial Sequence
  Synthetic
gtatggttatgtgaacatagctcgtaatttagatgggtttcagcagataaatttagaagagttaatgcgtactgg

SEQ ID NO: 300858 - DNA, 75 bp, Artificial Sequence
  Synthetic
tggtgtcagataaacagccattacaaagtgtgggaagattttagactgaagaagatatataataatgtgatggat

SEQ ID NO: 300859 - DNA, 75 bp, Artificial Sequence
  Synthetic
gctaaactagatgctactgtatttgctcagatcgttaagttacgtaaagtcgatacacttaaacctatactgtat

SEQ ID NO: 300860 - DNA, 75 bp, Artificial Sequence
  Synthetic
ctaaaggaatagcagtaacagaaaaagcgaaactgaactcatacgcaccggtttatttagagaagcgacgagctc

SEQ ID NO: 300861 - DNA, 75 bp, Artificial Sequence
  Synthetic
tttatttagtagcaaattacgattgggttccaacgtctactacaagagtatataagcaaattccgcaaatattcg

SEQ ID NO: 300862 - DNA, 75 bp, Artificial Sequence
  Synthetic
tggaaaaatggaatgaagctgtcgaagtattatttaattatctagaaccagtggatataaatggaacggagtatg

SEQ ID NO: 300863 - DNA, 75 bp, Artificial Sequence
  Synthetic
gatattaagtacaataatatttgattggtttgacgtaagatacatgagagaaacgccaatgacgacgtcaacaac

SEQ ID NO: 300864 - DNA, 75 bp, Artificial Sequence
  Synthetic
aaacgccaatgacgacgtcaacaacgaatcagcttagaacactgaataaaaggaatgagctcatagatgagtacg

SEQ ID NO: 300865 - DNA, 75 bp, Artificial Sequence
  Synthetic
tacgagaacaagagatacagctatatttagtttcattaggagttccaccagttgatgcaagtacatacgttggat

SEQ ID NO: 300866 - DNA, 75 bp, Artificial Sequence
  Synthetic
tttagtttcattaggagttccaccagttgatgcaagtacatacgttggatctagaatatattcacaggataaata

SEQ ID NO: 300867 - DNA, 75 bp, Artificial Sequence
  Synthetic
taaatgatggatcttggacggatacactatctcaattatttctaactaaagggtggcctaccggttcagtatact

SEQ ID NO: 300868 - DNA, 75 bp, Artificial Sequence
  Synthetic
ttacaacacaaatgacaattctagaggaatgaattatgaaacagatatgttcaaaaaagtagctacgttaatatg

SEQ ID NO: 300869 - DNA, 75 bp, Artificial Sequence
  Synthetic
aacagatgttgtggatggagtggatcataaaattaatattaatactgcaacgtgtacaattcgaaattgcaataa

SEQ ID NO: 300870 - DNA, 75 bp, Artificial Sequence
  Synthetic
gaaaactatcaagatgtactcttccattcaaaagaactactaattaaatcagtactaatagctattggtcacatt

SEQ ID NO: 300871 - DNA, 75 bp, Artificial Sequence
  Synthetic
tgcctatactagatcagaattttgtagaatataaagtcacattgaatgaagacaaaccaatctctgaatcacaca

SEQ ID NO: 300872 - DNA, 75 bp, Artificial Sequence
  Synthetic
gaatcacgctgatagagtatatgctactttcaaaagtaatagtaaaaatagcatgctatcagaatttaacctatt

SEQ ID NO: 300873 - DNA, 75 bp, Artificial Sequence
  Synthetic
aaacaagataagagttcttttaaaggtctgtcaaccgataggaaaatggatgaagtttcgcaagtaggagtttaa

SEQ ID NO: 300874 - DNA, 75 bp, Artificial Sequence
  Synthetic
gtctgtcaaccgataggaaaatggatgaagtttcgcaagtaggagtttaacaaaataattcgctattgattagag

SEQ ID NO: 300875 - DNA, 75 bp, Artificial Sequence
  Synthetic
tctatcttttgtatataattcgcagtcagcagtacaaattccaatatatcattcttcagacactatattagaaaa

SEQ ID NO: 300876 - DNA, 75 bp, Artificial Sequence
  Synthetic
actttattatctatattatcatattcatatgataaatataacgctgttgaaaggaaattagttaaatatgcaaaa

SEQ ID NO: 300877 - DNA, 75 bp, Artificial Sequence
  Synthetic
aaaattaattcaatttacttaagaaagattaaaggggaaaccgtatttgatatgtctgagtgagctaaaaactta

SEQ ID NO: 300878 - DNA, 75 bp, Artificial Sequence
  Synthetic
ctaacctttctgatatcatttattttattgaactatacattaaaatctttgactagaataatggacttcattatt

SEQ ID NO: 300879 - DNA, 75 bp, Artificial Sequence
  Synthetic
ggaggttctgtactcattgtcaaaaactttaaaggatgctagagataaaattgttgaaggtacactatattcaaa

SEQ ID NO: 300880 - DNA, 75 bp, Artificial Sequence
  Synthetic
ctaattccacacaagaagaggctttcctcacgtcaactttatgcctatattatccaactgaagctgcaacagaaa

SEQ ID NO: 300881 - DNA, 75 bp, Artificial Sequence
  Synthetic
agataaatatcgatatgaatacgatgtgatgaaagataagccatattatctagtaacatgggcaaattcatctat

SEQ ID NO: 300882 - DNA, 75 bp, Artificial Sequence
  Synthetic
attttcagtcgatccgcaattatattgtgattataatgtagtattaatgaaatatgacgcgaatctgcaattgga

SEQ ID NO: 300883 - DNA, 75 bp, Artificial Sequence
  Synthetic
tcatcgcctatgtctatactagttgcactagtagacattaatggcacattcattacaaatgaagaactagagtta

SEQ ID NO: 300884 - DNA, 75 bp, Artificial Sequence
  Synthetic
ttagcaggttacaaagaacaaattactactaaagatgaaatagaaaaacaaatggacagagtcgttaaagaaatg

SEQ ID NO: 300885 - DNA, 75 bp, Artificial Sequence
  Synthetic
atttctatgggatcttcatgcacgataaaagtatgtccacttaacacgcagactcttggaattggttgtttggct

SEQ ID NO: 300886 - DNA, 75 bp, Artificial Sequence
  Synthetic
taccaaaaatgatacaagactggttaatagatcgctcaatagaaaaatttccattaatggctaaaatatattcat

SEQ ID NO: 300887 - DNA, 75 bp, Artificial Sequence
  Synthetic
agaatatacaatgttaataagagatgaggttgtaaaaatgttggaagagccagttaaacatgatgaccatttact

SEQ ID NO: 300888 - DNA, 75 bp, Artificial Sequence
  Synthetic
ggcaagtattttacactgtagttgattacgtaaaccaaataatccaagcgatgtccaaaagatcacgatcactaa

SEQ ID NO: 300889 - DNA, 75 bp, Artificial Sequence
  Synthetic
aagaatatgcaggttatggatgatatggcaaaaggtagctatactccaggagtaataccaccagtaaatgttgaa

SEQ ID NO: 300890 - DNA, 75 bp, Artificial Sequence
  Synthetic
ttacgtaaaccaaataatccaagcgatgtccaaaagatcacgatcactaaattctgccgctttctattatagggt

SEQ ID NO: 300891 - DNA, 75 bp, Artificial Sequence
  Synthetic
aatttttatactaccatatgaatatttcatagctcagcatgctgtggtagagaaaatgttggtatatgcaaaaca

SEQ ID NO: 300892 - DNA, 75 bp, Artificial Sequence
  Synthetic
ggcttttttttgaaaagtcttgtgttagccatggcaacctttaaggatgcttgctttcattatagaagggttaca

SEQ ID NO: 300893 - DNA, 75 bp, Artificial Sequence
  Synthetic
ttgctttcattatagaagggttacaaaactaaacagagaattgctgagaattggagcaaattcagtatggactcc

SEQ ID NO: 300894 - DNA, 75 bp, Artificial Sequence
  Synthetic
cagtggtgcatccaaaacaaacgttgcttcttggacaatgaaccacatcttttaaaattaagaacttttgaatct

SEQ ID NO: 300895 - DNA, 75 bp, Artificial Sequence
  Synthetic
tttaaaattaagaacttttgaatctccaataacgaaggaaaaattacaatgcattattaatttatatgaattact

SEQ ID NO: 300896 - DNA, 75 bp, Artificial Sequence
  Synthetic
gtgatgtaataaaaaagattcaatacggtgcagttgcgtcaggtgaaaaacaaactaaagcagcgaattcaattg

SEQ ID NO: 300897 - DNA, 75 bp, Artificial Sequence
  Synthetic
caaatcatggtataatcagctactgcttccaattactttaaatgctgcagttttcaagtttcactcaagggatgt

SEQ ID NO: 300898 - DNA, 75 bp, Artificial Sequence
  Synthetic
cttccaattactttaaatgctgcagttttcaagtttcactcaagggatgtttatgtttttggattttatgaagga

SEQ ID NO: 300899 - DNA, 75 bp, Artificial Sequence
  Synthetic
ttttcaagtttcactcaagggatgtttatgtttttggattttatgaaggatcatcaccatgcatagatttgccat

SEQ ID NO: 300900 - DNA, 75 bp, Artificial Sequence
  Synthetic
attacagttcgcaaatgaaattactaaaagcatggttcagagcgtttcaaatgatgtacgagacgcgtatgcgcg

SEQ ID NO: 300901 - DNA, 75 bp, Artificial Sequence
  Synthetic
ttccagataatttacaatccatctatgcaaacaaatacttcaaattaagtagacttccttcaatgaagctaaaac

SEQ ID NO: 300902 - DNA, 75 bp, Artificial Sequence
  Synthetic
atacttaacaatgaaaaaagaggtcaaaacacacaatgggatcaagcagctgtattatattcaaactacattgtt

SEQ ID NO: 300903 - DNA, 75 bp, Artificial Sequence
  Synthetic
tgtgattacaatttagtcctgatgaaatacgattcaactctagaattagatatgtctgaattggcggatcttata

SEQ ID NO: 300904 - DNA, 75 bp, Artificial Sequence
  Synthetic
atcttactgaattcacctgggattctcaaactgatttacatcatgatctgattaatgataaagataaaatacttg

SEQ ID NO: 300905 - DNA, 75 bp, Artificial Sequence
  Synthetic
ctgaacgagtactaacaacaaattcgacatttaaagtatttgattcagaagatttcattattgaatatggaacaa

SEQ ID NO: 300906 - DNA, 75 bp, Artificial Sequence
  Synthetic
acaatttgaaacacatgatttaaatttggggagaataaaagctgacatttttgaacttggacatcactgcaaacc

SEQ ID NO: 300907 - DNA, 75 bp, Artificial Sequence
  Synthetic
tggtacgcgtttacatcttctatgaaacaaggtaatactcttgatgtatgtaagaaactactctttcaaaagatg

SEQ ID NO: 300908 - DNA, 75 bp, Artificial Sequence
  Synthetic
tgtatctaaattatcaagtcaactgcttgttactaagaatgctatagtttcaaaaggaattgctcaaacagaaaa

SEQ ID NO: 300909 - DNA, 75 bp, Artificial Sequence
  Synthetic
gaatcaatgtacaatgaacttttaagctttatccaatcttgctataaaagtaatgttaatgtaggacattgtagt

SEQ ID NO: 300910 - DNA, 75 bp, Artificial Sequence
  Synthetic
tcaattgaaaaagcttatccattagttaaagatatactttggcattcaattactgaatatattgatcaaactgtt

SEQ ID NO: 300911 - DNA, 75 bp, Artificial Sequence
  Synthetic
aacaaaataaccattaacgatatactaaaagatataaaaccgttttttacaactacagaaagttatttaccaata

SEQ ID NO: 300912 - DNA, 75 bp, Artificial Sequence
  Synthetic
tgcatataaatacctatcaacaggaaaagccaaggtgtgttgtgttaagttaactgctatggacttagaactacc

SEQ ID NO: 300913 - DNA, 75 bp, Artificial Sequence
  Synthetic
tgatactggaaaccgaggctcttccatttactttcacattgaatcagttcaattctataattaaagggattgtga

SEQ ID NO: 300914 - DNA, 75 bp, Artificial Sequence
  Synthetic
cagcgatatcaaaattaatatcaagatattcagtgtatagaccatcaattgaggaactatatagagtaatatcgc

SEQ ID NO: 300915 - DNA, 75 bp, Artificial Sequence
  Synthetic
atatgagcttctgatctcggactctgaagatgacgactaatgattgaattaactatcaccacagtttttgccatc

SEQ ID NO: 300916 - DNA, 75 bp, Artificial Sequence
  Synthetic
tagaatattagaatcgtatgtgtataacttgctatcggttaattatggatgttatcaactatttgacttcaattc

SEQ ID NO: 300917 - DNA, 75 bp, Artificial Sequence
  Synthetic
gctattaaaaatggtgcgtggattagcttattttgtaattacccaaaatctgagatgataaaattatggaaaaaa

SEQ ID NO: 300918 - DNA, 75 bp, Artificial Sequence
  Synthetic
tgagatgataaaattatggaaaaaaatgtggaaaattacatcattaagatcaccgtatacaaacgcaaacttctt

SEQ ID NO: 300919 - DNA, 75 bp, Artificial Sequence
  Synthetic
agataaaaaagatcaggataaattttataattcaataatttatggtattgcgccaccgccacaattcaaaaaacg

SEQ ID NO: 300920 - DNA, 75 bp, Artificial Sequence
  Synthetic
tgtacgaacgctagatgaatgggagaatggaaagaatccatacgaaccaagtgaagtgaccgcatcattgtgaga

SEQ ID NO: 300921 - DNA, 75 bp, Artificial Sequence
  Synthetic
tgccaattttagatcaaaatttcattgagtataaaattacagtaaatgaagacaaaccaatctcagagtcacatg

SEQ ID NO: 300922 - DNA, 75 bp, Artificial Sequence
  Synthetic
aattccaagcccgcaaacactatttcactattataacgtaaatgtaaattttcattctattacaacgaacgaatt

SEQ ID NO: 300923 - DNA, 75 bp, Artificial Sequence
  Synthetic
gatcgcaaccattgcatgataatttaatgggaactatgtggctaaacgcaggatcagaaatacaagttgcaggat

SEQ ID NO: 300924 - DNA, 75 bp, Artificial Sequence
  Synthetic
ctgataatatatatgtagcaaatgctagtggcgtattgtcaacttattttaaattatacaacatgttctatagaa

SEQ ID NO: 300925 - DNA, 75 bp, Artificial Sequence
  Synthetic
tttgatacaattagactgtcatttcaattgatgcgcccaccaaatatgacgccagcagttaatgctcttttccca

SEQ ID NO: 300926 - DNA, 75 bp, Artificial Sequence
  Synthetic
gtatggtattgaatataccacaattctaacttttttgatatcaatcattttgttgaattattcgctaaaatcatt

SEQ ID NO: 300927 - DNA, 75 bp, Artificial Sequence
  Synthetic
ttaacatgtagctatatcaagtcatacagactctgtaagtaagggtatatttatatattcgctacacagagtaac

SEQ ID NO: 300928 - DNA, 75 bp, Artificial Sequence
  Synthetic
acaggttctatggatactccatacgctaattctacacaagaagagacatttctaacttctactctgtgcttatat

SEQ ID NO: 300929 - DNA, 75 bp, Artificial Sequence
  Synthetic
ggatggccaactggatctatatatttcaaagagtatactgatattgcaactttttcagtggatcctcaactgtat

SEQ ID NO: 300930 - DNA, 75 bp, Artificial Sequence
  Synthetic
tggacataactttatattattatcagcaaactgatgaagcaaataaatggatatcaatgggttcatcatgtacga

SEQ ID NO: 300931 - DNA, 75 bp, Artificial Sequence
  Synthetic
tactgatgtagtcgatggcgttaatcataagttggatgttaccacagcaacatgtacaattagaaattgcaaaaa

SEQ ID NO: 300932 - DNA, 75 bp, Artificial Sequence
  Synthetic
atcagaaagaaatacaatatgaaattctacaaaaaacgataccaacttttgaaccaaaagaatcaattttgaaaa

SEQ ID NO: 300933 - DNA, 75 bp, Artificial Sequence
  Synthetic
ggctttttttaagaaaagtcttgtgttagccatggctactttcaaagatgcctgttttcattaccgtagattgac

SEQ ID NO: 300934 - DNA, 75 bp, Artificial Sequence
  Synthetic
cacttactttgcaagcattagctataaaattagagaataacacatattatgtatttgggtactatgattgtatgg

SEQ ID NO: 300935 - DNA, 75 bp, Artificial Sequence
  Synthetic
gatagattactattggatgatagaaactttaataggatggcatatttaccaccaatattacaacaagaatatgca

SEQ ID NO: 300936 - DNA, 75 bp, Artificial Sequence
  Synthetic
accaatattacaacaagaatatgcattgagatatttttcgaagtcgagatttatagataaaccgagcagagaact

SEQ ID NO: 300937 - DNA, 75 bp, Artificial Sequence
  Synthetic
gatgaatggaataaagcctgcacacaggtcatgagtgctaaagattacatggagataataaatactgcatatact

SEQ ID NO: 300938 - DNA, 75 bp, Artificial Sequence
  Synthetic
aggtcatgagtgctaaagattacatggagataataaatactgcatatactgaacactatagtgtctcacaaaggt

SEQ ID NO: 300939 - DNA, 75 bp, Artificial Sequence
  Synthetic
aagtttgatgaaaataatctttattatgtatttgggttatatgagaaatcagtcagcgatacatatattccatat

SEQ ID NO: 300940 - DNA, 75 bp, Artificial Sequence
  Synthetic
tgctataaaatatgggaagattttagaattaagaaaatatataataatgtattagattttatcagagcattgtct

SEQ ID NO: 300941 - DNA, 75 bp, Artificial Sequence
  Synthetic
caaagaaatacttccaggtgtcaagaatgccatcatcaaagttaaagcaaatttacttttcagactttaccaaag

SEQ ID NO: 300942 - DNA, 75 bp, Artificial Sequence
  Synthetic
agttatttcgtccattgaatggtacttacggtctatggaactatcagatgacattaaatcagatattgaacaaca

SEQ ID NO: 300943 - DNA, 75 bp, Artificial Sequence
  Synthetic
cttaaaaaatgacaagaacaaattgattgctgcaatgatgacgagtaaatatactcgattctatgctcatgataa

SEQ ID NO: 300944 - DNA, 75 bp, Artificial Sequence
  Synthetic
gaatatgtgctgtttgatcatgagattaattgggaagtaaggggtttaattttgcagtgcatgaatggaaatatt

SEQ ID NO: 300945 - DNA, 75 bp, Artificial Sequence
  Synthetic
taattttgggagattgaaaatgacaatatttgaattggggcatcattgtcagcctaactatatagcatctaacca

SEQ ID NO: 300946 - DNA, 75 bp, Artificial Sequence
  Synthetic
ttaatcaaaagattaatttggagtttatttactaatcatatagatcaaacaattgaagaagtgtttaaccatatg

SEQ ID NO: 300947 - DNA, 75 bp, Artificial Sequence
  Synthetic
tcattctcaattgatccacaactttattgtgattataatgttgtactgatgaagtatgattcaacgttagagcta

SEQ ID NO: 300948 - DNA, 75 bp, Artificial Sequence
  Synthetic
agtggcaaatggtataatgttaatgaattggctaaactgccaatgtcgataaaatcaacggaagagctgattaaa

SEQ ID NO: 300949 - DNA, 75 bp, Artificial Sequence
  Synthetic
ttaaaacagtattgtcaagaattgcgaacaaatattcttttataaccaagataattagagtagatggtgatgaca

SEQ ID NO: 300950 - DNA, 75 bp, Artificial Sequence
  Synthetic
tatggagcagatcgaacgagcttcagataaaattgctcaaggagtaataattgcttatagagatatgcaactaga

SEQ ID NO: 300951 - DNA, 75 bp, Artificial Sequence
  Synthetic
tactgtagacttatctgatgaaatacaagaaattggatcaacaaaaacacaaaacgttacagtgaatccaggacc

SEQ ID NO: 300952 - DNA, 75 bp, Artificial Sequence
  Synthetic
actttcaatccaccagtagattattggatgttactagctccaacagtaccaggtgtagtagtagagggaacaaat

SEQ ID NO: 300953 - DNA, 75 bp, Artificial Sequence
  Synthetic
aaaacacctcacaagatcagtggaagtttattgatgtagttaaaacaacggcaaatggtagcattgggcaatacg

SEQ ID NO: 300954 - DNA, 75 bp, Artificial Sequence
  Synthetic
tggtttatcaatatcactagcttcaaaaccaactggtaataatcatttgttcattttaagtggaacagacaagta

SEQ ID NO: 300955 - DNA, 75 bp, Artificial Sequence
  Synthetic
ttctacaacgaattatgattcagtaaatatgactgcattttgcgatttttacataataccacgcacagaagaagc

SEQ ID NO: 300956 - DNA, 75 bp, Artificial Sequence
  Synthetic
ttcgatattatatgtagacatacgaacggatagagaaaatatagattggaaaacgtggaggaaaattgtagagga

SEQ ID NO: 300957 - DNA, 75 bp, Artificial Sequence
  Synthetic
gctcaggcaaatgaggatatagtaatttcaaagacgtcattgtggaaagagatgcaacataatagagatataact

SEQ ID NO: 300958 - DNA, 75 bp, Artificial Sequence
  Synthetic
cacgtgatggagaagaagtcactgctcatactacatgttctgttaatggagtaaatgatttcagttttaatggag

SEQ ID NO: 300959 - DNA, 75 bp, Artificial Sequence
  Synthetic
tatggtttatgtacgttctttagctgcaaatttgaattcagtaatgtgtacagggggtagctataatttcagtct

SEQ ID NO: 300960 - DNA, 75 bp, Artificial Sequence
  Synthetic
cattatttgccttaactaaagctcagaattatggacttaatataccaataacaggatcaatggatactgtatatt

SEQ ID NO: 300961 - DNA, 75 bp, Artificial Sequence
  Synthetic
tgcaagagaattgatagtattatcatattctaatagatcaactttggcaaaactagtgtcatctccaatgtcaat

SEQ ID NO: 300962 - DNA, 75 bp, Artificial Sequence
  Synthetic
tcactaagatttagattcagattggcagttgaagaaccatattttagattaacacgaactagaatggataggttg

SEQ ID NO: 300963 - DNA, 75 bp, Artificial Sequence
  Synthetic
agacaccaatcgcgaattcagttactgttagacaagatttagaaagacaactaggagaactaagagaagagttca

SEQ ID NO: 300964 - DNA, 75 bp, Artificial Sequence
  Synthetic
atttattatagatataactattcatttgatcttaagcgatggatatacttacactcaacaaacaaggctagtatt

SEQ ID NO: 300965 - DNA, 75 bp, Artificial Sequence
  Synthetic
cgctgctaaatctatggcgacgaatgtgatgaaaaaattcaaaaaatctgggttggcgaattcagtatcgacctt

SEQ ID NO: 300966 - DNA, 75 bp, Artificial Sequence
  Synthetic
ataactgatatatcattaccaataagttcaatatctactcaaacatctactatcagtaaaagattaagacttaaa

SEQ ID NO: 300967 - DNA, 75 bp, Artificial Sequence
  Synthetic
agacgaaatttatgtagcaaatgtaagtggcgtgttatcaacatattttaaactttataacgcgttctacaaaga

SEQ ID NO: 300968 - DNA, 75 bp, Artificial Sequence
  Synthetic
ttcctgatattgtaactgaagcgtcagaaaaatttataccaaatcgagcgtatagagttatcaacaacgatgatg

SEQ ID NO: 300969 - DNA, 75 bp, Artificial Sequence
  Synthetic
ttcgccagtgatttcagctataattgattttaagactttaaaaaatttaaacgataattatggtattactaagca

SEQ ID NO: 300970 - DNA, 75 bp, Artificial Sequence
  Synthetic
gatccacgtgtactacgtgaatttattaatcaggataatccaataataagaaatagaatagaacaattgattatg

SEQ ID NO: 300971 - DNA, 75 bp, Artificial Sequence
  Synthetic
atgttttccatgttttcaggaattaaaagcacaattgatttaactaaatcaatggcgactagtgtaatgaagaaa

SEQ ID NO: 300972 - DNA, 75 bp, Artificial Sequence
  Synthetic
aatttaatgggaaccatgtggcttaatgctggatcagaaattcaagtagctggatttgattactcgtgtgctcta

SEQ ID NO: 300973 - DNA, 75 bp, Artificial Sequence
  Synthetic
tatattacatccaattgatcatgcatttaacgaatacttcttacagcatcaattagtagaaccgttaaataacga

SEQ ID NO: 300974 - DNA, 75 bp, Artificial Sequence
  Synthetic
acatgaccctctatgagcacaatagttaaaagctaacactgtcaaaaacctaaatggctataggggcgttatgtg

SEQ ID NO: 300975 - DNA, 75 bp, Artificial Sequence
  Synthetic
cattgatggatccagcaattttaacttcattgtcatcaaatttaaatgcagttatgttctggttggaaaaacatg

SEQ ID NO: 300976 - DNA, 75 bp, Artificial Sequence
  Synthetic
tcacacttttcaattaatgtattagagaacatacataatccaagtttcaaaatacagattacacgtaattgtagc

SEQ ID NO: 300977 - DNA, 75 bp, Artificial Sequence
  Synthetic
attagactttgtaacgacaaattatatgtcactcatctcaggtatgtggttacttactgtgattccaaacgatat

SEQ ID NO: 300978 - DNA, 75 bp, Artificial Sequence
  Synthetic
gccacttcaacattagaattgatgggtattcaatatgattataatgaagtatttactagagtcaagagtaaattt

SEQ ID NO: 300979 - DNA, 75 bp, Artificial Sequence
  Synthetic
gtataacgatgaatatgcaacacgtacaaacattaacgaccgagaaattgcaactaacatcagtaacatcattat

SEQ ID NO: 300980 - DNA, 75 bp, Artificial Sequence
  Synthetic
aatattcatcttaccatatgaatattttatagcacaacacgctgtagttgaaaaaatgctaatttatgcaaaaca

SEQ ID NO: 300981 - DNA, 75 bp, Artificial Sequence
  Synthetic
ttgaagaattaatgagatcgggagattatgctcaaattactaacatgctgcttaacaatcaaccagtagctttag

SEQ ID NO: 300982 - DNA, 75 bp, Artificial Sequence
  Synthetic
atgtctaagaggtccagatcactgaattcagcagcgttttattatagagtgtaggtattatgtagattagagttg

SEQ ID NO: 300983 - DNA, 75 bp, Artificial Sequence
  Synthetic
ttggagcattaccatttataacggactcatcagtaatttcgctaatagctaaattagatgcaaccgtctttgcac

SEQ ID NO: 300984 - DNA, 75 bp, Artificial Sequence
  Synthetic
gagataataactgatgcacaagatgacgttaaaatagctgatgaagttaagaagtcatcaaaagaagaatcgaaa

SEQ ID NO: 300985 - DNA, 75 bp, Artificial Sequence
  Synthetic
aataacagcaaaattacttcatcatccaactactgaaattagatcagaattttatgcaatcttagatgtatggga

SEQ ID NO: 300986 - DNA, 75 bp, Artificial Sequence
  Synthetic
tgaaagtactagctttaagacacagtgtggctcaagtgtatgcagacactcaagtctacattcatgatgatacaa

SEQ ID NO: 300987 - DNA, 75 bp, Artificial Sequence
  Synthetic
gggaatagctgcaattgctttacagtcacttgaagaactatttacattaataaggtgtaattttacttacgatta

SEQ ID NO: 300988 - DNA, 75 bp, Artificial Sequence
  Synthetic
tcacttgaagaactatttacattaataaggtgtaattttacttacgattatgaatctgatataatatatttgcat

SEQ ID NO: 300989 - DNA, 75 bp, Artificial Sequence
  Synthetic
actttgtatcaatactatgacatgtatcataagaagccaataatatacatgataggatcagcgccttcatattgg

SEQ ID NO: 300990 - DNA, 75 bp, Artificial Sequence
  Synthetic
atgatgtaaagaaattgaaggataattcaatattatatattgatataagaactgatagaggtaacattgactgga

SEQ ID NO: 300991 - DNA, 75 bp, Artificial Sequence
  Synthetic
gacagcgatggatttagaactgccaatttcagctaaattgctacatcatccaactacagaaataagatcagaatt

SEQ ID NO: 300992 - DNA, 75 bp, Artificial Sequence
  Synthetic
caactacagaaataagatcagaattttatttattactagatatttgggacttaactaatattagaagattcgttc

SEQ ID NO: 300993 - DNA, 75 bp, Artificial Sequence
  Synthetic
ggctataaaatggcttctttgatttacagacagttactatccaattcgtacgtaacgaatatttcagacgaggtt

SEQ ID NO: 300994 - DNA, 75 bp, Artificial Sequence
  Synthetic
catgttaattggaaatactacagttattccaagtccacaaacactgttccactattacaatgtaaatgtaaattt

SEQ ID NO: 300995 - DNA, 75 bp, Artificial Sequence
  Synthetic
tttaataaccgttagaataaataatacgtttagagatgatccaaaagttggattcaaaaatatctatgattggac

SEQ ID NO: 300996 - DNA, 75 bp, Artificial Sequence
  Synthetic
acattcaatttgccagttgactattggatgctaattgcgcctacccaaacaggtagagtggcagagggtacaaac

SEQ ID NO: 300997 - DNA, 75 bp, Artificial Sequence
  Synthetic
tctaacaataaacaatgacaacagcaatgtgtcgtgtgatgctgaattctatttgataccaagatcgcagaccga

SEQ ID NO: 300998 - DNA, 75 bp, Artificial Sequence
  Synthetic
ccgatgaattaccaatatacttatacgagagacggggaggagataacagcacatacaacatgttcagttaacgga

SEQ ID NO: 300999 - DNA, 75 bp, Artificial Sequence
  Synthetic
attaacgcagttgcttttgacaatatgcgcattatgaacgaactgtaaacgccaaccccactgtggagatatgac

SEQ ID NO: 301000 - DNA, 75 bp, Artificial Sequence
  Synthetic
tttctgataacatggtgccggatgtgattaatatattgaatatgatgaaaaatgaattatttaaaatggatgtta

SEQ ID NO: 301001 - DNA, 75 bp, Artificial Sequence
  Synthetic
caaccagttatacatatatgctatcagatggaatctacgtggcgaatatcagtggagtgctatctacatatttta

SEQ ID NO: 301002 - DNA, 75 bp, Artificial Sequence
  Synthetic
gggacgattcgcaagcatttaggaatatggtatatgttagatcattatcggctaatttaaatgatgtaatctgta

SEQ ID NO: 301003 - DNA, 75 bp, Artificial Sequence
  Synthetic
agttctattttatttgatatcattcgtttttgtgagttatattctaaaaactataacaagaataatggactatat

SEQ ID NO: 301004 - DNA, 75 bp, Artificial Sequence
  Synthetic
tatgccaattcaacacaaagcgatgatttcttgtcttcaactttatgtttatactatccaactgaagctcaaact

SEQ ID NO: 301005 - DNA, 75 bp, Artificial Sequence
  Synthetic
agacgccaatagctaattctgtgacagtgagacaggacttagaaaggcagcttggtgagttgagagaagagttta

SEQ ID NO: 301006 - DNA, 75 bp, Artificial Sequence
  Synthetic
tagaattttcaattgatccaaagttgtattgtgattataatatcgtactgattagatttgcttctggagaagagt

SEQ ID NO: 301007 - DNA, 75 bp, Artificial Sequence
  Synthetic
aacaaatttggctctgctataaggaacagaaattggcttgctgatacttctagagcagctaagttggatgaggat

SEQ ID NO: 301008 - DNA, 75 bp, Artificial Sequence
  Synthetic
actcactatcacaagaaattgcgttgtcgcaactgattgatttggcgacattaccgcttgacatgttctcaatgt

SEQ ID NO: 301009 - DNA, 75 bp, Artificial Sequence
  Synthetic
tcttcaattagtagatctacatccataagatcagtaggtagtaacacaacagtgcgaattagtactgctatacaa

SEQ ID NO: 301010 - DNA, 75 bp, Artificial Sequence
  Synthetic
ctatagtcgatgtcgttgatagtgtaaatcataaattggatgtcacgtccacaacatgtacaatccgaaattgta

SEQ ID NO: 301011 - DNA, 75 bp, Artificial Sequence
  Synthetic
aaattatggaattaatctaccaattactggttcaatggatactgcatacgctaattctacacaagaagaaacttt

SEQ ID NO: 301012 - DNA, 75 bp, Artificial Sequence
  Synthetic
ctaattctacacaagaagaaacttttctcacatcaactttgtgtttatactatccaactgaagctgcaacagaga

SEQ ID NO: 301013 - DNA, 75 bp, Artificial Sequence
  Synthetic
taaacaacaataatcctataattagaaatagaatagaaaatctgatagcgcaatgtagattgtaactgtctgttc

SEQ ID NO: 301014 - DNA, 75 bp, Artificial Sequence
  Synthetic
ataataactgatgtacaagatgacattaaaatagctgatgaggttaaaaaatcatcaaaagaagagtcgaaacag

SEQ ID NO: 301015 - DNA, 75 bp, Artificial Sequence
  Synthetic
gaaaatccacaagatattctatttcattcaaaggatttacttttaagatcaactttgattgctattggacagtct

SEQ ID NO: 301016 - DNA, 75 bp, Artificial Sequence
  Synthetic
gaagttaaaattgctgatgaagtgaagaaatcgacgaaagaagaatctaagcaattacttgaagtgttgaaaacg

SEQ ID NO: 301017 - DNA, 75 bp, Artificial Sequence
  Synthetic
ggatgtcctctattctttgtcaaaaactcttaaagatgctagagacaaaattgtcgaaggcacactgtactcaaa

SEQ ID NO: 301018 - DNA, 75 bp, Artificial Sequence
  Synthetic
ggtgaaaataagcagtttaacgtagaaaatagttcagataaatggaaatttttcgaaatgtttaaaggtagtagt

SEQ ID NO: 301019 - DNA, 75 bp, Artificial Sequence
  Synthetic
aattttgattttggtttactaggtacgacattacttaatcttgatgctaattatgttgaaactgctcgcaccaca

SEQ ID NO: 301020 - DNA, 75 bp, Artificial Sequence
  Synthetic
tagagaatcacagcggaatggaatagcacctcagtctgatgctctaaggaaattgtcaggcataaagtttaaaag

SEQ ID NO: 301021 - DNA, 75 bp, Artificial Sequence
  Synthetic
ttttcataagccaaacatattcccctattcagcatcgttcactcttaatagatctcaaccacaacatgataatct

SEQ ID NO: 301022 - DNA, 75 bp, Artificial Sequence
  Synthetic
atataaagatgtaacagaaaaagcaactctactatccatattatcatactcatatgataaatataatgcagttga

SEQ ID NO: 301023 - DNA, 75 bp, Artificial Sequence
  Synthetic
agacagcgcgtacaagctgacagaaatgttgttaactacccatcaatattgcatccaattgattacgctttcaac

SEQ ID NO: 301024 - DNA, 75 bp, Artificial Sequence
  Synthetic
ccgacagctgaagaatatacggattcattaatggatccagcgatattaacatcgttatcttcaaatttaaatgca

SEQ ID NO: 301025 - DNA, 75 bp, Artificial Sequence
  Synthetic
gaagttgaatttttgttgaatgggcaaataattaatacgtatcaggctagatttggcacaattatcgccaggaac

SEQ ID NO: 301026 - DNA, 75 bp, Artificial Sequence
  Synthetic
aaataattaatacgtatcaggctagatttggcacaattatcgccaggaactttgacactattagattgtcatttc

SEQ ID NO: 301027 - DNA, 75 bp, Artificial Sequence
  Synthetic
aattcaaaagatgtcacaagatttgcaattagaagcattaacaatacagtcagaaacgcagtttttaacaggcat

SEQ ID NO: 301028 - DNA, 75 bp, Artificial Sequence
  Synthetic
ataaatatggagtaccaagacataacgcaaagtacagatatgagtacgaagtaatgaaagataagccatattacc

SEQ ID NO: 301029 - DNA, 75 bp, Artificial Sequence
  Synthetic
cgattcagccatttgtgaatctgtactcgctgacgccaccgaaacaatgttggctaatgtcacagctgttaggca

SEQ ID NO: 301030 - DNA, 75 bp, Artificial Sequence
  Synthetic
gttaattggaaataccacagtaattccaagtccacaaacactatttcactattataacgtaaatgtgaattttca

SEQ ID NO: 301031 - DNA, 75 bp, Artificial Sequence
  Synthetic
gtggaaaaatattctttagggctggaataaatttactgaacaatgaaaagagaggacaaagtacacagtgggatc

SEQ ID NO: 301032 - DNA, 75 bp, Artificial Sequence
  Synthetic
tagatctactttagccaagctggtttcatctccaatgtctatactagttgcattaatagatataaacggtacatt

SEQ ID NO: 301033 - DNA, 75 bp, Artificial Sequence
  Synthetic
agaggacaaagtacacagtgggatcaagcagctgtcttatattcaaactatattgtgaatagacttcgaggattt

SEQ ID NO: 301034 - DNA, 75 bp, Artificial Sequence
  Synthetic
gtgtttactgtggcctccattagaagcatgcttgttaagtgaggaccaagctagcaccttggtatccaatcttat

SEQ ID NO: 301035 - DNA, 75 bp, Artificial Sequence
  Synthetic
gcatgcttgttaagtgaggaccaagctagcaccttggtatccaatcttatcacgcatgtagctatatcaagctgc

SEQ ID NO: 301036 - DNA, 75 bp, Artificial Sequence
  Synthetic
atgaaaaaagccggtttagtagatatacctaaaatgatacaagattggctggttgattgttcgattgagaaattt

SEQ ID NO: 301037 - DNA, 75 bp, Artificial Sequence
  Synthetic
cacgcatgtagctatatcaagctgctcagactttacaagtaagggtatattggtacattcgctacgtaaagaact

SEQ ID NO: 301038 - DNA, 75 bp, Artificial Sequence
  Synthetic
aaaatgttgatgatgagatgtacagggaatatacaatgctaattagagacgaaatagtaaaaatgctcgaggagg

SEQ ID NO: 301039 - DNA, 75 bp, Artificial Sequence
  Synthetic
aatgttcatataaagtaattaaatactgtattgtatcaatatttaatactctactgaaattagctgggtacaagg

SEQ ID NO: 301040 - DNA, 75 bp, Artificial Sequence
  Synthetic
tcgaaagactattttttcaactaagaaaaacatgcatgtgatggatgatatggcaaatggaaaatatacaccagg

SEQ ID NO: 301041 - DNA, 75 bp, Artificial Sequence
  Synthetic
aatagaacaggtagagttacttaaacgaattcatgacatgctaataattaaaccagttgataagattgatatgtc

SEQ ID NO: 301042 - DNA, 75 bp, Artificial Sequence
  Synthetic
tttattgcacagcatgctgttgtggagaagatgctcatttatgccaaacatacgagagaatatgcggaattttat

SEQ ID NO: 301043 - DNA, 75 bp, Artificial Sequence
  Synthetic
gatgtgtcacagtgggattcatcccaacataatacccaaccatttaggaaaggaataatcatgggactagatatg

SEQ ID NO: 301044 - DNA, 75 bp, Artificial Sequence
  Synthetic
attaataatacgaaacaacacaaatgtagaaatgaatgtatgacacagtggtataatcacttactaatgccaata

SEQ ID NO: 301045 - DNA, 75 bp, Artificial Sequence
  Synthetic
aaaaccaatattatataaaataaattcagattcaaatgacttctacctagttgccaattacgattgggtgcccac

SEQ ID NO: 301046 - DNA, 75 bp, Artificial Sequence
  Synthetic
aaacaaatggttcaggatgtttcaaatgatgtaagagatacatatgcaagaatgaacgccaaagttaaagcactt

SEQ ID NO: 301047 - DNA, 75 bp, Artificial Sequence
  Synthetic
ttgcttgcattcgtatcagctgatacagtagaacctataaatgcagttgcatttgataacatgcgcatcatgaac

SEQ ID NO: 301048 - DNA, 75 bp, Artificial Sequence
  Synthetic
agagtactcagtgggatcaagcagcagtgttatattcaaactacatagttaatcatttacgagggtttgaaacag

SEQ ID NO: 301049 - DNA, 75 bp, Artificial Sequence
  Synthetic
gacatttaaagtattcgattctgaggactttataatagaatatggtacaacagatgatgaagtatatatacaaag

SEQ ID NO: 301050 - DNA, 75 bp, Artificial Sequence
  Synthetic
ttaataaggtggctatgttaatttgcgaagcattgaattcaattaaggttactcaatctgatattgcaagtgtcc

SEQ ID NO: 301051 - DNA, 75 bp, Artificial Sequence
  Synthetic
aagcaattttcaaacggtgcatatatcgtaaaacatactattaaattgaagcaggagagatggttgggtaaaaga

SEQ ID NO: 301052 - DNA, 75 bp, Artificial Sequence
  Synthetic
ttagtatctaaaaatacgattgtatcacgagggatagcgctgacagaaaaagcgaagctgaactcatatgcacca

SEQ ID NO: 301053 - DNA, 75 bp, Artificial Sequence
  Synthetic
tacacgacatcaaaccattctttgtgactagtgaatctagtttaccaatccaatatcaaaaatttatgccaacac

SEQ ID NO: 301054 - DNA, 75 bp, Artificial Sequence
  Synthetic
atattcagtatacagaccttcaatagaggagttatataaagtgatatcattacatgagcaagagattcagttgta

SEQ ID NO: 301055 - DNA, 75 bp, Artificial Sequence
  Synthetic
tcgcatacttgaatcatacgtatataacttattatcaatcaattacggttgctatcaactgtttgatttcaattc

SEQ ID NO: 301056 - DNA, 75 bp, Artificial Sequence
  Synthetic
tggctagcggttagctccttttaatgtatggtattgaatataccacaattctaaattcattaatactggttgtat

SEQ ID NO: 301057 - DNA, 75 bp, Artificial Sequence
  Synthetic
agaaatgataaagctatggaagaagatgtggaatattacttcattacgatctccttatactagcgcaaacttctt

SEQ ID NO: 301058 - DNA, 75 bp, Artificial Sequence
  Synthetic
aaactatgggattaatttaccgataacaggatcaatggatggcgcgtatactaatataactgatgataagccatt

SEQ ID NO: 301059 - DNA, 75 bp, Artificial Sequence
  Synthetic
ctccttaaacaaaggattaaacgtaaaagctaatttagattcatcgatatcgatatctacagatactaagaagga

SEQ ID NO: 301060 - DNA, 75 bp, Artificial Sequence
  Synthetic
ggttggcctatgggttcagtgtatttcaatgaatatgttaacatagctgaattttcaattaatccgcaacttttt

SEQ ID NO: 301061 - DNA, 75 bp, Artificial Sequence
  Synthetic
tggacgtgaccttatattattatcaacagaccgacgaagcaaacaagtggatatcaatgggtacgtcttgcacaa

SEQ ID NO: 301062 - DNA, 75 bp, Artificial Sequence
  Synthetic
ttaaaggttgtccattgaatacacaaacgcttgggattgggtgcttgaccactgatacgagttcatttgaaactg

SEQ ID NO: 301063 - DNA, 75 bp, Artificial Sequence
  Synthetic
tttaccgatctcaattatacactgagtgtgattacgcttatgaatgacacgctacatactataatggaagatcct

SEQ ID NO: 301064 - DNA, 75 bp, Artificial Sequence
  Synthetic
agtgttcatataaagtagttaaatattgtattgtgtccatattcaatactctactaaaactagctggttataaag

SEQ ID NO: 301065 - DNA, 75 bp, Artificial Sequence
  Synthetic
ggcaagtattctacacaattgttgattatatcaatcaaattgttaaagttatgtcaaaaagatccagatcattaa

SEQ ID NO: 301066 - DNA, 75 bp, Artificial Sequence
  Synthetic
aatagagcaagtagaactacttaaaagaatttatgatatgatgattgtcagacctactgaaaaagttgatatgtc

SEQ ID NO: 301067 - DNA, 75 bp, Artificial Sequence
  Synthetic
gggctgccgttgtctgtccacggaagcgacggagtccttaacagtaagcaccatcggacctgacaaccagctgag

SEQ ID NO: 301068 - DNA, 75 bp, Artificial Sequence
  Synthetic
ccatcggacctgacaaccagctgagaagccacagttggttgtatcgcgtgtgactaagtcttaatcccgtttaac

SEQ ID NO: 301069 - DNA, 75 bp, Artificial Sequence
  Synthetic
ctactttattgaatttggatgcaaattacgttgagacagctagaaccacaatagaatattttgttgattttatag

SEQ ID NO: 301070 - DNA, 75 bp, Artificial Sequence
  Synthetic
aactgtctggaattaaatttaaaagaattaattttgataactcttcagaatatatagaaaattggaatttgcaga

SEQ ID NO: 301071 - DNA, 75 bp, Artificial Sequence
  Synthetic
taaactatatagaagaagagagagtctattcagaatagtcgcgtcaactgttaataagtatggtgttccaagaca

SEQ ID NO: 301072 - DNA, 75 bp, Artificial Sequence
  Synthetic
aatgggaaccatgtggcttaatgctggttcagaaattcaggtagcaggatttgattactcttgtgctataaatgc

SEQ ID NO: 301073 - DNA, 75 bp, Artificial Sequence
  Synthetic
gatcataatgattatttaattgctgaagaacttattattaattcatattcaaacagatcaactttagcaaaaata

SEQ ID NO: 301074 - DNA, 75 bp, Artificial Sequence
  Synthetic
attagatggtccgtatcagccaactacattcaacttacctattaactattggatgctgatcgcaccaactcaagc

SEQ ID NO: 301075 - DNA, 75 bp, Artificial Sequence
  Synthetic
ccaagagtaattaattctgctgatggagctacaacatggtatttcaatccagtcgtactacgaccaaacaatgta

SEQ ID NO: 301076 - DNA, 75 bp, Artificial Sequence
  Synthetic
aacttatgcgtccaccaaatatgacagctgccgtcgctgccctgtttccaaatgctcagcctttcgaacatcatg

SEQ ID NO: 301077 - DNA, 75 bp, Artificial Sequence
  Synthetic
agactcgtgggaatattaaaatatggtggaagaatatggacatttcatggtgaaacaccgagggctactactgat

SEQ ID NO: 301078 - DNA, 75 bp, Artificial Sequence
  Synthetic
agaatatgctataccggttggaccagtgtttccaccaggaatgaattggactgatctaatcactaattattcacc

SEQ ID NO: 301079 - DNA, 75 bp, Artificial Sequence
  Synthetic
gatgaagtggtcaagatgttacaagaatcagttatacatgatgaccatttattagttgattcagagttagctggc

SEQ ID NO: 301080 - DNA, 75 bp, Artificial Sequence
  Synthetic
taaacatgtagctacattaagctaattagactttatacgtaagaacatgacttcatgttcgctacataaagtaac

SEQ ID NO: 301081 - DNA, 75 bp, Artificial Sequence
  Synthetic
atgtatggtattgaatataccacagttttgacctttttgatatcaattatattattgaattatattctaaaatca

SEQ ID NO: 301082 - DNA, 75 bp, Artificial Sequence
  Synthetic
tagagaaaatgttacaatatgctaagcatacgagagaatatgcagagttctactcacagtcaaatcaattgctgt

SEQ ID NO: 301083 - DNA, 75 bp, Artificial Sequence
  Synthetic
ggctctagtaggagcgttaccatttgtaacagactcatcagttatatcactcattgctaagttggatgctacagt

SEQ ID NO: 301084 - DNA, 75 bp, Artificial Sequence
  Synthetic
gtaacagactcatcagttatatcactcattgctaagttggatgctacagtttttgctcagatagtcaaacttaga

SEQ ID NO: 301085 - DNA, 75 bp, Artificial Sequence
  Synthetic
tactcacagtcaaatcaattgctgtcatatggtgacgtaacgcggtttttgtcagatgacgcacttgtgttatat

SEQ ID NO: 301086 - DNA, 75 bp, Artificial Sequence
  Synthetic
ttaggtcaattggcagtaatgcaacatcgcggattagtacagccattcaagctggtgatgatctgagaacagtag

SEQ ID NO: 301087 - DNA, 75 bp, Artificial Sequence
  Synthetic
agttgcgacgactgagaaattagcaattactgacgttgtggatggagtcaaccataaactgagcgtaacgacaaa

SEQ ID NO: 301088 - DNA, 75 bp, Artificial Sequence
  Synthetic
ctagcgtaatgaaaaaatttagaaaatcaaaattagctacatcagtttcagaaatgactaattcattgtcagacg

SEQ ID NO: 301089 - DNA, 75 bp, Artificial Sequence
  Synthetic
gttaataagttaagaggatttagtactgatagagagtttattttgactaaaataatgcaaatgacttcagttgca

SEQ ID NO: 301090 - DNA, 75 bp, Artificial Sequence
  Synthetic
gtatggtattgaatataccacaactctaacttttttgatattgcttgtattgttgaactatatattaaaatcaat

SEQ ID NO: 301091 - DNA, 75 bp, Artificial Sequence
  Synthetic
aatccaaaaacgttgaaagagtttataaataataataatccaataatacgaaacagaatagaaaatttgatagcg

SEQ ID NO: 301092 - DNA, 75 bp, Artificial Sequence
  Synthetic
atatgtctactcaaattgggaaaaatactttacctgacatagtcacagaggcatctgagaaatttattccaaaac

SEQ ID NO: 301093 - DNA, 75 bp, Artificial Sequence
  Synthetic
tttgtcaataaacccgcaattatactgtgactataacattgtactaatgaagtataatgctagttcagaattaga

SEQ ID NO: 301094 - DNA, 75 bp, Artificial Sequence
  Synthetic
agcgttaaatttaattaaatcgaatccaaatatgttacgtaatttcattaatcaaaataatccaattataaggaa

SEQ ID NO: 301095 - DNA, 75 bp, Artificial Sequence
  Synthetic
ggcaagtcttttacactgttgttgattacgtaaatcaaataatccaagcaatgtccaagagatcacgatcactag

SEQ ID NO: 301096 - DNA, 75 bp, Artificial Sequence
  Synthetic
ttacgtaaatcaaataatccaagcaatgtccaagagatcacgatcactagattcagcagcgttttactacagaat

SEQ ID NO: 301097 - DNA, 75 bp, Artificial Sequence
  Synthetic
aattgagaacttttgaatcaccaattactaaggaaaaattacaatgtattattgatttgtataatattctattcc

SEQ ID NO: 301098 - DNA, 75 bp, Artificial Sequence
  Synthetic
aatcactctaaatgctgcagtatttaagtttcattcaaggggaatttacatttttggattttacgaaggatcttc

SEQ ID NO: 301099 - DNA, 75 bp, Artificial Sequence
  Synthetic
agtaatttacaatccatttacgcaaataaatacttcaagttaagtagaattccttcaatgaagctaaagcaaatg

SEQ ID NO: 301100 - DNA, 75 bp, Artificial Sequence
  Synthetic
tgtgcttttaatgcaccagcaaatattcagcagtttgaacatgttgtaccactaagacgtgctcttacaacagct

SEQ ID NO: 301101 - DNA, 75 bp, Artificial Sequence
  Synthetic
tccttcaatgaagctaaagcaaatgtactattcagttttcttcaaacaaaatttaataaacaaatataaatctaa

SEQ ID NO: 301102 - DNA, 75 bp, Artificial Sequence
  Synthetic
caattaataacagttatactgtatggaatgattttagaattaagaagatatatgataacattttcaattttctac

SEQ ID NO: 301103 - DNA, 75 bp, Artificial Sequence
  Synthetic
agcttcaagaatttctcagtgtaagtggtgtaacgtaaaatatgcttttagagacatggattggagaatggaatc

SEQ ID NO: 301104 - DNA, 75 bp, Artificial Sequence
  Synthetic
ttgaagcaggagaaatggttaggtaaaagagtatcacaatttgatatcggacaatataaaaacatgttaaatgtg

SEQ ID NO: 301105 - DNA, 75 bp, Artificial Sequence
  Synthetic
gagaatgaaacaggttgctatgcaattgatcgaagatttgtaggtctaacctgagaggtcactagggagctcccc

SEQ ID NO: 301106 - DNA, 75 bp, Artificial Sequence
  Synthetic
ttattaatttgattaataaacaaaaacaatcactcattactgttcgtataaataacacttttaaagatgaaccaa

SEQ ID NO: 301107 - DNA, 75 bp, Artificial Sequence
  Synthetic
ggatcaatggacactgtatactccaactctactcaagaaggaatatttctaacatccacattatgtttgtattat

SEQ ID NO: 301108 - DNA, 75 bp, Artificial Sequence
  Synthetic
actgtagaaggtggaagatattatgaacatgcaccaattgaattaatatatgcatgccgatcagctaaagaattt

SEQ ID NO: 301109 - DNA, 75 bp, Artificial Sequence
  Synthetic
ccgacctcaactacacattgagtgtaatcactttaatgaatagtacattacatacaatactagaggatccaggaa

SEQ ID NO: 301110 - DNA, 75 bp, Artificial Sequence
  Synthetic
agatatgacaaaagaaattaatcaaaagaacgtgagaacgctagaagagtgggagaatggaaaaaatccttatga

SEQ ID NO: 301111 - DNA, 75 bp, Artificial Sequence
  Synthetic
gtcagaattagctgatttaatattgaatgaatggttatgtaatccaatggatataacattatattattatcaaca

SEQ ID NO: 301112 - DNA, 75 bp, Artificial Sequence
  Synthetic
agttgacgttatagatatgtcgaaggaatttaatcagaagaatatcaaaacgctagatgaatgggagagtggaaa

SEQ ID NO: 301113 - DNA, 75 bp, Artificial Sequence
  Synthetic
tgaaagtattagctttaagacacagtgtggctcaggtatatgcagatacacaaacctatttgcatgatgattcaa

SEQ ID NO: 301114 - DNA, 75 bp, Artificial Sequence
  Synthetic
aatgaatggttatgcaatccaatggacataacgttgtattactatcaacagacggacgaagcgaacaaatggatt

SEQ ID NO: 301115 - DNA, 75 bp, Artificial Sequence
  Synthetic
aaacaaactaaactatttagaatatttgaaccaagacaattaccaatatatcgggcgaacggtgagagagaatta

SEQ ID NO: 301116 - DNA, 75 bp, Artificial Sequence
  Synthetic
agattatgacagaacatttttgatgttaaaaggactgttgaagcaatgcaactatgaatatgtatatgaatagtc

SEQ ID NO: 301117 - DNA, 75 bp, Artificial Sequence
  Synthetic
tttacatgataattttgagtcattatgggacacgataacaacatcaaactatatattagctagatcagttgtgcc

SEQ ID NO: 301118 - DNA, 75 bp, Artificial Sequence
  Synthetic
atggacaaacttaccgacctcaactacacattgagtgtgatctctttaatgaacagtacattgcacacaatatta

SEQ ID NO: 301119 - DNA, 75 bp, Artificial Sequence
  Synthetic
tcattcacatgtcaaaacgctgcaactgatgatgacttaataatagaatacatttattctgaagcgttagacttc

SEQ ID NO: 301120 - DNA, 75 bp, Artificial Sequence
  Synthetic
tctatatcagaagaaaatgaaatcgatagttgaagactttctgaagagactacaaatttttgatgtaccacgagt

SEQ ID NO: 301121 - DNA, 75 bp, Artificial Sequence
  Synthetic
agtatgttgtgttaaaatgactgctatggatttagaactaccgatatctgcgaaactactacaccacccaactac

SEQ ID NO: 301122 - DNA, 75 bp, Artificial Sequence
  Synthetic
tacaaatttttgatgtaccacgagtgccagatgatcaaatgtatagactgagagatagacttagattgttaccag

SEQ ID NO: 301123 - DNA, 75 bp, Artificial Sequence
  Synthetic
gaactatggcataaatttaccaattactggatctatggatacaacctatcagaacggatcaacttcagagccatt

SEQ ID NO: 301124 - DNA, 75 bp, Artificial Sequence
  Synthetic
gaaaatcatcaagatgtacttttccattcgaaagaactactcttaaaatctgttttgatagctattggtcagtca

SEQ ID NO: 301125 - DNA, 75 bp, Artificial Sequence
  Synthetic
cttaacgaatggttatgtaatccaatggacataacgttgtactattatcagcaaacagatgaaggaaacaaatgg

SEQ ID NO: 301126 - DNA, 75 bp, Artificial Sequence
  Synthetic
catgtgtataatgcattgatttattatagatataattattcatttgatcttaagcgatggatatatttacattca

SEQ ID NO: 301127 - DNA, 75 bp, Artificial Sequence
  Synthetic
tgactatcattgtgaacgcgcaaaattatggaataaatctacccatcacaggatcgatggacactgcatatgcaa

SEQ ID NO: 301128 - DNA, 75 bp, Artificial Sequence
  Synthetic
ttatgtaaatcaaataattcaagcaatgtccaaaagatgccgatcattagactcagcagcattttattatagaat

SEQ ID NO: 301129 - DNA, 75 bp, Artificial Sequence
  Synthetic
attttataggcattaaatttagacacattccttataaatatgatgttaaaattccacatttaacatttggagtac

SEQ ID NO: 301130 - DNA, 75 bp, Artificial Sequence
  Synthetic
aattgctagattgtcaaatcgtgtatttagagataaattgtttccatctattgtgaacatatataaaaaagtgat

SEQ ID NO: 301131 - DNA, 75 bp, Artificial Sequence
  Synthetic
tatatttgaggaaaataaaaggcgatacagtgttcgatatggctgagtgagctaaaaacttaacacactggtcac

SEQ ID NO: 301132 - DNA, 75 bp, Artificial Sequence
  Synthetic
aatagattggaaatctagatatgaacaattggaaaaacgctttgaatcactgaaacaaagggtgaatgaaaaata

SEQ ID NO: 301133 - DNA, 75 bp, Artificial Sequence
  Synthetic
aaaattagctcaatatatttaagaaaaattaaaggagatacggtgtttgatatgtctgagtgagctaaaaactta

SEQ ID NO: 301134 - DNA, 75 bp, Artificial Sequence
  Synthetic
tagacataacagctgatccaacaactgcaccacagacagaaagaatgatgcgagtaaattggaaaaaatggtggc

SEQ ID NO: 301135 - DNA, 75 bp, Artificial Sequence
  Synthetic
tatgtcaagtcaatcagactctacaagtaagggtatgatttcatactcgctacgtagagtaactgtttgaatgat

SEQ ID NO: 301136 - DNA, 75 bp, Artificial Sequence
  Synthetic
gtgaaccagataattcaagcaatgtccaaaagatccagatcactggattcagctgctttttactatagggtgtag

SEQ ID NO: 301137 - DNA, 75 bp, Artificial Sequence
  Synthetic
agtatcttcagttgaatggtacatgaaatcaatggaattgcctgatgaagttaagacggatattgaacaacagct

SEQ ID NO: 301138 - DNA, 75 bp, Artificial Sequence
  Synthetic
gagtgattaattcagctgacggagctactacatggtacttcaacccagtgattcttagaccaaataacgttgaag

SEQ ID NO: 301139 - DNA, 75 bp, Artificial Sequence
  Synthetic
agtatgatgtaatgaaagataaaccatattacttagtgacttgggctaattcagccattgaaatgcttatgtcag

SEQ ID NO: 301140 - DNA, 75 bp, Artificial Sequence
  Synthetic
attttaaattatataatatgttctatagaaatcacatcacgtttggacaatcacgaatgtttattccacatatta

SEQ ID NO: 301141 - DNA, 75 bp, Artificial Sequence
  Synthetic
accggatcataaaagtaggaaacactacccaagaattgaagcagattctgatacagatgaatacgtacttgatga

SEQ ID NO: 301142 - DNA, 75 bp, Artificial Sequence
  Synthetic
tggatctatttaccatagtagcatctacaataaataaatatggagtacctagacataatgaaaaatacagatatg

SEQ ID NO: 301143 - DNA, 75 bp, Artificial Sequence
  Synthetic
ttccgcaagcacaaccttttcaacatcatgcaacagttggacttacattacgtattgagtctgcagtttgtgaat

SEQ ID NO: 301144 - DNA, 75 bp, Artificial Sequence
  Synthetic
tcatgcaacagttggacttacattacgtattgagtctgcagtttgtgaatcagtgcttgcggatgcaaatgaaac

SEQ ID NO: 301145 - DNA, 75 bp, Artificial Sequence
  Synthetic
gaaattaatcaaaagaacgtgaaaacgctagaagaatgggagagtggaagaaatccttatgaaccaaaagaagtg

SEQ ID NO: 301146 - DNA, 75 bp, Artificial Sequence
  Synthetic
ggatgatattgcacacggaaggtatactccaggtgttattcctccagtgaatatagatagaccaattccattagg

SEQ ID NO: 301147 - DNA, 75 bp, Artificial Sequence
  Synthetic
actatcgtatggtgatgttacaagatttttatccagtaactccatggtgttatatacagatgtatcacagtggga

SEQ ID NO: 301148 - DNA, 75 bp, Artificial Sequence
  Synthetic
aatttatataaacagacacaaattaatcttatggactcatacgtacaaataccagacggtaatgtaataaagaag

SEQ ID NO: 301149 - DNA, 75 bp, Artificial Sequence
  Synthetic
agatttcttctcattatagttatactgtcaccatttcttaacgcacaaaattatggaataaaccttccaattact

SEQ ID NO: 301150 - DNA, 75 bp, Artificial Sequence
  Synthetic
ccaactgaagctgcgacacaaataaatgacaattcgtggaaagatacactttctcagctatttttaactaaaggg

SEQ ID NO: 301151 - DNA, 75 bp, Artificial Sequence
  Synthetic
gaagaaagtaaatgaaaatatgtactctcttcagaatgtcatttcacaacagcaaaaccaaatagcagatcttca

SEQ ID NO: 301152 - DNA, 75 bp, Artificial Sequence
  Synthetic
aataaattgaatggttccattttaaaattaggagctaatgatgaatggagaccagcaccaataacaaaattcaaa

SEQ ID NO: 301153 - DNA, 75 bp, Artificial Sequence
  Synthetic
ggttggtgtctagattgttgccaatatacaaatctaacatactgtaggggatgtgctctatatcatgtatgtcaa

SEQ ID NO: 301154 - DNA, 75 bp, Artificial Sequence
  Synthetic
aacatggatgtccttttttcattatcaaaaactctcaaagatgctagagacaaaattgtcgagggtacgttatat

SEQ ID NO: 301155 - DNA, 75 bp, Artificial Sequence
  Synthetic
tgcttaatatgtatgacactctattcccaatacatgaaaaaatagtgaataagtttattaataatgttaagcaac

SEQ ID NO: 301156 - DNA, 75 bp, Artificial Sequence
  Synthetic
ccaaaatctgagatgattaaactgtggaagaaaatgtggaatataacagcattacggtctccctatactagtgcg

SEQ ID NO: 301157 - DNA, 75 bp, Artificial Sequence
  Synthetic
gcagagtagaagacagagaacagggttcacatttcataaaccaaatatttttccatactcattttcgttcactct

SEQ ID NO: 301158 - DNA, 75 bp, Artificial Sequence
  Synthetic
acgcaggttcggagattcaagttgcaggatttgactactcatgtgcacttaatgctccggctaatacccaacaat

SEQ ID NO: 301159 - DNA, 75 bp, Artificial Sequence
  Synthetic
gttttccaagagttgtcaattctgcagacggcgcaacaacatggtattttaatcctgtagtactgagaccaaaca

SEQ ID NO: 301160 - DNA, 75 bp, Artificial Sequence
  Synthetic
agacggcgcaacaacatggtattttaatcctgtagtactgagaccaaacaatgttgaagttgaatttcttttaaa

SEQ ID NO: 301161 - DNA, 75 bp, Artificial Sequence
  Synthetic
gctaattatgttgagactgcaagaactacgattgagtattttattgattttattgataatgtatgtatggatgaa

SEQ ID NO: 301162 - DNA, 75 bp, Artificial Sequence
  Synthetic
ctgttctagcggacgctaatgaaacactgttagctaatgttacatcagttcgacaagaatatgctgttccagttg

SEQ ID NO: 301163 - DNA, 75 bp, Artificial Sequence
  Synthetic
tcaaccacgaatgaattacgtaaattaaacagaaagaatgaattgattgatgagtatgatctggaactatcagac

SEQ ID NO: 301164 - DNA, 75 bp, Artificial Sequence
  Synthetic
agttctattctatttgatatcattcgtctttgtgagttacattctgaaaactatagtaaaaataatggactacat

SEQ ID NO: 301165 - DNA, 75 bp, Artificial Sequence
  Synthetic
cgtttggctagcggttagctccttttaatgtatggtattgaatataccacaattctaacctttttgatatcgatt

SEQ ID NO: 301166 - DNA, 75 bp, Artificial Sequence
  Synthetic
tatgcaaattcaacgcaaaatagtgatttcttatcttcaactctgtgcttgtactatccaactgaggcttcaaca

SEQ ID NO: 301167 - DNA, 75 bp, Artificial Sequence
  Synthetic
gcagatacaactaatgcaactagttcaatagcgacacaaaccgccacaattagtaaacgattaagattgaaagaa

SEQ ID NO: 301168 - DNA, 75 bp, Artificial Sequence
  Synthetic
tgcttacaaattcctatacagttgatttatctgatgaaatacaagaaattggatctacaaaaactcaaaatacaa

SEQ ID NO: 301169 - DNA, 75 bp, Artificial Sequence
  Synthetic
tagaattttcaatagatccgaaattgtattgtgattacaatattgttttagtcagatttatcgctggagaagagt

SEQ ID NO: 301170 - DNA, 75 bp, Artificial Sequence
  Synthetic
accatatcagccaactacgtttaacccaccaatagattattggatgttgttagcgcctacgacagctggtgtggt

SEQ ID NO: 301171 - DNA, 75 bp, Artificial Sequence
  Synthetic
ggggactaggttataaatggtccgaaatatcatataaagcagcaaactatcaatataattatttacgtgatggcg

SEQ ID NO: 301172 - DNA, 75 bp, Artificial Sequence
  Synthetic
gtggatatcaatgggatcgtcgtgcactataaaggtgtgtccattgaatactcagactttaggaattggatgcca

SEQ ID NO: 301173 - DNA, 75 bp, Artificial Sequence
  Synthetic
gaacagattgtagtagctaacacttcacaaacacaatggaagtttattgacgttgttaaaactacacaaaatgga

SEQ ID NO: 301174 - DNA, 75 bp, Artificial Sequence
  Synthetic
actggttctatggatacaccatatatgaattcaacaatgagtgaaacattctcaacttctactttatgtttatat

SEQ ID NO: 301175 - DNA, 75 bp, Artificial Sequence
  Synthetic
aaatcacaaattagatataacttctacaacatgcacgatacgcaattgtaataaattaggaccaagagaaaatgt

SEQ ID NO: 301176 - DNA, 75 bp, Artificial Sequence
  Synthetic
caactactggatactattcaactacaaattatgattcggtgaatatgacagcattttgtgacttttatattatac

SEQ ID NO: 301177 - DNA, 75 bp, Artificial Sequence
  Synthetic
ttaaagaatatacagatgttgcatcattttccgtagatccacaactatattgtgattataatattgtattaatga

SEQ ID NO: 301178 - DNA, 75 bp, Artificial Sequence
  Synthetic
aaattatgattcggtgaatatgacagcattttgtgacttttatattataccaagatcagaagaagcaacatgtac

SEQ ID NO: 301179 - DNA, 75 bp, Artificial Sequence
  Synthetic
tggatatagctctttactattatcaacaaacagatgaagcaaataaatggatatcaatgggcgattcatgtacga

SEQ ID NO: 301180 - DNA, 75 bp, Artificial Sequence
  Synthetic
aatgaggacattgtcgtatctaaaacgtcattatggaaagagatgcagtacaatagagacattataatccgattt

SEQ ID NO: 301181 - DNA, 75 bp, Artificial Sequence
  Synthetic
aacagatgttgtagatggagttaaccacaaactagatgtgacaaccgctacgtgtacaataagaaactgtaaaaa

SEQ ID NO: 301182 - DNA, 75 bp, Artificial Sequence
  Synthetic
gggaagaagtaacagcacacacaacatgttctgtaaatggaatgaatgacttcaactttaacggaggatcactac

SEQ ID NO: 301183 - DNA, 75 bp, Artificial Sequence
  Synthetic
tgtgagatcgttagctgcaaatttaaactctgtaatgtgtacgggaggtgattacagctttgcattaccagttgg

SEQ ID NO: 301184 - DNA, 75 bp, Artificial Sequence
  Synthetic
gaactacggcattaatttaccgataacggggtcaatggatacaaattatcaaaatgtatctaatccagaaccgtt

SEQ ID NO: 301185 - DNA, 75 bp, Artificial Sequence
  Synthetic
tcacgttctttaaattccgctgctttttattatcgagtctagatatatcttaagttagaattgtatgatgtgacc

SEQ ID NO: 301186 - DNA, 75 bp, Artificial Sequence
  Synthetic
attagtatcaaagaacgcaattgtatccaaaggtatagcagtaacagaaaaggcaaaattgaattcatatgcacc

SEQ ID NO: 301187 - DNA, 75 bp, Artificial Sequence
  Synthetic
cattactaatttgtcagatgaaattactgatattggaaatgaaaaaaatagtaatgtcactgtcaatccaggacc

SEQ ID NO: 301188 - DNA, 75 bp, Artificial Sequence
  Synthetic
caaatatcagcattattaactatgttgcagaaaccagtgtcatttaaatcaaataaaattactattaatgatatt

SEQ ID NO: 301189 - DNA, 75 bp, Artificial Sequence
  Synthetic
aacaaattatgcaccagtgacttggagtcatggagaagtgaatgattcaacaacaatagaaccagtactcgatgg

SEQ ID NO: 301190 - DNA, 75 bp, Artificial Sequence
  Synthetic
tttagatttagattagctgtggaagaaccatcgtttgcgattactagaactagagtcagtagactatatggacta

SEQ ID NO: 301191 - DNA, 75 bp, Artificial Sequence
  Synthetic
attctcattaatatcgctagttccatctaacgatgattaccagacaccaatagccaactcagtgacagttagaca

SEQ ID NO: 301192 - DNA, 75 bp, Artificial Sequence
  Synthetic
tctttcaatttaccagtggattattggatgatgatgtcaccaacacaagcaggtagagtagctgaaggaacaaat

SEQ ID NO: 301193 - DNA, 75 bp, Artificial Sequence
  Synthetic
tatgtcagaattagccgatttgatacttaatgaatggctttgtaacccaatggacataacattgtactactatca

SEQ ID NO: 301194 - DNA, 75 bp, Artificial Sequence
  Synthetic
ctatattttgaatatggacatgaatttgccatcaacagcaagatatattagaccaaatctattgcaagatagact

SEQ ID NO: 301195 - DNA, 75 bp, Artificial Sequence
  Synthetic
gatatgttttcaatgttttctggtattaaaagcactatagacgcagctaaatcaatggctactaatgtaatgaaa

SEQ ID NO: 301196 - DNA, 75 bp, Artificial Sequence
  Synthetic
ataacacatctaatactatgtggaaattcatattatttatcaaacttacgaaaagcggaaactattcacaatact

SEQ ID NO: 301197 - DNA, 75 bp, Artificial Sequence
  Synthetic
tttcaacataagcgtactttaacatcagatactaagttagctgggtttttaaagcatggtggacgtgtttggact

SEQ ID NO: 301198 - DNA, 75 bp, Artificial Sequence
  Synthetic
tgggatcatcagtttcagcgtggacagatgtctcaacacaagttactgacatttcttcgtctgttagtacgattt

SEQ ID NO: 301199 - DNA, 75 bp, Artificial Sequence
  Synthetic
tttgacaatcaataatgataatagtattatttctagtgatgtagatttttatttaataccacgtactcagactga

SEQ ID NO: 301200 - DNA, 75 bp, Artificial Sequence
  Synthetic
caacgcagacttcgactattagtagaaggttgagactaaaagaaatggctactcaaacagaaggaatgaattttg

SEQ ID NO: 301201 - DNA, 75 bp, Artificial Sequence
  Synthetic
ctacgtaaatcaaataattcaagcaatgtccaagagatcacggtcattggattcagcatcattttattatagaat

SEQ ID NO: 301202 - DNA, 75 bp, Artificial Sequence
  Synthetic
gcacaaatgaatgaggatattatcatatctaaaacatcactatggaaggaaatgcaatataacagagatataacc

SEQ ID NO: 301203 - DNA, 75 bp, Artificial Sequence
  Synthetic
tattcctaatagagcatatagagtaataaataatgatgaagtgtttgaagctggaacagatggtaggttttttgc

SEQ ID NO: 301204 - DNA, 75 bp, Artificial Sequence
  Synthetic
atagagacggagaagaagtgactgcgcatacaacttgttcagtaaatggtgttaatgatttcagctataatagtg

SEQ ID NO: 301205 - DNA, 75 bp, Artificial Sequence
  Synthetic
agttataatggaggaacactgccaactgattttagtctatcaaggtatgaagtaattaaggaaaattcttatgtc

SEQ ID NO: 301206 - DNA, 75 bp, Artificial Sequence
  Synthetic
acattgaagaatttgaatgataattatggtattagtaaacaacaagcatttaatttgttaagatccgatccaagg

SEQ ID NO: 301207 - DNA, 75 bp, Artificial Sequence
  Synthetic
taatttgttaagatccgatccaagggtattacgtgagttcattaatcaagataatccaataatacggaacaggat

SEQ ID NO: 301208 - DNA, 75 bp, Artificial Sequence
  Synthetic
tatggtttacgttcgatcattatcggcaaatttaaatgatgtgcaatgtattggaggaaattatgattttgtact

SEQ ID NO: 301209 - DNA, 75 bp, Artificial Sequence
  Synthetic
cattatcaactcagtttactgatttcgtatcacttaattcattaagatttagattcagtttaacagttgaagagc

SEQ ID NO: 301210 - DNA, 75 bp, Artificial Sequence
  Synthetic
tcattaagatttagatttagattatcggttggggaaccatcattttcaataataagaaccagaatgagtggactt

SEQ ID NO: 301211 - DNA, 75 bp, Artificial Sequence
  Synthetic
cacgagttgggtgcagaaagcaaaaaaagtaaatgaaaacatgtactctcttcagaatgttatatcacaacaaca

SEQ ID NO: 301212 - DNA, 75 bp, Artificial Sequence
  Synthetic
aaactccaatagccaattcagtcactgttagacaagatttagaccgacaattaagtgaattaaggaatgaattta

SEQ ID NO: 301213 - DNA, 75 bp, Artificial Sequence
  Synthetic
agtatttataaacatgaatcatcttcaacaacgtcaactctttctggaaaatctattggtaggagtgaacagtac

SEQ ID NO: 301214 - DNA, 75 bp, Artificial Sequence
  Synthetic
agcaattaggtctttaaccactaatgtaatgaaaaagtttaaaaattcaaatattgctcgatcgatatcaagttt

SEQ ID NO: 301215 - DNA, 75 bp, Artificial Sequence
  Synthetic
cagataaagtactttcaaagaaagaagaagttgtaactgatagtcaagaggagattaaaattgctgatgaagtga

SEQ ID NO: 301216 - DNA, 75 bp, Artificial Sequence
  Synthetic
atagagtctatagctgacatttcaacacaagtatcatcaataagtagacaattaaggttaaaagaattttctact

SEQ ID NO: 301217 - DNA, 75 bp, Artificial Sequence
  Synthetic
accaaaacgagcttacagagttctaaaagatgatgaagtaatggaggctgacgtggatgggaaattctttgcata

SEQ ID NO: 301218 - DNA, 75 bp, Artificial Sequence
  Synthetic
tatcagaatcgtcagaaaagtttataccttcaagaacatatagatttattgatgatgataatgtgtttgaggcta

SEQ ID NO: 301219 - DNA, 75 bp, Artificial Sequence
  Synthetic
ttcagcgataatagattttaagacattgaaaaatttaaatgataattacggaattactaaaaaacaagcattgga

SEQ ID NO: 301220 - DNA, 75 bp, Artificial Sequence
  Synthetic
gtattcaatatgattataatgaagtatttactagagttaaaagtaaatttgattatgtaatggatgattctggtg

SEQ ID NO: 301221 - DNA, 75 bp, Artificial Sequence
  Synthetic
cagtagagaataagaactcaagagacgcgggtaaggtcgttgattcagaaacagctagtatatgtgatgcaatat

SEQ ID NO: 301222 - DNA, 75 bp, Artificial Sequence
  Synthetic
ttcagtttcaggacatgtttataatgcattaatttactacaggtataattatgcatttgatcttaaaagatggat

SEQ ID NO: 301223 - DNA, 75 bp, Artificial Sequence
  Synthetic
cgtcaactatattttgaatatggatatgaatttgccatcaacagcaagatatattagaccaaatctattgcaaga

SEQ ID NO: 301224 - DNA, 75 bp, Artificial Sequence
  Synthetic
tcttatatactcaaatccgaaaacattgaaagaatttataaacaatgataatccaataatcagaaacaggatcga

SEQ ID NO: 301225 - DNA, 75 bp, Artificial Sequence
  Synthetic
attggacttttgattttggtctattaggcacaacactcttaaatttagatgctaattatgttgagaacgcaagaa

SEQ ID NO: 301226 - DNA, 75 bp, Artificial Sequence
  Synthetic
acttaccacaacaaaatgaacgtctgcaagaaaaagaaattgaaaataatacagacgcaatcatggaaaataaaa

SEQ ID NO: 301227 - DNA, 75 bp, Artificial Sequence
  Synthetic
aatattttctgaatcatcaattagttgaaccattgaataacgaaatcatttttaattatataccagaaagaataa

SEQ ID NO: 301228 - DNA, 75 bp, Artificial Sequence
  Synthetic
ttggacattgttcgtcacaggaaaagatatatgaatatattaaagatgttctggatgtatgtgatgatgaaaaat

SEQ ID NO: 301229 - DNA, 75 bp, Artificial Sequence
  Synthetic
tagaaatggacaagttattaatcaattaatggaagcattaatgcagttatctagacaacaatttccgactatgcc

SEQ ID NO: 301230 - DNA, 75 bp, Artificial Sequence
  Synthetic
aacgataatattaggaatggacaagttattaatcaattaatggaagcattaatgcagttatctagacaacaattt

SEQ ID NO: 301231 - DNA, 75 bp, Artificial Sequence
  Synthetic
gattatttgttacctggatggaaattaacatatgttggatataatggaaaagacacacgaggtcactacaatttc

SEQ ID NO: 301232 - DNA, 75 bp, Artificial Sequence
  Synthetic
gatcaatccaaagaggaatattgttattgtctaacagattaggtcagttagttgatttaacaagattattatcat

SEQ ID NO: 301233 - DNA, 75 bp, Artificial Sequence
  Synthetic
tataactatgaacatgcaacatgttcaaactctcactaccgaaaaattacagttaacttctgtcacatctttatg

SEQ ID NO: 301234 - DNA, 75 bp, Artificial Sequence
  Synthetic
tggagcagatcgaacgagcttcagataaaattgctcaaggagtaataattgcttacagagatatgcaactagaaa

SEQ ID NO: 301235 - DNA, 75 bp, Artificial Sequence
  Synthetic
taaaggatggccaactggatcagtttattttaaagaatacactgatatcgcttcattctcaattgatccacaact

SEQ ID NO: 301236 - DNA, 75 bp, Artificial Sequence
  Synthetic
ctattaagcaattttcaaatggtgcatacctcgttaagcatactattaaattgaaacaggagagatggttaggta

SEQ ID NO: 301237 - DNA, 75 bp, Artificial Sequence
  Synthetic
tactgtcaccactccttaatgcacaaaattatggaataaatcttccgattactggatcaatggacacaccatata

SEQ ID NO: 301238 - DNA, 75 bp, Artificial Sequence
  Synthetic
ggctataaaatggcttcgctcatttatagacaattgcttactaattcatataccgtagatttatcagatgaaata

SEQ ID NO: 301239 - DNA, 75 bp, Artificial Sequence
  Synthetic
aatgtgtttatacaaccttcctttaagttaaaaacgtcacctaatgattacatagtggcattgtacgctttatct

SEQ ID NO: 301240 - DNA, 75 bp, Artificial Sequence
  Synthetic
aaattatggaattaatttaccaattactggctccatggatacagcatatgcaaattcgtcacagcaagaaacatt

SEQ ID NO: 301241 - DNA, 75 bp, Artificial Sequence
  Synthetic
catatgggtatttctagaagatcacatcaaattagattttcagaatctgcgacatcatattcaggatacattttt

SEQ ID NO: 301242 - DNA, 75 bp, Artificial Sequence
  Synthetic
aatttctaatctcactacacataatatattatatctaaattatagcattaagacattgcaaatattgaataaatc

SEQ ID NO: 301243 - DNA, 75 bp, Artificial Sequence
  Synthetic
catttctaatctaactacacataatatattgtatttaaattatagtgttaaaacattaagaatattaaataaatc

SEQ ID NO: 301244 - DNA, 75 bp, Artificial Sequence
  Synthetic
ataaacaaaaacaatcacttattactgttcgtatgaataacacctttaaagacgaacctaaggtaaattttaaaa

SEQ ID NO: 301245 - DNA, 75 bp, Artificial Sequence
  Synthetic
tataccttatgaatacgatgttaaaattccacatctgacgttcggagtactatttatatctgataacatgataca

SEQ ID NO: 301246 - DNA, 75 bp, Artificial Sequence
  Synthetic
aactgatgtcgttgatggtgtgaaccataaacttgatgtaactacaaatacctgtacaattagaaattgtaagaa

SEQ ID NO: 301247 - DNA, 75 bp, Artificial Sequence
  Synthetic
ttctaatgagctggattttcaaactttcctattaagaaaaattaaagaaagaatgacaacgtctcttccgattgc

SEQ ID NO: 301248 - DNA, 75 bp, Artificial Sequence
  Synthetic
aatgctagtggtgtattgtcgacttattttaaattgtacaatatgttctatagaaatcatatcacgttcggacaa

SEQ ID NO: 301249 - DNA, 75 bp, Artificial Sequence
  Synthetic
tcacgaatgtttattcctcacattacacttagctttagtaataaacggacggttagaatagaaaatacaagactc

SEQ ID NO: 301250 - DNA, 75 bp, Artificial Sequence
  Synthetic
cacttcagaaatacaggacacaatagatgatatttcagcacagaaaacagaaagtgttactgtgaatccaggacc

SEQ ID NO: 301251 - DNA, 75 bp, Artificial Sequence
  Synthetic
agtgtgatcgtacaaccacaatactgggtactgatgaatccagaaaaagacggagttattgctgaagcggacgta

SEQ ID NO: 301252 - DNA, 75 bp, Artificial Sequence
  Synthetic
ataccgatcaaagcaaatataaatttttcgaccttgtaagtacagatggatctacttattcaaaaattcaagagt

SEQ ID NO: 301253 - DNA, 75 bp, Artificial Sequence
  Synthetic
gagatgttaataaacttaaagataattcaattttatacatagacataagaaccgatagggggaatatagactgga

SEQ ID NO: 301254 - DNA, 75 bp, Artificial Sequence
  Synthetic
ggatgatatagagcatgttcaaaccaacattaagtgtaactattacatagtttcacaaagtcaaacacaacagtt

SEQ ID NO: 301255 - DNA, 75 bp, Artificial Sequence
  Synthetic
tgtttataattcacaatctgcagttcaaataccaatttattattcttccaattcagaattagaaaaaagatgtat

SEQ ID NO: 301256 - DNA, 75 bp, Artificial Sequence
  Synthetic
gaagacattgtgatttctaaaacatcattatggaaagagatgcagtataatagagatattgttataagatttaaa

SEQ ID NO: 301257 - DNA, 75 bp, Artificial Sequence
  Synthetic
gaggattagggtataagtggtcagaaatatcatttaaacctatgaattatgagtatacgtatgaaagggatggtg

SEQ ID NO: 301258 - DNA, 75 bp, Artificial Sequence
  Synthetic
tctatattatcatattcttatgacaaatacaacgctgtggaacggaaactagtcaattatgctaaaggtaaacct

SEQ ID NO: 301259 - DNA, 75 bp, Artificial Sequence
  Synthetic
agtactgaaaggtaattcatatgtgtacatcgattattgggatgattcacaagcatttaaaaatatggtatatgt

SEQ ID NO: 301260 - DNA, 75 bp, Artificial Sequence
  Synthetic
gtgacactgaactcagatgctgttacactgtcgacgcagtatactgattttgtgtcattaaattcactaaggttc

SEQ ID NO: 301261 - DNA, 75 bp, Artificial Sequence
  Synthetic
attattatgaagcagcaggaaggttctcactaatatcactagtaccgtcaaacgacgattatcagactccaattc

SEQ ID NO: 301262 - DNA, 75 bp, Artificial Sequence
  Synthetic
caccaattgaattaatatatgcatgtcgatcagctaaagaatttgctatgttacaagacgatttaacagtattaa

SEQ ID NO: 301263 - DNA, 75 bp, Artificial Sequence
  Synthetic
taaatgcagttatgttctggttagagcgacattcaaacgatgtcgctgatgcaaacaaaatttacaaacgtagat

SEQ ID NO: 301264 - DNA, 75 bp, Artificial Sequence
  Synthetic
acactgttgtcaatattatcatattcttatgataaatataacgctgttgaaaggaaattagtaaaatatgcaaaa

SEQ ID NO: 301265 - DNA, 75 bp, Artificial Sequence
  Synthetic
agatttagcattactgccactagatatgtttgcaatgttttcaggaattaagtcaacactggatgctgttaaatc

SEQ ID NO: 301266 - DNA, 75 bp, Artificial Sequence
  Synthetic
aggtcatcttcaattcgatcaaacgcttcagtatggaataacttagttgactcgactacgcaaacgtcgaacgtt

SEQ ID NO: 301267 - DNA, 75 bp, Artificial Sequence
  Synthetic
agtggtgtattatcaacttatttcaaactgtataatatgttttatagaaatcacattacatttggacaatcacga

SEQ ID NO: 301268 - DNA, 75 bp, Artificial Sequence
  Synthetic
cagcagccgtactaaaaactaagattgacaaaatagaatcggtgcaacctaagattctaccaactataattacag

SEQ ID NO: 301269 - DNA, 75 bp, Artificial Sequence
  Synthetic
atatactgaagatgtggataacgaaatgtataatgaatacacaatgctaattagagacgaaatagttaaaatgct

SEQ ID NO: 301270 - DNA, 75 bp, Artificial Sequence
  Synthetic
tgatactttcgaagaagtaatatttgatgtggagaagttcgctgatttggtaactgattcaccggtaatttcagc

SEQ ID NO: 301271 - DNA, 75 bp, Artificial Sequence
  Synthetic
atgatatttcagcagcagtattgaaaacgaaaatcgataaatcaacgcaaattgcagctaacaacataccagatg

SEQ ID NO: 301272 - DNA, 75 bp, Artificial Sequence
  Synthetic
gactttataaatcaaaataatccaataataaagaatagaattgaacaactaattctgcaatgtagaatatagtag

SEQ ID NO: 301273 - DNA, 75 bp, Artificial Sequence
  Synthetic
aataccagctgtaacattcatattgcatctttatgctaaactagagataataaactacgccattaaaaataaagc

SEQ ID NO: 301274 - DNA, 75 bp, Artificial Sequence
  Synthetic
ttctaaaggaattgatcaaaagatgagagtacttaatgcttgttttagtgtaaaaagaataccaggaaaatcatc

SEQ ID NO: 301275 - DNA, 75 bp, Artificial Sequence
  Synthetic
gactgttgaagcagtgcaattatgaatatgcatgtgagtagtcacataattaaagatattaaccatctacacatg

SEQ ID NO: 301276 - DNA, 75 bp, Artificial Sequence
  Synthetic
cttaatgagtggttatgtaatcccatggatattactttgtattattatcaacaaacagatgaggcgaataagtgg

SEQ ID NO: 301277 - DNA, 75 bp, Artificial Sequence
  Synthetic
atcaattggttgaaccattgaataatgatataatatttaattatataccagaaaggataagaaatgatgttaatt

SEQ ID NO: 301278 - DNA, 75 bp, Artificial Sequence
  Synthetic
gaaatggcgactcaaacagacggtatgaattttgatgatatatcagcagcagtacttaagactaaaattgataaa

SEQ ID NO: 301279 - DNA, 75 bp, Artificial Sequence
  Synthetic
caaacacttaatgataatattagaaatggacaagttatcaatcaattgatggaagcattaatgcagctgtctaga

SEQ ID NO: 301280 - DNA, 75 bp, Artificial Sequence
  Synthetic
ggaagcattaatgcagctgtctagacaacagtttccaactatgccagttgattataaaagatcaatacaaagagg

SEQ ID NO: 301281 - DNA, 75 bp, Artificial Sequence
  Synthetic
catgtatataatgcacttatttattatagatataattattcttttgatttaaaaagatggatatatttacattcg

SEQ ID NO: 301282 - DNA, 75 bp, Artificial Sequence
  Synthetic
catctgtcctgacagttttgttcacattgcacaaagcatcaattccaacgatgaaaatagcattgaagacgtcaa

SEQ ID NO: 301283 - DNA, 75 bp, Artificial Sequence
  Synthetic
acttttggacaatccagaatgtttatcccacatataacattaagttttagtaataataaaacagtaagaatagag

SEQ ID NO: 301284 - DNA, 75 bp, Artificial Sequence
  Synthetic
tggtattgaatataccacaactctaacttttttgatattgcttgtattgttgaattatatattaaaatcaataac

SEQ ID NO: 301285 - DNA, 75 bp, Artificial Sequence
  Synthetic
tgaattatatattaaaatcaataactagagtaatggactacatattgtatcgattcttgctttttgttgttgtta

SEQ ID NO: 301286 - DNA, 75 bp, Artificial Sequence
  Synthetic
ggatcaatggacacaaattatcaaaatgtgtcagttcaagaaccatttttgacatcaacactctgcttgtattat

SEQ ID NO: 301287 - DNA, 75 bp, Artificial Sequence
  Synthetic
ggatccagcaattctaacttccttatcatcaaatttaaatgcagttatgttttggctagaaaaacacgaaaatga

SEQ ID NO: 301288 - DNA, 75 bp, Artificial Sequence
  Synthetic
aaagttatgcggatattgcgactttctcaataaatcctcagttgtattgtgattataatattgtgttgatgaagt

SEQ ID NO: 301289 - DNA, 75 bp, Artificial Sequence
  Synthetic
gacagatgaggcgaataaatggatttcaatgggagattcatgcacaattaaagtatgtccattaaatacgcagac

SEQ ID NO: 301290 - DNA, 75 bp, Artificial Sequence
  Synthetic
tgacgtcgtagatggagtaaactataagataaatgttactactactacatgtacaattaggaactgtaagaaact

SEQ ID NO: 301291 - DNA, 75 bp, Artificial Sequence
  Synthetic
ggcatgtatttaccaataacgggatcactagacgctgtatacacaaattcaactagtggagaatcatttctaact

SEQ ID NO: 301292 - DNA, 75 bp, Artificial Sequence
  Synthetic
agagtgaattggaaaaaatggtggcaagttttctacactgtcgttgattatgtgaatcaaataattcaagcaatg

SEQ ID NO: 301293 - DNA, 75 bp, Artificial Sequence
  Synthetic
ctcaatgggactcatctcagcataatactcaaccatttaggaaaggaataataatgggattagacatactagcta

SEQ ID NO: 301294 - DNA, 75 bp, Artificial Sequence
  Synthetic
aagttttctacactgtcgttgattatgtgaatcaaataattcaagcaatgtccaaaaggtcaagatcactagatt

SEQ ID NO: 301295 - DNA, 75 bp, Artificial Sequence
  Synthetic
tacataaagcgtcacttcccacaatgaaaattgcattaaaaacgtcaaaatgttcatacaaaatagtgaagtact

SEQ ID NO: 301296 - DNA, 75 bp, Artificial Sequence
  Synthetic
tctaacttccacattatgcttgtattatccgaatgaagcggctactgaaattgcagacgccaagtggacggagac

SEQ ID NO: 301297 - DNA, 75 bp, Artificial Sequence
  Synthetic
tgtgattataatattgtgttaatgaaatacgatgcaaacttacaattagatatgtctgaattagctgatctaata

SEQ ID NO: 301298 - DNA, 75 bp, Artificial Sequence
  Synthetic
ttaaagtgtgtcctctgaatgcgcagacccttggaataggatgcttaactacggatactaattcatttgaagtag

SEQ ID NO: 301299 - DNA, 75 bp, Artificial Sequence
  Synthetic
attatattatataataatattgttatatcgagttattgaatttaataactttctaacgagagaagattaatgcgt

SEQ ID NO: 301300 - DNA, 75 bp, Artificial Sequence
  Synthetic
acttggaccaagagagaacgttgcagtaattcaagtaggaggttcaaacatacttgatataacagcagacccaac

SEQ ID NO: 301301 - DNA, 75 bp, Artificial Sequence
  Synthetic
ttttgtaactactaattatatgtcattgatttcaggtatgtggctattgacggtcgtaccaaatgatatgtttat

SEQ ID NO: 301302 - DNA, 75 bp, Artificial Sequence
  Synthetic
ttacgttaaccaaattgtgcaagttatgtccaagcgatcgcgatctctaaactcagctgcattttactatcgagt

SEQ ID NO: 301303 - DNA, 75 bp, Artificial Sequence
  Synthetic
gatgggcacaatgtggttgaatgctggttcagaaattcaagttgctggatttgactattcttgcgctattaatgc

SEQ ID NO: 301304 - DNA, 75 bp, Artificial Sequence
  Synthetic
tctgcataaggcatcaattccaacaatgaaaatagcattgaagacatcgaaatgttcatataaagtaattaaata

SEQ ID NO: 301305 - DNA, 75 bp, Artificial Sequence
  Synthetic
aagtccacaaacattatttcattattataatgttaacgtcaattttcattcaaattacaatgagagaattaatga

SEQ ID NO: 301306 - DNA, 75 bp, Artificial Sequence
  Synthetic
ccattggacctgatggctgactgagaagccccagtcagccatatcgcgtgtggctcacccttaatcccgtttaac

SEQ ID NO: 301307 - DNA, 75 bp, Artificial Sequence
  Synthetic
tgatggacttcattatttatagatttctctttattatagttattctgtcaccattattgaaagctcaaaactatg

SEQ ID NO: 301308 - DNA, 75 bp, Artificial Sequence
  Synthetic
ttctggatccgtctactttaaagaatatgcagatattgcttctttttcaattgatccgcagttatattgtgatta

SEQ ID NO: 301309 - DNA, 75 bp, Artificial Sequence
  Synthetic
tatgcagatattgcttctttttcaattgatccgcagttatattgtgattacaatgtagtactgatgaaatatgac

SEQ ID NO: 301310 - DNA, 75 bp, Artificial Sequence
  Synthetic
ccatttgacgtaaataaatttgctgaacttgtaacaaattctccagttatatcagcaataattgattttaaaaca

SEQ ID NO: 301311 - DNA, 75 bp, Artificial Sequence
  Synthetic
cacctattacaagattctgaattagctggcttgttatcaatgtcttcagcatcgaatggagaatcaagacagctt

SEQ ID NO: 301312 - DNA, 75 bp, Artificial Sequence
  Synthetic
taactggaagaaatggtggcaagtattctacactatagttgattatgtgaatcaaatagttcaagcaatgtccaa

SEQ ID NO: 301313 - DNA, 75 bp, Artificial Sequence
  Synthetic
actcttaaagacgctcgcgacaagattgtcgagggcacgttgtattctaatgttagcgatttaatacagcaattc

SEQ ID NO: 301314 - DNA, 75 bp, Artificial Sequence
  Synthetic
tttagaaaaggaataataatgggattggatatattagctaacatgactaatgatgctaaagttattcagacacta

SEQ ID NO: 301315 - DNA, 75 bp, Artificial Sequence
  Synthetic
ccactctacttaacttggatgccaactacgttgagacagctagaacgacgattgaatattttgtggattttatag

SEQ ID NO: 301316 - DNA, 75 bp, Artificial Sequence
  Synthetic
aatttatataaacaaacacaaattaacttgatggactcatatgttcaaataccagatggtaatgttattaagaaa

SEQ ID NO: 301317 - DNA, 75 bp, Artificial Sequence
  Synthetic
aataaattttgataactcatctgaatatatagagaattggaacttacagagcagaagacagagaactggattcac

SEQ ID NO: 301318 - DNA, 75 bp, Artificial Sequence
  Synthetic
gggtctgaaattcaagttgctggatttgactacgcatgcgctattaatgctccagccaatattcaacagtttgaa

SEQ ID NO: 301319 - DNA, 75 bp, Artificial Sequence
  Synthetic
gcgcaacaacatggtattttaatccagtagtactaagacctagtaatgtggaagtcgaatttctgttaaacggtc

SEQ ID NO: 301320 - DNA, 75 bp, Artificial Sequence
  Synthetic
tccagcagttgccgcgttatttccaaacgcacaaccattcgaacatcatgctaccgttggtttaactttaagaat

SEQ ID NO: 301321 - DNA, 75 bp, Artificial Sequence
  Synthetic
gtttttccacctggtatgaattggactgatctaatcactaattattctccatcgagagaagataatttacagcgt

SEQ ID NO: 301322 - DNA, 75 bp, Artificial Sequence
  Synthetic
tgagcatgtagctatgtcaagctgcttagacttcataagtaaggatacgatattcgtgttcgctacgtgaagtaa

SEQ ID NO: 301323 - DNA, 75 bp, Artificial Sequence
  Synthetic
agtcaataaggcatttatatgaggaatacaaagatgtgatagatagagcaacgttattatcagtgttatcgtatt

SEQ ID NO: 301324 - DNA, 75 bp, Artificial Sequence
  Synthetic
atacaaagatgtgatagatagagcaacgttattatcagtgttatcgtattcatatggtaagtatggaaatgttga

SEQ ID NO: 301325 - DNA, 75 bp, Artificial Sequence
  Synthetic
atcatcaggacgtgcttttccattcaaaagagttgttgttgaaatcagtactaatagctattggtcactcaaaag

SEQ ID NO: 301326 - DNA, 75 bp, Artificial Sequence
  Synthetic
tttaataggtacgaatgtagagaattcagtatccggacacgtatataatgcattgatttattatagatataatta

SEQ ID NO: 301327 - DNA, 75 bp, Artificial Sequence
  Synthetic
attacatacaatactagaggatccaggaatggcgtattttccttatattgcatctgtcctgacagttttgttcac

SEQ ID NO: 301328 - DNA, 75 bp, Artificial Sequence
  Synthetic
ccattggacctgatggctggctaagaagccatagtcagtcatatcgcgtgtggctcaagccttaatcccgtttaa

SEQ ID NO: 301329 - DNA, 75 bp, Artificial Sequence
  Synthetic
gatcataatgattatttagttgctgaggagcttattattaattcgtattcaaacagatcaactttggcgaaaata

SEQ ID NO: 301330 - DNA, 75 bp, Artificial Sequence
  Synthetic
cttgaattttcgaacaaatatgtaaaagctattgtgccgcagaaaactttagatgagctaaatgatatgttaatt

SEQ ID NO: 301331 - DNA, 75 bp, Artificial Sequence
  Synthetic
ctttctcattccatgttgggtttagaaaacaaaaaatgatagacgcggctttagatcagttaaacacagagtact

SEQ ID NO: 301332 - DNA, 75 bp, Artificial Sequence
  Synthetic
ttatccccatttggagaacgatagctataaatttattccatttaataatttagctataaaatgtatgttgacagc

SEQ ID NO: 301333 - DNA, 75 bp, Artificial Sequence
  Synthetic
gatgaagtggttaaaatgttacaggagtcagttatacacgatgatcacttattagtcgattcggaattagctgga

SEQ ID NO: 301334 - DNA, 75 bp, Artificial Sequence
  Synthetic
tactctcagtcgaatcaattactgtcatatggtgatgtaacacgatttttatcagatgatgcactcgtattatat

SEQ ID NO: 301335 - DNA, 75 bp, Artificial Sequence
  Synthetic
tttaaataatatatcaattacaattcattcagaattttatattattccaaggtcccaagagtctaagtgtaatga

SEQ ID NO: 301336 - DNA, 75 bp, Artificial Sequence
  Synthetic
aaaaaatcaaagagacgcccgaaaaatatagacagacgcagataaatttaatggattcatacgttcaaattccag

SEQ ID NO: 301337 - DNA, 75 bp, Artificial Sequence
  Synthetic
atatagacagacgcagataaatttaatggattcatacgttcaaattccagatggtgataaaatcttaaaaattca

SEQ ID NO: 301338 - DNA, 75 bp, Artificial Sequence
  Synthetic
tttacgatgttagacagtactctgattttatatttgaaacttgggatccacttgatactccatattcatccatac

SEQ ID NO: 301339 - DNA, 75 bp, Artificial Sequence
  Synthetic
atcatccaactacagaaattaggtcagaattttatttaataatggatatatgggattctaaaaatattaaacgat

SEQ ID NO: 301340 - DNA, 75 bp, Artificial Sequence
  Synthetic
gaagtaatggaaattaatactgaaggaaaattctttgcatataaaattgatacacttaatgaagtgccatttgat

SEQ ID NO: 301341 - DNA, 75 bp, Artificial Sequence
  Synthetic
attttacatttgaaacatgggatccattagacactccatattctacaacacatcataaggaattattttttgata

SEQ ID NO: 301342 - DNA, 75 bp, Artificial Sequence
  Synthetic
ctactgacgacgacgtatatttacaaagagcttttatgtcattatcatcacaatcatcttcaatagctgatgaaa

SEQ ID NO: 301343 - DNA, 75 bp, Artificial Sequence
  Synthetic
aaaccaactggaaataatcatctgttcattttgagcggtactaataaatattttaaattggatcaatttgcgaat

SEQ ID NO: 301344 - DNA, 75 bp, Artificial Sequence
  Synthetic
ccaattgcattagaaaaaagaagagcgcaattgtcatcactgttaacaatgttgcaaaagccagttagatttaag

SEQ ID NO: 301345 - DNA, 75 bp, Artificial Sequence
  Synthetic
aatcgcgtgtttacaatcaagataagtacagaatattggaatcatatatctataatttattatcaataaattatg

SEQ ID NO: 301346 - DNA, 75 bp, Artificial Sequence
  Synthetic
caaactgaaggaatgagttttgatgatatttcagcagcagtattaaaaacaaaaatagatatgtctactcaaatt

SEQ ID NO: 301347 - DNA, 75 bp, Artificial Sequence
  Synthetic
gtggagtataacctctttaagatcaccatattcaaacgctaattttttccaagattaaggcgctaagatgtgacc

SEQ ID NO: 301348 - DNA, 75 bp, Artificial Sequence
  Synthetic
aaatggcttcttctataattaactcttctttcgaggcagcagttgttgctgcaacttctactcttgaactgatgg

SEQ ID NO: 301349 - DNA, 75 bp, Artificial Sequence
  Synthetic
aaacggttttatcacgtatttctaataaatattcatttgccacaaaaataataagagttgacggtgatgataact

SEQ ID NO: 301350 - DNA, 75 bp, Artificial Sequence
  Synthetic
gctaatgatgaatggagaccagcaccaataacgaaattcaaaggttggtgtttggattgctgtcaatatacaaat

SEQ ID NO: 301351 - DNA, 75 bp, Artificial Sequence
  Synthetic
gaacatttaaaaacactataagtaaagaagatattgaaaacctactaaacatgtatgacactctgttcccaatac

SEQ ID NO: 301352 - DNA, 75 bp, Artificial Sequence
  Synthetic
ccaattaatgctatagatgattttgaatcactgatcagaaatattatactcgactatgacagaatatttttaatg

SEQ ID NO: 301353 - DNA, 75 bp, Artificial Sequence
  Synthetic
tttgcaagcattaactatacagttagagaacaatacatattatatatttggatattatgattgtatggagcaaga

SEQ ID NO: 301354 - DNA, 75 bp, Artificial Sequence
  Synthetic
ctacagcaagaatatgcgttgaggtatttttcaaagtcgaggtttctagataaaccaaataggggcttaaaaaga

SEQ ID NO: 301355 - DNA, 75 bp, Artificial Sequence
  Synthetic
agaatgccacactgttgtcaatattatcgtactcttacgataaatataacgctgttgaaaggaaattagtaaaat

SEQ ID NO: 301356 - DNA, 75 bp, Artificial Sequence
  Synthetic
ggaataaagcatgcacgcaagttacaaatgctaaaaattatatggaggtaatgaattctgcatatactgaacatt

SEQ ID NO: 301357 - DNA, 75 bp, Artificial Sequence
  Synthetic
atgaattctgcatatactgaacattatagcgtctcacaaagatgtaaactttatactaaaaataaacttaataca

SEQ ID NO: 301358 - DNA, 75 bp, Artificial Sequence
  Synthetic
taatttattagttcagagtgttgataaagtaccgcaaatactgactttgaatgatattgtcataattatgaaatc

SEQ ID NO: 301359 - DNA, 75 bp, Artificial Sequence
  Synthetic
aaatatgggaagactttagaattaagaaaatatataataatgtattagattttattagagcattatctaagtcaa

SEQ ID NO: 301360 - DNA, 75 bp, Artificial Sequence
  Synthetic
tagtctatttaaatgcttggaacctgttgaaataagtgaagtggaatatgtgctgtttgatcatgaaattaactg

SEQ ID NO: 301361 - DNA, 75 bp, Artificial Sequence
  Synthetic
tggtttgatataagatacatgagagacacaccaatgataacgtcaaccacaaatgaattgcgtaagttaaataaa

SEQ ID NO: 301362 - DNA, 75 bp, Artificial Sequence
  Synthetic
acacaccaatgataacgtcaaccacaaatgaattgcgtaagttaaataaaaagaatgaactaattgatgagtacg

SEQ ID NO: 301363 - DNA, 75 bp, Artificial Sequence
  Synthetic
atagacaacttctcactaattcatattcggtagacttgcatgacgaaatagaacagattggatcggagaaaactc

SEQ ID NO: 301364 - DNA, 75 bp, Artificial Sequence
  Synthetic
atgattcaactacagtggaaccagttttagatggtccttatcaaccaactacatttaaaccacccaatgattatt

SEQ ID NO: 301365 - DNA, 75 bp, Artificial Sequence
  Synthetic
accagatgcagagagatttagttctcctagagtaattaattcagctgatggtactaccacatggtacttcaatcc

SEQ ID NO: 301366 - DNA, 75 bp, Artificial Sequence
  Synthetic
caagttaatgaagatattacaatttcaaaaacttcattatggaaggaaatgcaatataatagagatattataata

SEQ ID NO: 301367 - DNA, 75 bp, Artificial Sequence
  Synthetic
ttacgtgaaccaaattgtgcaagcaatgtctaagaggtccagatcactgaattcagcagcgttttattatagagt

SEQ ID NO: 301368 - DNA, 75 bp, Artificial Sequence
  Synthetic
tccagatcactgaattcagcagcgttttattatagagtgtagatattatgtagattagagttgtatgatgtgacc

SEQ ID NO: 301369 - DNA, 75 bp, Artificial Sequence
  Synthetic
tgagatagctgcatcatcaacgtttaagaattatgtatctagattatctgagcagctgttattttcaaagaataa

SEQ ID NO: 301370 - DNA, 75 bp, Artificial Sequence
  Synthetic
tggaagttaacactgaaggaaagttttttgcttataaagtggatacacttaatgagattccatttgatataaata

SEQ ID NO: 301371 - DNA, 75 bp, Artificial Sequence
  Synthetic
aattctaacttttttgatatcgcttgtatttattaattatatattaaaatcagtgactagaacaatggacttaat

SEQ ID NO: 301372 - DNA, 75 bp, Artificial Sequence
  Synthetic
cagtgactagaacaatggacttaattatttatagatttttactaatcatagttttgcttgcgccaatcattaaga

SEQ ID NO: 301373 - DNA, 75 bp, Artificial Sequence
  Synthetic
atcatattcttacgacaaatataatgctgttgagcgaaaattagtcaaatatgcaaaaggtaaaccgcttgaggc

SEQ ID NO: 301374 - DNA, 75 bp, Artificial Sequence
  Synthetic
attggcgaatgttaccgcagtacgtcaagagtatgctataccagttggaccagtgtttccaccaggcatgaattg

SEQ ID NO: 301375 - DNA, 75 bp, Artificial Sequence
  Synthetic
tacttattattgaaagatatggcagtagaaaataagaactctagggatgcaggtaaagtcgttgactcagaaacg

SEQ ID NO: 301376 - DNA, 75 bp, Artificial Sequence
  Synthetic
ctgagtatatagaaaattggaatttgcagagtagaagacagaggacgggattcacgttccataaacctaatattt

SEQ ID NO: 301377 - DNA, 75 bp, Artificial Sequence
  Synthetic
ttcacaagcagctaacgattgttttaaaaccttaattgcagcaatgttaagtcaacgtactatgtcattagattt

SEQ ID NO: 301378 - DNA, 75 bp, Artificial Sequence
  Synthetic
gctatagtaaatacaataatctatccagcatttggaatgcaacgaatgcattatagaaacggagatccacaaaca

SEQ ID NO: 301379 - DNA, 75 bp, Artificial Sequence
  Synthetic
ctgaactaacaattcagtatccgatcttaaccggcatgtagctatatcaagctgctcagactctataagtaagga

SEQ ID NO: 301380 - DNA, 75 bp, Artificial Sequence
  Synthetic
atattgtaaacagacttagaggatttgagactgatagagaatttattttaactaaaataatgcaaatgacgtctg

SEQ ID NO: 301381 - DNA, 75 bp, Artificial Sequence
  Synthetic
tcatgaccattgtcacgaacgcgcagaattatggagtgaatttacccattacaggatcaatggatactgcgtatg

SEQ ID NO: 301382 - DNA, 75 bp, Artificial Sequence
  Synthetic
tagcagacacagagtggaaaaacacattatctcaactatttctaacaaaaggatggccgacaggatcagtgtatt

SEQ ID NO: 301383 - DNA, 75 bp, Artificial Sequence
  Synthetic
aatgcagctacagatgacgatgcaataatagagtatatctactcaaatgaattagattttcagaactttatactc

SEQ ID NO: 301384 - DNA, 75 bp, Artificial Sequence
  Synthetic
agaggaggcagttaagcatgatgatcatcttcttcaagattctgaattagcaggactgctctcaatgtcatcagc

SEQ ID NO: 301385 - DNA, 75 bp, Artificial Sequence
  Synthetic
agacagttatgcacaggagtgaagactgttgattatgattccggtatatctgacgttgaataatgaaatagagat

SEQ ID NO: 301386 - DNA, 75 bp, Artificial Sequence
  Synthetic
ttaccacaacaaaatgaacgtctgcaagagaaagaagttgaaaagaatatagacgcagctatggagagcaaagct

SEQ ID NO: 301387 - DNA, 75 bp, Artificial Sequence
  Synthetic
actctcttcagaatgttatttcacaacagcaaaaccaaatagcagatcttcaacaatattgtagtaaattggaag

SEQ ID NO: 301388 - DNA, 75 bp, Artificial Sequence
  Synthetic
gaagatcatcagaaagaggtacaatatgaaattttacaaaaaacaataccaacttttgaaccaaaagagtcaatt

SEQ ID NO: 301389 - DNA, 75 bp, Artificial Sequence
  Synthetic
gagaatacttcttaaatttatatgatcagatattgatagaaatgccagattatttattattgaaagatatggcgg

SEQ ID NO: 301390 - DNA, 75 bp, Artificial Sequence
  Synthetic
actgtcacagctgtttctgactaaaggatggccaactggatccgtgtatttcaaagaatatgctgacatagcagc

SEQ ID NO: 301391 - DNA, 75 bp, Artificial Sequence
  Synthetic
ttaaagagcttgtttctgaattaagatggcagtacaacaaatttgctgtaataacacatggtaaaggtcactata

SEQ ID NO: 301392 - DNA, 75 bp, Artificial Sequence
  Synthetic
atgaaatagaaaattatattaatagagtgtatagcataacgtacgctgatgaccctaactatttcattggaatta

SEQ ID NO: 301393 - DNA, 75 bp, Artificial Sequence
  Synthetic
ttgcgacaactgaaaaattaataattactgacgttgtagatggcgtaaatcacaagttgaatgtaacaacagcta

SEQ ID NO: 301394 - DNA, 75 bp, Artificial Sequence
  Synthetic
aatctgaaacacagtttctagctggtataaattcacaagcagcgaatgattgttttaaaacactaatagcagcta

SEQ ID NO: 301395 - DNA, 75 bp, Artificial Sequence
  Synthetic
ttatgttaatcaaataattcaagcgatgtccaagagatctaggtcactaaattcatcagcattttattacagagt

SEQ ID NO: 301396 - DNA, 75 bp, Artificial Sequence
  Synthetic
aaacaaatggacagagtggtcaaagagatgcgacgccagttggaaatgattgataaattaactacacgtgagatt

SEQ ID NO: 301397 - DNA, 75 bp, Artificial Sequence
  Synthetic
tgtcagaatgcagctacggatgacgacgcaataatagaatatatttactcaaatgaattagatttccagaatttc

SEQ ID NO: 301398 - DNA, 75 bp, Artificial Sequence
  Synthetic
gagatttcagataatgaatgggaaaatactctatcacaattatttttaactaaaggatggccgactggatcagtt

SEQ ID NO: 301399 - DNA, 75 bp, Artificial Sequence
  Synthetic
tcaagaggtatgaactatgaaactccaatgtttaataaggtggcagctctaatttgtgaagcgcttaattcaatt

SEQ ID NO: 301400 - DNA, 75 bp, Artificial Sequence
  Synthetic
attacacttgtacttacgagtaattgaacgaccaattcaatattaccatctacacgtaaccctctatgagcacaa

SEQ ID NO: 301401 - DNA, 75 bp, Artificial Sequence
  Synthetic
cagaactatggagtgaatttgccaattacaggttcaatggatactgcgtatgcaaactctacgcaaagtgagcca

SEQ ID NO: 301402 - DNA, 75 bp, Artificial Sequence
  Synthetic
gtttataagggaatcgttagtcgcgtgtcaactggctatagtaaatacaataatttatccagcatttggaatgca

SEQ ID NO: 301403 - DNA, 75 bp, Artificial Sequence
  Synthetic
tcgcttatcatttcaattagtacgtccaccgaatatgacaccagcagttgcaaacctatttccgcaagcgccacc

SEQ ID NO: 301404 - DNA, 75 bp, Artificial Sequence
  Synthetic
tatagattcttgctatttgttgtaattgtcacaccattcgtaaactcacagaattatggcataaatctaccaatt

SEQ ID NO: 301405 - DNA, 75 bp, Artificial Sequence
  Synthetic
tatccagcagaagctgagacagagattgctgatagttcatggaaagacacattgtcacagttatttttgacaaaa

SEQ ID NO: 301406 - DNA, 75 bp, Artificial Sequence
  Synthetic
atggcgtacaggaaacgtggagcgcgccgtgaggcgaatataaataataatgaccgaatgcaagagaaagatgat

SEQ ID NO: 301407 - DNA, 75 bp, Artificial Sequence
  Synthetic
acgtatataatttattatcaattaattatggatgttatcaactatttgattttaattctccagatttagagaaac

SEQ ID NO: 301408 - DNA, 75 bp, Artificial Sequence
  Synthetic
actgatacggcaacatttgaagaagtcgctacagctgaaaaattggtgattactgacgttgttgatggtgtgaat

SEQ ID NO: 301409 - DNA, 75 bp, Artificial Sequence
  Synthetic
taaatctggtatagctgcaatagagatacagaagatagatgagttattcacattaattagatgtaattttacata

SEQ ID NO: 301410 - DNA, 75 bp, Artificial Sequence
  Synthetic
gacagcaccacaaactgagagaatgatgagagttaattggaagaaatggtggcaagttttttacactgttgttga

SEQ ID NO: 301411 - DNA, 75 bp, Artificial Sequence
  Synthetic
ctaaaaggtatattgcaggtgggaaaatattctttagggctggaataaatttactgaataatgaaaaaagaggac

SEQ ID NO: 301412 - DNA, 75 bp, Artificial Sequence
  Synthetic
cggcattccaatgacgttgctgatgcaaataaaatttataaacgtaggttagatctattcattatagtggcatct

SEQ ID NO: 301413 - DNA, 75 bp, Artificial Sequence
  Synthetic
aaagagatgagacgtcagctggagatgattgataaattaactactcgtgaaattgaacaggttgaattacttaaa

SEQ ID NO: 301414 - DNA, 75 bp, Artificial Sequence
  Synthetic
atgttggatgcgatcaaatggatttctccttgaatagaggtataaaaattgatgctgcagtggattcttcaatat

SEQ ID NO: 301415 - DNA, 75 bp, Artificial Sequence
  Synthetic
tatactgaagatgtagatagtgaaatgtacaatgaatatacaatgttaattagagatgagatagttaaaatgtta

SEQ ID NO: 301416 - DNA, 75 bp, Artificial Sequence
  Synthetic
attagatgattcagatagtgatgatggtaaatgtaaaaattgtaaatataaaaagaaatatttcgcacttcgatt

SEQ ID NO: 301417 - DNA, 75 bp, Artificial Sequence
  Synthetic
tttaacttgattgaaaaacgagctcttcgctaatgttataaagaagaattaaatgtttgacttgattgaatataa

SEQ ID NO: 301418 - DNA, 75 bp, Artificial Sequence
  Synthetic
tggctaacggttagctccttttaatgtatggtattgaatataccacaattctaatctttctgatatcagttattt

SEQ ID NO: 301419 - DNA, 75 bp, Artificial Sequence
  Synthetic
ctccaggcgtcattcctccagtgaatgtagatagaccaattccattagggcgtagagatgttcctggacgaagaa

SEQ ID NO: 301420 - DNA, 75 bp, Artificial Sequence
  Synthetic
gaataatatttatattataaagtatgatatgttattaaacttaataaggtattaatgagcgaaggttgatacgtc

SEQ ID NO: 301421 - DNA, 75 bp, Artificial Sequence
  Synthetic
gtagtggagaagatgttatcctatgcgaagcatactagagaatacgcggagttctattcacagtcaaatcagtta

SEQ ID NO: 301422 - DNA, 75 bp, Artificial Sequence
  Synthetic
gatccaaaagtaatacagacgttaaatttgtataaacaaacacaaattaatcttatggattcatatgtacaaata

SEQ ID NO: 301423 - DNA, 75 bp, Artificial Sequence
  Synthetic
acaatctgaaacgcagtttctggctggtataaattcacaagcagcaaatgattgttttaaaacactaatagcagc

SEQ ID NO: 301424 - DNA, 75 bp, Artificial Sequence
  Synthetic
atgatcaaatgtatagattgagggatagactacgattactgccagtagaagtaagacgattggatatttttaatt

SEQ ID NO: 301425 - DNA, 75 bp, Artificial Sequence
  Synthetic
tcattcaaattataacgaacgaattaacgatgctgtggctattattacggctgctaatagactaaacttatatca

SEQ ID NO: 301426 - DNA, 75 bp, Artificial Sequence
  Synthetic
caagtcaagcaaaattactattaatgatattttgcgtgacataaaaccattctttgtgactaccgaggctaattt

SEQ ID NO: 301427 - DNA, 75 bp, Artificial Sequence
  Synthetic
cattttgattttggattacttggtactactctactcaatttggacgctaattatgttgaaacggcacgcactaca

SEQ ID NO: 301428 - DNA, 75 bp, Artificial Sequence
  Synthetic
agttgtcaggtataagatttaagagaatcaattttgataattcttctgaatatatagagaactggaatcttcaaa

SEQ ID NO: 301429 - DNA, 75 bp, Artificial Sequence
  Synthetic
gttggatcaagaatatattcacaggacaaatataaaatattagagtcttatgtgtacaatttactatctattaat

SEQ ID NO: 301430 - DNA, 75 bp, Artificial Sequence
  Synthetic
atcatattcatatgacaaatataacgctgtcgaacggaaattagttaaatatgcgaaaggtaaaccgttagaagc

SEQ ID NO: 301431 - DNA, 75 bp, Artificial Sequence
  Synthetic
aatgggtacgatgtggttaaatgcaggatctgaaattcaagttgcaggatttgactactcatgtgcgattaatgc

SEQ ID NO: 301432 - DNA, 75 bp, Artificial Sequence
  Synthetic
cctagagttataaattccgcagacggtgctataacttggtattttaatcctgtagttcttagaccaaacaatgtt

SEQ ID NO: 301433 - DNA, 75 bp, Artificial Sequence
  Synthetic
aactgatgcgtcctcctaatatgacaccagctgttgccgctctttttccgaatgctcaaccatttcagcaccacg

SEQ ID NO: 301434 - DNA, 75 bp, Artificial Sequence
  Synthetic
ggaacattcattacaaatgaagagttagagttggagttttcgaataaatacgtacgagccatagtaccagaccaa

SEQ ID NO: 301435 - DNA, 75 bp, Artificial Sequence
  Synthetic
aaaaatttccattaatggctaaaatatattcatggtcgtttcatgttggatttagaaagcaaaaaatgttagatg

SEQ ID NO: 301436 - DNA, 75 bp, Artificial Sequence
  Synthetic
tcggcatgtagctacatcaagctgtccagactttacaagtaagggcatgtttacatgctcgctacgtaaagtaac

SEQ ID NO: 301437 - DNA, 75 bp, Artificial Sequence
  Synthetic
ttgcgaatcatgcagatagagtttatgctactttcaagagtaataataaaaatggaaatgtactggaatttaatt

SEQ ID NO: 301438 - DNA, 75 bp, Artificial Sequence
  Synthetic
atattcatggtcgtttcatgttggatttagaaagcaaaaaatgttagatgccgccctagatcaattgaaaactga

SEQ ID NO: 301439 - DNA, 75 bp, Artificial Sequence
  Synthetic
aagatttgcaacttgaagctttaacaatacaatctgaaacgcagtttctagccggtataaattcacaagcagcga

SEQ ID NO: 301440 - DNA, 75 bp, Artificial Sequence
  Synthetic
tatatctaatcttacaacgcataacatcttatatttaaattacagtattaaaacgcttgaaatattgaataaatc

SEQ ID NO: 301441 - DNA, 75 bp, Artificial Sequence
  Synthetic
tggagaaaagtggtggaacagcaaactgtcaacaatctaaatattgcatataaatatctagcaacaggaaaagcc

SEQ ID NO: 301442 - DNA, 75 bp, Artificial Sequence
  Synthetic
acgcggcagaatttagtgatcgtgatcttttggacatcgcttgaattatttggtttacgtaatcaactacagtgt

SEQ ID NO: 301443 - DNA, 75 bp, Artificial Sequence
  Synthetic
aaaacaataccaacttttgaaccaaaagaatcaattttgaaaaaattagaagatataagaccagaacaagctaag

SEQ ID NO: 301444 - DNA, 75 bp, Artificial Sequence
  Synthetic
aacttgaattacagctacgttctctcttggtcctaatttcttgcaattcctaatagtacacgcattagtcgtaac

SEQ ID NO: 301445 - DNA, 75 bp, Artificial Sequence
  Synthetic
attccaagagtctgcgtgttaagtggacatacttttatcgtgcatgaagatcccatagaaatccacttattagtt

SEQ ID NO: 301446 - DNA, 75 bp, Artificial Sequence
  Synthetic
tcgcgtcatatttcattaatactacattataatcacaatataattgcggatcgactgaaaatgaagcaatatttg

SEQ ID NO: 301447 - DNA, 75 bp, Artificial Sequence
  Synthetic
ttcagttggataatataggcataaagttgacgtgaggaaagcctcttcttgtgtggaattagcatatgcagtatc

SEQ ID NO: 301448 - DNA, 75 bp, Artificial Sequence
  Synthetic
gttgacgtgaggaaagcctcttcttgtgtggaattagcatatgcagtatccattgaaccagtaattggtaagtta

SEQ ID NO: 301449 - DNA, 75 bp, Artificial Sequence
  Synthetic
ggcattatatgcattatcaaatgattttaatgatagaacagatgtaattaacttaattaacaatcagaaacaatc

SEQ ID NO: 301450 - DNA, 75 bp, Artificial Sequence
  Synthetic
gaacttaccagattgaagatgatggttcaaaatcagcaatatctcggcttatatcaaagtactcagtttataaac

SEQ ID NO: 301451 - DNA, 75 bp, Artificial Sequence
  Synthetic
ggcatttcaagaagatcacaccaaattagattttcagagtccgcaacgtcgtattcaggatacatatttagagat

SEQ ID NO: 301452 - DNA, 75 bp, Artificial Sequence
  Synthetic
tacatttacaattgataaattaagacgattatatacaggattaaagactgttgaatatgattctggtatatctga

SEQ ID NO: 301453 - DNA, 75 bp, Artificial Sequence
  Synthetic
aagtgattaatatattggtccatagtattggtaaagtaccacaaatattaactgttggagaatgttataacaatc

SEQ ID NO: 301454 - DNA, 75 bp, Artificial Sequence
  Synthetic
tttaattcaccagacttagaaaaattaattagaataccattcaaagggaagataccagctgtcacatttatacta

SEQ ID NO: 301455 - DNA, 75 bp, Artificial Sequence
  Synthetic
gtgacagattcatcagttatatcactcattgcaaaattggatgctacagtttttgctcaaatagttaaacttaga

SEQ ID NO: 301456 - DNA, 75 bp, Artificial Sequence
  Synthetic
ctgaattgactttttgtcacggatgttcgttggctcacgtttgtcagtggtgcattcaaaataaacgctgcttct

SEQ ID NO: 301457 - DNA, 75 bp, Artificial Sequence
  Synthetic
actaaggacctttgagtctccaatcacaaaggaaaaattgcaatgcataattgatttgtataatttactatttcc

SEQ ID NO: 301458 - DNA, 75 bp, Artificial Sequence
  Synthetic
tttgagagaatgagttctctccctgataacctacaatctatctatgcaaacaaatatttcaaattaagcagactt

SEQ ID NO: 301459 - DNA, 75 bp, Artificial Sequence
  Synthetic
tatcgacatcatcattaaaacaatttgaaacacatgacgtaaacttgggaagaataaaagctgatatttttaaac

SEQ ID NO: 301460 - DNA, 75 bp, Artificial Sequence
  Synthetic
agatatggattggaagatggaatcaatgtataatgaacttttaagctttatccaatcatgttataaaagtaatgt

SEQ ID NO: 301461 - DNA, 75 bp, Artificial Sequence
  Synthetic
ttatttaacgcaatgaatccagtgcaagtgaatgaacaacaggtaattaatttctgctggcaaatagatattgca

SEQ ID NO: 301462 - DNA, 75 bp, Artificial Sequence
  Synthetic
ataattaagggaatcgtgaaccaatggtgcgatattactaaattagatcacttgccgctatgtattgaacagact

SEQ ID NO: 301463 - DNA, 75 bp, Artificial Sequence
  Synthetic
caggtatagcagcagttgaagtacaatctccagatgaattgtttgcattaataagatgtaatttcacgtatgatt

SEQ ID NO: 301464 - DNA, 75 bp, Artificial Sequence
  Synthetic
acgaaaataatatagtttatttgcacgattattcgtactacactaataatgaagtaagaacagatcaacattggg

SEQ ID NO: 301465 - DNA, 75 bp, Artificial Sequence
  Synthetic
cagattatcaatatctttatcatctaaacccaccggaaataatcatttattcataataaatggaactgacaaata

SEQ ID NO: 301466 - DNA, 75 bp, Artificial Sequence
  Synthetic
ctgattatcaatatctttatcatctaaacccaccggaaataatcatttattcataataaatggaactgacaaata

SEQ ID NO: 301467 - DNA, 75 bp, Artificial Sequence
  Synthetic
ccgattatcaatatctttatcatctaaacccaccggaaataatcatttattcataataaatggaactgacaaata

SEQ ID NO: 301468 - DNA, 75 bp, Artificial Sequence
  Synthetic
cggattatcaatatctttatcatctaaacccaccggaaataatcatttattcataataaatggaactgacaaata

SEQ ID NO: 301469 - DNA, 75 bp, Artificial Sequence
  Synthetic
aacatacataagaaagtgataaatgttggtccgagaaatgaatctatgttcacgtttttaaattttccaactatt

SEQ ID NO: 301470 - DNA, 75 bp, Artificial Sequence
  Synthetic
gtatcgcaatttgatattggacaatataaaaacatgttaaatgtagttactactatatactattactataatcta

SEQ ID NO: 301471 - DNA, 75 bp, Artificial Sequence
  Synthetic
tggttcaactccatcttattggatttacaatattaaacactattctgattttacatttgaaacatgggatccatt

SEQ ID NO: 301472 - DNA, 75 bp, Artificial Sequence
  Synthetic
tggttcatctccatcttattggatttacaatattaaacactattctgattttacatttgaaacatgggatccatt

SEQ ID NO: 301473 - DNA, 75 bp, Artificial Sequence
  Synthetic
tggttcacctccatcttattggatttacaatattaaacactattctgattttacatttgaaacatgggatccatt

SEQ ID NO: 301474 - DNA, 75 bp, Artificial Sequence
  Synthetic
tggttcagctccatcttattggatttacaatattaaacactattctgattttacatttgaaacatgggatccatt

SEQ ID NO: 301475 - DNA, 75 bp, Artificial Sequence
  Synthetic
taaacaatataactacagaaaatgtgtttatacagcctcctttcaagttaaaaacgtcacccaatgattatatag

SEQ ID NO: 301476 - DNA, 75 bp, Artificial Sequence
  Synthetic
gggtatttctagaagatcgcatcaaattagattctcagaatctgcgacatcgtattcaggatacattttcagaga

SEQ ID NO: 301477 - DNA, 75 bp, Artificial Sequence
  Synthetic
ataggaattaaattcagtagtataccttatgaatatgatgtcaaaattccgcacttgacgctcggagtgttattt

SEQ ID NO: 301478 - DNA, 75 bp, Artificial Sequence
  Synthetic
agctttagtaataaacaaacggttagaatagaaagtacgaaactcaaaatcagttcgatttatttgaggagaatt

SEQ ID NO: 301479 - DNA, 75 bp, Artificial Sequence
  Synthetic
taaatgaaaatatgtactctcttcaaaatgtcatctcacaacagcaaaatcaaatagcagatcttcaacaatatt

SEQ ID NO: 301480 - DNA, 75 bp, Artificial Sequence
  Synthetic
ctcagaactatggaattaacttgccaataactggatccatggatacaccatatacgaactcaacgatgagtgaaa

SEQ ID NO: 301481 - DNA, 75 bp, Artificial Sequence
  Synthetic
cgtctaatttaacttttaccgtttattctgatttgctatctttcgtttctgcagacacggttgaacctattaacg

SEQ ID NO: 301482 - DNA, 75 bp, Artificial Sequence
  Synthetic
ggcgtttatgtcactatcaagccagaaatcaggaatagcagacgaaatcgcagcatcacaaacgtttaaaaatta

SEQ ID NO: 301483 - DNA, 75 bp, Artificial Sequence
  Synthetic
ttgaagaatataaagatgtaatagataatgcaacgttactatctatattatcatattcttatgataaatacaacg

SEQ ID NO: 301484 - DNA, 75 bp, Artificial Sequence
  Synthetic
aggtaaagtggcagagggtacaaatacgactgatagatggttcgcttgtgtcttagttgaaccaaacgtacaaaa

SEQ ID NO: 301485 - DNA, 75 bp, Artificial Sequence
  Synthetic
ttgtttagaatatttgaaccaagacaattaccaatctatcgagcaaatggtgagaaagaattaaggaatagatgg

SEQ ID NO: 301486 - DNA, 75 bp, Artificial Sequence
  Synthetic
agaaaataaaaactctagagatgctggtaaagttgtagactctgagactgcaagtatttgtgatgctatatttca

SEQ ID NO: 301487 - DNA, 75 bp, Artificial Sequence
  Synthetic
aacaagttcaggctgataggaatattgtcaattatccatcaattttacatccaattgatcatgcatttaatgaat

SEQ ID NO: 301488 - DNA, 75 bp, Artificial Sequence
  Synthetic
gttttaaaacattgatagcagctatgttaagtcaacgtacaatgtcattagattttgtaactacgaattatatgt

SEQ ID NO: 301489 - DNA, 75 bp, Artificial Sequence
  Synthetic
ggctgtgtaatccaatggacgttacattatattattatcagcaaacagacgaaacaaacaaatggatagcaatgg

SEQ ID NO: 301490 - DNA, 75 bp, Artificial Sequence
  Synthetic
ttgatttaacaagattattatcatataattatgaaactttaatggcttgtataactatgaatatgcaacatgttc

SEQ ID NO: 301491 - DNA, 75 bp, Artificial Sequence
  Synthetic
taggtggtgctgatgtccttgatataacgtctgatccgacaactaatccacaaactgaacggatgatgagaataa

SEQ ID NO: 301492 - DNA, 75 bp, Artificial Sequence
  Synthetic
aggaattgaccaaaagatgagagtacttaatgcttgttttagtgtgaaaagaataccaggaaaatcatcatcaat

SEQ ID NO: 301493 - DNA, 75 bp, Artificial Sequence
  Synthetic
aggtcactataatttctcatttatatgtcaaaatgcagctacagatgacgatataataattgaatatatatattc

SEQ ID NO: 301494 - DNA, 75 bp, Artificial Sequence
  Synthetic
ggcttttaaagcgtctcagtcgccgtttgagcttgcggtgtcgttatggctgagctagcctgcttttgctatccc

SEQ ID NO: 301495 - DNA, 75 bp, Artificial Sequence
  Synthetic
attatcaaatcgtgtatttagagataaattatttccatctattgtgaacatacataaaaaagtgataaatgttgg

SEQ ID NO: 301496 - DNA, 75 bp, Artificial Sequence
  Synthetic
atacattagtctatggattggcaccaccaccaatctataagaaaagatttaacgatggaaataattcaagaggga

SEQ ID NO: 301497 - DNA, 75 bp, Artificial Sequence
  Synthetic
tgtcccaatttcagttagacatatggaaaatttaattagacgtattgaaaacgttgatgatataatttctgacga

SEQ ID NO: 301498 - DNA, 75 bp, Artificial Sequence
  Synthetic
gcaggatttactatgtggaaacttgactataaatcacacattttaatgccaatttctgatcccaactttatagaa

SEQ ID NO: 301499 - DNA, 75 bp, Artificial Sequence
  Synthetic
ctcatggcaaaggacactatagagtagtacgatattcaactgtcgcaaatcatgctgatagagtgttttctactt

SEQ ID NO: 301500 - DNA, 75 bp, Artificial Sequence
  Synthetic
agtacgatattcaactgtcgcaaatcatgctgatagagtgttttctacttatagagctattcagaaacgtaaccc

SEQ ID NO: 301501 - DNA, 75 bp, Artificial Sequence
  Synthetic
aatgaatggctatgtaatccaatggatataacactatattattatcaacaaacagatgaagcgaataaatggata

SEQ ID NO: 301502 - DNA, 75 bp, Artificial Sequence
  Synthetic
cagtcacttccttatgtatgctaataggaaatgctacagttatcccaagtccacaaacattatttcattattata

SEQ ID NO: 301503 - DNA, 75 bp, Artificial Sequence
  Synthetic
caaatgatacatcttttaagggagtgacgtcggaaagaaaaatagatgaagtatcacttctgggctaaatttgtt

SEQ ID NO: 301504 - DNA, 75 bp, Artificial Sequence
  Synthetic
aagagactacaaatattcgatgtttctagagttccagatgatcaaatgtacagactcagagatagattgagatta

SEQ ID NO: 301505 - DNA, 75 bp, Artificial Sequence
  Synthetic
tttcattattataacgttaatgttaattttcattcaaattacaatgagagaattaatgatgcagtagctataata

SEQ ID NO: 301506 - DNA, 75 bp, Artificial Sequence
  Synthetic
acaatagttgactacgtgaatcaaattgtgcaagcaatgtccaaaagatcgagatcattaaattctgctgcattt

SEQ ID NO: 301507 - DNA, 75 bp, Artificial Sequence
  Synthetic
tagacattactggatcactaaggttatttccgtcagaacgagtgttaactactaattctacattcaaagtatttg

SEQ ID NO: 301508 - DNA, 75 bp, Artificial Sequence
  Synthetic
tagtcattactggatcactaaggttatttccgtcagaacgagtgttaactactaattctacattcaaagtatttg

SEQ ID NO: 301509 - DNA, 75 bp, Artificial Sequence
  Synthetic
tagccattactggatcactaaggttatttccgtcagaacgagtgttaactactaattctacattcaaagtatttg

SEQ ID NO: 301510 - DNA, 75 bp, Artificial Sequence
  Synthetic
taggcattactggatcactaaggttatttccgtcagaacgagtgttaactactaattctacattcaaagtatttg

SEQ ID NO: 301511 - DNA, 75 bp, Artificial Sequence
  Synthetic
taaaagagagaatttccgtctggctagcggttagctccttttaatgtatggtattgaatataccacaattctaat

SEQ ID NO: 301512 - DNA, 75 bp, Artificial Sequence
  Synthetic
ttacaatctagttttaatgaaatatgattcaacactagaattggacatgtctgaactagcggaccttatattgaa

SEQ ID NO: 301513 - DNA, 75 bp, Artificial Sequence
  Synthetic
agcagatttgacagtgaatgaattagattatgagaataacaagataacatctgaactttttccaaccgcagaaga

SEQ ID NO: 301514 - DNA, 75 bp, Artificial Sequence
  Synthetic
taagaagccatagtcagccatatcgcgtgtggctcaagccttaatcccgtttaaccaatccggtcagcaccggac

SEQ ID NO: 301515 - DNA, 75 bp, Artificial Sequence
  Synthetic
gaaaaactcaaaatctacaaaaggagattggatttatttactatagtagcttcaacagtaaataaatatggtgta

SEQ ID NO: 301516 - DNA, 75 bp, Artificial Sequence
  Synthetic
atgctcaagatggagtctactcagcagatggtaagttctattattaacacttcttttgaagctgcagttgtcgct

SEQ ID NO: 301517 - DNA, 75 bp, Artificial Sequence
  Synthetic
tgctgaattacgtgctcaaatcagtgactagaataatggactacattatatatagatttctattaattattgtaa

SEQ ID NO: 301518 - DNA, 75 bp, Artificial Sequence
  Synthetic
atagacagttattatcaaactcatatgttacaaacatctctgacgaagttaatgaaattggaactaaaaaaacaa

SEQ ID NO: 301519 - DNA, 75 bp, Artificial Sequence
  Synthetic
tatgtcagaattagctgatttgatactgaatgaatggttatgtaatccaatggatataacattatattattatca

SEQ ID NO: 301520 - DNA, 75 bp, Artificial Sequence
  Synthetic
ttctcactaattcatattcggtagacttgcatgacgaaatagaacagattggatcagagaaaactcaaaatgtga

SEQ ID NO: 301521 - DNA, 75 bp, Artificial Sequence
  Synthetic
agataaaaaagatcaggacaagttttataactctatcatctatggaattgcaccaccaccacagttcagaaaacg

SEQ ID NO: 301522 - DNA, 75 bp, Artificial Sequence
  Synthetic
ttaggagttaatgatacatggagaccatcacctccgaccaaatataaaggatggtgtttggattgttgtcaacat

SEQ ID NO: 301523 - DNA, 75 bp, Artificial Sequence
  Synthetic
actctttccttctgaacgcgtattaactacgaattctacatttaaagtatttgactcggaggactttatcataga

SEQ ID NO: 301524 - DNA, 75 bp, Artificial Sequence
  Synthetic
ctgaaggaggggaaataatgtttcaaaacacagcattcactatgtggaaattaacatatttagaacataaactaa

SEQ ID NO: 301525 - DNA, 75 bp, Artificial Sequence
  Synthetic
ctacgtaattttattaatcaaaataatccaattataagaaatagaattgaacagttaattctacaatgtaaattg

SEQ ID NO: 301526 - DNA, 75 bp, Artificial Sequence
  Synthetic
gaattagatggtgatgtttattacatatttggatattatgacaacatgaataatattaatcaaactccattctca

SEQ ID NO: 301527 - DNA, 75 bp, Artificial Sequence
  Synthetic
aaatataaaaagaaatattttgcactaagaatgagaatgaaacaagtcgcaatgcaattgatagaagatttgtaa

SEQ ID NO: 301528 - DNA, 75 bp, Artificial Sequence
  Synthetic
ttaccgcttgatatgttctcaatgttctctggaataaaatcaacggtagaggcagtaaaatctatgactacgaat

SEQ ID NO: 301529 - DNA, 75 bp, Artificial Sequence
  Synthetic
ctacgagctttagttaaatcaaatgttaatattggacattgttcatcacaggaaaagatatatgaatatgttgaa

SEQ ID NO: 301530 - DNA, 75 bp, Artificial Sequence
  Synthetic
ataggtgcagaaaagaaagagaatgtgactgtgcagattggtgaattcgctcaaagtcaatacgcaccagtttca

SEQ ID NO: 301531 - DNA, 75 bp, Artificial Sequence
  Synthetic
acgcaaatttcacaacaaacaatgccagatattatagctgagtcatctgagaagtttataccgaagagatcgtat

SEQ ID NO: 301532 - DNA, 75 bp, Artificial Sequence
  Synthetic
aacttaccgtctaactattggtatttgatcaatccatcaaatgatggtgtggtgttttcagtaacgaataacagc

SEQ ID NO: 301533 - DNA, 75 bp, Artificial Sequence
  Synthetic
attaagacaattatatacaggattaaagactgttgaatatgattctggcatatctgatattgaatagtaaagaaa

SEQ ID NO: 301534 - DNA, 75 bp, Artificial Sequence
  Synthetic
catttctaatctaactacacataacatattatatttgaattatagtcttaaaacattaaaaatattaaataaatc

SEQ ID NO: 301535 - DNA, 75 bp, Artificial Sequence
  Synthetic
caggtggacttggttataaatggtcagagatatcatataaagctaataactaccaatatacgtatatgagagatg

SEQ ID NO: 301536 - DNA, 75 bp, Artificial Sequence
  Synthetic
tctatctgatgagattgatgaaattggatcatcaaaatcacaagatgttacagtaaatccaggaccatttgctca

SEQ ID NO: 301537 - DNA, 75 bp, Artificial Sequence
  Synthetic
atatatgataggatcagcgccatcatattggatatatgatgttaaacagtactctgatttaaaatttgagacgtg

SEQ ID NO: 301538 - DNA, 75 bp, Artificial Sequence
  Synthetic
ttgctcctaatgacaagggtatagttgccgaactgacaaataatacagatatatggttagtcattatactgatcg

SEQ ID NO: 301539 - DNA, 75 bp, Artificial Sequence
  Synthetic
ttttagtagaagaagtcaaaatgatacttatatatctaatgatgcacttttgtcagacacgaaactgcaagctgc

SEQ ID NO: 301540 - DNA, 75 bp, Artificial Sequence
  Synthetic
acttatatatctaatgatgcacttttgtcagacacgaaactgcaagctgcaatgaaatacggtgcaaggctattt

SEQ ID NO: 301541 - DNA, 75 bp, Artificial Sequence
  Synthetic
cattactaatgaagagttagaacttgaattttcagataaatatgttaaagcaattgtacctgaccaaactttcaa

SEQ ID NO: 301542 - DNA, 75 bp, Artificial Sequence
  Synthetic
ggtatatgtaaggtcattggcggctgatttaaattcaataatttgtagtggtggtagctatagttttgcattgcc

SEQ ID NO: 301543 - DNA, 75 bp, Artificial Sequence
  Synthetic
ctgagattcaggttcaggttggcagttgaggaaccaccattttcaataacacgcacacgagtaagtcgattatac

SEQ ID NO: 301544 - DNA, 75 bp, Artificial Sequence
  Synthetic
ggattaccagccgtaaacccgaataatgctagagacttttacgaaataacgggaaggttctctttgatatcgcta

SEQ ID NO: 301545 - DNA, 75 bp, Artificial Sequence
  Synthetic
taaacagacacaaattaatcttatggattcatacgtacaaatacctgacggtaatgtgattaaaaagatccaata

SEQ ID NO: 301546 - DNA, 75 bp, Artificial Sequence
  Synthetic
aatgtaagcggtgtgctatcaacatattttaaaatttacaacgcgttttataaagaacagattacatttggacag

SEQ ID NO: 301547 - DNA, 75 bp, Artificial Sequence
  Synthetic
ttaacactacgagacaacataaatgtagaaacgaatgtatgacacagtggtacaatcatttactaatgccaataa

SEQ ID NO: 301548 - DNA, 75 bp, Artificial Sequence
  Synthetic
aaatttagtagatatatatgataaattattacttgatgatgtgaattttactagaatgtcattcttaccagcatc

SEQ ID NO: 301549 - DNA, 75 bp, Artificial Sequence
  Synthetic
aactgatagaaagatggatgaagtttctcaagtaggaatctaattcgttatctgtttgaaggtgggtatggcaga

SEQ ID NO: 301550 - DNA, 75 bp, Artificial Sequence
  Synthetic
gcatgtaagcttgttaaaaacgtcagtgcgtattttgacatgctgaaaacatcacgtattgaattttatagtgtt

SEQ ID NO: 301551 - DNA, 75 bp, Artificial Sequence
  Synthetic
gtttatttagaaaagcgtcgtgcgcaaatatcagcactattaactatgttgcagaaaccagtgtcgtttaaatca

SEQ ID NO: 301552 - DNA, 75 bp, Artificial Sequence
  Synthetic
aaccatgaaataaattgggatgtgattaatgtattggtccatagtattggtaaagtaccacaaatattaactttg

SEQ ID NO: 301553 - DNA, 75 bp, Artificial Sequence
  Synthetic
atgttgataaaccaataccattaggaagaagagatgtaccaggaagaagaactagaataatattcatattgccgt

SEQ ID NO: 301554 - DNA, 75 bp, Artificial Sequence
  Synthetic
acacattagtttatggattagcgccaccaccaatgtataaaaagagattcaatgatggaaataattcaaggggga

SEQ ID NO: 301555 - DNA, 75 bp, Artificial Sequence
  Synthetic
tattccaatttcagttagacatatggaaaatttgattaggcgtattgaaaatagtgatgacgtaatttctgatga

SEQ ID NO: 301556 - DNA, 75 bp, Artificial Sequence
  Synthetic
gcaggatttaccatgtggaaacttgattataaatcgcatattttaatgccaatttcagatcctaactttatggaa

SEQ ID NO: 301557 - DNA, 75 bp, Artificial Sequence
  Synthetic
cacatggtaaaggccattatcgagtagtaagatattcaacagttgctaatcatgctgatagagtgttctccacct

SEQ ID NO: 301558 - DNA, 75 bp, Artificial Sequence
  Synthetic
agtaagatattcaacagttgctaatcatgctgatagagtgttctccacctacaaagcaatccaaaagcgcaatcc

SEQ ID NO: 301559 - DNA, 75 bp, Artificial Sequence
  Synthetic
aggctacttttcactaaaatgaaaccaaatgatacaccatttaaaggagtgacgtcagaaaggaaaatagatgaa

SEQ ID NO: 301560 - DNA, 75 bp, Artificial Sequence
  Synthetic
taagatgtaattttacgtatgactatgaaaataatatagtttatttacatgattattcatactatactaataatg

SEQ ID NO: 301561 - DNA, 75 bp, Artificial Sequence
  Synthetic
caaatgatacaccatttaaaggagtgacgtcagaaaggaaaatagatgaagtttcacttttaggttaaacttgtt

SEQ ID NO: 301562 - DNA, 75 bp, Artificial Sequence
  Synthetic
atagacgacagcgtactggatttattttccataaaccaaacatatttccatactcatcatcatttactttgaata

SEQ ID NO: 301563 - DNA, 75 bp, Artificial Sequence
  Synthetic
agggatggcgtattttccctatattgcatctgtcctgacggttttattcacattgcataaagcgtcaattccaac

SEQ ID NO: 301564 - DNA, 75 bp, Artificial Sequence
  Synthetic
gatcacaaccagtgcatgataatttaatgggaactatgtggttaaacgctggatcagagattcaggtagctggat

SEQ ID NO: 301565 - DNA, 75 bp, Artificial Sequence
  Synthetic
aaattaaagagagaatgactacatctcttccaattgctagattgtcaaatcgtgtatttagagataaattatttc

SEQ ID NO: 301566 - DNA, 75 bp, Artificial Sequence
  Synthetic
gaagatattataatttcaaaaacttcattatggaaagaaatgcaatataatagagatattataataagatttaaa

SEQ ID NO: 301567 - DNA, 75 bp, Artificial Sequence
  Synthetic
aactaatgcgaccaccaaatatgacgccagcagtcactaatatattcccacaggcaccaccattcatttttcacg

SEQ ID NO: 301568 - DNA, 75 bp, Artificial Sequence
  Synthetic
aagtgactgcagcaatgtaagaggttgagctgccgtcgactgtcctcggaagcggcggagttcttcacagtaagc

SEQ ID NO: 301569 - DNA, 75 bp, Artificial Sequence
  Synthetic
ggcttttaatgcttttcagtggttgctgctcaagatgctcaagatggagtctactcaccatatggttagttctat

SEQ ID NO: 301570 - DNA, 75 bp, Artificial Sequence
  Synthetic
acatttacaccacctactgattattggatacttattaattcaaatacaaatggagtagtatacgagagtacaaat

SEQ ID NO: 301571 - DNA, 75 bp, Artificial Sequence
  Synthetic
ttagcatgtagttatatcaagtcatccagactctacacgtaaggacatgatttcatgtccgctacgtagagtaac

SEQ ID NO: 301572 - DNA, 75 bp, Artificial Sequence
  Synthetic
ggcatctctagaagatcacatcaaattagattctcggagtctgcaacatcatattcagggtacatttttagagat

SEQ ID NO: 301573 - DNA, 75 bp, Artificial Sequence
  Synthetic
ttacaagatgatttaacagtattaagatatgctaatgaaattgaaggatacataaataaagtatataacataact

SEQ ID NO: 301574 - DNA, 75 bp, Artificial Sequence
  Synthetic
gatcacatcaaattaggttttcagaatctgcgacatcatattcaggatatatttttagagatctttcaaacaaca

SEQ ID NO: 301575 - DNA, 75 bp, Artificial Sequence
  Synthetic
attgttaaattatattttgaaatcaataacgagagtgatggactacataatttatagatttttgtttgttgtagt

SEQ ID NO: 301576 - DNA, 75 bp, Artificial Sequence
  Synthetic
tacttctgaattacaagatacaattgatgatatttctgcccagaaatcacaggacgtaacaatcaatccaggacc

SEQ ID NO: 301577 - DNA, 75 bp, Artificial Sequence
  Synthetic
tttttgacatcaactctatgcctatattatccaaccgaagcgtcgaacgagattgcagatacggaatggaagaac

SEQ ID NO: 301578 - DNA, 75 bp, Artificial Sequence
  Synthetic
ggcttttaaagcgctacagtgatgtctctcagcattgacgttacgagtcttcccagcatctcatcaagtatcttt

SEQ ID NO: 301579 - DNA, 75 bp, Artificial Sequence
  Synthetic
tcaataataatacaaccacagtattggatattagcaaatcctgatactgaaggagtgatagtcgaagcggacgcc

SEQ ID NO: 301580 - DNA, 75 bp, Artificial Sequence
  Synthetic
atacgaattcaaacatgtataaattttgtgacttggttagtcacaacggaacgacatatactaaggttgaagagt

SEQ ID NO: 301581 - DNA, 75 bp, Artificial Sequence
  Synthetic
aatggcgatccccagactccatttcaaatagcagaacagcaaatacaaaatttccaagtagctaattggttacat

SEQ ID NO: 301582 - DNA, 75 bp, Artificial Sequence
  Synthetic
agttgcgacaacagagaaactagtgattacagatgttgtagatggtgtaaatcataagttaaatgtaacaacaga

SEQ ID NO: 301583 - DNA, 75 bp, Artificial Sequence
  Synthetic
tgctaatatagaaaatgttcaaactaacatcaaatgtaattattatatcgtacctaaaactcaaacgggacaact

SEQ ID NO: 301584 - DNA, 75 bp, Artificial Sequence
  Synthetic
cgttaatgacagtgagaattaataatacgtttaaagatgaaccaaaagtcggatttaaaaacatttacgattgga

SEQ ID NO: 301585 - DNA, 75 bp, Artificial Sequence
  Synthetic
gaagatatattaatctctaagacgtcattgtggaaggaagtacgatataatagagatattcttattagattcaaa

SEQ ID NO: 301586 - DNA, 75 bp, Artificial Sequence
  Synthetic
gtggcaagttttttatacaatagtcgtttacgtgaatcagatagtccaagcaatgtccaaaagatctagatcact

SEQ ID NO: 301587 - DNA, 75 bp, Artificial Sequence
  Synthetic
gtggattaggttataaatggtctgaaatttcttttaagccaatgaactatgagtacacgtatgaacgtgatggtg

SEQ ID NO: 301588 - DNA, 75 bp, Artificial Sequence
  Synthetic
actttgttatctatactatcatattcttatgacaaatacaacgctgtggaacggaagttagtcaattatgctaaa

SEQ ID NO: 301589 - DNA, 75 bp, Artificial Sequence
  Synthetic
gtaacattaaactccgacgctgtaacattatcaacacaatatacagattttgtatcacttaattcactacgattc

SEQ ID NO: 301590 - DNA, 75 bp, Artificial Sequence
  Synthetic
atattaacttcgctatcttcaaatttaaatgcagtcatgttttggttagaacgacattcaaatgacgttgctgat

SEQ ID NO: 301591 - DNA, 75 bp, Artificial Sequence
  Synthetic
aatactatgaaactgctggtagattttctttaatttcacttgttccatctaatgatgactatcaaactcctattc

SEQ ID NO: 301592 - DNA, 75 bp, Artificial Sequence
  Synthetic
tgaatacaaaattactttgaatgaagacagacccatttcagatgcatgtgtaaaggagcttgtagctgaactgag

SEQ ID NO: 301593 - DNA, 75 bp, Artificial Sequence
  Synthetic
aaaagatttgaatcattaaagcaaagagtcaatgaaaaatataatagttgggtgcaaaaagcgaagaaagtaaat

SEQ ID NO: 301594 - DNA, 75 bp, Artificial Sequence
  Synthetic
tgacttagctttattaccgcttgatatgttttcaatgttctcaggaattaaatcaacaatagatgcagtgaaatc

SEQ ID NO: 301595 - DNA, 75 bp, Artificial Sequence
  Synthetic
agatcatcatcaatacgttcgaatgcatcagtatggaatgacttaatagatacggcaacacaaacttcatatgct

SEQ ID NO: 301596 - DNA, 75 bp, Artificial Sequence
  Synthetic
tttaaaggattgttgcagcaaagtaattacacttatacttatgagtaaacatagcatattaccatcttcacgtaa

SEQ ID NO: 301597 - DNA, 75 bp, Artificial Sequence
  Synthetic
cagctgctgtattgaagacgaaaatcgataagcttgacgctgtacaaccaaaattattacctacaattatagctg

SEQ ID NO: 301598 - DNA, 75 bp, Artificial Sequence
  Synthetic
tatatagattccttctaattatagttatagtgtcaccatttctcaatgcacaaaattacgggataaaccttccga

SEQ ID NO: 301599 - DNA, 75 bp, Artificial Sequence
  Synthetic
ggatacgttagaagaagtggtatttgatgtagaaaagttcgctaatcttgttacggattcaccagtaatatcagc

SEQ ID NO: 301600 - DNA, 75 bp, Artificial Sequence
  Synthetic
gaattcataaatcagaataatccaattataaaaaatagaatagaacaactcatacttcaatgtagaatataatag

SEQ ID NO: 301601 - DNA, 75 bp, Artificial Sequence
  Synthetic
tatggacattactttgtattattatcaacagactgatgaggcaaacaaatggatttcaatgggatcgtcttgtac

SEQ ID NO: 301602 - DNA, 75 bp, Artificial Sequence
  Synthetic
aagcagatggttcaagatgtatcaaatgatgtaagatatatatattctaggatgaatgcaaaagttaaagcgttg

SEQ ID NO: 301603 - DNA, 75 bp, Artificial Sequence
  Synthetic
aataaaagtatgtccattaaatacacaaacattgggaatagggtgtttaactactgatacaaatacgttcgaaga

SEQ ID NO: 301604 - DNA, 75 bp, Artificial Sequence
  Synthetic
gtggcaagtattctatacgatagttgattatgtgaatcagattgtgcaagcaatgtccaaaagatcaagatcatt

SEQ ID NO: 301605 - DNA, 75 bp, Artificial Sequence
  Synthetic
tatatacagatgtgtctcaatgggattcatctcaacataatacgcaaccgtttaggaaaggaataataatgggat

SEQ ID NO: 301606 - DNA, 75 bp, Artificial Sequence
  Synthetic
taagagaacaagaaatacagttgtatttagtctcattgggagttccaccagttgatgctggtacatacgttgggt

SEQ ID NO: 301607 - DNA, 75 bp, Artificial Sequence
  Synthetic
tccagacttagagaagcttatacgaattccatttaaaggtaaaataccagctgtaacattcatattgcatcttta

SEQ ID NO: 301608 - DNA, 75 bp, Artificial Sequence
  Synthetic
tatggaatgattttagagttaagaagatatatgataatatcttaaattttttacgagctttagtcaaatcaaatg

SEQ ID NO: 301609 - DNA, 75 bp, Artificial Sequence
  Synthetic
aataattttaattataatggtggatttttacctacagactttaatatatctagatatgaagtgattaaagaaaat

SEQ ID NO: 301610 - DNA, 75 bp, Artificial Sequence
  Synthetic
ttcaaaattttctgttaagaaaaattaaagagagaatgaccacatctcttccaattgctagattgtcaaatcgtg

SEQ ID NO: 301611 - DNA, 75 bp, Artificial Sequence
  Synthetic
gaaattaatcaaaagaacgtaagaacgctagaagagtgggagagtggaaaaaatccttatgaaccaaaagaagtg

SEQ ID NO: 301612 - DNA, 75 bp, Artificial Sequence
  Synthetic
caaagaataatttggcagaactggtatgcgtttacatcttcaatgaaacaaggtaatactcttgatatatgtaag

SEQ ID NO: 301613 - DNA, 75 bp, Artificial Sequence
  Synthetic
atgacaccagcagtagcagcattatttccaaatgcgcaaccatttgaacatcatgctacagtaggactgacgctg

SEQ ID NO: 301614 - DNA, 75 bp, Artificial Sequence
  Synthetic
aacagtggctaaattagatgaagatgtgaataaacttagaatgatgttatcttctaaagggattgatcaaaagat

SEQ ID NO: 301615 - DNA, 75 bp, Artificial Sequence
  Synthetic
tggttagcggttagctccttttaatgtatgggatcgaatatacaacggcactaacctttttgatatcattcattt

SEQ ID NO: 301616 - DNA, 75 bp, Artificial Sequence
  Synthetic
tcaagatgaggaaacagaaggagtcattagaagattcatcgcagatatgagacaacaagttcaagctgacagaaa

SEQ ID NO: 301617 - DNA, 75 bp, Artificial Sequence
  Synthetic
tgggatccattagacactccatattctacaatacatcataaggaattattttttgataaggatgtcaataaactt

SEQ ID NO: 301618 - DNA, 75 bp, Artificial Sequence
  Synthetic
tattggatttatgatattaaacagtattctgatttcacatttgaaacatgggatccattagatactccatattct

SEQ ID NO: 301619 - DNA, 75 bp, Artificial Sequence
  Synthetic
ctactaaagatgaaatagaaaaacaaatggacagagttgttaaagaaatgagacgtcaattagagatgattgata

SEQ ID NO: 301620 - DNA, 75 bp, Artificial Sequence
  Synthetic
agagatctttcaaataataattttaatctaataggtactaacgtggagaattcagtttcaggacatgtctataat

SEQ ID NO: 301621 - DNA, 75 bp, Artificial Sequence
  Synthetic
tttggattatcaatatctctatcatctaaacccactggaaataatcatttatttataataaatggaactgacaaa

SEQ ID NO: 301622 - DNA, 75 bp, Artificial Sequence
  Synthetic
aagaatatacggacgctaaatgaatgggagaatggggagaatccatatgaaccaagtgaagtgaccgcaccattg

SEQ ID NO: 301623 - DNA, 75 bp, Artificial Sequence
  Synthetic
gtgacgtaaccaaacttaaagataattcgatattatatgtagatatacgaacggatagagaaaatacagattgga

SEQ ID NO: 301624 - DNA, 75 bp, Artificial Sequence
  Synthetic
cgaactcaacgcgagaggaagtattcctaacttcgactttatgtttatattacccaactgaagcagcaacagaaa

SEQ ID NO: 301625 - DNA, 75 bp, Artificial Sequence
  Synthetic
aactgatgttgttgacggagtcaatcacaagcttgatgtaaccacagctacttgtactattagaaattgcaaaaa

SEQ ID NO: 301626 - DNA, 75 bp, Artificial Sequence
  Synthetic
gcacgttggaatttaattcgctttcgattctaggatgatgatgacggagcaagaatagaaagcgcttatgtgacc

SEQ ID NO: 301627 - DNA, 75 bp, Artificial Sequence
  Synthetic
agaaatgttaatgtcagtgttttctcatgaggattatctgatagcaaaagagttgatagttctatcatattcaaa

SEQ ID NO: 301628 - DNA, 75 bp, Artificial Sequence
  Synthetic
cacagtaaataagtatggagtaccaagacataacgagaaatacagatatgattatgaagtaatgaaagataagcc

SEQ ID NO: 301629 - DNA, 75 bp, Artificial Sequence
  Synthetic
tcaggatcctgggatggcgtattttccatatattgcatctgttctgacagttttattcacattacataaagcttc

SEQ ID NO: 301630 - DNA, 75 bp, Artificial Sequence
  Synthetic
tttaccatagtggcatctacaataaataaatatggagtacccagacataatgaaaaatacagatatgaatacgag

SEQ ID NO: 301631 - DNA, 75 bp, Artificial Sequence
  Synthetic
accttatggattcatatgtccaaatccctgacggcaacgtgattaaaaagattcaatatggagctgttgcttcag

SEQ ID NO: 301632 - DNA, 75 bp, Artificial Sequence
  Synthetic
catattgcgtacaaatatctatctacaggaaaagctaagatatgttgtgttaaaatgaccgccatggatttagaa

SEQ ID NO: 301633 - DNA, 75 bp, Artificial Sequence
  Synthetic
agaattttatttaatgatggatatatgggactctaaaaatattaagagatttataccaaaaggtgtattatactc

SEQ ID NO: 301634 - DNA, 75 bp, Artificial Sequence
  Synthetic
actggatctatggatacaaattatcagaacgtctcaactttagaaccatttttgacatcaacattatgtttttat

SEQ ID NO: 301635 - DNA, 75 bp, Artificial Sequence
  Synthetic
aacctaagcaactaccaatatatagagcaaacggagagaaagaattacgtaacagatggtattggaaactaaaac

SEQ ID NO: 301636 - DNA, 75 bp, Artificial Sequence
  Synthetic
taataaaactaattaataatcagaaaaaagcgttgataacagtgagaattaataatacgtttaaggatgaaccaa

SEQ ID NO: 301637 - DNA, 75 bp, Artificial Sequence
  Synthetic
tttttcagtaaaccctcagttgtattgtgattataacatagttctaatgaaatacaatgctaattcagagttaga

SEQ ID NO: 301638 - DNA, 75 bp, Artificial Sequence
  Synthetic
catggctgttgagaataaaaattctagagatgcaggtaaagttgttgactctgaaactgcagccatttgtgacgc

SEQ ID NO: 301639 - DNA, 75 bp, Artificial Sequence
  Synthetic
atatcaaaatattcagtttataaaccatcaattgaagaattatataaagttatatctttaagagaacaagaaata

SEQ ID NO: 301640 - DNA, 75 bp, Artificial Sequence
  Synthetic
actaaacatggatcgaaatttgccctcgacggccagatatattagaccaaatctacttcaggatagacttaactt

SEQ ID NO: 301641 - DNA, 75 bp, Artificial Sequence
  Synthetic
ttttggatattacagctgatccaacgacagcaccacagactgagagaatgatgagagtaaattggaaaaaatggt

SEQ ID NO: 301642 - DNA, 75 bp, Artificial Sequence
  Synthetic
cagaacgagtgttaactactaattctacattcaaagtatttgattcagaagatttcattatagaatatggaacaa

SEQ ID NO: 301643 - DNA, 75 bp, Artificial Sequence
  Synthetic
atgtccaaaagatctagatcgttagattcagcggcattttattatagaatttaaatatcactgagattagaattg

SEQ ID NO: 301644 - DNA, 75 bp, Artificial Sequence
  Synthetic
gctcaaatacagaaaatgtcacaggatttacagttagaagcactgacaattcaatcagaaacacaatttttaaca

SEQ ID NO: 301645 - DNA, 75 bp, Artificial Sequence
  Synthetic
gtaacatacgctgatgatcctaactattttattggaattaagtttaaaaatattccttataagtacgacgttaag

SEQ ID NO: 301646 - DNA, 75 bp, Artificial Sequence
  Synthetic
cttaccgacctcaactatacattgagtgtaatcactctaatgaatagtacactacacacaatactagaggatcca

SEQ ID NO: 301647 - DNA, 75 bp, Artificial Sequence
  Synthetic
gggatggcgtattttccttacattgcatctgtcctaacagttttgttcacattgcacaaagcgtcaattccaacg

SEQ ID NO: 301648 - DNA, 75 bp, Artificial Sequence
  Synthetic
atattcagtttacaaaccatcaattgaggaactatataaagttatatctttacgagaacaagaaatacagttgta

SEQ ID NO: 301649 - DNA, 75 bp, Artificial Sequence
  Synthetic
aacgataacataagaaacggtcatgtaattaaccaattgatggaagcgttaatgcaattgtcacgacagcaattt

SEQ ID NO: 301650 - DNA, 75 bp, Artificial Sequence
  Synthetic
cctatcgaacagattaggacaattagttgacttaaccagactattggcgtataattatgaaactctaatggcgtg

SEQ ID NO: 301651 - DNA, 75 bp, Artificial Sequence
  Synthetic
aaatataagaaaaagtatttcgcactaagaatgaggatgaagcgagtcgcaatgcaattgatcgaagatttgtaa

SEQ ID NO: 301652 - DNA, 75 bp, Artificial Sequence
  Synthetic
aaatttggtaggaaaacagttttttcaactaaaaagaacatgcatgttatggatgatatggctaatggaagatat

SEQ ID NO: 301653 - DNA, 75 bp, Artificial Sequence
  Synthetic
actacgacatgtactattcgaaattgtaagaagttaggtccaagagagaacgtagctgtaatacaagttggtggc

SEQ ID NO: 301654 - DNA, 75 bp, Artificial Sequence
  Synthetic
acagtataagagagcacaagttaatgaagacattacaatttcaaaaacttcattatggaaagaaatgcaatataa

SEQ ID NO: 301655 - DNA, 75 bp, Artificial Sequence
  Synthetic
tcgatgtttctagagttccagatgatcaaatgtatagacttagagatagattgagattgcttccagttgaaatta

SEQ ID NO: 301656 - DNA, 75 bp, Artificial Sequence
  Synthetic
cattagaagcatgcttatcaaatgaggaccaagctaacatcttggtatctgattttggtgagtatgtagctgtat

SEQ ID NO: 301657 - DNA, 75 bp, Artificial Sequence
  Synthetic
ggcttttaaacgaagtcttcgacatggaggttctgtactcattgtcaaaaactttgaaagatgctagagacaaaa

SEQ ID NO: 301658 - DNA, 75 bp, Artificial Sequence
  Synthetic
ggtaaaggtcactatagagttgttaaatattcatcagttgctaatcatgcagatagagtatttgctacatataag

SEQ ID NO: 301659 - DNA, 75 bp, Artificial Sequence
  Synthetic
aatactaatgataactcaaggggaatgaactttgaaacgcaaatgttcaccaaggtggcaatgttgatttgtgaa

SEQ ID NO: 301660 - DNA, 75 bp, Artificial Sequence
  Synthetic
tgaactttgaaacgcaaatgttcaccaaggtggcaatgttgatttgtgaagctctgaattcactaaaaattactc

SEQ ID NO: 301661 - DNA, 75 bp, Artificial Sequence
  Synthetic
gatgggaactatgtggattaatgccggatcagaaattcaagtagctgggtttgattattcgtgcgctattaatgc

SEQ ID NO: 301662 - DNA, 75 bp, Artificial Sequence
  Synthetic
agttattctaagaccaagcaatgtggaagttgaatttctattgaatggacagataattaacacatatcaggcacg

SEQ ID NO: 301663 - DNA, 75 bp, Artificial Sequence
  Synthetic
cagtataacaaatttgcagttattacacacggaaagggacactatagagtagttaagtattcatcagtcgccaat

SEQ ID NO: 301664 - DNA, 75 bp, Artificial Sequence
  Synthetic
tcaatatggtagatgttttcttgataatgaaccacatttattaaggatgagaacttttaaaaatgaagtgacaaa

SEQ ID NO: 301665 - DNA, 75 bp, Artificial Sequence
  Synthetic
gatggtgatgtttattacatatttggatattatgataacatgaataatattaatcaaactccattctcatttgta

SEQ ID NO: 301666 - DNA, 75 bp, Artificial Sequence
  Synthetic
taaaacaaagggtaaatgagaaatatactacttgggtgcagaaagcaaaaagagttaatgaaaatatgtgtgctc

SEQ ID NO: 301667 - DNA, 75 bp, Artificial Sequence
  Synthetic
tactatctactattactataatttacactcttcaaaacctattatatacatgcttggttcagctccatcttattg

SEQ ID NO: 301668 - DNA, 75 bp, Artificial Sequence
  Synthetic
ttggacattgttcatcacaggaaaagatatatgaatatgttgaagatgttctgaatgtgtgtgatgacgaaagat

SEQ ID NO: 301669 - DNA, 75 bp, Artificial Sequence
  Synthetic
tgatagaacattcttaatgtttaagggactactacggcaatgcaactatgaatatgcatatgaatagtcacataa

SEQ ID NO: 301670 - DNA, 75 bp, Artificial Sequence
  Synthetic
tacttgatcaaagaataatatggcagaactggtatgcgtttacatcctcaatgaaacaaggtaacactcttgaaa

SEQ ID NO: 301671 - DNA, 75 bp, Artificial Sequence
  Synthetic
tactacttggtaacatgggcaaattcttcaattgaaatgctaatgtcagttttttctcatgaggattatttaatt

SEQ ID NO: 301672 - DNA, 75 bp, Artificial Sequence
  Synthetic
attatcagagaaagtgctatctcaaaaggaagaggtgattacagataatcaagaagaaattaaaatagctgatga

SEQ ID NO: 301673 - DNA, 75 bp, Artificial Sequence
  Synthetic
taaaaagaaatattttatattgagaatgagaatgaagcaagtcgcgatgcaattaattgaagacttgtaactcta

SEQ ID NO: 301674 - DNA, 75 bp, Artificial Sequence
  Synthetic
tgtatcgagaatatacaatgttaataagagatgaagttgtgaaaatgcttgaggaaccagtaaaacatgatgatc

SEQ ID NO: 301675 - DNA, 75 bp, Artificial Sequence
  Synthetic
tggtttactatcaatgtcatcagcgtcaaatggtgaatcaagacaactaaaatttggtagaaagacaattttttc

SEQ ID NO: 301676 - DNA, 75 bp, Artificial Sequence
  Synthetic
ttattacagcggctaacagattaaatttatatcaaaagaaaatgaagtcaatagttgaagattttttgaaaaggc

SEQ ID NO: 301677 - DNA, 75 bp, Artificial Sequence
  Synthetic
ctagaaatctcgatggataccaacaaatcaatctagaagaattgatgagaacaggagactatggccagattacca

SEQ ID NO: 301678 - DNA, 75 bp, Artificial Sequence
  Synthetic
gagaatcacaaagaaatggaattgctcctcaatccgatgcactacgtaaactatctggtattaaatttaaaagaa

SEQ ID NO: 301679 - DNA, 75 bp, Artificial Sequence
  Synthetic
caaactctaactactgaaaagttgcaattaacatcagttacttccttatgtatgttaataggaaatgctacagtt

SEQ ID NO: 301680 - DNA, 75 bp, Artificial Sequence
  Synthetic
ccgcaaatagattgaatttgtatcagaaaaagatgaagtcgatagttgaagatttcttaaagagactacaaatat

SEQ ID NO: 301681 - DNA, 75 bp, Artificial Sequence
  Synthetic
atggctgagctagcttgcttttgctatcctcatctagagaatgatagctataaatttattccttttaataattta

SEQ ID NO: 301682 - DNA, 75 bp, Artificial Sequence
  Synthetic
atttctcatttctaacctaactacacataatatactatatttaaattatagtcttaaaacattaaaaatattaaa

SEQ ID NO: 301683 - DNA, 75 bp, Artificial Sequence
  Synthetic
tttcaagagtagtttctgtgagacatcttgagaatttagtattgagaagagaaaatcatcaggacgttctttttc

SEQ ID NO: 301684 - DNA, 75 bp, Artificial Sequence
  Synthetic
atgaaacgagaaagtaatccatttaagggactgtcaactgatagaaagatggatgaagtttctcaagtaggaatt

SEQ ID NO: 301685 - DNA, 75 bp, Artificial Sequence
  Synthetic
gccatcaacagctagatatataagacctaatttactacaagacagactgaatttacatgacaattttgaatcctt

SEQ ID NO: 301686 - DNA, 75 bp, Artificial Sequence
  Synthetic
tgtgtaaaaggttgcttttccaaaaaatgaagcaagaaaaaaatccatttaaaggcctgtcaacggatagaaaga

SEQ ID NO: 301687 - DNA, 75 bp, Artificial Sequence
  Synthetic
caacaaactgatgaagcaaataaatggatatcaatgggttcatcctgtacagttaaagtgtgtccattaaatacg

SEQ ID NO: 301688 - DNA, 75 bp, Artificial Sequence
  Synthetic
ctattaagcaattttcaaatggtgcgtatattgtgaagcatactattaaattgaagcaggagaaatggttgggta

SEQ ID NO: 301689 - DNA, 75 bp, Artificial Sequence
  Synthetic
tgatactgatgaacatggatcagatagaacgcgcatcagataaaattgcgcagggtgttattattgcataccgcg

SEQ ID NO: 301690 - DNA, 75 bp, Artificial Sequence
  Synthetic
aatttagatgggttccagcaaataaacctagaagagttgatgagaacaggcgattatgcacaaataactaacatg

SEQ ID NO: 301691 - DNA, 75 bp, Artificial Sequence
  Synthetic
taactggatccatggatacaccatatgggaattctacgatgagcgaaacatttttaacttcaactttgtgtctat

SEQ ID NO: 301692 - DNA, 75 bp, Artificial Sequence
  Synthetic
tgggaattctacgatgagcgaaacatttttaacttcaactttgtgtctatactacccaaatgaagcagctactga

SEQ ID NO: 301693 - DNA, 75 bp, Artificial Sequence
  Synthetic
atgaagacagagctatttaaaatggaaattagtactagttatacttatatgctgtctgataatatatatgtagca

SEQ ID NO: 301694 - DNA, 75 bp, Artificial Sequence
  Synthetic
ggatatccatgggttcttcatgtacgattaaagtatgtcctctaaatacgcagactcttgggatagggtgtacaa

SEQ ID NO: 301695 - DNA, 75 bp, Artificial Sequence
  Synthetic
aagtagataaaaaagatcaagataaattttacaattctattgtttatggaattgcgccaccaccacaatttaaaa

SEQ ID NO: 301696 - DNA, 75 bp, Artificial Sequence
  Synthetic
actactgcaccacaaactgaaagaatgatgcgtataaactggaagagatggtggcaagtcttttatacaatagtc

SEQ ID NO: 301697 - DNA, 75 bp, Artificial Sequence
  Synthetic
actcttaaggatgctagagacaaaatcgtcgaaggcacattatactcgaatgtgagtgatctaattcaacaattt

SEQ ID NO: 301698 - DNA, 75 bp, Artificial Sequence
  Synthetic
gtggcaagtcttttatacaatagtcgattatgttaaccaaattgtacaagtcatgtccaagcggtcacgatcttt

SEQ ID NO: 301699 - DNA, 75 bp, Artificial Sequence
  Synthetic
aaagatgaatatgaaaatgcatttcttatttctaatctaactacacataatatattgtatttaaattatagcatt

SEQ ID NO: 301700 - DNA, 75 bp, Artificial Sequence
  Synthetic
tatattgaaaattggaatctacagaatagaagacagagaacaggttttacattccacaaaccaaacatctttcct

SEQ ID NO: 301701 - DNA, 75 bp, Artificial Sequence
  Synthetic
atgaaacaaggtaatacaattgatgtatgtaagaaactactcttccaaaagatgaaacaagagaaaaatccattt

SEQ ID NO: 301702 - DNA, 75 bp, Artificial Sequence
  Synthetic
tacatttaaagatgaaccaaaagtggggtttaaagatatttatgattggacttttttgccaactgattttgaaac

SEQ ID NO: 301703 - DNA, 75 bp, Artificial Sequence
  Synthetic
aaatgagtcaataattacgtcatatgacggttgtttaggtatatttggtttatcaatatcactagcttcaaaacc

SEQ ID NO: 301704 - DNA, 75 bp, Artificial Sequence
  Synthetic
gaacgcagttatgttttggttagaacggcattctaatgacgttgctgacgcaaataaaatttataaacgcagatt

SEQ ID NO: 301705 - DNA, 75 bp, Artificial Sequence
  Synthetic
agagaatggaggaaagtagtagaacagcaaaccattagtaatttaaacactgcatataaatacctatcaacagga

SEQ ID NO: 301706 - DNA, 75 bp, Artificial Sequence
  Synthetic
taagcatgtagctatatcaagctgattgaactctgtaagtaaggatgtatttatacattcgctacacagagtaat

SEQ ID NO: 301707 - DNA, 75 bp, Artificial Sequence
  Synthetic
actcaaacagatcgacactagctaaattagtatcgtctccaatgtcaatactagtcgcattaatagatattaatg

SEQ ID NO: 301708 - DNA, 75 bp, Artificial Sequence
  Synthetic
gctgcaagacgatttaacagtattaagatattcaaatgaaatagaaaactacattaataaagtgtatagtataac

SEQ ID NO: 301709 - DNA, 75 bp, Artificial Sequence
  Synthetic
cagatgaaatctatgtagcgaacgtaagcggcgtattatcaacatattttaaactttacaatgcattctacaaag

SEQ ID NO: 301710 - DNA, 75 bp, Artificial Sequence
  Synthetic
tatactgaagatgtagataatgaaatgtacaacgaatatacaatgttaatcagagatgaagtagtcaaaatgtta

SEQ ID NO: 301711 - DNA, 75 bp, Artificial Sequence
  Synthetic
gaatagatagtacgcgattgaatatagactttatatatttgaggaaaataaaaggcgatacagtgttcgatatga

SEQ ID NO: 301712 - DNA, 75 bp, Artificial Sequence
  Synthetic
gttctattcacagtcaaatcagttattggcgtatggtgacgttacaagatttctatctagcaattctatggtact

SEQ ID NO: 301713 - DNA, 75 bp, Artificial Sequence
  Synthetic
agataattcaattttatatatagatataagaactgatagaggtaatatggattggaaagagtggagaaaaatagt

SEQ ID NO: 301714 - DNA, 75 bp, Artificial Sequence
  Synthetic
aaattatacaacatgttctatagaaatcatattacgtttggacaatcacgaatgtttattcctcacattacgctt

SEQ ID NO: 301715 - DNA, 75 bp, Artificial Sequence
  Synthetic
aagcggctatcttatattcaaactatattattaataagttacgtggatttgagacggatagagaatttatattaa

SEQ ID NO: 301716 - DNA, 75 bp, Artificial Sequence
  Synthetic
cgattaatcccggaccgtttgctcaaacaaattatgcaccagtgacttggagtcatggggaagtgaatgattcga

SEQ ID NO: 301717 - DNA, 75 bp, Artificial Sequence
  Synthetic
aacgtacaatatataattcaatgtataggatctagaacttatcaaattgaagatgacggttcaaaatcagccata

SEQ ID NO: 301718 - DNA, 75 bp, Artificial Sequence
  Synthetic
gttatttaaatcagctgaagaatatactgattcattaatggatcctgccatattaacttcattatcgtcaaattt

SEQ ID NO: 301719 - DNA, 75 bp, Artificial Sequence
  Synthetic
tgatgtaatcacagtgctgaagaaaatgaagacagagctatttaaaatggaaattagcactagttatacttatat

SEQ ID NO: 301720 - DNA, 75 bp, Artificial Sequence
  Synthetic
cagctatagaaatgcttatgtcagtattttctcacgaagattatttaatcgcaaaggaactaattattctatcat

SEQ ID NO: 301721 - DNA, 75 bp, Artificial Sequence
  Synthetic
aaatggttcatggataagtttattctgtaattatccaaaatcagagatgataaaattatggaagaagatgtggaa

SEQ ID NO: 301722 - DNA, 75 bp, Artificial Sequence
  Synthetic
catcatcaataattaaatgcactagacttatgaaggataaaatagaacgtggggaagttgaggttgatgattcat

SEQ ID NO: 301723 - DNA, 75 bp, Artificial Sequence
  Synthetic
tgtggaatattacgtcactacgttcgccatatactaatgcgaacttctttcaagattagagcgcttagatgtgac

SEQ ID NO: 301724 - DNA, 75 bp, Artificial Sequence
  Synthetic
cttaatcagatctgatcccagagttttacgcgattttatcaaccagaataatccaattattaaaaatagaattga

SEQ ID NO: 301725 - DNA, 75 bp, Artificial Sequence
  Synthetic
ctcttcagaatgtcatttcacaacagcaaaaccaaatagcagatcttcaacaatattgtaataaattggaagctg

SEQ ID NO: 301726 - DNA, 75 bp, Artificial Sequence
  Synthetic
tgtacaatgagtacacgatgttgattagggatgaagtagtcaagatgctggaagaaccagtcaaacatgatgatc

SEQ ID NO: 301727 - DNA, 75 bp, Artificial Sequence
  Synthetic
tgatcaagctctaaatggtaaatttagttcagcaataaggaacagaaattggatgactgattctcaaactgtagc

SEQ ID NO: 301728 - DNA, 75 bp, Artificial Sequence
  Synthetic
tactagagttaaaagtaaatttgattatgtgatggatgactctggtgttaaaaacaatcttttgggtaaagctat

SEQ ID NO: 301729 - DNA, 75 bp, Artificial Sequence
  Synthetic
cgaagcatactagagaatatgcggagttctattcgcagtcaaatcagttgttatcgtatggcgatgttacaagat

SEQ ID NO: 301730 - DNA, 75 bp, Artificial Sequence
  Synthetic
attataactgatagccaagaaaagattgaaattgttgacgaagtaaaaaaatcaacgaaggaagaatccaaacaa

SEQ ID NO: 301731 - DNA, 75 bp, Artificial Sequence
  Synthetic
ataaagtgattaaatattgtatagtcacgatcattaatactcttttaaaattggctggatataaagagcaggtta

SEQ ID NO: 301732 - DNA, 75 bp, Artificial Sequence
  Synthetic
ctcttcaccgcaagccccattagacctgatgattgactgagaagccacagtcaatcatatcgcgtgtggctcagc

SEQ ID NO: 301733 - DNA, 75 bp, Artificial Sequence
  Synthetic
ctgagaagccacagtcaatcatatcgcgtgtggctcagccttaatcccgtttaaccaatccagcgagtgttggac

SEQ ID NO: 301734 - DNA, 75 bp, Artificial Sequence
  Synthetic
tggctagcggttagctccttttaatgtatggtattgaatataccacaactctaatcttcttgatattgcttgtat

SEQ ID NO: 301735 - DNA, 75 bp, Artificial Sequence
  Synthetic
taaatgcagttatgttttggctagaaaaacatgaaaatgatgttgctgaaaaatctaaaatttataaaaggagat

SEQ ID NO: 301736 - DNA, 75 bp, Artificial Sequence
  Synthetic
gtatggtattgaatataccacaactctaatcttcttgatattgcttgtattattgaattatatattaaaatcagt

SEQ ID NO: 301737 - DNA, 75 bp, Artificial Sequence
  Synthetic
acgatgttaattacatacttaatatggataggaatttaccatcaacagctagatacataagacccaatttattac

SEQ ID NO: 301738 - DNA, 75 bp, Artificial Sequence
  Synthetic
tccaccagttgacgcgggcacatacgttggatcaagaatatattcacaggataaatataaaatattagaatctta

SEQ ID NO: 301739 - DNA, 75 bp, Artificial Sequence
  Synthetic
tggattagtttattctgtaattatccaaaatctgagatgattaaattatggaagaaaatgtggaatataacagcg

SEQ ID NO: 301740 - DNA, 75 bp, Artificial Sequence
  Synthetic
aaattatggaagaaaatgtggaatataacagcgttacgatcgccttatactagtgcgaatttctttcaagattag

SEQ ID NO: 301741 - DNA, 75 bp, Artificial Sequence
  Synthetic
tgtcagtgcttattttgatatgctgaaaacatcacgtattgaattttatagtgtttctactagatgtagaatatt

SEQ ID NO: 301742 - DNA, 75 bp, Artificial Sequence
  Synthetic
ggcttttaatgcttttcagtggttgatgctcaagatggagtctactcagcagatggcatcttctattattaactc

SEQ ID NO: 301743 - DNA, 75 bp, Artificial Sequence
  Synthetic
ttataccaaaaggtgtattttatgcttttataaataatataaccacagaaaatgtgtttatacaacctcctttca

SEQ ID NO: 301744 - DNA, 75 bp, Artificial Sequence
  Synthetic
tacgcacgaatgaatgctaaagttaaggctctggtatctactgtgggaatagaaatagctaaaagatatattgca

SEQ ID NO: 301745 - DNA, 75 bp, Artificial Sequence
  Synthetic
tttaaagagtacgacgatatagctactttctcagtagatccacaactgtattgtgactataatatagttttgatg

SEQ ID NO: 301746 - DNA, 75 bp, Artificial Sequence
  Synthetic
atggctactttcaaagatgcttgttattattataagagaattaacaaattgaatcatgcagtcttgaaattagga

SEQ ID NO: 301747 - DNA, 75 bp, Artificial Sequence
  Synthetic
atacttgatataacatctgatccaactactactccacaaacagaacggatgatgcgaataaactggaaaaaatgg

SEQ ID NO: 301748 - DNA, 75 bp, Artificial Sequence
  Synthetic
atatcgaagtattcagtttataaaccttcaatagaagagttatataaagtaatttcactacacgagaatgaaata

SEQ ID NO: 301749 - DNA, 75 bp, Artificial Sequence
  Synthetic
atggtgatccacagactccattccaaatagcagaacaacagatacaaaattttcaagtagctaattggttacact

SEQ ID NO: 301750 - DNA, 75 bp, Artificial Sequence
  Synthetic
gactgctgaatatgattctggtatatctgatgttgaatagtaaaagaaaggtcacatttgccactacaagactcc

SEQ ID NO: 301751 - DNA, 75 bp, Artificial Sequence
  Synthetic
gatggcttgcataaccatgaatatgcaacatgtgcaaactcttactactgaaaaattacaattaacctctgttac

SEQ ID NO: 301752 - DNA, 75 bp, Artificial Sequence
  Synthetic
aacaaactgtcaacaatctaaatattgcatataaatatctatcaacaggaaaagccaaagtgtgttgtgttaaat

SEQ ID NO: 301753 - DNA, 75 bp, Artificial Sequence
  Synthetic
tgcatataaatatctatcaacaggaaaagccaaagtgtgttgtgttaaattaactgctatggatctagaattgcc

SEQ ID NO: 301754 - DNA, 75 bp, Artificial Sequence
  Synthetic
gttgacaaattaagacagttatgtacaggagtgaagactgttgattatgattccggcatatctgacgttgaataa

SEQ ID NO: 301755 - DNA, 75 bp, Artificial Sequence
  Synthetic
gaatgactacatctcttccaattgctagattatcaaatcgtgtgtttagagataaattatttccatctattgtga

SEQ ID NO: 301756 - DNA, 75 bp, Artificial Sequence
  Synthetic
aatgtttattccacatattacacttagttttagcaacaaacagacagttagaatagaaagtacaagactcaaaat

SEQ ID NO: 301757 - DNA, 75 bp, Artificial Sequence
  Synthetic
cttatgaatatgatgttaaagttccacatttgacattaggagtactatttatatctgataatatgatacatgatg

SEQ ID NO: 301758 - DNA, 75 bp, Artificial Sequence
  Synthetic
ttgaacatgttgtgccactaagacgtgctcttacaacagctacaattactctgctaccagatgctgaaagattca

SEQ ID NO: 301759 - DNA, 75 bp, Artificial Sequence
  Synthetic
tggacaaataattaatacatatcaagcacgatttggaactatcgtagctagaaattttgatactattcgtttatc

SEQ ID NO: 301760 - DNA, 75 bp, Artificial Sequence
  Synthetic
taaatgcagttgcatttgacaatatgcgcatcatgaacgaattgtagacgccaaccccactgtggagatatgacc

SEQ ID NO: 301761 - DNA, 75 bp, Artificial Sequence
  Synthetic
cgtcaagagtatgctataccagttggaccagtatttccaccaggcatgaattggactgaactgattactaactat

SEQ ID NO: 301762 - DNA, 75 bp, Artificial Sequence
  Synthetic
gtcatgctcaaaattatggggttaatgttccaatcacaggatcgttagacattactgtacagaaccaaacagctg

SEQ ID NO: 301763 - DNA, 75 bp, Artificial Sequence
  Synthetic
tttaaccaaaggatggccaacgacttctatttattttaatgaatatcaagatttacaaacgttttcgaataatcc

SEQ ID NO: 301764 - DNA, 75 bp, Artificial Sequence
  Synthetic
acagcaaaaccaaatagcagatcttcagcaatattgtaataaattggaaactgacctacaaaacaaaatcagctc

SEQ ID NO: 301765 - DNA, 75 bp, Artificial Sequence
  Synthetic
tgtaatgaaatggatattagtttgtattattatcaacagacttcagaggctaataaatggatagcaatgggcaca

SEQ ID NO: 301766 - DNA, 75 bp, Artificial Sequence
  Synthetic
aattagctattattgatgttgttgacggcgttaatcataagatagactatactgtaactacttgtaacgttaaga

SEQ ID NO: 301767 - DNA, 75 bp, Artificial Sequence
  Synthetic
gcaacgtgtaactagaattaattggaaaaggtggtggcaagtattttataccattgtcgattacataaatactat

SEQ ID NO: 301768 - DNA, 75 bp, Artificial Sequence
  Synthetic
taacaagattattatcatataattatgaaactctaatggcttgtataactatgaatatgcaacatgttcaaactc

SEQ ID NO: 301769 - DNA, 75 bp, Artificial Sequence
  Synthetic
ttaagatttagattcagtttaactgttgaagagccaccgttttcaattttacgtacacgtgtgtcaggattgtac

SEQ ID NO: 301770 - DNA, 75 bp, Artificial Sequence
  Synthetic
ccattgtcgattacataaatactatagtacaaactatgtctagaagatcgcgctcactgaatactagcgcttatt

SEQ ID NO: 301771 - DNA, 75 bp, Artificial Sequence
  Synthetic
aatttacatcataaggaattattttacatgaatgacgtgcaaaaacttaaagacaattcaatactatatatagat

SEQ ID NO: 301772 - DNA, 75 bp, Artificial Sequence
  Synthetic
gaaggtggtaagtattatgaacatgctccaattgaattgatttatgcatgcagatcagcgagagaatttgcgaaa

SEQ ID NO: 301773 - DNA, 75 bp, Artificial Sequence
  Synthetic
ctccaattgaattgatttatgcatgcagatcagcgagagaatttgcgaaactgcaagatgatttaacggtattaa

SEQ ID NO: 301774 - DNA, 75 bp, Artificial Sequence
  Synthetic
cttgccgacctcaactacacattgagtgtaatcactttaatgaatgacacactacattctattattcaagatcca

SEQ ID NO: 301775 - DNA, 75 bp, Artificial Sequence
  Synthetic
atggcttctctgatttacagacagctactgtcgaattcatatactgtagatctatcagatgaaatacaagttgtt

SEQ ID NO: 301776 - DNA, 75 bp, Artificial Sequence
  Synthetic
aactggatatgcgccagtgaattggggacccggagagacaaatgattcaacaacggttgagccagtgcttgacgg

SEQ ID NO: 301777 - DNA, 75 bp, Artificial Sequence
  Synthetic
caacggttgagccagtgcttgacggcccatatcagcctactacatttaatccaccagtaagctattggatattat

SEQ ID NO: 301778 - DNA, 75 bp, Artificial Sequence
  Synthetic
tgatgaggtgtatgtagcaaatataagtggtgtactatcaacatatttcaaaatttataatgcgttttataaaga

SEQ ID NO: 301779 - DNA, 75 bp, Artificial Sequence
  Synthetic
acgtacaatggtgagacaccgaatgcaactactggttattataccacaactaactacgacacagtaaacatgaca

SEQ ID NO: 301780 - DNA, 75 bp, Artificial Sequence
  Synthetic
actgttaaagtatgtccattaaatacacaaactttaggaattgggtgtcaaacgacgaatactgctacttttgaa

SEQ ID NO: 301781 - DNA, 75 bp, Artificial Sequence
  Synthetic
ctggtggtctagggtataagtggactgagatttcttttaaaccggcaaactatcaatataactatacacgggatg

SEQ ID NO: 301782 - DNA, 75 bp, Artificial Sequence
  Synthetic
gaaaatcatcaggacgttctttttcactcaaaagagctactactcaaatcagttttaatagctattggtcactca

SEQ ID NO: 301783 - DNA, 75 bp, Artificial Sequence
  Synthetic
gttgctgccacttcaacattagaattaatgggtattcagtatgattacaatgagatatttactagagttaagagt

SEQ ID NO: 301784 - DNA, 75 bp, Artificial Sequence
  Synthetic
cgcaagaaatagcaatgtcacaacttattgatttagctttattaccattagacatgttttctatgttcactggca

SEQ ID NO: 301785 - DNA, 75 bp, Artificial Sequence
  Synthetic
aatctttgaaccaagacaattaccaatttaccgagcaaatggtgaaaaagaattaaggaatagatggtattggaa

SEQ ID NO: 301786 - DNA, 75 bp, Artificial Sequence
  Synthetic
catctgtcctaacagttttgtttacgttgcacaaagcgtctattccaacaatgaaaattgcactaaagacatcca

SEQ ID NO: 301787 - DNA, 75 bp, Artificial Sequence
  Synthetic
tattttatactcaaattacattgttaacaagttacgaggattcgagactgacagagagttcatactaactaaaat

SEQ ID NO: 301788 - DNA, 75 bp, Artificial Sequence
  Synthetic
atgtatggtattgaatataccacaattctgaccattttgatatctatcatagtgtgctattttatattaacaagt

SEQ ID NO: 301789 - DNA, 75 bp, Artificial Sequence
  Synthetic
cgtctatatcaactttaacggactcgttatctgacgctgcttcatcaatttcgagaaatccttctataagatcag

SEQ ID NO: 301790 - DNA, 75 bp, Artificial Sequence
  Synthetic
tagtaaccgaagcttcagaaaaattcataccaaatcgaacttatagagttataaaagatgatgaagtgttagaag

SEQ ID NO: 301791 - DNA, 75 bp, Artificial Sequence
  Synthetic
atgtatggtattgaatataccacaattctaatctttctgatatcaatcattctattcaactatatattaaaatca

SEQ ID NO: 301792 - DNA, 75 bp, Artificial Sequence
  Synthetic
tctattcaactatatattaaaatcagtgactcgaataatggactacattatatatagatctttgttaatttctgt

SEQ ID NO: 301793 - DNA, 75 bp, Artificial Sequence
  Synthetic
cagatttagtcactgattcacctgtaatatcagctataatagattttaaaacgttgaaaaatttaaatgacaatt

SEQ ID NO: 301794 - DNA, 75 bp, Artificial Sequence
  Synthetic
gttgaactcgattgatgctattaatcctattaatgctatagacgatcttgaatcattaatcagaaacttaattca

SEQ ID NO: 301795 - DNA, 75 bp, Artificial Sequence
  Synthetic
acaatgaacgaattaacgatgctgtggctattattacggctgctaatagactaaatttatatcagaaaaaaatga

SEQ ID NO: 301796 - DNA, 75 bp, Artificial Sequence
  Synthetic
aaacagatggttcaagatgtatcgaacgatgtgagagaaacttacgcacgaatgaatgctaaagttaaagctcta

SEQ ID NO: 301797 - DNA, 75 bp, Artificial Sequence
  Synthetic
gcgtgcggaaagatggaaaagcttaccgacctcaattacacattgagtgtaatcactcttatgaatgatactttg

SEQ ID NO: 301798 - DNA, 75 bp, Artificial Sequence
  Synthetic
tgtcctaactgtactatttacgttacataaggcatcgattccaactatgaaaattgctcttaaaacgtcaaagtg

SEQ ID NO: 301799 - DNA, 75 bp, Artificial Sequence
  Synthetic
taactgctatggatctagaattaccaataacagcaaaattacttcatcatccaactactgaaattaggtcagaat

SEQ ID NO: 301800 - DNA, 75 bp, Artificial Sequence
  Synthetic
cgctgaatgagtgggctgaaggtgaaaatccatatgaaccaaaagaggtgactgcatcgttgtgagaggttgagc

SEQ ID NO: 301801 - DNA, 75 bp, Artificial Sequence
  Synthetic
tgcgtcgtctgtctgcggaagcggcggagttcttaacagtaagccccatcggacctgatgactggttgagaagcc

SEQ ID NO: 301802 - DNA, 75 bp, Artificial Sequence
  Synthetic
tactagagaatatgctgaattctactcacagtcaaatcagttattgtcttatggtgatgttacacgctttttatc

SEQ ID NO: 301803 - DNA, 75 bp, Artificial Sequence
  Synthetic
tcaagagtatgctataccagttggaccagtatttccaccaggcatgaattggactgaattaattactaattattc

SEQ ID NO: 301804 - DNA, 75 bp, Artificial Sequence
  Synthetic
tacttaatgagtggctttgtaatccaatggacataacgttgtattactatcaacagacggacgaagcgaataaat

SEQ ID NO: 301805 - DNA, 75 bp, Artificial Sequence
  Synthetic
aatggacataacgttgtattactatcaacagacggacgaagcgaataaatggatatctatgggagattcatgtac

SEQ ID NO: 301806 - DNA, 75 bp, Artificial Sequence
  Synthetic
aacctataatatacatgcttggttcagctccatcttattggatttatgatattaaacagtattctgattttacat

SEQ ID NO: 301807 - DNA, 75 bp, Artificial Sequence
  Synthetic
gcaaacctatgtacatgatgattcaaaagatgagtatgaaaatgcatttcttatttctaatctaactacgcataa

SEQ ID NO: 301808 - DNA, 75 bp, Artificial Sequence
  Synthetic
ataagatgtaattttacatatgattacgagaataatacagtttatttacatgattactcatactatactaataat

SEQ ID NO: 301809 - DNA, 75 bp, Artificial Sequence
  Synthetic
gacgaaccaaaagtaaattttaaaaatatttatgattggacgtttctgccaacagatttcgaacttaaagattcg

SEQ ID NO: 301810 - DNA, 75 bp, Artificial Sequence
  Synthetic
tactatatactattactataatttgcactcttcgaaacctataatatacatgcttggttcagccccatcttattg

SEQ ID NO: 301811 - DNA, 75 bp, Artificial Sequence
  Synthetic
agagttctaaaagatgatgaagtgatggaagctgacgtagatgggaaattctttgcatataaagttgacactttt

SEQ ID NO: 301812 - DNA, 75 bp, Artificial Sequence
  Synthetic
tgcatataaatatctatcaacaggaaaagccaaggtgtgttgtgttaaattaactgctatggacttagaattacc

SEQ ID NO: 301813 - DNA, 75 bp, Artificial Sequence
  Synthetic
gaagaagtaccattcgacgtagataaatttgttgatttggtaactgattctcctgtaatttcagctataattgat

SEQ ID NO: 301814 - DNA, 75 bp, Artificial Sequence
  Synthetic
acaattatggtataacgcgatctcaagcgttagatttaatcagatctgatcccagagttttacgcgattttatta

SEQ ID NO: 301815 - DNA, 75 bp, Artificial Sequence
  Synthetic
ccaaaaggtgtattctatgcttttataaacaatgtaatcacagaaaatgtgttcatacaacctccatttaaatta

SEQ ID NO: 301816 - DNA, 75 bp, Artificial Sequence
  Synthetic
ttttaatccaaggcaagatgttattaatttgattaataaacaaaaacaatcactcattactgttcgtataaataa

SEQ ID NO: 301817 - DNA, 75 bp, Artificial Sequence
  Synthetic
cactcattactgttcgtataaataacacctttaaagatgaaccgaaagttaattttaaaaatatttatgattgga

SEQ ID NO: 301818 - DNA, 75 bp, Artificial Sequence
  Synthetic
gggatggcgtattttccttacattgcatctgtcctgacagtgttgttcacattgcataaagcgtcgatcccgaca

SEQ ID NO: 301819 - DNA, 75 bp, Artificial Sequence
  Synthetic
gaagttaaggattcaataattacatcatatgatggttgtttaggcatatttggattatcaatatctctatcatct

SEQ ID NO: 301820 - DNA, 75 bp, Artificial Sequence
  Synthetic
agaaggtggaaaatactatgaacatgcaccaattgaattaatatatgcatgtcggtcagctaaagaattcgccat

SEQ ID NO: 301821 - DNA, 75 bp, Artificial Sequence
  Synthetic
ataggtgttaaatttgatagcataccctatgaatatgatgtcaaaattccacatttaacgcttggagtattattc

SEQ ID NO: 301822 - DNA, 75 bp, Artificial Sequence
  Synthetic
tagtggtgtattgtcaacttattttaaattatacaacatgttctatagaaatcatattacgtttggacaatcacg

SEQ ID NO: 301823 - DNA, 75 bp, Artificial Sequence
  Synthetic
gatcgcaaccagctcatgataacttgatgggtacgatgtggctgaacgcaggatcagaaattcaggtcgctggat

SEQ ID NO: 301824 - DNA, 75 bp, Artificial Sequence
  Synthetic
atcatattcctacgataaatataatgctgtagaacggaagttagttaattacgctaaaggtaaaccattagaagc

SEQ ID NO: 301825 - DNA, 75 bp, Artificial Sequence
  Synthetic
tgaaagaattagtcgctgagcttcgttggcagtataataaattcgcagttattacacatgggaaagggcattata

SEQ ID NO: 301826 - DNA, 75 bp, Artificial Sequence
  Synthetic
taaacttagaatgacattatcttctaaaggaattgaccaaaagatgagagtacttaatgcttgttttagtgtgaa

SEQ ID NO: 301827 - DNA, 75 bp, Artificial Sequence
  Synthetic
ctaacctttctgatatcaataattttattgaactatatattaaaatcactaactagtgcgatggactttataatc

SEQ ID NO: 301828 - DNA, 75 bp, Artificial Sequence
  Synthetic
tgaaagtgatagctttaagacgcgacctggtctcatcatatgcagatactcaagtctacgaacatgacgttgaca

SEQ ID NO: 301829 - DNA, 75 bp, Artificial Sequence
  Synthetic
aggaattgcatcacttatagctgccaacaaagatgagttggaaattttaataaaatctaattacacttatgacta

SEQ ID NO: 301830 - DNA, 75 bp, Artificial Sequence
  Synthetic
tattctagaatgaatgcaaaagtaaaagctttggtgtccacagttggtattgaaatagcaaaaagatacatcgct

SEQ ID NO: 301831 - DNA, 75 bp, Artificial Sequence
  Synthetic
atatcgatgggacaatcttgtactataaaagtgtgcccattaaatacacagactttaggaataggttgtattact

SEQ ID NO: 301832 - DNA, 75 bp, Artificial Sequence
  Synthetic
atattgtaaataagctacgggggtttgaaactgatagagaatttatattaactaaaattatacagatgacatctg

SEQ ID NO: 301833 - DNA, 75 bp, Artificial Sequence
  Synthetic
cattgatcagaaacttaattcaagattatgacagaacattcttaatgttaaaaggacttgtaaggcaatgcaact

SEQ ID NO: 301834 - DNA, 75 bp, Artificial Sequence
  Synthetic
tactgcgccacaaactgaacgtatgatgcgagtaaattggaagaaatggtggcaagttttctatacagtagtaga

SEQ ID NO: 301835 - DNA, 75 bp, Artificial Sequence
  Synthetic
atgtatggtattgaatataccacaattctaacttttttgatatcgaccatattattgaattatattttgaaatca

SEQ ID NO: 301836 - DNA, 75 bp, Artificial Sequence
  Synthetic
gaatatttgtattcaaaagtgccaaaagatactattaacattggaccaagaaatgagtctatgttcacactgctt

SEQ ID NO: 301837 - DNA, 75 bp, Artificial Sequence
  Synthetic
aaaaatgaatcgtcttctacaacgtcaactctttctggaaaatctattggtaggagtgaacagtacgtttcacca

SEQ ID NO: 301838 - DNA, 75 bp, Artificial Sequence
  Synthetic
tagaagcactaacaattcaatctgaaacacaattcttaacgggtatcaattcacaagccgctaatgattgtttta

SEQ ID NO: 301839 - DNA, 75 bp, Artificial Sequence
  Synthetic
ttgatattggacagtttaaaaatatgtgcaatgtgttatcaactatttattactactataataaatatcatgcat

SEQ ID NO: 301840 - DNA, 75 bp, Artificial Sequence
  Synthetic
tcattttcagtagacccgcaactgtattgtgactataatatagtaataatgaaatatcaatcagatttgcagtta

SEQ ID NO: 301841 - DNA, 75 bp, Artificial Sequence
  Synthetic
accattctcaaaacggcatcataaagctatgtttgcaatatctgacgtagagaaactaggtgataattcaattct

SEQ ID NO: 301842 - DNA, 75 bp, Artificial Sequence
  Synthetic
tcaaaattttcaagtagctaattggctacattttgttaataataatcaatttaggcaagtagtaattgacggagt

SEQ ID NO: 301843 - DNA, 75 bp, Artificial Sequence
  Synthetic
ggatttcaatgggatcatcatgcacaattaaagtttgtccattgaatacacaaactctcgggataggatgtttaa

SEQ ID NO: 301844 - DNA, 75 bp, Artificial Sequence
  Synthetic
aattaatttagaaataatgtataagtatctgcaacgcggaaaaagcaaaatttgttgctgcaaaatcactgctat

SEQ ID NO: 301845 - DNA, 75 bp, Artificial Sequence
  Synthetic
aagaaaagattcgtaccgaaaggagctttttattcatttattaataatactaaaactgataatgtttttattagt

SEQ ID NO: 301846 - DNA, 75 bp, Artificial Sequence
  Synthetic
gacgtgtacaattagaaattgcaataaattaggaccaagagaaaatgtcgcggtaattcaagttggtggtcctga

SEQ ID NO: 301847 - DNA, 75 bp, Artificial Sequence
  Synthetic
accactgagaagttgcaattaacatcagttacgtctttatgcatgttaataggaaatgctacagttataccaagt

SEQ ID NO: 301848 - DNA, 75 bp, Artificial Sequence
  Synthetic
tgatgcgcattaactggaagaaatggtggcaagtattctacactgtcgttgattatattaatcaaatagttcaag

SEQ ID NO: 301849 - DNA, 75 bp, Artificial Sequence
  Synthetic
attgtctaatgagaataatgatagggataaagtgatagattttacgcaaaaacaaaagagaggtgtcatcacatt

SEQ ID NO: 301850 - DNA, 75 bp, Artificial Sequence
  Synthetic
gattatattaatcaaatagttcaagttatgtccaaaagatcgagatcacttaattctgctgctttttattataga

SEQ ID NO: 301851 - DNA, 75 bp, Artificial Sequence
  Synthetic
gaggatgaataatactttcaactatgaatacagattgcagtttaaatcaacgtatgattatttatacttgccatc

SEQ ID NO: 301852 - DNA, 75 bp, Artificial Sequence
  Synthetic
tggcgtattttccatatattgcatctgttctgactgttttgtttactctacataaagcatcaattccaacaatga

SEQ ID NO: 301853 - DNA, 75 bp, Artificial Sequence
  Synthetic
cacttattcatttcattctctgacacgaactatgatcaaattgattcatactgtactcatatgggtatatcgagg

SEQ ID NO: 301854 - DNA, 75 bp, Artificial Sequence
  Synthetic
tagactcagggacaggttgaggttgcttccagtcgaaattagaagattagatatttttaatttaatattgatgaa

SEQ ID NO: 301855 - DNA, 75 bp, Artificial Sequence
  Synthetic
atatttttaatttaatattgatgaacatggaacaaattgaacgtgcgtcagataaaattgctcagggagtgatca

SEQ ID NO: 301856 - DNA, 75 bp, Artificial Sequence
  Synthetic
catgtttagagatataactaatggcaaatttaatttaattaatacaaatgtagaaaatgcagtatccgggcacgt

SEQ ID NO: 301857 - DNA, 75 bp, Artificial Sequence
  Synthetic
agtattcgcaaaattacaaaatgatttaacgctaatagaatacgtgaacgatgtaaatcgttatattttaaataa

SEQ ID NO: 301858 - DNA, 75 bp, Artificial Sequence
  Synthetic
ggattgttgtttttgaacgactttgacattcaaaatacaataacaatattaagatcagttaagaaagagttaata

SEQ ID NO: 301859 - DNA, 75 bp, Artificial Sequence
  Synthetic
caaccactgaaattagatcagaattttatgcgatactagatgtgtgggatattagtaccattaaaagattcgtac

SEQ ID NO: 301860 - DNA, 75 bp, Artificial Sequence
  Synthetic
caattttattataagttatacatgaaattctatcgcaaacaaatagtattcgggcagtcaaggatgtttctacct

SEQ ID NO: 301861 - DNA, 75 bp, Artificial Sequence
  Synthetic
agcgttatatgctttgtctaacgatttcaatccaaggcaagatgttattaacttaattaataaacaaaaacaatc

SEQ ID NO: 301862 - DNA, 75 bp, Artificial Sequence
  Synthetic
agaaaaggaaatctatgcgtatagatgcgactaaacttgtaattaaatcaattaaattacggaaaattaaatcag

SEQ ID NO: 301863 - DNA, 75 bp, Artificial Sequence
  Synthetic
tgcgactaaacttgtaattaaatcaattaaattacggaaaattaaatcagacgttgagtattacatatagatgag

SEQ ID NO: 301864 - DNA, 75 bp, Artificial Sequence
  Synthetic
gtaaacaagttgagaatgatgttgtcatcaaaaggaattgaccaaaaaatgagagtactgaatgcttgttttagc

SEQ ID NO: 301865 - DNA, 75 bp, Artificial Sequence
  Synthetic
atcgatatctttatcatctaaaccaactggaaataatcacttatttataataaatgggactgacaaatattataa

SEQ ID NO: 301866 - DNA, 75 bp, Artificial Sequence
  Synthetic
gttttccaagggttatcaattcagctgacggtgcaaccacatggttcttcaatccagttattctaagaccaaata

SEQ ID NO: 301867 - DNA, 75 bp, Artificial Sequence
  Synthetic
ctcaggacatgtttataatgcgttaatttactatagatataattatgcatttgatcttaaaagatggatttatct

SEQ ID NO: 301868 - DNA, 75 bp, Artificial Sequence
  Synthetic
acaaatacgggaacatttgaagaagtcgcaacggctgaaaaattggtaattactgatgtagttgacggcgtaaat

SEQ ID NO: 301869 - DNA, 75 bp, Artificial Sequence
  Synthetic
agtggcgtgttatcaacttattttaaattgtacaacatgttttataaaaatcatattacgttcggacagtcacga

SEQ ID NO: 301870 - DNA, 75 bp, Artificial Sequence
  Synthetic
ggaagattaaaggtgaaaccgtatttgatatgtctgagtgagctaaaaacttaacacactagtcatgatgtgacc

SEQ ID NO: 301871 - DNA, 75 bp, Artificial Sequence
  Synthetic
cgagaaatgagacgtcagttggaaatgattgataaattgacaactcgtgaaattgaacaggtagaactactaaga

SEQ ID NO: 301872 - DNA, 75 bp, Artificial Sequence
  Synthetic
atgacttaataatagaatatatttattctgaagcgttggacttccaaaacttcatgttaaagaaaattaaagaaa

SEQ ID NO: 301873 - DNA, 75 bp, Artificial Sequence
  Synthetic
ttaaagaatacacagatattgcttccttctcggttgatccgcagttgtattgtgattacaatgtagtactaatga

SEQ ID NO: 301874 - DNA, 75 bp, Artificial Sequence
  Synthetic
gtttatttagaaaaacgtcgtgcgcaaatatcagcgttattaactatgttgcaaaaaccagtgtcatttaaatca

SEQ ID NO: 301875 - DNA, 75 bp, Artificial Sequence
  Synthetic
actgatacaactacatttgaagaagttgcaacggctgaaaaattggtaattactgatgttgttgatggagtaaat

SEQ ID NO: 301876 - DNA, 75 bp, Artificial Sequence
  Synthetic
gattgtcaactgatagaaagatggatgaagtctcgcaaattggaatttaattcgctttcgattcgaaggtgatgg

SEQ ID NO: 301877 - DNA, 75 bp, Artificial Sequence
  Synthetic
ttatgtaaatcaaatagttcaggcaatgtccaaaagatcacgatcactgaactccgctgcgttttattatagagt

SEQ ID NO: 301878 - DNA, 75 bp, Artificial Sequence
  Synthetic
ttgtcgaaggcacactgtactcaaatgtcagtgatctaattcagcaatttaaccaaatgctaatcacaatgaacg

SEQ ID NO: 301879 - DNA, 75 bp, Artificial Sequence
  Synthetic
tgtgttgataattcaaaaagaggcttatcattaaaaccgttatttgaagaatataaagatgtaatagataacgca

SEQ ID NO: 301880 - DNA, 75 bp, Artificial Sequence
  Synthetic
atataaagatgtaatagataacgcaactttactatctatattatcgtattcttatgataaatataatgccgtaga

SEQ ID NO: 301881 - DNA, 75 bp, Artificial Sequence
  Synthetic
ttatggaataaatctgccaattactggttcaatggatactgcatacgctaattctacgcaggaagagacgttcct

SEQ ID NO: 301882 - DNA, 75 bp, Artificial Sequence
  Synthetic
aactcaaaatttacaaaaggagattagatttatttactatagtagcttcaacagtaaataaatatggtgtaccaa

SEQ ID NO: 301883 - DNA, 75 bp, Artificial Sequence
  Synthetic
ttatgtagaaactgctagaactaccattgaatattttgttgattttgtagataatgtatgtatggatgaaatggc

SEQ ID NO: 301884 - DNA, 75 bp, Artificial Sequence
  Synthetic
cagtaaatgagcttgattatgaaaataataaaataacctctgagttatttcaatcagctgaagagtatactgact

SEQ ID NO: 301885 - DNA, 75 bp, Artificial Sequence
  Synthetic
tacatagagaattggaatttacaaagcagaagacaaagaactggattcacctttcataaaccgaatatctttcca

SEQ ID NO: 301886 - DNA, 75 bp, Artificial Sequence
  Synthetic
gcagaagacaaagaactggattcacctttcataaaccgaatatctttccatattccgcttcttttacgttgaata

SEQ ID NO: 301887 - DNA, 75 bp, Artificial Sequence
  Synthetic
taaatggaaccgataaatattataaattagatcaatttgcaaatcatactggtatttcgagaagatcacatcaaa

SEQ ID NO: 301888 - DNA, 75 bp, Artificial Sequence
  Synthetic
gtgatgaaagataaaccgtattatttagtgacttgggctaattcagctatagaaatgcttatgtcagtattttct

SEQ ID NO: 301889 - DNA, 75 bp, Artificial Sequence
  Synthetic
tagtgacttgggctaattcagctatagaaatgcttatgtcagtattttctcatgaagactatttaattgcgaaag

SEQ ID NO: 301890 - DNA, 75 bp, Artificial Sequence
  Synthetic
ttggaactaatgtggaaaattcagtttcaggacatgtgtacaatgcattaatttattatagatataattattctt

SEQ ID NO: 301891 - DNA, 75 bp, Artificial Sequence
  Synthetic
tcccgctaacactcaacagtttgagcatatagttcaactacgtcgtgtcctacctacagcgactattactctcct

SEQ ID NO: 301892 - DNA, 75 bp, Artificial Sequence
  Synthetic
aaaatttccattgatggctaaaatatattcgtggtcatttcatgtcgggttcagaaagcagaaaatgttggatgc

SEQ ID NO: 301893 - DNA, 75 bp, Artificial Sequence
  Synthetic
cattgatagatataaatggtacattcattactaatgaagagttagaacttgaattttcagataaatatgttaaag

SEQ ID NO: 301894 - DNA, 75 bp, Artificial Sequence
  Synthetic
gaagttgaatttctattaaatggacaaataattaacacttatcaagctagatttggaacgattgtcgcaagaaat

SEQ ID NO: 301895 - DNA, 75 bp, Artificial Sequence
  Synthetic
caactgttggactgacattgcgcattgattcagctatttgtgaatcagttcttgctgacgctactgaaacgatgt

SEQ ID NO: 301896 - DNA, 75 bp, Artificial Sequence
  Synthetic
tgatgagatatatgtggcgaatgttagtggagtcttagcgacatattttaaaatatataatttattttataagag

SEQ ID NO: 301897 - DNA, 75 bp, Artificial Sequence
  Synthetic
atcgcgtgaagataatttacagcgcgtatttactgtggcttccattcgaagcatgctcatcaagtgaggactgag

SEQ ID NO: 301898 - DNA, 75 bp, Artificial Sequence
  Synthetic
aagaatatgcatgtcatggatgatattgcacatggaagatacactcctggtgtcattcctccagtaaatgtagat

SEQ ID NO: 301899 - DNA, 75 bp, Artificial Sequence
  Synthetic
gtgtaatcactctaatgaatgatacattacatactataatggaagatcctggaatggcgtattttccttatatcg

SEQ ID NO: 301900 - DNA, 75 bp, Artificial Sequence
  Synthetic
aaaagatgttatcacacgcgaaacatactcgagaatatgcggagttttattcgcagtcaaatcaattattatcgt

SEQ ID NO: 301901 - DNA, 75 bp, Artificial Sequence
  Synthetic
ggaatggcgtattttccttatatcgcctctgttttaactgtgctgtttacgctacgcaaagcttcaattccaact

SEQ ID NO: 301902 - DNA, 75 bp, Artificial Sequence
  Synthetic
gatgcagaagcattcaataaatacatgctgtcgaagtctccagaggatattggaccatctgattctgcttcaaac

SEQ ID NO: 301903 - DNA, 75 bp, Artificial Sequence
  Synthetic
atataaagacgtcactgaaaacgcaactttactgtctatactatcgtattcgtatgacaagtataacgcagtaga

SEQ ID NO: 301904 - DNA, 75 bp, Artificial Sequence
  Synthetic
aggaataattatgggattagacatactagctagcatgactaatgatccaaaagtaatacagacattgaatttata

SEQ ID NO: 301905 - DNA, 75 bp, Artificial Sequence
  Synthetic
taataaattaactagtgatctatttccaacagctgaagaatatactgattctttaatggatccagcaatcttgac

SEQ ID NO: 301906 - DNA, 75 bp, Artificial Sequence
  Synthetic
ggatacttattaactcaaatacaaatggagtagtatacgaaagtacaaataatagtgacttttggactgcagtca

SEQ ID NO: 301907 - DNA, 75 bp, Artificial Sequence
  Synthetic
tctttcataactaaaataattagagttgatggtgatgataattacgcagtcttacaatttaacactgatgttact

SEQ ID NO: 301908 - DNA, 75 bp, Artificial Sequence
  Synthetic
gacgctatatacacaaactcaactattggagaatcatttctgacttccacgttatgcttatattatccaacagaa

SEQ ID NO: 301909 - DNA, 75 bp, Artificial Sequence
  Synthetic
ctagtgtctaaaaatgcaattgtatctaaaggtatagcagtaacagaaaaagcaaaattgaattcatatgcacca

SEQ ID NO: 301910 - DNA, 75 bp, Artificial Sequence
  Synthetic
agaaagaatgactacatctttaccaatagcacgattatctaatagagtttttagagataaattatttcctatatt

SEQ ID NO: 301911 - DNA, 75 bp, Artificial Sequence
  Synthetic
caatataggaaatttatgcctacgttgcctgataatgtccaatatgtcatacagtgcataggatcaagaacatac

SEQ ID NO: 301912 - DNA, 75 bp, Artificial Sequence
  Synthetic
tgaagcaggaaaggtggctaggaaagagaatatctcaatttgacattgggcaatataagaatatgatgaatgtca

SEQ ID NO: 301913 - DNA, 75 bp, Artificial Sequence
  Synthetic
tgcctgataatgtccaatatgtcatacagtgcataggatcaagaacataccaaatagaggatagcggatcaaaat

SEQ ID NO: 301914 - DNA, 75 bp, Artificial Sequence
  Synthetic
gatgtgtcacaatgggattcatctcaacataatacacaaccatttaggaaaggaataattatgggattggatatg

SEQ ID NO: 301915 - DNA, 75 bp, Artificial Sequence
  Synthetic
tgagatgatcaaattatggaagaaaatgtggaatataacagcgttacggtcgccttacacaaacgcaaatttctt

SEQ ID NO: 301916 - DNA, 75 bp, Artificial Sequence
  Synthetic
aagcagatggtacaagatgtatcaaatgatgttagagatacttatgcacgaatgaacgctaaagtaaaagccttg

SEQ ID NO: 301917 - DNA, 75 bp, Artificial Sequence
  Synthetic
cagtcacttattactgttagaattaataatacatttaaagatgaaccaaaagtaggatttaaaaacatatatgac

SEQ ID NO: 301918 - DNA, 75 bp, Artificial Sequence
  Synthetic
aatagactaagaggttttgaaactgatagagaattcatattaacgaaaatcatgcaaatgacatcagtagctatc

SEQ ID NO: 301919 - DNA, 75 bp, Artificial Sequence
  Synthetic
atagagaattcatattaacgaaaatcatgcaaatgacatcagtagctatcactggatcgcttagattgtttccat

SEQ ID NO: 301920 - DNA, 75 bp, Artificial Sequence
  Synthetic
aatatgatgtgatgaaagataaaccatattacttagtgacatgggcgaattcttcaattgaaatgctaatgtcag

SEQ ID NO: 301921 - DNA, 75 bp, Artificial Sequence
  Synthetic
gttcattgatgtaagtaaaactacgccaacaggaagttatacacaacacggaacattgttttctacaccaaagtt

SEQ ID NO: 301922 - DNA, 75 bp, Artificial Sequence
  Synthetic
aatatgacgtcattttgtgacttttatattataccaagaaatcaagaagaaaaatgtactgagtatatcaatcat

SEQ ID NO: 301923 - DNA, 75 bp, Artificial Sequence
  Synthetic
gctcaagttaatgaagatattgttgtttcaaaaacttcactttggaaagaaatgcaatacaacagagacgtaatc

SEQ ID NO: 301924 - DNA, 75 bp, Artificial Sequence
  Synthetic
ggctttaaaaagttctgttccgagagagtgtgtgcgggaagatggagaagcttaccgacctcaactacacatcga

SEQ ID NO: 301925 - DNA, 75 bp, Artificial Sequence
  Synthetic
taaatggtcagaaatatcttttaagccaattacttatcagtacacatacactagagatggagaacaaattacagc

SEQ ID NO: 301926 - DNA, 75 bp, Artificial Sequence
  Synthetic
gtgttatcactctaatgaacaacacattgcatacgattcttgaggaccccggaatggcgtacttcccatacattg

SEQ ID NO: 301927 - DNA, 75 bp, Artificial Sequence
  Synthetic
attgcatacgattcttgaggaccccggaatggcgtacttcccatacattgcatctgtcctaacagttttgtttac

SEQ ID NO: 301928 - DNA, 75 bp, Artificial Sequence
  Synthetic
atattcagtatacaggccatcaatagaagaattgtataaagtaatatcacttcatgaacaagaaattcaacttta

SEQ ID NO: 301929 - DNA, 75 bp, Artificial Sequence
  Synthetic
cattgataagatgtaactttacatatgattatgaaaataacacggtttatttacatgattattcatattatacta

SEQ ID NO: 301930 - DNA, 75 bp, Artificial Sequence
  Synthetic
ccaattacttatcagtacacatacactagagatggagaacaaattacagcgcacaccacatgttcagtcaatgga

SEQ ID NO: 301931 - DNA, 75 bp, Artificial Sequence
  Synthetic
aatttgttgtctataaattatggttgttatcaactttttgattttaattcaccagatctagagaaattaattaga

SEQ ID NO: 301932 - DNA, 75 bp, Artificial Sequence
  Synthetic
gggatgattcacaaacattcagaaatatggtgtatgttcgatcgcttgctgctgatttgaacacagtcacgtgca

SEQ ID NO: 301933 - DNA, 75 bp, Artificial Sequence
  Synthetic
gtttattttgtaactatccaaaatctgaaatgattaaactttggaagaaaatgtggaacataacttcattgagat

SEQ ID NO: 301934 - DNA, 75 bp, Artificial Sequence
  Synthetic
acatgttggaatttaattcgctttcgattcgagaatgatgatgacgaagcaagaatagaaagcgcttatgtgacc

SEQ ID NO: 301935 - DNA, 75 bp, Artificial Sequence
  Synthetic
tggcttaagccttaatccccttcaaccattcaggtcagcaccggacgttaatggagggaacggtcttaatgtgac

SEQ ID NO: 301936 - DNA, 75 bp, Artificial Sequence
  Synthetic
aactgatgcaatgtctgatgcagcatcatctatttcaagaagttcatcaatacgatcaataggatcatcagcatc

SEQ ID NO: 301937 - DNA, 75 bp, Artificial Sequence
  Synthetic
tacgatcaataggatcatcagcatctgcttggacggaagtatcaacttcgatcgcagatatttctacaacagttg

SEQ ID NO: 301938 - DNA, 75 bp, Artificial Sequence
  Synthetic
tgcttggacggaagtatcaacttcgatcgcagatatttctacaacagttgatacagtatcaacgcaaaccgctgc

SEQ ID NO: 301939 - DNA, 75 bp, Artificial Sequence
  Synthetic
ttaatgtgggtaattgtagttcaattgaaagtgcttatccgttggtaaaagatatgctttggcattcaattacta

SEQ ID NO: 301940 - DNA, 75 bp, Artificial Sequence
  Synthetic
ctaccaataacagcaaaattactacatcatccaactactgaaattagatcagaattttatgcaatattagatata

SEQ ID NO: 301941 - DNA, 75 bp, Artificial Sequence
  Synthetic
tccgtgcaaataacaccaaatacattaccggagatagttactgaagcttccgagaaatttattccaaatagaaca

SEQ ID NO: 301942 - DNA, 75 bp, Artificial Sequence
  Synthetic
tgggacgttggtaccatcaaaagatttgtaccgaaaggtgtattctatgcatttataaataacgtaatcacagaa

SEQ ID NO: 301943 - DNA, 75 bp, Artificial Sequence
  Synthetic
gttagaatagaaagtacaaaactcagaattaattcaatttacttaagaaagattaaaggtgaaaccgtatttgat

SEQ ID NO: 301944 - DNA, 75 bp, Artificial Sequence
  Synthetic
agaaattcgcagatttggttacagattcaccagtcatttctgcaataattgatcttaagacattaaaaaatctga

SEQ ID NO: 301945 - DNA, 75 bp, Artificial Sequence
  Synthetic
caacataaacttaaaatagcatctaaacatataaaaccaaattatgtgacatcaaatcataaaacgtcatgctaa

SEQ ID NO: 301946 - DNA, 75 bp, Artificial Sequence
  Synthetic
caacataaacttaaaatagcatctaaacatataaaaccaaattatgtgacatcaaatcataaaacgtcatgctat

SEQ ID NO: 301947 - DNA, 75 bp, Artificial Sequence
  Synthetic
caacataaacttaaaatagcatctaaacatataaaaccaaattatgtgacatcaaatcataaaacgtcatgctac

SEQ ID NO: 301948 - DNA, 75 bp, Artificial Sequence
  Synthetic
caacataaacttaaaatagcatctaaacatataaaaccaaattatgtgacatcaaatcataaaacgtcatgctag

SEQ ID NO: 301949 - DNA, 75 bp, Artificial Sequence
  Synthetic
aacagaaagaatgatgcgagtgaattggaagaaatggtggcaagtgttttatacaatagttgactacgtgaatca

SEQ ID NO: 301950 - DNA, 75 bp, Artificial Sequence
  Synthetic
gatccaagagtattacgtgaatttatcaatcagaataatccaataatacgaaatagaattgaaaatttaattatg

SEQ ID NO: 301951 - DNA, 75 bp, Artificial Sequence
  Synthetic
atccaataatacgaaatagaattgaaaatttaattatgcaatgtagattgtaagtagtgtctagaggttgtgacc

SEQ ID NO: 301952 - DNA, 75 bp, Artificial Sequence
  Synthetic
atcatattcatatgataaatataatgcagtggaaagaaagctggtgcattatgcaaaaggtaaacctttagaagc

SEQ ID NO: 301953 - DNA, 75 bp, Artificial Sequence
  Synthetic
atgtatggtattgaatataccgcaattctaacctttctgatatcgatagttttattgaactatatattaaaatca

SEQ ID NO: 301954 - DNA, 75 bp, Artificial Sequence
  Synthetic
ttagagatgaaattgtgaaaatgttagaagaagcagtcaaacatgatgatcatcttcttcaagattctgagctag

SEQ ID NO: 301955 - DNA, 75 bp, Artificial Sequence
  Synthetic
tgatgcgaataaattggaagaaatggtggcaggttttctatacggtagtagattatattaatcaaattgtgcaag

SEQ ID NO: 301956 - DNA, 75 bp, Artificial Sequence
  Synthetic
ttgacccacaattatattgtgattataacttagtactaatgaagtatgatcaaaatcttgaattagatatgtcag

SEQ ID NO: 301957 - DNA, 75 bp, Artificial Sequence
  Synthetic
ggaattaaaagtacaattgatttaactaaatcaatggcgactagtgtaatgaagaaatttagaaaatcaaaatta

SEQ ID NO: 301958 - DNA, 75 bp, Artificial Sequence
  Synthetic
taactaattcattaaacgatatttcaacacaaacatctacaattagtaagaaacttagattaaaagaaatgatta

SEQ ID NO: 301959 - DNA, 75 bp, Artificial Sequence
  Synthetic
gcgtacaggaagcgcggagctaaacgtgaagacttaccacaacaaaatgaacgtctgcaagaaaaagaaattgaa

SEQ ID NO: 301960 - DNA, 75 bp, Artificial Sequence
  Synthetic
tataccagaaagaataaggaatgatgtcaactatattttgaatatggatatgaatttgccatcaacagcgagata

SEQ ID NO: 301961 - DNA, 75 bp, Artificial Sequence
  Synthetic
ttggtccaagaaatgaatcaatgtttacgtttttaaattttccaactattaaacaattttcaaatggtgcatacc

SEQ ID NO: 301962 - DNA, 75 bp, Artificial Sequence
  Synthetic
atgacgtgcaaaaacttaaagataattcgatactatatatagatataagaacagatagaggaaatatggactgga

SEQ ID NO: 301963 - DNA, 75 bp, Artificial Sequence
  Synthetic
aaacaattttcaaatggtgcatacctagttaagcatactattaaactgaaacaggaaagatggttaggtaaaaga

SEQ ID NO: 301964 - DNA, 75 bp, Artificial Sequence
  Synthetic
ttataccaaatgatatgtttcttcgtgagtcgctagtcgcatgcgaattggccataataaatactatagtttacc

SEQ ID NO: 301965 - DNA, 75 bp, Artificial Sequence
  Synthetic
aataagtgataatgaatggaaagacacattatctcaactgttcttaactaaaggatggccgacaggttcagttta

SEQ ID NO: 301966 - DNA, 75 bp, Artificial Sequence
  Synthetic
aaggatggccgacaggttcagtttattttaatgaatattcaaatgtcctagaattttccgtcgatccaaagctgt

SEQ ID NO: 301967 - DNA, 75 bp, Artificial Sequence
  Synthetic
atcaatatcactagcttcaaaaccaaccggtaataatcatttattcattttaagtggtacggacaagtattttaa

SEQ ID NO: 301968 - DNA, 75 bp, Artificial Sequence
  Synthetic
atagttgacgttgttgatggtgtgaatcataaattagacattacgtccacaacatgtacaatacgaaactgcaac

SEQ ID NO: 301969 - DNA, 75 bp, Artificial Sequence
  Synthetic
ttttaaaacattgatagcagctatgttaagccaacgtacaatgtcattagattttgtaactacaaattatatgtc

SEQ ID NO: 301970 - DNA, 75 bp, Artificial Sequence
  Synthetic
agatggtatcttctattattaactcttcttttgaagctgcagttgtcgctgcaacttctacattggaattaatgg

SEQ ID NO: 301971 - DNA, 75 bp, Artificial Sequence
  Synthetic
ttggaattaagtttaaaaatattccttacaagtataacgttaaagtaccacatctcacatttggcgtgttaaata

SEQ ID NO: 301972 - DNA, 75 bp, Artificial Sequence
  Synthetic
aggtttcttttaatcatggttgtactgtcaccatttcttaatgcgcaaaactatggaataaatcttccgatcacc

SEQ ID NO: 301973 - DNA, 75 bp, Artificial Sequence
  Synthetic
attctactcaactatatattaaaatcagtgacccgaataatggactacattatatatagatttttgttaattttt

SEQ ID NO: 301974 - DNA, 75 bp, Artificial Sequence
  Synthetic
gactatgacgtgagagaatattttctaaatttgtatgatcaagtgcttactgaaatgccagactatctattatta

SEQ ID NO: 301975 - DNA, 75 bp, Artificial Sequence
  Synthetic
cgagtgaattggaaaaaatggtggcaagtattttatacaatagttgactatgtgaatcaaattgtgcaagcgatg

SEQ ID NO: 301976 - DNA, 75 bp, Artificial Sequence
  Synthetic
taatagatatatatgataaattattacttgataatgtaaattttaatagaatgtcattcttaccagtatctttga

SEQ ID NO: 301977 - DNA, 75 bp, Artificial Sequence
  Synthetic
taatagatatatatgataaattattacttgataatgtaaattttaatagaatgtcattcttaccagtatctttgt

SEQ ID NO: 301978 - DNA, 75 bp, Artificial Sequence
  Synthetic
taatagatatatatgataaattattacttgataatgtaaattttaatagaatgtcattcttaccagtatctttgc

SEQ ID NO: 301979 - DNA, 75 bp, Artificial Sequence
  Synthetic
taatagatatatatgataaattattacttgataatgtaaattttaatagaatgtcattcttaccagtatctttgg

SEQ ID NO: 301980 - DNA, 75 bp, Artificial Sequence
  Synthetic
taatagatatatatgataaattattacttgataatgtaaattttaattgaatgtcattcttaccagtatctttga

SEQ ID NO: 301981 - DNA, 75 bp, Artificial Sequence
  Synthetic
taatagatatatatgataaattattacttgataatgtaaattttaattgaatgtcattcttaccagtatctttgt

SEQ ID NO: 301982 - DNA, 75 bp, Artificial Sequence
  Synthetic
taatagatatatatgataaattattacttgataatgtaaattttaattgaatgtcattcttaccagtatctttgc

SEQ ID NO: 301983 - DNA, 75 bp, Artificial Sequence
  Synthetic
taatagatatatatgataaattattacttgataatgtaaattttaattgaatgtcattcttaccagtatctttgg

SEQ ID NO: 301984 - DNA, 75 bp, Artificial Sequence
  Synthetic
taatagatatatatgataaattattacttgataatgtaaattttaatcgaatgtcattcttaccagtatctttga

SEQ ID NO: 301985 - DNA, 75 bp, Artificial Sequence
  Synthetic
taatagatatatatgataaattattacttgataatgtaaattttaatcgaatgtcattcttaccagtatctttgt

SEQ ID NO: 301986 - DNA, 75 bp, Artificial Sequence
  Synthetic
taatagatatatatgataaattattacttgataatgtaaattttaatcgaatgtcattcttaccagtatctttgc

SEQ ID NO: 301987 - DNA, 75 bp, Artificial Sequence
  Synthetic
taatagatatatatgataaattattacttgataatgtaaattttaatcgaatgtcattcttaccagtatctttgg

SEQ ID NO: 301988 - DNA, 75 bp, Artificial Sequence
  Synthetic
taatagatatatatgataaattattacttgataatgtaaattttaatggaatgtcattcttaccagtatctttga

SEQ ID NO: 301989 - DNA, 75 bp, Artificial Sequence
  Synthetic
taatagatatatatgataaattattacttgataatgtaaattttaatggaatgtcattcttaccagtatctttgt

SEQ ID NO: 301990 - DNA, 75 bp, Artificial Sequence
  Synthetic
taatagatatatatgataaattattacttgataatgtaaattttaatggaatgtcattcttaccagtatctttgc

SEQ ID NO: 301991 - DNA, 75 bp, Artificial Sequence
  Synthetic
taatagatatatatgataaattattacttgataatgtaaattttaatggaatgtcattcttaccagtatctttgg

SEQ ID NO: 301992 - DNA, 75 bp, Artificial Sequence
  Synthetic
taatagatatatatgataaattattacttgataatgtaaattttattagaatgtcattcttaccagtatctttga

SEQ ID NO: 301993 - DNA, 75 bp, Artificial Sequence
  Synthetic
taatagatatatatgataaattattacttgataatgtaaattttattagaatgtcattcttaccagtatctttgt

SEQ ID NO: 301994 - DNA, 75 bp, Artificial Sequence
  Synthetic
taatagatatatatgataaattattacttgataatgtaaattttattagaatgtcattcttaccagtatctttgc

SEQ ID NO: 301995 - DNA, 75 bp, Artificial Sequence
  Synthetic
taatagatatatatgataaattattacttgataatgtaaattttattagaatgtcattcttaccagtatctttgg

SEQ ID NO: 301996 - DNA, 75 bp, Artificial Sequence
  Synthetic
taatagatatatatgataaattattacttgataatgtaaattttatttgaatgtcattcttaccagtatctttga

SEQ ID NO: 301997 - DNA, 75 bp, Artificial Sequence
  Synthetic
taatagatatatatgataaattattacttgataatgtaaattttatttgaatgtcattcttaccagtatctttgt

SEQ ID NO: 301998 - DNA, 75 bp, Artificial Sequence
  Synthetic
taatagatatatatgataaattattacttgataatgtaaattttatttgaatgtcattcttaccagtatctttgc

SEQ ID NO: 301999 - DNA, 75 bp, Artificial Sequence
  Synthetic
taatagatatatatgataaattattacttgataatgtaaattttatttgaatgtcattcttaccagtatctttgg

SEQ ID NO: 302000 - DNA, 75 bp, Artificial Sequence
  Synthetic
taatagatatatatgataaattattacttgataatgtaaattttattcgaatgtcattcttaccagtatctttga

SEQ ID NO: 302001 - DNA, 75 bp, Artificial Sequence
  Synthetic
taatagatatatatgataaattattacttgataatgtaaattttattcgaatgtcattcttaccagtatctttgt

SEQ ID NO: 302002 - DNA, 75 bp, Artificial Sequence
  Synthetic
taatagatatatatgataaattattacttgataatgtaaattttattcgaatgtcattcttaccagtatctttgc

SEQ ID NO: 302003 - DNA, 75 bp, Artificial Sequence
  Synthetic
taatagatatatatgataaattattacttgataatgtaaattttattcgaatgtcattcttaccagtatctttgg

SEQ ID NO: 302004 - DNA, 75 bp, Artificial Sequence
  Synthetic
taatagatatatatgataaattattacttgataatgtaaattttattggaatgtcattcttaccagtatctttga

SEQ ID NO: 302005 - DNA, 75 bp, Artificial Sequence
  Synthetic
taatagatatatatgataaattattacttgataatgtaaattttattggaatgtcattcttaccagtatctttgt

SEQ ID NO: 302006 - DNA, 75 bp, Artificial Sequence
  Synthetic
taatagatatatatgataaattattacttgataatgtaaattttattggaatgtcattcttaccagtatctttgc

SEQ ID NO: 302007 - DNA, 75 bp, Artificial Sequence
  Synthetic
taatagatatatatgataaattattacttgataatgtaaattttattggaatgtcattcttaccagtatctttgg

SEQ ID NO: 302008 - DNA, 75 bp, Artificial Sequence
  Synthetic
taatagatatatatgataaattattacttgataatgtaaattttactagaatgtcattcttaccagtatctttga

SEQ ID NO: 302009 - DNA, 75 bp, Artificial Sequence
  Synthetic
taatagatatatatgataaattattacttgataatgtaaattttactagaatgtcattcttaccagtatctttgt

SEQ ID NO: 302010 - DNA, 75 bp, Artificial Sequence
  Synthetic
taatagatatatatgataaattattacttgataatgtaaattttactagaatgtcattcttaccagtatctttgc

SEQ ID NO: 302011 - DNA, 75 bp, Artificial Sequence
  Synthetic
taatagatatatatgataaattattacttgataatgtaaattttactagaatgtcattcttaccagtatctttgg

SEQ ID NO: 302012 - DNA, 75 bp, Artificial Sequence
  Synthetic
taatagatatatatgataaattattacttgataatgtaaattttacttgaatgtcattcttaccagtatctttga

SEQ ID NO: 302013 - DNA, 75 bp, Artificial Sequence
  Synthetic
taatagatatatatgataaattattacttgataatgtaaattttacttgaatgtcattcttaccagtatctttgt

SEQ ID NO: 302014 - DNA, 75 bp, Artificial Sequence
  Synthetic
taatagatatatatgataaattattacttgataatgtaaattttacttgaatgtcattcttaccagtatctttgc

SEQ ID NO: 302015 - DNA, 75 bp, Artificial Sequence
  Synthetic
taatagatatatatgataaattattacttgataatgtaaattttacttgaatgtcattcttaccagtatctttgg

SEQ ID NO: 302016 - DNA, 75 bp, Artificial Sequence
  Synthetic
taatagatatatatgataaattattacttgataatgtaaattttactcgaatgtcattcttaccagtatctttga

SEQ ID NO: 302017 - DNA, 75 bp, Artificial Sequence
  Synthetic
taatagatatatatgataaattattacttgataatgtaaattttactcgaatgtcattcttaccagtatctttgt

SEQ ID NO: 302018 - DNA, 75 bp, Artificial Sequence
  Synthetic
taatagatatatatgataaattattacttgataatgtaaattttactcgaatgtcattcttaccagtatctttgc

SEQ ID NO: 302019 - DNA, 75 bp, Artificial Sequence
  Synthetic
taatagatatatatgataaattattacttgataatgtaaattttactcgaatgtcattcttaccagtatctttgg

SEQ ID NO: 302020 - DNA, 75 bp, Artificial Sequence
  Synthetic
taatagatatatatgataaattattacttgataatgtaaattttactggaatgtcattcttaccagtatctttga

SEQ ID NO: 302021 - DNA, 75 bp, Artificial Sequence
  Synthetic
taatagatatatatgataaattattacttgataatgtaaattttactggaatgtcattcttaccagtatctttgt

SEQ ID NO: 302022 - DNA, 75 bp, Artificial Sequence
  Synthetic
taatagatatatatgataaattattacttgataatgtaaattttactggaatgtcattcttaccagtatctttgc

SEQ ID NO: 302023 - DNA, 75 bp, Artificial Sequence
  Synthetic
taatagatatatatgataaattattacttgataatgtaaattttactggaatgtcattcttaccagtatctttgg

SEQ ID NO: 302024 - DNA, 75 bp, Artificial Sequence
  Synthetic
taatagatatatatgataaattattacttgataatgtaaattttagtagaatgtcattcttaccagtatctttga

SEQ ID NO: 302025 - DNA, 75 bp, Artificial Sequence
  Synthetic
taatagatatatatgataaattattacttgataatgtaaattttagtagaatgtcattcttaccagtatctttgt

SEQ ID NO: 302026 - DNA, 75 bp, Artificial Sequence
  Synthetic
taatagatatatatgataaattattacttgataatgtaaattttagtagaatgtcattcttaccagtatctttgc

SEQ ID NO: 302027 - DNA, 75 bp, Artificial Sequence
  Synthetic
taatagatatatatgataaattattacttgataatgtaaattttagtagaatgtcattcttaccagtatctttgg

SEQ ID NO: 302028 - DNA, 75 bp, Artificial Sequence
  Synthetic
taatagatatatatgataaattattacttgataatgtaaattttagttgaatgtcattcttaccagtatctttga

SEQ ID NO: 302029 - DNA, 75 bp, Artificial Sequence
  Synthetic
taatagatatatatgataaattattacttgataatgtaaattttagttgaatgtcattcttaccagtatctttgt

SEQ ID NO: 302030 - DNA, 75 bp, Artificial Sequence
  Synthetic
taatagatatatatgataaattattacttgataatgtaaattttagttgaatgtcattcttaccagtatctttgc

SEQ ID NO: 302031 - DNA, 75 bp, Artificial Sequence
  Synthetic
taatagatatatatgataaattattacttgataatgtaaattttagttgaatgtcattcttaccagtatctttgg

SEQ ID NO: 302032 - DNA, 75 bp, Artificial Sequence
  Synthetic
taatagatatatatgataaattattacttgataatgtaaattttagtcgaatgtcattcttaccagtatctttga

SEQ ID NO: 302033 - DNA, 75 bp, Artificial Sequence
  Synthetic
taatagatatatatgataaattattacttgataatgtaaattttagtcgaatgtcattcttaccagtatctttgt

SEQ ID NO: 302034 - DNA, 75 bp, Artificial Sequence
  Synthetic
taatagatatatatgataaattattacttgataatgtaaattttagtcgaatgtcattcttaccagtatctttgc

SEQ ID NO: 302035 - DNA, 75 bp, Artificial Sequence
  Synthetic
taatagatatatatgataaattattacttgataatgtaaattttagtcgaatgtcattcttaccagtatctttgg

SEQ ID NO: 302036 - DNA, 75 bp, Artificial Sequence
  Synthetic
taatagatatatatgataaattattacttgataatgtaaattttagtggaatgtcattcttaccagtatctttga

SEQ ID NO: 302037 - DNA, 75 bp, Artificial Sequence
  Synthetic
taatagatatatatgataaattattacttgataatgtaaattttagtggaatgtcattcttaccagtatctttgt

SEQ ID NO: 302038 - DNA, 75 bp, Artificial Sequence
  Synthetic
taatagatatatatgataaattattacttgataatgtaaattttagtggaatgtcattcttaccagtatctttgc

SEQ ID NO: 302039 - DNA, 75 bp, Artificial Sequence
  Synthetic
taatagatatatatgataaattattacttgataatgtaaattttagtggaatgtcattcttaccagtatctttgg

SEQ ID NO: 302040 - DNA, 75 bp, Artificial Sequence
  Synthetic
aaaacgctataatactaatgacaattcaagaggaatgaatttcgaaacgcaaatgttcactaaggtggcgacctt

SEQ ID NO: 302041 - DNA, 75 bp, Artificial Sequence
  Synthetic
agaaaagagaatcatcaagacattcttttccattcaaaggatctgctaataaaatcagtactcatagctattgga

SEQ ID NO: 302042 - DNA, 75 bp, Artificial Sequence
  Synthetic
ctactgctgaaggaggaaaaattgtgttccaaaacgccgctttcactatgtggaaactgacgtatcttgatcatc

SEQ ID NO: 302043 - DNA, 75 bp, Artificial Sequence
  Synthetic
ggttaagaaaatatgtgataatatttttaactttctacgagctttagttaaatcaaatgttaatattggacattg

SEQ ID NO: 302044 - DNA, 75 bp, Artificial Sequence
  Synthetic
tcttcttgatcaaagaataatttggcagaattggtatgcatttacatcctcaatgaaacaaggaaatactcttga

SEQ ID NO: 302045 - DNA, 75 bp, Artificial Sequence
  Synthetic
attctactcacagtcaaatcagctactatcctatggtgatgttacaagatttttgtcgagcaattctatggtatt

SEQ ID NO: 302046 - DNA, 75 bp, Artificial Sequence
  Synthetic
attcttcatttgaagctgcagtagttgctgcaacttctacgcttgaactaatgggcattcaatatgattataatg

SEQ ID NO: 302047 - DNA, 75 bp, Artificial Sequence
  Synthetic
gacccaaaagtggtgcagacactgaatttgtataaacaaacgcaaatcaaccttatggattcgtacgtgcaaata

SEQ ID NO: 302048 - DNA, 75 bp, Artificial Sequence
  Synthetic
aaatggaaaatttggttcggcaattagaaatagaaattggatggctgattctcgaactgtggctaaattggatga

SEQ ID NO: 302049 - DNA, 75 bp, Artificial Sequence
  Synthetic
ttataataaatgggactgacaaatattataaactagatcagtatgcaaatcacatgggcatttctagaagatcac

SEQ ID NO: 302050 - DNA, 75 bp, Artificial Sequence
  Synthetic
gacaagatgttattaatttaattaataaacaaaaacaatcactcattactgttcgtataaataacacttttaaag

SEQ ID NO: 302051 - DNA, 75 bp, Artificial Sequence
  Synthetic
aattaatgaaagacaagctagaacgtggtgaagttgaagtggatgattctttcgttgaagagaaaatggaagtcg

SEQ ID NO: 302052 - DNA, 75 bp, Artificial Sequence
  Synthetic
agtataatacttgggttgtaaaggctagaaaggtgaacgaaaatatgaactctcttcagaatgtgatttctcaac

SEQ ID NO: 302053 - DNA, 75 bp, Artificial Sequence
  Synthetic
aacaagcacacattaatgaactacagatgtacaacaacaaattagagcgtgacttgcagtcaaaaattggatcag

SEQ ID NO: 302054 - DNA, 75 bp, Artificial Sequence
  Synthetic
tagtcagaaatcaggaatagctgatgaaatcgcttcttcacaaacgtttaaaaattatgttaacaagttatctga

SEQ ID NO: 302055 - DNA, 75 bp, Artificial Sequence
  Synthetic
gtgaaagtagatattgagcaacagcttaattcgatagaccagttaaatccagttaatgcaatagatgattttgaa

SEQ ID NO: 302056 - DNA, 75 bp, Artificial Sequence
  Synthetic
ttaattcgatagaccagttaaatccagttaatgcaatagatgattttgaatcagtgcttcgcaacttgatttctg

SEQ ID NO: 302057 - DNA, 75 bp, Artificial Sequence
  Synthetic
taggagtactatttatatctgataatatgatacatgatgtaatcacagtgctgaagaaaatgaagacagaactat

SEQ ID NO: 302058 - DNA, 75 bp, Artificial Sequence
  Synthetic
attcacaatccgctgtacaaattccaatttattattcttccaattcagatctagaaaaaagatgtatagaatttc

SEQ ID NO: 302059 - DNA, 75 bp, Artificial Sequence
  Synthetic
tccaccagttgatgcaagtacatacgttggatctagaatatattcacaggataaatacaaaatacttgaatctta

SEQ ID NO: 302060 - DNA, 75 bp, Artificial Sequence
  Synthetic
ggtactaatgtggagaattcagtttctggacatgtctataatgcgttgatttactacagatataattatacgttt

SEQ ID NO: 302061 - DNA, 75 bp, Artificial Sequence
  Synthetic
tctatcatatatgagtggtttgatatcagatatatgaggaatacgccaatgactacatttacagttgacaaatta

SEQ ID NO: 302062 - DNA, 75 bp, Artificial Sequence
  Synthetic
tttagttgcattagtagatataaatggtactttcattactaatgaagaattagagttggaattttccaataaata

SEQ ID NO: 302063 - DNA, 75 bp, Artificial Sequence
  Synthetic
aattgtatccaaaggtatagctgtaacagagaaagcgaaattgaattcatatgcaccagtttatttagaaaaacg

SEQ ID NO: 302064 - DNA, 75 bp, Artificial Sequence
  Synthetic
gatattagttgcattaatagatatcaatggtacgtttattacaaatgaagagttagaacttgaattttcagataa

SEQ ID NO: 302065 - DNA, 75 bp, Artificial Sequence
  Synthetic
aattatggaagaaaatgtggaacataacagcattacggtctccctatactagtgcgaatttctttcaagattaga

SEQ ID NO: 302066 - DNA, 75 bp, Artificial Sequence
  Synthetic
atgaggcaacaagtccaagccgacagaaatgttgttaactatccatcaattttacatccaattgatcacgcattt

SEQ ID NO: 302067 - DNA, 75 bp, Artificial Sequence
  Synthetic
ctacaaaaaagaatatgcatgtaatggatgatatggctaacggaaaatatacgccaggagtcattccaccagtta

SEQ ID NO: 302068 - DNA, 75 bp, Artificial Sequence
  Synthetic
tagaagcatgttgattaagtgaggaccagactaaacatctggtatccaatctttaattgatatgtagctacatca

SEQ ID NO: 302069 - DNA, 75 bp, Artificial Sequence
  Synthetic
agttgttgaaaaaatgttaatttatgcaaaacatactagagaatatgctgaattttattcacaatctaaccaatt

SEQ ID NO: 302070 - DNA, 75 bp, Artificial Sequence
  Synthetic
atgataattttgagtcattatgggatacgataacaacatcaaattatatattagctaggtcagttgtgcctgatc

SEQ ID NO: 302071 - DNA, 75 bp, Artificial Sequence
  Synthetic
aaattatggaattaatttgccgataacagggtcaatggataatgcgtatgctaatgtaactgatgataagccatt

SEQ ID NO: 302072 - DNA, 75 bp, Artificial Sequence
  Synthetic
tacaagtttttacttatagttacaattgcctcgatttttgttagtgcacagaactatggtgttaatctaccaata

SEQ ID NO: 302073 - DNA, 75 bp, Artificial Sequence
  Synthetic
ggttggcctacgggttcagtatactttaatgaatatgctaacatagctgaattttcaattaatccacaactcttc

SEQ ID NO: 302074 - DNA, 75 bp, Artificial Sequence
  Synthetic
tggatataactctatactactaccagcaaactgatgaagcaaataagtggatatcaatgggtacgtcatgcacaa

SEQ ID NO: 302075 - DNA, 75 bp, Artificial Sequence
  Synthetic
ttaaagtttgcccactaaatacacagacacttggaattggatgtgtgacaactgatacgaattcatttgaaactg

SEQ ID NO: 302076 - DNA, 75 bp, Artificial Sequence
  Synthetic
ctactctactaaacttagatgctaattacgttgaaactgcacgtaatacaattgattattttgtcgattttgtgg

SEQ ID NO: 302077 - DNA, 75 bp, Artificial Sequence
  Synthetic
tattctagaatgaatgctaaagttaaagcattagtatctacagtcggtattgaaatagcaaaaagatatatagct

SEQ ID NO: 302078 - DNA, 75 bp, Artificial Sequence
  Synthetic
aaaaactatgtatctaagctttcagaccgactattagtatcaaaaaatgtgattgtttcaagaggcatagcacta

SEQ ID NO: 302079 - DNA, 75 bp, Artificial Sequence
  Synthetic
ggcaagtattttacactatagtcgattatgtgaaccagattgtacaagcgatgtctaagaggtccagatcactag

SEQ ID NO: 302080 - DNA, 75 bp, Artificial Sequence
  Synthetic
ttatgtgaaccagattgtacaagcgatgtctaagaggtccagatcactagactccgcagcgttttactatagagt

SEQ ID NO: 302081 - DNA, 75 bp, Artificial Sequence
  Synthetic
ggtaaatgtaaaaactgtaaatataaaaggaagtatttcgcactaagaatgagaatgaaacaagtcgcaatgcaa

SEQ ID NO: 302082 - DNA, 75 bp, Artificial Sequence
  Synthetic
gtctaaatcagctatttcaagattaatatcgaaatattcagtgtacagaccatcaatagaagaactgtataaagt

SEQ ID NO: 302083 - DNA, 75 bp, Artificial Sequence
  Synthetic
gcgccgcagtcagattcactcaggaagttatcaggtattaagtttaagcggataaactttgataattcatcagaa

SEQ ID NO: 302084 - DNA, 75 bp, Artificial Sequence
  Synthetic
aggaagcgcggaacaaagcgtgagaactttccacaacagaatgaacggttgcaagaaaaagagattgaaaagagt

SEQ ID NO: 302085 - DNA, 75 bp, Artificial Sequence
  Synthetic
gagattattaccgacgcacacgacgatgtcaaaaatgctgatgaaatcaagaaatcatctaaagaggaatctaag

SEQ ID NO: 302086 - DNA, 75 bp, Artificial Sequence
  Synthetic
aattatcagaaaaagtgttatctcagaaagaagaagtaattacggataaccaagaagaaactagaatagctgatg

SEQ ID NO: 302087 - DNA, 75 bp, Artificial Sequence
  Synthetic
tttgacacgattagattgtcatttcaactaatgcgaccgccaaacatgactccagcagttgcagcactcttcccg

SEQ ID NO: 302088 - DNA, 75 bp, Artificial Sequence
  Synthetic
tggtactgggagctgaagaaagatactatacccgatggagattatgatgttagagaatacttccttaacttgtat

SEQ ID NO: 302089 - DNA, 75 bp, Artificial Sequence
  Synthetic
ctatacccgatggagattatgatgttagagaatacttccttaacttgtatgatcacgtcctcactgaaatgccag

SEQ ID NO: 302090 - DNA, 75 bp, Artificial Sequence
  Synthetic
ccacagtaggcctaacgttgcgtatcgagtctgcggtttgcgagtcagtgcttgctgatgctagtgagacgatgt

SEQ ID NO: 302091 - DNA, 75 bp, Artificial Sequence
  Synthetic
gagcaaatggggaaaaagagttgcgcaatagatggtactggaaactgaaacgtgacactttacccgatggagatt

SEQ ID NO: 302092 - DNA, 75 bp, Artificial Sequence
  Synthetic
gcatgatgaggaaacagaaggtgcagtgaggcgcatcatggcggaatttagacagcgcatacaagctgaaagaaa

SEQ ID NO: 302093 - DNA, 75 bp, Artificial Sequence
  Synthetic
gtgactagaacaatggactttattgtttatagatttttaatggttatagttttacttgcaccaattattaagacc

SEQ ID NO: 302094 - DNA, 75 bp, Artificial Sequence
  Synthetic
agtatttcttgcaacaccaattagttgaaccattgaataatgatataatatttaattatctcccagaaaagataa

SEQ ID NO: 302095 - DNA, 75 bp, Artificial Sequence
  Synthetic
tttaattatctcccagaaaagataaggaatgacgttaactacattcttataatggacagaaatctgccatcaaca

SEQ ID NO: 302096 - DNA, 75 bp, Artificial Sequence
  Synthetic
aaaacagtgctttcaagaattgcgaataaatattcttttataactaaaataattagagttgatggtgatgataat

SEQ ID NO: 302097 - DNA, 75 bp, Artificial Sequence
  Synthetic
ggaattagtttcaaccgaagcgcacattcaaaaattttcgcacgacttgcaactagaagcaataacaatacagtc

SEQ ID NO: 302098 - DNA, 75 bp, Artificial Sequence
  Synthetic
aagctttagtgtccacagttggtattgaaatagcaaaaagatacatagctggagggaaaatatttttcagagctg

SEQ ID NO: 302099 - DNA, 75 bp, Artificial Sequence
  Synthetic
atcttaaagaattagtatccacggaggctcaaatacaaaaaatgtcacaagacttacagttagaagcactaacaa

SEQ ID NO: 302100 - DNA, 75 bp, Artificial Sequence
  Synthetic
tgtagtgccaaatgacatgttcataagggggactttaattgcatgtcaactggctatagtgaatacaattattta

SEQ ID NO: 302101 - DNA, 75 bp, Artificial Sequence
  Synthetic
gtttatacgtgaatctttagtggcatgtcagttagcaataattaataccatcatatacccagcttttggcatgca

SEQ ID NO: 302102 - DNA, 75 bp, Artificial Sequence
  Synthetic
accaactccacgtttaaagtattcgattcagaagacttcataatagaatatggaacgactgatgatgaagtatat

SEQ ID NO: 302103 - DNA, 75 bp, Artificial Sequence
  Synthetic
gtggcaagtattctatacaatagttgattatgttaatcaaattgtacaagttatgtccaaacgatcgcgttcatt

SEQ ID NO: 302104 - DNA, 75 bp, Artificial Sequence
  Synthetic
actaccgcaccacaaactgaaagaatgatgcgtataaattggaaaagatggtggcaagtattctatacaatagtt

SEQ ID NO: 302105 - DNA, 75 bp, Artificial Sequence
  Synthetic
tccagcgtggaatttttttgctatcaaataggcttggccaattagttgatttaaccgggctactagcttataact

SEQ ID NO: 302106 - DNA, 75 bp, Artificial Sequence
  Synthetic
aatggggaatgcaaccgttatacccagcccgcaaaccttgttccactactataatgttaatgttaatattcattc

SEQ ID NO: 302107 - DNA, 75 bp, Artificial Sequence
  Synthetic
tcaaataggaatttaattcgttatcggtttgagaatgggtatgacaaagtaagaatagaaagcgcttatgtgacc

SEQ ID NO: 302108 - DNA, 75 bp, Artificial Sequence
  Synthetic
tccattcaaactacaatgagagaataaatgatgcagtagcaatcataaccgctgcaaatagattgaatttatatc

SEQ ID NO: 302109 - DNA, 75 bp, Artificial Sequence
  Synthetic
atcataaattgaacgtgacgacaaatacttgtacaattaggaattgtaaaaaattaggaccaagggaaaacgtag

SEQ ID NO: 302110 - DNA, 75 bp, Artificial Sequence
  Synthetic
aaataaggactgatcaacattgggtgactaaaacaaatatagaagactatttactaccgggatggaaactaacgt

SEQ ID NO: 302111 - DNA, 75 bp, Artificial Sequence
  Synthetic
attgatgagaacaggcgattatgcacaaataacaaaaatactcttgaataatcaccccgttgcgctagttggagc

SEQ ID NO: 302112 - DNA, 75 bp, Artificial Sequence
  Synthetic
tgcagttggagagagatgaaatgtatggttatgttaatatagctcgtaacttggatgggtttcaacagataaatt

SEQ ID NO: 302113 - DNA, 75 bp, Artificial Sequence
  Synthetic
ctcaaatgaattggacttccagaattttatactcaaaaagattaaagaaaggatgacaacttcattgccaatagc

SEQ ID NO: 302114 - DNA, 75 bp, Artificial Sequence
  Synthetic
atcttgtagcgaactatgattgggttccaacgtctacaacaaaagtttataaacaagtaccacaacaattcgatt

SEQ ID NO: 302115 - DNA, 75 bp, Artificial Sequence
  Synthetic
taaccaagacaaatatagaagattatttattaccaggatggaagctgacatatgttggatacaatggaagtgata

SEQ ID NO: 302116 - DNA, 75 bp, Artificial Sequence
  Synthetic
atcgaagaaagccaataatatatatgatagggtcggcgccttcatattggatttatgatgtgaagcaatactcta

SEQ ID NO: 302117 - DNA, 75 bp, Artificial Sequence
  Synthetic
ttcaatattatacatagatataagaacagatagaaaagatacagactggaaaacatggaggaaaattgtagagga

SEQ ID NO: 302118 - DNA, 75 bp, Artificial Sequence
  Synthetic
tatgctaattcaacgcaagataacaattttttatcttcaactttgtgtttgtactatccaactgaggcttcgaca

SEQ ID NO: 302119 - DNA, 75 bp, Artificial Sequence
  Synthetic
atatttttagagatctttcaaataataatttcaacttgataggtactaatgtagaaaattcagtttcaggacatg

SEQ ID NO: 302120 - DNA, 75 bp, Artificial Sequence
  Synthetic
tagaattctcaatcgatccaaaactatattgtgattataatattgttttagttagattcatcgctgggcaagaat

SEQ ID NO: 302121 - DNA, 75 bp, Artificial Sequence
  Synthetic
atattgtgattataatattgttttagttagattcatcgctgggcaagaattagatgtatctgaattagcagatct

SEQ ID NO: 302122 - DNA, 75 bp, Artificial Sequence
  Synthetic
aaataatgtaattaccgaaaacgtgtttatccaacaaccatttaaattgaaggtgttaaaagacgaatatatggt

SEQ ID NO: 302123 - DNA, 75 bp, Artificial Sequence
  Synthetic
gtatggtattgaatataccacagttttaacctttttgatatcagttatattgttgaattacgtactcaaatcatt

SEQ ID NO: 302124 - DNA, 75 bp, Artificial Sequence
  Synthetic
gatttaaggatatttatgactggacttttttaccaactgattttgaaacaaaagaatcaataatcacatcatatg

SEQ ID NO: 302125 - DNA, 75 bp, Artificial Sequence
  Synthetic
aaaccacaagctggatataacttctacgacatgcacaatacgaaattgtaacaaactgggaccaagagagaatgt

SEQ ID NO: 302126 - DNA, 75 bp, Artificial Sequence
  Synthetic
catcataaggaattgttttttgataaggatgtcactaaacttaaagacaattcaattctatatatagacataaga

SEQ ID NO: 302127 - DNA, 75 bp, Artificial Sequence
  Synthetic
ttggaatcaaatttaaaaatataccctacaaatatgatgttaaagtaccacatcttactttcggtgtgttgaaca

SEQ ID NO: 302128 - DNA, 75 bp, Artificial Sequence
  Synthetic
gattttatatttgaaacatgggatccattagatactccatattctacaacacatcataaagaattattttttgat

SEQ ID NO: 302129 - DNA, 75 bp, Artificial Sequence
  Synthetic
cattagatactccatattctacaacacatcataaagaattattttttgataaggatgtcaataaacttaaagata

SEQ ID NO: 302130 - DNA, 75 bp, Artificial Sequence
  Synthetic
ttatactagagtcaaaagtaaatttgattatgtgatggatgattccggcgtcaagaataatctattgggtaaggc

SEQ ID NO: 302131 - DNA, 75 bp, Artificial Sequence
  Synthetic
catctaaaggaattgatcagaaaatgagagtacttaatgcatgtttcagtgttaaaagaattccaggtaagtcat

SEQ ID NO: 302132 - DNA, 75 bp, Artificial Sequence
  Synthetic
aatgacgattatcaaactccaatcatgaattcagttacagtgcgacaagatcttgaacgccaactaggtgattta

SEQ ID NO: 302133 - DNA, 75 bp, Artificial Sequence
  Synthetic
agatttagcattattaccattagatatgttttctatgttctcaggtattaaaagcacaattgacgcagctaaatc

SEQ ID NO: 302134 - DNA, 75 bp, Artificial Sequence
  Synthetic
tgtgtcgataattcaaagaaaggtttatcactgagctctctgttcgaagaatataaagatataatagaaaacgca

SEQ ID NO: 302135 - DNA, 75 bp, Artificial Sequence
  Synthetic
taacagaattacttctgaattaatgaagtcagctgaagaatacacagattcattgatggatcctgctatattaac

SEQ ID NO: 302136 - DNA, 75 bp, Artificial Sequence
  Synthetic
tttacaatagttgcttcaactgtaaataaatatggcgtaccaaggcacaatgcaaaatatagatatgagtatgat

SEQ ID NO: 302137 - DNA, 75 bp, Artificial Sequence
  Synthetic
caagaggattatttaatagcgagagaattgataatcttatcatattctaataggtctacgttagctaaattggta

SEQ ID NO: 302138 - DNA, 75 bp, Artificial Sequence
  Synthetic
aagtggataaaaaggatcaggataaattttataactctattatatatggaattgcgccgccaccacagtttaaaa

SEQ ID NO: 302139 - DNA, 75 bp, Artificial Sequence
  Synthetic
aattgataatcttatcatattctaataggtctacgttagctaaattggtatcatctcctatgtcaatattagtcg

SEQ ID NO: 302140 - DNA, 75 bp, Artificial Sequence
  Synthetic
ttccattcgaaagaactattattgaaatctgttttaatagctattggtcaaacaaaagaaattgaaactactgcc

SEQ ID NO: 302141 - DNA, 75 bp, Artificial Sequence
  Synthetic
catgttgtacagctccgaagagtgttaactacagctacaataacccttttaccagatgcagaaagatttagtttt

SEQ ID NO: 302142 - DNA, 75 bp, Artificial Sequence
  Synthetic
tcattgaatataaaatcactgtaaatgaagataaaccaatttcagatgtgcatattaaagaacttgtttctgaac

SEQ ID NO: 302143 - DNA, 75 bp, Artificial Sequence
  Synthetic
tgaatacacgatgctaattagggatgagattgtcaagatgcttgaagtgccagtcaagcatgatgatcatctgtt

SEQ ID NO: 302144 - DNA, 75 bp, Artificial Sequence
  Synthetic
acaagattccgaactagctggactactctcgatgtcatcagcttctaacggtgagtcaaggcaattgaagtttgg

SEQ ID NO: 302145 - DNA, 75 bp, Artificial Sequence
  Synthetic
acgtgattctgagttagctggatttctatctatgtcatcagcctcaaatggtgaatcaagacaactaaaatttgg

SEQ ID NO: 302146 - DNA, 75 bp, Artificial Sequence
  Synthetic
taatacttcttttgaagctgcagttgttgctgccacttcaacattagaattgatgggtattcaatatgattacaa

SEQ ID NO: 302147 - DNA, 75 bp, Artificial Sequence
  Synthetic
tagtaattctatggtattatatacagacgtttcgcaatgggattcatcacaacacaatacacaaccattccgaaa

SEQ ID NO: 302148 - DNA, 75 bp, Artificial Sequence
  Synthetic
tagatggagatgacaactatgctgtactacaatttaatacggaagtgacaaaacaaatggtgcaagacgtgtcaa

SEQ ID NO: 302149 - DNA, 75 bp, Artificial Sequence
  Synthetic
tgaatattttatagcacagcatgctgtggttgaaaaaatgttgatctatgcaaagcatactagagaatatgctga

SEQ ID NO: 302150 - DNA, 75 bp, Artificial Sequence
  Synthetic
ctaaaggtatagcagtaacagagaaagcgaaattgaactcgtatgcacccgtatatttagagaaacgtcgcgctc

SEQ ID NO: 302151 - DNA, 75 bp, Artificial Sequence
  Synthetic
ttcagaggattttatcatagaatatggaacaactgatgatgaagtatatatacagagagcattcatgtccttgtc

SEQ ID NO: 302152 - DNA, 75 bp, Artificial Sequence
  Synthetic
aaaaaaattacaattaacgatatcttgcgcgatataaaaccattctttgtaactaccgaagctaaattaccaatt

SEQ ID NO: 302153 - DNA, 75 bp, Artificial Sequence
  Synthetic
tgggtttttaaaacattataatagtgtttggactttccacggtgaaacgccacatgctacaactgattactcatc

SEQ ID NO: 302154 - DNA, 75 bp, Artificial Sequence
  Synthetic
atagtatctagaggaatagctttgactgaaaaagcaaagttgaattcatatgcaccaatatcacttgaaaaaaga

SEQ ID NO: 302155 - DNA, 75 bp, Artificial Sequence
  Synthetic
ccgaccttaccagaaaatgtacaatatataattcagtgtatagggtcaagaacttaccagattgaagatgatggc

SEQ ID NO: 302156 - DNA, 75 bp, Artificial Sequence
  Synthetic
gagatagcaaagagatacatagctggaggaaaaatattttttagagctggaataaatttattgaataatgaaaaa

SEQ ID NO: 302157 - DNA, 75 bp, Artificial Sequence
  Synthetic
aacaaatcactactaaggatgaaattgaaaaacagatggatagagtagtgaaagaaatgagacgtcaattggaaa

SEQ ID NO: 302158 - DNA, 75 bp, Artificial Sequence
  Synthetic
aaagaaatgagacgtcaattggaaatgattgataaactaacaacacgtgaaattgaacaggtagagttgctaaag

SEQ ID NO: 302159 - DNA, 75 bp, Artificial Sequence
  Synthetic
attgtatccaaaggtatagcagtaacagagaaagcaaaattgaattcgtacgcaccagtttacttagaaaagcgc

SEQ ID NO: 302160 - DNA, 75 bp, Artificial Sequence
  Synthetic
ttgttattactataaaagaattaacaaattaaaccatgcagtcttgagattaggagttaatgatgcatggagacc

SEQ ID NO: 302161 - DNA, 75 bp, Artificial Sequence
  Synthetic
gcaggaaaaggacgatgaaaaacgagaatcgaataacaagatgcaactatctgataaagtgctttcaaagaaaga

SEQ ID NO: 302162 - DNA, 75 bp, Artificial Sequence
  Synthetic
tgtagtcagtatggtagatgctttcttgataatgaaccgcacttactgagaatgagaacgttcaaaaatgatata

SEQ ID NO: 302163 - DNA, 75 bp, Artificial Sequence
  Synthetic
caacataaactcaaaatggcatctaaattaatcaaaccaaactatataacctcgaatcataaaacattagctact

SEQ ID NO: 302164 - DNA, 75 bp, Artificial Sequence
  Synthetic
aattaatcaaaccaaactatataacctcgaatcataaaacattagctactgaggtacgtaattgcaagtggtgtt

SEQ ID NO: 302165 - DNA, 75 bp, Artificial Sequence
  Synthetic
acaaaagatgatttgatgaacttaattgatatgtataatatattgtttcctatgaatcagaaaatagtgaataaa

SEQ ID NO: 302166 - DNA, 75 bp, Artificial Sequence
  Synthetic
aaagaagagcatcaaaaagaaattcagtatgaaatattgcagaaaactataccaacattcgaacctaaagaatcg

SEQ ID NO: 302167 - DNA, 75 bp, Artificial Sequence
  Synthetic
ttagagagtactttctgaatttgtatgaccaagtgctagctgaaatgccagattacctactactgaaggatatgg

SEQ ID NO: 302168 - DNA, 75 bp, Artificial Sequence
  Synthetic
cagatatttttctaaatcaagatttattactgaaggaaggaaatgcattaatgattctcatttctctgttaatat

SEQ ID NO: 302169 - DNA, 75 bp, Artificial Sequence
  Synthetic
ctgttgaatatgattctggcatatctgatattgaatagtaaagaaagatcacgtttgccactacaagactccctg

SEQ ID NO: 302170 - DNA, 75 bp, Artificial Sequence
  Synthetic
gtgaatacttattttaatgttttgaagacgtcgcatattgaattctacagtatttccactagatgtagattattc

SEQ ID NO: 302171 - DNA, 75 bp, Artificial Sequence
  Synthetic
aggaatgacgttaattacatcctcaatatggatagaaacttgccatcaacggctagatatataaggccgaatttg

SEQ ID NO: 302172 - DNA, 75 bp, Artificial Sequence
  Synthetic
gctcaattaataccagttatactgtatggaatgacttcagaatcaaaaaagtttatgataacattttcagttttg

SEQ ID NO: 302173 - DNA, 75 bp, Artificial Sequence
  Synthetic
ggctagatatataaggccgaatttgcttcaggacagactaaatttacatgataattttgaatcactgtgggatac

SEQ ID NO: 302174 - DNA, 75 bp, Artificial Sequence
  Synthetic
actttcgcagctatttttaactaaaggatggccaacaggatctatttattttaaagattatactgatattgcctc

SEQ ID NO: 302175 - DNA, 75 bp, Artificial Sequence
  Synthetic
taaatggaattcatcagtaacagagatatttaattgtctagaaccagtggaactaaacaccaccagatatgttct

SEQ ID NO: 302176 - DNA, 75 bp, Artificial Sequence
  Synthetic
caattagaagcattgacaatccagtcagaaacgcaattccttacaggtataaactcacaggcagccaacgattgt

SEQ ID NO: 302177 - DNA, 75 bp, Artificial Sequence
  Synthetic
ttggtaaagttccacaaatattaactttgaatgatattgtcattgttttacaatccattatatatgattggtttg

SEQ ID NO: 302178 - DNA, 75 bp, Artificial Sequence
  Synthetic
ccgttataccaaatgacatgtttataagagagtcactagttgcatgccaattagctatagtaaatacaataatat

SEQ ID NO: 302179 - DNA, 75 bp, Artificial Sequence
  Synthetic
ttagctatagtaaatacaataatatatccagcatttggaatgcagcggatgcattatagaaatggagacccacag

SEQ ID NO: 302180 - DNA, 75 bp, Artificial Sequence
  Synthetic
gcgtactgaatcaagtactaaatgacaacattagaaatggacatgtcattaatcaattaatggaggctctaatgc

SEQ ID NO: 302181 - DNA, 75 bp, Artificial Sequence
  Synthetic
ctaataggcttggacagttggttgacctgactagattgttagcttataattatgaaacattgatggcatgtataa

SEQ ID NO: 302182 - DNA, 75 bp, Artificial Sequence
  Synthetic
gtggctagagttccagatgatcaaatgtatagattgagagacagactacgcttattgccagtagaagttaggagg

SEQ ID NO: 302183 - DNA, 75 bp, Artificial Sequence
  Synthetic
cttattgccagtagaagttaggaggttagacattttcaatctaatattgatgaatatggagcaaatagagcgtgc

SEQ ID NO: 302184 - DNA, 75 bp, Artificial Sequence
  Synthetic
gaagttgaagttgatgattcattcgttgaagagaagatggaagttgatacaattgactggaaatcaagatatgat

SEQ ID NO: 302185 - DNA, 75 bp, Artificial Sequence
  Synthetic
ttaaactgaggaaagttgatacgctaaaaccgatactgtataagataaattcagattcgaatgacttctacttgg

SEQ ID NO: 302186 - DNA, 75 bp, Artificial Sequence
  Synthetic
tactgtaataaattagaagctgatttacagaataaaattggttcactagtttcatctgttgaatggtatctcaaa

SEQ ID NO: 302187 - DNA, 75 bp, Artificial Sequence
  Synthetic
acatagtgtggctcaggtgtatgcagacactcaggtgtacacacatgatgactctaaagatgagtatgagaatgc

SEQ ID NO: 302188 - DNA, 75 bp, Artificial Sequence
  Synthetic
gtgacttggagtcatggggaagtgaatgattcgacaacgatagaaccagtactcgatggtccttatcaaccaaca

SEQ ID NO: 302189 - DNA, 75 bp, Artificial Sequence
  Synthetic
tgaaaactaaagaggatcatcagaaagaagtacaatatgaaattctacaaaaaacaataccaacttttgaaccaa

SEQ ID NO: 302190 - DNA, 75 bp, Artificial Sequence
  Synthetic
ccgagagttattaattcagctgatggcactactacatggtattttaatccagttattctaagaccaagcaatgtg

SEQ ID NO: 302191 - DNA, 75 bp, Artificial Sequence
  Synthetic
aattcttgatcaaaactttattgagtataaaatcacagtaaatgaagataaaccaatttcagagtcgcacgtaaa

SEQ ID NO: 302192 - DNA, 75 bp, Artificial Sequence
  Synthetic
aatgtagaaatgaatgtatgacacagtggtacaatcatttattaatgccaataacattacaatctctatcaattg

SEQ ID NO: 302193 - DNA, 75 bp, Artificial Sequence
  Synthetic
attataaaagatcaatacaaagaggaatattactattatcaaacagattaggtcaattagttgatttaacaagac

SEQ ID NO: 302194 - DNA, 75 bp, Artificial Sequence
  Synthetic
tctaatgaacagcacattgcacacaatactagaagatccaggaatggcgtattttccttatattgcatctgtcct

SEQ ID NO: 302195 - DNA, 75 bp, Artificial Sequence
  Synthetic
agggacagacttagattattgccagttgaaagacgaagacttgatatattcaatttaatattaatgaatatggag

SEQ ID NO: 302196 - DNA, 75 bp, Artificial Sequence
  Synthetic
acagactattagtaatttaaatattgcgtataagtatctatcaacagggaaagctaaggtgtgctgcgttaaatt

SEQ ID NO: 302197 - DNA, 75 bp, Artificial Sequence
  Synthetic
caactactgagatcaggtcagaattttatgcgatactagatgtatgggatattagcactattaaaaggtttatac

SEQ ID NO: 302198 - DNA, 75 bp, Artificial Sequence
  Synthetic
caagaattatattcatattaccatatgaatactttattgcgcagcacgctgtcgtagaaaaaatgttattatacg

SEQ ID NO: 302199 - DNA, 75 bp, Artificial Sequence
  Synthetic
tggcaggttataaagagcaaatcactacaaaagatgaaatagaaaaacaaatggacagagtcgttaaagagatga

SEQ ID NO: 302200 - DNA, 75 bp, Artificial Sequence
  Synthetic
aagtatacaaacaggtaccgcaaccctttgactttagagcgtcaatgcatatgctaacatctaatctaactttta

SEQ ID NO: 302201 - DNA, 75 bp, Artificial Sequence
  Synthetic
tagtcaaaagtcaggaatagctgatgaaattgcttcttcacaaacatttaaaaattatgttaacaaattatctga

SEQ ID NO: 302202 - DNA, 75 bp, Artificial Sequence
  Synthetic
atggcttcgctcatttatagacagttgcttactaattcatacacagtagaactttcagatgaaatacaagaaatt

SEQ ID NO: 302203 - DNA, 75 bp, Artificial Sequence
  Synthetic
aatttctatttgaaacatgggacccgctagatactccatattcatccatacaccataaagaactgttcttcgaaa

SEQ ID NO: 302204 - DNA, 75 bp, Artificial Sequence
  Synthetic
aaccaaatgtacagcaagttgagcgaacatatacattatttggacaacaagttcaagtaacggtatcaaatgact

SEQ ID NO: 302205 - DNA, 75 bp, Artificial Sequence
  Synthetic
acttataatggagagacaccgaacgcaaacactggttactactctacaactaactttgacactgtaaatatgaca

SEQ ID NO: 302206 - DNA, 75 bp, Artificial Sequence
  Synthetic
ttcagtcaatggtgtgaataacttcagttataatggaggatcactgccaactgattttagcgtatcaagatatga

SEQ ID NO: 302207 - DNA, 75 bp, Artificial Sequence
  Synthetic
caaaaggagtgttatattcatttataaataacgttattactgacaatgtatttatacaatcaccatttaagatta

SEQ ID NO: 302208 - DNA, 75 bp, Artificial Sequence
  Synthetic
atataaagatgtaatagataatgcgactttattatctatattatcatattcctatgataaatacaatgctgtgga

SEQ ID NO: 302209 - DNA, 75 bp, Artificial Sequence
  Synthetic
attggatcaattcgcaaaccatacaggtatttcaagaagatcacatcagattagattttcagagtctgcaacatc

SEQ ID NO: 302210 - DNA, 75 bp, Artificial Sequence
  Synthetic
gttatgctaatgaaatcgagaattatattaataaagtatatagtataacatacgctgacgatccaaactatttta

SEQ ID NO: 302211 - DNA, 75 bp, Artificial Sequence
  Synthetic
agtctataaacgtagattagatttatttactatagtagcatctacaataaataaatatggagttccgagacataa

SEQ ID NO: 302212 - DNA, 75 bp, Artificial Sequence
  Synthetic
cattacaaatgaagaattggaacttgaattttcagataagtatgttagagcaattgtacctgaccaaacttttaa

SEQ ID NO: 302213 - DNA, 75 bp, Artificial Sequence
  Synthetic
acattaatgtcaaaaatttattcttggtcattccatgttggatttagaaaacaaaaaatgattgatgcagcatta

SEQ ID NO: 302214 - DNA, 75 bp, Artificial Sequence
  Synthetic
aatttaatcaaatgatagtcactatgaatggaaatgatttccaaacaggaggaataggaaatttgccaatcagga

SEQ ID NO: 302215 - DNA, 75 bp, Artificial Sequence
  Synthetic
gtgagtcaagacaactaaaatttggtcgtaaaacgatattttcaaccaagaaaaatatgcatgttatggatgata

SEQ ID NO: 302216 - DNA, 75 bp, Artificial Sequence
  Synthetic
gaacttaccagattgaagatgatggctcaaaatcagcaatatccagacttatatcaaagtattcagtttataaac

SEQ ID NO: 302217 - DNA, 75 bp, Artificial Sequence
  Synthetic
aatgcaccagctaatacacaacaatttgaacatatcgtgcagctccgaagagtactgactactgctacgataact

SEQ ID NO: 302218 - DNA, 75 bp, Artificial Sequence
  Synthetic
gtaacataattaaaaagattcaatatggagctgttgcttcaggagaaaaacagactaaggcagctaattctatag

SEQ ID NO: 302219 - DNA, 75 bp, Artificial Sequence
  Synthetic
gaaactttgatactattagattgtcattccagctaatgagaccaccaaatatgacaccagcagtggcagcactat

SEQ ID NO: 302220 - DNA, 75 bp, Artificial Sequence
  Synthetic
gaattgcgccgccaccacagtttaaaaaacgttataatactaatgacaattcaagaggtatgaattatgaaactc

SEQ ID NO: 302221 - DNA, 75 bp, Artificial Sequence
  Synthetic
ggttgcaactgccgagaaactagtaattactgacgttgttgatggagtcaatcataagcttgacattaccacagc

SEQ ID NO: 302222 - DNA, 75 bp, Artificial Sequence
  Synthetic
gattatattaatcaaattatacaagttatgtccaaacggtcaagatcattagacacggctgctttttattataga

SEQ ID NO: 302223 - DNA, 75 bp, Artificial Sequence
  Synthetic
tcaggtctatgtcaatgatgatgagaaggatagttatgaaaatgcattcttgatctctaacctaactacacacaa

SEQ ID NO: 302224 - DNA, 75 bp, Artificial Sequence
  Synthetic
ataagatgcaattttacatacgactatgagaataatgtagtttatcttcatgactactcttactatactaataat

SEQ ID NO: 302225 - DNA, 75 bp, Artificial Sequence
  Synthetic
ctagagggcactataatttctcattcacgtgtcaaaatgctgctactgacgatgatataataatagagtacattt

SEQ ID NO: 302226 - DNA, 75 bp, Artificial Sequence
  Synthetic
agacaagttgtttccattactattaaaagagcatgccaggataacgaacgtgggaccacggaatgagtcaatgtt

SEQ ID NO: 302227 - DNA, 75 bp, Artificial Sequence
  Synthetic
gtagttgaaaaaatgttgatttacgcaaaacatacgagagaatacgctgaattttattcacaatcaaaccaatta

SEQ ID NO: 302228 - DNA, 75 bp, Artificial Sequence
  Synthetic
caataaaacagttctcgaatggaccatacctagttaaagacacaattaaacttaaacaagagagatggcttggca

SEQ ID NO: 302229 - DNA, 75 bp, Artificial Sequence
  Synthetic
gctaccaattgtttgattttaattctccagatttagagaagcttatacgaattccttttaaaggtaaaataccag

SEQ ID NO: 302230 - DNA, 75 bp, Artificial Sequence
  Synthetic
tcaatacaaaaatatgctgaatgtattgacaactctatatcaatattatgacatgtaccatgagaaaccagttat

SEQ ID NO: 302231 - DNA, 75 bp, Artificial Sequence
  Synthetic
gtgtcacagttcgatattggccagtataagaacatgttaaatgtagttacaaccatctactattattataattta

SEQ ID NO: 302232 - DNA, 75 bp, Artificial Sequence
  Synthetic
tattggatatatgatgttagacagtactctgacttaaaatttgagacgtgggatccgttagatacaccatattct

SEQ ID NO: 302233 - DNA, 75 bp, Artificial Sequence
  Synthetic
cattggatacaccgtactcgactgtacatcacaaagaactgttcttcgaaaaagatgttggaaaactaagagaca

SEQ ID NO: 302234 - DNA, 75 bp, Artificial Sequence
  Synthetic
tgcctataaatatctaattactggaaaagctaaagtatgttgcgttaaaatgacagctatggatttagagttacc

SEQ ID NO: 302235 - DNA, 75 bp, Artificial Sequence
  Synthetic
ccaaagggagtgctatactcttttattaataatacaattacagaaaatgtgttcattcaagcaccatttaaacca

SEQ ID NO: 302236 - DNA, 75 bp, Artificial Sequence
  Synthetic
aatgattttaacaatagagaaaatgtggtaaaactaattaataatcagaaaaaagcgttgataacagtgagaatt

SEQ ID NO: 302237 - DNA, 75 bp, Artificial Sequence
  Synthetic
tgggtttttaaaacatggtggacgtgtttggacttttcacggtgaaacgccgcatgctacaactgattactcatc

SEQ ID NO: 302238 - DNA, 75 bp, Artificial Sequence
  Synthetic
cgctcatcacagtaagaattaataatacttttaaagacgatccaaaagtaggttttaagacaatatttgactgga

SEQ ID NO: 302239 - DNA, 75 bp, Artificial Sequence
  Synthetic
aacaggaaataatcacttatttatattaaatgggacggataagtattataaacttgatcaatttgctaaccacat

SEQ ID NO: 302240 - DNA, 75 bp, Artificial Sequence
  Synthetic
atagacactaatatagagaattcggtgtcaggccatgtatacaacgcactcatatactatagacataattactcc

SEQ ID NO: 302241 - DNA, 75 bp, Artificial Sequence
  Synthetic
tggctaatggaagatatacaccaggtataattccacctgtgaatgttgataaaccaataccattaggaagaagag

SEQ ID NO: 302242 - DNA, 75 bp, Artificial Sequence
  Synthetic
gtagatcggcaaaggaattcgctaagatacaagatgacttaacggtattgaggtattcgaatgaaatcgaaaact

SEQ ID NO: 302243 - DNA, 75 bp, Artificial Sequence
  Synthetic
gcatttaacattcggagtgctacacatatcagacaatatggtaccagatgtggtggaagtgttgaaggaagtaaa

SEQ ID NO: 302244 - DNA, 75 bp, Artificial Sequence
  Synthetic
agaatatataatgtcttctacaaacgtcagattacctttgggcaatcaaggatgttcattccacacataacgctt

SEQ ID NO: 302245 - DNA, 75 bp, Artificial Sequence
  Synthetic
agtttcagtaactctaagacaataaggatagagcccgtaaagctaaaaatcgaatcgatttatttgaggaaaata

SEQ ID NO: 302246 - DNA, 75 bp, Artificial Sequence
  Synthetic
cttatcagatgaaatacaagaaattggatctacaaaaacccaaaacgttacaattaatccaggtccattcgcgca

SEQ ID NO: 302247 - DNA, 75 bp, Artificial Sequence
  Synthetic
tagctacatcaatttctgaattaactggatcgttatcaagtgctgcctcatcagtttccagaagctcatctatta

SEQ ID NO: 302248 - DNA, 75 bp, Artificial Sequence
  Synthetic
ccaccagtagagtactggatgctgctatcgcctaccgcacctggagtaatagtagaggggacaaacaatatagat

SEQ ID NO: 302249 - DNA, 75 bp, Artificial Sequence
  Synthetic
caaagacacagtggaaatttgttgacgtagtcaaaactacgcagaatggaagttattcgcaatatggaccactac

SEQ ID NO: 302250 - DNA, 75 bp, Artificial Sequence
  Synthetic
taattatgactcagtgagcatgacagctttttgcgatttttacataataccacgagcagaggaatcagtgtgcac

SEQ ID NO: 302251 - DNA, 75 bp, Artificial Sequence
  Synthetic
aaatgttggaccaagaaatgaatcaatgttcacatttttaaatttcccaactattaaacaattttcaaatggtgc

SEQ ID NO: 302252 - DNA, 75 bp, Artificial Sequence
  Synthetic
aacgaagacattgtcgtatcaaaaacatcattatggaaagaaatgcagtataatagggacataacaataagattt

SEQ ID NO: 302253 - DNA, 75 bp, Artificial Sequence
  Synthetic
gcgaagaggtaacagctcatacgacatgttctgttaatggcgtgaatgatttcaattttaatggaggatcattgc

SEQ ID NO: 302254 - DNA, 75 bp, Artificial Sequence
  Synthetic
attctaacctttctgatatcaataattttattgaactatatattaaaatcactaactagtgcgatggactttata

SEQ ID NO: 302255 - DNA, 75 bp, Artificial Sequence
  Synthetic
tgtgagatctttagctgctaatttaaattctgtaatgtgcacaggaggcgattatagctttgcattgccagttgg

SEQ ID NO: 302256 - DNA, 75 bp, Artificial Sequence
  Synthetic
gcaggaaaaagaaattgaaaaaggtgcagacgcaatcatggaaaataagactaacaataaaaaacagcaattatc

SEQ ID NO: 302257 - DNA, 75 bp, Artificial Sequence
  Synthetic
tttaggtttagactagctgtggaggagccttcatttgcaattaagaggactagaatcagtaggttgtatggatta

SEQ ID NO: 302258 - DNA, 75 bp, Artificial Sequence
  Synthetic
tagctaattcagtcacagttagacaagatttagaacggcagttaggcgaacttagagaggaattcaacgctttat

SEQ ID NO: 302259 - DNA, 75 bp, Artificial Sequence
  Synthetic
gtcaatgactactaatgtgatgaagaaatttaaaagatcgagtctagctaattcagtttcaacattaacggaatc

SEQ ID NO: 302260 - DNA, 75 bp, Artificial Sequence
  Synthetic
cactgccagatggagattatgatgtacgagaatactttttaaacttatatgatcaaatattaatagaaatgccag

SEQ ID NO: 302261 - DNA, 75 bp, Artificial Sequence
  Synthetic
attcagtttcaacattaacggaatcattatctgatgcagcctcttcgatatcaagaggatcatccattcgatcag

SEQ ID NO: 302262 - DNA, 75 bp, Artificial Sequence
  Synthetic
acggttacgattaaaggaaatggcaacgcaaactgaaggaatgaattttgatgatatatctgcggcagtcttaaa

SEQ ID NO: 302263 - DNA, 75 bp, Artificial Sequence
  Synthetic
atgtatggtattgaatataccacaactctaatcttcttgatattgcttgtattattgaattatatattaaaatca

SEQ ID NO: 302264 - DNA, 75 bp, Artificial Sequence
  Synthetic
attaataatgacgaggtttttgaagctggaacggacggaaagttttttgcatatcgcgtcgagacatttgaagaa

SEQ ID NO: 302265 - DNA, 75 bp, Artificial Sequence
  Synthetic
gaaatgatgtcaattatattctaaatatggacatgaatttaccatcaacggcaagatatattagaccaaatctac

SEQ ID NO: 302266 - DNA, 75 bp, Artificial Sequence
  Synthetic
taattttgaatcgttatgggatacaataacaacatcaaactacatattagctagatcagtcgtacctgatttgaa

SEQ ID NO: 302267 - DNA, 75 bp, Artificial Sequence
  Synthetic
acggcattagtagacaacaagcattcaatttattgcgatctgacccaagggtactgcgcgagttcattaatcaag

SEQ ID NO: 302268 - DNA, 75 bp, Artificial Sequence
  Synthetic
caatttattgcgatctgacccaagggtactgcgcgagttcattaatcaagataatccaataattcgaaatagaat

SEQ ID NO: 302269 - DNA, 75 bp, Artificial Sequence
  Synthetic
ttcgcaatcagcggtacaaattccaatctactactcttccaattcagatttagaaaaaaggtgcatagaatttca

SEQ ID NO: 302270 - DNA, 75 bp, Artificial Sequence
  Synthetic
tcatattcatatgacaaatataatgcagttgaaaggaaactagtacaatatgcaaaagggaaacctttagaggcg

SEQ ID NO: 302271 - DNA, 75 bp, Artificial Sequence
  Synthetic
acgcaaagtgcgtcgataattcaaagaaaggtttatcactaaaaccattgtttgaagagtacaaagatgtgatag

SEQ ID NO: 302272 - DNA, 75 bp, Artificial Sequence
  Synthetic
ttctcacatcattgtcgtcaaatcttaatgccgttatgttctggctggaaaaacattcaaatgattgtgctgaaa

SEQ ID NO: 302273 - DNA, 75 bp, Artificial Sequence
  Synthetic
atatgatgtgatgaaagacaaaccatattatcttgtgacgtgggcaaattcagctattgaaatgctaatgtcagt

SEQ ID NO: 302274 - DNA, 75 bp, Artificial Sequence
  Synthetic
atactgacttcattatcatctaatttaaatgcagttatgttttggttagagcgtcactcaaatgatgttgctgac

SEQ ID NO: 302275 - DNA, 75 bp, Artificial Sequence
  Synthetic
attattataatgtaaatgtaaatttccattcaaattataatgaacgaattaacgacgcggtagctatcattacag

SEQ ID NO: 302276 - DNA, 75 bp, Artificial Sequence
  Synthetic
ttagttgcattagtagatataaatggtacattcattacgaatgaagaattggagttagaattttccaataaatat

SEQ ID NO: 302277 - DNA, 75 bp, Artificial Sequence
  Synthetic
atatctatgggacaatcttgtacaataaaagtgtgtccattgaatacacaaactttaggaataggctgtacaact

SEQ ID NO: 302278 - DNA, 75 bp, Artificial Sequence
  Synthetic
attggctgttagagtgctcgatcgagaagtttccactgatggcaaaaatttattcgtggtcctttcatgtaggat

SEQ ID NO: 302279 - DNA, 75 bp, Artificial Sequence
  Synthetic
tagagatgaggtagtcaagatgctagaggaagcagtgaagcacgatgatcacttactccaagattcagaactagc

SEQ ID NO: 302280 - DNA, 75 bp, Artificial Sequence
  Synthetic
ttattcttggtcgtttcatgttggatttaggaaacagaaaatgatagatgcagcgttagatcaattgaaaacaga

SEQ ID NO: 302281 - DNA, 75 bp, Artificial Sequence
  Synthetic
tcatcagttatatcactcattgcaaagttggatgccacagtttttgctcagatagttaaacttagaaaagtagat

SEQ ID NO: 302282 - DNA, 75 bp, Artificial Sequence
  Synthetic
gatagttaaacttagaaaagtagatactttaaaaccaatattatataaaataaattccgattcaaatgatttcta

SEQ ID NO: 302283 - DNA, 75 bp, Artificial Sequence
  Synthetic
gatgacatggcaaacggaaagtatacgccaggagtgatcccgcctgtcaatgttagcaggccaattccactaggc

SEQ ID NO: 302284 - DNA, 75 bp, Artificial Sequence
  Synthetic
atgtacaatgagtacacaatgttaattagagatgaaatagtcaaaatgttagaagtgccagttaagcatgacgat

SEQ ID NO: 302285 - DNA, 75 bp, Artificial Sequence
  Synthetic
cacctattacgtgattctgagttagctggattactatcaatgtcatcagcctcaaatggtgaatcaagacaatta

SEQ ID NO: 302286 - DNA, 75 bp, Artificial Sequence
  Synthetic
tgaatactttatagcccaacatgcagtagttgaaaaaatgttagtctacgctaaacataccagagagtatgcaga

SEQ ID NO: 302287 - DNA, 75 bp, Artificial Sequence
  Synthetic
tcgtcacagcacaatacgcagccatttagaaaagggattattatgggactagatatgctggctaacatgactaat

SEQ ID NO: 302288 - DNA, 75 bp, Artificial Sequence
  Synthetic
actatcctatggtgatgttacaaggtttttgtcaagtaattctatggtgttatatactgatgtttctcagtggga

SEQ ID NO: 302289 - DNA, 75 bp, Artificial Sequence
  Synthetic
tacaatatggcgctgtcgcatctggggagaagcagactaaagctgcgaattcgatagcaaatttagtgctaatta

SEQ ID NO: 302290 - DNA, 75 bp, Artificial Sequence
  Synthetic
ttcgtcgcaacataacacgcaaccgttcagaaaagggataattatgggtttagatatattagctaatatgacaaa

SEQ ID NO: 302291 - DNA, 75 bp, Artificial Sequence
  Synthetic
tacaaaataaaattagttcacttgtgtcttcagttgaatggtacatgaaatcgatggaattgcctgatgaaatta

SEQ ID NO: 302292 - DNA, 75 bp, Artificial Sequence
  Synthetic
ggtcaccaaacaaatggtacaggacgtatcgaatgacgtgagagagacatacgcacgaatgaatgctaaagtgaa

SEQ ID NO: 302293 - DNA, 75 bp, Artificial Sequence
  Synthetic
ttccattgatgtaataaatccaattaatgctatagatgattttgaatcactgatcagaaacattatactcgatta

SEQ ID NO: 302294 - DNA, 75 bp, Artificial Sequence
  Synthetic
attcaatacggagccgtcgcctcaggtgaaaaacagactaaagcggcaaattctatagctaacttagcacttatt

SEQ ID NO: 302295 - DNA, 75 bp, Artificial Sequence
  Synthetic
gtgaaaaacagactaaagcggcaaattctatagctaacttagcacttattaaaacagtgctttcaagaattgcga

SEQ ID NO: 302296 - DNA, 75 bp, Artificial Sequence
  Synthetic
agaggacaaaacactcaatgggatcaagccgccgtactatattcaaattatatagttaatagattaagaggattt

SEQ ID NO: 302297 - DNA, 75 bp, Artificial Sequence
  Synthetic
ctaactcaacctttaaggttttcgactctgaagacttcataattgaatatggtacgactgatgatgaagtataca

SEQ ID NO: 302298 - DNA, 75 bp, Artificial Sequence
  Synthetic
tcagttactagtatcaaagaatacaatagtttcgagagggatcgctctgacggagaaggcgaagttaaactccta

SEQ ID NO: 302299 - DNA, 75 bp, Artificial Sequence
  Synthetic
attcagaagattttataatagaatatggaacgactgatgatgaagtatatattcagagagcattcatgtcgttat

SEQ ID NO: 302300 - DNA, 75 bp, Artificial Sequence
  Synthetic
gatattctacgtgacattaaaccattttttatagtgagtgaagctagcttgccaattcagtaccagaagtttatg

SEQ ID NO: 302301 - DNA, 75 bp, Artificial Sequence
  Synthetic
agaatacttcacagacgcaatggaggtttgttgatgtatctaaaactacgcagaatggaagttattcacagtatg

SEQ ID NO: 302302 - DNA, 75 bp, Artificial Sequence
  Synthetic
acagaaaaagcaaaactaaactcatacgcgcctgtttatttagagaaacgacgtgctcaaatttcagcactatta

SEQ ID NO: 302303 - DNA, 75 bp, Artificial Sequence
  Synthetic
acgtgctcaaatttcagcactattaactatgctacaaaaaccagtatcatttaaatcgaataaaattactatcaa

SEQ ID NO: 302304 - DNA, 75 bp, Artificial Sequence
  Synthetic
tttcaaagtactcggtatatagaccatcaatagaggagttgtacaaagtgatatcactgcacgaacaagaaattc

SEQ ID NO: 302305 - DNA, 75 bp, Artificial Sequence
  Synthetic
tgtgtacaatctattgtccataaactatggttgctaccagctatttgacttcaattcgccagatttagaaaaatt

SEQ ID NO: 302306 - DNA, 75 bp, Artificial Sequence
  Synthetic
tggatcagcttgttttgcaactatccgaaatcagaaatgattaaactatggaagaaaatgtggaacattacatcc

SEQ ID NO: 302307 - DNA, 75 bp, Artificial Sequence
  Synthetic
ttattcgtattccatttaaaggtaaaataccagcagtaacatttatattgcatctttacgctaaacttgaaataa

SEQ ID NO: 302308 - DNA, 75 bp, Artificial Sequence
  Synthetic
ttcacaatctgcagttcaaattccaatttattactcttccaatagtgaactggaaagtagatgtatagaatttca

SEQ ID NO: 302309 - DNA, 75 bp, Artificial Sequence
  Synthetic
tgagcgattgcaagaagagaaggaggatcccaagctcaaaggtaatgatgctggtaatgttactcaaactgctaa

SEQ ID NO: 302310 - DNA, 75 bp, Artificial Sequence
  Synthetic
tcaaaacagctactagaagtgttaaagactaaggaagagcatcagaaggaagtgcaatatgaaatattgcagaag

SEQ ID NO: 302311 - DNA, 75 bp, Artificial Sequence
  Synthetic
aaccaaaacaattaccaatctacagagccaacggagagaaagagttgcgaaatagatggtactggaaattgaaaa

SEQ ID NO: 302312 - DNA, 75 bp, Artificial Sequence
  Synthetic
aatggcgactagcgtaatgaaaaaatttagaaaatcaaaattagctacatcagtttcagaaatgactaattcatt

SEQ ID NO: 302313 - DNA, 75 bp, Artificial Sequence
  Synthetic
catggccgttgaaaacaaaaatccaagggatgcaggtaaagttgttgactctgaaactgcggcaatctgtgacgc

SEQ ID NO: 302314 - DNA, 75 bp, Artificial Sequence
  Synthetic
attctacacccaatagatcatgcatttaatgaatattttctgcaacatcaattagttgaaccattgaacaatgac

SEQ ID NO: 302315 - DNA, 75 bp, Artificial Sequence
  Synthetic
atctattacaagatagattgaatttgcatgataattttgaatcattgtgggacaccatgacaacatcaaattata

SEQ ID NO: 302316 - DNA, 75 bp, Artificial Sequence
  Synthetic
acaatctgaaactcaattcttgacaggaataaattcacaagcggctaatgactgtttcaaaacattgattgcggc

SEQ ID NO: 302317 - DNA, 75 bp, Artificial Sequence
  Synthetic
ttcattcgtgaatcacttgttgcgtgtcaattagctatcattaataccatcgtttacccagcctttggcatgcaa

SEQ ID NO: 302318 - DNA, 75 bp, Artificial Sequence
  Synthetic
acaaccaattcagacacgttgtcatagatggagtgttgaaccaggtattaaacgataacataaggaatggacatg

SEQ ID NO: 302319 - DNA, 75 bp, Artificial Sequence
  Synthetic
ttgattcaaatacaaatggagtagtatatgagagcacgaataatagtgatttttggactgcagttattgctgttg

SEQ ID NO: 302320 - DNA, 75 bp, Artificial Sequence
  Synthetic
gctatctaataggctaggacagctagtggacttaaccagactattgtcctataattatgagactctcatggcatg

SEQ ID NO: 302321 - DNA, 75 bp, Artificial Sequence
  Synthetic
gaggaagttagctggtattaaatttaaaagaataaactttgataattcatcagaatatatagaaaattggaattt

SEQ ID NO: 302322 - DNA, 75 bp, Artificial Sequence
  Synthetic
ataccagatccacaaacgctgttccactattataatgtcaacgtcaatttccactctaactacaatgaacgaatt

SEQ ID NO: 302323 - DNA, 75 bp, Artificial Sequence
  Synthetic
ttgacgttgctagagtgccggacgatcagatgtatagattgagggacaggttgaggctactgccagttgaaatca

SEQ ID NO: 302324 - DNA, 75 bp, Artificial Sequence
  Synthetic
gcagttggagagagatgaaatgtatggttttgtgaacatcgctcgaaatttagatgggtttcagcagatcaattt

SEQ ID NO: 302325 - DNA, 75 bp, Artificial Sequence
  Synthetic
tcgtccgtgatatcactcatcgctaaacttgatgcaactgtatttgcacaaatagtgaagctgaggaaggtggac

SEQ ID NO: 302326 - DNA, 75 bp, Artificial Sequence
  Synthetic
ctttgtccacacaattcactgacttcgtatcattgaattcactgcgatttaggttcagtttaacagtggatgaac

SEQ ID NO: 302327 - DNA, 75 bp, Artificial Sequence
  Synthetic
agcaagtaccacaaccattcgattttagagcttcaatgtatatgttgacttcgaatctaaccttcactgtgtact

SEQ ID NO: 302328 - DNA, 75 bp, Artificial Sequence
  Synthetic
tcgaatctaaccttcactgtgtactcagatcttcttgcattcgtctcagctgatactgttgaaccgattaatgct

SEQ ID NO: 302329 - DNA, 75 bp, Artificial Sequence
  Synthetic
ttagaaattcaatgcatatgttaacttcgaatcttacttttacggtttattcagatcttctcgcattcgtatcag

SEQ ID NO: 302330 - DNA, 75 bp, Artificial Sequence
  Synthetic
tccaaaacgctgcttttactatgtggaaattgacatatctagatcataaactaatgcctattttagatcaaaact

SEQ ID NO: 302331 - DNA, 75 bp, Artificial Sequence
  Synthetic
ttactaccatatattactactataatttgtaccattcgaaaccaataatatacatgctcggttcagctccatctt

SEQ ID NO: 302332 - DNA, 75 bp, Artificial Sequence
  Synthetic
tactgtagatttatcggatgagattgagataattggatcagaaaaatcagttaacgtaacagtcaatcctggtcc

SEQ ID NO: 302333 - DNA, 75 bp, Artificial Sequence
  Synthetic
acatttaagcctgatatcaactattggattctattagaaccaaagaaccaagacgtaatttttgagacaactaac

SEQ ID NO: 302334 - DNA, 75 bp, Artificial Sequence
  Synthetic
caaatgcttcatccaagtggaaattcgttgatttaattaagaaaacagtagatggcagttttacacaacgtggtc

SEQ ID NO: 302335 - DNA, 75 bp, Artificial Sequence
  Synthetic
tacattgaattacagcgaactgattatagcagtatattgtgatttttatataattccaagagcgcaagagaaaca

SEQ ID NO: 302336 - DNA, 75 bp, Artificial Sequence
  Synthetic
caagcgaatgaagacattatagtatccaagacttcattatggaaagagatgcaatataatagggatattaaaatt

SEQ ID NO: 302337 - DNA, 75 bp, Artificial Sequence
  Synthetic
gtgatggagagttagtaacagcacatacaacttgttcagtcaatggcgtatatgattttagttttaatagtggac

SEQ ID NO: 302338 - DNA, 75 bp, Artificial Sequence
  Synthetic
gtaaataaattaagaatgatgttatcatcaaaaggaattgatcaaaagatgagagtattgaacgcatgttttagt

SEQ ID NO: 302339 - DNA, 75 bp, Artificial Sequence
  Synthetic
ggtgtatgttagatcattagccgccaatttaaattccataacgtgcagtggtggtgactacactttcaagttgcc

SEQ ID NO: 302340 - DNA, 75 bp, Artificial Sequence
  Synthetic
gagagtattgaacgcatgttttagtgttaaaagaatccccggaaaatcatcgtctatagtgaaatgtactaggtt

SEQ ID NO: 302341 - DNA, 75 bp, Artificial Sequence
  Synthetic
ttacgatttagatttagtttagaagtactagacccacctttttcaattctaagaactagggtgtccagactatat

SEQ ID NO: 302342 - DNA, 75 bp, Artificial Sequence
  Synthetic
tattgattggaaatcaagatacgaacaactggaaaaaagatttgaatcattgaaacatcgggttaacgagaaata

SEQ ID NO: 302343 - DNA, 75 bp, Artificial Sequence
  Synthetic
agctcatataaatgaattacaaatgtacaataataaattggagcgtgatctgcaatcaaagattggatcagtcgt

SEQ ID NO: 302344 - DNA, 75 bp, Artificial Sequence
  Synthetic
cacccattatgaattcggttacagtgaggcaagatttagaacagcaattaaacagcttaagggatgagtttaata

SEQ ID NO: 302345 - DNA, 75 bp, Artificial Sequence
  Synthetic
tgcaaaatcaatggctactagtgtgatgaagaaatttaaaaaatctagtctagcttcagcagtatcatcactaac

SEQ ID NO: 302346 - DNA, 75 bp, Artificial Sequence
  Synthetic
agaccagttgacattatagatatgacgaaggaatttaatcagaagaatataaaaacgctagatgagtgggagagc

SEQ ID NO: 302347 - DNA, 75 bp, Artificial Sequence
  Synthetic
tgcttcgtaatctgatttctgattatgataaactatttataatgtttaaaggattattgcagcaatgtaattata

SEQ ID NO: 302348 - DNA, 75 bp, Artificial Sequence
  Synthetic
cttattcctatgaatgaacgaattattgaataccatctacacatgaccctctatgagcacaatagttaaaagcta

SEQ ID NO: 302349 - DNA, 75 bp, Artificial Sequence
  Synthetic
cgaaaacgtggagcgcgtcgtgagacgaatctaaaacaagatgaacgaatgcaagaaaaagaagatagcaagaac

SEQ ID NO: 302350 - DNA, 75 bp, Artificial Sequence
  Synthetic
gtagatgtatcaaattctgttgcaagtcaaacgtcaacaatcagtcggagattaagactgaaagaaatagctact

SEQ ID NO: 302351 - DNA, 75 bp, Artificial Sequence
  Synthetic
attaataatgacagtcctaaatcacaattatcagaaaaagtattatctaagaaagaagagataattacagataat

SEQ ID NO: 302352 - DNA, 75 bp, Artificial Sequence
  Synthetic
taactgaggcatcagagaaattcattcccaacagatcatatagagtaattaaaaatgatgaagtactagaagcgg

SEQ ID NO: 302353 - DNA, 75 bp, Artificial Sequence
  Synthetic
ccgagagtaattaactcagctgatggtactaccacatggtacttcaatccagttattctaagaccaagtaatgta

SEQ ID NO: 302354 - DNA, 75 bp, Artificial Sequence
  Synthetic
aagttcagtatgaaatattacaaaaaactatccctacatttgaaccaaaagagtcaatactcaaaaaattagaag

SEQ ID NO: 302355 - DNA, 75 bp, Artificial Sequence
  Synthetic
ggctataaaatggcttctttgatctacagacagttgctatccaattcatacgtaacaaacatctctgatgaagtt

SEQ ID NO: 302356 - DNA, 75 bp, Artificial Sequence
  Synthetic
ttctgcaataatagattttaagactcttaagaatttgaatgacaattatggtatcacacgtgaacaagcttttaa

SEQ ID NO: 302357 - DNA, 75 bp, Artificial Sequence
  Synthetic
cgaacgttacggttaatccagggcctttcgcgcagactgggtatgctccagttaactggggacacggtgaattgt

SEQ ID NO: 302358 - DNA, 75 bp, Artificial Sequence
  Synthetic
taatagatggtattggaaattgaaacgagatactcttcctgatggagattatgatgttagagagtattttttaaa

SEQ ID NO: 302359 - DNA, 75 bp, Artificial Sequence
  Synthetic
tttactgaaatcagatccacgcgtattaagagaattcattaaccaaaataatccaattattaaaaataggataga

SEQ ID NO: 302360 - DNA, 75 bp, Artificial Sequence
  Synthetic
atatggctgtagagaataaaaattcaagggatgctggcaaagtagttgattctgaaacagccgcaatatgcgatg

SEQ ID NO: 302361 - DNA, 75 bp, Artificial Sequence
  Synthetic
aggtgcagtaagaagattcatagctgagatgagacaacgagttcaagctgatcgaaatgtagtcaattatccatc

SEQ ID NO: 302362 - DNA, 75 bp, Artificial Sequence
  Synthetic
tatattgcatccaattgaccatgcgtttaacggatacttcttacaacatcagttggtagaaccattaaataatga

SEQ ID NO: 302363 - DNA, 75 bp, Artificial Sequence
  Synthetic
tctaacaataaataatgacaatagtaatgtatcatgcgacgctgagttttatttgataccaagatcacaaactga

SEQ ID NO: 302364 - DNA, 75 bp, Artificial Sequence
  Synthetic
aacttgctacaagataggttaaatttacatgataattttgagtcactctgggatactataactacatctaattat

SEQ ID NO: 302365 - DNA, 75 bp, Artificial Sequence
  Synthetic
atttgataccaagatcacaaactgaattgtgtgagcagtacataaataatgggctgcctccaatgcagaatacta

SEQ ID NO: 302366 - DNA, 75 bp, Artificial Sequence
  Synthetic
gaaatgtagtaccagtgagcgtgacatcgagagaaataagacacacacgcgcacaaatgaatgaagacatagtgg

SEQ ID NO: 302367 - DNA, 75 bp, Artificial Sequence
  Synthetic
ctgccaccaattcaaaatactagaaatgtagtaccattatcattatcatctagatctatacagtataagagagca

SEQ ID NO: 302368 - DNA, 75 bp, Artificial Sequence
  Synthetic
tacaatcagagactcagtttttaacaggtataaactcacaagccgctaatgattgttttaaaactttgattgctg

SEQ ID NO: 302369 - DNA, 75 bp, Artificial Sequence
  Synthetic
gattgttttaaaactttgattgctgctatgttgagtcagagaaccatgtcattagatttcgtaacgacaaattac

SEQ ID NO: 302370 - DNA, 75 bp, Artificial Sequence
  Synthetic
caaatggtctgaaatatcatttaagcccatgaactatcagtatacgtatacgcgtgacggagaggaaataactgc

SEQ ID NO: 302371 - DNA, 75 bp, Artificial Sequence
  Synthetic
aagaatgcattataggaatggtgatccacagactccctttcaaattgcagagcaacagattcaaaattttcaggt

SEQ ID NO: 302372 - DNA, 75 bp, Artificial Sequence
  Synthetic
gtagtcaaccaattaatggaagctctgatgcaattatctagacaacagtttcccacaatgccagttgattataaa

SEQ ID NO: 302373 - DNA, 75 bp, Artificial Sequence
  Synthetic
aatgattttaataacagagaagatgtaataaaattaattaacaatcagaagaacgcgttaataactgtgagaatt

SEQ ID NO: 302374 - DNA, 75 bp, Artificial Sequence
  Synthetic
cagctggagtcacattgtcaacgcaatttacagactatgtttcacttaattcactgagatttagatttaggttag

SEQ ID NO: 302375 - DNA, 75 bp, Artificial Sequence
  Synthetic
gcataacaatgaatatgcagcatgttcaaacattaacaactgaaaaattgcaattaacatcagtaacatcattat

SEQ ID NO: 302376 - DNA, 75 bp, Artificial Sequence
  Synthetic
ctagtaccaactaatgacgattatcagacgccaatagctaattcagtgacggtgagacaagatttagagagacaa

SEQ ID NO: 302377 - DNA, 75 bp, Artificial Sequence
  Synthetic
taatgacgcagttgcaattataactgcggcaaatagattaaatttatatcaaaagaaaatgaaatcaatagttga

SEQ ID NO: 302378 - DNA, 75 bp, Artificial Sequence
  Synthetic
agaagattagatatttttaatttgatagcaatgaatatggaacagattgaacgtgcatcagataaaattgcacaa

SEQ ID NO: 302379 - DNA, 75 bp, Artificial Sequence
  Synthetic
aatgcgaattagtactgccatacaaactggagaagatttaaggacaatgactaacgcgtcaacacagatatcaaa

SEQ ID NO: 302380 - DNA, 75 bp, Artificial Sequence
  Synthetic
ttcttattaagaaaaattaaggaaagaatgactacatctcttccaattgctagactatcaaatcgtgtgtttaga

SEQ ID NO: 302381 - DNA, 75 bp, Artificial Sequence
  Synthetic
ttgaagaattgatgagatcaggagattatgctcaaattactaacatgctacttaataatcaaccagtagctttag

SEQ ID NO: 302382 - DNA, 75 bp, Artificial Sequence
  Synthetic
cacgttaaaacccatcctatataagataaattcagattctaatgacttttatttggtggctaattatgattggat

SEQ ID NO: 302383 - DNA, 75 bp, Artificial Sequence
  Synthetic
caggagagatggttaggtaagagagtgtcgcagtttgacattggacaatataaaaatatgctaaatgttgttacc

SEQ ID NO: 302384 - DNA, 75 bp, Artificial Sequence
  Synthetic
aaaaatttaataaactaattacagattcaccagtattgtcagctataatcgactttaaaacactaaaaaatctaa

SEQ ID NO: 302385 - DNA, 75 bp, Artificial Sequence
  Synthetic
tcctacatctactacaaaagtgtataaacaagttccacaacaatttgattttagagcgtcaatgcatatgttaac

SEQ ID NO: 302386 - DNA, 75 bp, Artificial Sequence
  Synthetic
aatgatggaaacaattctagagggatgaactttgacacagatatgtatgataaagtggcagacttacttgtacaa

SEQ ID NO: 302387 - DNA, 75 bp, Artificial Sequence
  Synthetic
tgtcgcagtttgacattggacaatataaaaatatgctaaatgttgttaccaccatttactattactataacttgc

SEQ ID NO: 302388 - DNA, 75 bp, Artificial Sequence
  Synthetic
aatccgaggactttgaaagagtttataaataataataatccaataattaggaatagaacagagaatttgatagcg

SEQ ID NO: 302389 - DNA, 75 bp, Artificial Sequence
  Synthetic
ataaggatgacataatttcagtagattcaaatttgattactaaatccgtactaatagcaatgggcttaattaaag

SEQ ID NO: 302390 - DNA, 75 bp, Artificial Sequence
  Synthetic
ttaatgctgttgcttttgataatatgcgcatcatgaacgaactgtaaacgccaaccccactgtggagatatgacc

SEQ ID NO: 302391 - DNA, 75 bp, Artificial Sequence
  Synthetic
ggatgtcctatactctttgtcaaagactcttaaagacgctagagacaaaattgtcgaaggcacattgtattctaa

SEQ ID NO: 302392 - DNA, 75 bp, Artificial Sequence
  Synthetic
actgatagaggaaatatggattggaaagagtggagaaaagtagtagaacaacagacacttagtaatcttgatatt

SEQ ID NO: 302393 - DNA, 75 bp, Artificial Sequence
  Synthetic
aattactgatccaaattttgtggagtataaaattacgttaaatcacactgatcccattgatgataagatagttaa

SEQ ID NO: 302394 - DNA, 75 bp, Artificial Sequence
  Synthetic
caactttgctgaacttagacgctaattatgttgaaacggcaagaaatacaattgattatttcgtggattttgtag

SEQ ID NO: 302395 - DNA, 75 bp, Artificial Sequence
  Synthetic
caatataacaaatttgcagtgattacgcatggcaagggacattacagagttgttagatattcaactgttgctaat

SEQ ID NO: 302396 - DNA, 75 bp, Artificial Sequence
  Synthetic
aacagattactactaaagaatggattgaaaaacagttggacaaagtaataaaagaaatgagacgtcagctagaaa

SEQ ID NO: 302397 - DNA, 75 bp, Artificial Sequence
  Synthetic
ttatgcgatactagatgtgtgggacattagtactattaaaagatttgtaccaaaaggtgtattttatgcattcat

SEQ ID NO: 302398 - DNA, 75 bp, Artificial Sequence
  Synthetic
tgatagataaattgacaactcgagaaattgaacaggtagagctactaaaacgtatatacgacaaactaatgatac

SEQ ID NO: 302399 - DNA, 75 bp, Artificial Sequence
  Synthetic
tttaatccaagacaagatgttattgatttaattaataaacagaaacagtcactaattactgttcgcataaataat

SEQ ID NO: 302400 - DNA, 75 bp, Artificial Sequence
  Synthetic
cttaccgacctcaactacacattgagtgtaatcactctaatgaacagtacattgcatacaatactagaagatcca

SEQ ID NO: 302401 - DNA, 75 bp, Artificial Sequence
  Synthetic
ataacatatgctgacgatccaaattactttataggaattaaatttaataatataccttatgaataagatgttaaa

SEQ ID NO: 302402 - DNA, 75 bp, Artificial Sequence
  Synthetic
ataacatatgctgacgatccaaattactttataggaattaaatttaataatataccttatgaatatgatgttaaa

SEQ ID NO: 302403 - DNA, 75 bp, Artificial Sequence
  Synthetic
ataacatatgctgacgatccaaattactttataggaattaaatttaataatataccttatgaatacgatgttaaa

SEQ ID NO: 302404 - DNA, 75 bp, Artificial Sequence
  Synthetic
ataacatatgctgacgatccaaattactttataggaattaaatttaataatataccttatgaataggatgttaaa

SEQ ID NO: 302405 - DNA, 75 bp, Artificial Sequence
  Synthetic
ataacatatgctgacgatccaaattactttataggaattaaattttataatataccttatgaataagatgttaaa

SEQ ID NO: 302406 - DNA, 75 bp, Artificial Sequence
  Synthetic
ataacatatgctgacgatccaaattactttataggaattaaattttataatataccttatgaatatgatgttaaa

SEQ ID NO: 302407 - DNA, 75 bp, Artificial Sequence
  Synthetic
ataacatatgctgacgatccaaattactttataggaattaaattttataatataccttatgaatacgatgttaaa

SEQ ID NO: 302408 - DNA, 75 bp, Artificial Sequence
  Synthetic
ataacatatgctgacgatccaaattactttataggaattaaattttataatataccttatgaataggatgttaaa

SEQ ID NO: 302409 - DNA, 75 bp, Artificial Sequence
  Synthetic
ataacatatgctgacgatccaaattactttataggaattaaatttcataatataccttatgaataagatgttaaa

SEQ ID NO: 302410 - DNA, 75 bp, Artificial Sequence
  Synthetic
ataacatatgctgacgatccaaattactttataggaattaaatttcataatataccttatgaatatgatgttaaa

SEQ ID NO: 302411 - DNA, 75 bp, Artificial Sequence
  Synthetic
ataacatatgctgacgatccaaattactttataggaattaaatttcataatataccttatgaatacgatgttaaa

SEQ ID NO: 302412 - DNA, 75 bp, Artificial Sequence
  Synthetic
ataacatatgctgacgatccaaattactttataggaattaaatttcataatataccttatgaataggatgttaaa

SEQ ID NO: 302413 - DNA, 75 bp, Artificial Sequence
  Synthetic
ataacatatgctgacgatccaaattactttataggaattaaatttgataatataccttatgaataagatgttaaa

SEQ ID NO: 302414 - DNA, 75 bp, Artificial Sequence
  Synthetic
ataacatatgctgacgatccaaattactttataggaattaaatttgataatataccttatgaatatgatgttaaa

SEQ ID NO: 302415 - DNA, 75 bp, Artificial Sequence
  Synthetic
ataacatatgctgacgatccaaattactttataggaattaaatttgataatataccttatgaatacgatgttaaa

SEQ ID NO: 302416 - DNA, 75 bp, Artificial Sequence
  Synthetic
ataacatatgctgacgatccaaattactttataggaattaaatttgataatataccttatgaataggatgttaaa

SEQ ID NO: 302417 - DNA, 75 bp, Artificial Sequence
  Synthetic
ataacttatgctgacgatccaaattactttataggaattaaatttaataatataccttatgaataagatgttaaa

SEQ ID NO: 302418 - DNA, 75 bp, Artificial Sequence
  Synthetic
ataacttatgctgacgatccaaattactttataggaattaaatttaataatataccttatgaatatgatgttaaa

SEQ ID NO: 302419 - DNA, 75 bp, Artificial Sequence
  Synthetic
ataacttatgctgacgatccaaattactttataggaattaaatttaataatataccttatgaatacgatgttaaa

SEQ ID NO: 302420 - DNA, 75 bp, Artificial Sequence
  Synthetic
ataacttatgctgacgatccaaattactttataggaattaaatttaataatataccttatgaataggatgttaaa

SEQ ID NO: 302421 - DNA, 75 bp, Artificial Sequence
  Synthetic
ataacttatgctgacgatccaaattactttataggaattaaattttataatataccttatgaataagatgttaaa

SEQ ID NO: 302422 - DNA, 75 bp, Artificial Sequence
  Synthetic
ataacttatgctgacgatccaaattactttataggaattaaattttataatataccttatgaatatgatgttaaa

SEQ ID NO: 302423 - DNA, 75 bp, Artificial Sequence
  Synthetic
ataacttatgctgacgatccaaattactttataggaattaaattttataatataccttatgaatacgatgttaaa

SEQ ID NO: 302424 - DNA, 75 bp, Artificial Sequence
  Synthetic
ataacttatgctgacgatccaaattactttataggaattaaattttataatataccttatgaataggatgttaaa

SEQ ID NO: 302425 - DNA, 75 bp, Artificial Sequence
  Synthetic
ataacttatgctgacgatccaaattactttataggaattaaatttcataatataccttatgaataagatgttaaa

SEQ ID NO: 302426 - DNA, 75 bp, Artificial Sequence
  Synthetic
ataacttatgctgacgatccaaattactttataggaattaaatttcataatataccttatgaatatgatgttaaa

SEQ ID NO: 302427 - DNA, 75 bp, Artificial Sequence
  Synthetic
ataacttatgctgacgatccaaattactttataggaattaaatttcataatataccttatgaatacgatgttaaa

SEQ ID NO: 302428 - DNA, 75 bp, Artificial Sequence
  Synthetic
ataacttatgctgacgatccaaattactttataggaattaaatttcataatataccttatgaataggatgttaaa

SEQ ID NO: 302429 - DNA, 75 bp, Artificial Sequence
  Synthetic
ataacttatgctgacgatccaaattactttataggaattaaatttgataatataccttatgaataagatgttaaa

SEQ ID NO: 302430 - DNA, 75 bp, Artificial Sequence
  Synthetic
ataacttatgctgacgatccaaattactttataggaattaaatttgataatataccttatgaatatgatgttaaa

SEQ ID NO: 302431 - DNA, 75 bp, Artificial Sequence
  Synthetic
ataacttatgctgacgatccaaattactttataggaattaaatttgataatataccttatgaatacgatgttaaa

SEQ ID NO: 302432 - DNA, 75 bp, Artificial Sequence
  Synthetic
ataacttatgctgacgatccaaattactttataggaattaaatttgataatataccttatgaataggatgttaaa

SEQ ID NO: 302433 - DNA, 75 bp, Artificial Sequence
  Synthetic
ataacctatgctgacgatccaaattactttataggaattaaatttaataatataccttatgaataagatgttaaa

SEQ ID NO: 302434 - DNA, 75 bp, Artificial Sequence
  Synthetic
ataacctatgctgacgatccaaattactttataggaattaaatttaataatataccttatgaatatgatgttaaa

SEQ ID NO: 302435 - DNA, 75 bp, Artificial Sequence
  Synthetic
ataacctatgctgacgatccaaattactttataggaattaaatttaataatataccttatgaatacgatgttaaa

SEQ ID NO: 302436 - DNA, 75 bp, Artificial Sequence
  Synthetic
ataacctatgctgacgatccaaattactttataggaattaaatttaataatataccttatgaataggatgttaaa

SEQ ID NO: 302437 - DNA, 75 bp, Artificial Sequence
  Synthetic
ataacctatgctgacgatccaaattactttataggaattaaattttataatataccttatgaataagatgttaaa

SEQ ID NO: 302438 - DNA, 75 bp, Artificial Sequence
  Synthetic
ataacctatgctgacgatccaaattactttataggaattaaattttataatataccttatgaatatgatgttaaa

SEQ ID NO: 302439 - DNA, 75 bp, Artificial Sequence
  Synthetic
ataacctatgctgacgatccaaattactttataggaattaaattttataatataccttatgaatacgatgttaaa

SEQ ID NO: 302440 - DNA, 75 bp, Artificial Sequence
  Synthetic
ataacctatgctgacgatccaaattactttataggaattaaattttataatataccttatgaataggatgttaaa

SEQ ID NO: 302441 - DNA, 75 bp, Artificial Sequence
  Synthetic
ataacctatgctgacgatccaaattactttataggaattaaatttcataatataccttatgaataagatgttaaa

SEQ ID NO: 302442 - DNA, 75 bp, Artificial Sequence
  Synthetic
ataacctatgctgacgatccaaattactttataggaattaaatttcataatataccttatgaatatgatgttaaa

SEQ ID NO: 302443 - DNA, 75 bp, Artificial Sequence
  Synthetic
ataacctatgctgacgatccaaattactttataggaattaaatttcataatataccttatgaatacgatgttaaa

SEQ ID NO: 302444 - DNA, 75 bp, Artificial Sequence
  Synthetic
ataacctatgctgacgatccaaattactttataggaattaaatttcataatataccttatgaataggatgttaaa

SEQ ID NO: 302445 - DNA, 75 bp, Artificial Sequence
  Synthetic
ataacctatgctgacgatccaaattactttataggaattaaatttgataatataccttatgaataagatgttaaa

SEQ ID NO: 302446 - DNA, 75 bp, Artificial Sequence
  Synthetic
ataacctatgctgacgatccaaattactttataggaattaaatttgataatataccttatgaatatgatgttaaa

SEQ ID NO: 302447 - DNA, 75 bp, Artificial Sequence
  Synthetic
ataacctatgctgacgatccaaattactttataggaattaaatttgataatataccttatgaatacgatgttaaa

SEQ ID NO: 302448 - DNA, 75 bp, Artificial Sequence
  Synthetic
ataacctatgctgacgatccaaattactttataggaattaaatttgataatataccttatgaataggatgttaaa

SEQ ID NO: 302449 - DNA, 75 bp, Artificial Sequence
  Synthetic
ataacgtatgctgacgatccaaattactttataggaattaaatttaataatataccttatgaataagatgttaaa

SEQ ID NO: 302450 - DNA, 75 bp, Artificial Sequence
  Synthetic
ataacgtatgctgacgatccaaattactttataggaattaaatttaataatataccttatgaatatgatgttaaa

SEQ ID NO: 302451 - DNA, 75 bp, Artificial Sequence
  Synthetic
ataacgtatgctgacgatccaaattactttataggaattaaatttaataatataccttatgaatacgatgttaaa

SEQ ID NO: 302452 - DNA, 75 bp, Artificial Sequence
  Synthetic
ataacgtatgctgacgatccaaattactttataggaattaaatttaataatataccttatgaataggatgttaaa

SEQ ID NO: 302453 - DNA, 75 bp, Artificial Sequence
  Synthetic
ataacgtatgctgacgatccaaattactttataggaattaaattttataatataccttatgaataagatgttaaa

SEQ ID NO: 302454 - DNA, 75 bp, Artificial Sequence
  Synthetic
ataacgtatgctgacgatccaaattactttataggaattaaattttataatataccttatgaatatgatgttaaa

SEQ ID NO: 302455 - DNA, 75 bp, Artificial Sequence
  Synthetic
ataacgtatgctgacgatccaaattactttataggaattaaattttataatataccttatgaatacgatgttaaa

SEQ ID NO: 302456 - DNA, 75 bp, Artificial Sequence
  Synthetic
ataacgtatgctgacgatccaaattactttataggaattaaattttataatataccttatgaataggatgttaaa

SEQ ID NO: 302457 - DNA, 75 bp, Artificial Sequence
  Synthetic
ataacgtatgctgacgatccaaattactttataggaattaaatttcataatataccttatgaataagatgttaaa

SEQ ID NO: 302458 - DNA, 75 bp, Artificial Sequence
  Synthetic
ataacgtatgctgacgatccaaattactttataggaattaaatttcataatataccttatgaatatgatgttaaa

SEQ ID NO: 302459 - DNA, 75 bp, Artificial Sequence
  Synthetic
ataacgtatgctgacgatccaaattactttataggaattaaatttcataatataccttatgaatacgatgttaaa

SEQ ID NO: 302460 - DNA, 75 bp, Artificial Sequence
  Synthetic
ataacgtatgctgacgatccaaattactttataggaattaaatttcataatataccttatgaataggatgttaaa

SEQ ID NO: 302461 - DNA, 75 bp, Artificial Sequence
  Synthetic
ataacgtatgctgacgatccaaattactttataggaattaaatttgataatataccttatgaataagatgttaaa

SEQ ID NO: 302462 - DNA, 75 bp, Artificial Sequence
  Synthetic
ataacgtatgctgacgatccaaattactttataggaattaaatttgataatataccttatgaatatgatgttaaa

SEQ ID NO: 302463 - DNA, 75 bp, Artificial Sequence
  Synthetic
ataacgtatgctgacgatccaaattactttataggaattaaatttgataatataccttatgaatacgatgttaaa

SEQ ID NO: 302464 - DNA, 75 bp, Artificial Sequence
  Synthetic
ataacgtatgctgacgatccaaattactttataggaattaaatttgataatataccttatgaataggatgttaaa

SEQ ID NO: 302465 - DNA, 75 bp, Artificial Sequence
  Synthetic
tattcagcatcatttacactaaatagatcacaacccgctcatgataatttgatgggcacaatgtggttaaacgca

SEQ ID NO: 302466 - DNA, 75 bp, Artificial Sequence
  Synthetic
ggaatagcatattttccttatatcgcatctgtcctgacagtcttgttcacattacacaaagcgtcgatcccgacg

SEQ ID NO: 302467 - DNA, 75 bp, Artificial Sequence
  Synthetic
atgaagacagaactatttaataaggaaattagtactagttaaacttatatgctatctgataatatatatgtagca

SEQ ID NO: 302468 - DNA, 75 bp, Artificial Sequence
  Synthetic
atgaagacagaactatttaataaggaaattagtactagttaaacttatatgctatctgataatatttatgtagca

SEQ ID NO: 302469 - DNA, 75 bp, Artificial Sequence
  Synthetic
atgaagacagaactatttaataaggaaattagtactagttaaacttatatgctatctgataatatctatgtagca

SEQ ID NO: 302470 - DNA, 75 bp, Artificial Sequence
  Synthetic
atgaagacagaactatttaataaggaaattagtactagttaaacttatatgctatctgataatatgtatgtagca

SEQ ID NO: 302471 - DNA, 75 bp, Artificial Sequence
  Synthetic
atgaagacagaactatttaatatggaaattagtactagttaaacttatatgctatctgataatatatatgtagca

SEQ ID NO: 302472 - DNA, 75 bp, Artificial Sequence
  Synthetic
atgaagacagaactatttaatatggaaattagtactagttaaacttatatgctatctgataatatttatgtagca

SEQ ID NO: 302473 - DNA, 75 bp, Artificial Sequence
  Synthetic
atgaagacagaactatttaatatggaaattagtactagttaaacttatatgctatctgataatatctatgtagca

SEQ ID NO: 302474 - DNA, 75 bp, Artificial Sequence
  Synthetic
atgaagacagaactatttaatatggaaattagtactagttaaacttatatgctatctgataatatgtatgtagca

SEQ ID NO: 302475 - DNA, 75 bp, Artificial Sequence
  Synthetic
atgaagacagaactatttaatacggaaattagtactagttaaacttatatgctatctgataatatatatgtagca

SEQ ID NO: 302476 - DNA, 75 bp, Artificial Sequence
  Synthetic
atgaagacagaactatttaatacggaaattagtactagttaaacttatatgctatctgataatatttatgtagca

SEQ ID NO: 302477 - DNA, 75 bp, Artificial Sequence
  Synthetic
atgaagacagaactatttaatacggaaattagtactagttaaacttatatgctatctgataatatctatgtagca

SEQ ID NO: 302478 - DNA, 75 bp, Artificial Sequence
  Synthetic
atgaagacagaactatttaatacggaaattagtactagttaaacttatatgctatctgataatatgtatgtagca

SEQ ID NO: 302479 - DNA, 75 bp, Artificial Sequence
  Synthetic
atgaagacagaactatttaatagggaaattagtactagttaaacttatatgctatctgataatatatatgtagca

SEQ ID NO: 302480 - DNA, 75 bp, Artificial Sequence
  Synthetic
atgaagacagaactatttaatagggaaattagtactagttaaacttatatgctatctgataatatttatgtagca

SEQ ID NO: 302481 - DNA, 75 bp, Artificial Sequence
  Synthetic
atgaagacagaactatttaatagggaaattagtactagttaaacttatatgctatctgataatatctatgtagca

SEQ ID NO: 302482 - DNA, 75 bp, Artificial Sequence
  Synthetic
atgaagacagaactatttaatagggaaattagtactagttaaacttatatgctatctgataatatgtatgtagca

SEQ ID NO: 302483 - DNA, 75 bp, Artificial Sequence
  Synthetic
atgaagacagatctatttaataaggaaattagtactagttaaacttatatgctatctgataatatatatgtagca

SEQ ID NO: 302484 - DNA, 75 bp, Artificial Sequence
  Synthetic
atgaagacagatctatttaataaggaaattagtactagttaaacttatatgctatctgataatatttatgtagca

SEQ ID NO: 302485 - DNA, 75 bp, Artificial Sequence
  Synthetic
atgaagacagatctatttaataaggaaattagtactagttaaacttatatgctatctgataatatctatgtagca

SEQ ID NO: 302486 - DNA, 75 bp, Artificial Sequence
  Synthetic
atgaagacagatctatttaataaggaaattagtactagttaaacttatatgctatctgataatatgtatgtagca

SEQ ID NO: 302487 - DNA, 75 bp, Artificial Sequence
  Synthetic
atgaagacagatctatttaatatggaaattagtactagttaaacttatatgctatctgataatatatatgtagca

SEQ ID NO: 302488 - DNA, 75 bp, Artificial Sequence
  Synthetic
atgaagacagatctatttaatatggaaattagtactagttaaacttatatgctatctgataatatttatgtagca

SEQ ID NO: 302489 - DNA, 75 bp, Artificial Sequence
  Synthetic
atgaagacagatctatttaatatggaaattagtactagttaaacttatatgctatctgataatatctatgtagca

SEQ ID NO: 302490 - DNA, 75 bp, Artificial Sequence
  Synthetic
atgaagacagatctatttaatatggaaattagtactagttaaacttatatgctatctgataatatgtatgtagca

SEQ ID NO: 302491 - DNA, 75 bp, Artificial Sequence
  Synthetic
atgaagacagatctatttaatacggaaattagtactagttaaacttatatgctatctgataatatatatgtagca

SEQ ID NO: 302492 - DNA, 75 bp, Artificial Sequence
  Synthetic
atgaagacagatctatttaatacggaaattagtactagttaaacttatatgctatctgataatatttatgtagca

SEQ ID NO: 302493 - DNA, 75 bp, Artificial Sequence
  Synthetic
atgaagacagatctatttaatacggaaattagtactagttaaacttatatgctatctgataatatctatgtagca

SEQ ID NO: 302494 - DNA, 75 bp, Artificial Sequence
  Synthetic
atgaagacagatctatttaatacggaaattagtactagttaaacttatatgctatctgataatatgtatgtagca

SEQ ID NO: 302495 - DNA, 75 bp, Artificial Sequence
  Synthetic
atgaagacagatctatttaatagggaaattagtactagttaaacttatatgctatctgataatatatatgtagca

SEQ ID NO: 302496 - DNA, 75 bp, Artificial Sequence
  Synthetic
atgaagacagatctatttaatagggaaattagtactagttaaacttatatgctatctgataatatttatgtagca

SEQ ID NO: 302497 - DNA, 75 bp, Artificial Sequence
  Synthetic
atgaagacagatctatttaatagggaaattagtactagttaaacttatatgctatctgataatatctatgtagca

SEQ ID NO: 302498 - DNA, 75 bp, Artificial Sequence
  Synthetic
atgaagacagatctatttaatagggaaattagtactagttaaacttatatgctatctgataatatgtatgtagca

SEQ ID NO: 302499 - DNA, 75 bp, Artificial Sequence
  Synthetic
atgaagacagacctatttaataaggaaattagtactagttaaacttatatgctatctgataatatatatgtagca

SEQ ID NO: 302500 - DNA, 75 bp, Artificial Sequence
  Synthetic
atgaagacagacctatttaataaggaaattagtactagttaaacttatatgctatctgataatatttatgtagca

SEQ ID NO: 302501 - DNA, 75 bp, Artificial Sequence
  Synthetic
atgaagacagacctatttaataaggaaattagtactagttaaacttatatgctatctgataatatctatgtagca

SEQ ID NO: 302502 - DNA, 75 bp, Artificial Sequence
  Synthetic
atgaagacagacctatttaataaggaaattagtactagttaaacttatatgctatctgataatatgtatgtagca

SEQ ID NO: 302503 - DNA, 75 bp, Artificial Sequence
  Synthetic
atgaagacagacctatttaatatggaaattagtactagttaaacttatatgctatctgataatatatatgtagca

SEQ ID NO: 302504 - DNA, 75 bp, Artificial Sequence
  Synthetic
atgaagacagacctatttaatatggaaattagtactagttaaacttatatgctatctgataatatttatgtagca

SEQ ID NO: 302505 - DNA, 75 bp, Artificial Sequence
  Synthetic
atgaagacagacctatttaatatggaaattagtactagttaaacttatatgctatctgataatatctatgtagca

SEQ ID NO: 302506 - DNA, 75 bp, Artificial Sequence
  Synthetic
atgaagacagacctatttaatatggaaattagtactagttaaacttatatgctatctgataatatgtatgtagca

SEQ ID NO: 302507 - DNA, 75 bp, Artificial Sequence
  Synthetic
atgaagacagacctatttaatacggaaattagtactagttaaacttatatgctatctgataatatatatgtagca

SEQ ID NO: 302508 - DNA, 75 bp, Artificial Sequence
  Synthetic
atgaagacagacctatttaatacggaaattagtactagttaaacttatatgctatctgataatatttatgtagca

SEQ ID NO: 302509 - DNA, 75 bp, Artificial Sequence
  Synthetic
atgaagacagacctatttaatacggaaattagtactagttaaacttatatgctatctgataatatctatgtagca

SEQ ID NO: 302510 - DNA, 75 bp, Artificial Sequence
  Synthetic
atgaagacagacctatttaatacggaaattagtactagttaaacttatatgctatctgataatatgtatgtagca

SEQ ID NO: 302511 - DNA, 75 bp, Artificial Sequence
  Synthetic
atgaagacagacctatttaatagggaaattagtactagttaaacttatatgctatctgataatatatatgtagca

SEQ ID NO: 302512 - DNA, 75 bp, Artificial Sequence
  Synthetic
atgaagacagacctatttaatagggaaattagtactagttaaacttatatgctatctgataatatttatgtagca

SEQ ID NO: 302513 - DNA, 75 bp, Artificial Sequence
  Synthetic
atgaagacagacctatttaatagggaaattagtactagttaaacttatatgctatctgataatatctatgtagca

SEQ ID NO: 302514 - DNA, 75 bp, Artificial Sequence
  Synthetic
atgaagacagacctatttaatagggaaattagtactagttaaacttatatgctatctgataatatgtatgtagca

SEQ ID NO: 302515 - DNA, 75 bp, Artificial Sequence
  Synthetic
atgaagacagagctatttaataaggaaattagtactagttaaacttatatgctatctgataatatatatgtagca

SEQ ID NO: 302516 - DNA, 75 bp, Artificial Sequence
  Synthetic
atgaagacagagctatttaataaggaaattagtactagttaaacttatatgctatctgataatatttatgtagca

SEQ ID NO: 302517 - DNA, 75 bp, Artificial Sequence
  Synthetic
atgaagacagagctatttaataaggaaattagtactagttaaacttatatgctatctgataatatctatgtagca

SEQ ID NO: 302518 - DNA, 75 bp, Artificial Sequence
  Synthetic
atgaagacagagctatttaataaggaaattagtactagttaaacttatatgctatctgataatatgtatgtagca

SEQ ID NO: 302519 - DNA, 75 bp, Artificial Sequence
  Synthetic
atgaagacagagctatttaatatggaaattagtactagttaaacttatatgctatctgataatatatatgtagca

SEQ ID NO: 302520 - DNA, 75 bp, Artificial Sequence
  Synthetic
atgaagacagagctatttaatatggaaattagtactagttaaacttatatgctatctgataatatttatgtagca

SEQ ID NO: 302521 - DNA, 75 bp, Artificial Sequence
  Synthetic
atgaagacagagctatttaatatggaaattagtactagttaaacttatatgctatctgataatatctatgtagca

SEQ ID NO: 302522 - DNA, 75 bp, Artificial Sequence
  Synthetic
atgaagacagagctatttaatatggaaattagtactagttaaacttatatgctatctgataatatgtatgtagca

SEQ ID NO: 302523 - DNA, 75 bp, Artificial Sequence
  Synthetic
atgaagacagagctatttaatacggaaattagtactagttaaacttatatgctatctgataatatatatgtagca

SEQ ID NO: 302524 - DNA, 75 bp, Artificial Sequence
  Synthetic
atgaagacagagctatttaatacggaaattagtactagttaaacttatatgctatctgataatatttatgtagca

SEQ ID NO: 302525 - DNA, 75 bp, Artificial Sequence
  Synthetic
atgaagacagagctatttaatacggaaattagtactagttaaacttatatgctatctgataatatctatgtagca

SEQ ID NO: 302526 - DNA, 75 bp, Artificial Sequence
  Synthetic
atgaagacagagctatttaatacggaaattagtactagttaaacttatatgctatctgataatatgtatgtagca

SEQ ID NO: 302527 - DNA, 75 bp, Artificial Sequence
  Synthetic
atgaagacagagctatttaatagggaaattagtactagttaaacttatatgctatctgataatatatatgtagca

SEQ ID NO: 302528 - DNA, 75 bp, Artificial Sequence
  Synthetic
atgaagacagagctatttaatagggaaattagtactagttaaacttatatgctatctgataatatttatgtagca

SEQ ID NO: 302529 - DNA, 75 bp, Artificial Sequence
  Synthetic
atgaagacagagctatttaatagggaaattagtactagttaaacttatatgctatctgataatatctatgtagca

SEQ ID NO: 302530 - DNA, 75 bp, Artificial Sequence
  Synthetic
atgaagacagagctatttaatagggaaattagtactagttaaacttatatgctatctgataatatgtatgtagca

SEQ ID NO: 302531 - DNA, 75 bp, Artificial Sequence
  Synthetic
attttaaattatataatatgttctaaagaaatcagataacatttggacaatcacgaatgtttataccacaaatta

SEQ ID NO: 302532 - DNA, 75 bp, Artificial Sequence
  Synthetic
attttaaattatataatatgttctaaagaaatcagataacatttggacaatcacgaatgtttataccacatatta

SEQ ID NO: 302533 - DNA, 75 bp, Artificial Sequence
  Synthetic
attttaaattatataatatgttctaaagaaatcagataacatttggacaatcacgaatgtttataccacacatta

SEQ ID NO: 302534 - DNA, 75 bp, Artificial Sequence
  Synthetic
attttaaattatataatatgttctaaagaaatcagataacatttggacaatcacgaatgtttataccacagatta

SEQ ID NO: 302535 - DNA, 75 bp, Artificial Sequence
  Synthetic
attttaaattatataatatgttctaaagaaatcagataacttttggacaatcacgaatgtttataccacaaatta

SEQ ID NO: 302536 - DNA, 75 bp, Artificial Sequence
  Synthetic
attttaaattatataatatgttctaaagaaatcagataacttttggacaatcacgaatgtttataccacatatta

SEQ ID NO: 302537 - DNA, 75 bp, Artificial Sequence
  Synthetic
attttaaattatataatatgttctaaagaaatcagataacttttggacaatcacgaatgtttataccacacatta

SEQ ID NO: 302538 - DNA, 75 bp, Artificial Sequence
  Synthetic
attttaaattatataatatgttctaaagaaatcagataacttttggacaatcacgaatgtttataccacagatta

SEQ ID NO: 302539 - DNA, 75 bp, Artificial Sequence
  Synthetic
attttaaattatataatatgttctaaagaaatcagataacctttggacaatcacgaatgtttataccacaaatta

SEQ ID NO: 302540 - DNA, 75 bp, Artificial Sequence
  Synthetic
attttaaattatataatatgttctaaagaaatcagataacctttggacaatcacgaatgtttataccacatatta

SEQ ID NO: 302541 - DNA, 75 bp, Artificial Sequence
  Synthetic
attttaaattatataatatgttctaaagaaatcagataacctttggacaatcacgaatgtttataccacacatta

SEQ ID NO: 302542 - DNA, 75 bp, Artificial Sequence
  Synthetic
attttaaattatataatatgttctaaagaaatcagataacctttggacaatcacgaatgtttataccacagatta

SEQ ID NO: 302543 - DNA, 75 bp, Artificial Sequence
  Synthetic
attttaaattatataatatgttctaaagaaatcagataacgtttggacaatcacgaatgtttataccacaaatta

SEQ ID NO: 302544 - DNA, 75 bp, Artificial Sequence
  Synthetic
attttaaattatataatatgttctaaagaaatcagataacgtttggacaatcacgaatgtttataccacatatta

SEQ ID NO: 302545 - DNA, 75 bp, Artificial Sequence
  Synthetic
attttaaattatataatatgttctaaagaaatcagataacgtttggacaatcacgaatgtttataccacacatta

SEQ ID NO: 302546 - DNA, 75 bp, Artificial Sequence
  Synthetic
attttaaattatataatatgttctaaagaaatcagataacgtttggacaatcacgaatgtttataccacagatta

SEQ ID NO: 302547 - DNA, 75 bp, Artificial Sequence
  Synthetic
attttaaattatataatatgttctaaagaaatcagattacatttggacaatcacgaatgtttataccacaaatta

SEQ ID NO: 302548 - DNA, 75 bp, Artificial Sequence
  Synthetic
attttaaattatataatatgttctaaagaaatcagattacatttggacaatcacgaatgtttataccacatatta

SEQ ID NO: 302549 - DNA, 75 bp, Artificial Sequence
  Synthetic
attttaaattatataatatgttctaaagaaatcagattacatttggacaatcacgaatgtttataccacacatta

SEQ ID NO: 302550 - DNA, 75 bp, Artificial Sequence
  Synthetic
attttaaattatataatatgttctaaagaaatcagattacatttggacaatcacgaatgtttataccacagatta

SEQ ID NO: 302551 - DNA, 75 bp, Artificial Sequence
  Synthetic
attttaaattatataatatgttctaaagaaatcagattacttttggacaatcacgaatgtttataccacaaatta

SEQ ID NO: 302552 - DNA, 75 bp, Artificial Sequence
  Synthetic
attttaaattatataatatgttctaaagaaatcagattacttttggacaatcacgaatgtttataccacatatta

SEQ ID NO: 302553 - DNA, 75 bp, Artificial Sequence
  Synthetic
attttaaattatataatatgttctaaagaaatcagattacttttggacaatcacgaatgtttataccacacatta

SEQ ID NO: 302554 - DNA, 75 bp, Artificial Sequence
  Synthetic
attttaaattatataatatgttctaaagaaatcagattacttttggacaatcacgaatgtttataccacagatta

SEQ ID NO: 302555 - DNA, 75 bp, Artificial Sequence
  Synthetic
attttaaattatataatatgttctaaagaaatcagattacctttggacaatcacgaatgtttataccacaaatta

SEQ ID NO: 302556 - DNA, 75 bp, Artificial Sequence
  Synthetic
attttaaattatataatatgttctaaagaaatcagattacctttggacaatcacgaatgtttataccacatatta

SEQ ID NO: 302557 - DNA, 75 bp, Artificial Sequence
  Synthetic
attttaaattatataatatgttctaaagaaatcagattacctttggacaatcacgaatgtttataccacacatta

SEQ ID NO: 302558 - DNA, 75 bp, Artificial Sequence
  Synthetic
attttaaattatataatatgttctaaagaaatcagattacctttggacaatcacgaatgtttataccacagatta

SEQ ID NO: 302559 - DNA, 75 bp, Artificial Sequence
  Synthetic
attttaaattatataatatgttctaaagaaatcagattacgtttggacaatcacgaatgtttataccacaaatta

SEQ ID NO: 302560 - DNA, 75 bp, Artificial Sequence
  Synthetic
attttaaattatataatatgttctaaagaaatcagattacgtttggacaatcacgaatgtttataccacatatta

SEQ ID NO: 302561 - DNA, 75 bp, Artificial Sequence
  Synthetic
attttaaattatataatatgttctaaagaaatcagattacgtttggacaatcacgaatgtttataccacacatta

SEQ ID NO: 302562 - DNA, 75 bp, Artificial Sequence
  Synthetic
attttaaattatataatatgttctaaagaaatcagattacgtttggacaatcacgaatgtttataccacagatta

SEQ ID NO: 302563 - DNA, 75 bp, Artificial Sequence
  Synthetic
attttaaattatataatatgttctaaagaaatcagatcacatttggacaatcacgaatgtttataccacaaatta

SEQ ID NO: 302564 - DNA, 75 bp, Artificial Sequence
  Synthetic
attttaaattatataatatgttctaaagaaatcagatcacatttggacaatcacgaatgtttataccacatatta

SEQ ID NO: 302565 - DNA, 75 bp, Artificial Sequence
  Synthetic
attttaaattatataatatgttctaaagaaatcagatcacatttggacaatcacgaatgtttataccacacatta

SEQ ID NO: 302566 - DNA, 75 bp, Artificial Sequence
  Synthetic
attttaaattatataatatgttctaaagaaatcagatcacatttggacaatcacgaatgtttataccacagatta

SEQ ID NO: 302567 - DNA, 75 bp, Artificial Sequence
  Synthetic
attttaaattatataatatgttctaaagaaatcagatcacttttggacaatcacgaatgtttataccacaaatta

SEQ ID NO: 302568 - DNA, 75 bp, Artificial Sequence
  Synthetic
attttaaattatataatatgttctaaagaaatcagatcacttttggacaatcacgaatgtttataccacatatta

SEQ ID NO: 302569 - DNA, 75 bp, Artificial Sequence
  Synthetic
attttaaattatataatatgttctaaagaaatcagatcacttttggacaatcacgaatgtttataccacacatta

SEQ ID NO: 302570 - DNA, 75 bp, Artificial Sequence
  Synthetic
attttaaattatataatatgttctaaagaaatcagatcacttttggacaatcacgaatgtttataccacagatta

SEQ ID NO: 302571 - DNA, 75 bp, Artificial Sequence
  Synthetic
attttaaattatataatatgttctaaagaaatcagatcacctttggacaatcacgaatgtttataccacaaatta

SEQ ID NO: 302572 - DNA, 75 bp, Artificial Sequence
  Synthetic
attttaaattatataatatgttctaaagaaatcagatcacctttggacaatcacgaatgtttataccacatatta

SEQ ID NO: 302573 - DNA, 75 bp, Artificial Sequence
  Synthetic
attttaaattatataatatgttctaaagaaatcagatcacctttggacaatcacgaatgtttataccacacatta

SEQ ID NO: 302574 - DNA, 75 bp, Artificial Sequence
  Synthetic
attttaaattatataatatgttctaaagaaatcagatcacctttggacaatcacgaatgtttataccacagatta

SEQ ID NO: 302575 - DNA, 75 bp, Artificial Sequence
  Synthetic
attttaaattatataatatgttctaaagaaatcagatcacgtttggacaatcacgaatgtttataccacaaatta

SEQ ID NO: 302576 - DNA, 75 bp, Artificial Sequence
  Synthetic
attttaaattatataatatgttctaaagaaatcagatcacgtttggacaatcacgaatgtttataccacatatta

SEQ ID NO: 302577 - DNA, 75 bp, Artificial Sequence
  Synthetic
attttaaattatataatatgttctaaagaaatcagatcacgtttggacaatcacgaatgtttataccacacatta

SEQ ID NO: 302578 - DNA, 75 bp, Artificial Sequence
  Synthetic
attttaaattatataatatgttctaaagaaatcagatcacgtttggacaatcacgaatgtttataccacagatta

SEQ ID NO: 302579 - DNA, 75 bp, Artificial Sequence
  Synthetic
attttaaattatataatatgttctaaagaaatcagatgacatttggacaatcacgaatgtttataccacaaatta

SEQ ID NO: 302580 - DNA, 75 bp, Artificial Sequence
  Synthetic
attttaaattatataatatgttctaaagaaatcagatgacatttggacaatcacgaatgtttataccacatatta

SEQ ID NO: 302581 - DNA, 75 bp, Artificial Sequence
  Synthetic
attttaaattatataatatgttctaaagaaatcagatgacatttggacaatcacgaatgtttataccacacatta

SEQ ID NO: 302582 - DNA, 75 bp, Artificial Sequence
  Synthetic
attttaaattatataatatgttctaaagaaatcagatgacatttggacaatcacgaatgtttataccacagatta

SEQ ID NO: 302583 - DNA, 75 bp, Artificial Sequence
  Synthetic
attttaaattatataatatgttctaaagaaatcagatgacttttggacaatcacgaatgtttataccacaaatta

SEQ ID NO: 302584 - DNA, 75 bp, Artificial Sequence
  Synthetic
attttaaattatataatatgttctaaagaaatcagatgacttttggacaatcacgaatgtttataccacatatta

SEQ ID NO: 302585 - DNA, 75 bp, Artificial Sequence
  Synthetic
attttaaattatataatatgttctaaagaaatcagatgacttttggacaatcacgaatgtttataccacacatta

SEQ ID NO: 302586 - DNA, 75 bp, Artificial Sequence
  Synthetic
attttaaattatataatatgttctaaagaaatcagatgacttttggacaatcacgaatgtttataccacagatta

SEQ ID NO: 302587 - DNA, 75 bp, Artificial Sequence
  Synthetic
attttaaattatataatatgttctaaagaaatcagatgacctttggacaatcacgaatgtttataccacaaatta

SEQ ID NO: 302588 - DNA, 75 bp, Artificial Sequence
  Synthetic
attttaaattatataatatgttctaaagaaatcagatgacctttggacaatcacgaatgtttataccacatatta

SEQ ID NO: 302589 - DNA, 75 bp, Artificial Sequence
  Synthetic
attttaaattatataatatgttctaaagaaatcagatgacctttggacaatcacgaatgtttataccacacatta

SEQ ID NO: 302590 - DNA, 75 bp, Artificial Sequence
  Synthetic
attttaaattatataatatgttctaaagaaatcagatgacctttggacaatcacgaatgtttataccacagatta

SEQ ID NO: 302591 - DNA, 75 bp, Artificial Sequence
  Synthetic
attttaaattatataatatgttctaaagaaatcagatgacgtttggacaatcacgaatgtttataccacaaatta

SEQ ID NO: 302592 - DNA, 75 bp, Artificial Sequence
  Synthetic
attttaaattatataatatgttctaaagaaatcagatgacgtttggacaatcacgaatgtttataccacatatta

SEQ ID NO: 302593 - DNA, 75 bp, Artificial Sequence
  Synthetic
attttaaattatataatatgttctaaagaaatcagatgacgtttggacaatcacgaatgtttataccacacatta

SEQ ID NO: 302594 - DNA, 75 bp, Artificial Sequence
  Synthetic
attttaaattatataatatgttctaaagaaatcagatgacgtttggacaatcacgaatgtttataccacagatta

SEQ ID NO: 302595 - DNA, 75 bp, Artificial Sequence
  Synthetic
actggaaataatcatttatttataataaatggaactgacaaatatcataaattggatcagtatgcgaatcatatg

SEQ ID NO: 302596 - DNA, 75 bp, Artificial Sequence
  Synthetic
aacaaattactaccaaagatgaaatagaaaaacagatggacagagttgttaaagaaatgagacgtcagttggaaa

SEQ ID NO: 302597 - DNA, 75 bp, Artificial Sequence
  Synthetic
aatcaataaagcatttatatgaggaatataaagatgtgatagataaagcaacactattatcagtgttatcatatt

SEQ ID NO: 302598 - DNA, 75 bp, Artificial Sequence
  Synthetic
taaatgatttagactatgaaaataataaattaacttctgaattatttgacgaagaaaactacactgatagcttaa

SEQ ID NO: 302599 - DNA, 75 bp, Artificial Sequence
  Synthetic
caacagtgggattgacacttagaattgagtctgcagtttgtgagtctgtactcgccgatgcaagtgaaactctat

SEQ ID NO: 302600 - DNA, 75 bp, Artificial Sequence
  Synthetic
ttatgaatatgatgttaaagttccgcatctaacattcggagtgctatttatatctgataatatgatacatgatgt

SEQ ID NO: 302601 - DNA, 75 bp, Artificial Sequence
  Synthetic
atgtttattcctcacataacgcttagctttagtaataaacaaacggttagaatagaaaatacgagacttaaaatt

SEQ ID NO: 302602 - DNA, 75 bp, Artificial Sequence
  Synthetic
ttgaaactactgccactgcagaaggaggagaaatagtattacaaaatgcagcttttactatgtggaaattgacgt

SEQ ID NO: 302603 - DNA, 75 bp, Artificial Sequence
  Synthetic
ttgaaactactgccactgcagaaggaggagaaatagtattacaaaatgctgcttttactatgtggaaattgacgt

SEQ ID NO: 302604 - DNA, 75 bp, Artificial Sequence
  Synthetic
ttgaaactactgccactgcagaaggaggagaaatagtattacaaaatgccgcttttactatgtggaaattgacgt

SEQ ID NO: 302605 - DNA, 75 bp, Artificial Sequence
  Synthetic
ttgaaactactgccactgcagaaggaggagaaatagtattacaaaatgcggcttttactatgtggaaattgacgt

SEQ ID NO: 302606 - DNA, 75 bp, Artificial Sequence
  Synthetic
ttgaaactactgccactgcagaaggaggagaaatagtatttcaaaatgcagcttttactatgtggaaattgacgt

SEQ ID NO: 302607 - DNA, 75 bp, Artificial Sequence
  Synthetic
ttgaaactactgccactgcagaaggaggagaaatagtatttcaaaatgctgcttttactatgtggaaattgacgt

SEQ ID NO: 302608 - DNA, 75 bp, Artificial Sequence
  Synthetic
ttgaaactactgccactgcagaaggaggagaaatagtatttcaaaatgccgcttttactatgtggaaattgacgt

SEQ ID NO: 302609 - DNA, 75 bp, Artificial Sequence
  Synthetic
ttgaaactactgccactgcagaaggaggagaaatagtatttcaaaatgcggcttttactatgtggaaattgacgt

SEQ ID NO: 302610 - DNA, 75 bp, Artificial Sequence
  Synthetic
ttgaaactactgccactgcagaaggaggagaaatagtattccaaaatgcagcttttactatgtggaaattgacgt

SEQ ID NO: 302611 - DNA, 75 bp, Artificial Sequence
  Synthetic
ttgaaactactgccactgcagaaggaggagaaatagtattccaaaatgctgcttttactatgtggaaattgacgt

SEQ ID NO: 302612 - DNA, 75 bp, Artificial Sequence
  Synthetic
ttgaaactactgccactgcagaaggaggagaaatagtattccaaaatgccgcttttactatgtggaaattgacgt

SEQ ID NO: 302613 - DNA, 75 bp, Artificial Sequence
  Synthetic
ttgaaactactgccactgcagaaggaggagaaatagtattccaaaatgcggcttttactatgtggaaattgacgt

SEQ ID NO: 302614 - DNA, 75 bp, Artificial Sequence
  Synthetic
ttgaaactactgccactgcagaaggaggagaaatagtattgcaaaatgcagcttttactatgtggaaattgacgt

SEQ ID NO: 302615 - DNA, 75 bp, Artificial Sequence
  Synthetic
ttgaaactactgccactgcagaaggaggagaaatagtattgcaaaatgctgcttttactatgtggaaattgacgt

SEQ ID NO: 302616 - DNA, 75 bp, Artificial Sequence
  Synthetic
ttgaaactactgccactgcagaaggaggagaaatagtattgcaaaatgccgcttttactatgtggaaattgacgt

SEQ ID NO: 302617 - DNA, 75 bp, Artificial Sequence
  Synthetic
ttgaaactactgccactgcagaaggaggagaaatagtattgcaaaatgcggcttttactatgtggaaattgacgt

SEQ ID NO: 302618 - DNA, 75 bp, Artificial Sequence
  Synthetic
ttgaaactactgccactgctgaaggaggagaaatagtattacaaaatgcagcttttactatgtggaaattgacgt

SEQ ID NO: 302619 - DNA, 75 bp, Artificial Sequence
  Synthetic
ttgaaactactgccactgctgaaggaggagaaatagtattacaaaatgctgcttttactatgtggaaattgacgt

SEQ ID NO: 302620 - DNA, 75 bp, Artificial Sequence
  Synthetic
ttgaaactactgccactgctgaaggaggagaaatagtattacaaaatgccgcttttactatgtggaaattgacgt

SEQ ID NO: 302621 - DNA, 75 bp, Artificial Sequence
  Synthetic
ttgaaactactgccactgctgaaggaggagaaatagtattacaaaatgcggcttttactatgtggaaattgacgt

SEQ ID NO: 302622 - DNA, 75 bp, Artificial Sequence
  Synthetic
ttgaaactactgccactgctgaaggaggagaaatagtatttcaaaatgcagcttttactatgtggaaattgacgt

SEQ ID NO: 302623 - DNA, 75 bp, Artificial Sequence
  Synthetic
ttgaaactactgccactgctgaaggaggagaaatagtatttcaaaatgctgcttttactatgtggaaattgacgt

SEQ ID NO: 302624 - DNA, 75 bp, Artificial Sequence
  Synthetic
ttgaaactactgccactgctgaaggaggagaaatagtatttcaaaatgccgcttttactatgtggaaattgacgt

SEQ ID NO: 302625 - DNA, 75 bp, Artificial Sequence
  Synthetic
ttgaaactactgccactgctgaaggaggagaaatagtatttcaaaatgcggcttttactatgtggaaattgacgt

SEQ ID NO: 302626 - DNA, 75 bp, Artificial Sequence
  Synthetic
ttgaaactactgccactgctgaaggaggagaaatagtattccaaaatgcagcttttactatgtggaaattgacgt

SEQ ID NO: 302627 - DNA, 75 bp, Artificial Sequence
  Synthetic
ttgaaactactgccactgctgaaggaggagaaatagtattccaaaatgctgcttttactatgtggaaattgacgt

SEQ ID NO: 302628 - DNA, 75 bp, Artificial Sequence
  Synthetic
ttgaaactactgccactgctgaaggaggagaaatagtattccaaaatgccgcttttactatgtggaaattgacgt

SEQ ID NO: 302629 - DNA, 75 bp, Artificial Sequence
  Synthetic
ttgaaactactgccactgctgaaggaggagaaatagtattccaaaatgcggcttttactatgtggaaattgacgt

SEQ ID NO: 302630 - DNA, 75 bp, Artificial Sequence
  Synthetic
ttgaaactactgccactgctgaaggaggagaaatagtattgcaaaatgcagcttttactatgtggaaattgacgt

SEQ ID NO: 302631 - DNA, 75 bp, Artificial Sequence
  Synthetic
ttgaaactactgccactgctgaaggaggagaaatagtattgcaaaatgctgcttttactatgtggaaattgacgt

SEQ ID NO: 302632 - DNA, 75 bp, Artificial Sequence
  Synthetic
ttgaaactactgccactgctgaaggaggagaaatagtattgcaaaatgccgcttttactatgtggaaattgacgt

SEQ ID NO: 302633 - DNA, 75 bp, Artificial Sequence
  Synthetic
ttgaaactactgccactgctgaaggaggagaaatagtattgcaaaatgcggcttttactatgtggaaattgacgt

SEQ ID NO: 302634 - DNA, 75 bp, Artificial Sequence
  Synthetic
ttgaaactactgccactgccgaaggaggagaaatagtattacaaaatgcagcttttactatgtggaaattgacgt

SEQ ID NO: 302635 - DNA, 75 bp, Artificial Sequence
  Synthetic
ttgaaactactgccactgccgaaggaggagaaatagtattacaaaatgctgcttttactatgtggaaattgacgt

SEQ ID NO: 302636 - DNA, 75 bp, Artificial Sequence
  Synthetic
ttgaaactactgccactgccgaaggaggagaaatagtattacaaaatgccgcttttactatgtggaaattgacgt

SEQ ID NO: 302637 - DNA, 75 bp, Artificial Sequence
  Synthetic
ttgaaactactgccactgccgaaggaggagaaatagtattacaaaatgcggcttttactatgtggaaattgacgt

SEQ ID NO: 302638 - DNA, 75 bp, Artificial Sequence
  Synthetic
ttgaaactactgccactgccgaaggaggagaaatagtatttcaaaatgcagcttttactatgtggaaattgacgt

SEQ ID NO: 302639 - DNA, 75 bp, Artificial Sequence
  Synthetic
ttgaaactactgccactgccgaaggaggagaaatagtatttcaaaatgctgcttttactatgtggaaattgacgt

SEQ ID NO: 302640 - DNA, 75 bp, Artificial Sequence
  Synthetic
ttgaaactactgccactgccgaaggaggagaaatagtatttcaaaatgccgcttttactatgtggaaattgacgt

SEQ ID NO: 302641 - DNA, 75 bp, Artificial Sequence
  Synthetic
ttgaaactactgccactgccgaaggaggagaaatagtatttcaaaatgcggcttttactatgtggaaattgacgt

SEQ ID NO: 302642 - DNA, 75 bp, Artificial Sequence
  Synthetic
ttgaaactactgccactgccgaaggaggagaaatagtattccaaaatgcagcttttactatgtggaaattgacgt

SEQ ID NO: 302643 - DNA, 75 bp, Artificial Sequence
  Synthetic
ttgaaactactgccactgccgaaggaggagaaatagtattccaaaatgctgcttttactatgtggaaattgacgt

SEQ ID NO: 302644 - DNA, 75 bp, Artificial Sequence
  Synthetic
ttgaaactactgccactgccgaaggaggagaaatagtattccaaaatgccgcttttactatgtggaaattgacgt

SEQ ID NO: 302645 - DNA, 75 bp, Artificial Sequence
  Synthetic
ttgaaactactgccactgccgaaggaggagaaatagtattccaaaatgcggcttttactatgtggaaattgacgt

SEQ ID NO: 302646 - DNA, 75 bp, Artificial Sequence
  Synthetic
ttgaaactactgccactgccgaaggaggagaaatagtattgcaaaatgcagcttttactatgtggaaattgacgt

SEQ ID NO: 302647 - DNA, 75 bp, Artificial Sequence
  Synthetic
ttgaaactactgccactgccgaaggaggagaaatagtattgcaaaatgctgcttttactatgtggaaattgacgt

SEQ ID NO: 302648 - DNA, 75 bp, Artificial Sequence
  Synthetic
ttgaaactactgccactgccgaaggaggagaaatagtattgcaaaatgccgcttttactatgtggaaattgacgt

SEQ ID NO: 302649 - DNA, 75 bp, Artificial Sequence
  Synthetic
ttgaaactactgccactgccgaaggaggagaaatagtattgcaaaatgcggcttttactatgtggaaattgacgt

SEQ ID NO: 302650 - DNA, 75 bp, Artificial Sequence
  Synthetic
ttgaaactactgccactgcggaaggaggagaaatagtattacaaaatgcagcttttactatgtggaaattgacgt

SEQ ID NO: 302651 - DNA, 75 bp, Artificial Sequence
  Synthetic
ttgaaactactgccactgcggaaggaggagaaatagtattacaaaatgctgcttttactatgtggaaattgacgt

SEQ ID NO: 302652 - DNA, 75 bp, Artificial Sequence
  Synthetic
ttgaaactactgccactgcggaaggaggagaaatagtattacaaaatgccgcttttactatgtggaaattgacgt

SEQ ID NO: 302653 - DNA, 75 bp, Artificial Sequence
  Synthetic
ttgaaactactgccactgcggaaggaggagaaatagtattacaaaatgcggcttttactatgtggaaattgacgt

SEQ ID NO: 302654 - DNA, 75 bp, Artificial Sequence
  Synthetic
ttgaaactactgccactgcggaaggaggagaaatagtatttcaaaatgcagcttttactatgtggaaattgacgt

SEQ ID NO: 302655 - DNA, 75 bp, Artificial Sequence
  Synthetic
ttgaaactactgccactgcggaaggaggagaaatagtatttcaaaatgctgcttttactatgtggaaattgacgt

SEQ ID NO: 302656 - DNA, 75 bp, Artificial Sequence
  Synthetic
ttgaaactactgccactgcggaaggaggagaaatagtatttcaaaatgccgcttttactatgtggaaattgacgt

SEQ ID NO: 302657 - DNA, 75 bp, Artificial Sequence
  Synthetic
ttgaaactactgccactgcggaaggaggagaaatagtatttcaaaatgcggcttttactatgtggaaattgacgt

SEQ ID NO: 302658 - DNA, 75 bp, Artificial Sequence
  Synthetic
ttgaaactactgccactgcggaaggaggagaaatagtattccaaaatgcagcttttactatgtggaaattgacgt

SEQ ID NO: 302659 - DNA, 75 bp, Artificial Sequence
  Synthetic
ttgaaactactgccactgcggaaggaggagaaatagtattccaaaatgctgcttttactatgtggaaattgacgt

SEQ ID NO: 302660 - DNA, 75 bp, Artificial Sequence
  Synthetic
ttgaaactactgccactgcggaaggaggagaaatagtattccaaaatgccgcttttactatgtggaaattgacgt

SEQ ID NO: 302661 - DNA, 75 bp, Artificial Sequence
  Synthetic
ttgaaactactgccactgcggaaggaggagaaatagtattccaaaatgcggcttttactatgtggaaattgacgt

SEQ ID NO: 302662 - DNA, 75 bp, Artificial Sequence
  Synthetic
ttgaaactactgccactgcggaaggaggagaaatagtattgcaaaatgcagcttttactatgtggaaattgacgt

SEQ ID NO: 302663 - DNA, 75 bp, Artificial Sequence
  Synthetic
ttgaaactactgccactgcggaaggaggagaaatagtattgcaaaatgctgcttttactatgtggaaattgacgt

SEQ ID NO: 302664 - DNA, 75 bp, Artificial Sequence
  Synthetic
ttgaaactactgccactgcggaaggaggagaaatagtattgcaaaatgccgcttttactatgtggaaattgacgt

SEQ ID NO: 302665 - DNA, 75 bp, Artificial Sequence
  Synthetic
ttgaaactactgccactgcggaaggaggagaaatagtattgcaaaatgcggcttttactatgtggaaattgacgt

SEQ ID NO: 302666 - DNA, 75 bp, Artificial Sequence
  Synthetic
aaatgattttaatttggtagaccaaagaatcatttggcaaaaatggtatgcttttacatcttcaatgaaacaggg

SEQ ID NO: 302667 - DNA, 75 bp, Artificial Sequence
  Synthetic
aaatgattttaatttggtagaccaaagaatcatttggcaaaaatggtatgcttttacatcttctatgaaacaggg

SEQ ID NO: 302668 - DNA, 75 bp, Artificial Sequence
  Synthetic
aaatgattttaatttggtagaccaaagaatcatttggcaaaaatggtatgcttttacatcttccatgaaacaggg

SEQ ID NO: 302669 - DNA, 75 bp, Artificial Sequence
  Synthetic
aaatgattttaatttggtagaccaaagaatcatttggcaaaaatggtatgcttttacatcttcgatgaaacaggg

SEQ ID NO: 302670 - DNA, 75 bp, Artificial Sequence
  Synthetic
aaatgattttaatttggtagaccaaagaatcatttggcaaaattggtatgcttttacatcttcaatgaaacaggg

SEQ ID NO: 302671 - DNA, 75 bp, Artificial Sequence
  Synthetic
aaatgattttaatttggtagaccaaagaatcatttggcaaaattggtatgcttttacatcttctatgaaacaggg

SEQ ID NO: 302672 - DNA, 75 bp, Artificial Sequence
  Synthetic
aaatgattttaatttggtagaccaaagaatcatttggcaaaattggtatgcttttacatcttccatgaaacaggg

SEQ ID NO: 302673 - DNA, 75 bp, Artificial Sequence
  Synthetic
aaatgattttaatttggtagaccaaagaatcatttggcaaaattggtatgcttttacatcttcgatgaaacaggg

SEQ ID NO: 302674 - DNA, 75 bp, Artificial Sequence
  Synthetic
aaatgattttaatttggtagaccaaagaatcatttggcaaaactggtatgcttttacatcttcaatgaaacaggg

SEQ ID NO: 302675 - DNA, 75 bp, Artificial Sequence
  Synthetic
aaatgattttaatttggtagaccaaagaatcatttggcaaaactggtatgcttttacatcttctatgaaacaggg

SEQ ID NO: 302676 - DNA, 75 bp, Artificial Sequence
  Synthetic
aaatgattttaatttggtagaccaaagaatcatttggcaaaactggtatgcttttacatcttccatgaaacaggg

SEQ ID NO: 302677 - DNA, 75 bp, Artificial Sequence
  Synthetic
aaatgattttaatttggtagaccaaagaatcatttggcaaaactggtatgcttttacatcttcgatgaaacaggg

SEQ ID NO: 302678 - DNA, 75 bp, Artificial Sequence
  Synthetic
aaatgattttaatttggtagaccaaagaatcatttggcaaaagtggtatgcttttacatcttcaatgaaacaggg

SEQ ID NO: 302679 - DNA, 75 bp, Artificial Sequence
  Synthetic
aaatgattttaatttggtagaccaaagaatcatttggcaaaagtggtatgcttttacatcttctatgaaacaggg

SEQ ID NO: 302680 - DNA, 75 bp, Artificial Sequence
  Synthetic
aaatgattttaatttggtagaccaaagaatcatttggcaaaagtggtatgcttttacatcttccatgaaacaggg

SEQ ID NO: 302681 - DNA, 75 bp, Artificial Sequence
  Synthetic
aaatgattttaatttggtagaccaaagaatcatttggcaaaagtggtatgcttttacatcttcgatgaaacaggg

SEQ ID NO: 302682 - DNA, 75 bp, Artificial Sequence
  Synthetic
aattgattttaatttggtagaccaaagaatcatttggcaaaaatggtatgcttttacatcttcaatgaaacaggg

SEQ ID NO: 302683 - DNA, 75 bp, Artificial Sequence
  Synthetic
aattgattttaatttggtagaccaaagaatcatttggcaaaaatggtatgcttttacatcttctatgaaacaggg

SEQ ID NO: 302684 - DNA, 75 bp, Artificial Sequence
  Synthetic
aattgattttaatttggtagaccaaagaatcatttggcaaaaatggtatgcttttacatcttccatgaaacaggg

SEQ ID NO: 302685 - DNA, 75 bp, Artificial Sequence
  Synthetic
aattgattttaatttggtagaccaaagaatcatttggcaaaaatggtatgcttttacatcttcgatgaaacaggg

SEQ ID NO: 302686 - DNA, 75 bp, Artificial Sequence
  Synthetic
aattgattttaatttggtagaccaaagaatcatttggcaaaattggtatgcttttacatcttcaatgaaacaggg

SEQ ID NO: 302687 - DNA, 75 bp, Artificial Sequence
  Synthetic
aattgattttaatttggtagaccaaagaatcatttggcaaaattggtatgcttttacatcttctatgaaacaggg

SEQ ID NO: 302688 - DNA, 75 bp, Artificial Sequence
  Synthetic
aattgattttaatttggtagaccaaagaatcatttggcaaaattggtatgcttttacatcttccatgaaacaggg

SEQ ID NO: 302689 - DNA, 75 bp, Artificial Sequence
  Synthetic
aattgattttaatttggtagaccaaagaatcatttggcaaaattggtatgcttttacatcttcgatgaaacaggg

SEQ ID NO: 302690 - DNA, 75 bp, Artificial Sequence
  Synthetic
aattgattttaatttggtagaccaaagaatcatttggcaaaactggtatgcttttacatcttcaatgaaacaggg

SEQ ID NO: 302691 - DNA, 75 bp, Artificial Sequence
  Synthetic
aattgattttaatttggtagaccaaagaatcatttggcaaaactggtatgcttttacatcttctatgaaacaggg

SEQ ID NO: 302692 - DNA, 75 bp, Artificial Sequence
  Synthetic
aattgattttaatttggtagaccaaagaatcatttggcaaaactggtatgcttttacatcttccatgaaacaggg

SEQ ID NO: 302693 - DNA, 75 bp, Artificial Sequence
  Synthetic
aattgattttaatttggtagaccaaagaatcatttggcaaaactggtatgcttttacatcttcgatgaaacaggg

SEQ ID NO: 302694 - DNA, 75 bp, Artificial Sequence
  Synthetic
aattgattttaatttggtagaccaaagaatcatttggcaaaagtggtatgcttttacatcttcaatgaaacaggg

SEQ ID NO: 302695 - DNA, 75 bp, Artificial Sequence
  Synthetic
aattgattttaatttggtagaccaaagaatcatttggcaaaagtggtatgcttttacatcttctatgaaacaggg

SEQ ID NO: 302696 - DNA, 75 bp, Artificial Sequence
  Synthetic
aattgattttaatttggtagaccaaagaatcatttggcaaaagtggtatgcttttacatcttccatgaaacaggg

SEQ ID NO: 302697 - DNA, 75 bp, Artificial Sequence
  Synthetic
aattgattttaatttggtagaccaaagaatcatttggcaaaagtggtatgcttttacatcttcgatgaaacaggg

SEQ ID NO: 302698 - DNA, 75 bp, Artificial Sequence
  Synthetic
aactgattttaatttggtagaccaaagaatcatttggcaaaaatggtatgcttttacatcttcaatgaaacaggg

SEQ ID NO: 302699 - DNA, 75 bp, Artificial Sequence
  Synthetic
aactgattttaatttggtagaccaaagaatcatttggcaaaaatggtatgcttttacatcttctatgaaacaggg

SEQ ID NO: 302700 - DNA, 75 bp, Artificial Sequence
  Synthetic
aactgattttaatttggtagaccaaagaatcatttggcaaaaatggtatgcttttacatcttccatgaaacaggg

SEQ ID NO: 302701 - DNA, 75 bp, Artificial Sequence
  Synthetic
aactgattttaatttggtagaccaaagaatcatttggcaaaaatggtatgcttttacatcttcgatgaaacaggg

SEQ ID NO: 302702 - DNA, 75 bp, Artificial Sequence
  Synthetic
aactgattttaatttggtagaccaaagaatcatttggcaaaattggtatgcttttacatcttcaatgaaacaggg

SEQ ID NO: 302703 - DNA, 75 bp, Artificial Sequence
  Synthetic
aactgattttaatttggtagaccaaagaatcatttggcaaaattggtatgcttttacatcttctatgaaacaggg

SEQ ID NO: 302704 - DNA, 75 bp, Artificial Sequence
  Synthetic
aactgattttaatttggtagaccaaagaatcatttggcaaaattggtatgcttttacatcttccatgaaacaggg

SEQ ID NO: 302705 - DNA, 75 bp, Artificial Sequence
  Synthetic
aactgattttaatttggtagaccaaagaatcatttggcaaaattggtatgcttttacatcttcgatgaaacaggg

SEQ ID NO: 302706 - DNA, 75 bp, Artificial Sequence
  Synthetic
aactgattttaatttggtagaccaaagaatcatttggcaaaactggtatgcttttacatcttcaatgaaacaggg

SEQ ID NO: 302707 - DNA, 75 bp, Artificial Sequence
  Synthetic
aactgattttaatttggtagaccaaagaatcatttggcaaaactggtatgcttttacatcttctatgaaacaggg

SEQ ID NO: 302708 - DNA, 75 bp, Artificial Sequence
  Synthetic
aactgattttaatttggtagaccaaagaatcatttggcaaaactggtatgcttttacatcttccatgaaacaggg

SEQ ID NO: 302709 - DNA, 75 bp, Artificial Sequence
  Synthetic
aactgattttaatttggtagaccaaagaatcatttggcaaaactggtatgcttttacatcttcgatgaaacaggg

SEQ ID NO: 302710 - DNA, 75 bp, Artificial Sequence
  Synthetic
aactgattttaatttggtagaccaaagaatcatttggcaaaagtggtatgcttttacatcttcaatgaaacaggg

SEQ ID NO: 302711 - DNA, 75 bp, Artificial Sequence
  Synthetic
aactgattttaatttggtagaccaaagaatcatttggcaaaagtggtatgcttttacatcttctatgaaacaggg

SEQ ID NO: 302712 - DNA, 75 bp, Artificial Sequence
  Synthetic
aactgattttaatttggtagaccaaagaatcatttggcaaaagtggtatgcttttacatcttccatgaaacaggg

SEQ ID NO: 302713 - DNA, 75 bp, Artificial Sequence
  Synthetic
aactgattttaatttggtagaccaaagaatcatttggcaaaagtggtatgcttttacatcttcgatgaaacaggg

SEQ ID NO: 302714 - DNA, 75 bp, Artificial Sequence
  Synthetic
aagtgattttaatttggtagaccaaagaatcatttggcaaaaatggtatgcttttacatcttcaatgaaacaggg

SEQ ID NO: 302715 - DNA, 75 bp, Artificial Sequence
  Synthetic
aagtgattttaatttggtagaccaaagaatcatttggcaaaaatggtatgcttttacatcttctatgaaacaggg

SEQ ID NO: 302716 - DNA, 75 bp, Artificial Sequence
  Synthetic
aagtgattttaatttggtagaccaaagaatcatttggcaaaaatggtatgcttttacatcttccatgaaacaggg

SEQ ID NO: 302717 - DNA, 75 bp, Artificial Sequence
  Synthetic
aagtgattttaatttggtagaccaaagaatcatttggcaaaaatggtatgcttttacatcttcgatgaaacaggg

SEQ ID NO: 302718 - DNA, 75 bp, Artificial Sequence
  Synthetic
aagtgattttaatttggtagaccaaagaatcatttggcaaaattggtatgcttttacatcttcaatgaaacaggg

SEQ ID NO: 302719 - DNA, 75 bp, Artificial Sequence
  Synthetic
aagtgattttaatttggtagaccaaagaatcatttggcaaaattggtatgcttttacatcttctatgaaacaggg

SEQ ID NO: 302720 - DNA, 75 bp, Artificial Sequence
  Synthetic
aagtgattttaatttggtagaccaaagaatcatttggcaaaattggtatgcttttacatcttccatgaaacaggg

SEQ ID NO: 302721 - DNA, 75 bp, Artificial Sequence
  Synthetic
aagtgattttaatttggtagaccaaagaatcatttggcaaaattggtatgcttttacatcttcgatgaaacaggg

SEQ ID NO: 302722 - DNA, 75 bp, Artificial Sequence
  Synthetic
aagtgattttaatttggtagaccaaagaatcatttggcaaaactggtatgcttttacatcttcaatgaaacaggg

SEQ ID NO: 302723 - DNA, 75 bp, Artificial Sequence
  Synthetic
aagtgattttaatttggtagaccaaagaatcatttggcaaaactggtatgcttttacatcttctatgaaacaggg

SEQ ID NO: 302724 - DNA, 75 bp, Artificial Sequence
  Synthetic
aagtgattttaatttggtagaccaaagaatcatttggcaaaactggtatgcttttacatcttccatgaaacaggg

SEQ ID NO: 302725 - DNA, 75 bp, Artificial Sequence
  Synthetic
aagtgattttaatttggtagaccaaagaatcatttggcaaaactggtatgcttttacatcttcgatgaaacaggg

SEQ ID NO: 302726 - DNA, 75 bp, Artificial Sequence
  Synthetic
aagtgattttaatttggtagaccaaagaatcatttggcaaaagtggtatgcttttacatcttcaatgaaacaggg

SEQ ID NO: 302727 - DNA, 75 bp, Artificial Sequence
  Synthetic
aagtgattttaatttggtagaccaaagaatcatttggcaaaagtggtatgcttttacatcttctatgaaacaggg

SEQ ID NO: 302728 - DNA, 75 bp, Artificial Sequence
  Synthetic
aagtgattttaatttggtagaccaaagaatcatttggcaaaagtggtatgcttttacatcttccatgaaacaggg

SEQ ID NO: 302729 - DNA, 75 bp, Artificial Sequence
  Synthetic
aagtgattttaatttggtagaccaaagaatcatttggcaaaagtggtatgcttttacatcttcgatgaaacaggg

SEQ ID NO: 302730 - DNA, 75 bp, Artificial Sequence
  Synthetic
tatcactaaaaccattgttcgaagaatataaagatgtgatagacaatggaactttgttatctatactatcatatt

SEQ ID NO: 302731 - DNA, 75 bp, Artificial Sequence
  Synthetic
aaaacagaaaatgatagacgcagctttagatcagttaaacacagaatactcagatgatgtggatgatgagatgta

SEQ ID NO: 302732 - DNA, 75 bp, Artificial Sequence
  Synthetic
caaacgacgtcgctgatgcaaacaaaatttacaaacgtagattggatttattcactatagtagcatccacagtaa

SEQ ID NO: 302733 - DNA, 75 bp, Artificial Sequence
  Synthetic
cgagctagcctgcttttgctatccctgtgatagggaaggagcgtcagtagtaagatactcaagaagtgcaattaa

SEQ ID NO: 302734 - DNA, 75 bp, Artificial Sequence
  Synthetic
aatgatggaaataattctagagggatgaactttgacactgacatgtatgataaagtagcggacttacttgtgcaa

SEQ ID NO: 302735 - DNA, 75 bp, Artificial Sequence
  Synthetic
aaaaaattaaagagacactcgaaaaatatagacaaacgcaaataaatttaatggattcctacgttcaaattccgg

SEQ ID NO: 302736 - DNA, 75 bp, Artificial Sequence
  Synthetic
ggctttataatggcttcgctaatatacagacagctactctataactcatattcagtagatttatcagacgaaata

SEQ ID NO: 302737 - DNA, 75 bp, Artificial Sequence
  Synthetic
ataaggatgatatactttcagcagatccgaatttgattactaaatcagtattaatagcaatgggtctaattaaag

SEQ ID NO: 302738 - DNA, 75 bp, Artificial Sequence
  Synthetic
ggttgattgttcattagaaaaatttacgttgatgtcaaaaatttattcttggtcatttcacgtcggatttagaaa

SEQ ID NO: 302739 - DNA, 75 bp, Artificial Sequence
  Synthetic
tatgcatttaaaactaaaataataagagttgatggagatgataactatgcagtgctacaatttaattcaaaaata

SEQ ID NO: 302740 - DNA, 75 bp, Artificial Sequence
  Synthetic
aattactgatccaaattttgtagagtataaaattacattgaatcacactgatccaattgatgataaaatagttaa

SEQ ID NO: 302741 - DNA, 75 bp, Artificial Sequence
  Synthetic
ttgctaagaggtatattgctggaggaaaaatattttttagagctggaattaatctacttaataacgaaaagagag

SEQ ID NO: 302742 - DNA, 75 bp, Artificial Sequence
  Synthetic
atttagtcttaccaaatacagctcagactaatgtcacagtaaatgtgatgaatgagacggtgaatatatcaatag

SEQ ID NO: 302743 - DNA, 75 bp, Artificial Sequence
  Synthetic
gaaaatggatgagctattcacactaattagatgtaattttacgtatgattacattgatgatatcgtttatttaca

SEQ ID NO: 302744 - DNA, 75 bp, Artificial Sequence
  Synthetic
caatataataaatttgcagtgattacacatggtaaagggcattatagagtcgttagatattcgactgtcgctaat

SEQ ID NO: 302745 - DNA, 75 bp, Artificial Sequence
  Synthetic
aatgagacggtgaatatatcaatagacaattcgggttcgacatacagatttgtggattacattaaaactagttcc

SEQ ID NO: 302746 - DNA, 75 bp, Artificial Sequence
  Synthetic
aagaatatgcatgtcatggatgatatagcgcatggaagatatactccaggtgtcattcctccagtgaatatagat

SEQ ID NO: 302747 - DNA, 75 bp, Artificial Sequence
  Synthetic
ctgcattcgtgaagtcaatgctgaatggaatgaagctagatgattcaaagcgtctgctttttacgaaaatgaaac

SEQ ID NO: 302748 - DNA, 75 bp, Artificial Sequence
  Synthetic
atacacaaggcgatttgagggttggaacatattctaatcccgtgccgaatgcagtgatcaatctaaatgcagatt

SEQ ID NO: 302749 - DNA, 75 bp, Artificial Sequence
  Synthetic
cacaacggaaagaaaactcgatgaagtttcactattaggttaaagtaccgcatagggatgtaatagcaggaattg

SEQ ID NO: 302750 - DNA, 75 bp, Artificial Sequence
  Synthetic
tagtaattctatggtgttatatacagatgtttcacaatgggattcgtcacaacataatacgcagccatttagaaa

SEQ ID NO: 302751 - DNA, 75 bp, Artificial Sequence
  Synthetic
caacttacgtgacaccaattagttatactattagaagtcaaagaattgcgagaccgaatgaagacataatcatat

SEQ ID NO: 302752 - DNA, 75 bp, Artificial Sequence
  Synthetic
cagactaaagcggcgaattctatagctaacttagcacttattaaaacagtattgtcaagaattgcaaacaaatat

SEQ ID NO: 302753 - DNA, 75 bp, Artificial Sequence
  Synthetic
atagttgaagaatttttaaagagactgcaaatctttgatgtaccgcgagtgcccgatgatcaaatgtatagacta

SEQ ID NO: 302754 - DNA, 75 bp, Artificial Sequence
  Synthetic
aaattatgatgttttgaaagaaagttcgttcgtatacgttgattattgggacgattcacaggctttcagaaatat

SEQ ID NO: 302755 - DNA, 75 bp, Artificial Sequence
  Synthetic
atatctaatgtcacttggtgtaccagatatagactcatctgcttatatagaatcgcgtgtttacaatcaagataa

SEQ ID NO: 302756 - DNA, 75 bp, Artificial Sequence
  Synthetic
cagatcgagcgagcttcagacaaaattgcccaaggtgtaataattgcttatagagatatgcaactagaaagagat

SEQ ID NO: 302757 - DNA, 75 bp, Artificial Sequence
  Synthetic
tgttggctcatggccggtgatgccaggagggagtgtgattctaacatttgatggtgtaacgttatcaacgcaatt

SEQ ID NO: 302758 - DNA, 75 bp, Artificial Sequence
  Synthetic
ttactgaataacgaaaaacgtggacaaagtacacagtgggatcaagcagctatcatgtactcgaattacatagtc

SEQ ID NO: 302759 - DNA, 75 bp, Artificial Sequence
  Synthetic
agaataccattcaaaggtaaaataccgtcagtaacatttattttacatatttatgcgaaactacatattataaat

SEQ ID NO: 302760 - DNA, 75 bp, Artificial Sequence
  Synthetic
aatttccgcaaaattattacatcatccaactacagaaattagatcagaattttatttaataatggatatatggga

SEQ ID NO: 302761 - DNA, 75 bp, Artificial Sequence
  Synthetic
aagacaggatttagagagacagctagatgaaatgagaagagaattcaatgaactatcagctaatatagctttgtc

SEQ ID NO: 302762 - DNA, 75 bp, Artificial Sequence
  Synthetic
gatgaaatgagaagagaattcaatgaactatcagctaatatagctttgtcccagctaatagatttagcactattg

SEQ ID NO: 302763 - DNA, 75 bp, Artificial Sequence
  Synthetic
aagaagcaagacattaaagctgaaccggagaacgatcagcaaaattctaaagaaaacaaaacatcgtttaaaaca

SEQ ID NO: 302764 - DNA, 75 bp, Artificial Sequence
  Synthetic
ataatcttaaattagataaacaagtgacgagctcaaaaaaagaagattcgaagcagttaatagaagtattgaaaa

SEQ ID NO: 302765 - DNA, 75 bp, Artificial Sequence
  Synthetic
tatcaatatcattagcttcaaaaccaactggtaataatcatttgtttattttaagtggcacagacaaatatttta

SEQ ID NO: 302766 - DNA, 75 bp, Artificial Sequence
  Synthetic
aataaaattactattaatgatattttacgtgatataaaaccattttttgttaccgctgaagctaatttaccaatt

SEQ ID NO: 302767 - DNA, 75 bp, Artificial Sequence
  Synthetic
gtggacggatataagtgacatagtagactcaacagataatgttgtggcagctacagcaacagccgctgcgaagaa

SEQ ID NO: 302768 - DNA, 75 bp, Artificial Sequence
  Synthetic
gactcaacagataatgttgtggcagctacagcaacagccgctgcgaagaaattcagagttaaagagttcacaacg

SEQ ID NO: 302769 - DNA, 75 bp, Artificial Sequence
  Synthetic
aaaaccagatccagctaaaaaatcagaaaagttattcaggttatttgaaccaaagcaactgccaatttatcgtgc

SEQ ID NO: 302770 - DNA, 75 bp, Artificial Sequence
  Synthetic
catgttttctatgttttcaggaattaaaagcacaattgatataaccaaatcaatggcgactagcgtaatgaaaaa

SEQ ID NO: 302771 - DNA, 75 bp, Artificial Sequence
  Synthetic
catgttttctatgttttcaggaattaaaagcacaattgatttaaccaaatcaatggcgactagcgtaatgaaaaa

SEQ ID NO: 302772 - DNA, 75 bp, Artificial Sequence
  Synthetic
catgttttctatgttttcaggaattaaaagcacaattgatctaaccaaatcaatggcgactagcgtaatgaaaaa

SEQ ID NO: 302773 - DNA, 75 bp, Artificial Sequence
  Synthetic
catgttttctatgttttcaggaattaaaagcacaattgatgtaaccaaatcaatggcgactagcgtaatgaaaaa

SEQ ID NO: 302774 - DNA, 75 bp, Artificial Sequence
  Synthetic
tactcacaggtacttgaatacatgccagactacatgcttctaaaggagatggcagtagagaataagaattcacgt

SEQ ID NO: 302775 - DNA, 75 bp, Artificial Sequence
  Synthetic
tgaggcaaagggtgaatgcagaacgtaatacggtggattatccagctatacttcacccaatagattatgaattca

SEQ ID NO: 302776 - DNA, 75 bp, Artificial Sequence
  Synthetic
gaatatggacgtaaatttgccaccgacagctagatatataagaccagttctgcttcaggacaggctcaatctgca

SEQ ID NO: 302777 - DNA, 75 bp, Artificial Sequence
  Synthetic
tgctgcaacttctactcttgaactaatgggtattcaatacgattataatgaggtgtatactagagtcaagagtaa

SEQ ID NO: 302778 - DNA, 75 bp, Artificial Sequence
  Synthetic
cagattcagaaaatgtcgcaagatttgcaactagaagcgctaacagtccaatcagaaacgcaattcttaacaggt

SEQ ID NO: 302779 - DNA, 75 bp, Artificial Sequence
  Synthetic
atcagaaacgcaattcttaacaggtattaactctcaagcggcgaatgatgcattcaagacgataatagcatgcat

SEQ ID NO: 302780 - DNA, 75 bp, Artificial Sequence
  Synthetic
tattgaatgaatggctgtgcaatcctatggatatatcactttactattatcaacaaaatagcgaatcaaataaat

SEQ ID NO: 302781 - DNA, 75 bp, Artificial Sequence
  Synthetic
taaattctttgcataaaaaatgaatacatttaatgaagtgccattagatctaaataaattggctgaactagtaac

SEQ ID NO: 302782 - DNA, 75 bp, Artificial Sequence
  Synthetic
taaattctttgcataaaaaatgaatacatttaatgaagtgccattagatctaaataaattggctgaacttgtaac

SEQ ID NO: 302783 - DNA, 75 bp, Artificial Sequence
  Synthetic
taaattctttgcataaaaaatgaatacatttaatgaagtgccattagatctaaataaattggctgaactcgtaac

SEQ ID NO: 302784 - DNA, 75 bp, Artificial Sequence
  Synthetic
taaattctttgcataaaaaatgaatacatttaatgaagtgccattagatctaaataaattggctgaactggtaac

SEQ ID NO: 302785 - DNA, 75 bp, Artificial Sequence
  Synthetic
taaattctttgcataaaaaatgaatacatttaatgaagtgccatttgatctaaataaattggctgaactagtaac

SEQ ID NO: 302786 - DNA, 75 bp, Artificial Sequence
  Synthetic
taaattctttgcataaaaaatgaatacatttaatgaagtgccatttgatctaaataaattggctgaacttgtaac

SEQ ID NO: 302787 - DNA, 75 bp, Artificial Sequence
  Synthetic
taaattctttgcataaaaaatgaatacatttaatgaagtgccatttgatctaaataaattggctgaactcgtaac

SEQ ID NO: 302788 - DNA, 75 bp, Artificial Sequence
  Synthetic
taaattctttgcataaaaaatgaatacatttaatgaagtgccatttgatctaaataaattggctgaactggtaac

SEQ ID NO: 302789 - DNA, 75 bp, Artificial Sequence
  Synthetic
taaattctttgcataaaaaatgaatacatttaatgaagtgccattcgatctaaataaattggctgaactagtaac

SEQ ID NO: 302790 - DNA, 75 bp, Artificial Sequence
  Synthetic
taaattctttgcataaaaaatgaatacatttaatgaagtgccattcgatctaaataaattggctgaacttgtaac

SEQ ID NO: 302791 - DNA, 75 bp, Artificial Sequence
  Synthetic
taaattctttgcataaaaaatgaatacatttaatgaagtgccattcgatctaaataaattggctgaactcgtaac

SEQ ID NO: 302792 - DNA, 75 bp, Artificial Sequence
  Synthetic
taaattctttgcataaaaaatgaatacatttaatgaagtgccattcgatctaaataaattggctgaactggtaac

SEQ ID NO: 302793 - DNA, 75 bp, Artificial Sequence
  Synthetic
taaattctttgcataaaaaatgaatacatttaatgaagtgccattggatctaaataaattggctgaactagtaac

SEQ ID NO: 302794 - DNA, 75 bp, Artificial Sequence
  Synthetic
taaattctttgcataaaaaatgaatacatttaatgaagtgccattggatctaaataaattggctgaacttgtaac

SEQ ID NO: 302795 - DNA, 75 bp, Artificial Sequence
  Synthetic
taaattctttgcataaaaaatgaatacatttaatgaagtgccattggatctaaataaattggctgaactcgtaac

SEQ ID NO: 302796 - DNA, 75 bp, Artificial Sequence
  Synthetic
taaattctttgcataaaaaatgaatacatttaatgaagtgccattggatctaaataaattggctgaactggtaac

SEQ ID NO: 302797 - DNA, 75 bp, Artificial Sequence
  Synthetic
taaattctttgcatataaaatgaatacatttaatgaagtgccattagatctaaataaattggctgaactagtaac

SEQ ID NO: 302798 - DNA, 75 bp, Artificial Sequence
  Synthetic
taaattctttgcatataaaatgaatacatttaatgaagtgccattagatctaaataaattggctgaacttgtaac

SEQ ID NO: 302799 - DNA, 75 bp, Artificial Sequence
  Synthetic
taaattctttgcatataaaatgaatacatttaatgaagtgccattagatctaaataaattggctgaactcgtaac

SEQ ID NO: 302800 - DNA, 75 bp, Artificial Sequence
  Synthetic
taaattctttgcatataaaatgaatacatttaatgaagtgccattagatctaaataaattggctgaactggtaac

SEQ ID NO: 302801 - DNA, 75 bp, Artificial Sequence
  Synthetic
taaattctttgcatataaaatgaatacatttaatgaagtgccatttgatctaaataaattggctgaactagtaac

SEQ ID NO: 302802 - DNA, 75 bp, Artificial Sequence
  Synthetic
taaattctttgcatataaaatgaatacatttaatgaagtgccatttgatctaaataaattggctgaacttgtaac

SEQ ID NO: 302803 - DNA, 75 bp, Artificial Sequence
  Synthetic
taaattctttgcatataaaatgaatacatttaatgaagtgccatttgatctaaataaattggctgaactcgtaac

SEQ ID NO: 302804 - DNA, 75 bp, Artificial Sequence
  Synthetic
taaattctttgcatataaaatgaatacatttaatgaagtgccatttgatctaaataaattggctgaactggtaac

SEQ ID NO: 302805 - DNA, 75 bp, Artificial Sequence
  Synthetic
taaattctttgcatataaaatgaatacatttaatgaagtgccattcgatctaaataaattggctgaactagtaac

SEQ ID NO: 302806 - DNA, 75 bp, Artificial Sequence
  Synthetic
taaattctttgcatataaaatgaatacatttaatgaagtgccattcgatctaaataaattggctgaacttgtaac

SEQ ID NO: 302807 - DNA, 75 bp, Artificial Sequence
  Synthetic
taaattctttgcatataaaatgaatacatttaatgaagtgccattcgatctaaataaattggctgaactcgtaac

SEQ ID NO: 302808 - DNA, 75 bp, Artificial Sequence
  Synthetic
taaattctttgcatataaaatgaatacatttaatgaagtgccattcgatctaaataaattggctgaactggtaac

SEQ ID NO: 302809 - DNA, 75 bp, Artificial Sequence
  Synthetic
taaattctttgcatataaaatgaatacatttaatgaagtgccattggatctaaataaattggctgaactagtaac

SEQ ID NO: 302810 - DNA, 75 bp, Artificial Sequence
  Synthetic
taaattctttgcatataaaatgaatacatttaatgaagtgccattggatctaaataaattggctgaacttgtaac

SEQ ID NO: 302811 - DNA, 75 bp, Artificial Sequence
  Synthetic
taaattctttgcatataaaatgaatacatttaatgaagtgccattggatctaaataaattggctgaactcgtaac

SEQ ID NO: 302812 - DNA, 75 bp, Artificial Sequence
  Synthetic
taaattctttgcatataaaatgaatacatttaatgaagtgccattggatctaaataaattggctgaactggtaac

SEQ ID NO: 302813 - DNA, 75 bp, Artificial Sequence
  Synthetic
taaattctttgcatacaaaatgaatacatttaatgaagtgccattagatctaaataaattggctgaactagtaac

SEQ ID NO: 302814 - DNA, 75 bp, Artificial Sequence
  Synthetic
taaattctttgcatacaaaatgaatacatttaatgaagtgccattagatctaaataaattggctgaacttgtaac

SEQ ID NO: 302815 - DNA, 75 bp, Artificial Sequence
  Synthetic
taaattctttgcatacaaaatgaatacatttaatgaagtgccattagatctaaataaattggctgaactcgtaac

SEQ ID NO: 302816 - DNA, 75 bp, Artificial Sequence
  Synthetic
taaattctttgcatacaaaatgaatacatttaatgaagtgccattagatctaaataaattggctgaactggtaac

SEQ ID NO: 302817 - DNA, 75 bp, Artificial Sequence
  Synthetic
taaattctttgcatacaaaatgaatacatttaatgaagtgccatttgatctaaataaattggctgaactagtaac

SEQ ID NO: 302818 - DNA, 75 bp, Artificial Sequence
  Synthetic
taaattctttgcatacaaaatgaatacatttaatgaagtgccatttgatctaaataaattggctgaacttgtaac

SEQ ID NO: 302819 - DNA, 75 bp, Artificial Sequence
  Synthetic
taaattctttgcatacaaaatgaatacatttaatgaagtgccatttgatctaaataaattggctgaactcgtaac

SEQ ID NO: 302820 - DNA, 75 bp, Artificial Sequence
  Synthetic
taaattctttgcatacaaaatgaatacatttaatgaagtgccatttgatctaaataaattggctgaactggtaac

SEQ ID NO: 302821 - DNA, 75 bp, Artificial Sequence
  Synthetic
taaattctttgcatacaaaatgaatacatttaatgaagtgccattcgatctaaataaattggctgaactagtaac

SEQ ID NO: 302822 - DNA, 75 bp, Artificial Sequence
  Synthetic
taaattctttgcatacaaaatgaatacatttaatgaagtgccattcgatctaaataaattggctgaacttgtaac

SEQ ID NO: 302823 - DNA, 75 bp, Artificial Sequence
  Synthetic
taaattctttgcatacaaaatgaatacatttaatgaagtgccattcgatctaaataaattggctgaactcgtaac

SEQ ID NO: 302824 - DNA, 75 bp, Artificial Sequence
  Synthetic
taaattctttgcatacaaaatgaatacatttaatgaagtgccattcgatctaaataaattggctgaactggtaac

SEQ ID NO: 302825 - DNA, 75 bp, Artificial Sequence
  Synthetic
taaattctttgcatacaaaatgaatacatttaatgaagtgccattggatctaaataaattggctgaactagtaac

SEQ ID NO: 302826 - DNA, 75 bp, Artificial Sequence
  Synthetic
taaattctttgcatacaaaatgaatacatttaatgaagtgccattggatctaaataaattggctgaacttgtaac

SEQ ID NO: 302827 - DNA, 75 bp, Artificial Sequence
  Synthetic
taaattctttgcatacaaaatgaatacatttaatgaagtgccattggatctaaataaattggctgaactcgtaac

SEQ ID NO: 302828 - DNA, 75 bp, Artificial Sequence
  Synthetic
taaattctttgcatacaaaatgaatacatttaatgaagtgccattggatctaaataaattggctgaactggtaac

SEQ ID NO: 302829 - DNA, 75 bp, Artificial Sequence
  Synthetic
taaattctttgcatagaaaatgaatacatttaatgaagtgccattagatctaaataaattggctgaactagtaac

SEQ ID NO: 302830 - DNA, 75 bp, Artificial Sequence
  Synthetic
taaattctttgcatagaaaatgaatacatttaatgaagtgccattagatctaaataaattggctgaacttgtaac

SEQ ID NO: 302831 - DNA, 75 bp, Artificial Sequence
  Synthetic
taaattctttgcatagaaaatgaatacatttaatgaagtgccattagatctaaataaattggctgaactcgtaac

SEQ ID NO: 302832 - DNA, 75 bp, Artificial Sequence
  Synthetic
taaattctttgcatagaaaatgaatacatttaatgaagtgccattagatctaaataaattggctgaactggtaac

SEQ ID NO: 302833 - DNA, 75 bp, Artificial Sequence
  Synthetic
taaattctttgcatagaaaatgaatacatttaatgaagtgccatttgatctaaataaattggctgaactagtaac

SEQ ID NO: 302834 - DNA, 75 bp, Artificial Sequence
  Synthetic
taaattctttgcatagaaaatgaatacatttaatgaagtgccatttgatctaaataaattggctgaacttgtaac

SEQ ID NO: 302835 - DNA, 75 bp, Artificial Sequence
  Synthetic
taaattctttgcatagaaaatgaatacatttaatgaagtgccatttgatctaaataaattggctgaactcgtaac

SEQ ID NO: 302836 - DNA, 75 bp, Artificial Sequence
  Synthetic
taaattctttgcatagaaaatgaatacatttaatgaagtgccatttgatctaaataaattggctgaactggtaac

SEQ ID NO: 302837 - DNA, 75 bp, Artificial Sequence
  Synthetic
taaattctttgcatagaaaatgaatacatttaatgaagtgccattcgatctaaataaattggctgaactagtaac

SEQ ID NO: 302838 - DNA, 75 bp, Artificial Sequence
  Synthetic
taaattctttgcatagaaaatgaatacatttaatgaagtgccattcgatctaaataaattggctgaacttgtaac

SEQ ID NO: 302839 - DNA, 75 bp, Artificial Sequence
  Synthetic
taaattctttgcatagaaaatgaatacatttaatgaagtgccattcgatctaaataaattggctgaactcgtaac

SEQ ID NO: 302840 - DNA, 75 bp, Artificial Sequence
  Synthetic
taaattctttgcatagaaaatgaatacatttaatgaagtgccattcgatctaaataaattggctgaactggtaac

SEQ ID NO: 302841 - DNA, 75 bp, Artificial Sequence
  Synthetic
taaattctttgcatagaaaatgaatacatttaatgaagtgccattggatctaaataaattggctgaactagtaac

SEQ ID NO: 302842 - DNA, 75 bp, Artificial Sequence
  Synthetic
taaattctttgcatagaaaatgaatacatttaatgaagtgccattggatctaaataaattggctgaacttgtaac

SEQ ID NO: 302843 - DNA, 75 bp, Artificial Sequence
  Synthetic
taaattctttgcatagaaaatgaatacatttaatgaagtgccattggatctaaataaattggctgaactcgtaac

SEQ ID NO: 302844 - DNA, 75 bp, Artificial Sequence
  Synthetic
taaattctttgcatagaaaatgaatacatttaatgaagtgccattggatctaaataaattggctgaactggtaac

SEQ ID NO: 302845 - DNA, 75 bp, Artificial Sequence
  Synthetic
ctacggacgtggatacatttgagattgttgcgtcgtctgaaaaattggtaattactgatgttgtaaatggtgtta

SEQ ID NO: 302846 - DNA, 75 bp, Artificial Sequence
  Synthetic
acgttcaatggaattatccgatgatgttaaggccgatattgaacaacaattaaattcaatagaccagctgaatcc

SEQ ID NO: 302847 - DNA, 75 bp, Artificial Sequence
  Synthetic
tgctaacagagtcggacagcttgtggacttgactcgtcttatgtgttataattacgagacactaatgtcatgcat

SEQ ID NO: 302848 - DNA, 75 bp, Artificial Sequence
  Synthetic
ccagagccgcgcaccttattccactattatcaaactaacgtgaatttccataataattataatgaaaggataaac

SEQ ID NO: 302849 - DNA, 75 bp, Artificial Sequence
  Synthetic
aatacaaatgataactcaagaggaatgaattatgagactacaatgtttaacaaggtggcggtgctaatttgtgaa

SEQ ID NO: 302850 - DNA, 75 bp, Artificial Sequence
  Synthetic
acgtggcaaaggtacctgatgatcaaatgtataggttgcgtgatagactcagacgcttgccagtggaaaggagac

SEQ ID NO: 302851 - DNA, 75 bp, Artificial Sequence
  Synthetic
actgttataccaaatgatatgtttcttcgtgaatcactagtcgcatgcgaattggctataataaatactatagtt

SEQ ID NO: 302852 - DNA, 75 bp, Artificial Sequence
  Synthetic
cctagactacgatgaattatatggatttgtcaacttagcgcgcgatgttaatggttaccaacagattaacttaga

SEQ ID NO: 302853 - DNA, 75 bp, Artificial Sequence
  Synthetic
gctgtaacgtcattgatagcaaaactagacgccacagtcttcgcacagattgtcaagcagagaaaggtagatacg

SEQ ID NO: 302854 - DNA, 75 bp, Artificial Sequence
  Synthetic
actccgactcgaatgatttttacctcgtcgtcaattacaattggataccgacttcaacaacgaaggtgtttaaac

SEQ ID NO: 302855 - DNA, 75 bp, Artificial Sequence
  Synthetic
tggtagattttctcttatttcattagtaccgtctaatgacgattatcaaactccaatcatgaattcagttacagt

SEQ ID NO: 302856 - DNA, 75 bp, Artificial Sequence
  Synthetic
aaagaaatgagacgtcaattggaaatgattgataaattaactactcgtgaaattgaacaggttgagttacttaaa

SEQ ID NO: 302857 - DNA, 75 bp, Artificial Sequence
  Synthetic
tggatcattatcaaacgctgcttcatcagtttccagaagttcatctattagatctaacatatcatccatttcagt

SEQ ID NO: 302858 - DNA, 75 bp, Artificial Sequence
  Synthetic
agaacgctagatgaatgggaaagtggaaaaaatccatatgaaccatcagaagtgactgcatctatgtgagaggtt

SEQ ID NO: 302859 - DNA, 75 bp, Artificial Sequence
  Synthetic
gtggaggttcttacagttttgcgttacctgtaggcaatcatccagtgatgagtggtggcgcagtgaccttaacat

SEQ ID NO: 302860 - DNA, 75 bp, Artificial Sequence
  Synthetic
aaataataatgaccgaatgcaagagaaggatgatgagaaacaagatcaaaacaatagaatgcaattgtctgataa

SEQ ID NO: 302861 - DNA, 75 bp, Artificial Sequence
  Synthetic
aaattgctgacgaagtgaagaaatcaacgaaagaagaatctaaacaattacttgaaatattgaaaacaaaagaag

SEQ ID NO: 302862 - DNA, 75 bp, Artificial Sequence
  Synthetic
ggcttttaaacgaagtcttcaacatggatgtcctgtactcattgtcaaaaactcttaaagatgctagagacaaaa

SEQ ID NO: 302863 - DNA, 75 bp, Artificial Sequence
  Synthetic
tggaacaactctactaaatttagacgctaactacgttgaaacggcccgtaatacaattgattattttgtagattt

SEQ ID NO: 302864 - DNA, 75 bp, Artificial Sequence
  Synthetic
cacaagacgatgttaaaatagctgatgaagttaaaaagtcatcaaaagaagagtcaaaacaactacttgagatac

SEQ ID NO: 302865 - DNA, 75 bp, Artificial Sequence
  Synthetic
acagaaaaattgcagttaacttcagtcacgtcgttgtgtatgcttattggaaatgcaaccgttatacccagtcca

SEQ ID NO: 302866 - DNA, 75 bp, Artificial Sequence
  Synthetic
taattatattatataatagtattactatatcgcgttattgaatttaataatttttaatgagagaagattaatgcg

SEQ ID NO: 302867 - DNA, 75 bp, Artificial Sequence
  Synthetic
tacgtgtactattaggaattgcaagaaattaggaccaagagagaacgtagctgtaattcaagttggaggttctga

SEQ ID NO: 302868 - DNA, 75 bp, Artificial Sequence
  Synthetic
actgatacaaatacgtttgaagaagttgcaacagctgaaaaattagtgattactgacgttgtagatagagtcaat

SEQ ID NO: 302869 - DNA, 75 bp, Artificial Sequence
  Synthetic
aaatactattgtttatccagcattcggaatgcaaagaatgcattataggaatggtgatcctcagaccccatttca

SEQ ID NO: 302870 - DNA, 75 bp, Artificial Sequence
  Synthetic
taataacggacgttgttgatggagtgaactataaggtaaacgtcactactacaacatgtaccattagaaattgta

SEQ ID NO: 302871 - DNA, 75 bp, Artificial Sequence
  Synthetic
tttttcagttgatccgcaactgtattgcgattataacgtagtactaatgaaatatgatgcaactctacagttgga

SEQ ID NO: 302872 - DNA, 75 bp, Artificial Sequence
  Synthetic
aaaaactacagttaacctctgtcacatctctatgtatgttgattggaaatactacagtcattccgagtccacaaa

SEQ ID NO: 302873 - DNA, 75 bp, Artificial Sequence
  Synthetic
atgtccaaaagatcacgatcactaaattctgccgcattttactacagagtttaggtatagcttagattagaattg

SEQ ID NO: 302874 - DNA, 75 bp, Artificial Sequence
  Synthetic
aaatccatttaaagggttgtcaactgatagaaagatggatgaagtttcacacgttggaatttaattcgctttcga

SEQ ID NO: 302875 - DNA, 75 bp, Artificial Sequence
  Synthetic
tacaaaataaaattagttcacttgtgtcttcagttgaatggtacctgaaatcaatggaattgcctgatgaaatta

SEQ ID NO: 302876 - DNA, 75 bp, Artificial Sequence
  Synthetic
aaatatggtgtaccaaggcacaacgcgaaatatagatatgaatatgaagtaatgaaagataagccgtactacttg

SEQ ID NO: 302877 - DNA, 75 bp, Artificial Sequence
  Synthetic
gcttgctttcattatagaagaattacaaagctaaacagagagttgctgaggattggagcgaactcagtatggacc

SEQ ID NO: 302878 - DNA, 75 bp, Artificial Sequence
  Synthetic
ggtgtatccaaaataaacgttgctttctagacaatgagccgcatcttttaaaactcagaacttttgaatctccaa

SEQ ID NO: 302879 - DNA, 75 bp, Artificial Sequence
  Synthetic
gaaatgtagaaatgaacttgaccaatcatggtataatcaactattacttccaatcactctaaatgctgcagtgtt

SEQ ID NO: 302880 - DNA, 75 bp, Artificial Sequence
  Synthetic
gataaattactattggatcaaataaattttgaaaggatgagttctcttccggatggcttacaatccatctacgca

SEQ ID NO: 302881 - DNA, 75 bp, Artificial Sequence
  Synthetic
ctattactcagatttctctaaacagaatttaattaataagtataaaactaaaagccgcgtagtcattagaaacct

SEQ ID NO: 302882 - DNA, 75 bp, Artificial Sequence
  Synthetic
ggagaataaaagctgatatttttgaacttggacatcattgcaaaccaaattacatctcatcaaatcattggcaac

SEQ ID NO: 302883 - DNA, 75 bp, Artificial Sequence
  Synthetic
caatgtataatgaacttttaagcttcatccaatcttgttataaaagtaatattaatgtagggcattgtagttcta

SEQ ID NO: 302884 - DNA, 75 bp, Artificial Sequence
  Synthetic
acaagtggatggacagcaggtaattagctttcactggcaaatagatattgcgttatacatgcatattaaaatgat

SEQ ID NO: 302885 - DNA, 75 bp, Artificial Sequence
  Synthetic
ctataattaaaggaatcgtgaatcaatggtgtgacgtcactgaattagatcagttaccgttatgcactgaacaaa

SEQ ID NO: 302886 - DNA, 75 bp, Artificial Sequence
  Synthetic
taattactaacgcagtttttgccatcacaagaccttctggactagagtagcgcctaggaagcaaaaactgtgacc

SEQ ID NO: 302887 - DNA, 75 bp, Artificial Sequence
  Synthetic
tgaaagtactagctttaagacacagtgtggctcaggtatatgcagacactcaagtctatactcatgatgatacga

SEQ ID NO: 302888 - DNA, 75 bp, Artificial Sequence
  Synthetic
gagctactacatggtattttaatccagtaattcttagaccaaataacgttgaagtagagtttctgttgaatgggc

SEQ ID NO: 302889 - DNA, 75 bp, Artificial Sequence
  Synthetic
agtaattcttagaccaaataacgttgaagtagagtttctgttgaatgggcaaataataaatacttatcaagcaag

SEQ ID NO: 302890 - DNA, 75 bp, Artificial Sequence
  Synthetic
aacaattctcaaatggtccatatttagttaaaaataccattaaattgaaacaggagaggtggttaggaaagagag

SEQ ID NO: 302891 - DNA, 75 bp, Artificial Sequence
  Synthetic
gatcgagatcattaaattctgctgcattttattacagagtatagatatagcttagattagaattgtatgatgtga

SEQ ID NO: 302892 - DNA, 75 bp, Artificial Sequence
  Synthetic
gtgtttacagtggcttccattagaagcatgcttattaaatgaggaccaagctaactacttggtatccgaacttga

SEQ ID NO: 302893 - DNA, 75 bp, Artificial Sequence
  Synthetic
ttgaactttgtaagtaaggatgtatttgtgcattcgctacacagagtaatcactcagatggcatagtgagaggat

SEQ ID NO: 302894 - DNA, 75 bp, Artificial Sequence
  Synthetic
gacaaattatttaagacgttggtatcagatcattacagagtagttaacgtcggaccaaggaatgaatctatgttt

SEQ ID NO: 302895 - DNA, 75 bp, Artificial Sequence
  Synthetic
gcatatcagtatttagctactggtaagtcaaaagtatgctgtgttaaattgacagctatggatttagaacttccc

SEQ ID NO: 302896 - DNA, 75 bp, Artificial Sequence
  Synthetic
tattgatgatattgtttatctccatgactattcatattacactaacaatgaaataaggactgaccagcattgggt

SEQ ID NO: 302897 - DNA, 75 bp, Artificial Sequence
  Synthetic
gagattgtcaaatcgtgtgtttagggacaaattatttaagacattagtatcagatcattatagagtagttaatat

SEQ ID NO: 302898 - DNA, 75 bp, Artificial Sequence
  Synthetic
acaggaaacaatcatttgtttattttaaatggaacagaaaaatattataagttggatcagttcgcaaatcataca

SEQ ID NO: 302899 - DNA, 75 bp, Artificial Sequence
  Synthetic
tttaataatagagaggatgtgataaaattaattaataatcagaaagacgcattgataactgtgaggattaataat

SEQ ID NO: 302900 - DNA, 75 bp, Artificial Sequence
  Synthetic
atctaaagtttgagacatgggatccactagatacgccatactctgatttacatcataaagaactattttttataa

SEQ ID NO: 302901 - DNA, 75 bp, Artificial Sequence
  Synthetic
gtgatgtaaacaaacttaaagatgaatcaatattatatatagatatacggacggataagggagatacggattgga

SEQ ID NO: 302902 - DNA, 75 bp, Artificial Sequence
  Synthetic
tagatcagcgaaggagtttgctttactgcaagatgatttaacagtattacgatacgccaatgaaatcgagagtta

SEQ ID NO: 302903 - DNA, 75 bp, Artificial Sequence
  Synthetic
cggacctgatggctgactgagaagccacagtcagccatatcgcgtgtggcttaagccttaatcccgtttaaccaa

SEQ ID NO: 302904 - DNA, 75 bp, Artificial Sequence
  Synthetic
ttatttaataatggatctctgggattctaagaacatcaagcgatttataccaaaaggcgtactgtactcatatat

SEQ ID NO: 302905 - DNA, 75 bp, Artificial Sequence
  Synthetic
ttaacaatcagaagaatgcgttaataactgtaaggattaataatacatttaaagatgaaccaaaagtaggtttta

SEQ ID NO: 302906 - DNA, 75 bp, Artificial Sequence
  Synthetic
aacaatcatttgttcattttaagcggtactaataaatattttaaattggatcaatttgcaaatcatatgagtata

SEQ ID NO: 302907 - DNA, 75 bp, Artificial Sequence
  Synthetic
catctaacatttggtgtattaagcatttcagactcgacggtgtcagatgtagtagcaattttgaagaaatttaag

SEQ ID NO: 302908 - DNA, 75 bp, Artificial Sequence
  Synthetic
taatgatgcagtagctataataactgctgctaatagattgaatctatatcagaaaaaaatgaaggctattgttga

SEQ ID NO: 302909 - DNA, 75 bp, Artificial Sequence
  Synthetic
attacacatggtaaaggtcactacagagttgtaaaatattcatcagttgcaaaccatgcagatagagtttacgct

SEQ ID NO: 302910 - DNA, 75 bp, Artificial Sequence
  Synthetic
catgtatcatgtttgtcaatggtgcagtcaatatggtagatgctttcttgataatgaaccgcatttattaagaat

SEQ ID NO: 302911 - DNA, 75 bp, Artificial Sequence
  Synthetic
aactttataatgcattctataaagagcaaattacattcgggcaatcgagaatgtttattccacatataacattga

SEQ ID NO: 302912 - DNA, 75 bp, Artificial Sequence
  Synthetic
ggaagataaaaggtgatacagtgtttgatatgactgagtgagctaaaaacttaacacactagtcatgatgtgacc

SEQ ID NO: 302913 - DNA, 75 bp, Artificial Sequence
  Synthetic
aagtttgattatgtaatggatgactctggtgtcaagaacaatctcttaggtaaggctatgactattgatcaagca

SEQ ID NO: 302914 - DNA, 75 bp, Artificial Sequence
  Synthetic
ccaacagctgaagaatatactgattctttgatggatccggctattctaacgtcattatcttcaaatctcaatgct

SEQ ID NO: 302915 - DNA, 75 bp, Artificial Sequence
  Synthetic
gaagatgtgaataaacttagaatgatgttgtcttctaaaggaattgatcaaaaaatgagagtacttaatgcttgt

SEQ ID NO: 302916 - DNA, 75 bp, Artificial Sequence
  Synthetic
attgtcagatgaaattagaacaattggatcagaaaagaatcaaaacgtaacaattaaccctggtccgtttgctca

SEQ ID NO: 302917 - DNA, 75 bp, Artificial Sequence
  Synthetic
cgcaaaatataggtatgaatacgaagtaatgaaagataaaccatattatttagtaacctgggcgaactcatcaat

SEQ ID NO: 302918 - DNA, 75 bp, Artificial Sequence
  Synthetic
tttagtgtaaaaagaataccgggaaaatcatcatctgtcattaagtgcactagattaatgaaagataagatagaa

SEQ ID NO: 302919 - DNA, 75 bp, Artificial Sequence
  Synthetic
ccacctaatgattattggatattattaaatccaaccaatcaagccatcgtattagagggcactaatagaactgat

SEQ ID NO: 302920 - DNA, 75 bp, Artificial Sequence
  Synthetic
gtcatgttttggttggagaaacacgaaaatgatactgctgaaagacttaaaatttataaaaggagattggacttg

SEQ ID NO: 302921 - DNA, 75 bp, Artificial Sequence
  Synthetic
ctgatttgcagggtaaaatcggttcactagtgtcatcggttgagtggtatctgagatctatggaattgtcagatg

SEQ ID NO: 302922 - DNA, 75 bp, Artificial Sequence
  Synthetic
caaataagtggaaattctttgaaatgtttagaaacaatattaattctgagtttcaacataaacgtactttaacat

SEQ ID NO: 302923 - DNA, 75 bp, Artificial Sequence
  Synthetic
tttatcatttatatacaattcacaatctgcagttcaaattccgatttattattcttccaatagtgaactggaaag

SEQ ID NO: 302924 - DNA, 75 bp, Artificial Sequence
  Synthetic
tgtcgctaacgaaactcttcatagaatataatgacgttatagaaaatgctacgttgttatcaattctatcatact

SEQ ID NO: 302925 - DNA, 75 bp, Artificial Sequence
  Synthetic
cttgtctgaaatagagactgtgatacacgctgaattttatataataccaagatcacaagagtctaagtgtaatga

SEQ ID NO: 302926 - DNA, 75 bp, Artificial Sequence
  Synthetic
atggcttcgctcatatacagacagctgctcgctaattcttatgcagtgaatttgtctgatgagatacagtcagtt

SEQ ID NO: 302927 - DNA, 75 bp, Artificial Sequence
  Synthetic
cagtaaatgaattagattatgaaaataataaaataacctctgagctatttccaacagcggaagagtatactgatt

SEQ ID NO: 302928 - DNA, 75 bp, Artificial Sequence
  Synthetic
tttgtctgatgagatacagtcagttggatcaggaaagaaccaacgcgttacagtgaatccaggaccatttgcgca

SEQ ID NO: 302929 - DNA, 75 bp, Artificial Sequence
  Synthetic
ttcggttaatggtgtaaataatttcagttacaatgggggatcactaccaactgattttagcgtatcaagatatga

SEQ ID NO: 302930 - DNA, 75 bp, Artificial Sequence
  Synthetic
tacgttgattattgggatgactcgcaagcgttcagaaatatggtgtacgttagatcattggcagcaaatttgaat

SEQ ID NO: 302931 - DNA, 75 bp, Artificial Sequence
  Synthetic
ccacgaccaaaggatactttataacgaattacgcatcggctgaggtaaggccatatagtgacttctatataattt

SEQ ID NO: 302932 - DNA, 75 bp, Artificial Sequence
  Synthetic
aattaaaccaagagaagtgcaggctaatgaagatattgtagtttctaagacttcactatggaaagaaatgcaata

SEQ ID NO: 302933 - DNA, 75 bp, Artificial Sequence
  Synthetic
ttctcttatttccttagttccatctaacgacgattatcaaactccaatcatgaattcagttacagtacgtcagga

SEQ ID NO: 302934 - DNA, 75 bp, Artificial Sequence
  Synthetic
tgcatgagaacgaaatacaattatacctaatttcattaggtataccaaaaatagacgctgatacatacgttgggt

SEQ ID NO: 302935 - DNA, 75 bp, Artificial Sequence
  Synthetic
atgttttctatgttttcaggcattaaaagtacaattgacgtagctaaatctatggctacaaatgtaatgaagaag

SEQ ID NO: 302936 - DNA, 75 bp, Artificial Sequence
  Synthetic
caatctctgagttgactggatcactgtcaagtgctgcttcatcaatttctaggaattcatctattagatccaaca

SEQ ID NO: 302937 - DNA, 75 bp, Artificial Sequence
  Synthetic
tgacattatctacacaattcaccgacttcgtgtcgttgaattcactaagatttaggtttagactggcggttgagg

SEQ ID NO: 302938 - DNA, 75 bp, Artificial Sequence
  Synthetic
aaatttccgcactattaacaatgctccaaaaaccagtgacatttaaatcaaacaagattacaatcaatgacattt

SEQ ID NO: 302939 - DNA, 75 bp, Artificial Sequence
  Synthetic
aaagatgacgaggtgatggaagctgatatggatggtaaatttttcgcatataaagttgatacttttgaagaaata

SEQ ID NO: 302940 - DNA, 75 bp, Artificial Sequence
  Synthetic
gagttattcagactctaaatttatataagcaaacacagattaatttaatgaattcatacgttcaaataccagatg

SEQ ID NO: 302941 - DNA, 75 bp, Artificial Sequence
  Synthetic
cacaagagatagccgtgtcacagttaattgacttagctatgttgccactagacatgttttcgatgttctcgggaa

SEQ ID NO: 302942 - DNA, 75 bp, Artificial Sequence
  Synthetic
aattgacttagctatgttgccactagacatgttttcgatgttctcgggaattgagagtaccgtgaatgcagcaaa

SEQ ID NO: 302943 - DNA, 75 bp, Artificial Sequence
  Synthetic
gtataacacgctctcaagcgttagatttaattagatctgatcccagagttttacgtgactttattaaccaaaata

SEQ ID NO: 302944 - DNA, 75 bp, Artificial Sequence
  Synthetic
tttaattagatctgatcccagagttttacgtgactttattaaccaaaataatccaattattaaaaacagaattga

SEQ ID NO: 302945 - DNA, 75 bp, Artificial Sequence
  Synthetic
tatggtattgaatataccacaattctaatcttcttgatatcggttacattgttgaattatatattaaaatcaata

SEQ ID NO: 302946 - DNA, 75 bp, Artificial Sequence
  Synthetic
acgagaataatggactatataatctacagatttttatttacagtagtaatactggccacaataacaaatgcacaa

SEQ ID NO: 302947 - DNA, 75 bp, Artificial Sequence
  Synthetic
atccagtcgaagcatcaaatgaaatagctgatactgaatggaaaaatacactgtcacagctgtttctgactaaag

SEQ ID NO: 302948 - DNA, 75 bp, Artificial Sequence
  Synthetic
tgcaattatcacgacaacaatttccaacgatgccagttgattataaaaggtcaattcaacgtggaatattgttat

SEQ ID NO: 302949 - DNA, 75 bp, Artificial Sequence
  Synthetic
tgctaaattagaagttataaactacgctattaagaatggttcatggataagtttgttctgtaattatccaaaatc

SEQ ID NO: 302950 - DNA, 75 bp, Artificial Sequence
  Synthetic
ggaaatgataaaactatggaagaaaatgtggaatattacatcattacgatcaccatatactaatgcgaatttctt

SEQ ID NO: 302951 - DNA, 75 bp, Artificial Sequence
  Synthetic
ctctaacttttctaatattgcttgtattattgaattacatattaaaatcaataaccagaatcatggactacatac

SEQ ID NO: 302952 - DNA, 75 bp, Artificial Sequence
  Synthetic
caaaccgacgaagcgaataaatggatatcaatgggttcatcttgtacggttaaagtatgtccattgaacacgcaa

SEQ ID NO: 302953 - DNA, 75 bp, Artificial Sequence
  Synthetic
agaacaagcaaaaaaacaaactaaattatttagaatatttgaacctaaacaattaccaatatatagagcgaatgg

SEQ ID NO: 302954 - DNA, 75 bp, Artificial Sequence
  Synthetic
tcaaaatgtgtctaatccggaaccgtttttaacatcaacgctatgcctgtattatccagtagaagcagagacaga

SEQ ID NO: 302955 - DNA, 75 bp, Artificial Sequence
  Synthetic
gtggtggtgattacagtttcgcattaccagtaggcgcatacccagtaatgagtggtggcgcagtgacactatcac

SEQ ID NO: 302956 - DNA, 75 bp, Artificial Sequence
  Synthetic
aaggatggccaactggttctgtttatcttaaaagctatacagatattgcgactttttcaataaacccgcaactat

SEQ ID NO: 302957 - DNA, 75 bp, Artificial Sequence
  Synthetic
ctggtatagctgcagttgaagtacaatcatcagacgaattatttgcattaatcaggtgtaatttcacatatgatt

SEQ ID NO: 302958 - DNA, 75 bp, Artificial Sequence
  Synthetic
tacttaatgagtggctttgtaatccaatggacatagcattgtactactatcaacagacggatgaggcaaacaagt

SEQ ID NO: 302959 - DNA, 75 bp, Artificial Sequence
  Synthetic
gatcagttgtaccagatcttaaagaattagtatctacagaggctcaaatacagaaaatgtcacaagatttgcagc

SEQ ID NO: 302960 - DNA, 75 bp, Artificial Sequence
  Synthetic
tacgttaaccagataattcaagcaatgtccaagagatctaggtcgctaaattcatcagcgttttattacagagta

SEQ ID NO: 302961 - DNA, 75 bp, Artificial Sequence
  Synthetic
gacggatttcagcaaataaatttagaagaattaatgagaacaggtgattatgcacaaataactaatatgctttta

SEQ ID NO: 302962 - DNA, 75 bp, Artificial Sequence
  Synthetic
tttcaggaatgtggctgttaacggttatacctaatgatatgtttatacgtgaatctttagtggcgtgtcagttgg

SEQ ID NO: 302963 - DNA, 75 bp, Artificial Sequence
  Synthetic
tgttgaattacgtgcttaaatcattaactagaataatggacttcattatctacagatttcttttaattatagttg

SEQ ID NO: 302964 - DNA, 75 bp, Artificial Sequence
  Synthetic
tatattggatattacggcagatccaacaacagcaccacaaacagaaagaatgatgagaataaattggaagaaatg

SEQ ID NO: 302965 - DNA, 75 bp, Artificial Sequence
  Synthetic
acaagaacgatggctaggtaagaaagtctctcaatttgatatcggacagtacaaaaatatgctgaatgtaattac

SEQ ID NO: 302966 - DNA, 75 bp, Artificial Sequence
  Synthetic
aacaaacaattgataatttgaacatcgcatataagtacttatcgacaggaaaggcgaaagtatgctgtgttaagt

SEQ ID NO: 302967 - DNA, 75 bp, Artificial Sequence
  Synthetic
tattagtactataaagagatttataccgaaaggtgtattctacgctttcataaataacgtaattacagagaatgt

SEQ ID NO: 302968 - DNA, 75 bp, Artificial Sequence
  Synthetic
aagttaggaccaagagaaaatgtagcgattatacaagtcggtggttcagatgtgttagatattacagcggatcca

SEQ ID NO: 302969 - DNA, 75 bp, Artificial Sequence
  Synthetic
taaataacgtaattacagagaatgtattcatacaacctccattcaaattgaaagtatcaccgaatgactacatag

SEQ ID NO: 302970 - DNA, 75 bp, Artificial Sequence
  Synthetic
taactgaccccgattggacgaacacactgtcacaacttttcctgactaaaggatggccgacaaattccgtctact

SEQ ID NO: 302971 - DNA, 75 bp, Artificial Sequence
  Synthetic
cactggaaataaccatctgtttataataagtgggactaacaagtattataaattagatcagtatgcaaatcatat

SEQ ID NO: 302972 - DNA, 75 bp, Artificial Sequence
  Synthetic
gtctaataaagaagaatctaagcaattactagaagttttaaaaactaaagaagagcatcagaaagaagttcaata

SEQ ID NO: 302973 - DNA, 75 bp, Artificial Sequence
  Synthetic
ataggaattaagcttgacaacataccgtatgaatatgatgtgaaagttccacatttgacatttggagtattattc

SEQ ID NO: 302974 - DNA, 75 bp, Artificial Sequence
  Synthetic
ctgacaatgtgtatgtggcaaatgttagtggtgtattgtcaacatatttcagattatataatgtgttctatagaa

SEQ ID NO: 302975 - DNA, 75 bp, Artificial Sequence
  Synthetic
agctttagtaacaagcgaacgattagaattgagactacaaagcttaaaattaattctatttatctgaggaaaatt

SEQ ID NO: 302976 - DNA, 75 bp, Artificial Sequence
  Synthetic
atggctacgttcaaagatgctagttattactacaagaggttgaacaaattgaattatgcagtcttgaaattagga

SEQ ID NO: 302977 - DNA, 75 bp, Artificial Sequence
  Synthetic
agttaactatccatcaatattacacccaattgatcatgctttcaatgagtattttttgcaacaccaattagttga

SEQ ID NO: 302978 - DNA, 75 bp, Artificial Sequence
  Synthetic
tctaacttcgactttatgtttgtattacccaactgaagctgcaacagaaataaacgataattcatggaaagatac

SEQ ID NO: 302979 - DNA, 75 bp, Artificial Sequence
  Synthetic
tatatcatgtttgtcagtggtgcaatcaatatggtagatgctttcttgataatgaaccgcatttattgagaatga

SEQ ID NO: 302980 - DNA, 75 bp, Artificial Sequence
  Synthetic
ttttgaatctttgtgggatactataacaacatcaaattacatcttagctagatcggttgtaccagacttaaaaga

SEQ ID NO: 302981 - DNA, 75 bp, Artificial Sequence
  Synthetic
aatcaaatgatagtaactatgaatggaaatgactttcaaactggaggaattggcaatttacccattagaaattgg

SEQ ID NO: 302982 - DNA, 75 bp, Artificial Sequence
  Synthetic
taataatacaaaacaacataagtgtagaaatgaacttgtgccgcaatggtacaatcacttactgatgccaataac

SEQ ID NO: 302983 - DNA, 75 bp, Artificial Sequence
  Synthetic
tcacaagctgctaatgattgttttaaaacgttgattgctgctatgcttagccagcgcactatgtcattagatttc

SEQ ID NO: 302984 - DNA, 75 bp, Artificial Sequence
  Synthetic
tgttaaaacacaaaattatggaattaatttaccgattactggttccatggatacagcatatgcaaattcatcaca

SEQ ID NO: 302985 - DNA, 75 bp, Artificial Sequence
  Synthetic
aatttaatagatatgtatgatagattgttgcttgacgatgtgaattttaacagaatgtcatttttaccattggta

SEQ ID NO: 302986 - DNA, 75 bp, Artificial Sequence
  Synthetic
catgtactattagaaattgtaaaaagttggggccacgtgagaatgtcgcagtcattcaagtaggcggatcaaata

SEQ ID NO: 302987 - DNA, 75 bp, Artificial Sequence
  Synthetic
aaaatttacataatccaaattttaaaatacaaattactcgtaattgcagtgctatgattggtaaatggaatgaag

SEQ ID NO: 302988 - DNA, 75 bp, Artificial Sequence
  Synthetic
ctttccagattgctgaacagcaaattcaaaattttcaagtagccaactggttgcactttgttaacaataatcagt

SEQ ID NO: 302989 - DNA, 75 bp, Artificial Sequence
  Synthetic
gcataaactaaaagcagtgtcaaaagtgatcaaaccaaattatattacatcaaatcatagagctttagcgactga

SEQ ID NO: 302990 - DNA, 75 bp, Artificial Sequence
  Synthetic
aaactttaatggcgtgtattactatgaacatgcaacatgtacaaactctaaccactgaaaagttgcagttgacat

SEQ ID NO: 302991 - DNA, 75 bp, Artificial Sequence
  Synthetic
gctttagtcaagtcaaatacccacattggacattgttcatcacaagagcgaatatatagttatattagagatatt

SEQ ID NO: 302992 - DNA, 75 bp, Artificial Sequence
  Synthetic
ttataatgaaagaataaatgatgcggtagcaattataactgctgcaaatagattaaatttatatcaaaaaaagat

SEQ ID NO: 302993 - DNA, 75 bp, Artificial Sequence
  Synthetic
attatgaggtgaactgggatgttgctaacgtattagttcaaaatattggaaaaattccacaaatactgactctaa

SEQ ID NO: 302994 - DNA, 75 bp, Artificial Sequence
  Synthetic
atgtgattaatgtattggtccatagtattggtaaagtaccacaaatattaactttggataatgtcattacaatca

SEQ ID NO: 302995 - DNA, 75 bp, Artificial Sequence
  Synthetic
cttccggtcgaaattagaaggctggatatttttaacttaatattaatgaatatggaacagattgaaagagcatca

SEQ ID NO: 302996 - DNA, 75 bp, Artificial Sequence
  Synthetic
agatatatgagaaacacaccaacaactacgtttacagttgacaaattgagacaattgtacgcaagacgaaagatt

SEQ ID NO: 302997 - DNA, 75 bp, Artificial Sequence
  Synthetic
taaattatttagaatatttgaaccaagacagctacctatttatagagcgaatggtgagaaagagttacgtaatag

SEQ ID NO: 302998 - DNA, 75 bp, Artificial Sequence
  Synthetic
aacgtgaaaatttactacaacaaaatgaacgtctgcgagaagaaaaagaaattgaaaagaacacagacgtaacca

SEQ ID NO: 302999 - DNA, 75 bp, Artificial Sequence
  Synthetic
gattacttactattaaaagatatggcagttgaaaacaaaaattcaagagatgccggcaaagttgtcgattctgaa

SEQ ID NO: 303000 - DNA, 75 bp, Artificial Sequence
  Synthetic
acgttgttaattacccatcaatattgcatccaatagattacgcctttaatgaatattttttacaacatcagttgg

SEQ ID NO: 303001 - DNA, 75 bp, Artificial Sequence
  Synthetic
atacaatatggtgctgtagcgtcaggagagaagcagacgaaagcagcgaattcaatagcaaatttagcactgatt

SEQ ID NO: 303002 - DNA, 75 bp, Artificial Sequence
  Synthetic
ttgaagagtataaagatgtaatagataatgcaactttactatctatattatcatattcttacgataaatataatg

SEQ ID NO: 303003 - DNA, 75 bp, Artificial Sequence
  Synthetic
acaactttgaatctttatgggacacaataacaacttcaaactatattttagcaagatcagtagtaccagatttaa

SEQ ID NO: 303004 - DNA, 75 bp, Artificial Sequence
  Synthetic
taatgcaactttactatctatattatcatattcttacgataaatataatgctgtagaacggaagttggttaacta

SEQ ID NO: 303005 - DNA, 75 bp, Artificial Sequence
  Synthetic
cagctggaagcgttgacaatacagtcggaaacgcagtttttaacaggtataaattcacaagcagctaatgactgt

SEQ ID NO: 303006 - DNA, 75 bp, Artificial Sequence
  Synthetic
atattatatttaaactatagcattaaaacattgcaaatattgaataagtctggtatagctgcaatagaaatacag

SEQ ID NO: 303007 - DNA, 75 bp, Artificial Sequence
  Synthetic
ctggatgtatgtgatgatgaaaaatggaaaatggcggtagcggaaatatttaattgtttagaaccagtagaactt

SEQ ID NO: 303008 - DNA, 75 bp, Artificial Sequence
  Synthetic
agaactcgagttctcagataaatacgtgagggcaatcgtacctgatcaaacttttaatgaattacaggaaatgat

SEQ ID NO: 303009 - DNA, 75 bp, Artificial Sequence
  Synthetic
ctcagatgaattagacttccagaattttatcctcagaaagattaaagaaagaatgacaacttcactgccaatagc

SEQ ID NO: 303010 - DNA, 75 bp, Artificial Sequence
  Synthetic
acttttttagatcatccatcaataaaacagttttcaaatggaccatatctagttaaagatacaataaaacttaga

SEQ ID NO: 303011 - DNA, 75 bp, Artificial Sequence
  Synthetic
tcaaatagcagaacagcaaatacagaattttcaagtagctaattggctgcattttattaataacaatagatttag

SEQ ID NO: 303012 - DNA, 75 bp, Artificial Sequence
  Synthetic
atcgtaaaaagccaataatttatatgatagggtcggcaccttcatattggatatatgatgtgaaacaatattcta

SEQ ID NO: 303013 - DNA, 75 bp, Artificial Sequence
  Synthetic
tagctgataccgaatggaaagataccttatcacaactgttcttgacaaaaggatggccaacaggatcggtgtact

SEQ ID NO: 303014 - DNA, 75 bp, Artificial Sequence
  Synthetic
ttcaatattatatatagatataagaacagataggaaagacacagattggaaaacgtggagaaaaattgtagagga

SEQ ID NO: 303015 - DNA, 75 bp, Artificial Sequence
  Synthetic
aaacattgtttcattattataatgtaaatgtgaattttcattcaaattataacgaacgaattaatgatgcagtag

SEQ ID NO: 303016 - DNA, 75 bp, Artificial Sequence
  Synthetic
acttttgattttggtctattaggcacaacacttttaaatttagatgctaattacgttgagaatgcaaggacaacg

SEQ ID NO: 303017 - DNA, 75 bp, Artificial Sequence
  Synthetic
atatccgcaaaattactacatcatccaactacggagattagatcagaattttatctaataatggatatgtgggat

SEQ ID NO: 303018 - DNA, 75 bp, Artificial Sequence
  Synthetic
caaagggtgtgctatactcatatataaataacgtaatcactgagaacgtgtttattcaacaaccatttaaattga

SEQ ID NO: 303019 - DNA, 75 bp, Artificial Sequence
  Synthetic
agtgccagatgaccaaatgtacagattaagagatagacttagactgttgccagttgaaagacggagacttgatat

SEQ ID NO: 303020 - DNA, 75 bp, Artificial Sequence
  Synthetic
ttaattggaaatactacagtaattccaagtccacaaacactatttcactattataacgtaaatgtgaattttcac

SEQ ID NO: 303021 - DNA, 75 bp, Artificial Sequence
  Synthetic
aaacagtactttcaagaattgcaaacaaatattcctttataactaaaataatcagagttgatggtgatgataatt

SEQ ID NO: 303022 - DNA, 75 bp, Artificial Sequence
  Synthetic
aaattgctcaaggagtgataatcgcttatagagatatgcaactagagagagatgaaatgtatgggtacgttaata

SEQ ID NO: 303023 - DNA, 75 bp, Artificial Sequence
  Synthetic
aatgggaactatgtggcttaatgctggatcagagattcaagtggctggatttgattattcatgtgctataaatgc

SEQ ID NO: 303024 - DNA, 75 bp, Artificial Sequence
  Synthetic
tgaaagtattagctttaagacatagtgtggctcaggtgtatgcggacactcaagtgtatactcatgatgaaacta

SEQ ID NO: 303025 - DNA, 75 bp, Artificial Sequence
  Synthetic
gatttaaggacatttatgattggacttttttaccaactgattttgaaacaaatgaatcaataattacgtcgtacg

SEQ ID NO: 303026 - DNA, 75 bp, Artificial Sequence
  Synthetic
agaaccggagattatggtcaaatcactaatatgctcttgaataaccaaccagtagctttagtaggggcattacca

SEQ ID NO: 303027 - DNA, 75 bp, Artificial Sequence
  Synthetic
taactacagctactataactttattacctgatgcagaaagatttagttttccaagagttatcaattcagctgatg

SEQ ID NO: 303028 - DNA, 75 bp, Artificial Sequence
  Synthetic
aatttctaatctcactacgcataatatactatatctaaattatagcattaagacgctgcaaatattgaataaatc

SEQ ID NO: 303029 - DNA, 75 bp, Artificial Sequence
  Synthetic
agttattctaagaccaaataatgtagaagtagaatttttgttgaatggacaaattatcaatacatatcaagctag

SEQ ID NO: 303030 - DNA, 75 bp, Artificial Sequence
  Synthetic
tattgtataagataaattctgactcaaatgatttctatttggttgcaaattacgattggataccaacttcaacta

SEQ ID NO: 303031 - DNA, 75 bp, Artificial Sequence
  Synthetic
acactcgacaggcaaagctagtattgaaggtggcagatattatgaacatgctccgatagagctaatttatgcatg

SEQ ID NO: 303032 - DNA, 75 bp, Artificial Sequence
  Synthetic
ctcgaatgaattagacttccaaaattttatacttaaaaagattaaggaaagaatgacaacatcactgccaatagc

SEQ ID NO: 303033 - DNA, 75 bp, Artificial Sequence
  Synthetic
agatgaaatctatgtggcaaatgtaagtggagtgttatcaacatatttcaaactttacaacgcattctataaaga

SEQ ID NO: 303034 - DNA, 75 bp, Artificial Sequence
  Synthetic
agtggagtgttatcaacatatttcaaactttacaacgcattctataaagagcaaattacgttcggacaatcgaga

SEQ ID NO: 303035 - DNA, 75 bp, Artificial Sequence
  Synthetic
atggagtctactcagcagatggcaagttctattatcaacacttcttttgaagctgcagttgttgctgccacttca

SEQ ID NO: 303036 - DNA, 75 bp, Artificial Sequence
  Synthetic
atgtaatccgatggacgtaacgttgtactattatcaacagacagatgaagcaaataaatggatatcaatgggaga

SEQ ID NO: 303037 - DNA, 75 bp, Artificial Sequence
  Synthetic
attggaccaatttgcaaatcatatgagtatatcacgacggtcacatcaaatacgattttcagaatcagcaacttc

SEQ ID NO: 303038 - DNA, 75 bp, Artificial Sequence
  Synthetic
aagagaaatccaaacatgaaactaagaacagaaaatgttatccaaagattgaagcagagtcagattctgatgact

SEQ ID NO: 303039 - DNA, 75 bp, Artificial Sequence
  Synthetic
aagttagttcactagtttcatctgttgaatggtatcttaaatcaatggaattgccagatgaagtcaaaactgata

SEQ ID NO: 303040 - DNA, 75 bp, Artificial Sequence
  Synthetic
tataaaaagaagtattttgcacttcggttaagaatgaaacaagttgcaatgcaattaattgaaaatttgtgaata

SEQ ID NO: 303041 - DNA, 75 bp, Artificial Sequence
  Synthetic
ataaagtatttaatttcatttcgtttaaagtaggaaacactaccattatatagaaaataatacacataattatta

SEQ ID NO: 303042 - DNA, 75 bp, Artificial Sequence
  Synthetic
tagaaaataatacacataattattattatatatattaaatgttattttactgtcttatatgatgttaatcttatg

SEQ ID NO: 303043 - DNA, 75 bp, Artificial Sequence
  Synthetic
aactttataatgcattctataaagagcaaattacgttcgggcaatcaagaatgtttattccacacataacattaa

SEQ ID NO: 303044 - DNA, 75 bp, Artificial Sequence
  Synthetic
agaagtacaatatgaaattctacaaaagacaataccaacctttgaaccaaaagaatcaattttgaaaaagttaga

SEQ ID NO: 303045 - DNA, 75 bp, Artificial Sequence
  Synthetic
ttataacacaaatgacaattcaagaggaatgaattatgaaactccaatgtttaataaggtggcggtgttaatttg

SEQ ID NO: 303046 - DNA, 75 bp, Artificial Sequence
  Synthetic
agaaatagatggtattggaaattgaaaaaagatacattgccagatggagattatgatgtacgagaatatttctta

SEQ ID NO: 303047 - DNA, 75 bp, Artificial Sequence
  Synthetic
tttatctttcatttacaattcgcaatccgctgtacaaataccaatttattattcttccaatagtgaattagaaca

SEQ ID NO: 303048 - DNA, 75 bp, Artificial Sequence
  Synthetic
gagatgtattgactttcattcgaaatgtttagaaaattcaaagaaaggtctttcacttaaaaatttgttcattga

SEQ ID NO: 303049 - DNA, 75 bp, Artificial Sequence
  Synthetic
tatcttcaaatttaaatgcagttatgttttggttagaacggcactcaaatgacgttgctgatgcaaataaaattt

SEQ ID NO: 303050 - DNA, 75 bp, Artificial Sequence
  Synthetic
attgattattttgtagattttgtagataatgtatgcatggatgaaatggttagagaatcgcaaagaaatggaatc

SEQ ID NO: 303051 - DNA, 75 bp, Artificial Sequence
  Synthetic
agtataatctaatcttgtcagaatatttatcattcatatataattcacaatctgcagttcaaattccaatttact

SEQ ID NO: 303052 - DNA, 75 bp, Artificial Sequence
  Synthetic
tctgcagttcaaattccaatttactattcttccaatagtgaactagagaatagatgtattgaattccattctaaa

SEQ ID NO: 303053 - DNA, 75 bp, Artificial Sequence
  Synthetic
tggttgcatgtgaattggctataataaatactattgtttatccagcatttggaatgcaaagaatgcattatagaa

SEQ ID NO: 303054 - DNA, 75 bp, Artificial Sequence
  Synthetic
caacatgttcaaactcttactactgaaaaattacagttaacctctgttacatctctgtgtatgttgatcggaaat

SEQ ID NO: 303055 - DNA, 75 bp, Artificial Sequence
  Synthetic
attctatggtgttatacacagacgtttcacaatgggattcgtcacaacataacacacagccatttagaaaaggaa

SEQ ID NO: 303056 - DNA, 75 bp, Artificial Sequence
  Synthetic
tgcagatctttgatgtaccacgagtgccagatgaccaaatgtatagactgagagatagacttaggttactgccag

SEQ ID NO: 303057 - DNA, 75 bp, Artificial Sequence
  Synthetic
atgctgctgcatttaagtttgatgaaaataatctttattatgtttttgggttatatgagaaatcagtcagtgata

SEQ ID NO: 303058 - DNA, 75 bp, Artificial Sequence
  Synthetic
tgaattaaaacagatgcttgacaacatgagaaaagctgggttaactgacatacctaagatgatacaggactggtt

SEQ ID NO: 303059 - DNA, 75 bp, Artificial Sequence
  Synthetic
atggggacgttactcgttttttgtcaaataacgctatggtattgtacactgacgtatcacaatgggattcatcac

SEQ ID NO: 303060 - DNA, 75 bp, Artificial Sequence
  Synthetic
ttgagagacgaagacttgacatattcaacctaatattgatgaacatggaacagattgaacgagcttcggataaaa

SEQ ID NO: 303061 - DNA, 75 bp, Artificial Sequence
  Synthetic
aaatgttggtccgagaaatgaatcaatgttcacgtttttgaacttcccaactattaaacaattttcaaatggtgc

SEQ ID NO: 303062 - DNA, 75 bp, Artificial Sequence
  Synthetic
gtaatcaaaaagattcagtatggtgctgttgcttcaggagaaaaacaaactaaggcagctaattctatagctaat

SEQ ID NO: 303063 - DNA, 75 bp, Artificial Sequence
  Synthetic
atgtgccaggaagacggactagaataatatttatcttaccatacgaatattttatagcacaacacgctgtagttg

SEQ ID NO: 303064 - DNA, 75 bp, Artificial Sequence
  Synthetic
agacaattcaattttatatatagacataagaaccgatagaggaaatatggattggagagagtggagaaaagtagt

SEQ ID NO: 303065 - DNA, 75 bp, Artificial Sequence
  Synthetic
caggaaaagctaaggtgtgctgtgttaagttgactgctatggatttagaactaccaataacagcaaaattactac

SEQ ID NO: 303066 - DNA, 75 bp, Artificial Sequence
  Synthetic
cattatagagtatggaacaactgacgatgaagtatatatacagagagcatttatgtcattgtctagtcaaaagtc

SEQ ID NO: 303067 - DNA, 75 bp, Artificial Sequence
  Synthetic
cacatggatcaaacaattgaagaagtgtttaatcacatgtcgccagtgtcagttgaaggtacgaatgtcatcatg

SEQ ID NO: 303068 - DNA, 75 bp, Artificial Sequence
  Synthetic
cttccttttcagtcgatccacaattgtattgtgattataacgtagtgctaatgaaatacgacgcaactctacagt

SEQ ID NO: 303069 - DNA, 75 bp, Artificial Sequence
  Synthetic
actacttgtactattaggaattgtaaaaaattgggaccaagagaaaacgtagcggtaatacaagttggaggttct

SEQ ID NO: 303070 - DNA, 75 bp, Artificial Sequence
  Synthetic
tggtggcaagtattttatacggtagttgactacgtaaatcaaataattcaagcaatgtccaaaagatcacggtca

SEQ ID NO: 303071 - DNA, 75 bp, Artificial Sequence
  Synthetic
caacgagttatacatatatgttatctgacgaggtgtacgtagcgaatgtaaatggcgtattatcaacatatttta

SEQ ID NO: 303072 - DNA, 75 bp, Artificial Sequence
  Synthetic
acattcaatttaccgattgattattggatgctaattgcgcctactcaagtaggtagagtagcagagggtacaaac

SEQ ID NO: 303073 - DNA, 75 bp, Artificial Sequence
  Synthetic
gttttagtaatgagaaaacagtgagaatagatactacaaagctacacatagattctatttatttaagaaaaataa

SEQ ID NO: 303074 - DNA, 75 bp, Artificial Sequence
  Synthetic
tgattatgtacttgatgattctgatagtgatgatggtaaatgtaaaaattgtaaatataaaaggaagtatttcgc

SEQ ID NO: 303075 - DNA, 75 bp, Artificial Sequence
  Synthetic
tgggatattattaccattaaaagatttataccaaagggtgtattttatgcttttataaataatataaccacagag

SEQ ID NO: 303076 - DNA, 75 bp, Artificial Sequence
  Synthetic
gcacaaatgaatgaagatatagtggtatcaaaaacatcattatggaaagagatgcaatataacagagatataata

SEQ ID NO: 303077 - DNA, 75 bp, Artificial Sequence
  Synthetic
gttatgttctggttggaaaaacatgaaaatgatactgctgagaagcttaagatttataaaagaagactagattta

SEQ ID NO: 303078 - DNA, 75 bp, Artificial Sequence
  Synthetic
gtggcggtgattatagtttcgcattaccggtaggtgcatatccagtaatgagtggcggtgcagtaacactgtcac

SEQ ID NO: 303079 - DNA, 75 bp, Artificial Sequence
  Synthetic
cgaactgaaacaaatgcttgataatatgagaaaagctggactagttgatataccaaaaatgatacaggattggtt

SEQ ID NO: 303080 - DNA, 75 bp, Artificial Sequence
  Synthetic
agttgatttaactagattattagcttacaattatgagacattaatggcatgcattacaatgaacatgcaacatgt

SEQ ID NO: 303081 - DNA, 75 bp, Artificial Sequence
  Synthetic
gaggttgagctgccgtcgactgtcttcggaagcggcggagttcttcacagtaagccccatcggacctgatggctg

SEQ ID NO: 303082 - DNA, 75 bp, Artificial Sequence
  Synthetic
aagatgtagatgacgagatgtatcgagagtacacaatgttaataagagatgaagttgttaaaatgcttgaggaac

SEQ ID NO: 303083 - DNA, 75 bp, Artificial Sequence
  Synthetic
agccggtagattttcattaatatctctagtaccaactaatgatgattaccagacaccaatagctaattctgtgac

SEQ ID NO: 303084 - DNA, 75 bp, Artificial Sequence
  Synthetic
gatgcgaattagtactggtattcaagctggagaagacttgagaacgatggcggatgtatcaacgcaaatatcaaa

SEQ ID NO: 303085 - DNA, 75 bp, Artificial Sequence
  Synthetic
ctggattattatcaatgtcatcagcttcaaatggtgaatcaagacaacttaaatttggtcgtaaaacaatatttt

SEQ ID NO: 303086 - DNA, 75 bp, Artificial Sequence
  Synthetic
tggctcagccttaatcccgtttaaccaatccagcgaatgttggacgttaatggaaggaatggtcttagtgtgacc

SEQ ID NO: 303087 - DNA, 75 bp, Artificial Sequence
  Synthetic
agcgtttatgtcattatcaagtcagagatcgggaatagctgatgaaatagctgcatcaacaacatttaaaaatta

SEQ ID NO: 303088 - DNA, 75 bp, Artificial Sequence
  Synthetic
acagaagacaacgaacaggttttacatttcataaaccaaacattttcccttattcagcgtcattcacactgaata

SEQ ID NO: 303089 - DNA, 75 bp, Artificial Sequence
  Synthetic
gttattgaatttaataactttctaatgagagaagattaatgcgtctaccctaagagatcactagggagctcccca

SEQ ID NO: 303090 - DNA, 75 bp, Artificial Sequence
  Synthetic
gcggcggagttcttaacagtaagccccatcggacctgatggctggctgagaagccacagtcagtcatatcgcgtg

SEQ ID NO: 303091 - DNA, 75 bp, Artificial Sequence
  Synthetic
caaatgtcacagttaatccaggtccgttcgcacagactggatatgctccagttaattggggacacggtgaattgt

SEQ ID NO: 303092 - DNA, 75 bp, Artificial Sequence
  Synthetic
aagcatttaggaacatggtatatgttagatcattagcagcaaatttaaattcagtaaagtgtagcggaggaaatt

SEQ ID NO: 303093 - DNA, 75 bp, Artificial Sequence
  Synthetic
aagagaatcattagttgcatgtcaactagctatagtgaacacaatagtgtatccagcgtttggaatgcaacgaat

SEQ ID NO: 303094 - DNA, 75 bp, Artificial Sequence
  Synthetic
agctatcgcgacaacaatttccaacaatgcctgttgattataagaggtcaattcagcgtggaatattgttgctat

SEQ ID NO: 303095 - DNA, 75 bp, Artificial Sequence
  Synthetic
tcaatcttacatccaattgatcatgcattcaatgaatactttctaaaccaccaattagttgaaccattgaataat

SEQ ID NO: 303096 - DNA, 75 bp, Artificial Sequence
  Synthetic
gaaataatttttaattatataccagaaaggataagaaacgatgtcaattacattctaaacatggatatgaatcta

SEQ ID NO: 303097 - DNA, 75 bp, Artificial Sequence
  Synthetic
gtcgcaactaattgatttggcaacattaccacttgatatgttctcaatgttttctggaattaaatcaacagtgga

SEQ ID NO: 303098 - DNA, 75 bp, Artificial Sequence
  Synthetic
acaatgtcattagaatttgtgactacaaattatatgtcacttatatctggtatgtggttactaacagttatacca

SEQ ID NO: 303099 - DNA, 75 bp, Artificial Sequence
  Synthetic
gatgctacagtttttgcccaaatagttaaattgcggaaagttgacactttaaaaccaatactgtataagataaat

SEQ ID NO: 303100 - DNA, 75 bp, Artificial Sequence
  Synthetic
tcaccaccatcaatgaaacacttgttgaggaggtatataatatgacattaggctactttgagcataatgttatta

SEQ ID NO: 303101 - DNA, 75 bp, Artificial Sequence
  Synthetic
atctggatataaagtgattaaagtagtagttgtgacagttttcaattgcattctgaggatatttggctcaaaaac

SEQ ID NO: 303102 - DNA, 75 bp, Artificial Sequence
  Synthetic
ggtcaattagttgacttgacaagactattatcatataattatgaaaccctgatggcttgtataaccatgaatatg

SEQ ID NO: 303103 - DNA, 75 bp, Artificial Sequence
  Synthetic
aattgaataatacagtcttaaaattaggagttaatgatacatggaggccgtcacctccaactaaatataaaggat

SEQ ID NO: 303104 - DNA, 75 bp, Artificial Sequence
  Synthetic
aaactatggcattaatttaccaataactggatcaatggatgcatcatacgtgaacgctaccaaggacgagccatt

SEQ ID NO: 303105 - DNA, 75 bp, Artificial Sequence
  Synthetic
ttggaacaagtaaaattgcttgcagatatttatgaactactaaagtacaaaagtgaaggaaatgtaccctctgag

SEQ ID NO: 303106 - DNA, 75 bp, Artificial Sequence
  Synthetic
cgtagaatgacgggtgaacccatcggacctgcatgaacatggagaagccaccatgttcatgatcgggtgtggcaa

SEQ ID NO: 303107 - DNA, 75 bp, Artificial Sequence
  Synthetic
gggtggccaactggatctgtgtactttaaggagtatgatgatatagttacattttcagtagatccgcaactgtat

SEQ ID NO: 303108 - DNA, 75 bp, Artificial Sequence
  Synthetic
ttgaaagacgaaggcttgatatattcaatttaatattaatgaatatggagcagattgaacgagcttcagacaaaa

SEQ ID NO: 303109 - DNA, 75 bp, Artificial Sequence
  Synthetic
gacctgcatgaacatggagaagccaccatgttcatgatcgggtgtggcaagaagccttaatccctggtaccccaa

SEQ ID NO: 303110 - DNA, 75 bp, Artificial Sequence
  Synthetic
tgtgattataatatagttctaatgggatacaattaaagtttagagttagatatgtcagaattagccaatctaata

SEQ ID NO: 303111 - DNA, 75 bp, Artificial Sequence
  Synthetic
ttttatgctcaagaagattaaagaaaggatgacaacatcactaccaatagcaagactttcaaatcgcgtatttag

SEQ ID NO: 303112 - DNA, 75 bp, Artificial Sequence
  Synthetic
taccgatgtagtcgacggtgtgaatcataaactagatgtaactactacgacttgtactattcggaattgtaagaa

SEQ ID NO: 303113 - DNA, 75 bp, Artificial Sequence
  Synthetic
ttatgtaaatcaaattgtgcaagcgatgtccaaaaggtctaggtcactaaattcagcagcattttactacagggt

SEQ ID NO: 303114 - DNA, 75 bp, Artificial Sequence
  Synthetic
aacatcacatattgaattttatagtgtttctaccagatgtagaatattcacacaatgtaaactcaaaatggcatc

SEQ ID NO: 303115 - DNA, 75 bp, Artificial Sequence
  Synthetic
aatattggacattgttcatcacaggaaaagatatatgaatatgttaaagacgttctgaatgtgtgtgatgacgaa

SEQ ID NO: 303116 - DNA, 75 bp, Artificial Sequence
  Synthetic
atgatttcagtataccagtaggtgcatggccagtaataaatggtggcgctgtttcgttgcattttgccggagtta

SEQ ID NO: 303117 - DNA, 75 bp, Artificial Sequence
  Synthetic
aataattgatgttgtcgacagcgtaaatcataaattagatgtcacatctactacatgtacaatacggaattgtaa

SEQ ID NO: 303118 - DNA, 75 bp, Artificial Sequence
  Synthetic
tttaacaacggagaaattacagttaacttcagttacatcgctgtgcatgctcattggaaatgcaactgttatacc

SEQ ID NO: 303119 - DNA, 75 bp, Artificial Sequence
  Synthetic
aattactactaaagatgaaatagaaaaacaaatggacagagtcgttaaagaaatgagacgtcagttagagatgat

SEQ ID NO: 303120 - DNA, 75 bp, Artificial Sequence
  Synthetic
gaagccatggctacttttaaagacgcttgttatcattacaaaagaattaacaaattgaatcatacagtcttaaaa

SEQ ID NO: 303121 - DNA, 75 bp, Artificial Sequence
  Synthetic
cgtgtctatggattcatcaacacaatcacgaccttcaagcaacgttgggtgcgatcaagtggatttctccttaac

SEQ ID NO: 303122 - DNA, 75 bp, Artificial Sequence
  Synthetic
ccaagaattgaagcagattctgattctgaagattacgttttagatgattcagatagtgatgacggtaaatgtaag

SEQ ID NO: 303123 - DNA, 75 bp, Artificial Sequence
  Synthetic
attttattggaattaaatttaaaaatataccatatgaatatgatgttaaagtaccacatcttacatttggtgtat

SEQ ID NO: 303124 - DNA, 75 bp, Artificial Sequence
  Synthetic
actatgttgcagaaaccagtatcatttaaatcaaataaaattactattaatgacattttgcgtgacataaaacca

SEQ ID NO: 303125 - DNA, 75 bp, Artificial Sequence
  Synthetic
ttctaacttcaacgctatgtctgtactatccagcagaggctaaaaatgagatttcagatgatgaatgggaaaata

SEQ ID NO: 303126 - DNA, 75 bp, Artificial Sequence
  Synthetic
acattgttaataaattacgaggatttgagactgatagagaatttatattaactaaaattatacaaatgacatctg

SEQ ID NO: 303127 - DNA, 75 bp, Artificial Sequence
  Synthetic
ttacggatgttatcaactattcgattttaattctccagatttagaaaaacttatacgaattccttttaaaggcaa

SEQ ID NO: 303128 - DNA, 75 bp, Artificial Sequence
  Synthetic
ttacagttaacttcagttacatcgttgtgcatgcttattgggaatgcaactgttatacccagtccacagacgttg

SEQ ID NO: 303129 - DNA, 75 bp, Artificial Sequence
  Synthetic
tgtgcatgcttattgggaatgcaactgttatacccagtccacagacgttgtttcactattataatgttaatgtta

SEQ ID NO: 303130 - DNA, 75 bp, Artificial Sequence
  Synthetic
aaaattcattagcgttagatgtttcagaactcgctgatttaattttaaatgaatggttatgtaatccgatggacg

SEQ ID NO: 303131 - DNA, 75 bp, Artificial Sequence
  Synthetic
accagaaaaagatgaaagcgatagttgaagatttcctaaaaagattacatattttcgatgtggctagagttccag

SEQ ID NO: 303132 - DNA, 75 bp, Artificial Sequence
  Synthetic
agaactcgctgatttaattttaaatgaatggttatgtaatccgatggacgtaacgttgtactattatcaacaaac

SEQ ID NO: 303133 - DNA, 75 bp, Artificial Sequence
  Synthetic
gcagtgcgtcaagaatatgctataccagttggaccggtatttccaccaggcatgaattggactgagctaattact

SEQ ID NO: 303134 - DNA, 75 bp, Artificial Sequence
  Synthetic
cattggataactaaaactgatataattgactatctattacctggatggaaattaacgtatgtaggatataatgga

SEQ ID NO: 303135 - DNA, 75 bp, Artificial Sequence
  Synthetic
tttacctagttgctaactatgactgggtgcctacttcaacaacaaaagtatataaacaagttccacagcaatttg

SEQ ID NO: 303136 - DNA, 75 bp, Artificial Sequence
  Synthetic
aatctacttgatatcaattatattacttaattacatattaaagagtataactagaatgatggactacataattta

SEQ ID NO: 303137 - DNA, 75 bp, Artificial Sequence
  Synthetic
aatggaaggactctctatcacaaatgcttctgactaaaggttggccaactggatcagtctattttaaagagtact

SEQ ID NO: 303138 - DNA, 75 bp, Artificial Sequence
  Synthetic
acttcaattgttgttaatgcacaaaattacggtatcaatttaccaataaccggatcaatggacatgtcatatgtg

SEQ ID NO: 303139 - DNA, 75 bp, Artificial Sequence
  Synthetic
agacggacgaggcaaacaaatggatagcaatgggacaatcatgtacaataaaagtgtgtccattgaatactcaaa

SEQ ID NO: 303140 - DNA, 75 bp, Artificial Sequence
  Synthetic
ctaatccacaaactgaacggatgatgcgaataaattggaagaaatggtggcaagtgttctatactatagttgatt

SEQ ID NO: 303141 - DNA, 75 bp, Artificial Sequence
  Synthetic
aaattgaaactactgccactgctgaaggaggagaaatagtattccaaaatactgcttttactatgtggaaattga

SEQ ID NO: 303142 - DNA, 75 bp, Artificial Sequence
  Synthetic
ataaaccaaacattttcccttactcagcgtcattcacactgaacagatcacaaccagctcatgataacttgatgg

SEQ ID NO: 303143 - DNA, 75 bp, Artificial Sequence
  Synthetic
ggaaaatgtaaaaattgcaaatacaaacggaagtacttcgcgctaagaatgagaatgaaacatgtcgcaatgcaa

SEQ ID NO: 303144 - DNA, 75 bp, Artificial Sequence
  Synthetic
aaaatataacaattgggtgcaaaaagcaaagaaagtaaatgaaaatatgtactctcttcaaaatgttatttcaca

SEQ ID NO: 303145 - DNA, 75 bp, Artificial Sequence
  Synthetic
tcaaatgattcactcactaatgttgggtgcgattgaatgggtttctcctttaataaagtagtaaaagtaaatgca

SEQ ID NO: 303146 - DNA, 75 bp, Artificial Sequence
  Synthetic
aatactttttaaatcaccaattagttgaaccattaaataatgaaataatttttaattatataccagaaaggataa

SEQ ID NO: 303147 - DNA, 75 bp, Artificial Sequence
  Synthetic
cagataaatggaagtttttagaaatgtttagaagcagtagtcaaaatgaattttataatagacgtacactaactt

SEQ ID NO: 303148 - DNA, 75 bp, Artificial Sequence
  Synthetic
gtgcggaaagatggaaaagcttaccgacctcaactatacattgagtgtaatcactctaatgaacagcacattgca

SEQ ID NO: 303149 - DNA, 75 bp, Artificial Sequence
  Synthetic
ttactactaaagatgagatagaaaagcaaatggacagggtagtcaaagagatgagacgtcagctagaaatgattg

SEQ ID NO: 303150 - DNA, 75 bp, Artificial Sequence
  Synthetic
tattggatttatgatattagacagtattctgattttacatttgaaacatgggatccattagacactccatattct

SEQ ID NO: 303151 - DNA, 75 bp, Artificial Sequence
  Synthetic
ggactctacctactgatttttcaatatctagatttgaagtgattaaagagaattcgaaagtgtatatagattact

SEQ ID NO: 303152 - DNA, 75 bp, Artificial Sequence
  Synthetic
cacaagatgatgttaagatagctgacgaggttaagaaatcgtcaaaggaggaatcaaagcagttattggaaatat

SEQ ID NO: 303153 - DNA, 75 bp, Artificial Sequence
  Synthetic
gtggtggtgattatacgttcgcattgccagtaggggcatggccagtaatgagcggtggtgcagtaacgctgtcgt

SEQ ID NO: 303154 - DNA, 75 bp, Artificial Sequence
  Synthetic
gtcagacgcagcatcatcagcatcaagaagcgtttctatcagatcgaatatatccacaatttcgaattggactaa

SEQ ID NO: 303155 - DNA, 75 bp, Artificial Sequence
  Synthetic
agctaatgagaccaccaaatatgacaccagcagtagcagcactattcccaaatgcacaaccattcgaacatcatg

SEQ ID NO: 303156 - DNA, 75 bp, Artificial Sequence
  Synthetic
tctagagatgctggtaaagtagtggattccgaaacagcaagtatttgtgacgccatatttcaagatgaagaaaca

SEQ ID NO: 303157 - DNA, 75 bp, Artificial Sequence
  Synthetic
aacagtgaaatccatgacaactaacattatgaaaaagtttaaaacgtcaaacttagctaatgccatatcagatct

SEQ ID NO: 303158 - DNA, 75 bp, Artificial Sequence
  Synthetic
cttttacgcatacagagttgatacttttgacgaagtgccatttgatgtggaaaggtttaataagttaatcacaga

SEQ ID NO: 303159 - DNA, 75 bp, Artificial Sequence
  Synthetic
acaagccatggaattattacaatcaaatccaaaaacgttaaaagaatttataaataataataatccaataattcg

SEQ ID NO: 303160 - DNA, 75 bp, Artificial Sequence
  Synthetic
ataatgtatgtatggatgaaatggttagagagtcacaaagaaatggaattgcaccacaatcagattcacttagaa

SEQ ID NO: 303161 - DNA, 75 bp, Artificial Sequence
  Synthetic
tacagtttttgctcaaatagttaaacttagaaaagtggacactttaaaaccaatattgtataagataaattctga

SEQ ID NO: 303162 - DNA, 75 bp, Artificial Sequence
  Synthetic
gaacgaattaacgatgcagtagcaattattacagcagctaatagactgaatttatatcagaagaagatgaagtca

SEQ ID NO: 303163 - DNA, 75 bp, Artificial Sequence
  Synthetic
tgaatcatgcagtcttgaagttaggagttaatgatacatggagaccatcacctccgactaaatataaaggatggt

SEQ ID NO: 303164 - DNA, 75 bp, Artificial Sequence
  Synthetic
tatgaactctactacaagtgaaacatttttgacttcaacattatgtctatattatccaaatgaagcggctacaga

SEQ ID NO: 303165 - DNA, 75 bp, Artificial Sequence
  Synthetic
acattatcgcagttgtttctaacaaaaggatggccaacagggtcggtttattttaaaggatatgcggatattgca

SEQ ID NO: 303166 - DNA, 75 bp, Artificial Sequence
  Synthetic
aaccaaaacaaatatagaggattatttattaccaggatggaagctaacatacgtcggctataacggaaatgatac

SEQ ID NO: 303167 - DNA, 75 bp, Artificial Sequence
  Synthetic
tgcattatacgcgttatctaacgacttcaatactagagaagatgtgataaaattagttgacaatcagaagagtgc

SEQ ID NO: 303168 - DNA, 75 bp, Artificial Sequence
  Synthetic
agttaaagacacaattaaacttaaacaagaaagatggcttggtaaaaggttgtcacagtttgacattggtcaata

SEQ ID NO: 303169 - DNA, 75 bp, Artificial Sequence
  Synthetic
tgatgcgtataaattggaagagatggtggcaagtcttttatacaatagttgattatgttaatcaaattgtgcaag

SEQ ID NO: 303170 - DNA, 75 bp, Artificial Sequence
  Synthetic
gattatgttaatcaaattgtgcaagtcatgtccaagcgatcacgctctttagattccgctgccttttattatcgg

SEQ ID NO: 303171 - DNA, 75 bp, Artificial Sequence
  Synthetic
atatatgacgttaaacaatactctgacttaaagttcgaaacatgggatccgctagatacgccatattctaattta

SEQ ID NO: 303172 - DNA, 75 bp, Artificial Sequence
  Synthetic
acttaaagttcgaaacatgggatccgctagatacgccatattctaatttacatcataaagaactattttatatca

SEQ ID NO: 303173 - DNA, 75 bp, Artificial Sequence
  Synthetic
tggtggcaagtgttctacacggtagtggattatgtcaaccaaataattcaaacaatgtccaaaagatccagatcg

SEQ ID NO: 303174 - DNA, 75 bp, Artificial Sequence
  Synthetic
cgtgtacaagccgatagaaatgttgtcaattatccatcaatattacatccaatagattatgcatttaatgagtat

SEQ ID NO: 303175 - DNA, 75 bp, Artificial Sequence
  Synthetic
catcaattgaagaactatataaagttatatctttacgagaacaagaaatacagttgtatttagtttcactaggag

SEQ ID NO: 303176 - DNA, 75 bp, Artificial Sequence
  Synthetic
aatggatcaataattacttcatatgatggatgtttgggtatttttggtttatcaatatcgctagcttcaaaacca

SEQ ID NO: 303177 - DNA, 75 bp, Artificial Sequence
  Synthetic
attcactttaaaccgatcacaaccagctcatgacaatttaatgggaactatgtggattaatgctggatcagaaat

SEQ ID NO: 303178 - DNA, 75 bp, Artificial Sequence
  Synthetic
cgcaagcacaaccttttcaacatcatgcaacagttggacttacattacgtattgaatctgcagtttgtgagtcag

SEQ ID NO: 303179 - DNA, 75 bp, Artificial Sequence
  Synthetic
aaaatttccactaatggctaaaatatattcatggtcatttcatgttggatttaggaaacagaaaatgttagatgc

SEQ ID NO: 303180 - DNA, 75 bp, Artificial Sequence
  Synthetic
tgtatcgagaatacacaatgctaataagagatgaagttgttaaaatgctcgaggaaccggtgaaacatgatgatc

SEQ ID NO: 303181 - DNA, 75 bp, Artificial Sequence
  Synthetic
aaccaaaaagaatatgcacgttatggatgatatggctaatggaagatatacaccaggtataataccaccagtaaa

SEQ ID NO: 303182 - DNA, 75 bp, Artificial Sequence
  Synthetic
gcattgatttattacagatataattattcatttgatcttaaacgatggatatacttacattcaacaggtaaagct

SEQ ID NO: 303183 - DNA, 75 bp, Artificial Sequence
  Synthetic
caacagataaatttagaggagctgatgagatcaggtgactatgcgcaaataactaacatgcttttgaataatcaa

SEQ ID NO: 303184 - DNA, 75 bp, Artificial Sequence
  Synthetic
gagttattcagacgttaaatttatataaacaaacacagattaatttaatggattcatacgtccaaataccagatg

SEQ ID NO: 303185 - DNA, 75 bp, Artificial Sequence
  Synthetic
aattaatttagaagaattgatgaggacaggagattatggtcaaattactaacatgctattaaacaatcaaccagt

SEQ ID NO: 303186 - DNA, 75 bp, Artificial Sequence
  Synthetic
acgttactatcaattctatcatactcatatgataaatataatgctgttgaaaggaaattagttaagtatgcaaga

SEQ ID NO: 303187 - DNA, 75 bp, Artificial Sequence
  Synthetic
tgaatctgcagtttgtgaatctgtgcttgcggacgcttcagaaactttgttggcaaatgtaacatcagtacgtca

SEQ ID NO: 303188 - DNA, 75 bp, Artificial Sequence
  Synthetic
aaataatgcaattttaaagttaggagctaatgatgtttggagatcttctactctaacaaaacgtaaaggatggtg

SEQ ID NO: 303189 - DNA, 75 bp, Artificial Sequence
  Synthetic
tatatcacgtttgtgaatggtgtagtcaatatagtagatgttttcttgatgatgatccgcatttactaagaatgc

SEQ ID NO: 303190 - DNA, 75 bp, Artificial Sequence
  Synthetic
ggacttttagaaatgaagtcacaaagagtgatttagaaaacttaattaatatgtatgatacattatttcctataa

SEQ ID NO: 303191 - DNA, 75 bp, Artificial Sequence
  Synthetic
taaaattggctggatataaagaacaggttactactaaagacgaaattgaacaacagatggacagaattgttaaag

SEQ ID NO: 303192 - DNA, 75 bp, Artificial Sequence
  Synthetic
ataatcattttttgatgccaattacattacagtctttatcaatagaattagatggagatatatattatatatttg

SEQ ID NO: 303193 - DNA, 75 bp, Artificial Sequence
  Synthetic
tagaatggcatttttatcattaacattacaacaagagtatgcacttagatatttttcaaaatcaagatttattac

SEQ ID NO: 303194 - DNA, 75 bp, Artificial Sequence
  Synthetic
aatatgtcagttgaatggaataaagcatgtaatcttattagaaatataagtgattatttcgatatactcaaatcg

SEQ ID NO: 303195 - DNA, 75 bp, Artificial Sequence
  Synthetic
ctcctagatgtagaatgttcacgcaatataaattaaaaatagcatctaaattaattaaaccaaattatgtagcat

SEQ ID NO: 303196 - DNA, 75 bp, Artificial Sequence
  Synthetic
atataaattaaaaatagcatctaaattaattaaaccaaattatgtagcatcaaatcataattccttggctactga

SEQ ID NO: 303197 - DNA, 75 bp, Artificial Sequence
  Synthetic
aagttattcagacactaaatttatacaaacagacacaaattaatttaatggactcatatgttcaaataccagatg

SEQ ID NO: 303198 - DNA, 75 bp, Artificial Sequence
  Synthetic
caggtattaaatttaaaagaataaattttgataattcatcagaatacatagagaactggaatttgcaaaacagaa

SEQ ID NO: 303199 - DNA, 75 bp, Artificial Sequence
  Synthetic
attatgaaataaattggaatgttatgaatgtattaattaatagtatcggtaaaataccaaaaatattgactttga

SEQ ID NO: 303200 - DNA, 75 bp, Artificial Sequence
  Synthetic
gtggcaagtattctacactgtagttgattatattaatcagatagtacaagtaatgtccaaaagatcaagatcgtt

SEQ ID NO: 303201 - DNA, 75 bp, Artificial Sequence
  Synthetic
caaaattgttgaaggtacattatattctaatgttagcgatcttattcagcaatttaatcaaatgatagtaactat

SEQ ID NO: 303202 - DNA, 75 bp, Artificial Sequence
  Synthetic
aggtttatgagaaacacgccaatgactacgttcacagtcaataaattgaagcaattatatgaaaaggataaaact

SEQ ID NO: 303203 - DNA, 75 bp, Artificial Sequence
  Synthetic
gtacagctccgaagagttttaactacagctacaataacacttttaccagatgcagaaagatttagttttccaaga

SEQ ID NO: 303204 - DNA, 75 bp, Artificial Sequence
  Synthetic
caaaaaggtatattgcaggtggaaagatattttttagagcaggaataaatttacttaataatgaaaaaagaggac

SEQ ID NO: 303205 - DNA, 75 bp, Artificial Sequence
  Synthetic
gatattttttagagcaggaataaatttacttaataatgaaaaaagaggacagagcacacaatgggatcaagcagc

SEQ ID NO: 303206 - DNA, 75 bp, Artificial Sequence
  Synthetic
tagagaatcacaacgaaatggaatagcgccacaatctgaagcactaagaaagctgtcgggtattaaatttaaaag

SEQ ID NO: 303207 - DNA, 75 bp, Artificial Sequence
  Synthetic
caaagatctattctcaagacaagtatagaatattagaatcatatgtgtataacctattatctattaattatggat

SEQ ID NO: 303208 - DNA, 75 bp, Artificial Sequence
  Synthetic
gctattaagaatggttcatggataagtttattctgtaattatccaaaatcagaaatgataaagctatggaagaaa

SEQ ID NO: 303209 - DNA, 75 bp, Artificial Sequence
  Synthetic
tgccgtcgtctgtcttcggaagcggcggaactcttcaccgcaagccccattggacctgatgattgactgagaagc

SEQ ID NO: 303210 - DNA, 75 bp, Artificial Sequence
  Synthetic
attagtactattaaaagattcgtaccaaaaggcgtgttttatgctttcataaacaatgtaaccacagaaaatgta

SEQ ID NO: 303211 - DNA, 75 bp, Artificial Sequence
  Synthetic
gtttttacagtagcttccattagaagcatgctgattaagtgaggaccaggctaactacctggtatccgatcttaa

SEQ ID NO: 303212 - DNA, 75 bp, Artificial Sequence
  Synthetic
actggaaataatcatttatttataataaatggaactgacaaatattataaactagatcagtatgcaaatcatatg

SEQ ID NO: 303213 - DNA, 75 bp, Artificial Sequence
  Synthetic
ggcatttctagaagatcgcatcaaattagattttcagagtctgcaacatcatattcgggatacatttttagagat

SEQ ID NO: 303214 - DNA, 75 bp, Artificial Sequence
  Synthetic
atactagttatacttatatgctatctgatggtatatatgtagcaaatgctagtggtgtattgtcgacttatttta

SEQ ID NO: 303215 - DNA, 75 bp, Artificial Sequence
  Synthetic
ttcagtttcaggacatgtttataacgcattgatttattacagatataattatgcatttgatcttaaaagatggat

SEQ ID NO: 303216 - DNA, 75 bp, Artificial Sequence
  Synthetic
attgtttaagtcagctgaagaatacactgattcattaatggatcctgctatattaacttcactatcatctaactt

SEQ ID NO: 303217 - DNA, 75 bp, Artificial Sequence
  Synthetic
caaataggcttggtcaactagttgatttgactaggttattagcttataattatgagacactaatggcatgtatta

SEQ ID NO: 303218 - DNA, 75 bp, Artificial Sequence
  Synthetic
aaaaattcacattaatgtcgaagatctattcttggtcgttccatgttggatttaggaaacaaaagatgatagatg

SEQ ID NO: 303219 - DNA, 75 bp, Artificial Sequence
  Synthetic
atcagataaaattgcacaaggtgttattattgcataccgtgacatgcaattagaaagagatgaaatgtatggtta

SEQ ID NO: 303220 - DNA, 75 bp, Artificial Sequence
  Synthetic
gcaaataactaacatgcttttgaataatcaaccagtagcgctggttggagctcttccatttattaccgattcatc

SEQ ID NO: 303221 - DNA, 75 bp, Artificial Sequence
  Synthetic
ttgtcgtatggtgacgttacgagattcttatctagtaattctatggtattatatacagatgtttcgcaatgggat

SEQ ID NO: 303222 - DNA, 75 bp, Artificial Sequence
  Synthetic
atggcttctttaatttatagacagttattatcaaactcatatgttacaaacatctctgacgaagttaatgaaatt

SEQ ID NO: 303223 - DNA, 75 bp, Artificial Sequence
  Synthetic
attcgcacaaacgggatatgcgcctgttgactggggacatggtgaattgcctgattctacattagtgcaaccaac

SEQ ID NO: 303224 - DNA, 75 bp, Artificial Sequence
  Synthetic
gatccgaaagtggtgcagacattaaatttatataaacaaacacaaattaatctcatggattcatacgtacaaata

SEQ ID NO: 303225 - DNA, 75 bp, Artificial Sequence
  Synthetic
gtcaatcagataattcagacaatgtccaaaagatctagatcgcttaattcgtcagcgttctattacagagtatag

SEQ ID NO: 303226 - DNA, 75 bp, Artificial Sequence
  Synthetic
ggtgatatcactcatcttgtgttcactatggaggcaactactctttcagtaaagtcaattcttgttgctgcattt

SEQ ID NO: 303227 - DNA, 75 bp, Artificial Sequence
  Synthetic
acgactgacagatggtttgcttgtgtgctagttgaaccaaatgtgcaaaatacacaaagacaatacgtattagat

SEQ ID NO: 303228 - DNA, 75 bp, Artificial Sequence
  Synthetic
tacacaaagacaatacgtattagatgggcaaaatgtccaattacaggtctcaaacgattcaagtacttcgtggaa

SEQ ID NO: 303229 - DNA, 75 bp, Artificial Sequence
  Synthetic
ttcttgaagactctggagtgaaggcaaacattcttgggaaagcggcgactatagatcaggctctaagtggaaaga

SEQ ID NO: 303230 - DNA, 75 bp, Artificial Sequence
  Synthetic
gagggaaaatatttttcagagctggcataaatttattaaataatgaaaaacgtggacagagtacacaatgggatc

SEQ ID NO: 303231 - DNA, 75 bp, Artificial Sequence
  Synthetic
aaatataacacaagagactagagttttgaattcctgctttaaagtacgacgcgatccaaataaatcatcaagtta

SEQ ID NO: 303232 - DNA, 75 bp, Artificial Sequence
  Synthetic
ctaaaattatacaaatgacatctgtggctatcactggatcgttgaggttatttccatcagaacgagtactgacaa

SEQ ID NO: 303233 - DNA, 75 bp, Artificial Sequence
  Synthetic
gattggaaagctaaatttgaaaagcttaagactagatttcaagaaaaatacgatagttgggtagttaaagcacgt

SEQ ID NO: 303234 - DNA, 75 bp, Artificial Sequence
  Synthetic
attcgatttaaatttgctaattcaataattaaatcaggtggactaggttataagtggtcggaaatatcatttaag

SEQ ID NO: 303235 - DNA, 75 bp, Artificial Sequence
  Synthetic
acatacaacatgttcagtgaatggtgtcaatgattttaattataatggaggtacattacctactgattttgcaat

SEQ ID NO: 303236 - DNA, 75 bp, Artificial Sequence
  Synthetic
attgtatctaaaggtatagcagtgacagagaaagcaaaattgaattcgtacgcaccagtttatttagagaaacgt

SEQ ID NO: 303237 - DNA, 75 bp, Artificial Sequence
  Synthetic
gtacattacctactgattttgcaatatcgagatttgaggtcataaaggaaaattcttatgtatatgtagattatt

SEQ ID NO: 303238 - DNA, 75 bp, Artificial Sequence
  Synthetic
acaagaataggattgaagcactaatttcatccatcaaatgtaaaattgagtcaaaacagttcaataccgaaacga

SEQ ID NO: 303239 - DNA, 75 bp, Artificial Sequence
  Synthetic
ttctgactctaccgtactattacaggaattggccttacgacttggactattagtgtcatttgaataataatatat

SEQ ID NO: 303240 - DNA, 75 bp, Artificial Sequence
  Synthetic
tagtgtcatttgaataataatatatcaccaaatcttatcagcataaagtcccagtgtagttagaagctaacttga

SEQ ID NO: 303241 - DNA, 75 bp, Artificial Sequence
  Synthetic
gtttagcaaacgccatatctgatttaacaagcaatatgtcggaagcggcatcatctgtaagattgacgtcagtaa

SEQ ID NO: 303242 - DNA, 75 bp, Artificial Sequence
  Synthetic
ggcgatgacttaaggtctatgcaggacgtatcaacacaagtgtcaaatgtgagtagaaatttgagattgaaagag

SEQ ID NO: 303243 - DNA, 75 bp, Artificial Sequence
  Synthetic
ttcacgacgcaaactgatactttaagctttgatgacatatctgcagctgtattgaagacgaaactagacaaatcg

SEQ ID NO: 303244 - DNA, 75 bp, Artificial Sequence
  Synthetic
tcgaaactggaattgacggaacgttttatgcttacaaagtcgatacatttaatgaaattccgtttgatatggaac

SEQ ID NO: 303245 - DNA, 75 bp, Artificial Sequence
  Synthetic
caaagaataatatggcaaaattggtacgcatttacgtcctcaatgaaacaaggtaatactcttgatgtatgcaaa

SEQ ID NO: 303246 - DNA, 75 bp, Artificial Sequence
  Synthetic
gttaaacgggattaaggcttgagccacacgcgatatggctgactgtggcttctcagccagccatcaggtccgatg

SEQ ID NO: 303247 - DNA, 75 bp, Artificial Sequence
  Synthetic
tccaaaacgatcatatcgaatattaaaagatgatgaagtaatggaaattaatactgaaggaaaattctttgcata

SEQ ID NO: 303248 - DNA, 75 bp, Artificial Sequence
  Synthetic
ccactctcccattcttctagcgttttcacgtcttttgattaatttcttttgtcatgtctatctcgccagttgatt

SEQ ID NO: 303249 - DNA, 75 bp, Artificial Sequence
  Synthetic
tttaattaaatcaaatccaaatgtattacgtaattttattaatcaaaataatccaattataaggaatagaattga

SEQ ID NO: 303250 - DNA, 75 bp, Artificial Sequence
  Synthetic
aacgactctatccatttgcttttctatttcatctttagtagttatctgttctttataacccgctagtttcaataa

SEQ ID NO: 303251 - DNA, 75 bp, Artificial Sequence
  Synthetic
caagattatgacaaaacatttttaatgttgaaaggacttgcgaggcaatgcaactatgaatgtacgtacgaatag

SEQ ID NO: 303252 - DNA, 75 bp, Artificial Sequence
  Synthetic
gtgaacaaaaccgtcaggacagatgcaatatagggaaaatacgccattcctggatcctctagtattgtgtgtagt

SEQ ID NO: 303253 - DNA, 75 bp, Artificial Sequence
  Synthetic
tggatcctctagtattgtgtgtagtgtactgttcattagagtgattacactcaatgtgtagttgaggtcggtaag

SEQ ID NO: 303254 - DNA, 75 bp, Artificial Sequence
  Synthetic
atgtatggtattgaatataccacagttctattttatctgatatctttcgttcttgtgagttatattttgaaaact

SEQ ID NO: 303255 - DNA, 75 bp, Artificial Sequence
  Synthetic
caaaattatggaataaatttgccaattaccggatctatggatacagcctatgctaattcaacgcaaaatgaaaat

SEQ ID NO: 303256 - DNA, 75 bp, Artificial Sequence
  Synthetic
aaggatggccaacaggctcagtctattttaatgaatactcgaatgttctagaattctccgtcgatccaaagttat

SEQ ID NO: 303257 - DNA, 75 bp, Artificial Sequence
  Synthetic
atcataaattagatattacatctacaacatgtacgatacgaaactgtaataaattgggaccaagagaaaatgtag

SEQ ID NO: 303258 - DNA, 75 bp, Artificial Sequence
  Synthetic
ggggcaagttatttatacagtagttgattatattaatcagatagtgcaagtaatgtccaaaagatcaaggtcact

SEQ ID NO: 303259 - DNA, 75 bp, Artificial Sequence
  Synthetic
gattatattaatcagatagtgcaagtaatgtccaaaagatcaaggtcactagactcatcttctttttattataga

SEQ ID NO: 303260 - DNA, 75 bp, Artificial Sequence
  Synthetic
gagagaataagaaatgacgttaattatatacttaatatggatagaaatttgccatcaacagctagatatataaga

SEQ ID NO: 303261 - DNA, 75 bp, Artificial Sequence
  Synthetic
atgggatacaataacaacttcgaattacattttagcacgatcagtagtgccagatttgaaggaattagtttcaac

SEQ ID NO: 303262 - DNA, 75 bp, Artificial Sequence
  Synthetic
tcaaatgtaagtgatttgattcaacaatttaatcaaatgatagttactatgaatggaaatgattttcaaacggga

SEQ ID NO: 303263 - DNA, 75 bp, Artificial Sequence
  Synthetic
tggacatattagctaacatgactaatgatgctaaagttattcagacactaaatttatataaacaaacacaaatta

SEQ ID NO: 303264 - DNA, 75 bp, Artificial Sequence
  Synthetic
caatagtgtatccagcgttcggaatgcaacggatgcattataggaacggagacccacaaacaccattccagatag

SEQ ID NO: 303265 - DNA, 75 bp, Artificial Sequence
  Synthetic
attggacttttgactttggattacttggtactactttacttaatctagatgcaaattacgttgagaatgctagaa

SEQ ID NO: 303266 - DNA, 75 bp, Artificial Sequence
  Synthetic
gagttgtaaaatattcatcagttgcaaatcatgcagatagagtttacgctactttcaagagtaacaacaaaagcg

SEQ ID NO: 303267 - DNA, 75 bp, Artificial Sequence
  Synthetic
ctttaatgcaactatcacgacaacagtttccaacgatgcctgttgattataaaagatcaattcaacgtggaatat

SEQ ID NO: 303268 - DNA, 75 bp, Artificial Sequence
  Synthetic
tgttcaaactttaacaacggaaaagttgcagttaacttcagttacatcattgtgcatgctaattgggaatgcaac

SEQ ID NO: 303269 - DNA, 75 bp, Artificial Sequence
  Synthetic
actgcagccaacagactgaacttatatcagaaaaagatgaaagcaatagtcgaggatttcctaaaaagattacat

SEQ ID NO: 303270 - DNA, 75 bp, Artificial Sequence
  Synthetic
agtgataacggacgacctgcaacaagacaaaaaggacgtatcatcagatgacaaccttaaattagataaacaagt

SEQ ID NO: 303271 - DNA, 75 bp, Artificial Sequence
  Synthetic
atcccatcatttcaacctagtgaaacggtattgaagaaacttatagacataaaaccagatccagttaaaaaatca

SEQ ID NO: 303272 - DNA, 75 bp, Artificial Sequence
  Synthetic
ataatttaaattcagtaaaatgtacaggtggaagttatgatttcagtataccagtaggtgaatggccagtaataa

SEQ ID NO: 303273 - DNA, 75 bp, Artificial Sequence
  Synthetic
ttaatttaaattcagtaaaatgtacaggtggaagttatgatttcagtataccagtaggtgaatggccagtaataa

SEQ ID NO: 303274 - DNA, 75 bp, Artificial Sequence
  Synthetic
ctaatttaaattcagtaaaatgtacaggtggaagttatgatttcagtataccagtaggtgaatggccagtaataa

SEQ ID NO: 303275 - DNA, 75 bp, Artificial Sequence
  Synthetic
gtaatttaaattcagtaaaatgtacaggtggaagttatgatttcagtataccagtaggtgaatggccagtaataa

SEQ ID NO: 303276 - DNA, 75 bp, Artificial Sequence
  Synthetic
atgatttacctgaaggagattatgacgtcagagaatactttctacacctttattcgcaggtacttgaatacatgc

SEQ ID NO: 303277 - DNA, 75 bp, Artificial Sequence
  Synthetic
aatccttatgaaccaaaagaagtgactgcagcaatgtaagaggttgagctgccgtcgactgtcttcggaagcggc

SEQ ID NO: 303278 - DNA, 75 bp, Artificial Sequence
  Synthetic
atttcaggatgaagaaactgaaggtgtagttagaagattcattgccgatatgaggcaaagggtgaatgcagaacg

SEQ ID NO: 303279 - DNA, 75 bp, Artificial Sequence
  Synthetic
aaagttctgttccgagagagcgcgtgcggaaagatggataagcttgccgacctcaactacacattgagtgtaatc

SEQ ID NO: 303280 - DNA, 75 bp, Artificial Sequence
  Synthetic
aatctgatgtcgccaatgttctttcaagagtagtttctattagacatttggaaaatctagtgttaaggaaagaaa

SEQ ID NO: 303281 - DNA, 75 bp, Artificial Sequence
  Synthetic
atttataactacataccagaaaggctaagaaacgatccaaattacattctgaatatggatataaacttaccaccg

SEQ ID NO: 303282 - DNA, 75 bp, Artificial Sequence
  Synthetic
tagccagatcagttgtaccggatttgaaggaattggtgtcaactgaagcacagattcagaagatgtcgcaagatt

SEQ ID NO: 303283 - DNA, 75 bp, Artificial Sequence
  Synthetic
gtcggagacacaatttttaacaggcatcaattctcaagcagcgaacgatgcattcaagacgatcatagcatgcat

SEQ ID NO: 303284 - DNA, 75 bp, Artificial Sequence
  Synthetic
ggcttttaaacgaagtcttcgacatggaggttctgtattcattatcaaaaactttgaaagatgctagggataaaa

SEQ ID NO: 303285 - DNA, 75 bp, Artificial Sequence
  Synthetic
tgtgagtgatttaattcaacaattcaatcaaatgatagttactatgaatggaaatgattttcagacaggaggaat

SEQ ID NO: 303286 - DNA, 75 bp, Artificial Sequence
  Synthetic
atacgagaatcactagtggcatgtcagttagcagtagtaaacacaataatttacccagccttcggactgcagaag

SEQ ID NO: 303287 - DNA, 75 bp, Artificial Sequence
  Synthetic
atacatttaatcaagttgtcatcgatggagttattaatcaaacgttaaacgatcaaataaggcgtggtttaatta

SEQ ID NO: 303288 - DNA, 75 bp, Artificial Sequence
  Synthetic
atactggtctgccaccaattcaaaatactagaaatgtaattccattgccattatcatctagatcgatacagtata

SEQ ID NO: 303289 - DNA, 75 bp, Artificial Sequence
  Synthetic
tggagttattaatcaaacgttaaacgatcaaataaggcgtggtttaattataaatcaacttatggaagcattgaa

SEQ ID NO: 303290 - DNA, 75 bp, Artificial Sequence
  Synthetic
tacttaattacatattaaagagtataactagaatgatggactacataatttacaaatttttgcttatagtcacaa

SEQ ID NO: 303291 - DNA, 75 bp, Artificial Sequence
  Synthetic
tctaacatcaacattatgtttgtactatccaacagaagctagaacagaaataaatgataatgagtggacaagtac

SEQ ID NO: 303292 - DNA, 75 bp, Artificial Sequence
  Synthetic
aatgggaactatgtggattaacgctgggtcagaaattcaggtagctggatttgattattcgtgtgcttttaatgc

SEQ ID NO: 303293 - DNA, 75 bp, Artificial Sequence
  Synthetic
attatcagactaacgttaacttccataacaattataatgagagaataaacgatgccgttgctattattgctgcgg

SEQ ID NO: 303294 - DNA, 75 bp, Artificial Sequence
  Synthetic
gatatacagacttcgtgataggctcagacggctaccagtggaaaggagacgcgttgacgtattcggtataatact

SEQ ID NO: 303295 - DNA, 75 bp, Artificial Sequence
  Synthetic
ttcgtcaacttggcgcgcgatgttaacggttatcaacagattaatttagaagagctaatgcgctctggagactac

SEQ ID NO: 303296 - DNA, 75 bp, Artificial Sequence
  Synthetic
tagatgctacagtcttcgcgcaaatcgtcaagcagagaaaggtagacacgatcaaaccaattctgttcaagatta

SEQ ID NO: 303297 - DNA, 75 bp, Artificial Sequence
  Synthetic
actaaaattatacaaatgacatctgtagccattactggatcactaaggctatttccatcagaacgagtgttaact

SEQ ID NO: 303298 - DNA, 75 bp, Artificial Sequence
  Synthetic
cataaattagatgttacaacgacaacttgtactatacgcaactgtaaaaaattaggaccaagagaaaatgtggca

SEQ ID NO: 303299 - DNA, 75 bp, Artificial Sequence
  Synthetic
tgcagcaatgcacatattgtcatcgaatttaacttttaccatgttttatgagttgttaccatttgtaaatgctga

SEQ ID NO: 303300 - DNA, 75 bp, Artificial Sequence
  Synthetic
agttgttaccatttgtaaatgctgatacagtcgaaccaattaatgctgttgcaattcgacaatgttagaattatg

SEQ ID NO: 303301 - DNA, 75 bp, Artificial Sequence
  Synthetic
acatggttctttaatccaattatcctaagaccaaacaatgtagaggtagaatttttactgaatggacaaattatt

SEQ ID NO: 303302 - DNA, 75 bp, Artificial Sequence
  Synthetic
atagaaattggatgactgattctaaaacagtggctaaattagatgaagatgtgaacaaacttagaatgatgttat

SEQ ID NO: 303303 - DNA, 75 bp, Artificial Sequence
  Synthetic
gtgaacaaacttagaatgatgttatcttctaaaggaattgatcagaagatgagagtacttaatgcttgctttagt

SEQ ID NO: 303304 - DNA, 75 bp, Artificial Sequence
  Synthetic
ttgatgaaaaaatggagattgatactattgattggaaatctagatatgatcaattagaaaagagatttgaatcat

SEQ ID NO: 303305 - DNA, 75 bp, Artificial Sequence
  Synthetic
tgaagaatatactgattcattaatggatcccgctatattaacttcactatcttcaaatttaaatgcagttatgtt

SEQ ID NO: 303306 - DNA, 75 bp, Artificial Sequence
  Synthetic
cttgtactattagaaattgtagaaaattaggaccaagagagaatgtggcaattatacaagttggcggctcagaag

SEQ ID NO: 303307 - DNA, 75 bp, Artificial Sequence
  Synthetic
attttatcatattcgaataggtcaacactagctaaattagtttcatctccaatgtcaatattggtcgcactgata

SEQ ID NO: 303308 - DNA, 75 bp, Artificial Sequence
  Synthetic
ttacattaatcagatagtgcaaatgatgtccaaaagatcgagatcgttagagtcggggcccttctattatagagt

SEQ ID NO: 303309 - DNA, 75 bp, Artificial Sequence
  Synthetic
agtacttattttaatgtgctaaaaacatcacatattgaattttatagtatttcaaccagatgtagaatgtttacg

SEQ ID NO: 303310 - DNA, 75 bp, Artificial Sequence
  Synthetic
cttaatgaatggctttgcaatccaatggatattactttatactattatcaacaaactgatgaagctaataaatgg

SEQ ID NO: 303311 - DNA, 75 bp, Artificial Sequence
  Synthetic
cataaaattaacgtaacaacaactacttgtaccatcagaaattgtaaaaaattaggaccaagagaaaacgtagca

SEQ ID NO: 303312 - DNA, 75 bp, Artificial Sequence
  Synthetic
gaagaaattacaatttcaaatacttcattatggaaagaaatgcaatataaaagagatattataataagatttaaa

SEQ ID NO: 303313 - DNA, 75 bp, Artificial Sequence
  Synthetic
gaagaaattacaatttcaaatacttcattatggaaagaaatgcaatataatagagatattataataagatttaaa

SEQ ID NO: 303314 - DNA, 75 bp, Artificial Sequence
  Synthetic
gaagaaattacaatttcaaatacttcattatggaaagaaatgcaatataacagagatattataataagatttaaa

SEQ ID NO: 303315 - DNA, 75 bp, Artificial Sequence
  Synthetic
gaagaaattacaatttcaaatacttcattatggaaagaaatgcaatataagagagatattataataagatttaaa

SEQ ID NO: 303316 - DNA, 75 bp, Artificial Sequence
  Synthetic
gaagaaattacaatttcaaatacttcattatggaatgaaatgcaatataaaagagatattataataagatttaaa

SEQ ID NO: 303317 - DNA, 75 bp, Artificial Sequence
  Synthetic
gaagaaattacaatttcaaatacttcattatggaatgaaatgcaatataatagagatattataataagatttaaa

SEQ ID NO: 303318 - DNA, 75 bp, Artificial Sequence
  Synthetic
gaagaaattacaatttcaaatacttcattatggaatgaaatgcaatataacagagatattataataagatttaaa

SEQ ID NO: 303319 - DNA, 75 bp, Artificial Sequence
  Synthetic
gaagaaattacaatttcaaatacttcattatggaatgaaatgcaatataagagagatattataataagatttaaa

SEQ ID NO: 303320 - DNA, 75 bp, Artificial Sequence
  Synthetic
gaagaaattacaatttcaaatacttcattatggaacgaaatgcaatataaaagagatattataataagatttaaa

SEQ ID NO: 303321 - DNA, 75 bp, Artificial Sequence
  Synthetic
gaagaaattacaatttcaaatacttcattatggaacgaaatgcaatataatagagatattataataagatttaaa

SEQ ID NO: 303322 - DNA, 75 bp, Artificial Sequence
  Synthetic
gaagaaattacaatttcaaatacttcattatggaacgaaatgcaatataacagagatattataataagatttaaa

SEQ ID NO: 303323 - DNA, 75 bp, Artificial Sequence
  Synthetic
gaagaaattacaatttcaaatacttcattatggaacgaaatgcaatataagagagatattataataagatttaaa

SEQ ID NO: 303324 - DNA, 75 bp, Artificial Sequence
  Synthetic
gaagaaattacaatttcaaatacttcattatggaaggaaatgcaatataaaagagatattataataagatttaaa

SEQ ID NO: 303325 - DNA, 75 bp, Artificial Sequence
  Synthetic
gaagaaattacaatttcaaatacttcattatggaaggaaatgcaatataatagagatattataataagatttaaa

SEQ ID NO: 303326 - DNA, 75 bp, Artificial Sequence
  Synthetic
gaagaaattacaatttcaaatacttcattatggaaggaaatgcaatataacagagatattataataagatttaaa

SEQ ID NO: 303327 - DNA, 75 bp, Artificial Sequence
  Synthetic
gaagaaattacaatttcaaatacttcattatggaaggaaatgcaatataagagagatattataataagatttaaa

SEQ ID NO: 303328 - DNA, 75 bp, Artificial Sequence
  Synthetic
gaagatattacaatttcaaatacttcattatggaaagaaatgcaatataaaagagatattataataagatttaaa

SEQ ID NO: 303329 - DNA, 75 bp, Artificial Sequence
  Synthetic
gaagatattacaatttcaaatacttcattatggaaagaaatgcaatataatagagatattataataagatttaaa

SEQ ID NO: 303330 - DNA, 75 bp, Artificial Sequence
  Synthetic
gaagatattacaatttcaaatacttcattatggaaagaaatgcaatataacagagatattataataagatttaaa

SEQ ID NO: 303331 - DNA, 75 bp, Artificial Sequence
  Synthetic
gaagatattacaatttcaaatacttcattatggaaagaaatgcaatataagagagatattataataagatttaaa

SEQ ID NO: 303332 - DNA, 75 bp, Artificial Sequence
  Synthetic
gaagatattacaatttcaaatacttcattatggaatgaaatgcaatataaaagagatattataataagatttaaa

SEQ ID NO: 303333 - DNA, 75 bp, Artificial Sequence
  Synthetic
gaagatattacaatttcaaatacttcattatggaatgaaatgcaatataatagagatattataataagatttaaa

SEQ ID NO: 303334 - DNA, 75 bp, Artificial Sequence
  Synthetic
gaagatattacaatttcaaatacttcattatggaatgaaatgcaatataacagagatattataataagatttaaa

SEQ ID NO: 303335 - DNA, 75 bp, Artificial Sequence
  Synthetic
gaagatattacaatttcaaatacttcattatggaatgaaatgcaatataagagagatattataataagatttaaa

SEQ ID NO: 303336 - DNA, 75 bp, Artificial Sequence
  Synthetic
gaagatattacaatttcaaatacttcattatggaacgaaatgcaatataaaagagatattataataagatttaaa

SEQ ID NO: 303337 - DNA, 75 bp, Artificial Sequence
  Synthetic
gaagatattacaatttcaaatacttcattatggaacgaaatgcaatataatagagatattataataagatttaaa

SEQ ID NO: 303338 - DNA, 75 bp, Artificial Sequence
  Synthetic
gaagatattacaatttcaaatacttcattatggaacgaaatgcaatataacagagatattataataagatttaaa

SEQ ID NO: 303339 - DNA, 75 bp, Artificial Sequence
  Synthetic
gaagatattacaatttcaaatacttcattatggaacgaaatgcaatataagagagatattataataagatttaaa

SEQ ID NO: 303340 - DNA, 75 bp, Artificial Sequence
  Synthetic
gaagatattacaatttcaaatacttcattatggaaggaaatgcaatataaaagagatattataataagatttaaa

SEQ ID NO: 303341 - DNA, 75 bp, Artificial Sequence
  Synthetic
gaagatattacaatttcaaatacttcattatggaaggaaatgcaatataatagagatattataataagatttaaa

SEQ ID NO: 303342 - DNA, 75 bp, Artificial Sequence
  Synthetic
gaagatattacaatttcaaatacttcattatggaaggaaatgcaatataacagagatattataataagatttaaa

SEQ ID NO: 303343 - DNA, 75 bp, Artificial Sequence
  Synthetic
gaagatattacaatttcaaatacttcattatggaaggaaatgcaatataagagagatattataataagatttaaa

SEQ ID NO: 303344 - DNA, 75 bp, Artificial Sequence
  Synthetic
gaagacattacaatttcaaatacttcattatggaaagaaatgcaatataaaagagatattataataagatttaaa

SEQ ID NO: 303345 - DNA, 75 bp, Artificial Sequence
  Synthetic
gaagacattacaatttcaaatacttcattatggaaagaaatgcaatataatagagatattataataagatttaaa

SEQ ID NO: 303346 - DNA, 75 bp, Artificial Sequence
  Synthetic
gaagacattacaatttcaaatacttcattatggaaagaaatgcaatataacagagatattataataagatttaaa

SEQ ID NO: 303347 - DNA, 75 bp, Artificial Sequence
  Synthetic
gaagacattacaatttcaaatacttcattatggaaagaaatgcaatataagagagatattataataagatttaaa

SEQ ID NO: 303348 - DNA, 75 bp, Artificial Sequence
  Synthetic
gaagacattacaatttcaaatacttcattatggaatgaaatgcaatataaaagagatattataataagatttaaa

SEQ ID NO: 303349 - DNA, 75 bp, Artificial Sequence
  Synthetic
gaagacattacaatttcaaatacttcattatggaatgaaatgcaatataatagagatattataataagatttaaa

SEQ ID NO: 303350 - DNA, 75 bp, Artificial Sequence
  Synthetic
gaagacattacaatttcaaatacttcattatggaatgaaatgcaatataacagagatattataataagatttaaa

SEQ ID NO: 303351 - DNA, 75 bp, Artificial Sequence
  Synthetic
gaagacattacaatttcaaatacttcattatggaatgaaatgcaatataagagagatattataataagatttaaa

SEQ ID NO: 303352 - DNA, 75 bp, Artificial Sequence
  Synthetic
gaagacattacaatttcaaatacttcattatggaacgaaatgcaatataaaagagatattataataagatttaaa

SEQ ID NO: 303353 - DNA, 75 bp, Artificial Sequence
  Synthetic
gaagacattacaatttcaaatacttcattatggaacgaaatgcaatataatagagatattataataagatttaaa

SEQ ID NO: 303354 - DNA, 75 bp, Artificial Sequence
  Synthetic
gaagacattacaatttcaaatacttcattatggaacgaaatgcaatataacagagatattataataagatttaaa

SEQ ID NO: 303355 - DNA, 75 bp, Artificial Sequence
  Synthetic
gaagacattacaatttcaaatacttcattatggaacgaaatgcaatataagagagatattataataagatttaaa

SEQ ID NO: 303356 - DNA, 75 bp, Artificial Sequence
  Synthetic
gaagacattacaatttcaaatacttcattatggaaggaaatgcaatataaaagagatattataataagatttaaa

SEQ ID NO: 303357 - DNA, 75 bp, Artificial Sequence
  Synthetic
gaagacattacaatttcaaatacttcattatggaaggaaatgcaatataatagagatattataataagatttaaa

SEQ ID NO: 303358 - DNA, 75 bp, Artificial Sequence
  Synthetic
gaagacattacaatttcaaatacttcattatggaaggaaatgcaatataacagagatattataataagatttaaa

SEQ ID NO: 303359 - DNA, 75 bp, Artificial Sequence
  Synthetic
gaagacattacaatttcaaatacttcattatggaaggaaatgcaatataagagagatattataataagatttaaa

SEQ ID NO: 303360 - DNA, 75 bp, Artificial Sequence
  Synthetic
gaagagattacaatttcaaatacttcattatggaaagaaatgcaatataaaagagatattataataagatttaaa

SEQ ID NO: 303361 - DNA, 75 bp, Artificial Sequence
  Synthetic
gaagagattacaatttcaaatacttcattatggaaagaaatgcaatataatagagatattataataagatttaaa

SEQ ID NO: 303362 - DNA, 75 bp, Artificial Sequence
  Synthetic
gaagagattacaatttcaaatacttcattatggaaagaaatgcaatataacagagatattataataagatttaaa

SEQ ID NO: 303363 - DNA, 75 bp, Artificial Sequence
  Synthetic
gaagagattacaatttcaaatacttcattatggaaagaaatgcaatataagagagatattataataagatttaaa

SEQ ID NO: 303364 - DNA, 75 bp, Artificial Sequence
  Synthetic
gaagagattacaatttcaaatacttcattatggaatgaaatgcaatataaaagagatattataataagatttaaa

SEQ ID NO: 303365 - DNA, 75 bp, Artificial Sequence
  Synthetic
gaagagattacaatttcaaatacttcattatggaatgaaatgcaatataatagagatattataataagatttaaa

SEQ ID NO: 303366 - DNA, 75 bp, Artificial Sequence
  Synthetic
gaagagattacaatttcaaatacttcattatggaatgaaatgcaatataacagagatattataataagatttaaa

SEQ ID NO: 303367 - DNA, 75 bp, Artificial Sequence
  Synthetic
gaagagattacaatttcaaatacttcattatggaatgaaatgcaatataagagagatattataataagatttaaa

SEQ ID NO: 303368 - DNA, 75 bp, Artificial Sequence
  Synthetic
gaagagattacaatttcaaatacttcattatggaacgaaatgcaatataaaagagatattataataagatttaaa

SEQ ID NO: 303369 - DNA, 75 bp, Artificial Sequence
  Synthetic
gaagagattacaatttcaaatacttcattatggaacgaaatgcaatataatagagatattataataagatttaaa

SEQ ID NO: 303370 - DNA, 75 bp, Artificial Sequence
  Synthetic
gaagagattacaatttcaaatacttcattatggaacgaaatgcaatataacagagatattataataagatttaaa

SEQ ID NO: 303371 - DNA, 75 bp, Artificial Sequence
  Synthetic
gaagagattacaatttcaaatacttcattatggaacgaaatgcaatataagagagatattataataagatttaaa

SEQ ID NO: 303372 - DNA, 75 bp, Artificial Sequence
  Synthetic
gaagagattacaatttcaaatacttcattatggaaggaaatgcaatataaaagagatattataataagatttaaa

SEQ ID NO: 303373 - DNA, 75 bp, Artificial Sequence
  Synthetic
gaagagattacaatttcaaatacttcattatggaaggaaatgcaatataatagagatattataataagatttaaa

SEQ ID NO: 303374 - DNA, 75 bp, Artificial Sequence
  Synthetic
gaagagattacaatttcaaatacttcattatggaaggaaatgcaatataacagagatattataataagatttaaa

SEQ ID NO: 303375 - DNA, 75 bp, Artificial Sequence
  Synthetic
gaagagattacaatttcaaatacttcattatggaaggaaatgcaatataagagagatattataataagatttaaa

SEQ ID NO: 303376 - DNA, 75 bp, Artificial Sequence
  Synthetic
gttaaaagaatccctggaaaatcatcatctatagtgaaatgtactagattaatgaaagataaattagagcgtggt

SEQ ID NO: 303377 - DNA, 75 bp, Artificial Sequence
  Synthetic
tacaataataaattggagcgtgatttgcaatcaaagattggatcagttgtttcatctgtagaatggtatctacgt

SEQ ID NO: 303378 - DNA, 75 bp, Artificial Sequence
  Synthetic
atatctatcatattattgaattacatattaaaaactataactaatacaatggactacataatttttagattttta

SEQ ID NO: 303379 - DNA, 75 bp, Artificial Sequence
  Synthetic
atgtatgttgacagcaaaagtagataaaaaagatcaagataaattttacaattctattgtttatgggattgcgcc

SEQ ID NO: 303380 - DNA, 75 bp, Artificial Sequence
  Synthetic
ggttataaatggtctgaaatatcatataaggcagcaaattatcaatataattatttacgtgacggtgaacaagta

SEQ ID NO: 303381 - DNA, 75 bp, Artificial Sequence
  Synthetic
caaccctattgaatctagatgctaattatgttgagaccgcccgtaacacgattgattattttgttgattttgtag

SEQ ID NO: 303382 - DNA, 75 bp, Artificial Sequence
  Synthetic
tatatagaaaattggaatttgcaaaatagaagacagagaacaggctttacatttcataaaccaaacattttccca

SEQ ID NO: 303383 - DNA, 75 bp, Artificial Sequence
  Synthetic
aagatagttatgaaaatgcatttcttatatctaatcttacaacacacaacatattatatttaaattacagcatta

SEQ ID NO: 303384 - DNA, 75 bp, Artificial Sequence
  Synthetic
tgaaaataggataatttatttacatgattactcatattacactaacaatgaaataagaactgatcaacattgggt

SEQ ID NO: 303385 - DNA, 75 bp, Artificial Sequence
  Synthetic
accagagaaaacctattatatatatggttggttcagctccttcatattggatttacgatgtcaaacaatattctg

SEQ ID NO: 303386 - DNA, 75 bp, Artificial Sequence
  Synthetic
aaataataaataattatcaggcaaggtttggaacaattgtagcaaggaattttgatacaattagactgtcatttc

SEQ ID NO: 303387 - DNA, 75 bp, Artificial Sequence
  Synthetic
ttccatattatatattgatattagaactgatcgtggaaacacagattggaaagaatggaggaagatagttgaggc

SEQ ID NO: 303388 - DNA, 75 bp, Artificial Sequence
  Synthetic
accatgctacagtaggattaaccctacgaattgaatccgcaatttgtgagtcagtacttgctgatgccagtgaga

SEQ ID NO: 303389 - DNA, 75 bp, Artificial Sequence
  Synthetic
atttaattaacaatcagaaacaatcacttattactgtgagaattaataatacatttaaagatgaaccaaaagtag

SEQ ID NO: 303390 - DNA, 75 bp, Artificial Sequence
  Synthetic
ttcaccatctagagaggataatttacaacgagtatttacagtggcttccattagaagcatgcttatcaaataagg

SEQ ID NO: 303391 - DNA, 75 bp, Artificial Sequence
  Synthetic
cttaacagcaagtctcatcggacctgatgatcagttgagaagccacaactgatcatatcgcgtgtggcttaagcc

SEQ ID NO: 303392 - DNA, 75 bp, Artificial Sequence
  Synthetic
gacaatcacgtatgtttattcctcacataacgcttagctttagtaataaacaaacggttagaatagaaagtacga

SEQ ID NO: 303393 - DNA, 75 bp, Artificial Sequence
  Synthetic
aatataatgctaattcagagttggatatgtcggaattggcggacctgatacttaatgaatggttatgcaatccaa

SEQ ID NO: 303394 - DNA, 75 bp, Artificial Sequence
  Synthetic
tgcaagagaactaataattctttcatattcgaatagatctactttagctaaaatcgtttcgtcaccaatgtcaat

SEQ ID NO: 303395 - DNA, 75 bp, Artificial Sequence
  Synthetic
actgacactacgacttttgaagaagttgcaacagctgagaaattggcaataacggacgttgttgatggagtaaac

SEQ ID NO: 303396 - DNA, 75 bp, Artificial Sequence
  Synthetic
atgagagtaaattggaaaaaatggtggcaagttttttatactgttgttgattatgtaaaccagataattcaagca

SEQ ID NO: 303397 - DNA, 75 bp, Artificial Sequence
  Synthetic
aaccagtgtcatttaaatcaaataaaattactattaatgacattttgcgtgacataaaaccattttttgtcactt

SEQ ID NO: 303398 - DNA, 75 bp, Artificial Sequence
  Synthetic
taccaaagatgatacaggattggctagtggattgttcaattgaaaaatttccattaatggcgaagatttattctt

SEQ ID NO: 303399 - DNA, 75 bp, Artificial Sequence
  Synthetic
gaaacgatgttaattatatcctaaacatggatatgaacctaccatcaacagcaagatatattagaccaaatttgt

SEQ ID NO: 303400 - DNA, 75 bp, Artificial Sequence
  Synthetic
atttaatggattcatatgtacaaataccagatggagatgtgattaaaaagatacagtatggagcagttgcatcag

SEQ ID NO: 303401 - DNA, 75 bp, Artificial Sequence
  Synthetic
tagagatatgcaactagaaagagatgaaatgtatggatacgtcaatattgctagaaacctggacggatatcaaca

SEQ ID NO: 303402 - DNA, 75 bp, Artificial Sequence
  Synthetic
gcagctaattccatagctaacttagcactcattaaaacagtattgtcaagaattgcgaataagtattcttttata

SEQ ID NO: 303403 - DNA, 75 bp, Artificial Sequence
  Synthetic
aaaagatgttagtttatgcaaagcatactagggaatatgctgaattttactcgcagtccaatcagcttctttcgt

SEQ ID NO: 303404 - DNA, 75 bp, Artificial Sequence
  Synthetic
aagccctagtttcaacggttggaatagagattgctaaacgttacattgctggcggaaaaatatttttcagagcag

SEQ ID NO: 303405 - DNA, 75 bp, Artificial Sequence
  Synthetic
attactggatcactaagattatttccgtcagaacgagtgttaactactaattctacattcaaagtatttgactca

SEQ ID NO: 303406 - DNA, 75 bp, Artificial Sequence
  Synthetic
gaaatgtgattaagaaaatacagtatggagcggttgcatcaggtgaaaaacaaacaaaagccgctaattccatag

SEQ ID NO: 303407 - DNA, 75 bp, Artificial Sequence
  Synthetic
gcaaacaggagaggcaaataaatggatatcaatgggatcatcatgtactgttaaagtgtgtccattaaatacgca

SEQ ID NO: 303408 - DNA, 75 bp, Artificial Sequence
  Synthetic
ttaagtcaaataaaataactattaatgatattttacatgatattaaaccatactttgtaacaagtgaggctaatc

SEQ ID NO: 303409 - DNA, 75 bp, Artificial Sequence
  Synthetic
agatttggaacaatcgtagctagaaactttgatacaatcagattgtcattccagttgatgagaccaccaaatatg

SEQ ID NO: 303410 - DNA, 75 bp, Artificial Sequence
  Synthetic
ctccttaactaaaggtattaatgttagtgctaatcttgattcatgtatatcaatttcaactgatcataaaaagga

SEQ ID NO: 303411 - DNA, 75 bp, Artificial Sequence
  Synthetic
caaaaatttattctcaagataagtatagaatactagaatcatacgtatataatttattgtccattaattatgggt

SEQ ID NO: 303412 - DNA, 75 bp, Artificial Sequence
  Synthetic
agaaatattttgcactaagaatgaggatgaagcaagtcgcaatgcaattgatcgaagatttgtaatgtcaacctg

SEQ ID NO: 303413 - DNA, 75 bp, Artificial Sequence
  Synthetic
tgctggaggctagtactgatggtaaatatttcgcttacaaagttgaaacatttgaagagattccattcgatgtcc

SEQ ID NO: 303414 - DNA, 75 bp, Artificial Sequence
  Synthetic
actctaccagatggagattatgatgttagagagtacttccttaatttatatgaccaggtacttactgaaatgcca

SEQ ID NO: 303415 - DNA, 75 bp, Artificial Sequence
  Synthetic
gaagttgaagttgatgattcatttgttgatgagaaaatggaaattgatactattgattggaaatctagatatgat

SEQ ID NO: 303416 - DNA, 75 bp, Artificial Sequence
  Synthetic
acagcaacgaacatatacaatttttggagtacaagaacaaattacagtagagaatacttcacagacgcaatggag

SEQ ID NO: 303417 - DNA, 75 bp, Artificial Sequence
  Synthetic
aaatcaaatagcagatcttcagcaatattgcaataaattagaaactgacttacaaaataaaattagttcattagt

SEQ ID NO: 303418 - DNA, 75 bp, Artificial Sequence
  Synthetic
ttcaattgacgcgatcaatccaattaatgctgtagatgatcttgaatcactgattagaaatttaattcaagatta

SEQ ID NO: 303419 - DNA, 75 bp, Artificial Sequence
  Synthetic
aatgatgcgaataaattggaaaaaatggtggcaagtgttttacacggtagtggattacgtcaatcaaataattca

SEQ ID NO: 303420 - DNA, 75 bp, Artificial Sequence
  Synthetic
gcaagaaaaggagattgaaaagaatacagacgcaataatggaaaataaagctagcaataaaaaacagcaattatc

SEQ ID NO: 303421 - DNA, 75 bp, Artificial Sequence
  Synthetic
caacttagattcgaatattcagttgctaaattcaccagatcatgttttactccaacacttaaatcaacagagtac

SEQ ID NO: 303422 - DNA, 75 bp, Artificial Sequence
  Synthetic
gaatactttttacaacaccaattagtagaaccactaaataatgatataatatttaattacattccagaaaggata

SEQ ID NO: 303423 - DNA, 75 bp, Artificial Sequence
  Synthetic
ccaacttttgaaccaaaggaatctattttgaaaaaattagaagatataagaccagagcaagctaaaaaacaaact

SEQ ID NO: 303424 - DNA, 75 bp, Artificial Sequence
  Synthetic
agaatgactacatctcttccaatcgctagattgtcaaatcgtgtgtttagagataaattatttccatctattgta

SEQ ID NO: 303425 - DNA, 75 bp, Artificial Sequence
  Synthetic
caaataggcttggtcaactagttgatttaactagattgctagcttacaattatgagacactaatggcatgcatta

SEQ ID NO: 303426 - DNA, 75 bp, Artificial Sequence
  Synthetic
ggacatgtggcattttccataatgtgtactcgtgtgatttttgcaacgtcaatcatatttgtagatcttgtaagg

SEQ ID NO: 303427 - DNA, 75 bp, Artificial Sequence
  Synthetic
gatcaaatattaatagaaatgccagattatttactattgaaagatatggctgtggaaaataaaaattctagagac

SEQ ID NO: 303428 - DNA, 75 bp, Artificial Sequence
  Synthetic
agatgaaggcaatagttgaagattttctaaaaagattacatattttcgacgtggctagagttccagatgatcaaa

SEQ ID NO: 303429 - DNA, 75 bp, Artificial Sequence
  Synthetic
tttgttacataatctaattcctctatacgaaaaatactttaaaatcttaagtaaaatatcgagaagtgccgtgtg

SEQ ID NO: 303430 - DNA, 75 bp, Artificial Sequence
  Synthetic
attagaagatttattgcagatatgagacagcaagttcaagctgacagaaacattgtcaattatccatcaatttta

SEQ ID NO: 303431 - DNA, 75 bp, Artificial Sequence
  Synthetic
ttagatatttttaatttaatactgatgaacatggatcagatagaacgtgcctcagataaaattgcacagggtgtt

SEQ ID NO: 303432 - DNA, 75 bp, Artificial Sequence
  Synthetic
gcattcaaatctgttgacaaatgcaatgtaattggctacgagaaaatttatatgaatttgctgtttgggcattat

SEQ ID NO: 303433 - DNA, 75 bp, Artificial Sequence
  Synthetic
ttgcgctgtccagaggtaaagctttaaattccatggttaatatggatgtatcctccaatgttgtggagataccgt

SEQ ID NO: 303434 - DNA, 75 bp, Artificial Sequence
  Synthetic
ataacaacatcaaattatatattagctagatcagtggtacctgacttgaaggaaaaagagttggtttcgactgaa

SEQ ID NO: 303435 - DNA, 75 bp, Artificial Sequence
  Synthetic
aattttgtcatgttttcatccagaacaacttctaaaagagatttttacttcatggatggtaataaacgtaagagt

SEQ ID NO: 303436 - DNA, 75 bp, Artificial Sequence
  Synthetic
ttcagaagattttatcatagagtatggaacaactgatgatgaagtgtatatacaaagagcatttatgtctttatc

SEQ ID NO: 303437 - DNA, 75 bp, Artificial Sequence
  Synthetic
tacttttcatactatgagaatttagtacatgatgtgttggacaatttgcaggacattagaaaatttgctggagct

SEQ ID NO: 303438 - DNA, 75 bp, Artificial Sequence
  Synthetic
gaaaaacaagattcaaataaaatacaattatctgataaggtactttcgaaaaaagaagaagttgtaacggatagt

SEQ ID NO: 303439 - DNA, 75 bp, Artificial Sequence
  Synthetic
atagtatctagaggaatagctttaactgaaaaagcgaaattgaattcgtatgcaccaatatcactcgagaagaga

SEQ ID NO: 303440 - DNA, 75 bp, Artificial Sequence
  Synthetic
gtaagatattgatgaaaacatgttgttatcatgatacacgctgtgctgatattactacaatttttagcatttcac

SEQ ID NO: 303441 - DNA, 75 bp, Artificial Sequence
  Synthetic
cgatggagtattgaatcaaacacttaatgataacattaggaatgggcaagtcattaatcaattaatggaagcgtt

SEQ ID NO: 303442 - DNA, 75 bp, Artificial Sequence
  Synthetic
ctcaaatgaattagatttccaaaattttatacttaaaaagattaaggaaagaatgacaacatcattgccaatagc

SEQ ID NO: 303443 - DNA, 75 bp, Artificial Sequence
  Synthetic
ttttcacattgagtgaagcacatttaccaatgcagtatcaaaagttcatgccaaacttgccggaaaacgtacaat

SEQ ID NO: 303444 - DNA, 75 bp, Artificial Sequence
  Synthetic
aggcttgattgctgagtttgatacactatgtgagtggagtgactcttcaaagctaaaattaagacatttttgtgc

SEQ ID NO: 303445 - DNA, 75 bp, Artificial Sequence
  Synthetic
acaactatgaaactctaatggcctgtataactatgaatatgcaacacgttcagactcttaccactgaaaaattac

SEQ ID NO: 303446 - DNA, 75 bp, Artificial Sequence
  Synthetic
tactacaaagtttttgagattctaccgagagactcagaagtgttgatttcgataactactgaatacgattatgaa

SEQ ID NO: 303447 - DNA, 75 bp, Artificial Sequence
  Synthetic
agtattgatagctattggtcattcaaaagagattgagacaactgccactgccgaaggaggtgaaatcgttttcca

SEQ ID NO: 303448 - DNA, 75 bp, Artificial Sequence
  Synthetic
gtcgggtcaaagatttattctcaagataaatataggatactggaatcatatgtatataatctgttatctatcaat

SEQ ID NO: 303449 - DNA, 75 bp, Artificial Sequence
  Synthetic
aaagagattgagacaactgccactgccgaaggaggtgaaatcgttttccaaaatgcagcttttacaatgtggaga

SEQ ID NO: 303450 - DNA, 75 bp, Artificial Sequence
  Synthetic
ttactgaaaaatacaagaatctagagaattaaaactaaaaatgataaaaatagtaaacaccaaaaaatacaaaaa

SEQ ID NO: 303451 - DNA, 75 bp, Artificial Sequence
  Synthetic
gtcgtagaaaaaatgttatcgtacgcaaagcatactagagagtatgcggaattttactcacagtcaaatcagtta

SEQ ID NO: 303452 - DNA, 75 bp, Artificial Sequence
  Synthetic
ctatttaataatggatatatgggattctaaaaatattaaacggtttataccaaaaggtgtattatactcatatat

SEQ ID NO: 303453 - DNA, 75 bp, Artificial Sequence
  Synthetic
gaaatagcaaaaagatatatagctggaggaaaaatattttttagagctggtataaatttattaaataatgagaaa

SEQ ID NO: 303454 - DNA, 75 bp, Artificial Sequence
  Synthetic
aaacgtaaataaataaaaggtgaacgataaaataaataagaaatgcgaaatattacaataaattaaaataaaata

SEQ ID NO: 303455 - DNA, 75 bp, Artificial Sequence
  Synthetic
gataaaataaataagaaatgcgaaatattacaataaattaaaataaaataaaataaaataaaataaagccgcgta

SEQ ID NO: 303456 - DNA, 75 bp, Artificial Sequence
  Synthetic
agaggaattgatgagaactggagattatggtcaaattactaacatgctattaaataatcagccagtagcattagt

SEQ ID NO: 303457 - DNA, 75 bp, Artificial Sequence
  Synthetic
tatgctgacgatccaaactattttattggaataaaatttaaaaatataccctataaatatgatgttaaagtacca

SEQ ID NO: 303458 - DNA, 75 bp, Artificial Sequence
  Synthetic
aaatggtgaaaaagaattaaggaatagatggtattggaaattgaaaaaggatacgctgccagacggagattatga

SEQ ID NO: 303459 - DNA, 75 bp, Artificial Sequence
  Synthetic
atttcaggatgaggaaacagagggagttatcagaagatttattgcagatatgagacaacaagttcaggctgatag

SEQ ID NO: 303460 - DNA, 75 bp, Artificial Sequence
  Synthetic
agacgctgcaaatattaaataaatctggtataactgcaatagagatacagaaaatggatgaactgtttacgttaa

SEQ ID NO: 303461 - DNA, 75 bp, Artificial Sequence
  Synthetic
acatgccaaaatgcagcgacagacgatgatataataattgagtatatatattcaaatgaattggattttcaaact

SEQ ID NO: 303462 - DNA, 75 bp, Artificial Sequence
  Synthetic
gactaaaacgaatatagaagattacttgttaccaggatggaaattgacgtatgttggatataatggaagcgccac

SEQ ID NO: 303463 - DNA, 75 bp, Artificial Sequence
  Synthetic
tttatactcaagaagatcaaagagagaatgacgacatcactgccgatagcaagactctcaaatcgtgtatttaga

SEQ ID NO: 303464 - DNA, 75 bp, Artificial Sequence
  Synthetic
acaatttactactattacaacttacattcttcaaaacctattatatacatgcttggttcagccccatcgtattgg

SEQ ID NO: 303465 - DNA, 75 bp, Artificial Sequence
  Synthetic
agcagttctcaaatggaccatatctggttaaagacacaattaaactaaagcaagaaaggtggcttggcaaaaggt

SEQ ID NO: 303466 - DNA, 75 bp, Artificial Sequence
  Synthetic
atttatgacattaagcagtattcagattttacgtttgagacgtgggatccattagacactccttattctacaaca

SEQ ID NO: 303467 - DNA, 75 bp, Artificial Sequence
  Synthetic
attagacactccttattctacaacacatcataaggaattattttttgataaagacgttggcaaacttaaagataa

SEQ ID NO: 303468 - DNA, 75 bp, Artificial Sequence
  Synthetic
tataaattcattccatttaatagtttagcagtaaaatgtatgttgactgcaaaggtagataaaaaagatcaggac

SEQ ID NO: 303469 - DNA, 75 bp, Artificial Sequence
  Synthetic
gctgggatcggcgccatcgtactggatatacgatgtcaagcagtactcagatttaaagtttgagacatgggatcc

SEQ ID NO: 303470 - DNA, 75 bp, Artificial Sequence
  Synthetic
caatgttcaacaaagttgctctattgatctgtgaagcgttgaattcaattaaagtcacacagtctgatatcgcaa

SEQ ID NO: 303471 - DNA, 75 bp, Artificial Sequence
  Synthetic
acagatagaaaagatgtagactggaaaacatggcggaaaattgtggaagaacaaactattagcaatttaaatatt

SEQ ID NO: 303472 - DNA, 75 bp, Artificial Sequence
  Synthetic
gaaatcggttctaatcgctattggtcactcaaaggagatcgaaactactgctactgctgaaggaggagaaattgt

SEQ ID NO: 303473 - DNA, 75 bp, Artificial Sequence
  Synthetic
agcattatacgctttatcaaatgattttaatccaagacaagatgttattaatttaattaataaacaaaagcagtc

SEQ ID NO: 303474 - DNA, 75 bp, Artificial Sequence
  Synthetic
ttcagttttatatattgatatacgaactgatagggaaaatatggattggaaagagtggagaaaagtagtggaaca

SEQ ID NO: 303475 - DNA, 75 bp, Artificial Sequence
  Synthetic
tttcattgaatataaaattacagttaatgaagataaaccaatttctgaatcacatgtaaaagaacttatagctga

SEQ ID NO: 303476 - DNA, 75 bp, Artificial Sequence
  Synthetic
caactacagaaattagatcagaattttacatgattatgaatatatgggatttaagaaatattagaaggtttatac

SEQ ID NO: 303477 - DNA, 75 bp, Artificial Sequence
  Synthetic
ttcatacagcagccgtttaaattgaaaatattgaaagatgagtatatagttgcattatatgctttatcaaatgat

SEQ ID NO: 303478 - DNA, 75 bp, Artificial Sequence
  Synthetic
atcaatatcgctatcttcaaaaccaactggaaataatcatttgtttgttttaagtggtacagataagtattttaa

SEQ ID NO: 303479 - DNA, 75 bp, Artificial Sequence
  Synthetic
atactgtatagtatcgatttttaatactctactaaaactagctggatacaaagaacaaataacaactaaggatga

SEQ ID NO: 303480 - DNA, 75 bp, Artificial Sequence
  Synthetic
gtgaaagaaatgagacgtcaactagaaatgattgataaattgacgactagagaaatagaacaaatagaacttcta

SEQ ID NO: 303481 - DNA, 75 bp, Artificial Sequence
  Synthetic
gagggtggtagatattacgaacatgctccaatagagttaatttatgcatgtaggtcagcaaaagaatttgcaaaa

SEQ ID NO: 303482 - DNA, 75 bp, Artificial Sequence
  Synthetic
aagagaatttatgatatgctaatagcgacgtcagttgataaaatagatatgacacaagaattcaaccaaaagcat

SEQ ID NO: 303483 - DNA, 75 bp, Artificial Sequence
  Synthetic
aaggtgaaaatccatataagccaaaagaagtgactgcatctttgtaagaggttgagctgccgtcgtctgtctacg

SEQ ID NO: 303484 - DNA, 75 bp, Artificial Sequence
  Synthetic
acagaaaccagttaccttcaaatcaagtaaaataacaataaatgatatacttagagatataaagccattttttac

SEQ ID NO: 303485 - DNA, 75 bp, Artificial Sequence
  Synthetic
gttgagctgccgtcgtctgtctacggaagcggcggagttcttaacagtaagccccatcggacctgatggttggtt

SEQ ID NO: 303486 - DNA, 75 bp, Artificial Sequence
  Synthetic
cagcgccagtgacaaaatacaagggatggtgtctagattgctgtcagcatacaaatttgacttattgcagaggat

SEQ ID NO: 303487 - DNA, 75 bp, Artificial Sequence
  Synthetic
ggatgaagtatacgtagcaaacataagtggtgttctatcagtatatttcaaaatctataatgcattttatagaga

SEQ ID NO: 303488 - DNA, 75 bp, Artificial Sequence
  Synthetic
gacaaaagaagacatagagggattgctgacaatgtatgaaatgctgttcccaataaatgaaaaattggtgaacaa

SEQ ID NO: 303489 - DNA, 75 bp, Artificial Sequence
  Synthetic
acgaaagttagtcaattatgctaaaggtaaaccactagaggccgatttaacagcaaatgagttagattatgaaaa

SEQ ID NO: 303490 - DNA, 75 bp, Artificial Sequence
  Synthetic
aaacttgaggataatgtgtattatatatttggatattatgactgtatggaacatgagaaccaaacaccattccaa

SEQ ID NO: 303491 - DNA, 75 bp, Artificial Sequence
  Synthetic
taagatacttttcaaaatcaaggtttttaagcaaaaaggagaaaaggttgagtaggaacgatttttcagacaatc

SEQ ID NO: 303492 - DNA, 75 bp, Artificial Sequence
  Synthetic
aaattaacgtatgtaggctataatggaaagaatacacgaggtcaatataatttttcatttatatgtcaaaatgca

SEQ ID NO: 303493 - DNA, 75 bp, Artificial Sequence
  Synthetic
agaaatgcttatgtcagtattttcacatgaagattatttaatagcgaaggaattgataattttatcatactcaaa

SEQ ID NO: 303494 - DNA, 75 bp, Artificial Sequence
  Synthetic
tgtagttaatcctaaaagctacattgacattatgaactcatcatacactgaacattacagcgtttcacaaagatg

SEQ ID NO: 303495 - DNA, 75 bp, Artificial Sequence
  Synthetic
attaaagagagaatgaccacatctcttccaattgctagattatcaaatcgtgtgtttagagataaattatttcca

SEQ ID NO: 303496 - DNA, 75 bp, Artificial Sequence
  Synthetic
cagatcaacgctagccaaattggtttcatctccgatgtcgatattagttgcattaatagacattaatggtacatt

SEQ ID NO: 303497 - DNA, 75 bp, Artificial Sequence
  Synthetic
ttccaagagttattaattcagctgatggcgcaactacatggttcttcaatccagttattctaagaccaaacaatg

SEQ ID NO: 303498 - DNA, 75 bp, Artificial Sequence
  Synthetic
tgcaaatggtgccagataaacaaccattataaagtatgggacgattttagactcaagaaaatatataataatatg

SEQ ID NO: 303499 - DNA, 75 bp, Artificial Sequence
  Synthetic
gtgaaatggaaaaatggaatgaggctgttagagcgttgtttagatatttagaaccagtggatataaacggagagg

SEQ ID NO: 303500 - DNA, 75 bp, Artificial Sequence
  Synthetic
aaggaaaatattaagcgcaataatgttcgattggtttgacgtaagatatatgagagaaacaccgttgacaacgtt

SEQ ID NO: 303501 - DNA, 75 bp, Artificial Sequence
  Synthetic
aataaattttgacaattcatcagagtatattgaaaattggaatttacagaatagaagacagagaacaggttttac

SEQ ID NO: 303502 - DNA, 75 bp, Artificial Sequence
  Synthetic
agtacgacttagaactttcagatgtcgagtaaatgtggtcatgattacgccaacacaagactctctgcactagag

SEQ ID NO: 303503 - DNA, 75 bp, Artificial Sequence
  Synthetic
atgttcctggacggagaacgaggattatatttatattaccatatgaatattttattgcacaacatgctgtagtag

SEQ ID NO: 303504 - DNA, 75 bp, Artificial Sequence
  Synthetic
agcataatacacagccatttagaaagggaataattatgggtttagatatgttatcaaatatgactaatgatccaa

SEQ ID NO: 303505 - DNA, 75 bp, Artificial Sequence
  Synthetic
tgaattaaagcagatgcttgacaacatgagaaaagctggattaactgatatacctaagatgatacaggactggtt

SEQ ID NO: 303506 - DNA, 75 bp, Artificial Sequence
  Synthetic
tcttttataactaagataattagagtcgatggtgatgataattatgcagtgttacaatttaatactgatgttact

SEQ ID NO: 303507 - DNA, 75 bp, Artificial Sequence
  Synthetic
attgattattttgtagattttgtggataatgtatgtatggatgagatggttagggaatcgcaaagaaatggaatc

SEQ ID NO: 303508 - DNA, 75 bp, Artificial Sequence
  Synthetic
ggtcacaaccagctcatgataatttaatgggtacaatgtggttgaatgcaggatcagaaattcaggttgctggat

SEQ ID NO: 303509 - DNA, 75 bp, Artificial Sequence
  Synthetic
atagagaatttatattaactaaaattatacaaatgacatctgtggctattactggatcattaagattattcccgt

SEQ ID NO: 303510 - DNA, 75 bp, Artificial Sequence
  Synthetic
ctgatgatgaagtatatatacagagagcgtttatgtcactgtctagccaaaagtcaggaattgctgacgagatag

SEQ ID NO: 303511 - DNA, 75 bp, Artificial Sequence
  Synthetic
agcaaaattgaattcgtatgcaccagtttatttagaaaaacgccgtgcgcaaatatcagcgttattgactatgtt

SEQ ID NO: 303512 - DNA, 75 bp, Artificial Sequence
  Synthetic
gtggcaagtattttacactatagtagattatattaaccagatcatacaggtaatgtccaaaagatcaagatcatt

SEQ ID NO: 303513 - DNA, 75 bp, Artificial Sequence
  Synthetic
agaatagaaagtacaagactcaaaatcaattcaatttacttaagaaagattaaaggggagaccgtatttgatatg

SEQ ID NO: 303514 - DNA, 75 bp, Artificial Sequence
  Synthetic
ttagatgtaattttacttatgattatattgatgacattgtttaccttcatgattattcatattataccaacaatg

SEQ ID NO: 303515 - DNA, 75 bp, Artificial Sequence
  Synthetic
tgaaatgattaagttatggaagaaaatgtggaacataacagcactacgatcaccatatactagcgcgaatttctt

SEQ ID NO: 303516 - DNA, 75 bp, Artificial Sequence
  Synthetic
aaattggaaactgacttacaaaacaaaattagttcattagtgtcatcagttgaatggtatctaaggtctatggaa

SEQ ID NO: 303517 - DNA, 75 bp, Artificial Sequence
  Synthetic
tgaacaacagatggacagaattgttaaagagatgagacgtcagctggaaatgattgataaactaactactcgtga

SEQ ID NO: 303518 - DNA, 75 bp, Artificial Sequence
  Synthetic
atgcgaataaattggaaaaaatggtggcaagtgttttatacagtagttgattatattaaccaaattatacaagtt

SEQ ID NO: 303519 - DNA, 75 bp, Artificial Sequence
  Synthetic
tgaggttaagaaatcatcaaaagaagaatcgaaacagctattggagatattgaaaactaaagaagatcatcagaa

SEQ ID NO: 303520 - DNA, 75 bp, Artificial Sequence
  Synthetic
cgtgacgaacatttctgatgaagttagtgaaattggggctaggaaagcaacgaacgttacagttaatccaggacc

SEQ ID NO: 303521 - DNA, 75 bp, Artificial Sequence
  Synthetic
agcagttttcaaatggtgcatatctcgtcaaacatactataaaattgaaacaagagagatggttaggtaagagag

SEQ ID NO: 303522 - DNA, 75 bp, Artificial Sequence
  Synthetic
aggtagagtagcagagggtacgaacacaactgacagatggttcgcttgtgtacttgttgaaccaaacgtatcaaa

SEQ ID NO: 303523 - DNA, 75 bp, Artificial Sequence
  Synthetic
agttgatgctatagatatgtcgaaagaatttaatcagaagaacattagaacgctagatgaatgggaaaacggaaa

SEQ ID NO: 303524 - DNA, 75 bp, Artificial Sequence
  Synthetic
aaaaatggaacttattctcaatattcaacgttatctacatcaaacaagttatgtgcatggatgaagagagaaggg

SEQ ID NO: 303525 - DNA, 75 bp, Artificial Sequence
  Synthetic
aatgtgtcatgcgatgctgagttttatttaataccaagatcgcagactgacttgtgcgcgcaatatataaataac

SEQ ID NO: 303526 - DNA, 75 bp, Artificial Sequence
  Synthetic
tttacatgataattttgagtcattatgggatacgataacaacatcaaattatatattagctagatcagttgtgcc

SEQ ID NO: 303527 - DNA, 75 bp, Artificial Sequence
  Synthetic
taaatggtcagaaatatcatttaaaccaatgaattatcaatatacttacacaagagatggagaagaaataacagc

SEQ ID NO: 303528 - DNA, 75 bp, Artificial Sequence
  Synthetic
agtggtggcgcagtgacactgtcaccagcgggagttacgttgtcaacgcaatttactgattatgtatcacttaat

SEQ ID NO: 303529 - DNA, 75 bp, Artificial Sequence
  Synthetic
ataacaatgtagaatattatgaaatagctggcagattttcattaatatctctagtgccacctaatgacgattatc

SEQ ID NO: 303530 - DNA, 75 bp, Artificial Sequence
  Synthetic
tataaacaaagtgtatagtataacttatgctgatgaccctaattacttcataggaattaaattcagtagtatacc

SEQ ID NO: 303531 - DNA, 75 bp, Artificial Sequence
  Synthetic
tctctggaattaaatcaacagtggaggcagtaaaatccatgacgacgaatattatgaaaaagtttaaaacatcaa

SEQ ID NO: 303532 - DNA, 75 bp, Artificial Sequence
  Synthetic
gtactagttacacttatatgctatctgataatatatatgtagcaaatgccagtggcgtattatcaacttatttta

SEQ ID NO: 303533 - DNA, 75 bp, Artificial Sequence
  Synthetic
aatacgagttagtactgctatacaaactggagaggatttaaaaacgatggtggacgcatcaacgcaagtctcaaa

SEQ ID NO: 303534 - DNA, 75 bp, Artificial Sequence
  Synthetic
atagacagttactatcaaactcatacgttacaaatatctctgatgaagttagcgaaattggagctaaaaaaacaa

SEQ ID NO: 303535 - DNA, 75 bp, Artificial Sequence
  Synthetic
tcaacacaaatttcgcaaaatacaataccagatataatatctgagtcatcagaaaaattcataccaatgcgaacc

SEQ ID NO: 303536 - DNA, 75 bp, Artificial Sequence
  Synthetic
cattcgagactggaattgatggcacattctacgcgtatagagttgatacttttgatgaagttccgtttgatgtgg

SEQ ID NO: 303537 - DNA, 75 bp, Artificial Sequence
  Synthetic
acgactgatagatggtttgcttgcgtattagttgaaccaaatgtgcaaagtacacaaagacagtacgtactagat

SEQ ID NO: 303538 - DNA, 75 bp, Artificial Sequence
  Synthetic
gcaagctatggaattattgcagtcaaatccgaggactttgaaagaatttataaacaacaataaccctataatcag

SEQ ID NO: 303539 - DNA, 75 bp, Artificial Sequence
  Synthetic
caaccttgtcaacaccacacaaattatgcgcgtggatgaagagagataacagagtatactggtaccaaggaacga

SEQ ID NO: 303540 - DNA, 75 bp, Artificial Sequence
  Synthetic
ttgaatgaatggttgtgtaatccaatggacattactctttattattatcaacaaacagatgaagctaataagtgg

SEQ ID NO: 303541 - DNA, 75 bp, Artificial Sequence
  Synthetic
ctacgaattatatgtcactcatatctggcatgtggctattaactgttataccaaatgatatgtttcttcgtgagt

SEQ ID NO: 303542 - DNA, 75 bp, Artificial Sequence
  Synthetic
gttaagagaatacctgggaaatcatcatctatagtaaaatgcactaagttaatgaaagacaaactagaacgtggt

SEQ ID NO: 303543 - DNA, 75 bp, Artificial Sequence
  Synthetic
tttcaattcaagacaagatgttattaatttgattaataatcaaaaacaatcacttattactgttcgtatgaataa

SEQ ID NO: 303544 - DNA, 75 bp, Artificial Sequence
  Synthetic
cggtgagtgagccatcattttctatttcgcgaactagaatgagtggcatatacggattacctgctgtgaatccaa

SEQ ID NO: 303545 - DNA, 75 bp, Artificial Sequence
  Synthetic
agtatgaaattttacaaaaaacaataccaacgtttgaaccaaaagagtcaatactgaagaaattagaggacatta

SEQ ID NO: 303546 - DNA, 75 bp, Artificial Sequence
  Synthetic
accaacgtttgaaccaaaagagtcaatactgaagaaattagaggacattaaaccagaacaggcaaagaagcagac

SEQ ID NO: 303547 - DNA, 75 bp, Artificial Sequence
  Synthetic
aagagctagggtttcactgcaggcgggtgatagcttaaggtccattcaagacgtatcaacacaagtgtcgaatgt

SEQ ID NO: 303548 - DNA, 75 bp, Artificial Sequence
  Synthetic
gagtaggaatttgagactgagggagtttacgacgcaaactgatactttaaactttgatgatatctctgcagccgt

SEQ ID NO: 303549 - DNA, 75 bp, Artificial Sequence
  Synthetic
cgaataattgatgaggataccgcattcgagactgggattgatggaacgttttatgcttacaaagttgatacattt

SEQ ID NO: 303550 - DNA, 75 bp, Artificial Sequence
  Synthetic
acatttcataaaccgaatattttcccttattcagcgtcattcacactaaatagatcacaaccagctcatgataac

SEQ ID NO: 303551 - DNA, 75 bp, Artificial Sequence
  Synthetic
cgtttggctagcggttagctccttttaatgtatggtattgaatataccacaattctaacctttttgatatcaatt

SEQ ID NO: 303552 - DNA, 75 bp, Artificial Sequence
  Synthetic
attctattaaattatatattaaaatcaataactaatatgatggactttatcatatatcggtttttactaatagtt

SEQ ID NO: 303553 - DNA, 75 bp, Artificial Sequence
  Synthetic
acgacgtaagagaaacgtatgcgcgaatgaatgctaaagttaaagccttagtatctacagtgggaatagaaatag

SEQ ID NO: 303554 - DNA, 75 bp, Artificial Sequence
  Synthetic
ggcaaagttaaactcatacgcaccaatatcacttgagaaaagacgtgcgcaaatatcagctttattgactatgct

SEQ ID NO: 303555 - DNA, 75 bp, Artificial Sequence
  Synthetic
cgttttaacagtcttgttcacattacataaagcatcgattccaacgatgaagatagcactaaaaacgtcaaaatg

SEQ ID NO: 303556 - DNA, 75 bp, Artificial Sequence
  Synthetic
tgcgttaaagaacttgttgctgaattaaggtggcagtataatagatttgctgtgataacacatggtaaaggtcac

SEQ ID NO: 303557 - DNA, 75 bp, Artificial Sequence
  Synthetic
caacagatggacaggattgttaaagagatgaggcgtcagttggaaatgattgataaactaaccactcgtgaaatt

SEQ ID NO: 303558 - DNA, 75 bp, Artificial Sequence
  Synthetic
atacatgctcggttcagctccatcttattggatttatgatgttaaacagtactctgattttacatttgaaacatg

SEQ ID NO: 303559 - DNA, 75 bp, Artificial Sequence
  Synthetic
atcaaaagaaattgaaactactgctactgctgaaggaggagaaatagtatttcagaatgcagctttcactatgtg

SEQ ID NO: 303560 - DNA, 75 bp, Artificial Sequence
  Synthetic
attcacaatctgcagttcaaattccaatttattattcttccaatagtgaactagaaagtagatgtatagaatttc

SEQ ID NO: 303561 - DNA, 75 bp, Artificial Sequence
  Synthetic
tgtgaatatagccagaaatctagatggatttcagcaaataaatctagaagaattaatgagaacaggtgattatgc

SEQ ID NO: 303562 - DNA, 75 bp, Artificial Sequence
  Synthetic
agttacaattgatcaggctttgaatggtaaatttagttcatctattagaaatagaaattggatgactgattctaa

SEQ ID NO: 303563 - DNA, 75 bp, Artificial Sequence
  Synthetic
gtcaactgatagaaaaatggatgaagtctcacatgttggaatttaattcgctttcggttcaagaatgatgatgac

SEQ ID NO: 303564 - DNA, 75 bp, Artificial Sequence
  Synthetic
tagacatgacaaaagaaattaatcaaaagaacgtaaaaacgctagaagaatgggagagtggaagaaatccttatg

SEQ ID NO: 303565 - DNA, 75 bp, Artificial Sequence
  Synthetic
cgaatataaataataatgataatgaccgaatgcaagagaaggacgatgagaagcaagatcaaaacaataaaatac

SEQ ID NO: 303566 - DNA, 75 bp, Artificial Sequence
  Synthetic
gatcacaacctgcgcatgataatttaatgggtacgatgtggttgaatgcaggttcagagattcaagttgctggat

SEQ ID NO: 303567 - DNA, 75 bp, Artificial Sequence
  Synthetic
atattaaaccggaacaagcaaagaagcaaactaaactatttagaatatttgaaccgagacagttaccaatttata

SEQ ID NO: 303568 - DNA, 75 bp, Artificial Sequence
  Synthetic
gttttccataaacccaacatatttccatattcagcttcatttactttaaatagatctcaaccaatgcatgacaat

SEQ ID NO: 303569 - DNA, 75 bp, Artificial Sequence
  Synthetic
ggaatatgcaataccagttggaccagtttttccaccaggtatgaattggactgatttaatcactaactattcacc

SEQ ID NO: 303570 - DNA, 75 bp, Artificial Sequence
  Synthetic
tgaaagtgatagctttaagacgcgacttggtctcatcttatgcggatactcagatctataaacacgacgaatcta

SEQ ID NO: 303571 - DNA, 75 bp, Artificial Sequence
  Synthetic
gggtgttgcatcaataatagctactaattctgaggaattgaatttacttattaagtctaattatacttacgatta

SEQ ID NO: 303572 - DNA, 75 bp, Artificial Sequence
  Synthetic
atgtatggtattgaatataccacaattctaacttttttgatatcgcttgtatttatcaattacatattaaaatca

SEQ ID NO: 303573 - DNA, 75 bp, Artificial Sequence
  Synthetic
ttaccaccaggctggaaattgacctatgtaggctatttaggaataaaaactagaggtcattacacccatagtttc

SEQ ID NO: 303574 - DNA, 75 bp, Artificial Sequence
  Synthetic
tgttttaatagctattggtcaatcaaaagaaattgaaactactgccactgctgaaggaggagaaatagtattcca

SEQ ID NO: 303575 - DNA, 75 bp, Artificial Sequence
  Synthetic
ttctaacttttttgatatcgcttgtatttatcaattacatattaaaatcagtgactagaataatggacttaatca

SEQ ID NO: 303576 - DNA, 75 bp, Artificial Sequence
  Synthetic
ggttaacatcagcattaaattatcgtagattgtcaaatagagtattaagagaattgttgtatttatcagttccaa

SEQ ID NO: 303577 - DNA, 75 bp, Artificial Sequence
  Synthetic
cgcgaattcaacaacgagtgaaacatttttaacttctacattatgcttatattacccaaatgaggcagctactga

SEQ ID NO: 303578 - DNA, 75 bp, Artificial Sequence
  Synthetic
acactatcacaattgtttctaactaaaggatggccaacaggatcagtttatttcaaaggatacgctgacatcgca

SEQ ID NO: 303579 - DNA, 75 bp, Artificial Sequence
  Synthetic
taaaatcgttgaaggcacactgtactcaaacgtcagtgacattattcaacagttcaatcagatgataatgactat

SEQ ID NO: 303580 - DNA, 75 bp, Artificial Sequence
  Synthetic
cctaattaaactaccacaagagaaatgggttggagcagaaaatacgcaatttgatattggtcaatttaaaaatat

SEQ ID NO: 303581 - DNA, 75 bp, Artificial Sequence
  Synthetic
gcaaattatgtagaaaatgcaagaactacaattgaatattttgttgatttcttagataatgtatgtatggatgaa

SEQ ID NO: 303582 - DNA, 75 bp, Artificial Sequence
  Synthetic
ttactggaaattcacaaatttacattcgaaacttgggatcctttggatactccctactcaacaaatcatcatttt

SEQ ID NO: 303583 - DNA, 75 bp, Artificial Sequence
  Synthetic
tgaaagtattagctttaagacatagtgtggctcaggtatatgcagacactcaggtttacacacacgatgactcca

SEQ ID NO: 303584 - DNA, 75 bp, Artificial Sequence
  Synthetic
ataactgatgtcgttgacggagttaatcataagttagatgtaacaacgaatacgtgtactataagaaattgtaaa

SEQ ID NO: 303585 - DNA, 75 bp, Artificial Sequence
  Synthetic
ctgagtatattgaaaattggaatctacaaagcaggagacagcgaacaggattcgtacttcataaacctaatatat

SEQ ID NO: 303586 - DNA, 75 bp, Artificial Sequence
  Synthetic
ggacgaaagttgaagaagaaactaagattaacttggatatgatgtatagatatttatccaagggacagaatagaa

SEQ ID NO: 303587 - DNA, 75 bp, Artificial Sequence
  Synthetic
aggatttgattactcatgtgctataaatgcgcctgctaatatacaacaattcgaacacattgtaccattacgtag

SEQ ID NO: 303588 - DNA, 75 bp, Artificial Sequence
  Synthetic
gtggcaagtcttttacacaatagtcgattatgttaatcaaattgtgcaagtaatgtccaaacgatcacgttcttt

SEQ ID NO: 303589 - DNA, 75 bp, Artificial Sequence
  Synthetic
gtgcactaaagagtcattgttagataaaaaaagatttgtaccaaagggatcgttttatgcatttataaataataa

SEQ ID NO: 303590 - DNA, 75 bp, Artificial Sequence
  Synthetic
gattatgttaatcaaattgtgcaagtaatgtccaaacgatcacgttctttgaattcagctgcattttactataga

SEQ ID NO: 303591 - DNA, 75 bp, Artificial Sequence
  Synthetic
aatcctgttgtcttaagaccaaataacgtagaaattgaatttttattgaacggacagataataaatgcctatcaa

SEQ ID NO: 303592 - DNA, 75 bp, Artificial Sequence
  Synthetic
gataaaatgttatcattcttaaaaaagcaaaagaatggtgttataacattacgcgtaaataatacatttaattat

SEQ ID NO: 303593 - DNA, 75 bp, Artificial Sequence
  Synthetic
atgcgaataaattggaagaaatggtggcaagttttctatacggtagtagattatattaatcagattgtgcaagtt

SEQ ID NO: 303594 - DNA, 75 bp, Artificial Sequence
  Synthetic
ttccattagttccacctttccaacaccacgccacagttggtctcacattgaaaattgaatctgcagtctgtgaat

SEQ ID NO: 303595 - DNA, 75 bp, Artificial Sequence
  Synthetic
aaatagttaaattacggaaagttgatactttaaaaccaatattgtataaaataaattcagattcaaatgacttct

SEQ ID NO: 303596 - DNA, 75 bp, Artificial Sequence
  Synthetic
ctatgcataatttatcatgttcattggaaggtaaggccacaggtaataatcatctttttgtctcattctcagata

SEQ ID NO: 303597 - DNA, 75 bp, Artificial Sequence
  Synthetic
tatgctgatgaccctaactactttataggaatcaagtttgatagcataccttatgactatgatgttaaaattccg

SEQ ID NO: 303598 - DNA, 75 bp, Artificial Sequence
  Synthetic
ttggactgagctgatcacaaattactctccatcaagagaagataatctacaacgtattttcacagtagcatccat

SEQ ID NO: 303599 - DNA, 75 bp, Artificial Sequence
  Synthetic
tatgtttagagatctaaccaatggaaaattcagtcttataaatacaaacgttgagaatgttgtatcaggacacgt

SEQ ID NO: 303600 - DNA, 75 bp, Artificial Sequence
  Synthetic
gtactagttacacctatatgctatctgacaatatatacgtagcaaatgctagtggcgtattatcaacctatttta

SEQ ID NO: 303601 - DNA, 75 bp, Artificial Sequence
  Synthetic
ccaagctaaccacttggtatccaaatttaattatcatgtagctatgtcaagtcattcagactctacaagtaagga

SEQ ID NO: 303602 - DNA, 75 bp, Artificial Sequence
  Synthetic
tattatgaacacgcaccaccagaattgctttatgcctgtcagtcagcacttacatttgcaaagctacaaaatgat

SEQ ID NO: 303603 - DNA, 75 bp, Artificial Sequence
  Synthetic
tcgtagatttaccatataagtcagaagtaaaaagaccacatttaactggtggattattattaataaacgacactg

SEQ ID NO: 303604 - DNA, 75 bp, Artificial Sequence
  Synthetic
tgtagcaaatgtaaatggttatctacaattttactataaattgtatatgatgttttataggaaaaatataacatt

SEQ ID NO: 303605 - DNA, 75 bp, Artificial Sequence
  Synthetic
acgtataatagttaagtcaatattcttgagtcagataggtacagatgttgagtatcggatttaggtgagatagga

SEQ ID NO: 303606 - DNA, 75 bp, Artificial Sequence
  Synthetic
caaagaattatttggcaaaattggtatgcatttacatcttcaatgaaacaaggtaacactctagacgtatgtaag

SEQ ID NO: 303607 - DNA, 75 bp, Artificial Sequence
  Synthetic
caaactctacacaacaagagaattttatgacttccactttatgcttatattatccaagttcagtcacgactgaaa

SEQ ID NO: 303608 - DNA, 75 bp, Artificial Sequence
  Synthetic
tgattactgatgttgtagatggagtcaatcataaattgaacgtgacgacaaatacttgtacaattagaaattgta

SEQ ID NO: 303609 - DNA, 75 bp, Artificial Sequence
  Synthetic
ctaatgtgagtgatctaattcaacaatttaatcaaatgataattactatgaatggaaatgagttccaaactggag

SEQ ID NO: 303610 - DNA, 75 bp, Artificial Sequence
  Synthetic
tttcattaatcaaaataatccaattataaggaatagaattgaacagttaattctacaatgtaaattgtgagaacg

SEQ ID NO: 303611 - DNA, 75 bp, Artificial Sequence
  Synthetic
ggctttaaaatggcttcgttcatttatagacaattgcttacgaattcatataccgtagatctttcagatgaaata

SEQ ID NO: 303612 - DNA, 75 bp, Artificial Sequence
  Synthetic
tttactatagttgcatcaacagtgaataaatacggtgtgccaagacataacgcaaaatatagatatgaatatgat

SEQ ID NO: 303613 - DNA, 75 bp, Artificial Sequence
  Synthetic
tattaattgaaccagacgtacaatcagttgaacgtacatacacactttttggacaacaagtacaattaacggtat

SEQ ID NO: 303614 - DNA, 75 bp, Artificial Sequence
  Synthetic
atatggagtaatgaaacatggagggaaaatttatacgtataatggtgagacgccgaacgctaacactggatacta

SEQ ID NO: 303615 - DNA, 75 bp, Artificial Sequence
  Synthetic
gggctaccaccaatacaaaatacgagaaatgttgtaccagtgtcaattgcttctagaagtatagttcataccaaa

SEQ ID NO: 303616 - DNA, 75 bp, Artificial Sequence
  Synthetic
ttgtgaaatcaggaggactaggttacaaatggtcagaagtgtcctttaaaccagcaaattatcaatatacttata

SEQ ID NO: 303617 - DNA, 75 bp, Artificial Sequence
  Synthetic
tgcaaaaggtaagtcgctagaagcagacttgacagtgaatgaattagattatgaaaataacaagataacatctga

SEQ ID NO: 303618 - DNA, 75 bp, Artificial Sequence
  Synthetic
ctattcttggtcgttccatgttggatttaggaaacaaaaaatgatagatgctgcattggatcaattaaagactga

SEQ ID NO: 303619 - DNA, 75 bp, Artificial Sequence
  Synthetic
tttatagcgcaacacgctgtagttgaaaaaatgttaatatatgcaaaacacactagagaatatgctgagttttat

SEQ ID NO: 303620 - DNA, 75 bp, Artificial Sequence
  Synthetic
ctcaaaatatgaagttattaaagaaaactcatacgtatatattgattattgggacgattcacaagcctttagaaa

SEQ ID NO: 303621 - DNA, 75 bp, Artificial Sequence
  Synthetic
accggtggggcagtatcattgcattcagctggggtaacgctctcaacgcaatttactgattttgtatcattaaat

SEQ ID NO: 303622 - DNA, 75 bp, Artificial Sequence
  Synthetic
ataattcacaagaatattatgagatagctggacggttctcactcatttcactagtgccttcgaatgatgactatc

SEQ ID NO: 303623 - DNA, 75 bp, Artificial Sequence
  Synthetic
gtcacagttgattgatctagcactgctaccattagatatgttttctatgttttcaggtatcaagagtacaataga

SEQ ID NO: 303624 - DNA, 75 bp, Artificial Sequence
  Synthetic
tcatcagtgtctagaagcgcatcaataagatcaataggatcgactacatcagcatggacagaagtatcaacgaca

SEQ ID NO: 303625 - DNA, 75 bp, Artificial Sequence
  Synthetic
gctcctaatctcagattctgaagacgatgatcaatgattaaataaaacattaacgcgatttttgccatcacaaga

SEQ ID NO: 303626 - DNA, 75 bp, Artificial Sequence
  Synthetic
tgaattttgatgacatatcagcagccgtattgaaaacaaaaattgacagatcaactcaagtaactccaaatacat

SEQ ID NO: 303627 - DNA, 75 bp, Artificial Sequence
  Synthetic
gttcttcgcttatagagtagaaactttcgaggaggtgccatttgacgtacaaaaatttgcagatctagtaactga

SEQ ID NO: 303628 - DNA, 75 bp, Artificial Sequence
  Synthetic
ttcgaggaggtgccatttgacgtacaaaaatttgcagatctagtaactgattcgcctgttatatcagcgataatt

SEQ ID NO: 303629 - DNA, 75 bp, Artificial Sequence
  Synthetic
attaggaccaagagaaaatgtagcggttatacaagtaggtggtgcaaacattttagacatcactgctgatccgac

SEQ ID NO: 303630 - DNA, 75 bp, Artificial Sequence
  Synthetic
ttttagacatcactgctgatccgacaactgcaccgcaaacagaaaggatgatgcgagtgaattggaaaaaatggt

SEQ ID NO: 303631 - DNA, 75 bp, Artificial Sequence
  Synthetic
ttacgttaaccagataattcaagcgatgtccaagagatctagatcactaaattcatcagcattctattacagaat

SEQ ID NO: 303632 - DNA, 75 bp, Artificial Sequence
  Synthetic
atattcgggatatatttttagggatttgtctaataataatttcaatttgataggtacgaatgtagagaattcagt

SEQ ID NO: 303633 - DNA, 75 bp, Artificial Sequence
  Synthetic
cttcagataaaattgctcaaggagtaataattgcttatagagatatgcaactagaaagagatgagatgtatggat

SEQ ID NO: 303634 - DNA, 75 bp, Artificial Sequence
  Synthetic
tctaatcagatgcaattttacttatgactatgaagataatataatatacttacatgactattcatactacactaa

SEQ ID NO: 303635 - DNA, 75 bp, Artificial Sequence
  Synthetic
aatatttgagttgggacatcattgtcagcctaactacgtggcatctaatcacccaggcaatgcttccgatatcca

SEQ ID NO: 303636 - DNA, 75 bp, Artificial Sequence
  Synthetic
gagttttcaaacaaatatgtacgagcgatagttcctgaccaaacatttgatgaattaaaacagatgcttgacaac

SEQ ID NO: 303637 - DNA, 75 bp, Artificial Sequence
  Synthetic
aatcaagcaattttcaaacggaccatatttagttaaggatactattaaattaaagcaggaaagatggctagggaa

SEQ ID NO: 303638 - DNA, 75 bp, Artificial Sequence
  Synthetic
actttattatccatattatcatattcgtatgataaatataatgctgtagagcggaaattagttagttatgctaaa

SEQ ID NO: 303639 - DNA, 75 bp, Artificial Sequence
  Synthetic
tctgtctcaattgttcttgactaaagggtggccaactggatcagtctattttaaagaatataccgatatcgcttc

SEQ ID NO: 303640 - DNA, 75 bp, Artificial Sequence
  Synthetic
acgttattatcaatattatcatactcctacgacaaatataacgccgttgaacggaaattagtcaaatatgcgaaa

SEQ ID NO: 303641 - DNA, 75 bp, Artificial Sequence
  Synthetic
atgtgttcatacaaccaccatttaaaataaagacatttaagaatgattatattgtggcattatatgcactgtcaa

SEQ ID NO: 303642 - DNA, 75 bp, Artificial Sequence
  Synthetic
acgctgatgtcaaaaatttactcttggtcattccatgttggatttagaaagcagaaaatgattgatgcggcgtta

SEQ ID NO: 303643 - DNA, 75 bp, Artificial Sequence
  Synthetic
tactagagaatatgcggaattctattcacagtcaaatcaattgttatcatacggtgatgttacgagatttttgtc

SEQ ID NO: 303644 - DNA, 75 bp, Artificial Sequence
  Synthetic
ttttataggtattaaatttagacacatcccttataaatatgatgttaaagttccacacttaacatttggagtatt

SEQ ID NO: 303645 - DNA, 75 bp, Artificial Sequence
  Synthetic
ctatctaatatgactaacgatccaaaggtagtacaagcattgaatttatataagcaaacacaaattaaccttatg

SEQ ID NO: 303646 - DNA, 75 bp, Artificial Sequence
  Synthetic
gtttattctgtaactacccaaaatcagaaatgataaaattatggaagaagatgtggaacattacgtcactacgtt

SEQ ID NO: 303647 - DNA, 75 bp, Artificial Sequence
  Synthetic
ctaacttagcccttattaaaacagtactatcaaggattgcaaataaatactcttttataactaaaataattagag

SEQ ID NO: 303648 - DNA, 75 bp, Artificial Sequence
  Synthetic
atggcagtataacagatttgctgcaataacacatggtaaaggtcactacagagttgttaaatattcgtcagttgc

SEQ ID NO: 303649 - DNA, 75 bp, Artificial Sequence
  Synthetic
agaaaatgttgatctatgcaaagcatactagagaatatgctgaattctattcgcaatcaaatcaactcttatcat

SEQ ID NO: 303650 - DNA, 75 bp, Artificial Sequence
  Synthetic
agtatgaaattttacaaaaaacgataccaacatttgaaccaaaagagtcaatactgaaaaaattagaagatatta

SEQ ID NO: 303651 - DNA, 75 bp, Artificial Sequence
  Synthetic
gactgtcaactgatagaaaaatggatgaagtatcacatgttggaatctaattcgctttcgattcgagaatgatga

SEQ ID NO: 303652 - DNA, 75 bp, Artificial Sequence
  Synthetic
atatggatagaaatttgccatcaacggctagatatataagacctaatctactacaagacagactaaatttacatg

SEQ ID NO: 303653 - DNA, 75 bp, Artificial Sequence
  Synthetic
gcaagatcagtagtgccagatttaaaggagttagtttcaactgaagcgcaaattcaaaagatgtcgcaggatttg

SEQ ID NO: 303654 - DNA, 75 bp, Artificial Sequence
  Synthetic
atatcacttgaaaaaagacgtgcgcagatatcagctttgttaacaatgttgcagaaaccagttactttcaaatca

SEQ ID NO: 303655 - DNA, 75 bp, Artificial Sequence
  Synthetic
tttaatttcattaggcataccaaaaatagatgctgatacatatgttggttcaaaaatttactctcaagataaata

SEQ ID NO: 303656 - DNA, 75 bp, Artificial Sequence
  Synthetic
gtttgggttgttttattacttgttgaaccgaacgtgaccaatcaaagtagacaatacacgttatttggagaaacg

SEQ ID NO: 303657 - DNA, 75 bp, Artificial Sequence
  Synthetic
actaaaggctcaaaattatggaattaatttgccaatcactggttcaatggacactgcatatactaattctacaca

SEQ ID NO: 303658 - DNA, 75 bp, Artificial Sequence
  Synthetic
ttaccaccaatgcagaatacaaggaatatagttccagttgcgttatcatctagatcagtgacttatcaacgtgct

SEQ ID NO: 303659 - DNA, 75 bp, Artificial Sequence
  Synthetic
tatagtggcattatatgctttatctaacgattttaattcaagacaagatgtcattaatttaattaataaacaaaa

SEQ ID NO: 303660 - DNA, 75 bp, Artificial Sequence
  Synthetic
gctgatctaatattgaatgaatggttgtgtaatccaatggacattactctgtactattatcaacagacagatgaa

SEQ ID NO: 303661 - DNA, 75 bp, Artificial Sequence
  Synthetic
ttaccacagctacttgtactattagaaattgtaaaaaattgggaccacgagaaaatgtagctgtgatccaagttg

SEQ ID NO: 303662 - DNA, 75 bp, Artificial Sequence
  Synthetic
ggaaaaaatggtggcaagtgttctacactgtagttgactatgtaaatcagataattcaagcaatgtccaaaagat

SEQ ID NO: 303663 - DNA, 75 bp, Artificial Sequence
  Synthetic
tattcagggtatatttttagagatctttcaaataataatttcaacttgataggtactaatgtagaaaattcagtt

SEQ ID NO: 303664 - DNA, 75 bp, Artificial Sequence
  Synthetic
aagaaatgagacgtcaattggaaatgattgataggttgacgacacgtgaaattgaacaagttgaactattgaaaa

SEQ ID NO: 303665 - DNA, 75 bp, Artificial Sequence
  Synthetic
catcggacctgatgatcagttgagaagccacaactgatcatatcgcgtgtggcttaagccttaatcccgtttaac

SEQ ID NO: 303666 - DNA, 75 bp, Artificial Sequence
  Synthetic
aggaaacgtggagcgcgccgtgaggcgaacttaaataataataatgatcgaatgcaggagaaaattgatgaaaaa

SEQ ID NO: 303667 - DNA, 75 bp, Artificial Sequence
  Synthetic
ttacttaataatggatatatgggattctaaaaatattaaacggtttataccaaaaggcgtgttatattcatatat

SEQ ID NO: 303668 - DNA, 75 bp, Artificial Sequence
  Synthetic
aaggaagaacatcagaaagaaatacagtatgaaatattacagaaaactataccaacatttgaacctaaagagacg

SEQ ID NO: 303669 - DNA, 75 bp, Artificial Sequence
  Synthetic
agtatgaaatattacagaaaactataccaacatttgaacctaaagagacgatattgagaaaattagaggatatta

SEQ ID NO: 303670 - DNA, 75 bp, Artificial Sequence
  Synthetic
aatagcaattttaaagaaatttaaaaatgaattattcaagatggatataacaacgagttatacgtatatgttatc

SEQ ID NO: 303671 - DNA, 75 bp, Artificial Sequence
  Synthetic
atatggacagaaatttaccatcaactgccagatatataagacctaatttacttcaagatagattgaatttgcacg

SEQ ID NO: 303672 - DNA, 75 bp, Artificial Sequence
  Synthetic
taagtcaacgtactatgtcattagattttgtaactactaattatatgtcattgatttcaggtatgtggctgttga

SEQ ID NO: 303673 - DNA, 75 bp, Artificial Sequence
  Synthetic
agctggaagattttctttaatatcattagtaccatctaatgatgattaccaaacaccaattatgaattcagtcac

SEQ ID NO: 303674 - DNA, 75 bp, Artificial Sequence
  Synthetic
aaattcaaaatttccaagtcgcaaattggttacattttgttaataataatcaatttagacaggcagttattgatg

SEQ ID NO: 303675 - DNA, 75 bp, Artificial Sequence
  Synthetic
gaaattgctactcagacagaaggtatgaactttgacgacatttcagcagcggtattgaaaacgaaaattgataaa

SEQ ID NO: 303676 - DNA, 75 bp, Artificial Sequence
  Synthetic
aatttcaaatataacggcacataacgttttatatgttgactactcgatacaagtaattgagatacttaacaaatc

SEQ ID NO: 303677 - DNA, 75 bp, Artificial Sequence
  Synthetic
ttttcgaagcaagcactgatggacgattctttgcttataaagtaggaacatttgaagaaataccattcgatgtgc

SEQ ID NO: 303678 - DNA, 75 bp, Artificial Sequence
  Synthetic
aattacgtaccgatcaatattggttaacaactacaaatattgaagaatatattttgcctggttggaagttgacgt

SEQ ID NO: 303679 - DNA, 75 bp, Artificial Sequence
  Synthetic
tagaggtcattatacctatagctttatatgtcaaaatactgctactgatgacgatattatatatgattacattta

SEQ ID NO: 303680 - DNA, 75 bp, Artificial Sequence
  Synthetic
gcaagcttttaatttattacgatctgatccaagagttttgagagaatttattaatcaagacaatccaataattaa

SEQ ID NO: 303681 - DNA, 75 bp, Artificial Sequence
  Synthetic
gatccaagagttttgagagaatttattaatcaagacaatccaataattaaaaataggatagagcaattaatatta

SEQ ID NO: 303682 - DNA, 75 bp, Artificial Sequence
  Synthetic
tggtggcaagtgttctatactatagttgattacgtaaaccaaattgtacaagcaatgtctaagaggtccagatca

SEQ ID NO: 303683 - DNA, 75 bp, Artificial Sequence
  Synthetic
ctttatcaaaaactcttaaagatgccagagataaaattgtcgaaggcaccttatattctaatgtaagtgatctaa

SEQ ID NO: 303684 - DNA, 75 bp, Artificial Sequence
  Synthetic
tgaagcactcaattcaattaaagttactcaatctgatgttgcgaatgttctttcaagagtagtttctgttagaca

SEQ ID NO: 303685 - DNA, 75 bp, Artificial Sequence
  Synthetic
tattactacaataaatatcatgcataccctcggatatacatgctcggttcagcaccatcatattggctgtacgat

SEQ ID NO: 303686 - DNA, 75 bp, Artificial Sequence
  Synthetic
gattaatttagaaataatgcgtaaatacctgcaacgtggaaaaaccagaatttgttgctgtaaaattactgctat

SEQ ID NO: 303687 - DNA, 75 bp, Artificial Sequence
  Synthetic
attattgaattatatattaaaaactataactaatacaatggactacataatttttagatttttactactcatcgc

SEQ ID NO: 303688 - DNA, 75 bp, Artificial Sequence
  Synthetic
caaattacattttttctagccatgaatcatgcgcattaaatgtacataattgtagatggtgtcagatcaacaacc

SEQ ID NO: 303689 - DNA, 75 bp, Artificial Sequence
  Synthetic
actgaacggacaaataataaataattatcaggcaagatttggaacaattatagcaagaaattttgatacgattag

SEQ ID NO: 303690 - DNA, 75 bp, Artificial Sequence
  Synthetic
gtaaaaaggaaaaatggaatgaagctgtcgaaatgttatttaattatctagaaccagtggatataaatggaacag

SEQ ID NO: 303691 - DNA, 75 bp, Artificial Sequence
  Synthetic
tgtagccatggctgagctagcttgcttttgttatcctcatttagagaacgatagctataaatttattccatttaa

SEQ ID NO: 303692 - DNA, 75 bp, Artificial Sequence
  Synthetic
tattatgaacatgctccaccagagttattatatgcatgtcaatcggcattagtatttgcaaaattgcaaaatgat

SEQ ID NO: 303693 - DNA, 75 bp, Artificial Sequence
  Synthetic
agtatttgcaaaattgcaaaatgatttaacgctaatagaatatgtgaacagtgtaaatcgttatattttaaataa

SEQ ID NO: 303694 - DNA, 75 bp, Artificial Sequence
  Synthetic
caagatggcaattattcacagcatggtcctctactgtcaacgccaaaactgtatggagtgatgaaacatggaggt

SEQ ID NO: 303695 - DNA, 75 bp, Artificial Sequence
  Synthetic
aatcaattgcattgcgactcgcttcatcctcattcttagtgcgaaatactttttcttatatttacaattcttaca

SEQ ID NO: 303696 - DNA, 75 bp, Artificial Sequence
  Synthetic
attgttttccagaatgcagctttcacaatgtggaaattgacatacttggagcacaaattgatgccaattttggat

SEQ ID NO: 303697 - DNA, 75 bp, Artificial Sequence
  Synthetic
tttttcataaacctaatatatttccatactcagcatcatttactttaaatagatctcaaccaatgcatgataatt

SEQ ID NO: 303698 - DNA, 75 bp, Artificial Sequence
  Synthetic
aacttctacattatgcttgtattacccgaatgaagcggctactgaaattgcggatagtaaatggacggaaacgct

SEQ ID NO: 303699 - DNA, 75 bp, Artificial Sequence
  Synthetic
ttctccttcttatgatcagttgaaattgatatacatgaatcaagattggcactaacgttaatacctttggtcaag

SEQ ID NO: 303700 - DNA, 75 bp, Artificial Sequence
  Synthetic
ggatgtgctttattcacttgccaagacgttgaaggatgctagagccaggatagttgaaggcacactctataccaa

SEQ ID NO: 303701 - DNA, 75 bp, Artificial Sequence
  Synthetic
aatcaagtaatcaattcaattaatggctcaaccttccaaactggaggaatcggcaacttgccagttagaaattgg

SEQ ID NO: 303702 - DNA, 75 bp, Artificial Sequence
  Synthetic
gtctgagttagctgatttgatactaaatgaatggttgtgtaatccaatggatgtaacactctattattaccaaca

SEQ ID NO: 303703 - DNA, 75 bp, Artificial Sequence
  Synthetic
atctaatcgaaaagctggtgagtggatcgtttgaagcagaatcagatggtccaatatcctctggagacttcgaca

SEQ ID NO: 303704 - DNA, 75 bp, Artificial Sequence
  Synthetic
aactgatgaagctaacaagtggatatccatgggttcttcatgtacaattaaagtatgtcctctaaatacacagac

SEQ ID NO: 303705 - DNA, 75 bp, Artificial Sequence
  Synthetic
ctaccaatagattttccagaaagagttgacgttgtagaagacgattcatttttaaagatactagaagaaattgag

SEQ ID NO: 303706 - DNA, 75 bp, Artificial Sequence
  Synthetic
attgactatttcattgattttgttgactctgtttgtattgatgagatagtgcgtgaatctcagcgtaatggaata

SEQ ID NO: 303707 - DNA, 75 bp, Artificial Sequence
  Synthetic
actctgtttgtattgatgagatagtgcgtgaatctcagcgtaatggaatagcgccacaatttgatttactgagac

SEQ ID NO: 303708 - DNA, 75 bp, Artificial Sequence
  Synthetic
tacaactgatttatccgatgaaattaatgaaattggatcattgaaatcgcaggatgtcactatcaatcctggtcc

SEQ ID NO: 303709 - DNA, 75 bp, Artificial Sequence
  Synthetic
aataaattatgataatgaatcggaatacatagaaaattggaatttacagaataggaggcaacggactggctattt

SEQ ID NO: 303710 - DNA, 75 bp, Artificial Sequence
  Synthetic
acattcaatccacctgtagactactggctgctatttgcgccaaatacacagggtgtcatagctgaaggaacaaac

SEQ ID NO: 303711 - DNA, 75 bp, Artificial Sequence
  Synthetic
ggatctgaaattgaaattgctggattcgattctgagtgcgcgctaaatgctccgggaaacattcaagaatttgaa

SEQ ID NO: 303712 - DNA, 75 bp, Artificial Sequence
  Synthetic
agagcagttataccaacagctgatggcttgaatacatggctgtttaacccaattatattgagaccaaacaacgta

SEQ ID NO: 303713 - DNA, 75 bp, Artificial Sequence
  Synthetic
aaaacacccatcagactaaatggaaattcatagacatcagcagagctaaccagagtgatagttatgcacaatacg

SEQ ID NO: 303714 - DNA, 75 bp, Artificial Sequence
  Synthetic
ttcaacaactaattacagggacgttgagatgactatattttgtgacttttatataattcctcgtgctcaagaaaa

SEQ ID NO: 303715 - DNA, 75 bp, Artificial Sequence
  Synthetic
aacttgttagaccaccgaatatgacacctgcagtagcggcactctttcctcaggcagcaccatttccaaatcatg

SEQ ID NO: 303716 - DNA, 75 bp, Artificial Sequence
  Synthetic
tatcaattgtaacaggtttgagacaggaatatgcaattccagtaggaccagtatttccagcaggtatgaactgga

SEQ ID NO: 303717 - DNA, 75 bp, Artificial Sequence
  Synthetic
gcaagtgttaatgaggacattgtgatatcaaaaacatcactatggaaagaaatgcagtacaatagggacatcacc

SEQ ID NO: 303718 - DNA, 75 bp, Artificial Sequence
  Synthetic
ccgagttgcttaataattattcagtatctagagaagataacttgcaacgtatatttacagcagcatccatccgga

SEQ ID NO: 303719 - DNA, 75 bp, Artificial Sequence
  Synthetic
cgtaacaacctataccgaagcttaatggtcatgtagctatactgaaggaaaattcgtagtggacgtaagcatttg

SEQ ID NO: 303720 - DNA, 75 bp, Artificial Sequence
  Synthetic
atagaaatggagaaacagttacagcacacacaacatgttctgttaatggagtcaacaatttcagttataacggtg

SEQ ID NO: 303721 - DNA, 75 bp, Artificial Sequence
  Synthetic
tatggtgtacgtccgttcgttggcagcggaactgaactcggtgacttgtaatggtgggagttacaatttcgctct

SEQ ID NO: 303722 - DNA, 75 bp, Artificial Sequence
  Synthetic
tcattaagatttagattcagattagaagttgcagaaccgttcttttcaatttcaagaacacgtgtaagcagattg

SEQ ID NO: 303723 - DNA, 75 bp, Artificial Sequence
  Synthetic
agactccaataatgaattcagtaactgtgagacaagaccttgaaagacagcttggagaattgcgtaatgaattta

SEQ ID NO: 303724 - DNA, 75 bp, Artificial Sequence
  Synthetic
ctagcttgcttttgttaccctcatctagagaatgatagctataaatttattccatttaatagtctagcgatcaaa

SEQ ID NO: 303725 - DNA, 75 bp, Artificial Sequence
  Synthetic
tattgcaaaatcaatggctacgaatgtaatgaagaagtttaagagatcgaaattagctagctcagtgtccacact

SEQ ID NO: 303726 - DNA, 75 bp, Artificial Sequence
  Synthetic
gcaaattatgttgaaaatgctagaactacgattgaatatttcattgattttatagataatgtatgtatggatgaa

SEQ ID NO: 303727 - DNA, 75 bp, Artificial Sequence
  Synthetic
ataccagtgataactcaaggggaatgaactttgaaacacaaatgtttactaaggtggcagtgttaatttgtgaag

SEQ ID NO: 303728 - DNA, 75 bp, Artificial Sequence
  Synthetic
gctgtagatgcatctacaacaatgaactcaatagctacacagactgccacaataagtagacgattaagactgaag

SEQ ID NO: 303729 - DNA, 75 bp, Artificial Sequence
  Synthetic
aagaaagctgtcaggtattaaatttaaaagaattaattttgataattcatctgattatattgagaattggaatct

SEQ ID NO: 303730 - DNA, 75 bp, Artificial Sequence
  Synthetic
taccagatattgttactgaagcttcagagaaatttataccgaacagaacatatcgcgtcataaacaatgatgaag

SEQ ID NO: 303731 - DNA, 75 bp, Artificial Sequence
  Synthetic
ggatggccaactggatccgtatactttaaagaatatgatgatatagctactttttcagttgatccacaactgtat

SEQ ID NO: 303732 - DNA, 75 bp, Artificial Sequence
  Synthetic
ttcaccagtcatttcagcaataatagattttaaaacgatcaaaaatttgaatgataattatggaataagtaaaca

SEQ ID NO: 303733 - DNA, 75 bp, Artificial Sequence
  Synthetic
gatccgagagtgttgcgggagttcatcaatcaagataatccaatcatacgaaatagaatcgagaatttaataatg

SEQ ID NO: 303734 - DNA, 75 bp, Artificial Sequence
  Synthetic
ggaaaagaatccattcagaggtctgtcaactgatagaaagatggatgaagtctctcaagtaggcgtttaattcgc

SEQ ID NO: 303735 - DNA, 75 bp, Artificial Sequence
  Synthetic
tccttgatataacatctgatccaacgactgctccacaaactgaacggatgatgcgaataaattggaaaaaatggt

SEQ ID NO: 303736 - DNA, 75 bp, Artificial Sequence
  Synthetic
cagttgttgctgcaacttctactcttgaattgatgggtattcagtatgattacaatgaggtttatactagagtta

SEQ ID NO: 303737 - DNA, 75 bp, Artificial Sequence
  Synthetic
agcacttaaaacatcaaaatgttcatataaagtaatcaaatattgtatagtcaccattattaatgctctattgaa

SEQ ID NO: 303738 - DNA, 75 bp, Artificial Sequence
  Synthetic
ataattaactcttcttttgaagcagcagttgttgctgcaacttctactcttgaattgatgggtattcagtatgat

SEQ ID NO: 303739 - DNA, 75 bp, Artificial Sequence
  Synthetic
gcagcgtcagcttgaaatgattgacaaattgactactcgtgagattgaacaggttgaactacttaaacgtatata

SEQ ID NO: 303740 - DNA, 75 bp, Artificial Sequence
  Synthetic
cagtatcaacagtttcgaaaaaggagaaatccaaatcagaccataaaagtaggaaacactaccctagaattgaag

SEQ ID NO: 303741 - DNA, 75 bp, Artificial Sequence
  Synthetic
tcaacacaatcacgaccatcaagtaatgttgggtgcgatcaagtggatttctcctttaacaaaggaattaaagta

SEQ ID NO: 303742 - DNA, 75 bp, Artificial Sequence
  Synthetic
gtatggtattgaatataccacagttttaacctttttgatatcagttgtattattgaattacatacttaaatcatt

SEQ ID NO: 303743 - DNA, 75 bp, Artificial Sequence
  Synthetic
ggaatggcgtattttccttacattgcttctgttctaaccgtgttatttacattacataaggcttcaattccaact

SEQ ID NO: 303744 - DNA, 75 bp, Artificial Sequence
  Synthetic
aaagaaatgagacgtcaactggagatgattgacaaattaactactagagaaatagaacaagtagagttactcaaa

SEQ ID NO: 303745 - DNA, 75 bp, Artificial Sequence
  Synthetic
gggtggccaacaggatcggtctatttcaaagattacgcagatattgcctcattttcagttgatccacaattatac

SEQ ID NO: 303746 - DNA, 75 bp, Artificial Sequence
  Synthetic
cttgtacaattagaaactgtaaaaaactaggaccaagagaaaacgtagcagttatacaagttggtggttcagata

SEQ ID NO: 303747 - DNA, 75 bp, Artificial Sequence
  Synthetic
ctgcactagatcaattgaaaactgaatatacagaagatgtggacgacgaaatgtatcgagaatatacaatgttaa

SEQ ID NO: 303748 - DNA, 75 bp, Artificial Sequence
  Synthetic
gaggttgaagttgacgattcatttgttgatgaaaagatggaagttgacactattgattggaagtctagatacgat

SEQ ID NO: 303749 - DNA, 75 bp, Artificial Sequence
  Synthetic
tgatcaggtcctgactgaaatgccggattacttactgttaaaggatatggcagttgaaaataagaattcaaggga

SEQ ID NO: 303750 - DNA, 75 bp, Artificial Sequence
  Synthetic
actgtcatatggtgacgttacacgttttttatctaataatgctatggtgttatatacggatgtatcccaatggga

SEQ ID NO: 303751 - DNA, 75 bp, Artificial Sequence
  Synthetic
agacaacgtgtacaagctgacagaaacgttgttaattacccatcaatattgcacccaatagattatgctttcaat

SEQ ID NO: 303752 - DNA, 75 bp, Artificial Sequence
  Synthetic
atatggatagaaacttaccatcaacagccagatacataagacctaacttattacaggatagactaaacttacatg

SEQ ID NO: 303753 - DNA, 75 bp, Artificial Sequence
  Synthetic
acaatatataaataatggtttaccaccaattcagaatacaaggaatattgtaccagtaaatattacatctagaca

SEQ ID NO: 303754 - DNA, 75 bp, Artificial Sequence
  Synthetic
gaatgaacgtctgcaagaaaaagaagttgaaaagaatatagacgcaactatggagagtaaaactaataataaaaa

SEQ ID NO: 303755 - DNA, 75 bp, Artificial Sequence
  Synthetic
gcaagatcagtagtaccagatttaaaagaattggtttcaacggaagcacaaatccaaaaaatgtcacaggattta

SEQ ID NO: 303756 - DNA, 75 bp, Artificial Sequence
  Synthetic
aacaaagatgagctagaaattttaataaaatctaattatacttatgattattataagaatattgtttacttgcat

SEQ ID NO: 303757 - DNA, 75 bp, Artificial Sequence
  Synthetic
taaaatctaattatacttatgattattataagaatattgtttacttgcatgattattcatactacaacctgaatg

SEQ ID NO: 303758 - DNA, 75 bp, Artificial Sequence
  Synthetic
tgtaaggtcgttagctgcaaatttgaatgatgtagtatgcagtggaggttcttacagttttgcgttacctgtagg

SEQ ID NO: 303759 - DNA, 75 bp, Artificial Sequence
  Synthetic
atccagcatttggaatgcaacgaatgcattatagaaacggagatccacagacaccatttcagatagcagaacaac

SEQ ID NO: 303760 - DNA, 75 bp, Artificial Sequence
  Synthetic
gattgactacagcgttaaattttcacagactatcaaatagaatatttagagaatatttgtattcaaaagtgccaa

SEQ ID NO: 303761 - DNA, 75 bp, Artificial Sequence
  Synthetic
aaaagatatggcggtagaaaacaaaaattctagggatgctggtaaagtcgtagattctgaaacagcaagcatttg

SEQ ID NO: 303762 - DNA, 75 bp, Artificial Sequence
  Synthetic
accctcggatctatatgctcggttcagcgccgtcatattggttgtacgatctattacaagtgcatgactttgaca

SEQ ID NO: 303763 - DNA, 75 bp, Artificial Sequence
  Synthetic
cgaaattaagtgataattcaatcctttatattgatataaggtcagatagaaatggcgttgattggagagaatgga

SEQ ID NO: 303764 - DNA, 75 bp, Artificial Sequence
  Synthetic
ttagatattttcaatttgatactaatgaatatggaccagatagaacgtgcttcagataaaattgcacagggtgtt

SEQ ID NO: 303765 - DNA, 75 bp, Artificial Sequence
  Synthetic
aaagagtttataaataataataatccaataattagaaatagaattgaaaatttaatatcgcagtgtaggttgtaa

SEQ ID NO: 303766 - DNA, 75 bp, Artificial Sequence
  Synthetic
catttatacgctaaattagaaattataaattacgccattaaaaatggttcatggataagtttattctgtaattat

SEQ ID NO: 303767 - DNA, 75 bp, Artificial Sequence
  Synthetic
tctgttgttgtaagattactgctatggatattgaactcccagttacatctatactattacattttcctacaacaa

SEQ ID NO: 303768 - DNA, 75 bp, Artificial Sequence
  Synthetic
aattaatgcggacaggcgattacgcgcagataactaatatgcttctgaacaatcaaccagtagcactggttggag

SEQ ID NO: 303769 - DNA, 75 bp, Artificial Sequence
  Synthetic
taaaactgataatgtttttattagcccagtctataaggtgaagccaacaaataagtttgtcgttgcattatattc

SEQ ID NO: 303770 - DNA, 75 bp, Artificial Sequence
  Synthetic
gaggatgaataatacttttaactacgagtacagattgcagtttaaatcaacgtatgattatttatatctgccatc

SEQ ID NO: 303771 - DNA, 75 bp, Artificial Sequence
  Synthetic
acaagttgtaattgatggagtattgaatcaaacacttaatgataatattagaaatggacaagttattaatcaatt

SEQ ID NO: 303772 - DNA, 75 bp, Artificial Sequence
  Synthetic
tgattgataaattgactacacgtgaaattgaacaagtagaattacttaaacgtatttatgataaactgatgatac

SEQ ID NO: 303773 - DNA, 75 bp, Artificial Sequence
  Synthetic
caatgcacaatctttctttatcattggaaagtaaagctacagggaataatcacttattcatctcattttctgata

SEQ ID NO: 303774 - DNA, 75 bp, Artificial Sequence
  Synthetic
tgtactctcttcaaaatgttatctcacagcagcaaaaccaaattgctgatcttcaacaatattgcaataaattgg

SEQ ID NO: 303775 - DNA, 75 bp, Artificial Sequence
  Synthetic
atagaagacaacgcaccggatttgtttttcataaacctaatatatttccatactcagcatcatttactttaaata

SEQ ID NO: 303776 - DNA, 75 bp, Artificial Sequence
  Synthetic
ttgttgatttgcctttcaagtacactgtatccgacccgcatttgactggagggttgttgttcttaaatgactttg

SEQ ID NO: 303777 - DNA, 75 bp, Artificial Sequence
  Synthetic
ccgaaggaggagaaattgtttttcagaacgcagcatttacaatgtggagactgacatatttggagcataaattga

SEQ ID NO: 303778 - DNA, 75 bp, Artificial Sequence
  Synthetic
gcattaaatttattaactcaatacacatatatgttgactgattcaatctatgcagcgaatgttgatggttactta

SEQ ID NO: 303779 - DNA, 75 bp, Artificial Sequence
  Synthetic
agtagcgttagtaggagcattaccattcgtaacggactcgtcagttatatcacttattgcgaagctagatgctac

SEQ ID NO: 303780 - DNA, 75 bp, Artificial Sequence
  Synthetic
tgcgtagataattcaaagagaggtttatcactgagctctctgtttgaagaatataaagatgttatagataacgca

SEQ ID NO: 303781 - DNA, 75 bp, Artificial Sequence
  Synthetic
taacgatttttatttagttgcgaactatgattggataccaacttctaccacaaaagtatataaacaggtaccgca

SEQ ID NO: 303782 - DNA, 75 bp, Artificial Sequence
  Synthetic
cagcgaatgaacttgattatgaaaataacaaaataacttctgaattattcaagtcagctgaagaatacacagatt

SEQ ID NO: 303783 - DNA, 75 bp, Artificial Sequence
  Synthetic
ggctattaaagctatacgatggggacgtataatgccttactctcggagtatctaagttttttgtatacttcaaat

SEQ ID NO: 303784 - DNA, 75 bp, Artificial Sequence
  Synthetic
cgtataatgccttactctcggagtatctaagttttttgtatacttcaaatgattcaatacaaataccaatttatt

SEQ ID NO: 303785 - DNA, 75 bp, Artificial Sequence
  Synthetic
ggaccagcgaataatatggcagaattggtatgcattcacgtcttcaatgaaacaaggtaacgctcttgatgtgtg

SEQ ID NO: 303786 - DNA, 75 bp, Artificial Sequence
  Synthetic
ggtttacagacgtagactagatttgttcattatagtcgcatccaccattaataaatatggagttccaagacataa

SEQ ID NO: 303787 - DNA, 75 bp, Artificial Sequence
  Synthetic
atacaaagatgtaatagataaagcaacgctactatcagtattatcatattcatatggtaagtatggaaatgttga

SEQ ID NO: 303788 - DNA, 75 bp, Artificial Sequence
  Synthetic
gaagaaagttatactgatagtttgatggatccagcaatacttacttcactctcttcgaatttgaacgctgctatg

SEQ ID NO: 303789 - DNA, 75 bp, Artificial Sequence
  Synthetic
ggtgactaaaacaaatatagaagattacttattgccgggatggaaattgacgtatgttggatataatggtagcgc

SEQ ID NO: 303790 - DNA, 75 bp, Artificial Sequence
  Synthetic
aattgaaatattaatgtcagtacatgatcataacgattatttaattgctgaagaacttattattaactcatattc

SEQ ID NO: 303791 - DNA, 75 bp, Artificial Sequence
  Synthetic
tcgccctacttgatattaatggaacatttatcacaacggaagaacttgaacttgaattctcaaataaatatgtga

SEQ ID NO: 303792 - DNA, 75 bp, Artificial Sequence
  Synthetic
aagctattgtaccgcagaaaactttagatgagttaaatgacatgttgattgctatggaaaaagcaaacttatata

SEQ ID NO: 303793 - DNA, 75 bp, Artificial Sequence
  Synthetic
tgttggacctagaaatgaatccatgttcacctttttagatcatccatcgattaagcaattctcaaatggaccata

SEQ ID NO: 303794 - DNA, 75 bp, Artificial Sequence
  Synthetic
tttagtgttaaaagaataccaggtaaatcgtcatcaattataaagtgtactagacttatgaaagataagattgaa

SEQ ID NO: 303795 - DNA, 75 bp, Artificial Sequence
  Synthetic
gatagatgcaccaacactaagtggctttaaattaatggctaaaatatactctttctcatttcatgttggatttag

SEQ ID NO: 303796 - DNA, 75 bp, Artificial Sequence
  Synthetic
aatcgtcatcaattataaagtgtactagacttatgaaagataagattgaacgtggtgaggtagaagttgatgatt

SEQ ID NO: 303797 - DNA, 75 bp, Artificial Sequence
  Synthetic
aaaacagaaaatgatagacgcggcactagatcagttaagtactgaatattcagatgatgtggacgatgagatgta

SEQ ID NO: 303798 - DNA, 75 bp, Artificial Sequence
  Synthetic
acaactttataccaatattacgacatgtaccacgaaaaaccaacaatatatatgctaggatcagcaccatcgtac

SEQ ID NO: 303799 - DNA, 75 bp, Artificial Sequence
  Synthetic
cagatttgaagtttgagacatgggacccattagatacaccatattctgatttgcatcacaaagagttattttata

SEQ ID NO: 303800 - DNA, 75 bp, Artificial Sequence
  Synthetic
ttattatcaatgtcatcagcatcgaatggtgagtccagacaattaaagtttggaaagaaaactattttttcaacg

SEQ ID NO: 303801 - DNA, 75 bp, Artificial Sequence
  Synthetic
acatgtacaatggaaaatacaatcctgaattagtgcctaaagttgaccaaacgcatccaataccattgggtagac

SEQ ID NO: 303802 - DNA, 75 bp, Artificial Sequence
  Synthetic
tgatatctgattatgacaaattattccttatgttcaaaggattaatacagagatgtaattatcaatattcatttg

SEQ ID NO: 303803 - DNA, 75 bp, Artificial Sequence
  Synthetic
acgcatccaataccattgggtagacgagatgtgccaggtaggagaactagaataatattcattctaccatatgaa

SEQ ID NO: 303804 - DNA, 75 bp, Artificial Sequence
  Synthetic
agaacaaactcttaacaatttaaacattgcatataaatatttatctacggggaaagctaaaatatgttgtgttaa

SEQ ID NO: 303805 - DNA, 75 bp, Artificial Sequence
  Synthetic
aaagccaatactgtataaaataaattcagattcaaatgatttttacttagttgctaattacgattgggtgccaac

SEQ ID NO: 303806 - DNA, 75 bp, Artificial Sequence
  Synthetic
tactcacagtcaaatcaattgttgtcatatggtgacgtaacgcgatttttgtcagatgatgcacttgtattatat

SEQ ID NO: 303807 - DNA, 75 bp, Artificial Sequence
  Synthetic
gatttaaaaaatgttaaaagatttataccgaaaggagtattatactcatacataaacaatactattactgaaaat

SEQ ID NO: 303808 - DNA, 75 bp, Artificial Sequence
  Synthetic
gtattcatacaacagccatttaaattgaaaacgttgaagaacgaatatatagttgcgttatatgctctgtcgaat

SEQ ID NO: 303809 - DNA, 75 bp, Artificial Sequence
  Synthetic
gtgtgtttagagataaattatttccatctatagtaaatatacataaaagagtggtaaatgttggtccaagaaatg

SEQ ID NO: 303810 - DNA, 75 bp, Artificial Sequence
  Synthetic
gaagggttaaagagacgctcgaaaagtatagacaaacgcaaataaatttaatggattcatacgttcaaattccag

SEQ ID NO: 303811 - DNA, 75 bp, Artificial Sequence
  Synthetic
ttggatttaaagacatttatgattggacttttctaccaacagattttgaaacgaatgaatcaatagttacttcat

SEQ ID NO: 303812 - DNA, 75 bp, Artificial Sequence
  Synthetic
tttgtcaatatcgttatcgtcgaaaccaactggaaacaatcatttattcattttaagtggtacaaacaagtattt

SEQ ID NO: 303813 - DNA, 75 bp, Artificial Sequence
  Synthetic
tgtattatccagacttgcaaataagtatgcatttaagactaaaataataagagttgatggagatgataattatgc

SEQ ID NO: 303814 - DNA, 75 bp, Artificial Sequence
  Synthetic
gacttatctaacaataattttaatttaataggtactaatatagaaaattcggtgtcggggcatgtatataatgca

SEQ ID NO: 303815 - DNA, 75 bp, Artificial Sequence
  Synthetic
aagaatgaatgctaaagtgaaagcattagtatcaactgtgggcatagaaattgctaaaagatatattgccggagg

SEQ ID NO: 303816 - DNA, 75 bp, Artificial Sequence
  Synthetic
tgcgattataacgttgtattgatgaagtatgattcaacattagagttagatatgtctgaactggctgatttgatt

SEQ ID NO: 303817 - DNA, 75 bp, Artificial Sequence
  Synthetic
aggtcagaattttatgcaatactagatgtatgggatattagcactattaaaagatttgtaccaaaaggtgtattt

SEQ ID NO: 303818 - DNA, 75 bp, Artificial Sequence
  Synthetic
atgctccaatagagttgatttatgcgtgtaggtcagcaaaggaattcgcgaaactgcaagacgatttaacagtgc

SEQ ID NO: 303819 - DNA, 75 bp, Artificial Sequence
  Synthetic
gataatgcaaatgacttcagttgcaataactggctccctgcgattatttccttcagaaagggtactgactacgaa

SEQ ID NO: 303820 - DNA, 75 bp, Artificial Sequence
  Synthetic
actgattttattattgagtatggaactactgacgacgatgtgtatttacaacgagctttcatgtcattatcatcg

SEQ ID NO: 303821 - DNA, 75 bp, Artificial Sequence
  Synthetic
tccttacaaatatgacgttaaagtaccacatcttacatttggtgtattaagtatttctgaaataatggtaccaga

SEQ ID NO: 303822 - DNA, 75 bp, Artificial Sequence
  Synthetic
ttgcctcatctcaagtgtttaaaagttatgtgaataaagtgtcaaatgatttattaaaatttaacaactcaatag

SEQ ID NO: 303823 - DNA, 75 bp, Artificial Sequence
  Synthetic
aaaagctaaattgaatagttatgcaccaattgcattggaaaaaagaagagcgcaactatcatcattgttaacaat

SEQ ID NO: 303824 - DNA, 75 bp, Artificial Sequence
  Synthetic
gttatcagttatttgatttcaattctccagatctagagaagctcattcggattccatttaaaggtaagataccag

SEQ ID NO: 303825 - DNA, 75 bp, Artificial Sequence
  Synthetic
ataagtggtgttctatcagtatacttcaaaatttacaacgcattttataaagaacaaattacatttggacagtcg

SEQ ID NO: 303826 - DNA, 75 bp, Artificial Sequence
  Synthetic
gttacaaaaaccagttagatttaaatcttcaaaaattactataaatgacattctttctgacattaaaccatactt

SEQ ID NO: 303827 - DNA, 75 bp, Artificial Sequence
  Synthetic
atacaatctatatatctaagaaagattaaaggtgatacggtgtttgatatgactgagtgagctaaaaactcaaca

SEQ ID NO: 303828 - DNA, 75 bp, Artificial Sequence
  Synthetic
ctctaccacacaatgttcaatatgtattacgatgtattggctctagaacgtaccaaattgaagatgatggttcaa

SEQ ID NO: 303829 - DNA, 75 bp, Artificial Sequence
  Synthetic
agaataccattcaaaggcaaaataccgtcagtaacattcatattacatatttatgcgaaattacatattataaac

SEQ ID NO: 303830 - DNA, 75 bp, Artificial Sequence
  Synthetic
ttaataaggtggctattttaatttgcgaagcattgaactctataaaagttactcaatctgatgttgcaaatgttc

SEQ ID NO: 303831 - DNA, 75 bp, Artificial Sequence
  Synthetic
ttatgcgaaattacatattataaacacagcgattaaaacaggaaaatggataacattgttttgtgattttccaaa

SEQ ID NO: 303832 - DNA, 75 bp, Artificial Sequence
  Synthetic
ggctataaaagctcaacatggcctacaggaataagcgtaaccaaggtagtaagaagcaagatactaaaactgaac

SEQ ID NO: 303833 - DNA, 75 bp, Artificial Sequence
  Synthetic
agtaataacggatgatccgcagcaagataagaaagatacaccgccagatgataatcttaaactagacaagcaggt

SEQ ID NO: 303834 - DNA, 75 bp, Artificial Sequence
  Synthetic
attccatcatttcaacctaacgagacagtgttaaagaaactcatagatattaaaccagatccagctaaaaaatca

SEQ ID NO: 303835 - DNA, 75 bp, Artificial Sequence
  Synthetic
atgacctaccagaaggagattacgatgttagagagtactttttacacctttactcacaagtgcttgaatacatgc

SEQ ID NO: 303836 - DNA, 75 bp, Artificial Sequence
  Synthetic
tactcacaagtgcttgaatacatgccagattacatgcttctaaaagagatggcagtggagaataagaattctcgc

SEQ ID NO: 303837 - DNA, 75 bp, Artificial Sequence
  Synthetic
taaatgacaattcatggaaagatacactctcacaattgtttttaactaaaggatggtctactggatcagtttatt

SEQ ID NO: 303838 - DNA, 75 bp, Artificial Sequence
  Synthetic
tcgatgaactacaagaaatgatcgataacatgaagaaagctggtttagtagacataccaagaatgattcaagaat

SEQ ID NO: 303839 - DNA, 75 bp, Artificial Sequence
  Synthetic
caaattcagaaaatgtcacaggatttgcaactagaggcgttgacaatccagtcagaaacgcagttcttgacaggt

SEQ ID NO: 303840 - DNA, 75 bp, Artificial Sequence
  Synthetic
tccaatggatataacattatattattatcaacaatcgggagaatcaaataagtggatatcaatgggatcatcatg

SEQ ID NO: 303841 - DNA, 75 bp, Artificial Sequence
  Synthetic
ttaaagtgtgtccgctcaatacgcaaactttaggaattggttgtttgactactgatgcgacaacattcgaagaag

SEQ ID NO: 303842 - DNA, 75 bp, Artificial Sequence
  Synthetic
attcgagaatcattagtagcatgtcagctagcagtcataaatacaatcatttatcctgcctttggattgcagaag

SEQ ID NO: 303843 - DNA, 75 bp, Artificial Sequence
  Synthetic
actaggaccaagagaaaatgtagcagtaattcaagttggaggttctgatgttcttgatataacagctgatcccac

SEQ ID NO: 303844 - DNA, 75 bp, Artificial Sequence
  Synthetic
acacgtttaaccaggtcgtcattgatggagttattaatcagacgctgaacgatcaaataagacgtggtttaatca

SEQ ID NO: 303845 - DNA, 75 bp, Artificial Sequence
  Synthetic
gtattttattgcacaacatgctgtagtagagaaaatgttgtcgtatgcaaagcatactagagagtacgctgaatt

SEQ ID NO: 303846 - DNA, 75 bp, Artificial Sequence
  Synthetic
gcgtgcggaaagatggataagcttgccgacctcaacagcacattgagcatgatcactttaataaatgatacacta

SEQ ID NO: 303847 - DNA, 75 bp, Artificial Sequence
  Synthetic
cgccaacagagttggacagctcgtggacttaactcgccttatgtgctataactatgagacactaatgtcatgtat

SEQ ID NO: 303848 - DNA, 75 bp, Artificial Sequence
  Synthetic
cataaagcattaattccgacaatgaaaatagcacttaaaacgtcaaaatgttcatataaagtaatcaaatattgc

SEQ ID NO: 303849 - DNA, 75 bp, Artificial Sequence
  Synthetic
ggatggcgtattttccttacattgcatctgtcctgacagtcttgttcacactgcataaagcgtcaattccgacga

SEQ ID NO: 303850 - DNA, 75 bp, Artificial Sequence
  Synthetic
acaaaaacctgttacttttaaatcaagtaaaataacaataaatgatatacttagagatataaagccattttttac

SEQ ID NO: 303851 - DNA, 75 bp, Artificial Sequence
  Synthetic
aaatgcagcgtcagcttgaaatgattgataaattgactactcgtgaaattgaacaagttgaattacttaaacgta

SEQ ID NO: 303852 - DNA, 75 bp, Artificial Sequence
  Synthetic
caaattgaagatgacggttcaaagtcagctatatctagactaatatcaaagtattcagtttacaagccgtcaatc

SEQ ID NO: 303853 - DNA, 75 bp, Artificial Sequence
  Synthetic
cgccattccgttcaccactgactcagctgtaacgtcattgatagcgaaactggacgctacagtctttgcgcaaat

SEQ ID NO: 303854 - DNA, 75 bp, Artificial Sequence
  Synthetic
acgtcgacaacgaaagtgtttaagcaagtaccgcagacttttgactttcgtgcagcgatgcatatactgtcatca

SEQ ID NO: 303855 - DNA, 75 bp, Artificial Sequence
  Synthetic
aattactgccgtttgtaaacgctgacacagttgagccaattaatgctgtcgcattcgacaacgtcagaatcatgc

SEQ ID NO: 303856 - DNA, 75 bp, Artificial Sequence
  Synthetic
gaggatccaggaatggcgtatttcccttatatagcatctgtcctaacagtcttgttcacgctacataaagcatca

SEQ ID NO: 303857 - DNA, 75 bp, Artificial Sequence
  Synthetic
cagcatttggaatgcaacgaatgcattatagaaatggggatccacaaacaccgtttcagatagcagaacagcaaa

SEQ ID NO: 303858 - DNA, 75 bp, Artificial Sequence
  Synthetic
ctgatccaacaacagcgccacaaacagaaagaatgatgcgagtgaattggaaaaaatggtggcaagtattttata

SEQ ID NO: 303859 - DNA, 75 bp, Artificial Sequence
  Synthetic
accaagctaaccacttggtatccgactttgatgagtatgtagctacgtcaagctgtttgaactctgtaagtaagg

SEQ ID NO: 303860 - DNA, 75 bp, Artificial Sequence
  Synthetic
tgttttacctctgatggtgtaaacatgaaagtactagctttaagacacagtgtggctcaggtgtatgcagatacg

SEQ ID NO: 303861 - DNA, 75 bp, Artificial Sequence
  Synthetic
ataatgtatgtatggatgaaatagctagagaatcacaacgaaatggaatagcaccacaatctgaagcactgagaa

SEQ ID NO: 303862 - DNA, 75 bp, Artificial Sequence
  Synthetic
gatatgtttcttcgtgagtcactagtcgcatgtgaattggctataataaatactatagtttacccagcatttgga

SEQ ID NO: 303863 - DNA, 75 bp, Artificial Sequence
  Synthetic
tatcatataattatgaaactctaatggcttgtataactatgaatatgcaacatgttcaaactctcactaccgaaa

SEQ ID NO: 303864 - DNA, 75 bp, Artificial Sequence
  Synthetic
ccagtctttccaccaggtatgaattggactgatttgatcactaattattcaccatctagagaggataacttgcag

SEQ ID NO: 303865 - DNA, 75 bp, Artificial Sequence
  Synthetic
gaattttccatcgacccaaagctatactgtgattataatgttgtgctaattagattcgcttctggtgaggagttg

SEQ ID NO: 303866 - DNA, 75 bp, Artificial Sequence
  Synthetic
gaaggtggaagatattatgaacatgcaccaatagaattaatatatgcatgccgatcagctagagaatttgccata

SEQ ID NO: 303867 - DNA, 75 bp, Artificial Sequence
  Synthetic
accaaaaggtgtattatactcatatataaacaacacaattactgaaaacgtattcatacaacagccttttaagtt

SEQ ID NO: 303868 - DNA, 75 bp, Artificial Sequence
  Synthetic
ttaacttattgtagaggttgtaccatgtatcatgtttgtcaatggtgtagtcaatatggtagatgctttcttgat

SEQ ID NO: 303869 - DNA, 75 bp, Artificial Sequence
  Synthetic
tgtatcatgtttgtcaatggtgtagtcaatatggtagatgctttcttgatgatgaaccacatttattaaggatga

SEQ ID NO: 303870 - DNA, 75 bp, Artificial Sequence
  Synthetic
ggtattatgataatatgaatagcgttaatcaaactccattttcatttacaaatttaatagatatgtatgataaat

SEQ ID NO: 303871 - DNA, 75 bp, Artificial Sequence
  Synthetic
aatttaatagatatgtatgataaattattacttgatgatgtaaatttcgttagaatgtcattcttaccaacatct

SEQ ID NO: 303872 - DNA, 75 bp, Artificial Sequence
  Synthetic
caatgttaagtcaacgcactatgtcattagattttgtaactactaattatatgtcattgatttcaggtatgtggc

SEQ ID NO: 303873 - DNA, 75 bp, Artificial Sequence
  Synthetic
tagtgacatgggcaaattcttcaattgaaatgctaatgtcagttttttctcatgaagattatttaattgcaagag

SEQ ID NO: 303874 - DNA, 75 bp, Artificial Sequence
  Synthetic
aggtggctattttaatttgcgaagcattgaattcaattaaggttactcaatctgatgttgcaaatgttctttcaa

SEQ ID NO: 303875 - DNA, 75 bp, Artificial Sequence
  Synthetic
agttctattttatttgatatcgttcgttcttgtgagttatattctgaaaactataataaaaataatggactatat

SEQ ID NO: 303876 - DNA, 75 bp, Artificial Sequence
  Synthetic
tacgctaactcaacacaaaacaataattttttatcttcaactttatgtctatattatccatcagaagctccaact

SEQ ID NO: 303877 - DNA, 75 bp, Artificial Sequence
  Synthetic
cacgtggtcactataatttctcattttcatgtcagaatgcagctacagatgacgatataataattgaatatatat

SEQ ID NO: 303878 - DNA, 75 bp, Artificial Sequence
  Synthetic
cgcagatagagtattcgctacatacaagaataatgctaaaagcggtaatgtcactgattttaatttactagatca

SEQ ID NO: 303879 - DNA, 75 bp, Artificial Sequence
  Synthetic
gagaaaaatccattcaaaggactgtcaactgatagaaaaatggacgaagtttcgcacgtcggaatttaattcgct

SEQ ID NO: 303880 - DNA, 75 bp, Artificial Sequence
  Synthetic
gtgcggaaagatggaaaagcttaccgacctcaactacacattgagtgtaatcactctaatgaacagtacactaca

SEQ ID NO: 303881 - DNA, 75 bp, Artificial Sequence
  Synthetic
gtttatacaacctccttttaaattgaaagcatcacctactgattatatagtggcattatatgctttatctaacga

SEQ ID NO: 303882 - DNA, 75 bp, Artificial Sequence
  Synthetic
aaagtcatcaaaagaagaatcgaaacagctactcgaaatattaaagactaaagaggatcatcagaaagaagtaca

SEQ ID NO: 303883 - DNA, 75 bp, Artificial Sequence
  Synthetic
tatatcaagtcattcagactttacaagtaaggacatggctccatgttcgctacgtagagtaactgtatgaatgat

SEQ ID NO: 303884 - DNA, 75 bp, Artificial Sequence
  Synthetic
tgaaccattgaacaatgaaatcatttttaattatataccagaaagaataagaaatgacgtaaattgcattttaaa

SEQ ID NO: 303885 - DNA, 75 bp, Artificial Sequence
  Synthetic
tggatattactttgtattattatcaacaaactgatgaggcgaataaatggatttcaatgggatcatcttgtacta

SEQ ID NO: 303886 - DNA, 75 bp, Artificial Sequence
  Synthetic
taaaatagaacgtggggaagttgaggttgatgattcatatgttgatgagaaaatggaaattgatactattgattg

SEQ ID NO: 303887 - DNA, 75 bp, Artificial Sequence
  Synthetic
acaaactgatgaggcgaataaatggatttcaatgggatcatcttgtactataaaagtatgtccactgaatacgca

SEQ ID NO: 303888 - DNA, 75 bp, Artificial Sequence
  Synthetic
tacttgacataacggctgatccaacgacagcaccacaaacagaaaggatgatgcgagtgaattggaaaaaatggt

SEQ ID NO: 303889 - DNA, 75 bp, Artificial Sequence
  Synthetic
aagaagaccatcaggacgtactttttcattcgaaagaactattgttgaagtctgttttaatagctattggtcaaa

SEQ ID NO: 303890 - DNA, 75 bp, Artificial Sequence
  Synthetic
gaagacttgatatatttaatctaatattaacgaatatggagcagattgaacgagcttcagataaaattgctcaag

SEQ ID NO: 303891 - DNA, 75 bp, Artificial Sequence
  Synthetic
gcaactagaaagggacgaaatgtatggatatgttaacattgccagaaatctcgacggatatcaacagattaattt

SEQ ID NO: 303892 - DNA, 75 bp, Artificial Sequence
  Synthetic
tctaatgttagcgatctcattcagcaatttaatcaaatgatagtaactatgaacggaaatgattttcaaactgga

SEQ ID NO: 303893 - DNA, 75 bp, Artificial Sequence
  Synthetic
taaattcagactcaaatgatttctacttggttgcaaattatgattggataccaacctcaaccacaaaagtatata

SEQ ID NO: 303894 - DNA, 75 bp, Artificial Sequence
  Synthetic
tatggatgttatcaactattcgattttaattctccagatttagagaaacttatacgaattccttttaaaggcaag

SEQ ID NO: 303895 - DNA, 75 bp, Artificial Sequence
  Synthetic
atggtgatgttacacgctttttatctaataatgctatggtgctatatacggacgtatcccagtgggattcatctc

SEQ ID NO: 303896 - DNA, 75 bp, Artificial Sequence
  Synthetic
gacgtatcccagtgggattcatctcaacacaatacgcagccatttaggaaagggataataatgggattggacatg

SEQ ID NO: 303897 - DNA, 75 bp, Artificial Sequence
  Synthetic
aacacaatacgcagccatttaggaaagggataataatgggattggacatgctagccaatatgactaatgatgcta

SEQ ID NO: 303898 - DNA, 75 bp, Artificial Sequence
  Synthetic
aatattctttagggctggaataaatttattgaataatgaaaagagaggacagagtacacagtgggatcaagcagc

SEQ ID NO: 303899 - DNA, 75 bp, Artificial Sequence
  Synthetic
ataccatttaaaggaaagataccagctgttacttttatactgcatttgtatgctaaactagaagttataaattat

SEQ ID NO: 303900 - DNA, 75 bp, Artificial Sequence
  Synthetic
ttactcttatcattaactgttaaatatttacttaatgtacggatgataaatgttgtttaattatattatataata

SEQ ID NO: 303901 - DNA, 75 bp, Artificial Sequence
  Synthetic
ttgacgaaaagatggaagtagatactattgattggaagtctaggtatgatcaattagagaagagattcgaatcac

SEQ ID NO: 303902 - DNA, 75 bp, Artificial Sequence
  Synthetic
gtaaaacatactattaaattgaagcaggagaaatggttgggtaaaagagtgtcacaatttgacattggacaatat

SEQ ID NO: 303903 - DNA, 75 bp, Artificial Sequence
  Synthetic
gttaattggggtcatggagaggtaaatgattcaactacagtagaaccaattttagatggcccttatcaaccaact

SEQ ID NO: 303904 - DNA, 75 bp, Artificial Sequence
  Synthetic
ttgctgttgaaccacacgttgatccagtagatagacaatacactatatttggtgagagtaagcactttaatgtaa

SEQ ID NO: 303905 - DNA, 75 bp, Artificial Sequence
  Synthetic
aggaatattaaaatatggtggaagaatatggacatttcataaagaaacgccaggagctgttactgatggttcaaa

SEQ ID NO: 303906 - DNA, 75 bp, Artificial Sequence
  Synthetic
gtatggacatttcatggtgaaacaccaagagctactactgatagttcgaatactgcggatttaaataatatatca

SEQ ID NO: 303907 - DNA, 75 bp, Artificial Sequence
  Synthetic
gatacgcaaacctatgtacatgatgattcaaaagatgaatatgaaaatgcatttctaatttctaatctaaccacg

SEQ ID NO: 303908 - DNA, 75 bp, Artificial Sequence
  Synthetic
ttggactagtgcctcgaatgatgtatcaaatatagctaattcgtttaatgatatttcaacacaaacgtctacaat

SEQ ID NO: 303909 - DNA, 75 bp, Artificial Sequence
  Synthetic
accatcacctccaactaaatataaaggatggtgtctggattgttgtcaacacactgatttaacttactgtcgagg

SEQ ID NO: 303910 - DNA, 75 bp, Artificial Sequence
  Synthetic
acccaaattgggaaaaatactttgcctgacataatcaccgaagcatctgaaaaatttattccaaaacggtcatat

SEQ ID NO: 303911 - DNA, 75 bp, Artificial Sequence
  Synthetic
gtgacgaaaaatgatttaatgaacttaattgatatgtacgatacattatttcctataaatcaaagaatagtagat

SEQ ID NO: 303912 - DNA, 75 bp, Artificial Sequence
  Synthetic
ccaaatatgctacgtaattttattaatcaaaacaatccaattataaggaatagaatagaacagttaattctacaa

SEQ ID NO: 303913 - DNA, 75 bp, Artificial Sequence
  Synthetic
ctaccgataactgcaaagttactgcatcatccaactactgaaattagatcagaattttatgcgatactagatata

SEQ ID NO: 303914 - DNA, 75 bp, Artificial Sequence
  Synthetic
caaagcagcgactattgatcaggcactaaatggaaaatttggttcagctatgaggaacaaaaactggatgactga

SEQ ID NO: 303915 - DNA, 75 bp, Artificial Sequence
  Synthetic
tagtatttcaaccagatgtagagtgtttacgcaacataaacttaaaatagcatctaaacatataaaaccaaatta

SEQ ID NO: 303916 - DNA, 75 bp, Artificial Sequence
  Synthetic
ctaaatggaaaatttggttcagctatgaggaacaaaaactggatgactgattcaagaacagtagctaaattggat

SEQ ID NO: 303917 - DNA, 75 bp, Artificial Sequence
  Synthetic
cagaattattgtaataaattagaagctgatttacagagtaaagttagttcactggtttcatctgttgaatggtat

SEQ ID NO: 303918 - DNA, 75 bp, Artificial Sequence
  Synthetic
tttaaaggactactacggcaatgcaactatgaatatgtgtatgaatagtcacataattcattaatcattttccat

SEQ ID NO: 303919 - DNA, 75 bp, Artificial Sequence
  Synthetic
aatgatcttaacaatagagaagatgtggtgaaactaattaataatcagaaaaaagcgttaataacagtgagaatt

SEQ ID NO: 303920 - DNA, 75 bp, Artificial Sequence
  Synthetic
tccaagagtgattaattcagctgacggagcaactacatggtactttaatccagtaattcttagaccaaacaacgt

SEQ ID NO: 303921 - DNA, 75 bp, Artificial Sequence
  Synthetic
agattgaaacgactgccactgctgaaggaggagaaattgtttttcaaaatgcagcatttacaatgtggaaattga

SEQ ID NO: 303922 - DNA, 75 bp, Artificial Sequence
  Synthetic
tcaagtgcttactgagatgccagactatctattattaaaagatatggcagtcgaaaataagaactccagagatgc

SEQ ID NO: 303923 - DNA, 75 bp, Artificial Sequence
  Synthetic
ggatatgaatttgccatcaacagcaagatatattagaccaaatttgttacaagatagactaaatttacatgataa

SEQ ID NO: 303924 - DNA, 75 bp, Artificial Sequence
  Synthetic
atggataagtctattctgtaactacccaaaatcagaaatgataaagttatggaagaaaatgtggaacattacgtc

SEQ ID NO: 303925 - DNA, 75 bp, Artificial Sequence
  Synthetic
gcagctatctagacaacaatttccgactatgccagttgattataaaagatcaatacaaagaggaatattactatt

SEQ ID NO: 303926 - DNA, 75 bp, Artificial Sequence
  Synthetic
atggtgaaaaggagttgcgtaatagatggtattggaagttgaagaaagatactttaccagatggagattatgatg

SEQ ID NO: 303927 - DNA, 75 bp, Artificial Sequence
  Synthetic
tatatagattactgggatgattcaaaagcatttagaaatatggtatatgttagatcgttagcagcaaatttgaat

SEQ ID NO: 303928 - DNA, 75 bp, Artificial Sequence
  Synthetic
caaaattatggaattaatttaccaatcactggctccatggatacagcatatgcaaattcgtcacagcaagaaaca

SEQ ID NO: 303929 - DNA, 75 bp, Artificial Sequence
  Synthetic
tgaacatggatcagatagaacgtgcctcagacaaaattgcacagggtgttattattgcataccgtgatatgcaat

SEQ ID NO: 303930 - DNA, 75 bp, Artificial Sequence
  Synthetic
cataaagcttcaattccaacaatgaaaatagcattgaaaacatcaaaatgttcatataaagtgattaaatattgt

SEQ ID NO: 303931 - DNA, 75 bp, Artificial Sequence
  Synthetic
ttctgaatgaatggttatgtaacccaatggatataacattatattattatcaacaaacagatgaagcgaataaat

SEQ ID NO: 303932 - DNA, 75 bp, Artificial Sequence
  Synthetic
tagcaataaaatgtatgttgacagcaaaagtggataaaaaagatcaagataaattttacaattctattgtttatg

SEQ ID NO: 303933 - DNA, 75 bp, Artificial Sequence
  Synthetic
gtcaactatccatcaattttacatccaattgatcatgcatttaacgaatattttttgaatcatcaattagttgaa

SEQ ID NO: 303934 - DNA, 75 bp, Artificial Sequence
  Synthetic
actgctgaaggaggagaaatagtattccaaaatactgcttttactatgtggaaattgacatatttagatcataaa

SEQ ID NO: 303935 - DNA, 75 bp, Artificial Sequence
  Synthetic
tcatgcaacagttggacttacgttacgtattgaatctgcagtttgtgaatcagtgcttgcggacgcaaatgaaac

SEQ ID NO: 303936 - DNA, 75 bp, Artificial Sequence
  Synthetic
ttgtgagttatattctgaaaaccataataaagataatggactatattatttatagaataacatttgtgattgtag

SEQ ID NO: 303937 - DNA, 75 bp, Artificial Sequence
  Synthetic
atgcgcgtgaactggaaaaaatggtggcaagtattctatactgtagttgattatattaatcagatagtacaagta

SEQ ID NO: 303938 - DNA, 75 bp, Artificial Sequence
  Synthetic
gttgcaaattatgattggataccgacttcaaccacaaaagtttataagcaagtaccacaaccttttgattttaga

SEQ ID NO: 303939 - DNA, 75 bp, Artificial Sequence
  Synthetic
aattctaacttttttgatatcgcttgtatttgtcaattatatactgaaatcagttactagaacaatggactttat

SEQ ID NO: 303940 - DNA, 75 bp, Artificial Sequence
  Synthetic
ggtgtaacactatcaacccagtatacagattatgtatcattaaattcattgcgattcaggtttagattggcggtg

SEQ ID NO: 303941 - DNA, 75 bp, Artificial Sequence
  Synthetic
aaaaggatggccaacagggtcagtttattttaaaggatatgcagatattgcgtcattttctatagaaccacagtt

SEQ ID NO: 303942 - DNA, 75 bp, Artificial Sequence
  Synthetic
aatattgaacgaatggctatgtaatccaatggacataacactatattattatcagcaaacagatgaggctaataa

SEQ ID NO: 303943 - DNA, 75 bp, Artificial Sequence
  Synthetic
ttcagaagattttattatagaatatggaacaactgacgacgaagtatatatacaaagagcatttatgtcattatc

SEQ ID NO: 303944 - DNA, 75 bp, Artificial Sequence
  Synthetic
ccataactgatgttgtcgatggggtcaatcataaattagatgtaacggcgaatacatgtactataaggaattgta

SEQ ID NO: 303945 - DNA, 75 bp, Artificial Sequence
  Synthetic
tggtggcaagttttttatacaatagttgattatgtcaaccagattgtgcaagttatgtccaagcgatcacgttca

SEQ ID NO: 303946 - DNA, 75 bp, Artificial Sequence
  Synthetic
accaattcaatataggaaatttatgcctacgttacctgataatgttcaatatgttatacaatgtataggatcaag

SEQ ID NO: 303947 - DNA, 75 bp, Artificial Sequence
  Synthetic
ggatatcgatgggacaatcttgtaccataaaagtatgtccattgaatacacagactttaggaataggttgtatta

SEQ ID NO: 303948 - DNA, 75 bp, Artificial Sequence
  Synthetic
tgttgcgtcgtctgaaaaattagtaattactgatgttgtaaatggtgttaatcataaaataaatatttcaataaa

SEQ ID NO: 303949 - DNA, 75 bp, Artificial Sequence
  Synthetic
tgataacatgaaaaaagctggtttagtagatatacccagaatgattcaagagtggttagtcgattgttcgttaga

SEQ ID NO: 303950 - DNA, 75 bp, Artificial Sequence
  Synthetic
actacagttattccaagtccgcaaacactatttcactactataacgtaaatgtgaacttccattcaaactataat

SEQ ID NO: 303951 - DNA, 75 bp, Artificial Sequence
  Synthetic
atatacggatgtttctcagtgggattcatcacaacataacacgcagccgttcagaaaaggaataattatgggttt

SEQ ID NO: 303952 - DNA, 75 bp, Artificial Sequence
  Synthetic
tcatcacaacataacacgcagccgttcagaaaaggaataattatgggtttagatatgctagccaatatgactaat

SEQ ID NO: 303953 - DNA, 75 bp, Artificial Sequence
  Synthetic
agctttagtaggagcattgccatttgtcacggattcatcagttatatcacttattgcaaaattggatgctacggt

SEQ ID NO: 303954 - DNA, 75 bp, Artificial Sequence
  Synthetic
atctatataaacaaacacaaatcaatcttatggattcatacgtgcagataccagatggtaacgtgataaagaaga

SEQ ID NO: 303955 - DNA, 75 bp, Artificial Sequence
  Synthetic
ccagatggtaacgtgataaagaagattcaatatggagctgtcgcctcaggtgaaaaacagactaaagcggcaaat

SEQ ID NO: 303956 - DNA, 75 bp, Artificial Sequence
  Synthetic
ctgagctagcttgcttttgctatcctcatttggagaatgatagctataaatttattccttttaataatttagcta

SEQ ID NO: 303957 - DNA, 75 bp, Artificial Sequence
  Synthetic
gtataatactaatgataattcaagaggcatgaattttgaaacaattatgtttactaaggtggctatgttgatatg

SEQ ID NO: 303958 - DNA, 75 bp, Artificial Sequence
  Synthetic
caaaattgtcgagggcacactatactcaaatgttagtgacctaattcaacaatttaatcaaatgataattactat

SEQ ID NO: 303959 - DNA, 75 bp, Artificial Sequence
  Synthetic
ggctttagtgtctacagttggtattgaaatagcaaaaaggtatatagctggaggaaaaatattttttagagctgg

SEQ ID NO: 303960 - DNA, 75 bp, Artificial Sequence
  Synthetic
gaaaatccacaggatattctatttcattcaaaagatttacttttgaaatcaacactgattgctattggacagtct

SEQ ID NO: 303961 - DNA, 75 bp, Artificial Sequence
  Synthetic
cgtggacaaagtacgcaatgggatcaagcagccatcatgtattcaaattacattgtaaataagttacgaggattt

SEQ ID NO: 303962 - DNA, 75 bp, Artificial Sequence
  Synthetic
caggaatagctgcaattgctttacaatcacttgaagaattattcacattaataaggtgtaatttcacttatgatt

SEQ ID NO: 303963 - DNA, 75 bp, Artificial Sequence
  Synthetic
gctaattatgttgaaactgctagaactacaattgattattttattgattttgtagataatgtatgtatggatgaa

SEQ ID NO: 303964 - DNA, 75 bp, Artificial Sequence
  Synthetic
atcacttgaagaattattcacattaataaggtgtaatttcacttatgattatgaacttgatataatatatttaca

SEQ ID NO: 303965 - DNA, 75 bp, Artificial Sequence
  Synthetic
gagcaaattggatcagaaaaaactcaaaatgtaactataaatccgggtccatttgcacagactagatatgctcca

SEQ ID NO: 303966 - DNA, 75 bp, Artificial Sequence
  Synthetic
tgccaattctggatcagaattttattgaatataaagttacattgaacgaagataaaccaatttcagatgttcatg

SEQ ID NO: 303967 - DNA, 75 bp, Artificial Sequence
  Synthetic
tatgttggttataatggaagtgaaactagaggacattataacttttcatttaaatgtcaaaacgctgcaacagat

SEQ ID NO: 303968 - DNA, 75 bp, Artificial Sequence
  Synthetic
tagtcaaaaatcaggaatagccgacgaaattgcttcttcgcaaacatttaaaaattacgttagcaagttatctga

SEQ ID NO: 303969 - DNA, 75 bp, Artificial Sequence
  Synthetic
taaatgtcaaaacgctgcaacagatgatgatctaataattgaatacatttattcagaagcgttggacttccaaaa

SEQ ID NO: 303970 - DNA, 75 bp, Artificial Sequence
  Synthetic
atcacacatggtaagggtcattatagaattgtaaagtattcatcagttgctaatcacgctgacagagtatatgca

SEQ ID NO: 303971 - DNA, 75 bp, Artificial Sequence
  Synthetic
aaagaacataagaatgtagtgaacgttggtccgcgtaatgaatctatgtttacatttttaaattatccaactata

SEQ ID NO: 303972 - DNA, 75 bp, Artificial Sequence
  Synthetic
aacagggtaatacacttgacgtgtgtaaaaggttgcttttccaaaaaatgaaaccagaaaaaaatccatttaaag

SEQ ID NO: 303973 - DNA, 75 bp, Artificial Sequence
  Synthetic
ttggtccgcgtaatgaatctatgtttacatttttaaattatccaactataaaacaattttcaaatggtgcgtatt

SEQ ID NO: 303974 - DNA, 75 bp, Artificial Sequence
  Synthetic
cgaagtttctcaagttggcgtttaattcgctatcaatttgaggatgatgatggcttagcaagaatagaaagcgct

SEQ ID NO: 303975 - DNA, 75 bp, Artificial Sequence
  Synthetic
cctacattgcctgataacgttcagtacgttatacagtgtataggatcaagaacatatcaaatagaagatagtgga

SEQ ID NO: 303976 - DNA, 75 bp, Artificial Sequence
  Synthetic
agcaatttattattactataatttatataaaagtaaaccaattatatatatgatcggatctgctccatcttattg

SEQ ID NO: 303977 - DNA, 75 bp, Artificial Sequence
  Synthetic
tatcaaaatattcagtttacaagccatcaattgaagagttatataaagtgatatccttacgagagcaagaaatac

SEQ ID NO: 303978 - DNA, 75 bp, Artificial Sequence
  Synthetic
aatgatgtgaagaaactgaaggataactcaatattgtatattgatataagaaccgataggggcaatgctgattgg

SEQ ID NO: 303979 - DNA, 75 bp, Artificial Sequence
  Synthetic
tatgttggatacaatggaagtgatacgagaggacattataatttttcttttagatgtcagaatgcagctacagat

SEQ ID NO: 303980 - DNA, 75 bp, Artificial Sequence
  Synthetic
tgacagctatggatttggaactgccaatttcagctaaattactgcaccacccaactacggaaataagatcagaat

SEQ ID NO: 303981 - DNA, 75 bp, Artificial Sequence
  Synthetic
tatcaagctgctcagactctataagtaagggtgtgatttcatactcactacatagagtaactgtgtagatgatat

SEQ ID NO: 303982 - DNA, 75 bp, Artificial Sequence
  Synthetic
ccaactacggaaataagatcagaattttatttattactagatacttgggatttaactaacattaggaggttcatt

SEQ ID NO: 303983 - DNA, 75 bp, Artificial Sequence
  Synthetic
tagcgttatatgcattatcaaatgattttaataatagatcagaagtaattaaattaattaataatcagaaacaat

SEQ ID NO: 303984 - DNA, 75 bp, Artificial Sequence
  Synthetic
tggttaaagatacaattaaactcaaacaagagagatggcttggtaaaagattatcacagtttgacattggtcaat

SEQ ID NO: 303985 - DNA, 75 bp, Artificial Sequence
  Synthetic
ctctaataactgttagaataaataatacgtttaaggatgaaccaaaagttgggttcaaaaatatctatgattgga

SEQ ID NO: 303986 - DNA, 75 bp, Artificial Sequence
  Synthetic
aacagggaataatcatttattcattttaagtggtacagataagtattataaattggatcaatttgctaatcacac

SEQ ID NO: 303987 - DNA, 75 bp, Artificial Sequence
  Synthetic
ttaagtggtacagataagtattataaattggatcaatttgctaatcacaccagtatatcgagaagatcacaccaa

SEQ ID NO: 303988 - DNA, 75 bp, Artificial Sequence
  Synthetic
caggaattaaaagtacaattgatttaactaaatcaatggcgactagtgtaatgaagaaatttagaaaatcaaaat

SEQ ID NO: 303989 - DNA, 75 bp, Artificial Sequence
  Synthetic
tatcaggtcatgtatataatgctttaatttattatagatataattattcatttgatcttaaacgctggatttatt

SEQ ID NO: 303990 - DNA, 75 bp, Artificial Sequence
  Synthetic
attgcaggatgacttaactgtattgagatattcaaacgaaatagagaattatattaatacagtatatagtataac

SEQ ID NO: 303991 - DNA, 75 bp, Artificial Sequence
  Synthetic
atttctgataacatggtgccagacgtgattgacatactaaagataatgaagaatgaattatttaaaatggatatt

SEQ ID NO: 303992 - DNA, 75 bp, Artificial Sequence
  Synthetic
atcaaataacttttggccaatccagaatgtttattccgcacataacattaagcttcaataacatgagaacagtaa

SEQ ID NO: 303993 - DNA, 75 bp, Artificial Sequence
  Synthetic
ggatagagactactaaattacaaattaaatccatttatttaagaaagattaagggtgatacagtgtttgatatgg

SEQ ID NO: 303994 - DNA, 75 bp, Artificial Sequence
  Synthetic
catactcgggatacatttttagagatttgtctaataataatttcaatttaataggtacgaatgtagagaattcag

SEQ ID NO: 303995 - DNA, 75 bp, Artificial Sequence
  Synthetic
ggaatggattatgaaacaactatgtttaataaggtggctatcttaatttgtgaagcacttaattcaattaaagtt

SEQ ID NO: 303996 - DNA, 75 bp, Artificial Sequence
  Synthetic
gttgataaattaagacaattatatacaggattaaagactgttgaatatgattctggcatatctgatattgaatag

SEQ ID NO: 303997 - DNA, 75 bp, Artificial Sequence
  Synthetic
atgtatggtattgaatataccacaattctaatcttcttgacatcgattacattgttgaattatatcttaaaatca

SEQ ID NO: 303998 - DNA, 75 bp, Artificial Sequence
  Synthetic
aacgagaataatggactatataatttacagatttctgcttatagtagtgatcttggccaccatgataaatgcgca

SEQ ID NO: 303999 - DNA, 75 bp, Artificial Sequence
  Synthetic
gcatgttgattaagtgaggaccagactaaacatctggtatccaatcttagttagcatgtagctacatcaagtcat

SEQ ID NO: 304000 - DNA, 75 bp, Artificial Sequence
  Synthetic
tatcctgttgaggcatcaaacgaaatagctgatactgaatggaaagataccttatcacaactgttcttgacaaaa

SEQ ID NO: 304001 - DNA, 75 bp, Artificial Sequence
  Synthetic
taaagatgagtatgaaaatgcattcttaatttctaatctcactacacataatatattatatttaaattatagtgt

SEQ ID NO: 304002 - DNA, 75 bp, Artificial Sequence
  Synthetic
tatgtctgaattggccgatcttatattgaacgaatggctgtgcaatccaatggacataacgctatattattatca

SEQ ID NO: 304003 - DNA, 75 bp, Artificial Sequence
  Synthetic
actaatccagacacgtttgaaacagttgcgacaacggagaagttagtgattacagatgttgtagatggtgtcaat

SEQ ID NO: 304004 - DNA, 75 bp, Artificial Sequence
  Synthetic
tacagatgttgtagatggtgtcaatcacaaattaaacgtcacaacggcaacgtgcaccatacgcaactgtaaaaa

SEQ ID NO: 304005 - DNA, 75 bp, Artificial Sequence
  Synthetic
gtcatacaggtaggcggcgcgaacattttagacatcacagctgatccaacaactacaccacagacagagagaatg

SEQ ID NO: 304006 - DNA, 75 bp, Artificial Sequence
  Synthetic
ttttagacatcacagctgatccaacaactacaccacagacagagagaatgatgcgaataaattggaaaaaatggt

SEQ ID NO: 304007 - DNA, 75 bp, Artificial Sequence
  Synthetic
ggcaagtgttttacacggtagtggattacgtcaatcagataattcagacaatgtccaaaagatctagatcgttta

SEQ ID NO: 304008 - DNA, 75 bp, Artificial Sequence
  Synthetic
ttacatttttccactaatgtaatagaaaatttacataatccaagttttaaaatacaaattacacgtaattgtagt

SEQ ID NO: 304009 - DNA, 75 bp, Artificial Sequence
  Synthetic
cagaatctgattcagatgactatgtacttgacgattctgatagtgatgatggtaaatgtaagaactgtaaatata

SEQ ID NO: 304010 - DNA, 75 bp, Artificial Sequence
  Synthetic
tatcatgagaaaccaatcgtatatatgataggatcagcgccctcgtattggatatatgacgtcaaacagtattct

SEQ ID NO: 304011 - DNA, 75 bp, Artificial Sequence
  Synthetic
ggatgacaacatcactaccaatagcaagactttcaaatcgcgtatttagagataaattatttaaaacgttgtcag

SEQ ID NO: 304012 - DNA, 75 bp, Artificial Sequence
  Synthetic
gaaaaataaaaggtgacacagtgtttgatatgactgagtgagctaaaaacttaacacactagtcatgatgtgacc

SEQ ID NO: 304013 - DNA, 75 bp, Artificial Sequence
  Synthetic
agaaaggagaaatccaaaaatgaccataaaagtaggaaacactaccctagaattgaagcagagtctgactcggat

SEQ ID NO: 304014 - DNA, 75 bp, Artificial Sequence
  Synthetic
aactatggaattaatttacctataactggttctatggatactccatatgcgaactcaactagagaagaaactttc

SEQ ID NO: 304015 - DNA, 75 bp, Artificial Sequence
  Synthetic
ataaccgatgttgttgatggtgtaaatcataaacttgatgtaactacaaacacctgcacaattagaaattgtaga

SEQ ID NO: 304016 - DNA, 75 bp, Artificial Sequence
  Synthetic
gatgtgtcgacatttgaagaggttgcaacaaccgagaagctggtgatcactgatgttgttgatggagtcaatcat

SEQ ID NO: 304017 - DNA, 75 bp, Artificial Sequence
  Synthetic
tgatgttgttgatggagtcaatcataagcttgatgtcactacaactacttgtactattagaaattgcaaaaagtt

SEQ ID NO: 304018 - DNA, 75 bp, Artificial Sequence
  Synthetic
tgtcaactagctatagtaaatacaataatctatccagcatttggaatgcaacgaatgcattatagaaacggagat

SEQ ID NO: 304019 - DNA, 75 bp, Artificial Sequence
  Synthetic
tatttaatttaatattaatgaatatggagcagatcgaacgagcttcagataaaattgctcaaggagtaataattg

SEQ ID NO: 304020 - DNA, 75 bp, Artificial Sequence
  Synthetic
gataatttgatgggaactatgtggcttaatgctggatcagaaattcaagtagctggatttgattattcatgcgct

SEQ ID NO: 304021 - DNA, 75 bp, Artificial Sequence
  Synthetic
gcggttagctccttttaatgtatggtattgaatataccacaattctaacctttttgatatcaattattctattaa

SEQ ID NO: 304022 - DNA, 75 bp, Artificial Sequence
  Synthetic
attccaatgaattagatttccaaacttttttgctaaggaaaattaaagagagaatgaccacatctctaccaatta

SEQ ID NO: 304023 - DNA, 75 bp, Artificial Sequence
  Synthetic
tacattcttaaatctcccaaccatcaagcaattttcgaatggtgcatatttagttaagcatacaattaaattgaa

SEQ ID NO: 304024 - DNA, 75 bp, Artificial Sequence
  Synthetic
cacttctcgaaacctatcatatacatgcttggttcagctccatcctactggatttatgacattaaacagtattct

SEQ ID NO: 304025 - DNA, 75 bp, Artificial Sequence
  Synthetic
caagaatatgcaataccagttggaccagtctttccaccaggtatgaactggactgatttgatcactaactattca

SEQ ID NO: 304026 - DNA, 75 bp, Artificial Sequence
  Synthetic
atacggtagtagattatattaatcagattgtgcaagttatgtccaaaagatcacggtcattaaattcagcagctt

SEQ ID NO: 304027 - DNA, 75 bp, Artificial Sequence
  Synthetic
ttatgctgatgatcccaattattttataggaatcgagtttactaatataccctatgaatacgatgttaaagtccc

SEQ ID NO: 304028 - DNA, 75 bp, Artificial Sequence
  Synthetic
agtaccagttatacttatatgctatctgataacatatatgtagcaaatgctagtggtgtattatcaacctatttt

SEQ ID NO: 304029 - DNA, 75 bp, Artificial Sequence
  Synthetic
atggctacttttaaagacgcttgttatcattataaaagaattaataaattaaatcagactgtcctaaaattaggg

SEQ ID NO: 304030 - DNA, 75 bp, Artificial Sequence
  Synthetic
ccattcaggaaaggaataataatgggactggacatattagctaatatgaccaatgatgctaaagttattcaaaca

SEQ ID NO: 304031 - DNA, 75 bp, Artificial Sequence
  Synthetic
attaaaacagttttatcacgtatctctaacaaatattcatttgccacaaaaataataagagttgatggtgatgac

SEQ ID NO: 304032 - DNA, 75 bp, Artificial Sequence
  Synthetic
tcacacttttcaattaatgtgttagagaacttgtataatccaaatttcaaagtacagatcacacgtaattgtagt

SEQ ID NO: 304033 - DNA, 75 bp, Artificial Sequence
  Synthetic
gacgttaccgttaatccaggaccgttcgcgcaaacaaattacgctccagttaattggggacctggtgaaacgaat

SEQ ID NO: 304034 - DNA, 75 bp, Artificial Sequence
  Synthetic
gactcaactacagttgaaccagtacttgatggaccatatcaaccaacgacttttaatccacctgtaagttattgg

SEQ ID NO: 304035 - DNA, 75 bp, Artificial Sequence
  Synthetic
ctaccagatgtagaatattcacgcgatgtaaactagagatggcatctaaattaattaaaccaaactatgtgactt

SEQ ID NO: 304036 - DNA, 75 bp, Artificial Sequence
  Synthetic
gggtagtagttgaaggtacgaacaatacaaacagatggttagcgacaatattaattgaaccaaatgtacagcaag

SEQ ID NO: 304037 - DNA, 75 bp, Artificial Sequence
  Synthetic
ccatatcgcgtgtggctcaagccttaatcccgtttaaccaatccggtcagcaccggacgttaatggaaggaatgg

SEQ ID NO: 304038 - DNA, 75 bp, Artificial Sequence
  Synthetic
aatttacacttataatggagagacaccgaacgcaactactgattactactctacaactaactttgacactgtaaa

SEQ ID NO: 304039 - DNA, 75 bp, Artificial Sequence
  Synthetic
actacgaaataaattgggatgttattaatgtattgattcatagtattggtaaagtaccacaaatacttactttgg

SEQ ID NO: 304040 - DNA, 75 bp, Artificial Sequence
  Synthetic
attaccaccaatacaaaatacgagaaatatcgtaccagtttcgatagtatcaaggaatattgtatatacaagagc

SEQ ID NO: 304041 - DNA, 75 bp, Artificial Sequence
  Synthetic
ttttaaatcaaataaaataacgataaacgacatacttaaagacataaagccattttttacagtcagtgaagcaca

SEQ ID NO: 304042 - DNA, 75 bp, Artificial Sequence
  Synthetic
tgcaatataatagagatatagtgataagatttaaatttgctaactcaatcattaaatcagggggattgggatata

SEQ ID NO: 304043 - DNA, 75 bp, Artificial Sequence
  Synthetic
aaataattttaattataatggtggatcattaccgactgatttcgtaatatcaaaatatgaagtgattaaggaaaa

SEQ ID NO: 304044 - DNA, 75 bp, Artificial Sequence
  Synthetic
tcattaccgactgatttcgtaatatcaaaatatgaagtgattaaggaaaattcttttgtgtatatagactactgg

SEQ ID NO: 304045 - DNA, 75 bp, Artificial Sequence
  Synthetic
agttacacaatctgaagttgcaaatgttctttcaagagtagtttctgttagacatttggaaaatttagtattaag

SEQ ID NO: 304046 - DNA, 75 bp, Artificial Sequence
  Synthetic
cacttggtcattatccagttatgactgggggtgctgtgtcattgcattcagcaggtgtaactttatcaacgcagt

SEQ ID NO: 304047 - DNA, 75 bp, Artificial Sequence
  Synthetic
atgctcaagatggagtctactcagcagatggcttcttctattattaattcttcatttgaagctgcagtggttgct

SEQ ID NO: 304048 - DNA, 75 bp, Artificial Sequence
  Synthetic
tactagatcaaagaataatatggcaaaattggtatgcgtttacgtcctcgatgaaacaaggtaatactcttgatg

SEQ ID NO: 304049 - DNA, 75 bp, Artificial Sequence
  Synthetic
tggacttccagcggcaagaccgaataattcacaagaatattatgagatagctgggagattttcattaatatcact

SEQ ID NO: 304050 - DNA, 75 bp, Artificial Sequence
  Synthetic
aatttatcacaacaaatcgctatgtcacaactgatagatcttgcgttactaccgttagacatgttctcaatgttt

SEQ ID NO: 304051 - DNA, 75 bp, Artificial Sequence
  Synthetic
ctgattcattgtctgatgcagcatcatcaatttctagaaatgcatcggttagatcagttagttcaactgcatcag

SEQ ID NO: 304052 - DNA, 75 bp, Artificial Sequence
  Synthetic
tgactattcatattatactaacaatgagataaggactgatcaacattgggtaactaagacaaatatagaagatta

SEQ ID NO: 304053 - DNA, 75 bp, Artificial Sequence
  Synthetic
gagataaggactgatcaacattgggtaactaagacaaatatagaagattatttattgccaggatggaagctgacg

SEQ ID NO: 304054 - DNA, 75 bp, Artificial Sequence
  Synthetic
tccgcgagtattacgtgaatttattaatcaggataatccaataatacgaaatagaatagaaagtttgataatgca

SEQ ID NO: 304055 - DNA, 75 bp, Artificial Sequence
  Synthetic
gttgactatgattctggcatatctgatattgaatagtaaaatgaaaatcacgtttgccaccacaggactccctgt

SEQ ID NO: 304056 - DNA, 75 bp, Artificial Sequence
  Synthetic
tgaatctgcagtttgtgaatctgtacttgccgacgcaagcgaaacaatgttagcaaatgtgacatctgttagaca

SEQ ID NO: 304057 - DNA, 75 bp, Artificial Sequence
  Synthetic
tggtggcaggtcttttatactgtagtcgattatgttaatcaaattgtacaagtcatgtccaagcgatcacgttcc

SEQ ID NO: 304058 - DNA, 75 bp, Artificial Sequence
  Synthetic
aagtgaattgtttagaatggatgtaaccacgagttatacatatatgttatcagacgaaatctatgtagcaaacgt

SEQ ID NO: 304059 - DNA, 75 bp, Artificial Sequence
  Synthetic
ttgctgttgaaccgcacgttaatccagtagatagacaatataatgtatttggtgaaaataaacaatttaatgtaa

SEQ ID NO: 304060 - DNA, 75 bp, Artificial Sequence
  Synthetic
ggatcaggagagacgttaagcggaaatgttgaagagcaacctttagacgggccatatacaccagataagtcaaat

SEQ ID NO: 304061 - DNA, 75 bp, Artificial Sequence
  Synthetic
taccaaatacagctcagactagtgtcgtagtaaatgtaatgaatgagacagtgaatatatcaatagacaactcag

SEQ ID NO: 304062 - DNA, 75 bp, Artificial Sequence
  Synthetic
aagaacgtgagaacgctaaaagaatgggaaaatggaaagaatccttatgaaccaaaagaagtgactgcagcaatg

SEQ ID NO: 304063 - DNA, 75 bp, Artificial Sequence
  Synthetic
ttaatgaatatggagcagatcgaacgagcttcagataaaattgctcaaggagtaataattgcttacagagatatg

SEQ ID NO: 304064 - DNA, 75 bp, Artificial Sequence
  Synthetic
gagagatggagatggaaatatatcaaattattggggttcggatgcatacggtgatctgagagttggaacatattt

SEQ ID NO: 304065 - DNA, 75 bp, Artificial Sequence
  Synthetic
aattattggggttcggatgcatacggtgatctgagagttggaacatattttaatccagtgccaaatgcagtgatt

SEQ ID NO: 304066 - DNA, 75 bp, Artificial Sequence
  Synthetic
ttcagaacgcagcttttactatgtggaaattgacgtatttagatcataaattgatgcctattttggatcagaatt

SEQ ID NO: 304067 - DNA, 75 bp, Artificial Sequence
  Synthetic
tttagaaagtcaaatttggcgaaaagtgttaatagtttgactgatgcaataacggatgccgctggctcaatttct

SEQ ID NO: 304068 - DNA, 75 bp, Artificial Sequence
  Synthetic
ttataccaaagggtgtattttatgcttttataaataatgtaatcacagagaatgtgtttatacaacctcctttta

SEQ ID NO: 304069 - DNA, 75 bp, Artificial Sequence
  Synthetic
actaacccggacacttttgaaacagttgcgacagcagaaaaactagcaattactgacgtcgtagacggtgtaaat

SEQ ID NO: 304070 - DNA, 75 bp, Artificial Sequence
  Synthetic
cagccgctgcgaagaaattcagagtcaaagaatttacgacagagtttaatggcgttagttttgatgacatatctg

SEQ ID NO: 304071 - DNA, 75 bp, Artificial Sequence
  Synthetic
cataaattggatgtaacgactacgacgtgtacaatacgcaactgtaaaaaactgggcccaagagaaaacgttgca

SEQ ID NO: 304072 - DNA, 75 bp, Artificial Sequence
  Synthetic
ggcaggttttttatacagtagttgactatgtgaatcaaataatccaagcaatgtccagaaggtctagatcactaa

SEQ ID NO: 304073 - DNA, 75 bp, Artificial Sequence
  Synthetic
ggaagtattttgcttatttgacagaaacattcgaagaggtaatgttcgatgcagagagatttgctgagttagtta

SEQ ID NO: 304074 - DNA, 75 bp, Artificial Sequence
  Synthetic
atgtatggtattgaatataccacagttctattttatttgatatcattcgttcttgtgagttatattctgaaaact

SEQ ID NO: 304075 - DNA, 75 bp, Artificial Sequence
  Synthetic
cacagtaaatgtgatgaatgagacagtaaatatatcaatagacaattcgggttcgacatataggtttgtggatta

SEQ ID NO: 304076 - DNA, 75 bp, Artificial Sequence
  Synthetic
gtcaactgatagaaaaatggatgaagtatcacatgttggaatttaattcgctttcgattcaagaatgatgatgac

SEQ ID NO: 304077 - DNA, 75 bp, Artificial Sequence
  Synthetic
tattgcaataaattagaaactgacttacaaaacaaaattagttcactagtgtcatcagttgagtggtatctaaga

SEQ ID NO: 304078 - DNA, 75 bp, Artificial Sequence
  Synthetic
aaattatggcattaatttaccgataacgggatcaatggatacgaactatcaaaacgtgtctaatcctgaaccgtt

SEQ ID NO: 304079 - DNA, 75 bp, Artificial Sequence
  Synthetic
tttgtgaagcactgaattcaattaaagttactcaatctgatgttgcgagtgtactttcaagagtagtttctgtaa

SEQ ID NO: 304080 - DNA, 75 bp, Artificial Sequence
  Synthetic
ggctataaaatggcttcgctcatttatagacagttacttacaaattcatataccgtagaactttcagatgaaata

SEQ ID NO: 304081 - DNA, 75 bp, Artificial Sequence
  Synthetic
gtcaattggggaccaggtgaaactaatgattcaacaacagtggaaccagtgttagatggaccatatcaacctacg

SEQ ID NO: 304082 - DNA, 75 bp, Artificial Sequence
  Synthetic
tactacttagtaacatgggcgaactcttcaattgagatgttaatgtcggttttttctcacgaagactatttaatt

SEQ ID NO: 304083 - DNA, 75 bp, Artificial Sequence
  Synthetic
ttttactggagcctaacgtacagtcagttgagcgtacatacacgctgtttggacagcaagtacagctaacagtat

SEQ ID NO: 304084 - DNA, 75 bp, Artificial Sequence
  Synthetic
gaacattcatcacaaacgaagagctagagctagagttctcaaataaatatgtgcgagccatagtaccagatcaaa

SEQ ID NO: 304085 - DNA, 75 bp, Artificial Sequence
  Synthetic
gtatggagtgatgaagcatggggggaaaatctatacgtataatggagagacaccaaacgctaataccgggtatta

SEQ ID NO: 304086 - DNA, 75 bp, Artificial Sequence
  Synthetic
aatatgacagcattttgtgatttctatataattccgttggcacaggaagcgaaatgcactgagtacataaataac

SEQ ID NO: 304087 - DNA, 75 bp, Artificial Sequence
  Synthetic
tagtgaaatcaggaggattagggtacaagtggtctgaagtatcgtttaaaccagcgaattatcaatatacatatg

SEQ ID NO: 304088 - DNA, 75 bp, Artificial Sequence
  Synthetic
atgactgctatggatttagaactaccaatatctgcaaaactattgcatcatccaactacagaaattaggtcagaa

SEQ ID NO: 304089 - DNA, 75 bp, Artificial Sequence
  Synthetic
atcaaagtacgaagtaattaaagagaattcatatgtatacattgattattgggatgattctcaagcgtttagaaa

SEQ ID NO: 304090 - DNA, 75 bp, Artificial Sequence
  Synthetic
actggtggcgcggtctcattgcactctgctggagtaacattatcaacgcagtttactgattttgtgtcacttaac

SEQ ID NO: 304091 - DNA, 75 bp, Artificial Sequence
  Synthetic
ataactcacaagaatattatgagatagctggacgtttctctctaatttcactggtaccatcaaatgatgattacc

SEQ ID NO: 304092 - DNA, 75 bp, Artificial Sequence
  Synthetic
gtcacagctaatcgacttagcactattaccactagatatgttctccatgttctcaggcattaagagtacaattga

SEQ ID NO: 304093 - DNA, 75 bp, Artificial Sequence
  Synthetic
agagaatgtgtttatacaacctccttttaaattaaaagcgtcacctactgattatatagtggcattatatgcttt

SEQ ID NO: 304094 - DNA, 75 bp, Artificial Sequence
  Synthetic
tcatcaatatctagaagtacatcgataagatcaataggttcagcaacatcagcctggacggaagtatctacagtg

SEQ ID NO: 304095 - DNA, 75 bp, Artificial Sequence
  Synthetic
tgaactttgatgacatatctgcagctgtgttaaaaacaaagattgatagatcaacacagatagctccaaatacgc

SEQ ID NO: 304096 - DNA, 75 bp, Artificial Sequence
  Synthetic
ttcagaagatttcatcatagagtatgggacaaccgacgatgaagtgtatatacaaagagcgtttatgtcattatc

SEQ ID NO: 304097 - DNA, 75 bp, Artificial Sequence
  Synthetic
gtactttgcctatagagtagaaacttttgaagaggtaccattcgacgtacagaaatttgcagatttagtgactga

SEQ ID NO: 304098 - DNA, 75 bp, Artificial Sequence
  Synthetic
tttgaagaggtaccattcgacgtacagaaatttgcagatttagtgactgactcaccagttatatcagcaataata

SEQ ID NO: 304099 - DNA, 75 bp, Artificial Sequence
  Synthetic
atagtatccaggggaatagctttgactgaaaaagcgaaattgaattcatatgcaccaatatcacttgagaaaaga

SEQ ID NO: 304100 - DNA, 75 bp, Artificial Sequence
  Synthetic
ttaatcaaaacaatccaataatacgaaacagaatagagaatttaataatgcaatgtagattgtaagtaactggaa

SEQ ID NO: 304101 - DNA, 75 bp, Artificial Sequence
  Synthetic
gatcaaaacaataaaatgcaactatctgataaagtgctttcaaaaaaagaagaagttataactgacaatcaagag

SEQ ID NO: 304102 - DNA, 75 bp, Artificial Sequence
  Synthetic
actttctcagctatattttaccaaagggtggccaaccgggaccaattattttaaagagaatcctgatattgcctc

SEQ ID NO: 304103 - DNA, 75 bp, Artificial Sequence
  Synthetic
tgatcaagttcttactgaaatgccagattacttattattaaaagatatggcagttgaaaacaaaaattcaagaga

SEQ ID NO: 304104 - DNA, 75 bp, Artificial Sequence
  Synthetic
atggcttcgctctacagacagttactatccaattcatacgtaacgaacatttctgatgaggttagtgaaattgga

SEQ ID NO: 304105 - DNA, 75 bp, Artificial Sequence
  Synthetic
atatcaaccaactacatttaatttgccaatcgactattggatgctaattgcgcctacccaaataggtagagtggc

SEQ ID NO: 304106 - DNA, 75 bp, Artificial Sequence
  Synthetic
taagtcagcgaactatgtcgcttgatttcgtaactaccaactatatgtcattaatttcaggtatgtggttgctaa

SEQ ID NO: 304107 - DNA, 75 bp, Artificial Sequence
  Synthetic
cagatagctattatctaacaataaacaatgacaacagcaatgtgtcgtgtgacgctgaattctatttgataccaa

SEQ ID NO: 304108 - DNA, 75 bp, Artificial Sequence
  Synthetic
atccagcgtttggaatgcaacgaatgcactatagaaacggagatccacagacaccatttcagatagcagaacagc

SEQ ID NO: 304109 - DNA, 75 bp, Artificial Sequence
  Synthetic
acaccatttcagatagcagaacagcagatacaaaactttcaagtagcgaattggctacattttgttaacaacaac

SEQ ID NO: 304110 - DNA, 75 bp, Artificial Sequence
  Synthetic
aatactagtgataattcgagaggaatgaattacgaaacaattatgtttaataaggtggctatcttaatttgtgaa

SEQ ID NO: 304111 - DNA, 75 bp, Artificial Sequence
  Synthetic
atgttttcaatgttctctggaattaaatcaacagtggaagcagtgaaatctatgacgacgaatattatgaaaaag

SEQ ID NO: 304112 - DNA, 75 bp, Artificial Sequence
  Synthetic
aatcaacagtggaagcagtgaaatctatgacgacgaatattatgaaaaagtttaaaacatcaaatttagcaaacg

SEQ ID NO: 304113 - DNA, 75 bp, Artificial Sequence
  Synthetic
gggttccagcaaataaatctagaagaattgatgagaacaggtgattatgcacaaataactaacatgcttttaaat

SEQ ID NO: 304114 - DNA, 75 bp, Artificial Sequence
  Synthetic
taatttaaattcagtgaaatgtacaggtggaagttacgactttagtatacctgtgggtgcatggccagttatgaa

SEQ ID NO: 304115 - DNA, 75 bp, Artificial Sequence
  Synthetic
gataacgataccgcatttgagactggaattgatggcacattttacgcgtatagagttgatactttcgatgaagtt

SEQ ID NO: 304116 - DNA, 75 bp, Artificial Sequence
  Synthetic
tagagttgatactttcgatgaagttccgttcgatgtggaaaaatttaataaactaatcacagactcaccagtact

SEQ ID NO: 304117 - DNA, 75 bp, Artificial Sequence
  Synthetic
ctccgccaccacaattcaaaaaacgttataatacaagtgataattcaagaggaatgaactatgaaacaccaatgt

SEQ ID NO: 304118 - DNA, 75 bp, Artificial Sequence
  Synthetic
tgacacagttgattggaaatcaagatatgatcaattggaaaaaagattcgaatcattgaaacagagagtgaatga

SEQ ID NO: 304119 - DNA, 75 bp, Artificial Sequence
  Synthetic
tgccaattttagatcaaaactttattgagtataaaattacggttaacgaggataaaccaatttctgaatcacata

SEQ ID NO: 304120 - DNA, 75 bp, Artificial Sequence
  Synthetic
aaaaacgtaaaaacgctagaagaatgggagagtggaaaaaatccttatgaaccaaaggaagtgactgcagcaatg

SEQ ID NO: 304121 - DNA, 75 bp, Artificial Sequence
  Synthetic
aatcaggaagaggttaaaattgctgatgaagtgaagaaatcaacgaaagaagaatctaagcagttacttgaagtg

SEQ ID NO: 304122 - DNA, 75 bp, Artificial Sequence
  Synthetic
acagaaaccagtgtcatttaaatcaaataaaattactattaacgacattttgcgtgatataaaaccattttttgt

SEQ ID NO: 304123 - DNA, 75 bp, Artificial Sequence
  Synthetic
caaatagaagatagtgggtcgaaatcatcgatttcgaagttaatatcaaaatattcagtttacaaaccatcaatt

SEQ ID NO: 304124 - DNA, 75 bp, Artificial Sequence
  Synthetic
ggaaggtgcagtaagaagattcattgcagaaatgagacagcgcgtacaagctgatagaaacgttgttaattatcc

SEQ ID NO: 304125 - DNA, 75 bp, Artificial Sequence
  Synthetic
gcaacgaatgcattatagaaacggggaccctcagacaccatttcagatagcagaacagcaaatacaaaactttca

SEQ ID NO: 304126 - DNA, 75 bp, Artificial Sequence
  Synthetic
catgtcattaatcaactaatggaagccttaatgcagctgtcacgacagcagtttccaacaatgcccgttgattat

SEQ ID NO: 304127 - DNA, 75 bp, Artificial Sequence
  Synthetic
atggttgtttaggtatgtttggcttatcaatatcattagcttcaaaaccaactggaaataatcatctgttcattt

SEQ ID NO: 304128 - DNA, 75 bp, Artificial Sequence
  Synthetic
gacgtttcacagtgggattcgtcacaacataacacacagccatttagaaaaggaataattatgggtttagatatg

SEQ ID NO: 304129 - DNA, 75 bp, Artificial Sequence
  Synthetic
gcaaagcttgatgctacagttttcgctcaaatagttaaattaaggaaagttgacactctaaaaccaatattgtat

SEQ ID NO: 304130 - DNA, 75 bp, Artificial Sequence
  Synthetic
ttaagaataatctattgggtaaagcggcaactattgatcaggcactgaatggaaaatttggatcagcagtaagga

SEQ ID NO: 304131 - DNA, 75 bp, Artificial Sequence
  Synthetic
gtgatgaaggataaaccgtactacttagtaacttgggctaactcatctatagaaatgcttatgtcagtattttca

SEQ ID NO: 304132 - DNA, 75 bp, Artificial Sequence
  Synthetic
tagtaacttgggctaactcatctatagaaatgcttatgtcagtattttcacatgaagattatttaatagcaaaag

SEQ ID NO: 304133 - DNA, 75 bp, Artificial Sequence
  Synthetic
aatagattggaagtctagatatgaacaattagaaaaaagatttgaatcattgaagcagagagttaatgaaaaata

SEQ ID NO: 304134 - DNA, 75 bp, Artificial Sequence
  Synthetic
tgcttagaaaattcaaagaaaggtctatcacttaaaaatctgttcactgaatataaagacgtgatagagaacgcg

SEQ ID NO: 304135 - DNA, 75 bp, Artificial Sequence
  Synthetic
ggattaaataacccaactgacgcttcaagcatggatctgattgaaacagttaatgcatgcgttagattgcaaaaa

SEQ ID NO: 304136 - DNA, 75 bp, Artificial Sequence
  Synthetic
caagcatggatctgattgaaacagttaatgcatgcgttagattgcaaaaaagaattttagacttagctccaaaca

SEQ ID NO: 304137 - DNA, 75 bp, Artificial Sequence
  Synthetic
cactctgaatgactataacgcattggcttcgagatgcaccgggagaacatatgctttgcttgaccaaactgcggt

SEQ ID NO: 304138 - DNA, 75 bp, Artificial Sequence
  Synthetic
gcttcgagatgcaccgggagaacatatgctttgcttgaccaaactgcggtctttactccttttaccatcaatgcc

SEQ ID NO: 304139 - DNA, 75 bp, Artificial Sequence
  Synthetic
tatccacagacgactacgatgacatgaggtctgggataaattctattttagatgttctcgccgctgctattagaa

SEQ ID NO: 304140 - DNA, 75 bp, Artificial Sequence
  Synthetic
gaggtctgggataaattctattttagatgttctcgccgctgctattagaacggaagggtctaggcctgtacgagt

SEQ ID NO: 304141 - DNA, 75 bp, Artificial Sequence
  Synthetic
gctgttagacagctggtagaggacctaaaactaaaaagtcttgtgtcaagtgtttccatcgcaaatttggcggct

SEQ ID NO: 304142 - DNA, 75 bp, Artificial Sequence
  Synthetic
taaaactaaaaagtcttgtgtcaagtgtttccatcgcaaatttggcggctgtagataccgctttaatccaaccag

SEQ ID NO: 304143 - DNA, 75 bp, Artificial Sequence
  Synthetic
atacgctgatatcatcgaacaagttgtgaatagaccacagatgaacatgacaggaggaaacatcagagctacttt

SEQ ID NO: 304144 - DNA, 75 bp, Artificial Sequence
  Synthetic
atacgctgatatcatcgaacaagttgtgaatagaccacagatgaacatgacaggtggaaacatcagagctacttt

SEQ ID NO: 304145 - DNA, 75 bp, Artificial Sequence
  Synthetic
atacgctgatatcatcgaacaagttgtgaatagaccacagatgaacatgacaggcggaaacatcagagctacttt

SEQ ID NO: 304146 - DNA, 75 bp, Artificial Sequence
  Synthetic
atacgctgatatcatcgaacaagttgtgaatagaccacagatgaacatgacagggggaaacatcagagctacttt

SEQ ID NO: 304147 - DNA, 75 bp, Artificial Sequence
  Synthetic
gtgaatagaccacagatgaacatgacaggaggaaacatcagagctactttaggtagatggtcaggtaataaggga

SEQ ID NO: 304148 - DNA, 75 bp, Artificial Sequence
  Synthetic
gtgaatagaccacagatgaacatgacaggaggaaacatcagagctactttaggtagttggtcaggtaataaggga

SEQ ID NO: 304149 - DNA, 75 bp, Artificial Sequence
  Synthetic
gtgaatagaccacagatgaacatgacaggaggaaacatcagagctactttaggtagctggtcaggtaataaggga

SEQ ID NO: 304150 - DNA, 75 bp, Artificial Sequence
  Synthetic
gtgaatagaccacagatgaacatgacaggaggaaacatcagagctactttaggtaggtggtcaggtaataaggga

SEQ ID NO: 304151 - DNA, 75 bp, Artificial Sequence
  Synthetic
gtgaatagaccacagatgaacatgacaggtggaaacatcagagctactttaggtagatggtcaggtaataaggga

SEQ ID NO: 304152 - DNA, 75 bp, Artificial Sequence
  Synthetic
gtgaatagaccacagatgaacatgacaggtggaaacatcagagctactttaggtagttggtcaggtaataaggga

SEQ ID NO: 304153 - DNA, 75 bp, Artificial Sequence
  Synthetic
gtgaatagaccacagatgaacatgacaggtggaaacatcagagctactttaggtagctggtcaggtaataaggga

SEQ ID NO: 304154 - DNA, 75 bp, Artificial Sequence
  Synthetic
gtgaatagaccacagatgaacatgacaggtggaaacatcagagctactttaggtaggtggtcaggtaataaggga

SEQ ID NO: 304155 - DNA, 75 bp, Artificial Sequence
  Synthetic
gtgaatagaccacagatgaacatgacaggcggaaacatcagagctactttaggtagatggtcaggtaataaggga

SEQ ID NO: 304156 - DNA, 75 bp, Artificial Sequence
  Synthetic
gtgaatagaccacagatgaacatgacaggcggaaacatcagagctactttaggtagttggtcaggtaataaggga

SEQ ID NO: 304157 - DNA, 75 bp, Artificial Sequence
  Synthetic
gtgaatagaccacagatgaacatgacaggcggaaacatcagagctactttaggtagctggtcaggtaataaggga

SEQ ID NO: 304158 - DNA, 75 bp, Artificial Sequence
  Synthetic
gtgaatagaccacagatgaacatgacaggcggaaacatcagagctactttaggtaggtggtcaggtaataaggga

SEQ ID NO: 304159 - DNA, 75 bp, Artificial Sequence
  Synthetic
gtgaatagaccacagatgaacatgacagggggaaacatcagagctactttaggtagatggtcaggtaataaggga

SEQ ID NO: 304160 - DNA, 75 bp, Artificial Sequence
  Synthetic
gtgaatagaccacagatgaacatgacagggggaaacatcagagctactttaggtagttggtcaggtaataaggga

SEQ ID NO: 304161 - DNA, 75 bp, Artificial Sequence
  Synthetic
gtgaatagaccacagatgaacatgacagggggaaacatcagagctactttaggtagctggtcaggtaataaggga

SEQ ID NO: 304162 - DNA, 75 bp, Artificial Sequence
  Synthetic
gtgaatagaccacagatgaacatgacagggggaaacatcagagctactttaggtaggtggtcaggtaataaggga

SEQ ID NO: 304163 - DNA, 75 bp, Artificial Sequence
  Synthetic
attcagagcacagattcactgttgatctaaaagcgagaactactgggataattaatgttgtgtatgtgccaactg

SEQ ID NO: 304164 - DNA, 75 bp, Artificial Sequence
  Synthetic
tctaaaagcgagaactactgggataattaatgttgtgtatgtgccaactgctggaaccatattgataccaatgcc

SEQ ID NO: 304165 - DNA, 75 bp, Artificial Sequence
  Synthetic
ctaatagatgtctcagcagagatgatggctgacaacttcgctattgattttatggatgatgatgctatagttcag

SEQ ID NO: 304166 - DNA, 75 bp, Artificial Sequence
  Synthetic
ctaattgatgtctcagcagagatgatggctgacaacttcgctattgattttatggatgatgatgctatagttcag

SEQ ID NO: 304167 - DNA, 75 bp, Artificial Sequence
  Synthetic
ctaatcgatgtctcagcagagatgatggctgacaacttcgctattgattttatggatgatgatgctatagttcag

SEQ ID NO: 304168 - DNA, 75 bp, Artificial Sequence
  Synthetic
ctaatggatgtctcagcagagatgatggctgacaacttcgctattgattttatggatgatgatgctatagttcag

SEQ ID NO: 304169 - DNA, 75 bp, Artificial Sequence
  Synthetic
tggctgacaacttcgctattgattttatggatgatgatgctatagttcagaccgagactggagttggagtctttt

SEQ ID NO: 304170 - DNA, 75 bp, Artificial Sequence
  Synthetic
gtttagaatttctccatgggatatgcaaaaagatcaagaaggtcttggtacagttcacatgacgaattgggcaca

SEQ ID NO: 304171 - DNA, 75 bp, Artificial Sequence
  Synthetic
caaaaagatcaagaaggtcttggtacagttcacatgacgaattgggcacagggaacggctgcgagacaaccggct

SEQ ID NO: 304172 - DNA, 75 bp, Artificial Sequence
  Synthetic
atacgttcaccgaaggtgactaccaacatttatcaaagtgcacacctaaatcacagtatatgttggatacaatat

SEQ ID NO: 304173 - DNA, 75 bp, Artificial Sequence
  Synthetic
ttcctgaaacttcattcgtgaataagccaaatgtagattggaatgttcagagtctacttacctcaaatgttcaaa

SEQ ID NO: 304174 - DNA, 75 bp, Artificial Sequence
  Synthetic
atgggaaataggcagtccagcttgcaatcgcagactcatcgcaccgatattaactcacataactcaaatatttac

SEQ ID NO: 304175 - DNA, 75 bp, Artificial Sequence
  Synthetic
aatcgcagactcatcgcaccgatattaactcacataactcaaatatttaccttcaaagcgcatcttttgctgaat

SEQ ID NO: 304176 - DNA, 75 bp, Artificial Sequence
  Synthetic
taactcacataactcaaatatttaccttcaaagcgcatcttttgctgaatttaaaacttaccatttgctaattac

SEQ ID NO: 304177 - DNA, 75 bp, Artificial Sequence
  Synthetic
ctgtttgcttttcttatctcaagtttagtgtgtaattgttacttaatacgaagattgaaacatggacctcgtaaa

SEQ ID NO: 304178 - DNA, 75 bp, Artificial Sequence
  Synthetic
tagtgtgtaattgttacttaatacgaagattgaaacatggacctcgtaaagtttatcgcacaagcaaagcacaag

SEQ ID NO: 304179 - DNA, 75 bp, Artificial Sequence
  Synthetic
acaattcattcgacccgacaactttgtctaagaaacctttaaagttagaactcattaaatacaacaacccattcc

SEQ ID NO: 304180 - DNA, 75 bp, Artificial Sequence
  Synthetic
gtctaagaaacctttaaagttagaactcattaaatacaacaacccattccgtgaagtgccccagcttgctggaga

SEQ ID NO: 304181 - DNA, 75 bp, Artificial Sequence
  Synthetic
ccttataatcatgaacatttttgcggtggtatacacattccaaaacaattcaatatgtcaccgaaaggaagaatt

SEQ ID NO: 304182 - DNA, 75 bp, Artificial Sequence
  Synthetic
gtggtatacacattccaaaacaattcaatatgtcaccgaaaggaagaattaatttcatcacatgtgacaagattg

SEQ ID NO: 304183 - DNA, 75 bp, Artificial Sequence
  Synthetic
cattatcgatggtaaaaaatacaccggttctgcgtttgtgaaatgtagatgcggacagccatacccaacaatcat

SEQ ID NO: 304184 - DNA, 75 bp, Artificial Sequence
  Synthetic
ggttctgcgtttgtgaaatgtagatgcggacagccatacccaacaatcatagatcaaaactccaccttcttcttt

SEQ ID NO: 304185 - DNA, 75 bp, Artificial Sequence
  Synthetic
agtcagtgaaaatcgggctaaatgaaaagtttaactgtttgaattgcagcaggagtgtgcgttggttcagtccag

SEQ ID NO: 304186 - DNA, 75 bp, Artificial Sequence
  Synthetic
aaagtttaactgtttgaattgcagcaggagtgtgcgttggttcagtccaggaagaggtatgcgaaccgcgaatca

SEQ ID NO: 304187 - DNA, 75 bp, Artificial Sequence
  Synthetic
ccagcatgcatgccatttcgcgacattgtcgctacaatgtctttactaaataaagtggaattcattggtgctgat

SEQ ID NO: 304188 - DNA, 75 bp, Artificial Sequence
  Synthetic
ttgtcgctacaatgtctttactaaataaagtggaattcattggtgctgattttgacaaaatgcgtactgactttg

SEQ ID NO: 304189 - DNA, 75 bp, Artificial Sequence
  Synthetic
ctgtgaatctgcttttagatcatttaattctccacaactggcacacaggatcgcaccatgtgaaaggatcgaacc

SEQ ID NO: 304190 - DNA, 75 bp, Artificial Sequence
  Synthetic
aattctccacaactggcacacaggatcgcaccatgtgaaaggatcgaaccaaatctcactttaaataccattgtt

SEQ ID NO: 304191 - DNA, 75 bp, Artificial Sequence
  Synthetic
gacaacataacaagatagaagttacaccattatgtagaggaaaggttgcagttagcgatggatatagacgatgcg

SEQ ID NO: 304192 - DNA, 75 bp, Artificial Sequence
  Synthetic
tcattgattttcaagataatgctgaactacattattcaatcaacatgctattgcttagctggaagcttatctaaa

SEQ ID NO: 304193 - DNA, 75 bp, Artificial Sequence
  Synthetic
ggcacaaattgtcgtcaaaatgcttgcatacctacgacgtgaatggcagtcttatggggaaactgtcatagctga

SEQ ID NO: 304194 - DNA, 75 bp, Artificial Sequence
  Synthetic
gcatacctacgacgtgaatggcagtcttatggggaaactgtcatagctgaaggtactttcaactcaacttcatca

SEQ ID NO: 304195 - DNA, 75 bp, Artificial Sequence
  Synthetic
cttatggggaaactgtcatagctgaaggtactttcaactcaacttcatcagacagtagtcagagtgaaaagccaa

SEQ ID NO: 304196 - DNA, 75 bp, Artificial Sequence
  Synthetic
tcaagccgagatcggtcgcaacgcttatagcatggacgctagaggcttcatgttaggcgagagtgatagacatgt

SEQ ID NO: 304197 - DNA, 75 bp, Artificial Sequence
  Synthetic
tatagcatggacgctagaggcttcatgttaggcgagagtgatagacatgttgacacaacacaatttctaccatat

SEQ ID NO: 304198 - DNA, 75 bp, Artificial Sequence
  Synthetic
aatactgcaatatagagcctccttgtggaacgctgctgcgtatgcattttgatgtgtccggcgatgtcagtgttg

SEQ ID NO: 304199 - DNA, 75 bp, Artificial Sequence
  Synthetic
tggaacgctgctgcgtatgcattttgatgtgtccggcgatgtcagtgttgatatgcaccgtgtcgcgtcaatcta

SEQ ID NO: 304200 - DNA, 75 bp, Artificial Sequence
  Synthetic
gacggttcacagtatacaatacgtggctatagagatagaaacctaacagccactgaaacacaaaagaaattgata

SEQ ID NO: 304201 - DNA, 75 bp, Artificial Sequence
  Synthetic
gctatagagatagaaacctaacagccactgaaacacaaaagaaattgatattttacggttttagaaagctaggaa

SEQ ID NO: 304202 - DNA, 75 bp, Artificial Sequence
  Synthetic
agttatgctcacgtcgaccatcattcagaagattagttataaacatcagtttacatttcaaatgcattcagaatc

SEQ ID NO: 304203 - DNA, 75 bp, Artificial Sequence
  Synthetic
cagaagattagttataaacatcagtttacatttcaaatgcattcagaatcgtacgtatggggcccatgttccgga

SEQ ID NO: 304204 - DNA, 75 bp, Artificial Sequence
  Synthetic
atgactcacgcataataatctacgaacaagaagatgggttttggaaaattctaaaagaaactttatggataaagt

SEQ ID NO: 304205 - DNA, 75 bp, Artificial Sequence
  Synthetic
acaagaagatgggttttggaaaattctaaaagaaactttatggataaagttgaagccatattttaagccgtatgg

SEQ ID NO: 304206 - DNA, 75 bp, Artificial Sequence
  Synthetic
tggttgattgattctggattcgagaaacatgaatacacttactcgtatgaacgtgatggccaagtagtgaacgcc

SEQ ID NO: 304207 - DNA, 75 bp, Artificial Sequence
  Synthetic
aacatgaatacacttactcgtatgaacgtgatggccaagtagtgaacgccaccactgtgacctatgtaaagccaa

SEQ ID NO: 304208 - DNA, 75 bp, Artificial Sequence
  Synthetic
atggaggccggccacagactacaacggtcagttcaccgtgcttcaaccagaagacgaattctcggtgtggtattt

SEQ ID NO: 304209 - DNA, 75 bp, Artificial Sequence
  Synthetic
ggtcagttcaccgtgcttcaaccagaagacgaattctcggtgtggtattttgaagataagtggcaaatcagtcag

SEQ ID NO: 304210 - DNA, 75 bp, Artificial Sequence
  Synthetic
cagacagtcaggttgagggtgaactgactaacaatggtgcgttgatatttaaaatgaattacataccctcgttag

SEQ ID NO: 304211 - DNA, 75 bp, Artificial Sequence
  Synthetic
gactaacaatggtgcgttgatatttaaaatgaattacataccctcgttagcgggaataaccaataagggcggaaa

SEQ ID NO: 304212 - DNA, 75 bp, Artificial Sequence
  Synthetic
ggctttgcacagatagatacttctagacatacgggattagcgataatattgaattttaaatgttatggaaagaaa

SEQ ID NO: 304213 - DNA, 75 bp, Artificial Sequence
  Synthetic
gacatacgggattagcgataatattgaattttaaatgttatggaaagaaattctatgctgataacaacaattacc

SEQ ID NO: 304214 - DNA, 75 bp, Artificial Sequence
  Synthetic
catatgctacattggggactcatacacgttatcgggaggtactcattaccgtcaaggcgcatgtgcaggtttcgc

SEQ ID NO: 304215 - DNA, 75 bp, Artificial Sequence
  Synthetic
acgttatcgggaggtactcattaccgtcaaggcgcatgtgcaggtttcgcagcaggatacgatgatgaaataact

SEQ ID NO: 304216 - DNA, 75 bp, Artificial Sequence
  Synthetic
cagtcatgaaaccgtccgatccggatttcgttacaggaggagataattatgggcaaacagttacatcagacattg

SEQ ID NO: 304217 - DNA, 75 bp, Artificial Sequence
  Synthetic
tttcgttacaggaggagataattatgggcaaacagttacatcagacattgagcgtagtatacgtgatttacagga

SEQ ID NO: 304218 - DNA, 75 bp, Artificial Sequence
  Synthetic
atgaacattcagcaagtcacatcagctgtttttacggccataacgaatttgggcgaactaccatctctttttagc

SEQ ID NO: 304219 - DNA, 75 bp, Artificial Sequence
  Synthetic
ctgtttttacggccataacgaatttgggcgaactaccatctctttttagcaacataaccaaggtgtttaacagag

SEQ ID NO: 304220 - DNA, 75 bp, Artificial Sequence
  Synthetic
gagcaggagcaattcagatatatcaccgataggagcgacaaaaatcatagacaagacaacattagaaactcccca

SEQ ID NO: 304221 - DNA, 75 bp, Artificial Sequence
  Synthetic
ccgataggagcgacaaaaatcatagacaagacaacattagaaactccccagttatcagtaattaatagaatgccc

SEQ ID NO: 304222 - DNA, 75 bp, Artificial Sequence
  Synthetic
acaattccatgagaacacggaaattgattgatgaacgcaagcatgacttcgatacattcgctgtagccacggaga

SEQ ID NO: 304223 - DNA, 75 bp, Artificial Sequence
  Synthetic
gattgatgaacgcaagcatgacttcgatacattcgctgtagccacggagatggaattaccctacatttcaaaggt

SEQ ID NO: 304224 - DNA, 75 bp, Artificial Sequence
  Synthetic
gactatctaaagaaacctgggcttctatccaacgacgatgtagcagtacagattgatccaatgaacaatagatta

SEQ ID NO: 304225 - DNA, 75 bp, Artificial Sequence
  Synthetic
tatccaacgacgatgtagcagtacagattgatccaatgaacaatagattatcagtactgagaagaaagtatgcag

SEQ ID NO: 304226 - DNA, 75 bp, Artificial Sequence
  Synthetic
agaactagcgcatgaagtgctttctaacatgtcaaacagcgctactaggtcactattttctttaaatgttcgtaa

SEQ ID NO: 304227 - DNA, 75 bp, Artificial Sequence
  Synthetic
aacatgtcaaacagcgctactaggtcactattttctttaaatgttcgtaagcaaatagctatgaacaattcattc

SEQ ID NO: 304228 - DNA, 75 bp, Artificial Sequence
  Synthetic
ttgatagaatgttcgatgatgggcaactaatagacgtactaaacaatctaaacagggaaacggccactgaactat

SEQ ID NO: 304229 - DNA, 75 bp, Artificial Sequence
  Synthetic
ttgatgaatttctcacacgaattaaaagcatgctagtgaagatgagttaatggcaatggtgacgcacacataaaa

SEQ ID NO: 304230 - DNA, 75 bp, Artificial Sequence
  Synthetic
acgcttcaagcatggatctgatcgaaacagttaatgcatgcgttaagttgcaaaagagagttttaagtttagcac

SEQ ID NO: 304231 - DNA, 75 bp, Artificial Sequence
  Synthetic
aacagttaatgcatgcgttaagttgcaaaagagagttttaagtttagcaccaaacacgaatttgaatacatctgg

SEQ ID NO: 304232 - DNA, 75 bp, Artificial Sequence
  Synthetic
gcattagcctcaagatgcaatggtagaacatacgcttttcaggatcaaactgcggtcttaactcccttcaccatc

SEQ ID NO: 304233 - DNA, 75 bp, Artificial Sequence
  Synthetic
gaacatacgcttttcaggatcaaactgcggtcttaactcccttcaccatcaatgctccaattatttctctttcag

SEQ ID NO: 304234 - DNA, 75 bp, Artificial Sequence
  Synthetic
tgacatgaaatccggaatggactcaatcctagatgtgcttgccgctgccattaggacagaaggatctagaccagt

SEQ ID NO: 304235 - DNA, 75 bp, Artificial Sequence
  Synthetic
atcctagatgtgcttgccgctgccattaggacagaaggatctagaccagtgagagcaatagaaagacgtgtcctt

SEQ ID NO: 304236 - DNA, 75 bp, Artificial Sequence
  Synthetic
aagacttaaagttaaaaagtctcacttctgatatttccgttgcaaatctggctgccgtagatactgccgtaattc

SEQ ID NO: 304237 - DNA, 75 bp, Artificial Sequence
  Synthetic
ttctgatatttccgttgcaaatctggctgccgtagatactgccgtaattcaaccagaaattatccagactgaaaa

SEQ ID NO: 304238 - DNA, 75 bp, Artificial Sequence
  Synthetic
caagttgtgaataggccacagatgaatatgactggcgggaacatcagagccactttgggaaggtggtcaggtaac

SEQ ID NO: 304239 - DNA, 75 bp, Artificial Sequence
  Synthetic
atatgactggcgggaacatcagagccactttgggaaggtggtcaggtaacaagggagtagtcacatgtatgtcag

SEQ ID NO: 304240 - DNA, 75 bp, Artificial Sequence
  Synthetic
cgttaattttaaggctagaactacaggaataataaacattgtttacataccagctgctggtactatattaatacc

SEQ ID NO: 304241 - DNA, 75 bp, Artificial Sequence
  Synthetic
cagctgctggtactatattaatacccatgccaaacggaagaaatagggaaggaaaattaatcgatgtctcagcgg

SEQ ID NO: 304242 - DNA, 75 bp, Artificial Sequence
  Synthetic
tgatttcatggacgatgatgctatacttcaaaccgaaactggagttggagtttactctttcccaatgtgtaatcg

SEQ ID NO: 304243 - DNA, 75 bp, Artificial Sequence
  Synthetic
tttactctttcccaatgtgtaatcgtattagatttagaatttctccatgggatatggataaagatcaagaaggtt

SEQ ID NO: 304244 - DNA, 75 bp, Artificial Sequence
  Synthetic
tattagatttagaatttctccatgggatatggataaagatcaagaaggtttgggaacagttcacatgacaaactg

SEQ ID NO: 304245 - DNA, 75 bp, Artificial Sequence
  Synthetic
ccagctatttcttttatgttcgaaactcgagacacctttactcaaggtgattatcagcatttgtcgaaatgcaca

SEQ ID NO: 304246 - DNA, 75 bp, Artificial Sequence
  Synthetic
cgattttccctgaaacttcattcataaataaaccaaacgttgattggaatattcagagtttacttacttccacta

SEQ ID NO: 304247 - DNA, 75 bp, Artificial Sequence
  Synthetic
ggtattaattagtccaaccagggcgtcctagagcatggatctgatcgaaacagttaacgcttgtgtccgcttgca

SEQ ID NO: 304248 - DNA, 75 bp, Artificial Sequence
  Synthetic
tcctagagcatggatctgatcgaaacagttaacgcttgtgtccgcttgcagagaagagttcttgatctagctcca

SEQ ID NO: 304249 - DNA, 75 bp, Artificial Sequence
  Synthetic
aatcaaccttaaatgattataatgcaacagcctcacgtgtcaatggtcgaacatatcctttgcttgatcaaactg

SEQ ID NO: 304250 - DNA, 75 bp, Artificial Sequence
  Synthetic
aacagcctcacgtgtcaatggtcgaacatatcctttgcttgatcaaactgcggttcttacaccatacaccgttca

SEQ ID NO: 304251 - DNA, 75 bp, Artificial Sequence
  Synthetic
agaatttcgactgacgattatgaggatatgagaagtggtatggaatcgatactcgattgtcttgctgcggcaatt

SEQ ID NO: 304252 - DNA, 75 bp, Artificial Sequence
  Synthetic
atatgagaagtggtatggaatcgatactcgattgtcttgctgcggcaattaggactgaaggttctagaccagtac

SEQ ID NO: 304253 - DNA, 75 bp, Artificial Sequence
  Synthetic
gccagtggttaaacagctgattgatgacttaaagcttaagagcttaatatctaatatttcagttgcaaactttgc

SEQ ID NO: 304254 - DNA, 75 bp, Artificial Sequence
  Synthetic
gacttaaagcttaagagcttaatatctaatatttcagttgcaaactttgccgccgccgatacatcattaatccag

SEQ ID NO: 304255 - DNA, 75 bp, Artificial Sequence
  Synthetic
cttttctcgtcggcataatcgaacagaccgtaatgcgacagccagctaatcttaatggtggaaacattcgagcag

SEQ ID NO: 304256 - DNA, 75 bp, Artificial Sequence
  Synthetic
gaccgtaatgcgacagccagctaatcttaatggtggaaacattcgagcagcagttggaagatggtcaggaaataa

SEQ ID NO: 304257 - DNA, 75 bp, Artificial Sequence
  Synthetic
atggaagctgaacatatctttttcgttgaattcaaagctagaacatgcggagtgttaaacgttatatacatacca

SEQ ID NO: 304258 - DNA, 75 bp, Artificial Sequence
  Synthetic
ttgaattcaaagctagaacatgcggagtgttaaacgttatatacataccagcaccaggtgtattaatgattccat

SEQ ID NO: 304259 - DNA, 75 bp, Artificial Sequence
  Synthetic
catatgcattgatgtctcagcagagatgactgctgatgactttaagattgacttttttgatgatgacactattgt

SEQ ID NO: 304260 - DNA, 75 bp, Artificial Sequence
  Synthetic
atgactgctgatgactttaagattgacttttttgatgatgacactattgtgcacactgcgaacggcgtaggcatt

SEQ ID NO: 304261 - DNA, 75 bp, Artificial Sequence
  Synthetic
taagattcagagtcactccttggactgaacagaagacacgagatggtcttgatactccatcgattacgaactgga

SEQ ID NO: 304262 - DNA, 75 bp, Artificial Sequence
  Synthetic
tgaacagaagacacgagatggtcttgatactccatcgattacgaactggaataatggaaatgccccacggcaacc

SEQ ID NO: 304263 - DNA, 75 bp, Artificial Sequence
  Synthetic
agacgcacattcactgaaaatgattataagttcgtttcaagatgcacaccaaaagtacagtacgttcttgacaac

SEQ ID NO: 304264 - DNA, 75 bp, Artificial Sequence
  Synthetic
ataagttcgtttcaagatgcacaccaaaagtacagtacgttcttgacaactattttccagaaacatcgttcgtga

SEQ ID NO: 304265 - DNA, 75 bp, Artificial Sequence
  Synthetic
tcaggagatgctaactacagatactcacactatatggtcacgaaaaatagcaatgctggtcgcggctttcgctgc

SEQ ID NO: 304266 - DNA, 75 bp, Artificial Sequence
  Synthetic
caatgctggtcgcggctttcgctgctaagatctgatctgccctggatccggaagccggattgctttagaggatga

SEQ ID NO: 304267 - DNA, 75 bp, Artificial Sequence
  Synthetic
acgcttcaagcatggatctgattgaaacagtaaacgcgtgcgttacattgcaaaaaagaatatacgacttagcac

SEQ ID NO: 304268 - DNA, 75 bp, Artificial Sequence
  Synthetic
aacagtaaacgcgtgcgttacattgcaaaaaagaatatacgacttagcaccaaataccaaccttaatacagcagg

SEQ ID NO: 304269 - DNA, 75 bp, Artificial Sequence
  Synthetic
caaaaaagaatatacgacttagcaccaaataccaaccttaatacagcagggcaaagtactctcaacgattacaac

SEQ ID NO: 304270 - DNA, 75 bp, Artificial Sequence
  Synthetic
aaacatatcctctacatgatctaactgcagtactaactccactaactatacacgctcctatcatctcactctcag

SEQ ID NO: 304271 - DNA, 75 bp, Artificial Sequence
  Synthetic
tgcagtactaactccactaactatacacgctcctatcatctcactctcagtacgtatctctactgatgattatga

SEQ ID NO: 304272 - DNA, 75 bp, Artificial Sequence
  Synthetic
atccttgatgtgctagcagcagcaattagaacagaaggttcgaggccagtgcgcgtaattgaaagacgcgttctt

SEQ ID NO: 304273 - DNA, 75 bp, Artificial Sequence
  Synthetic
ttagaacagaaggttcgaggccagtgcgcgtaattgaaagacgcgttcttgatccagttgtcaggcaattggttg

SEQ ID NO: 304274 - DNA, 75 bp, Artificial Sequence
  Synthetic
atcagaagtatctctagcaaacctagctgctgtggacactgccatgattcaacctgaactaattgaaactgaaaa

SEQ ID NO: 304275 - DNA, 75 bp, Artificial Sequence
  Synthetic
gctgctgtggacactgccatgattcaacctgaactaattgaaactgaaaatccactatttgctgacattattgag

SEQ ID NO: 304276 - DNA, 75 bp, Artificial Sequence
  Synthetic
atatgactggtggaaatgtcagggctaccttaggtagatggtcaggtaataaaggtgtgatcacttgcatgtcgg

SEQ ID NO: 304277 - DNA, 75 bp, Artificial Sequence
  Synthetic
taccttaggtagatggtcaggtaataaaggtgtgatcacttgcatgtcgggcatggactcagaacatagattcac

SEQ ID NO: 304278 - DNA, 75 bp, Artificial Sequence
  Synthetic
ggcgtattaaatattgtttacgtaccagcagccggtacgatgctcattccaatgccgaatggaagaaccagagaa

SEQ ID NO: 304279 - DNA, 75 bp, Artificial Sequence
  Synthetic
cagcagccggtacgatgctcattccaatgccgaatggaagaaccagagaagggaaacttattgatgtctcagctg

SEQ ID NO: 304280 - DNA, 75 bp, Artificial Sequence
  Synthetic
cgatttcatggaagacgatgctataatacaaactgaaaccggagtcggcgtttactcttttccaatgtgtaacag

SEQ ID NO: 304281 - DNA, 75 bp, Artificial Sequence
  Synthetic
atacaaactgaaaccggagtcggcgtttactcttttccaatgtgtaacagaataaggtttagaattaatccatgg

SEQ ID NO: 304282 - DNA, 75 bp, Artificial Sequence
  Synthetic
taggaacggtacacatgacaaattgggctcagggaaatgcaacaagacagccagctgtatcatttctctttgaaa

SEQ ID NO: 304283 - DNA, 75 bp, Artificial Sequence
  Synthetic
ctaccagcatctatcaagatgtacccctaaggcgcagtacatgttagataccgtgttcccagaatcgtcatttat

SEQ ID NO: 304284 - DNA, 75 bp, Artificial Sequence
  Synthetic
cctaaggcgcagtacatgttagataccgtgttcccagaatcgtcatttataaataagcctcccacagaatggaac

SEQ ID NO: 304285 - DNA, 75 bp, Artificial Sequence
  Synthetic
agcaatgctagtgtccgcgtttgctgccaaagtctgatccggcgtcagctccaaaagaggagtgcttcgagaggt

SEQ ID NO: 304286 - DNA, 75 bp, Artificial Sequence
  Synthetic
acgcttaaagcatggatctgattgaaacagttaatgcgtgcatcaaattgcaaaaaagagttctaagtttagcgc

SEQ ID NO: 304287 - DNA, 75 bp, Artificial Sequence
  Synthetic
aacagttaatgcgtgcatcaaattgcaaaaaagagttctaagtttagcgccaaacacgaatttgaacacatcagg

SEQ ID NO: 304288 - DNA, 75 bp, Artificial Sequence
  Synthetic
caaaaaagagttctaagtttagcgccaaacacgaatttgaacacatcaggtcagagtaccttgaatgattacaac

SEQ ID NO: 304289 - DNA, 75 bp, Artificial Sequence
  Synthetic
aaacatatgctttgctcgatcaaactgctgtcttaaccccctttactatcaatgccccaatcatttctctttcag

SEQ ID NO: 304290 - DNA, 75 bp, Artificial Sequence
  Synthetic
aatgccccaatcatttctctttcagtccgcatctctacagatgattatgacgacatgaaatctggaatggattca

SEQ ID NO: 304291 - DNA, 75 bp, Artificial Sequence
  Synthetic
aagagcaatagaaagacgcgttcttgatccagctgtcagacagctggtggaagaccttaaattgaaaagtctcac

SEQ ID NO: 304292 - DNA, 75 bp, Artificial Sequence
  Synthetic
gctgctgtagataccgccataattcaaccagaaatcattcaaactgaaaatccattatacgctgatattattgaa

SEQ ID NO: 304293 - DNA, 75 bp, Artificial Sequence
  Synthetic
aaccagaaatcattcaaactgaaaatccattatacgctgatattattgaacaagtcgtaaatagaccacaaatga

SEQ ID NO: 304294 - DNA, 75 bp, Artificial Sequence
  Synthetic
tactttaggaagatggtcaggcaacaaaggagtagttacatgtatgtcgggaatggattctgaacatagatttac

SEQ ID NO: 304295 - DNA, 75 bp, Artificial Sequence
  Synthetic
aaaggagtagttacatgtatgtcgggaatggattctgaacatagatttaccgtcgatctcaaagctagaactact

SEQ ID NO: 304296 - DNA, 75 bp, Artificial Sequence
  Synthetic
cgaccgcagggactatactaatacctatgccaaatgcaagaaatagagagggtaaattaattgacgtttcagcag

SEQ ID NO: 304297 - DNA, 75 bp, Artificial Sequence
  Synthetic
tatgccaaatgcaagaaatagagagggtaaattaattgacgtttcagcagaaatgatggctgagaatttcgccat

SEQ ID NO: 304298 - DNA, 75 bp, Artificial Sequence
  Synthetic
attcaaactgaaacaggagttggagtatattccttcccaatgtgcaatcgctttagatttagaatttctccgtgg

SEQ ID NO: 304299 - DNA, 75 bp, Artificial Sequence
  Synthetic
tatattccttcccaatgtgcaatcgctttagatttagaatttctccgtgggatatgcaaaaagatcaagatggtc

SEQ ID NO: 304300 - DNA, 75 bp, Artificial Sequence
  Synthetic
ggcgcagggaacagctgctagacaaccagctatatcctttatgttcgagactcgcgatacatttacccagggcga

SEQ ID NO: 304301 - DNA, 75 bp, Artificial Sequence
  Synthetic
ccagctatatcctttatgttcgagactcgcgatacatttacccagggcgactatcagcatttatctaaatgtgca

SEQ ID NO: 304302 - DNA, 75 bp, Artificial Sequence
  Synthetic
cgatctttcctgaaacatcattcgtgaataaaccaaatgtagactggaatattcagagtctactcacttcaagta

SEQ ID NO: 304303 - DNA, 75 bp, Artificial Sequence
  Synthetic
tagcgattttggtgtccgcatttgctgcgaaagtctgatccggcgtcagcttccaaagggagtgcttcgagaggt

SEQ ID NO: 304304 - DNA, 75 bp, Artificial Sequence
  Synthetic
acgcctcaagcatggatctgattgaaacagtaaatgcatgcatcaagttgcaaaaaagagttttgagtttagcac

SEQ ID NO: 304305 - DNA, 75 bp, Artificial Sequence
  Synthetic
aacagtaaatgcatgcatcaagttgcaaaaaagagttttgagtttagcaccaaatacgaatttgaatacattcgg

SEQ ID NO: 304306 - DNA, 75 bp, Artificial Sequence
  Synthetic
caaaaaagagttttgagtttagcaccaaatacgaatttgaatacattcggtcaaagcactctgaatgattacaac

SEQ ID NO: 304307 - DNA, 75 bp, Artificial Sequence
  Synthetic
aaacatatgctatgctcgatcaaacggcagttctaactccctttactatcaatgccccaatcatttctctttcag

SEQ ID NO: 304308 - DNA, 75 bp, Artificial Sequence
  Synthetic
ggcagttctaactccctttactatcaatgccccaatcatttctctttcagttcgtatctctacagatgattatga

SEQ ID NO: 304309 - DNA, 75 bp, Artificial Sequence
  Synthetic
atcttagacgtgttagctgctgctattagatcagaaggatctagacctgtgagagcgatagaaaggcgcgttctt

SEQ ID NO: 304310 - DNA, 75 bp, Artificial Sequence
  Synthetic
ttagatcagaaggatctagacctgtgagagcgatagaaaggcgcgttcttgatccggctgtcaaacaactggtag

SEQ ID NO: 304311 - DNA, 75 bp, Artificial Sequence
  Synthetic
ttctgaaatctctattgcaaacctagctgccgtggatactgccataattcaaccagaaatcattcagactgaaaa

SEQ ID NO: 304312 - DNA, 75 bp, Artificial Sequence
  Synthetic
gctgccgtggatactgccataattcaaccagaaatcattcagactgaaaatccattatatgctgatattattgag

SEQ ID NO: 304313 - DNA, 75 bp, Artificial Sequence
  Synthetic
atatgactggcggaaatattagggcaactttaggaagatggtcaggcaacaaaggagtagttacatgtatgtcag

SEQ ID NO: 304314 - DNA, 75 bp, Artificial Sequence
  Synthetic
aactttaggaagatggtcaggcaacaaaggagtagttacatgtatgtcaggaatggattcagaacacagattcac

SEQ ID NO: 304315 - DNA, 75 bp, Artificial Sequence
  Synthetic
ggaataattaatattgtttatgtaccaacagcaggaactatactgataccaatgccaaacgcacggaatagggaa

SEQ ID NO: 304316 - DNA, 75 bp, Artificial Sequence
  Synthetic
caacagcaggaactatactgataccaatgccaaacgcacggaatagggaaggtaaattgatcgacgtttcagcag

SEQ ID NO: 304317 - DNA, 75 bp, Artificial Sequence
  Synthetic
tgattttatggatggtgatgccatagttcaaacagaaacgggagttggagtatattccttcccaatgtgcgatcg

SEQ ID NO: 304318 - DNA, 75 bp, Artificial Sequence
  Synthetic
gttcaaacagaaacgggagttggagtatattccttcccaatgtgcgatcgtttcagattcagaatctctccatgg

SEQ ID NO: 304319 - DNA, 75 bp, Artificial Sequence
  Synthetic
ttggtacagttcatatgacgaactgggcacagggaacagccgctaggcaaccagctatatcttttatgtttgaga

SEQ ID NO: 304320 - DNA, 75 bp, Artificial Sequence
  Synthetic
ggcacagggaacagccgctaggcaaccagctatatcttttatgtttgagactcgtgacacgtttactcaagggga

SEQ ID NO: 304321 - DNA, 75 bp, Artificial Sequence
  Synthetic
cccaaatcacaatacatgttagacacaattttccctgaaacatcatttataaataaaccaaatgttgactggaac

SEQ ID NO: 304322 - DNA, 75 bp, Artificial Sequence
  Synthetic
caattttccctgaaacatcatttataaataaaccaaatgttgactggaacattcagagtctactcacttcaacaa

SEQ ID NO: 304323 - DNA, 75 bp, Artificial Sequence
  Synthetic
tagcaattctggtgtctgcatatgctgcgaaagtctgatccggcgtcagcttccaaaggaagtgcttcgagaggt

SEQ ID NO: 304324 - DNA, 75 bp, Artificial Sequence
  Synthetic
gtgctttgagcatggatctgattgagactgtcaacgcttgcattaagttgcaacaacgcattttgagtttagctc

SEQ ID NO: 304325 - DNA, 75 bp, Artificial Sequence
  Synthetic
gactgtcaacgcttgcattaagttgcaacaacgcattttgagtttagctccaaacactaatttaaatacttcagg

SEQ ID NO: 304326 - DNA, 75 bp, Artificial Sequence
  Synthetic
caacaacgcattttgagtttagctccaaacactaatttaaatacttcaggtcagagtgttctaaatgactacaat

SEQ ID NO: 304327 - DNA, 75 bp, Artificial Sequence
  Synthetic
aaacttatcctttacttgatcagactgcgatatacaccccatatactataaatgcgccagtcatatcactagcag

SEQ ID NO: 304328 - DNA, 75 bp, Artificial Sequence
  Synthetic
aatgcgccagtcatatcactagcagttagaattacaacagatgatttcgatgatatgcggcaagggatggattca

SEQ ID NO: 304329 - DNA, 75 bp, Artificial Sequence
  Synthetic
ttagaattacaacagatgatttcgatgatatgcggcaagggatggattcaatacttgatgtattggctgctgcta

SEQ ID NO: 304330 - DNA, 75 bp, Artificial Sequence
  Synthetic
tcgtgtaattgaacgtagagtgatcgagccgaatgtaagacaactggttgaagacataaaactgaaaagtctcac

SEQ ID NO: 304331 - DNA, 75 bp, Artificial Sequence
  Synthetic
gagccgaatgtaagacaactggttgaagacataaaactgaaaagtctcacgtctaacatctccattgctaacatg

SEQ ID NO: 304332 - DNA, 75 bp, Artificial Sequence
  Synthetic
aaccagaaataattgagacagaaaacccattactagctgatataattgaacgagtcacgaacagaccgaatatgt

SEQ ID NO: 304333 - DNA, 75 bp, Artificial Sequence
  Synthetic
aaaggagtgataacatgtatgtcaggaatggactttgaacatagatttacgattgatttcaaagcaagaacaaca

SEQ ID NO: 304334 - DNA, 75 bp, Artificial Sequence
  Synthetic
aatgccaactggaggtaatagagaaggaaaactaattgatgtttctgcagaaatgatggctgaggatttcgctat

SEQ ID NO: 304335 - DNA, 75 bp, Artificial Sequence
  Synthetic
agattttatggatgataataacatcatacagactgaaacaggagtaggtgtctattcgtttccaatgtgtaacaa

SEQ ID NO: 304336 - DNA, 75 bp, Artificial Sequence
  Synthetic
tctattcgtttccaatgtgtaacaaaattagattcagaatttctccttggactgttcagaaagaaaatgatggtc

SEQ ID NO: 304337 - DNA, 75 bp, Artificial Sequence
  Synthetic
actgttcagaaagaaaatgatggtcttggaacagctcacatgatgaactggtcacaaggaagagccgcaaaacaa

SEQ ID NO: 304338 - DNA, 75 bp, Artificial Sequence
  Synthetic
ttggaacagctcacatgatgaactggtcacaaggaagagccgcaaaacaaccggcaatagccttcatgtttgaaa

SEQ ID NO: 304339 - DNA, 75 bp, Artificial Sequence
  Synthetic
ctatcaacacttatcgagatgcacgccaagagctcaatatatgttggatactgttttttcagaagtgtcattcac

SEQ ID NO: 304340 - DNA, 75 bp, Artificial Sequence
  Synthetic
ccaagagctcaatatatgttggatactgttttttcagaagtgtcattcactaataaacccaatgttgattggaac

SEQ ID NO: 304341 - DNA, 75 bp, Artificial Sequence
  Synthetic
attgcactgttagtgtctgcgttctcagcgaagatctgattctgcactggctcctgaaaggagtgctccagaagt

SEQ ID NO: 304342 - DNA, 75 bp, Artificial Sequence
  Synthetic
acgcttcaagcatggatctgattgaaacagtgaatgcgtgcgtcgcattgcaaaaaagaatatatgatctagcac

SEQ ID NO: 304343 - DNA, 75 bp, Artificial Sequence
  Synthetic
aacagtgaatgcgtgcgtcgcattgcaaaaaagaatatatgatctagcaccaaatactaatcttaacacagcagg

SEQ ID NO: 304344 - DNA, 75 bp, Artificial Sequence
  Synthetic
caaaaaagaatatatgatctagcaccaaatactaatcttaacacagcaggacaaagtacactcaatgattataac

SEQ ID NO: 304345 - DNA, 75 bp, Artificial Sequence
  Synthetic
gaacataccccctgctcgatttgactgcagtgttaactccactaaccgttcatgctccagttatctcactatcag

SEQ ID NO: 304346 - DNA, 75 bp, Artificial Sequence
  Synthetic
tgcagtgttaactccactaaccgttcatgctccagttatctcactatcagtacgcatttcaactgatgactatga

SEQ ID NO: 304347 - DNA, 75 bp, Artificial Sequence
  Synthetic
gtacttgacgtgttggcggcagcaattaggaccgaaggctcaagaccagtacgcgtaatcgaaagacgcgttctt

SEQ ID NO: 304348 - DNA, 75 bp, Artificial Sequence
  Synthetic
ttaggaccgaaggctcaagaccagtacgcgtaatcgaaagacgcgttcttgatccagccgtcaaacaattggttg

SEQ ID NO: 304349 - DNA, 75 bp, Artificial Sequence
  Synthetic
atcagaaatatctttagcaaacttagccgccgtggacactgctatgattcaacctgaaataatcgaaactgaaaa

SEQ ID NO: 304350 - DNA, 75 bp, Artificial Sequence
  Synthetic
gccgccgtggacactgctatgattcaacctgaaataatcgaaactgaaaatccattgttcgctgacgttattgaa

SEQ ID NO: 304351 - DNA, 75 bp, Artificial Sequence
  Synthetic
atatgactggtggaaatattagagccactctaggtagatggtcaggtaataaaggcgtgattacctgtatgtcgg

SEQ ID NO: 304352 - DNA, 75 bp, Artificial Sequence
  Synthetic
cactctaggtagatggtcaggtaataaaggcgtgattacctgtatgtcgggtatggactcagagcatagattcac

SEQ ID NO: 304353 - DNA, 75 bp, Artificial Sequence
  Synthetic
ggtgtattaaacattgtctacgtaccaacggctggtacaatactcattccaatgccaaatggaagaaacagagaa

SEQ ID NO: 304354 - DNA, 75 bp, Artificial Sequence
  Synthetic
caacggctggtacaatactcattccaatgccaaatggaagaaacagagaagggaaactcattgatgtttcagccg

SEQ ID NO: 304355 - DNA, 75 bp, Artificial Sequence
  Synthetic
cgattttatggaagacgatgctataatacagaccgaaactggagtcggtgtcttttcttttccaatgtgcaatag

SEQ ID NO: 304356 - DNA, 75 bp, Artificial Sequence
  Synthetic
atacagaccgaaactggagtcggtgtcttttcttttccaatgtgcaataggatgagatttagaataaatccatgg

SEQ ID NO: 304357 - DNA, 75 bp, Artificial Sequence
  Synthetic
taggaacggtacacatggcaaattgggctcaggggactgcgacaagacagccagccgtgtcatttctattcgaaa

SEQ ID NO: 304358 - DNA, 75 bp, Artificial Sequence
  Synthetic
ttatcaacatctatcgaggtgtacccctaaggcacaacatatgctggacacagtgtttccggaatcgtcatttat

SEQ ID NO: 304359 - DNA, 75 bp, Artificial Sequence
  Synthetic
cctaaggcacaacatatgctggacacagtgtttccggaatcgtcatttataaataaacctcctgcggaatggaac

SEQ ID NO: 304360 - DNA, 75 bp, Artificial Sequence
  Synthetic
ctcagaaagtgtggggacagaagatagcgatgttagtgtccgcatttgctgctaaagtctgatccggcgtcagct

SEQ ID NO: 304361 - DNA, 75 bp, Artificial Sequence
  Synthetic
tagcgatgttagtgtccgcatttgctgctaaagtctgatccggcgtcagctcccaaagggagtgcttcgagaggt

SEQ ID NO: 304362 - DNA, 75 bp, Artificial Sequence
  Synthetic
ttagaattacaacagatgatttcgatgatatgcggcaaggaatggattcaatacttgatgtattggctgctgcca

SEQ ID NO: 304363 - DNA, 75 bp, Artificial Sequence
  Synthetic
tactttgggtagatggtctggaaataaaggagtgataacatgtatgtcaggaatggactttgaacatagatttac

SEQ ID NO: 304364 - DNA, 75 bp, Artificial Sequence
  Synthetic
ttggaacagctcacatgatgaactggtcacaaggaagagccgcaaaacaaccggctatagctttcatgtttgaaa

SEQ ID NO: 304365 - DNA, 75 bp, Artificial Sequence
  Synthetic
attgcaatgttagtgtctgcgttctcagcaaagatctgattctgcactggctcctgaaaggagtgctctagaagt

SEQ ID NO: 304366 - DNA, 75 bp, Artificial Sequence
  Synthetic
atgggaagtaggcagtccagcttgcaatcgcagacacatcgcactgacattaactcacatcattcaaacatctat

SEQ ID NO: 304367 - DNA, 75 bp, Artificial Sequence
  Synthetic
aatcgcagacacatcgcactgacattaactcacatcattcaaacatctatcttcagagtgcatcatttgccgaat

SEQ ID NO: 304368 - DNA, 75 bp, Artificial Sequence
  Synthetic
taactcacatcattcaaacatctatcttcagagtgcatcatttgccgaattcaagacttatcatttactgatcac

SEQ ID NO: 304369 - DNA, 75 bp, Artificial Sequence
  Synthetic
cttcttgcttttcttatttcaagtttagtgtgtaattgctatttactacgaagactgaaaaatggacctcgtaaa

SEQ ID NO: 304370 - DNA, 75 bp, Artificial Sequence
  Synthetic
tagtgtgtaattgctatttactacgaagactgaaaaatggacctcgtaaaatttatcgcacaagccaagtacaag

SEQ ID NO: 304371 - DNA, 75 bp, Artificial Sequence
  Synthetic
acaattcattcaatccgacaactttgtctaaaaaaccttcaaaattagaacttattaaacacagaaatccattcc

SEQ ID NO: 304372 - DNA, 75 bp, Artificial Sequence
  Synthetic
gtctaaaaaaccttcaaaattagaacttattaaacacagaaatccattccatgaagtacctcaactcgctggaga

SEQ ID NO: 304373 - DNA, 75 bp, Artificial Sequence
  Synthetic
ccttataatcacgagcatttctgtggaggtatgcacgttccaaaacagtttaatctagcaccaaaaggaaggatt

SEQ ID NO: 304374 - DNA, 75 bp, Artificial Sequence
  Synthetic
gaggtatgcacgttccaaaacagtttaatctagcaccaaaaggaaggattagctgcatcacaagcgataaaattg

SEQ ID NO: 304375 - DNA, 75 bp, Artificial Sequence
  Synthetic
gatcattgatggtaaagagtacactggttctgcgtttgttaaatgcagatgtggacaaccatatccaacaatcat

SEQ ID NO: 304376 - DNA, 75 bp, Artificial Sequence
  Synthetic
ggttctgcgtttgttaaatgcagatgtggacaaccatatccaacaatcatcgaccaaaactcgatttttttcttc

SEQ ID NO: 304377 - DNA, 75 bp, Artificial Sequence
  Synthetic
aatcagtgaaacttggattaagtgaaaaaattaattgtctgaattgcaacagaagtgtgcgttggtttagtccag

SEQ ID NO: 304378 - DNA, 75 bp, Artificial Sequence
  Synthetic
aaaaattaattgtctgaattgcaacagaagtgtgcgttggtttagtccaggaagaggcatacgtaccacgcatca

SEQ ID NO: 304379 - DNA, 75 bp, Artificial Sequence
  Synthetic
ccagcatgcatgccatttcgcgatatggtcgctttaatgtccttactaaataaagtggaattccttggagctgat

SEQ ID NO: 304380 - DNA, 75 bp, Artificial Sequence
  Synthetic
tggtcgctttaatgtccttactaaataaagtggaattccttggagctgatttcagtcaaatgcgtactgattttg

SEQ ID NO: 304381 - DNA, 75 bp, Artificial Sequence
  Synthetic
ttgtgaatcagccttcagatcattcaattctccacaactggcaagtagaattgcaccgcataagagaatagatcc

SEQ ID NO: 304382 - DNA, 75 bp, Artificial Sequence
  Synthetic
aattctccacaactggcaagtagaattgcaccgcataagagaatagatccaaaccatactctgaacaccgttacc

SEQ ID NO: 304383 - DNA, 75 bp, Artificial Sequence
  Synthetic
ggcagcataacaagatagaggttacaccaatatgtagagggaaagtcgcaattagtgacgggtatagacgatgta

SEQ ID NO: 304384 - DNA, 75 bp, Artificial Sequence
  Synthetic
ttctagaatttcaagataatgctgaattttactgttcagttaatttgctattgttgcgctggaagcttatctgaa

SEQ ID NO: 304385 - DNA, 75 bp, Artificial Sequence
  Synthetic
acgcttcaagcatggatctgattgaaacagtaaacgcatgcgttgcgttgcaaagaagaatatatgacttagcac

SEQ ID NO: 304386 - DNA, 75 bp, Artificial Sequence
  Synthetic
aacagtaaacgcatgcgttgcgttgcaaagaagaatatatgacttagcaccgaataccaatcttaatacagcggg

SEQ ID NO: 304387 - DNA, 75 bp, Artificial Sequence
  Synthetic
caaagaagaatatatgacttagcaccgaataccaatcttaatacagcggggcaaagcactctcaatgattacaac

SEQ ID NO: 304388 - DNA, 75 bp, Artificial Sequence
  Synthetic
ggacgtatcctctgcatgatctgacagcagtactaactccaataactattcacgctccaatcatttcactctcag

SEQ ID NO: 304389 - DNA, 75 bp, Artificial Sequence
  Synthetic
agcagtactaactccaataactattcacgctccaatcatttcactctcagtacgtatctctactgatgactatga

SEQ ID NO: 304390 - DNA, 75 bp, Artificial Sequence
  Synthetic
gtacttgacgtgctagcagcagcaatcagaaccgaaggctcgagaccagtgcgcgtaattgagagacgtgttctt

SEQ ID NO: 304391 - DNA, 75 bp, Artificial Sequence
  Synthetic
tcagaaccgaaggctcgagaccagtgcgcgtaattgagagacgtgttcttgatccagttgtcagacaattgatcg

SEQ ID NO: 304392 - DNA, 75 bp, Artificial Sequence
  Synthetic
gtcagaaatatctctagcaaacctagctgccgtggacactgccatgattcaacctgaattaattgagactgaaaa

SEQ ID NO: 304393 - DNA, 75 bp, Artificial Sequence
  Synthetic
gctgccgtggacactgccatgattcaacctgaattaattgagactgaaaatccactatttgccgacattattgaa

SEQ ID NO: 304394 - DNA, 75 bp, Artificial Sequence
  Synthetic
atatgactggtggaaatatcagggctactctaggtagatggtcaggtaacaaaggcgtaatcacttgtatgtcag

SEQ ID NO: 304395 - DNA, 75 bp, Artificial Sequence
  Synthetic
tactctaggtagatggtcaggtaacaaaggcgtaatcacttgtatgtcaggcatggattcagaacatagattcac

SEQ ID NO: 304396 - DNA, 75 bp, Artificial Sequence
  Synthetic
ggcgtgctgaacattgtctacgtaccagcagctggcacaatactcattccaatgccaaatggaagaaccagagaa

SEQ ID NO: 304397 - DNA, 75 bp, Artificial Sequence
  Synthetic
cagcagctggcacaatactcattccaatgccaaatggaagaaccagagaagggaaacttattgatgtttcggctg

SEQ ID NO: 304398 - DNA, 75 bp, Artificial Sequence
  Synthetic
tgatttcatggaggacgatgctataatacagaccgaaaccggagtcggtgtttactcttttccaatgtgtaacag

SEQ ID NO: 304399 - DNA, 75 bp, Artificial Sequence
  Synthetic
atacagaccgaaaccggagtcggtgtttactcttttccaatgtgtaacagaataaggtttagaataaatccatgg

SEQ ID NO: 304400 - DNA, 75 bp, Artificial Sequence
  Synthetic
tgggaacggtacatatgacaaattgggctcagggaaatgcaacaagacaaccggctgtgtcattcctctttgaaa

SEQ ID NO: 304401 - DNA, 75 bp, Artificial Sequence
  Synthetic
ctaccaacatttgtcgaggtgtactcctaaagcgcagtatatgttagacaccacgtttccagaatcatcgtttat

SEQ ID NO: 304402 - DNA, 75 bp, Artificial Sequence
  Synthetic
cctaaagcgcagtatatgttagacaccacgtttccagaatcatcgtttataaataagcccccaacagaatggaac

SEQ ID NO: 304403 - DNA, 75 bp, Artificial Sequence
  Synthetic
caatcaaaaagtgtggggacaaaagatagcaatgctagtgtccgcgtttgctgctaaagtctgatccggcgtcag

SEQ ID NO: 304404 - DNA, 75 bp, Artificial Sequence
  Synthetic
atgggaagtaggcaatccagcttgcagtctcaatcacaccgtattgacatacagtcacatcattcaaatatccat

SEQ ID NO: 304405 - DNA, 75 bp, Artificial Sequence
  Synthetic
agtctcaatcacaccgtattgacatacagtcacatcattcaaatatccatctaaacagtaatacgttagcagact

SEQ ID NO: 304406 - DNA, 75 bp, Artificial Sequence
  Synthetic
acagtcacatcattcaaatatccatctaaacagtaatacgttagcagacttcaaaacacatcacatcttagttgc

SEQ ID NO: 304407 - DNA, 75 bp, Artificial Sequence
  Synthetic
ttgcttgcattccttatttcatctttaatctgcaattgctatttgattcgtagactcagacatggacctaaaagg

SEQ ID NO: 304408 - DNA, 75 bp, Artificial Sequence
  Synthetic
taatctgcaattgctatttgattcgtagactcagacatggacctaaaaggttttatcgaacaagccaagctcaag

SEQ ID NO: 304409 - DNA, 75 bp, Artificial Sequence
  Synthetic
acaacccattcgatccaactacactgtctaaaaaaccacttaaattggcattagtcaagtacgaaaacccattac

SEQ ID NO: 304410 - DNA, 75 bp, Artificial Sequence
  Synthetic
gtctaaaaaaccacttaaattggcattagtcaagtacgaaaacccattacgcgaagttccacatttagctggtga

SEQ ID NO: 304411 - DNA, 75 bp, Artificial Sequence
  Synthetic
ccactcaatcatgagcatttctgtggtgccatccatgttccgaagcaaagcaatatgagaccgagaggcaggatt

SEQ ID NO: 304412 - DNA, 75 bp, Artificial Sequence
  Synthetic
gtgccatccatgttccgaagcaaagcaatatgagaccgagaggcaggattacacatatcacagctgataagatag

SEQ ID NO: 304413 - DNA, 75 bp, Artificial Sequence
  Synthetic
tctaattgatggaagaataattaccggctcagctttcgccaaatgtagatgcggacaaccatatccaacagtgat

SEQ ID NO: 304414 - DNA, 75 bp, Artificial Sequence
  Synthetic
ggctcagctttcgccaaatgtagatgcggacaaccatatccaacagtgatagatcaaccctctgagtttttcttt

SEQ ID NO: 304415 - DNA, 75 bp, Artificial Sequence
  Synthetic
aggctattaagttgggactttgtgaaaagttcaactgtctaaactgtcagagacccgttcgttggttcacaccag

SEQ ID NO: 304416 - DNA, 75 bp, Artificial Sequence
  Synthetic
aaagttcaactgtctaaactgtcagagacccgttcgttggttcacaccaggacgaggcctattgactaaaatcca

SEQ ID NO: 304417 - DNA, 75 bp, Artificial Sequence
  Synthetic
ccatcatgtatgccctttagagacttgcttgccacaatgtctctactgaataaagttgaattccttggtgctaac

SEQ ID NO: 304418 - DNA, 75 bp, Artificial Sequence
  Synthetic
tgcttgccacaatgtctctactgaataaagttgaattccttggtgctaactttgaacagatgaaaattgatttta

SEQ ID NO: 304419 - DNA, 75 bp, Artificial Sequence
  Synthetic
ctgtgaatccgcatttagatctcttaactccccacaaatagcccatagagttacaacctaccaaagactggaccc

SEQ ID NO: 304420 - DNA, 75 bp, Artificial Sequence
  Synthetic
aactccccacaaatagcccatagagttacaacctaccaaagactggacccaacatacacacttaatacaatgacg

SEQ ID NO: 304421 - DNA, 75 bp, Artificial Sequence
  Synthetic
cacagttaaacaaaatagaaatcacaccgatctgtagaggcaaagttgcagtttcagatggatacagaagatgtt

SEQ ID NO: 304422 - DNA, 75 bp, Artificial Sequence
  Synthetic
taatggagttcactgacaatgctgatttgcactgttctataaatatgttgttactgcgctggaagctcatctgaa

SEQ ID NO: 304423 - DNA, 75 bp, Artificial Sequence
  Synthetic
acgcttcaagcatggatctgattgaaacagtcaatgcatgcatcaagctgcaaaagagagttttaagtttagcac

SEQ ID NO: 304424 - DNA, 75 bp, Artificial Sequence
  Synthetic
aacagtcaatgcatgcatcaagctgcaaaagagagttttaagtttagcacccaacacgaatttaaatacatccgg

SEQ ID NO: 304425 - DNA, 75 bp, Artificial Sequence
  Synthetic
gctttggcatcaaggtgcaatggaagaacatacgcgttgcttgatcaaactgcagttcttacccctttcaccatc

SEQ ID NO: 304426 - DNA, 75 bp, Artificial Sequence
  Synthetic
gaacatacgcgttgcttgatcaaactgcagttcttacccctttcaccatcaacgctccaatcatttctctttcag

SEQ ID NO: 304427 - DNA, 75 bp, Artificial Sequence
  Synthetic
cgacatgaagtctggaatggattctattttagatgtaatagccgctgctattagaacagaaggatctaggcctgt

SEQ ID NO: 304428 - DNA, 75 bp, Artificial Sequence
  Synthetic
attttagatgtaatagccgctgctattagaacagaaggatctaggcctgtaagggcgatagagagacgcgtcctt

SEQ ID NO: 304429 - DNA, 75 bp, Artificial Sequence
  Synthetic
aagatctaaaactgaaaagtcttacttctgacatctccattgctaacttagctgctgtagacactgccacaattc

SEQ ID NO: 304430 - DNA, 75 bp, Artificial Sequence
  Synthetic
ttctgacatctccattgctaacttagctgctgtagacactgccacaattcaaccagaaattatccaaaccgaaaa

SEQ ID NO: 304431 - DNA, 75 bp, Artificial Sequence
  Synthetic
caagttgtaaataggccacaaatgaatatgactggcggaaatattagagccactttgggaagatggtctggcaac

SEQ ID NO: 304432 - DNA, 75 bp, Artificial Sequence
  Synthetic
gaatggattctgaacataggtttactgttgacctcaaagccagaaccaccggaataatcaatattgtatacgtgc

SEQ ID NO: 304433 - DNA, 75 bp, Artificial Sequence
  Synthetic
aatgccaaacgcaagaaatagggaaggtaaattaattgacgtttctgcagaaatgatggctgaaaactttgctat

SEQ ID NO: 304434 - DNA, 75 bp, Artificial Sequence
  Synthetic
gttcaaactgaaacaggagttggagtctattcctttccaatgtgcaatcgtttcagattcaggatttctccatgg

SEQ ID NO: 304435 - DNA, 75 bp, Artificial Sequence
  Synthetic
tttcagattcaggatttctccatgggacatgcaaaaagatcaagaaggtcttggcacagttcatatgacaaattg

SEQ ID NO: 304436 - DNA, 75 bp, Artificial Sequence
  Synthetic
ggcacaggggacagccgctaggcaaccagctatctccttcatgttcgaaactcgcgacactttcacccaaggtga

SEQ ID NO: 304437 - DNA, 75 bp, Artificial Sequence
  Synthetic
ccagctatctccttcatgttcgaaactcgcgacactttcacccaaggtgattaccaacatttatctaaatgcgca

SEQ ID NO: 304438 - DNA, 75 bp, Artificial Sequence
  Synthetic
caattttccctgaaacgtcgtttgtaaacaagccaaatgtagactggaacattcagagtttacttacttcaactg

SEQ ID NO: 304439 - DNA, 75 bp, Artificial Sequence
  Synthetic
ttgcaattctggtgtctgcatatgctgctaaagtctgatccggcgtcagcttccagaggaagtgcttcgagaggt

SEQ ID NO: 304440 - DNA, 75 bp, Artificial Sequence
  Synthetic
atgggaagtaggcagtccagctggcaatcacagacgcatcgtaccgacattaattcacataattcaaatattttt

SEQ ID NO: 304441 - DNA, 75 bp, Artificial Sequence
  Synthetic
aatcacagacgcatcgtaccgacattaattcacataattcaaatatttttctccagagtgcatctgctgctgaat

SEQ ID NO: 304442 - DNA, 75 bp, Artificial Sequence
  Synthetic
taattcacataattcaaatatttttctccagagtgcatctgctgctgaatttaaaactcaacatatactgattac

SEQ ID NO: 304443 - DNA, 75 bp, Artificial Sequence
  Synthetic
ttactcgctttcctcatttcaagtttagtgtgtaactgttacctgttacgaagactgagaaatggatctcgtaag

SEQ ID NO: 304444 - DNA, 75 bp, Artificial Sequence
  Synthetic
tagtgtgtaactgttacctgttacgaagactgagaaatggatctcgtaagatttatcgcacaggcaaagcacaag

SEQ ID NO: 304445 - DNA, 75 bp, Artificial Sequence
  Synthetic
acaattcattcaacccgaccactttgtctaaaaaaccattaaaattagaactcatcaaatacaacaatccatttc

SEQ ID NO: 304446 - DNA, 75 bp, Artificial Sequence
  Synthetic
gtctaaaaaaccattaaaattagaactcatcaaatacaacaatccatttcgtgaggtacctcaacttgcggggga

SEQ ID NO: 304447 - DNA, 75 bp, Artificial Sequence
  Synthetic
ccttacaatcatgagcatttctgtggcggcatacacattcccaagcaattcaacatgtcaccaagaggaagaatt

SEQ ID NO: 304448 - DNA, 75 bp, Artificial Sequence
  Synthetic
gcggcatacacattcccaagcaattcaacatgtcaccaagaggaagaatttgtcatatcacaagtgacaagattg

SEQ ID NO: 304449 - DNA, 75 bp, Artificial Sequence
  Synthetic
tattattgatggaaggaaatacactggttcagcattcgttaaatgtaggtgtgggcaaccatatccaacaatcat

SEQ ID NO: 304450 - DNA, 75 bp, Artificial Sequence
  Synthetic
ggttcagcattcgttaaatgtaggtgtgggcaaccatatccaacaatcattgagcaatcatcaactttctttttt

SEQ ID NO: 304451 - DNA, 75 bp, Artificial Sequence
  Synthetic
agtcagttaaaattggattaagtgaaaagttcaattgtttgaattgtaataggagcgtgcgctggtttagccctg

SEQ ID NO: 304452 - DNA, 75 bp, Artificial Sequence
  Synthetic
aaagttcaattgtttgaattgtaataggagcgtgcgctggtttagccctggaagaggactaagaactacgcatca

SEQ ID NO: 304453 - DNA, 75 bp, Artificial Sequence
  Synthetic
ccagcatgcatgccataccgcgatatagtcgcttcgatgtctttactgaataaagtagagtttcttggcgccgat

SEQ ID NO: 304454 - DNA, 75 bp, Artificial Sequence
  Synthetic
tagtcgcttcgatgtctttactgaataaagtagagtttcttggcgccgatttcagtcaaatgcgcgctgactttg

SEQ ID NO: 304455 - DNA, 75 bp, Artificial Sequence
  Synthetic
ctgtgaatctgctttcagatcattcaactctccacagttagcacatagagtcgcgccatatgaaagaattagttc

SEQ ID NO: 304456 - DNA, 75 bp, Artificial Sequence
  Synthetic
aactctccacagttagcacatagagtcgcgccatatgaaagaattagttcaaatctcactttaaataccattact

SEQ ID NO: 304457 - DNA, 75 bp, Artificial Sequence
  Synthetic
gacagcataataaaatagagattacaccaatatgcagaggaaaagtcgcagttagtgacggatacagacgatgca

SEQ ID NO: 304458 - DNA, 75 bp, Artificial Sequence
  Synthetic
ttctcgattttcaagataatgccgagttgcactgttcggttaatatgttattgcttcgctggaagcttatctgaa

SEQ ID NO: 304459 - DNA, 75 bp, Artificial Sequence
  Synthetic
gtgcttcaagcatggatctgattgagacggtgaatgcatgcattagattgcagaagagaatactgaacttagctc

SEQ ID NO: 304460 - DNA, 75 bp, Artificial Sequence
  Synthetic
gacggtgaatgcatgcattagattgcagaagagaatactgaacttagctccaaacacaaatttaaatacagcggg

SEQ ID NO: 304461 - DNA, 75 bp, Artificial Sequence
  Synthetic
acagagtactctgaatgattacaatgcaatcgcatcaagatgtacaggaaaaacgtatgcattgcttgatcaaac

SEQ ID NO: 304462 - DNA, 75 bp, Artificial Sequence
  Synthetic
tcagaacggaggggtctagatatgttagagttattgaaagacgcgtagttgatccaacagttagacagctgatcg

SEQ ID NO: 304463 - DNA, 75 bp, Artificial Sequence
  Synthetic
tagagttattgaaagacgcgtagttgatccaacagttagacagctgatcgaagatttgaaattaaaaagccttac

SEQ ID NO: 304464 - DNA, 75 bp, Artificial Sequence
  Synthetic
gctgccgtagacacggcactcattcaaccagaggtaatagaaacagaaaatccactatatgctgatgttattgag

SEQ ID NO: 304465 - DNA, 75 bp, Artificial Sequence
  Synthetic
tccactatatgctgatgttattgagcaagtgacgcataggccacagatgaatatgacagggggtaacattagagc

SEQ ID NO: 304466 - DNA, 75 bp, Artificial Sequence
  Synthetic
aaaggagtggttacatgtatgtcaggcatggattcagagcatagattcactgttgatctaaagacaaggacgact

SEQ ID NO: 304467 - DNA, 75 bp, Artificial Sequence
  Synthetic
tgttgatctaaagacaaggacgactggagttataaatgttgtgtataccccaaccgcgggtacaatactaatacc

SEQ ID NO: 304468 - DNA, 75 bp, Artificial Sequence
  Synthetic
ggagttataaatgttgtgtataccccaaccgcgggtacaatactaataccaatgccaaatgggagaaatagagaa

SEQ ID NO: 304469 - DNA, 75 bp, Artificial Sequence
  Synthetic
agatgatggcagatgattttgctatcgattttatggatgacgatgctatagttcaaactgaaactggagttggag

SEQ ID NO: 304470 - DNA, 75 bp, Artificial Sequence
  Synthetic
attcagattcagaatttccccttggaatatgcagaaagatcaagacggtctaggaacagtgcacatgactaactg

SEQ ID NO: 304471 - DNA, 75 bp, Artificial Sequence
  Synthetic
ccagctatttcttttatgtttgagactcgcagaactttcaccgaaagtgattatcaacatttgtccagatgcaca

SEQ ID NO: 304472 - DNA, 75 bp, Artificial Sequence
  Synthetic
cagtctttccagagacttcattcgttaacaaacccaacgtcgactggaacattcagagtttattaacgtctaaca

SEQ ID NO: 304473 - DNA, 75 bp, Artificial Sequence
  Synthetic
cgcaaaaagtgtggtgtcaaaaaatagcaatgctagtgtcttcatacgctgccaaaatctgatccggcgtcagct

SEQ ID NO: 304474 - DNA, 75 bp, Artificial Sequence
  Synthetic
tagcaatgctagtgtcttcatacgctgccaaaatctgatccggcgtcagcttccaaaggaagtgcttcgagaggt

SEQ ID NO: 304475 - DNA, 75 bp, Artificial Sequence
  Synthetic
acgcttcaagcatggatctgattgaaacagtgaatgcgtgcgttgcattgcaaaaaagaatatatgatctagcgc

SEQ ID NO: 304476 - DNA, 75 bp, Artificial Sequence
  Synthetic
acaaagtactctcaatgattacaatgcgttagcatcaagaattaatggaagaacgtaccccctacttgatttgac

SEQ ID NO: 304477 - DNA, 75 bp, Artificial Sequence
  Synthetic
gcgttagcatcaagaattaatggaagaacgtaccccctacttgatttgactgcagtgttaactccactaactgtt

SEQ ID NO: 304478 - DNA, 75 bp, Artificial Sequence
  Synthetic
tacgcatttcaactgacgactatgacgacatgagatcaggcattaattctgtacttgacgtgttggcagctgcaa

SEQ ID NO: 304479 - DNA, 75 bp, Artificial Sequence
  Synthetic
gtacttgacgtgttggcagctgcaattagaaccgaaggttcaaggccagtacgcgtaattgaaagacgcgtcctt

SEQ ID NO: 304480 - DNA, 75 bp, Artificial Sequence
  Synthetic
aggatcttaaactaaaaagcttaatatcagaaatatccttagcaaatctagctgccgtagacactgccatgattc

SEQ ID NO: 304481 - DNA, 75 bp, Artificial Sequence
  Synthetic
atcagaaatatccttagcaaatctagctgccgtagacactgccatgattcaacctgaagtaattgaaactgaaaa

SEQ ID NO: 304482 - DNA, 75 bp, Artificial Sequence
  Synthetic
caggtggtccacagaccaaatatgaacatgactggtggaaatattagagctactctaggcagatggtcaggtaat

SEQ ID NO: 304483 - DNA, 75 bp, Artificial Sequence
  Synthetic
acatgactggtggaaatattagagctactctaggcagatggtcaggtaataaaggcgtgattacctgcatgtcgg

SEQ ID NO: 304484 - DNA, 75 bp, Artificial Sequence
  Synthetic
gattaatttcaaggcaaagacaacaggtgtattaaacattgtctacgtaccaacggctggtacaatactcgttcc

SEQ ID NO: 304485 - DNA, 75 bp, Artificial Sequence
  Synthetic
ggtgtattaaacattgtctacgtaccaacggctggtacaatactcgttccaatgccgaatggaagaaacagagaa

SEQ ID NO: 304486 - DNA, 75 bp, Artificial Sequence
  Synthetic
aaatgatggctgatgatttcgccgttgattttatggaagatgatgccataatacagaccgaaactggagtcggtg

SEQ ID NO: 304487 - DNA, 75 bp, Artificial Sequence
  Synthetic
tgattttatggaagatgatgccataatacagaccgaaactggagtcggtgtcttttctttcccaatgtgtaatag

SEQ ID NO: 304488 - DNA, 75 bp, Artificial Sequence
  Synthetic
aacatgcaaaaagaccaagatggcttaggaacggtacacatggcaaactgggctcaggggactgcgacaaggcag

SEQ ID NO: 304489 - DNA, 75 bp, Artificial Sequence
  Synthetic
taggaacggtacacatggcaaactgggctcaggggactgcgacaaggcagccagctgtatcatttctattcgaaa

SEQ ID NO: 304490 - DNA, 75 bp, Artificial Sequence
  Synthetic
ttatcaacatttatcgaggtgcacccctaaagcacaacatatgttagacacagtgttcccggaatcatcatttat

SEQ ID NO: 304491 - DNA, 75 bp, Artificial Sequence
  Synthetic
cctaaagcacaacatatgttagacacagtgttcccggaatcatcatttataaataaacctcccgcggaatggaac

SEQ ID NO: 304492 - DNA, 75 bp, Artificial Sequence
  Synthetic
ctcaaaaagtatggggacaaaagatagcgatgttagtgtccgcattcgctgctaaagtctgatccggcgtcagct

SEQ ID NO: 304493 - DNA, 75 bp, Artificial Sequence
  Synthetic
tagcgatgttagtgtccgcattcgctgctaaagtctgatccggcgtcagctccaaaagggagtgcttcgaaaggt

SEQ ID NO: 304494 - DNA, 75 bp, Artificial Sequence
  Synthetic
tcctagagcatggatctgatcgaaacagttaacgcttgcgtccgcttgcaaagaagagtttttgatttagctcca

SEQ ID NO: 304495 - DNA, 75 bp, Artificial Sequence
  Synthetic
agtcaactttaaatgattacaacgcaacggcttcacgtgtcaatggtcgtacttatcctttgctcgatcaaactg

SEQ ID NO: 304496 - DNA, 75 bp, Artificial Sequence
  Synthetic
aacggcttcacgtgtcaatggtcgtacttatcctttgctcgatcaaactgcagtactaactccatataccatcca

SEQ ID NO: 304497 - DNA, 75 bp, Artificial Sequence
  Synthetic
agaatctcaaccgatgattatgaggacatgagaagcggtatggaatcaataattgattgtcttgccgcagctatt

SEQ ID NO: 304498 - DNA, 75 bp, Artificial Sequence
  Synthetic
acatgagaagcggtatggaatcaataattgattgtcttgccgcagctattagaactgaaggttccagaccagtac

SEQ ID NO: 304499 - DNA, 75 bp, Artificial Sequence
  Synthetic
gccagtagttaaacaattaattgatgatctaaaactcaaaagcttaatatcaaacatttcagttgcaaattttgc

SEQ ID NO: 304500 - DNA, 75 bp, Artificial Sequence
  Synthetic
gatctaaaactcaaaagcttaatatcaaacatttcagttgcaaattttgctgctgctgatacgtcattaatccag

SEQ ID NO: 304501 - DNA, 75 bp, Artificial Sequence
  Synthetic
catttctagttggcataattgaacagactgtaatgagacagccagtcaatctaaatggtggaaatatccgcgcag

SEQ ID NO: 304502 - DNA, 75 bp, Artificial Sequence
  Synthetic
gactgtaatgagacagccagtcaatctaaatggtggaaatatccgcgcagcagttgggagatggtcaggaaataa

SEQ ID NO: 304503 - DNA, 75 bp, Artificial Sequence
  Synthetic
atggaagctgagcacatcttttttgttgaatttaaagcaagaacatgtggagtactaaacgtcatatatataccg

SEQ ID NO: 304504 - DNA, 75 bp, Artificial Sequence
  Synthetic
ttgaatttaaagcaagaacatgtggagtactaaacgtcatatatataccggcaccaggagtgctaatgattccat

SEQ ID NO: 304505 - DNA, 75 bp, Artificial Sequence
  Synthetic
tgtgtgtattgatgtttcagcagagatgacagccgacgatttcaaaattgacttttttgatgatgacaccattgt

SEQ ID NO: 304506 - DNA, 75 bp, Artificial Sequence
  Synthetic
atgacagccgacgatttcaaaattgacttttttgatgatgacaccattgtgcacacagcgaacggtgtaggtatt

SEQ ID NO: 304507 - DNA, 75 bp, Artificial Sequence
  Synthetic
taaggtttagggttactccttggactgaacagaaaacacgcgatggtcttgacactccatcaatcacgaactgga

SEQ ID NO: 304508 - DNA, 75 bp, Artificial Sequence
  Synthetic
tgaacagaaaacacgcgatggtcttgacactccatcaatcacgaactggaataatggaaacgctccacggcagcc

SEQ ID NO: 304509 - DNA, 75 bp, Artificial Sequence
  Synthetic
agacgcacattcactgaaaatgattacaaattcgtttcgagatgcactccaaaagtacagtacgttcttgacaac

SEQ ID NO: 304510 - DNA, 75 bp, Artificial Sequence
  Synthetic
tactttccagagacatcattcgtaaataggcctcagattgaatggaatattcaagagatgttgactacagatact

SEQ ID NO: 304511 - DNA, 75 bp, Artificial Sequence
  Synthetic
caatgctggtcgcagctttcgctgcaaagatctgatctgccctgggtccgggagccggattgctttagaggatga

SEQ ID NO: 304512 - DNA, 75 bp, Artificial Sequence
  Synthetic
ggtataatacgggtgtgctgtctgtacaagtcagggaaacctatgggaaataggcaatccagcttgcaatcgcag

SEQ ID NO: 304513 - DNA, 75 bp, Artificial Sequence
  Synthetic
acaagtcagggaaacctatgggaaataggcaatccagcttgcaatcgcagacacacagaactgatattaactcac

SEQ ID NO: 304514 - DNA, 75 bp, Artificial Sequence
  Synthetic
taggcaatccagcttgcaatcgcagacacacagaactgatattaactcacacaattcaaatatctatcttcaaag

SEQ ID NO: 304515 - DNA, 75 bp, Artificial Sequence
  Synthetic
tatcatttattaatcactgttggtgctgccctaattgctttgttgcttgcattcctcatttcgagcttagtgtgt

SEQ ID NO: 304516 - DNA, 75 bp, Artificial Sequence
  Synthetic
ctgccctaattgctttgttgcttgcattcctcatttcgagcttagtgtgtaattgctatttattacgaaggctaa

SEQ ID NO: 304517 - DNA, 75 bp, Artificial Sequence
  Synthetic
cacaggcaaagcacaagaaggatcttatcccaacttatcaaaacaacttattcgactcgacaactttgtctaaaa

SEQ ID NO: 304518 - DNA, 75 bp, Artificial Sequence
  Synthetic
tatcccaacttatcaaaacaacttattcgactcgacaactttgtctaaaaaaccttcaaaaatagaactcattaa

SEQ ID NO: 304519 - DNA, 75 bp, Artificial Sequence
  Synthetic
cctcagtttgctggagaatctattctactggaagacatttgtccttacaaccatgagcacttctgtggtggtata

SEQ ID NO: 304520 - DNA, 75 bp, Artificial Sequence
  Synthetic
tactggaagacatttgtccttacaaccatgagcacttctgtggtggtatacacattccaaagcagtttaatatgt

SEQ ID NO: 304521 - DNA, 75 bp, Artificial Sequence
  Synthetic
cacgagtgataaaatcgcgtggccatgtggattggaatccatcataattgatggaaagagatacactggttcagc

SEQ ID NO: 304522 - DNA, 75 bp, Artificial Sequence
  Synthetic
tgtggattggaatccatcataattgatggaaagagatacactggttcagcatttgttaagtgtagatgtggacaa

SEQ ID NO: 304523 - DNA, 75 bp, Artificial Sequence
  Synthetic
tgtcaacttttttctttttgacatgttgctcgaatgatacaaaatcggtgaaaattggactaagtgaaaaattca

SEQ ID NO: 304524 - DNA, 75 bp, Artificial Sequence
  Synthetic
ttgctcgaatgatacaaaatcggtgaaaattggactaagtgaaaaattcaactgtttaaactgtaataggagtat

SEQ ID NO: 304525 - DNA, 75 bp, Artificial Sequence
  Synthetic
attcgaacagcgcatcaatactatcttccaagccaattatgtccagcgtgtatgccatttcgtgacatcgtcgct

SEQ ID NO: 304526 - DNA, 75 bp, Artificial Sequence
  Synthetic
ttccaagccaattatgtccagcgtgtatgccatttcgtgacatcgtcgctacaatgtccctgctgaataaagtgg

SEQ ID NO: 304527 - DNA, 75 bp, Artificial Sequence
  Synthetic
aatgcgtaccgattttgaatggaagaggcatttacaaaacaactgtgaatctgccttcagatcatttaattctcc

SEQ ID NO: 304528 - DNA, 75 bp, Artificial Sequence
  Synthetic
aggcatttacaaaacaactgtgaatctgccttcagatcatttaattctccacagttagcacacagaattacacca

SEQ ID NO: 304529 - DNA, 75 bp, Artificial Sequence
  Synthetic
ctctcaatacgatcactgagaccatatcttcagtgaatagaagacaacataacaaaatagagattacaccaatat

SEQ ID NO: 304530 - DNA, 75 bp, Artificial Sequence
  Synthetic
atcttcagtgaatagaagacaacataacaaaatagagattacaccaatatgtagaggaaaagtcgcgatttgcga

SEQ ID NO: 304531 - DNA, 75 bp, Artificial Sequence
  Synthetic
tttcaggacaacgctcaactacattgttcaatttgcacgctactgcttcgctggaagctgatttgaacatagaat

SEQ ID NO: 304532 - DNA, 75 bp, Artificial Sequence
  Synthetic
ctggaagctgatttgaacatagaatgagagttccagatctctaacctgacgcagtcactcgccctatcctaaaaa

SEQ ID NO: 304533 - DNA, 75 bp, Artificial Sequence
  Synthetic
atggatctgatcgaaacagttaacgcttgcgtccgcttgcaaagaagagttcttgacttagctccaaacacgaac

SEQ ID NO: 304534 - DNA, 75 bp, Artificial Sequence
  Synthetic
cttgcgtccgcttgcaaagaagagttcttgacttagctccaaacacgaacttgaacactgcaggccaatcaactt

SEQ ID NO: 304535 - DNA, 75 bp, Artificial Sequence
  Synthetic
tcttgacttagctccaaacacgaacttgaacactgcaggccaatcaactttaaatgactataatgcaacggcgtc

SEQ ID NO: 304536 - DNA, 75 bp, Artificial Sequence
  Synthetic
ttacttgatcaaaccgcagtcctcacaccgtatacaattcattcaccaatagtcccgttagccgtaagaatctca

SEQ ID NO: 304537 - DNA, 75 bp, Artificial Sequence
  Synthetic
caccgtatacaattcattcaccaatagtcccgttagccgtaagaatctcaactgatgattatgaagatatgcgaa

SEQ ID NO: 304538 - DNA, 75 bp, Artificial Sequence
  Synthetic
tctcgcagctgcaattagaactgaaggttctagaccagtacgcgttattgaacgtagagtactcgaaccagtagt

SEQ ID NO: 304539 - DNA, 75 bp, Artificial Sequence
  Synthetic
ggttctagaccagtacgcgttattgaacgtagagtactcgaaccagtagttaagcaattaatcgatgatttgaag

SEQ ID NO: 304540 - DNA, 75 bp, Artificial Sequence
  Synthetic
cagttgcaaatttcgctgctgctgatacttcactgatccaaccagaagtcgtagaaacggagaatcctttcctcg

SEQ ID NO: 304541 - DNA, 75 bp, Artificial Sequence
  Synthetic
tacttcactgatccaaccagaagtcgtagaaacggagaatcctttcctcgttggtatcatcgaacagaccgtgat

SEQ ID NO: 304542 - DNA, 75 bp, Artificial Sequence
  Synthetic
ggtaatatccgaacggcagttgggaggtggtcaggaaataaaggagcagttacgtgcgtatccggaatggaagct

SEQ ID NO: 304543 - DNA, 75 bp, Artificial Sequence
  Synthetic
ggtggtcaggaaataaaggagcagttacgtgcgtatccggaatggaagctgaacacattttttttgttgaattca

SEQ ID NO: 304544 - DNA, 75 bp, Artificial Sequence
  Synthetic
tgtaatatatgtaccagcgccaggcatgttgatgattccaatgccaaacggtccaaatagagaaagtgtatgtct

SEQ ID NO: 304545 - DNA, 75 bp, Artificial Sequence
  Synthetic
atgttgatgattccaatgccaaacggtccaaatagagaaagtgtatgtcttgacgtttcagcggaaatgacagct

SEQ ID NO: 304546 - DNA, 75 bp, Artificial Sequence
  Synthetic
atgatgataccatcgtacacacggcgaatggagtaggtatcgtgtcttttccaatgtgtacaagaatacgattca

SEQ ID NO: 304547 - DNA, 75 bp, Artificial Sequence
  Synthetic
gaatggagtaggtatcgtgtcttttccaatgtgtacaagaatacgattcagagttaccccttggactgaacagaa

SEQ ID NO: 304548 - DNA, 75 bp, Artificial Sequence
  Synthetic
tccatcacaaattggaataatggaaacgctccgcgccaaccaacagtctcttttatgtttgaagccagacgtact

SEQ ID NO: 304549 - DNA, 75 bp, Artificial Sequence
  Synthetic
acgctccgcgccaaccaacagtctcttttatgtttgaagccagacgtactttcactgagaatgattacaaattcg

SEQ ID NO: 304550 - DNA, 75 bp, Artificial Sequence
  Synthetic
gtacgtccttgacaactattttccagaaacgtcattcgtaaacagaccccaaattgaatggaacattcaagagat

SEQ ID NO: 304551 - DNA, 75 bp, Artificial Sequence
  Synthetic
gctaaccacagacactaacacagtatggtcacgtaaaatagcaatgctggtcgcagctttcgctgctaagatctg

SEQ ID NO: 304552 - DNA, 75 bp, Artificial Sequence
  Synthetic
tattaattagtccaaccagggttgcaagcatggatctgatcgagacagtgaatgcgtgtgtcaaattgcaaaaac

SEQ ID NO: 304553 - DNA, 75 bp, Artificial Sequence
  Synthetic
aagcatggatctgatcgagacagtgaatgcgtgtgtcaaattgcaaaaacgtattttacttctagctccaaatac

SEQ ID NO: 304554 - DNA, 75 bp, Artificial Sequence
  Synthetic
aatgcgtgtgtcaaattgcaaaaacgtattttacttctagctccaaatacaaatctcaatattgaaggtcaatct

SEQ ID NO: 304555 - DNA, 75 bp, Artificial Sequence
  Synthetic
cttctcgcatcaacggaaaaacttaccccttacttgatcaaacagctattttgacaccatatacaatacatgccc

SEQ ID NO: 304556 - DNA, 75 bp, Artificial Sequence
  Synthetic
ccccttacttgatcaaacagctattttgacaccatatacaatacatgccccaattgtcgcattggcagttagaat

SEQ ID NO: 304557 - DNA, 75 bp, Artificial Sequence
  Synthetic
cgaagtggaattgagtcaataattgactgccttgctgctgctattcgtactgaaggatcaagaccagtcagagtc

SEQ ID NO: 304558 - DNA, 75 bp, Artificial Sequence
  Synthetic
actgccttgctgctgctattcgtactgaaggatcaagaccagtcagagtcatcgagcgaagagtcgtcgaaccag

SEQ ID NO: 304559 - DNA, 75 bp, Artificial Sequence
  Synthetic
aaaattaaagagccttatctcagagataccaatcgcaaatttcgccgctactgacacagcattgattcagcctga

SEQ ID NO: 304560 - DNA, 75 bp, Artificial Sequence
  Synthetic
ataccaatcgcaaatttcgccgctactgacacagcattgattcagcctgaggttattgaagtagaaaatccactt

SEQ ID NO: 304561 - DNA, 75 bp, Artificial Sequence
  Synthetic
ttgttagacagccagcgacaaataatggaggaaacgttagagcagctttggggagatggtctgggaacaagggct

SEQ ID NO: 304562 - DNA, 75 bp, Artificial Sequence
  Synthetic
tggaggaaacgttagagcagctttggggagatggtctgggaacaagggctcagttacatgtatttcaggcatgga

SEQ ID NO: 304563 - DNA, 75 bp, Artificial Sequence
  Synthetic
tttaaaacacgcacttgtggagtactaaatatagtctacactccagcaccaggcgtaatgttaatccctatgccc

SEQ ID NO: 304564 - DNA, 75 bp, Artificial Sequence
  Synthetic
taaatatagtctacactccagcaccaggcgtaatgttaatccctatgccccaaggacgtaatagagagagcgtag

SEQ ID NO: 304565 - DNA, 75 bp, Artificial Sequence
  Synthetic
agctgatgatttcataattgagtttttcgatggtaacacgattgttcacacagaaaggggtattggaatattttc

SEQ ID NO: 304566 - DNA, 75 bp, Artificial Sequence
  Synthetic
ttcgatggtaacacgattgttcacacagaaaggggtattggaatattttcattcccaatgtgtgatagaattaga

SEQ ID NO: 304567 - DNA, 75 bp, Artificial Sequence
  Synthetic
agaaaacccaagataatcttgatacaccatcaatggcaacttgggcgaatggtacagctccacgtcagccaggaa

SEQ ID NO: 304568 - DNA, 75 bp, Artificial Sequence
  Synthetic
accatcaatggcaacttgggcgaatggtacagctccacgtcagccaggaatatctttcatgtttgaagttagacg

SEQ ID NO: 304569 - DNA, 75 bp, Artificial Sequence
  Synthetic
tttctttcccgttgtacgccgaaagttcagcacgtattggaaactaactttccagaaacatcattcattaacagg

SEQ ID NO: 304570 - DNA, 75 bp, Artificial Sequence
  Synthetic
ttcagcacgtattggaaactaactttccagaaacatcattcattaacaggcctcaaattgagtggaatatacaag

SEQ ID NO: 304571 - DNA, 75 bp, Artificial Sequence
  Synthetic
tgtatgggcacgcaaaattgcgatgttggtcgcctcattcgctgctaagatctgattcgccctgagcccgggagc

SEQ ID NO: 304572 - DNA, 75 bp, Artificial Sequence
  Synthetic
ttggtcgcctcattcgctgctaagatctgattcgccctgagcccgggagccgggttgcttcgagaggatgaaaaa

SEQ ID NO: 304573 - DNA, 75 bp, Artificial Sequence
  Synthetic
tattaattagtccaaccgacgcttcaagcatggatctgatcgaaacagtgaacgcatgcgttgcattgcagaaaa

SEQ ID NO: 304574 - DNA, 75 bp, Artificial Sequence
  Synthetic
aagcatggatctgatcgaaacagtgaacgcatgcgttgcattgcagaaaagaatattgaatttagctcctaacac

SEQ ID NO: 304575 - DNA, 75 bp, Artificial Sequence
  Synthetic
aacgcatgcgttgcattgcagaaaagaatattgaatttagctcctaacacgaatctgaatacagcaggacagagt

SEQ ID NO: 304576 - DNA, 75 bp, Artificial Sequence
  Synthetic
catcaagaataaccggtaaaacttacgcattgctcgatcttactgcagtgttaacaccatttactattactgcac

SEQ ID NO: 304577 - DNA, 75 bp, Artificial Sequence
  Synthetic
cgcattgctcgatcttactgcagtgttaacaccatttactattactgcaccgatcatttcactatcagtaagaat

SEQ ID NO: 304578 - DNA, 75 bp, Artificial Sequence
  Synthetic
agatcaggaatgaattctatattagacgtacttgctgcagccatcagaacagaaggatcaaggccagttcgtgtg

SEQ ID NO: 304579 - DNA, 75 bp, Artificial Sequence
  Synthetic
acgtacttgctgcagccatcagaacagaaggatcaaggccagttcgtgtgatcgaaagacgtgtccacgatcctg

SEQ ID NO: 304580 - DNA, 75 bp, Artificial Sequence
  Synthetic
caaaatgaagagtttagtatcagacatctcattagctaatcttgctgcggtggacactgctatgattcagccaga

SEQ ID NO: 304581 - DNA, 75 bp, Artificial Sequence
  Synthetic
atctcattagctaatcttgctgcggtggacactgctatgattcagccagaagtaattgaaactgaaaacccactg

SEQ ID NO: 304582 - DNA, 75 bp, Artificial Sequence
  Synthetic
ttcacagagcaaacatgaacatgactggaggaaacataagagccaccctaggcagatggtctggaaataaagggg

SEQ ID NO: 304583 - DNA, 75 bp, Artificial Sequence
  Synthetic
tggaggaaacataagagccaccctaggcagatggtctggaaataaaggggtaattacttgtatgtcaggcatgga

SEQ ID NO: 304584 - DNA, 75 bp, Artificial Sequence
  Synthetic
ctcaaagcgagaacgactggcattataaacattgtctatgttccaacagcaggaacgatacttattccaatgcca

SEQ ID NO: 304585 - DNA, 75 bp, Artificial Sequence
  Synthetic
taaacattgtctatgttccaacagcaggaacgatacttattccaatgccaaacggaaggacgagggaaggaaaac

SEQ ID NO: 304586 - DNA, 75 bp, Artificial Sequence
  Synthetic
ggcagataattttgccattgattttatggaggatgatgctatagtacagaccgagacaggagtcggtgttttctc

SEQ ID NO: 304587 - DNA, 75 bp, Artificial Sequence
  Synthetic
atggaggatgatgctatagtacagaccgagacaggagtcggtgttttctccttcccaatgtgtaataggataaga

SEQ ID NO: 304588 - DNA, 75 bp, Artificial Sequence
  Synthetic
aaaaagatcaagaaggtttgggaaccgtacatatgacaaactgggcacagggcaacgcaacgagacaaccagcca

SEQ ID NO: 304589 - DNA, 75 bp, Artificial Sequence
  Synthetic
cgtacatatgacaaactgggcacagggcaacgcaacgagacaaccagccatttctttcttatttgaaactaggag

SEQ ID NO: 304590 - DNA, 75 bp, Artificial Sequence
  Synthetic
catctgtccagatgtaccccaaaagctcaacatgtactagacacagtgtttccagagacgtccttcgtcaataaa

SEQ ID NO: 304591 - DNA, 75 bp, Artificial Sequence
  Synthetic
ctcaacatgtactagacacagtgtttccagagacgtccttcgtcaataaaccagatgttgactggaacattcaga

SEQ ID NO: 304592 - DNA, 75 bp, Artificial Sequence
  Synthetic
aacttgggctcagaagatagcaatgctagtatctgcgtttgctgctagaatctgatccggcgtcagcttccaaag

SEQ ID NO: 304593 - DNA, 75 bp, Artificial Sequence
  Synthetic
aacagttaatgcatgcgttaagttgcaaaagagagttttaagtttagcaccaaatacaaatttgaacacgtctgg

SEQ ID NO: 304594 - DNA, 75 bp, Artificial Sequence
  Synthetic
gcattagcttcaaggtgcaacggtagaacatacgcttttctggatcaaactgcagttctcacccctttcactatc

SEQ ID NO: 304595 - DNA, 75 bp, Artificial Sequence
  Synthetic
ttcgtatatccacagacgattatgatgacatgaaatctggaatggactcagtcttagatgtgcttgctgctgcca

SEQ ID NO: 304596 - DNA, 75 bp, Artificial Sequence
  Synthetic
gagagcaatagaaagacgtgtccttgaaccagctgttaaacaattggtagaagacttgaagttaaaaagtctcac

SEQ ID NO: 304597 - DNA, 75 bp, Artificial Sequence
  Synthetic
ttctgatatttctgttgcgaatctggctgccgtagatactgccgtgattcagccagaaatcattcagactgaaaa

SEQ ID NO: 304598 - DNA, 75 bp, Artificial Sequence
  Synthetic
caagttgtgaatagaccacagatgaatatgactggcggaaacatcagagctactttgggaagatggtcaggtaac

SEQ ID NO: 304599 - DNA, 75 bp, Artificial Sequence
  Synthetic
atatgactggcggaaacatcagagctactttgggaagatggtcaggtaacaaaggagtagttacatgcatgtcgg

SEQ ID NO: 304600 - DNA, 75 bp, Artificial Sequence
  Synthetic
tgttaatttcaaggccagaactacaggaataatcaacattgtttacataccgactgctggtactatattaatacc

SEQ ID NO: 304601 - DNA, 75 bp, Artificial Sequence
  Synthetic
cgactgctggtactatattaatacctatgccaaatggaagaaatagggaaggaaaattaatcgatgtttcagcag

SEQ ID NO: 304602 - DNA, 75 bp, Artificial Sequence
  Synthetic
ctccaaaccgaaactggagttggagtttactctttcccaatgtgtaatcgtatcagatttagaatttctccatgg

SEQ ID NO: 304603 - DNA, 75 bp, Artificial Sequence
  Synthetic
taggaacagttcatatgacaaactgggcacaggggacagctgctagacagccagctatttcttttatatttgaga

SEQ ID NO: 304604 - DNA, 75 bp, Artificial Sequence
  Synthetic
ctatcagcatttatctagatgcacaccaaaatcacaatacacactcgatacgattttccctgagacttcattcat

SEQ ID NO: 304605 - DNA, 75 bp, Artificial Sequence
  Synthetic
attcagagtttacttacttccactactcagacagtatggtgtaaaaaaatagcaattttagtgtctgcatatgct

SEQ ID NO: 304606 - DNA, 75 bp, Artificial Sequence
  Synthetic
tagcaattttagtgtctgcatatgctgcgaggatctgatccggcgtcagcttccaaaggaagtgcttcgagaggt

SEQ ID NO: 304607 - DNA, 75 bp, Artificial Sequence
  Synthetic
aacagttaacgcatgtatcaaattgcaaaaaagagttctaagtttagcaccgaatacgaacttaaacacatccgg

SEQ ID NO: 304608 - DNA, 75 bp, Artificial Sequence
  Synthetic
aacgctccaatcatctctctttcagttcgcatttctacagatgactatgaagacatgaagtccggaatggactct

SEQ ID NO: 304609 - DNA, 75 bp, Artificial Sequence
  Synthetic
ttagatcggaaggatctagacctgtaagagcaatagaaagacgcgtacttgatccagctgttaaacagttggtag

SEQ ID NO: 304610 - DNA, 75 bp, Artificial Sequence
  Synthetic
aagagcaatagaaagacgcgtacttgatccagctgttaaacagttggtagaagacctaaaattgaaaagtcttac

SEQ ID NO: 304611 - DNA, 75 bp, Artificial Sequence
  Synthetic
ctctgatatttccattgcaaacttagctgctgtagatactgccgtaattcaaccagaaattatccaaactgaaaa

SEQ ID NO: 304612 - DNA, 75 bp, Artificial Sequence
  Synthetic
gctgctgtagatactgccgtaattcaaccagaaattatccaaactgaaaatccattatatgctgatattattgaa

SEQ ID NO: 304613 - DNA, 75 bp, Artificial Sequence
  Synthetic
aaccagaaattatccaaactgaaaatccattatatgctgatattattgaacaagttgtaaatagaccacaaatga

SEQ ID NO: 304614 - DNA, 75 bp, Artificial Sequence
  Synthetic
tccattatatgctgatattattgaacaagttgtaaatagaccacaaatgaatatgactggcggaaatattagagc

SEQ ID NO: 304615 - DNA, 75 bp, Artificial Sequence
  Synthetic
cactttggggagatggtcaggtaataaaggagtaattacgtgtatgtcaggaatggactctgaacatagattcac

SEQ ID NO: 304616 - DNA, 75 bp, Artificial Sequence
  Synthetic
ggaataattaatattgtatatgtgccaaccgcagggactatattaatacccatgccaaatgcaagaaatagagaa

SEQ ID NO: 304617 - DNA, 75 bp, Artificial Sequence
  Synthetic
agatgatggctgagaacttcgccattgactttatggatgacgatgcaataattcagactgaaacaggagttggag

SEQ ID NO: 304618 - DNA, 75 bp, Artificial Sequence
  Synthetic
gatatgcagaaagatcaagaaggtcttggtacagttcatatgacaaactgggcacagggaacagctgccagacag

SEQ ID NO: 304619 - DNA, 75 bp, Artificial Sequence
  Synthetic
ttggtacagttcatatgacaaactgggcacagggaacagctgccagacagccagctgtatctttcatgttcgaaa

SEQ ID NO: 304620 - DNA, 75 bp, Artificial Sequence
  Synthetic
ctatcagcacctatccaagtgcgcaccaaaatcacagtacatgctggacacaatttttcccgaaacgtcattcgt

SEQ ID NO: 304621 - DNA, 75 bp, Artificial Sequence
  Synthetic
aaacaaaccaaacgtagactggaacattcagagcttgctaacctcaaccatccaaaaagtatggtgtcaaaaaat

SEQ ID NO: 304622 - DNA, 75 bp, Artificial Sequence
  Synthetic
tagcaattctggtgtctgcgtatgctgcgaaagtctgatccggcgtcggcttccaatggaagtgcttcgagaggt

SEQ ID NO: 304623 - DNA, 75 bp, Artificial Sequence
  Synthetic
acgcttcaagcatggatctgattgaaacagtaaatgcatgcgttgcattgcagaaaagaatatatgacctagcac

SEQ ID NO: 304624 - DNA, 75 bp, Artificial Sequence
  Synthetic
aacagtaaatgcatgcgttgcattgcagaaaagaatatatgacctagcaccaaacaccaatcttaacacggcggg

SEQ ID NO: 304625 - DNA, 75 bp, Artificial Sequence
  Synthetic
cagaaaagaatatatgacctagcaccaaacaccaatcttaacacggcggggcaaagtacccttaatgattacaac

SEQ ID NO: 304626 - DNA, 75 bp, Artificial Sequence
  Synthetic
aaacatatcctctacatgatctaactgcagtactaactccactcaccattcacgctcctatcatttcactctcgg

SEQ ID NO: 304627 - DNA, 75 bp, Artificial Sequence
  Synthetic
tgcagtactaactccactcaccattcacgctcctatcatttcactctcggtacgcatctctactgatgactatga

SEQ ID NO: 304628 - DNA, 75 bp, Artificial Sequence
  Synthetic
attcttgatgtgctagctgcggcaatcaggactgaaggttcgaggccagtacgcgtaattgaaagacgcgttctc

SEQ ID NO: 304629 - DNA, 75 bp, Artificial Sequence
  Synthetic
tcaggactgaaggttcgaggccagtacgcgtaattgaaagacgcgttctcgatccagttgtcaaacaattggttg

SEQ ID NO: 304630 - DNA, 75 bp, Artificial Sequence
  Synthetic
gtcagagatatctctggcaaacctagctgctgtagacactgctatgattcaacccgaactaattgaaactgagaa

SEQ ID NO: 304631 - DNA, 75 bp, Artificial Sequence
  Synthetic
gctgctgtagacactgctatgattcaacccgaactaattgaaactgagaaccctctatttgccgatattattgag

SEQ ID NO: 304632 - DNA, 75 bp, Artificial Sequence
  Synthetic
atatgactggtggtaacatcagagctactctaggcagatggtcaggtaacaaaggtgtaatcacttgtatgtcag

SEQ ID NO: 304633 - DNA, 75 bp, Artificial Sequence
  Synthetic
tactctaggcagatggtcaggtaacaaaggtgtaatcacttgtatgtcaggtatggactcagaacataggttcac

SEQ ID NO: 304634 - DNA, 75 bp, Artificial Sequence
  Synthetic
ggtgtattgaatatcgtatacgtacctgcagccggcacaatactcattccaatgccaaatggaagaactagagaa

SEQ ID NO: 304635 - DNA, 75 bp, Artificial Sequence
  Synthetic
ctgcagccggcacaatactcattccaatgccaaatggaagaactagagaaggaaaacttattgatgtctcagctg

SEQ ID NO: 304636 - DNA, 75 bp, Artificial Sequence
  Synthetic
cgatttcatggaagatgatgctataatacagaccgaaactggagtcggtgttttctcttttcctatgtgtaacag

SEQ ID NO: 304637 - DNA, 75 bp, Artificial Sequence
  Synthetic
atacagaccgaaactggagtcggtgttttctcttttcctatgtgtaacagaataaggtttagaatcaatccatgg

SEQ ID NO: 304638 - DNA, 75 bp, Artificial Sequence
  Synthetic
tggggacagtacacatgacaaattgggctcagggaaacgcaacaagacagccagccgtgtcatttctctttgaga

SEQ ID NO: 304639 - DNA, 75 bp, Artificial Sequence
  Synthetic
ggctcagggaaacgcaacaagacagccagccgtgtcatttctctttgagactaggagaacattcactgagggtga

SEQ ID NO: 304640 - DNA, 75 bp, Artificial Sequence
  Synthetic
cctaaagcacagtacatgttagatactgtattcccagaatcatcatttataaataagccccctacagagtggaac

SEQ ID NO: 304641 - DNA, 75 bp, Artificial Sequence
  Synthetic
atcaaaaagtatggggacagaagatagcgatgttagtgtctgcatttgctgctaaagtctgatccggcgtcagct

SEQ ID NO: 304642 - DNA, 75 bp, Artificial Sequence
  Synthetic
tagcgatgttagtgtctgcatttgctgctaaagtctgatccggcgtcagctccaaaaaggagtgcttcgagaggt

SEQ ID NO: 304643 - DNA, 75 bp, Artificial Sequence
  Synthetic
acgcttcaagcatggatctgattgaaacagttaatgcatgcgtaaagttgcaaaaaagaattctgaatttagcgc

SEQ ID NO: 304644 - DNA, 75 bp, Artificial Sequence
  Synthetic
aacagttaatgcatgcgtaaagttgcaaaaaagaattctgaatttagcgccaaacacgaatttaaacacgtccgg

SEQ ID NO: 304645 - DNA, 75 bp, Artificial Sequence
  Synthetic
caaaaaagaattctgaatttagcgccaaacacgaatttaaacacgtccggtcaaagcactctgaacgattacaac

SEQ ID NO: 304646 - DNA, 75 bp, Artificial Sequence
  Synthetic
gaacgtatgctttactcgatcaaacggcaattcttactcctctaactattaatgctccgatcatttctctttcag

SEQ ID NO: 304647 - DNA, 75 bp, Artificial Sequence
  Synthetic
ggcaattcttactcctctaactattaatgctccgatcatttctctttcagttcgtatatctacagacgactatga

SEQ ID NO: 304648 - DNA, 75 bp, Artificial Sequence
  Synthetic
attttagatgtactcgctgccgctattagaacggaaggatcaagaccagtgagagcaatagaaagacgtgtcctt

SEQ ID NO: 304649 - DNA, 75 bp, Artificial Sequence
  Synthetic
ttagaacggaaggatcaagaccagtgagagcaatagaaagacgtgtccttgaaccagctgttagacagattgtgg

SEQ ID NO: 304650 - DNA, 75 bp, Artificial Sequence
  Synthetic
ttctgatatttcggtcgcaaatttagcagcggtagataccgccgtaattcaaccagaaataattcaaactgaaaa

SEQ ID NO: 304651 - DNA, 75 bp, Artificial Sequence
  Synthetic
gcagcggtagataccgccgtaattcaaccagaaataattcaaactgaaaatccattgtatgctgatgttattgaa

SEQ ID NO: 304652 - DNA, 75 bp, Artificial Sequence
  Synthetic
atatgactggtggaaacattagggctactttaggaagatggtcaggcaacaagggagtagttacgtgtatgtcag

SEQ ID NO: 304653 - DNA, 75 bp, Artificial Sequence
  Synthetic
tactttaggaagatggtcaggcaacaagggagtagttacgtgtatgtcaggaatggattctgaacacagatttat

SEQ ID NO: 304654 - DNA, 75 bp, Artificial Sequence
  Synthetic
ggagtgatcaacattgtatatattccacctgctggtactatattaataccaatgccaaatggaagaaatagagaa

SEQ ID NO: 304655 - DNA, 75 bp, Artificial Sequence
  Synthetic
cacctgctggtactatattaataccaatgccaaatggaagaaatagagaaggtaaattgatagatgtctctgcag

SEQ ID NO: 304656 - DNA, 75 bp, Artificial Sequence
  Synthetic
tgatttcatggatgatgatgcaatagttcagactgaaactggagttggagttttctcttttccaatgtgtaaccg

SEQ ID NO: 304657 - DNA, 75 bp, Artificial Sequence
  Synthetic
gttcagactgaaactggagttggagttttctcttttccaatgtgtaaccgcattagatttagaatttctccatgg

SEQ ID NO: 304658 - DNA, 75 bp, Artificial Sequence
  Synthetic
taggaacagttcacatgacaaactgggcacaagggacagctgccagacagccagctatatcctttatgtttgaaa

SEQ ID NO: 304659 - DNA, 75 bp, Artificial Sequence
  Synthetic
ggcacaagggacagctgccagacagccagctatatcctttatgtttgaaactcgtgacacctttactcagggtga

SEQ ID NO: 304660 - DNA, 75 bp, Artificial Sequence
  Synthetic
cccaaatcacaatacatactggataccattttccctgagacttcattcgtaaacaggccaaatgttgattggaac

SEQ ID NO: 304661 - DNA, 75 bp, Artificial Sequence
  Synthetic
ctcagacagtatggtgcaaaaaaatagcgattttagtgtctgcatatgctgcgaaagtctgatccggcgtcagct

SEQ ID NO: 304662 - DNA, 75 bp, Artificial Sequence
  Synthetic
tagcgattttagtgtctgcatatgctgcgaaagtctgatccggcgtcagcttccaaaggaagtgcttcgagaggt

SEQ ID NO: 304663 - DNA, 75 bp, Artificial Sequence
  Synthetic
acgctacaagcatggatatgatcgaaacggtgaacgcatgcatcaaactgcaaaagagaatattgaacttagcac

SEQ ID NO: 304664 - DNA, 75 bp, Artificial Sequence
  Synthetic
acgctacaagcatggatttgatcgaaacggtgaacgcatgcatcaaactgcaaaagagaatattgaacttagcac

SEQ ID NO: 304665 - DNA, 75 bp, Artificial Sequence
  Synthetic
acgctacaagcatggatctgatcgaaacggtgaacgcatgcatcaaactgcaaaagagaatattgaacttagcac

SEQ ID NO: 304666 - DNA, 75 bp, Artificial Sequence
  Synthetic
acgctacaagcatggatgtgatcgaaacggtgaacgcatgcatcaaactgcaaaagagaatattgaacttagcac

SEQ ID NO: 304667 - DNA, 75 bp, Artificial Sequence
  Synthetic
aacggtgaacgcatgcatcaaactgcaaaagagaatattgaacttagcacctaatactaatttaaacacagctgg

SEQ ID NO: 304668 - DNA, 75 bp, Artificial Sequence
  Synthetic
caaaagagaatattgaacttagcacctaatactaatttaaacacagctggtcaaagcatactaaatgattataat

SEQ ID NO: 304669 - DNA, 75 bp, Artificial Sequence
  Synthetic
aaatgtacacgctgcttgatcaaacagcagtatatactccatacacaataactgcaccgattatttcactatctg

SEQ ID NO: 304670 - DNA, 75 bp, Artificial Sequence
  Synthetic
agcagtatatactccatacacaataactgcaccgattatttcactatctgtgcgtatttcaacagatgacttcga

SEQ ID NO: 304671 - DNA, 75 bp, Artificial Sequence
  Synthetic
attttagatatattagctgcagcaataagaactgaaggttctagatatgttagagtgattgaaagacgagtggtg

SEQ ID NO: 304672 - DNA, 75 bp, Artificial Sequence
  Synthetic
taagaactgaaggttctagatatgttagagtgattgaaagacgagtggtggatccaaatgttaaacagttagtcg

SEQ ID NO: 304673 - DNA, 75 bp, Artificial Sequence
  Synthetic
gtcagatatctccatagcaaatcttgctgcggttgacactgcgttgattcagccagaaatcattgaaacagagaa

SEQ ID NO: 304674 - DNA, 75 bp, Artificial Sequence
  Synthetic
gctgcggttgacactgcgttgattcagccagaaatcattgaaacagagaatccattgtttgctgacataatagaa

SEQ ID NO: 304675 - DNA, 75 bp, Artificial Sequence
  Synthetic
atctaacaggaggcaacattcgagcaacgctaggcagatggtcaggaaacaaaggagtcatcacttgcatgtccg

SEQ ID NO: 304676 - DNA, 75 bp, Artificial Sequence
  Synthetic
aacgctaggcagatggtcaggaaacaaaggagtcatcacttgcatgtccggtatggattcagagcatagattcac

SEQ ID NO: 304677 - DNA, 75 bp, Artificial Sequence
  Synthetic
ggagtaattaatatagtttacattccaaccgcaggaagaatgctgattccaatgccaaatggaagaaattgggaa

SEQ ID NO: 304678 - DNA, 75 bp, Artificial Sequence
  Synthetic
caaccgcaggaagaatgctgattccaatgccaaatggaagaaattgggaaggcaaactgatcgacgtgtcagctg

SEQ ID NO: 304679 - DNA, 75 bp, Artificial Sequence
  Synthetic
tgatttcatggatgatgatactataattcaaactgaaaccggagttggagtttactctttcccaatgtgcaacag

SEQ ID NO: 304680 - DNA, 75 bp, Artificial Sequence
  Synthetic
attcaaactgaaaccggagttggagtttactctttcccaatgtgcaacagaatgagattcaggatttcaccatgg

SEQ ID NO: 304681 - DNA, 75 bp, Artificial Sequence
  Synthetic
tcggaaccccacacatgggtaactgggcacaaggaaatgcagcttggcaaccagcaataactttcatgtttgaaa

SEQ ID NO: 304682 - DNA, 75 bp, Artificial Sequence
  Synthetic
ggcacaaggaaatgcagcttggcaaccagcaataactttcatgtttgaaaccagaagaacgttcacagaaggtga

SEQ ID NO: 304683 - DNA, 75 bp, Artificial Sequence
  Synthetic
cctaaagcacagtatatgctagatactcttttcccagagacatcttttattaacaaaccagctgtcgattggaac

SEQ ID NO: 304684 - DNA, 75 bp, Artificial Sequence
  Synthetic
gccagaaaacatggtgccagaaaatagcaatgctggtgtctgcatttgctgccaagatttgatccggcgtcagct

SEQ ID NO: 304685 - DNA, 75 bp, Artificial Sequence
  Synthetic
tagcaatgctggtgtctgcatttgctgccaagatttgatccggcgtcagcttccaaaggaagtgcttcgtaaggt

SEQ ID NO: 304686 - DNA, 75 bp, Artificial Sequence
  Synthetic
ggcaattgtcgtgatggattcaactgccttagtcgaatctgctaaaaccaacattcatggagttgactcaaaaac

SEQ ID NO: 304687 - DNA, 75 bp, Artificial Sequence
  Synthetic
gccttagtcgaatctgctaaaaccaacattcatggagttgactcaaaaacggagaagcaaactatatttgatcaa

SEQ ID NO: 304688 - DNA, 75 bp, Artificial Sequence
  Synthetic
acattcatggagttgactcaaaaacggagaagcaaactatatttgatcaactgatatcagatataaagagtcaga

SEQ ID NO: 304689 - DNA, 75 bp, Artificial Sequence
  Synthetic
acttccagatttactacaactggctgaaattaatggactaacgtttgagtacaaaccaaaggaaaagttaagtat

SEQ ID NO: 304690 - DNA, 75 bp, Artificial Sequence
  Synthetic
gaaattaatggactaacgtttgagtacaaaccaaaggaaaagttaagtatcatggatcgtccagatccaacgtct

SEQ ID NO: 304691 - DNA, 75 bp, Artificial Sequence
  Synthetic
ttagaacaattttatcgaaaacgctattcgttgatgtcgaaaatgaagattattcagtatatatccctaatgaaa

SEQ ID NO: 304692 - DNA, 75 bp, Artificial Sequence
  Synthetic
attcgttgatgtcgaaaatgaagattattcagtatatatccctaatgaaacgacgaaattgactcctgtgtcaat

SEQ ID NO: 304693 - DNA, 75 bp, Artificial Sequence
  Synthetic
catcctaaagctttgatgtacaaagacactgcgattcttccctctcatagagatgagatatcagatcaatatggt

SEQ ID NO: 304694 - DNA, 75 bp, Artificial Sequence
  Synthetic
acactgcgattcttccctctcatagagatgagatatcagatcaatatggtactgatgagatattatttgattctc

SEQ ID NO: 304695 - DNA, 75 bp, Artificial Sequence
  Synthetic
tcaaatacgagattttgacacgtacatattagataaatcaattcaaattcaaaacacgctaccaaatttagagtt

SEQ ID NO: 304696 - DNA, 75 bp, Artificial Sequence
  Synthetic
atattagataaatcaattcaaattcaaaacacgctaccaaatttagagtttatttccgcactggaaaaagaagtg

SEQ ID NO: 304697 - DNA, 75 bp, Artificial Sequence
  Synthetic
tatgtcttaatttcggtcaaaaagagtattacaacataattgcagatcgtacgaatctttctttccaacagagga

SEQ ID NO: 304698 - DNA, 75 bp, Artificial Sequence
  Synthetic
gtattacaacataattgcagatcgtacgaatctttctttccaacagaggagacattcagttcaatttgacaatgt

SEQ ID NO: 304699 - DNA, 75 bp, Artificial Sequence
  Synthetic
gccagggtttcactacgacttcatccatttgacagccaactgttagacatagtaagatttaacgttatccaagac

SEQ ID NO: 304700 - DNA, 75 bp, Artificial Sequence
  Synthetic
catttgacagccaactgttagacatagtaagatttaacgttatccaagaccagcccttggctgacattttaatgg

SEQ ID NO: 304701 - DNA, 75 bp, Artificial Sequence
  Synthetic
atttgtcgccactccaaaatttcgtgttgaccgtgacgccagactaatcgcagatgtaagatctccagtcatggc

SEQ ID NO: 304702 - DNA, 75 bp, Artificial Sequence
  Synthetic
gttgaccgtgacgccagactaatcgcagatgtaagatctccagtcatggctagattgtgcgaattgtcgccatat

SEQ ID NO: 304703 - DNA, 75 bp, Artificial Sequence
  Synthetic
caatgaccgattttacaccactatggaaagtcaatgttttctcaagttctatagataacgctaaagatgcaattt

SEQ ID NO: 304704 - DNA, 75 bp, Artificial Sequence
  Synthetic
gaaagtcaatgttttctcaagttctatagataacgctaaagatgcaatttatcgcatggctgaaatttcttttac

SEQ ID NO: 304705 - DNA, 75 bp, Artificial Sequence
  Synthetic
cttgcgtctgtgaatgtagcctccgctcagcagactcttttgacattactgaatttgtccctttttcgtttcgaa

SEQ ID NO: 304706 - DNA, 75 bp, Artificial Sequence
  Synthetic
ctcagcagactcttttgacattactgaatttgtccctttttcgtttcgaaattgatccgaccggaagccaatcaa

SEQ ID NO: 304707 - DNA, 75 bp, Artificial Sequence
  Synthetic
tctaatgctgatcgtatttccaactgatgagcaatcaatgtctaatatcacttttgacaatttgtgtaatttggt

SEQ ID NO: 304708 - DNA, 75 bp, Artificial Sequence
  Synthetic
gatgagcaatcaatgtctaatatcacttttgacaatttgtgtaatttggtattcaatgagttgattgcttggacc

SEQ ID NO: 304709 - DNA, 75 bp, Artificial Sequence
  Synthetic
gaactggtatgacaaacgctttcgaagcgaatgtgaatattggtggtggtaatatgactagagacataattgcgt

SEQ ID NO: 304710 - DNA, 75 bp, Artificial Sequence
  Synthetic
agcgaatgtgaatattggtggtggtaatatgactagagacataattgcgtacatgaggtttgtgttactacgcag

SEQ ID NO: 304711 - DNA, 75 bp, Artificial Sequence
  Synthetic
tatgatgatagatacgtgtctgacattatggtgccaaatatcgatgaagccaacgtcaatgatcaatgctacgtc

SEQ ID NO: 304712 - DNA, 75 bp, Artificial Sequence
  Synthetic
ttatggtgccaaatatcgatgaagccaacgtcaatgatcaatgctacgtcgccattaacaacctgtttaatggat

SEQ ID NO: 304713 - DNA, 75 bp, Artificial Sequence
  Synthetic
caacccaggacggcagatagctgccacttcttttaggaaattgctgaaatctatgaaggattcatgttgtaatag

SEQ ID NO: 304714 - DNA, 75 bp, Artificial Sequence
  Synthetic
acttcttttaggaaattgctgaaatctatgaaggattcatgttgtaataggatgataccattaatcagattatta

SEQ ID NO: 304715 - DNA, 75 bp, Artificial Sequence
  Synthetic
gtgtatacaggttttttccatatacagctgatttagtacacatcattcctgcttttagagatgagagactaagag

SEQ ID NO: 304716 - DNA, 75 bp, Artificial Sequence
  Synthetic
agctgatttagtacacatcattcctgcttttagagatgagagactaagagtgaaagttccagtgtctggaatgtt

SEQ ID NO: 304717 - DNA, 75 bp, Artificial Sequence
  Synthetic
gctccagattccttcgattggtacaatttgcttaaatttgctgatgttgtaagaactaagaacttcgcggaacga

SEQ ID NO: 304718 - DNA, 75 bp, Artificial Sequence
  Synthetic
atttgcttaaatttgctgatgttgtaagaactaagaacttcgcggaacgacaatctctagaatcaattatggtgc

SEQ ID NO: 304719 - DNA, 75 bp, Artificial Sequence
  Synthetic
tcccgcgcgatcaaaaaaagactatatacagcaaaatatcaaaccagcaacgaacgttgtcgcatcactgtctaa

SEQ ID NO: 304720 - DNA, 75 bp, Artificial Sequence
  Synthetic
atacagcaaaatatcaaaccagcaacgaacgttgtcgcatcactgtctaaattgccatcagcaacattcacaaca

SEQ ID NO: 304721 - DNA, 75 bp, Artificial Sequence
  Synthetic
atgagataaggcgaactcagagctatgtggttacaaatcgtattcgtgatgctgtcagagctgcatttgaacacg

SEQ ID NO: 304722 - DNA, 75 bp, Artificial Sequence
  Synthetic
tgtggttacaaatcgtattcgtgatgctgtcagagctgcatttgaacacgtgccaacagctgaacatgggatcgc

SEQ ID NO: 304723 - DNA, 75 bp, Artificial Sequence
  Synthetic
ccgcaaaattttcaacgatcctcagtgtatgttaggaaagataacatattgtacgatcctccagttggagttgat

SEQ ID NO: 304724 - DNA, 75 bp, Artificial Sequence
  Synthetic
tgtatgttaggaaagataacatattgtacgatcctccagttggagttgatagattcaatctaagtgacctactgg

SEQ ID NO: 304725 - DNA, 75 bp, Artificial Sequence
  Synthetic
taaccgagtgcaaaacatggcgccgtttgttatatcgggaccattgcaagtaaagccatccgatgcatctgcgat

SEQ ID NO: 304726 - DNA, 75 bp, Artificial Sequence
  Synthetic
tttgttatatcgggaccattgcaagtaaagccatccgatgcatctgcgattgaatctgttacatctgcctacctt

SEQ ID NO: 304727 - DNA, 75 bp, Artificial Sequence
  Synthetic
gcgtgagaccagaggatttacgacataaccgagttgtccacccacctaccgttgattattttagtgatgctagta

SEQ ID NO: 304728 - DNA, 75 bp, Artificial Sequence
  Synthetic
taaccgagttgtccacccacctaccgttgattattttagtgatgctagtattgctagacctaatacacaatttga

SEQ ID NO: 304729 - DNA, 75 bp, Artificial Sequence
  Synthetic
tttgttattgacgctccaagacttatagttcaaaatgacgctactgtatacacattcgactacaaagacattcaa

SEQ ID NO: 304730 - DNA, 75 bp, Artificial Sequence
  Synthetic
tagaatttacctcagttaaaacgccagacgttactctatttaatggaatgttggtttatgaagattaagtagttg

SEQ ID NO: 304731 - DNA, 75 bp, Artificial Sequence
  Synthetic
gccagacgttactctatttaatggaatgttggtttatgaagattaagtagttgtgacatgatattttaaaaaccc

SEQ ID NO: 304732 - DNA, 75 bp, Artificial Sequence
  Synthetic
ggtacattatgtccaagctcattgagttttcagatcttggcgctgagatctcaaatagagaagaccttttcaaac

SEQ ID NO: 304733 - DNA, 75 bp, Artificial Sequence
  Synthetic
gttttcagatcttggcgctgagatctcaaatagagaagaccttttcaaactgtctaatgacacatcatcttttaa

SEQ ID NO: 304734 - DNA, 75 bp, Artificial Sequence
  Synthetic
aaagattacattggaaccagtacgcattacgtagttttagatagaagagataatgatgaaactgccgatgttctt

SEQ ID NO: 304735 - DNA, 75 bp, Artificial Sequence
  Synthetic
attacgtagttttagatagaagagataatgatgaaactgccgatgttcttactacattgtttcctacttcagtta

SEQ ID NO: 304736 - DNA, 75 bp, Artificial Sequence
  Synthetic
aataatactcttcatattagcgatggcatgttcagttacggtgttaatagcatacaaaattggattcctcgtggg

SEQ ID NO: 304737 - DNA, 75 bp, Artificial Sequence
  Synthetic
ttgatgatcatgtaggtgattatattatcaaattattggtcgactcttgttcatctcaaaccatccgtgaaatga

SEQ ID NO: 304738 - DNA, 75 bp, Artificial Sequence
  Synthetic
tcatctcaaaccatccgtgaaatgaataaaatgagaccaggaacatatcccaggatggagcgtgttgaggaagaa

SEQ ID NO: 304739 - DNA, 75 bp, Artificial Sequence
  Synthetic
ctactcctcagaaagagattgattttcaatcgtacaactatgctgttcaaagacgacaaataggatatgttgtga

SEQ ID NO: 304740 - DNA, 75 bp, Artificial Sequence
  Synthetic
aagagatcataaatcttcttacagataaaaattacacagggaaatttattacattcacatttaattcgtcaaaaa

SEQ ID NO: 304741 - DNA, 75 bp, Artificial Sequence
  Synthetic
agaatatttaaacaaaaaagcaggttggaattatgtacatagaatgcgtcataagtatgaaaatgccttctgtca

SEQ ID NO: 304742 - DNA, 75 bp, Artificial Sequence
  Synthetic
tttaatttataatcatgtagcgaaacagagatcttactcaactatatacgttaacaccctctacaatgttggaaa

SEQ ID NO: 304743 - DNA, 75 bp, Artificial Sequence
  Synthetic
aatcagacttagtagtatactctccttccccatatgatgatgattcaaacgtgtggacagtatcgatcatgggga

SEQ ID NO: 304744 - DNA, 75 bp, Artificial Sequence
  Synthetic
ttccccatatgatgatgattcaaacgtgtggacagtatcgatcatggggaataagttgggtacaacttacaatga

SEQ ID NO: 304745 - DNA, 75 bp, Artificial Sequence
  Synthetic
aataatttaccaaattatgttttcggtggtgtaccatttaccgctgcggctttgaaattcgattatataaatatt

SEQ ID NO: 304746 - DNA, 75 bp, Artificial Sequence
  Synthetic
taaactccccagaactaatcaaggcaactttatcttatgaccacatttttacattcccatcatactcaaaaggag

SEQ ID NO: 304747 - DNA, 75 bp, Artificial Sequence
  Synthetic
aactttatcttatgaccacatttttacattcccatcatactcaaaaggagattggagagatgaaagagcgacaac

SEQ ID NO: 304748 - DNA, 75 bp, Artificial Sequence
  Synthetic
acattcccatcatactcaaaaggagattggagagatgaaagagcgacaacggatgacatcttcgttacaactgag

SEQ ID NO: 304749 - DNA, 75 bp, Artificial Sequence
  Synthetic
taatcgatgctaaaaatttgtcgcttgagatggatgttgaagttgtttctgaagctgttttcctacaatttggca

SEQ ID NO: 304750 - DNA, 75 bp, Artificial Sequence
  Synthetic
gaagctgttttcctacaatttggcaaacacagagcttttatatctgatatgtatcagcatttaatttcattcaga

SEQ ID NO: 304751 - DNA, 75 bp, Artificial Sequence
  Synthetic
atcagaaattttcacattttggtatacgtcaaccatccatatataatagagatatctatctctcttccaggttga

SEQ ID NO: 304752 - DNA, 75 bp, Artificial Sequence
  Synthetic
attgagtaccgacttatcattaattaagcaaaataattttgaaggattttctggacatttaattgctgttgaaaa

SEQ ID NO: 304753 - DNA, 75 bp, Artificial Sequence
  Synthetic
atgtcaccaatgagatgggccaaacgagcactatccgatgctatctattcaaaaactgattctttttccaacgct

SEQ ID NO: 304754 - DNA, 75 bp, Artificial Sequence
  Synthetic
gagcactatccgatgctatctattcaaaaactgattctttttccaacgctatcggtgatcgacattctttacatg

SEQ ID NO: 304755 - DNA, 75 bp, Artificial Sequence
  Synthetic
gggagatacgatcaaccccatattcaggtccaatttagttaccaacaaatttgctgatgatccgaaattcgctat

SEQ ID NO: 304756 - DNA, 75 bp, Artificial Sequence
  Synthetic
attacattacaattgaccactaaaaatccgcagattgcactacaggatattggaaatactattcatggaatggta

SEQ ID NO: 304757 - DNA, 75 bp, Artificial Sequence
  Synthetic
atccgcagattgcactacaggatattggaaatactattcatggaatggtaattaaaaaactagacaagaatgatt

SEQ ID NO: 304758 - DNA, 75 bp, Artificial Sequence
  Synthetic
tggaaatactattcatggaatggtaattaaaaaactagacaagaatgatttcggcaacattaaggtgattctata

SEQ ID NO: 304759 - DNA, 75 bp, Artificial Sequence
  Synthetic
aaaatctgtaatatacttcgttcaatggatattccgtgtcagcaacatcgaccatacattatgcatatgacagtc

SEQ ID NO: 304760 - DNA, 75 bp, Artificial Sequence
  Synthetic
taatcataattaacaggaatgatttaattatcaaagaaatcaagcgctgagcggacataccaagctgaatcagcg

SEQ ID NO: 304761 - DNA, 75 bp, Artificial Sequence
  Synthetic
ggtttaaatagcccaaccggtgattcaagcatggatctgatcgagacagtgaacgcatgcgtaaaattgcaaaag

SEQ ID NO: 304762 - DNA, 75 bp, Artificial Sequence
  Synthetic
gaacgcatgcgtaaaattgcaaaagcgagtacttggtttggctccaaatacgaatctcaatacagctggacaaag

SEQ ID NO: 304763 - DNA, 75 bp, Artificial Sequence
  Synthetic
cgaatctcaatacagctggacaaagcgtattaaatgattacaacgcactggcttctcgagtaaacgggaaaacgt

SEQ ID NO: 304764 - DNA, 75 bp, Artificial Sequence
  Synthetic
ttacactccttataccataaatgcgccaattatatctttggctgtacgaatctctaccgatgattacgatgatat

SEQ ID NO: 304765 - DNA, 75 bp, Artificial Sequence
  Synthetic
ccaattatatctttggctgtacgaatctctaccgatgattacgatgatatgcgatctgggattgaatctatctta

SEQ ID NO: 304766 - DNA, 75 bp, Artificial Sequence
  Synthetic
ctgaaggatcacgacctacacgagtaattgaaagacgtgttttagaaccaaatgtaaaacaattaattgacgatt

SEQ ID NO: 304767 - DNA, 75 bp, Artificial Sequence
  Synthetic
tttatcaatagcaaatttagccgccgtcgacactgcaatgatacaacctgaagtgattgaaactgaaaatcctct

SEQ ID NO: 304768 - DNA, 75 bp, Artificial Sequence
  Synthetic
ttatgcagatataatcgaacaggtagttcatagaccgaatataggtatgactggtggaaatattagagctactct

SEQ ID NO: 304769 - DNA, 75 bp, Artificial Sequence
  Synthetic
gttgtaacctgtatgtcaggtatggattctgaacatagatttacagtggaactcaaaacacgcacttgtggaata

SEQ ID NO: 304770 - DNA, 75 bp, Artificial Sequence
  Synthetic
attctgaacatagatttacagtggaactcaaaacacgcacttgtggaataattaacatcgtctacattcccacat

SEQ ID NO: 304771 - DNA, 75 bp, Artificial Sequence
  Synthetic
caccggtaggaatagagaaggtgatttgatagacgtgtcagctgaaatgatggcagatgattttgctatagattt

SEQ ID NO: 304772 - DNA, 75 bp, Artificial Sequence
  Synthetic
cggtgcatatggttaattgggctcaagggactgctccgaagcagccagctatatctttcatgtttgaaactcgtc

SEQ ID NO: 304773 - DNA, 75 bp, Artificial Sequence
  Synthetic
agggactgctccgaagcagccagctatatctttcatgtttgaaactcgtcggacgttcacggaaggagattacca

SEQ ID NO: 304774 - DNA, 75 bp, Artificial Sequence
  Synthetic
gcacaatacatgatggacacgcagttcaatgacgtttcttttacaaatagaccagctgtagactggaacattcaa

SEQ ID NO: 304775 - DNA, 75 bp, Artificial Sequence
  Synthetic
tcaatgacgtttcttttacaaatagaccagctgtagactggaacattcaaagtctactcacgtcaaatactcagc

SEQ ID NO: 304776 - DNA, 75 bp, Artificial Sequence
  Synthetic
gcttatcgcctcgttcgctgctaagatctagatcgacaccggattccaaaaagggattgcttcgaaaggtgcgaa

SEQ ID NO: 304777 - DNA, 75 bp, Artificial Sequence
  Synthetic
ggtagaaattaatctattcagtgtgtcgtgagagggctccatcaccctggtcaccatgacgcagtcagtttctct

SEQ ID NO: 304778 - DNA, 75 bp, Artificial Sequence
  Synthetic
tcgtgagagggctccatcaccctggtcaccatgacgcagtcagtttctctttctgatttcatcgttaagactgaa

SEQ ID NO: 304779 - DNA, 75 bp, Artificial Sequence
  Synthetic
tcaccatgacgcagtcagtttctctttctgatttcatcgttaagactgaagatggatatatgccatcagacagag

SEQ ID NO: 304780 - DNA, 75 bp, Artificial Sequence
  Synthetic
ttctgatttcatcgttaagactgaagatggatatatgccatcagacagagaatgtgttgcattggatagatattt

SEQ ID NO: 304781 - DNA, 75 bp, Artificial Sequence
  Synthetic
gaaacttttaaggatggaaaaaatgatagatcagctttaagaattaaaatgtttttatctccttcaccttccaga

SEQ ID NO: 304782 - DNA, 75 bp, Artificial Sequence
  Synthetic
atagatcagctttaagaattaaaatgtttttatctccttcaccttccagacgattcactcaacatggagttgttc

SEQ ID NO: 304783 - DNA, 75 bp, Artificial Sequence
  Synthetic
ggatataccaagtacactatggactcttgtgactgattggttactaaatttacttcaagatgaagaaaatcagga

SEQ ID NO: 304784 - DNA, 75 bp, Artificial Sequence
  Synthetic
cttgtgactgattggttactaaatttacttcaagatgaagaaaatcaggaaatgtttgaagattttattagttca

SEQ ID NO: 304785 - DNA, 75 bp, Artificial Sequence
  Synthetic
ccactgatgattcaatgatactagagtttcagccaataccagaatattttcgttgtggaagatcaaaagctacat

SEQ ID NO: 304786 - DNA, 75 bp, Artificial Sequence
  Synthetic
cgaacaacccgttaatggcatgctcgctctaaaagcagttgctggaaatcagttttttatgtaccatggacatgg

SEQ ID NO: 304787 - DNA, 75 bp, Artificial Sequence
  Synthetic
gctctaaaagcagttgctggaaatcagttttttatgtaccatggacatgggcacatcagaacagttccatatcat

SEQ ID NO: 304788 - DNA, 75 bp, Artificial Sequence
  Synthetic
gcacatcagaacagttccatatcatgaacttgctgatgccatcaaatcattcgctcgtaaagataaagaaacgct

SEQ ID NO: 304789 - DNA, 75 bp, Artificial Sequence
  Synthetic
gcagctcaatgtggtagtaaatttctcgatatgctcgatggaattagatcaaaacaaaaaattgaagatgtgatt

SEQ ID NO: 304790 - DNA, 75 bp, Artificial Sequence
  Synthetic
ttgaaagcaaaaatttttgaaaagaaaagaagctgaacgtgttaaatccgctgaaatgggttaacggctattttt

SEQ ID NO: 304791 - DNA, 75 bp, Artificial Sequence
  Synthetic
ggtataattagattgtcagtatccaggttcgggaaacctatgggaaacagacagtctagtgctcagttgaattcg

SEQ ID NO: 304792 - DNA, 75 bp, Artificial Sequence
  Synthetic
ggttcgggaaacctatgggaaacagacagtctagtgctcagttgaattcgcatttaactcacatcaactctcaga

SEQ ID NO: 304793 - DNA, 75 bp, Artificial Sequence
  Synthetic
acagtctagtgctcagttgaattcgcatttaactcacatcaactctcagaattcaaatctttttatttcagacag

SEQ ID NO: 304794 - DNA, 75 bp, Artificial Sequence
  Synthetic
catattttattagctgctggcgttggaataatcgctaccttgttagtcttattactttgtagttgtgtgttaaac

SEQ ID NO: 304795 - DNA, 75 bp, Artificial Sequence
  Synthetic
gaataatcgctaccttgttagtcttattactttgtagttgtgtgttaaactgttatctttgcagaaaactaaaaa

SEQ ID NO: 304796 - DNA, 75 bp, Artificial Sequence
  Synthetic
tgagcgaaatatcagacaaaacggatcttctgccaaaatatatgttaaaccagtcatgcaatccagcacaatcat

SEQ ID NO: 304797 - DNA, 75 bp, Artificial Sequence
  Synthetic
tcttctgccaaaatatatgttaaaccagtcatgcaatccagcacaatcatcgaagaagcctgagaaaatatcatt

SEQ ID NO: 304798 - DNA, 75 bp, Artificial Sequence
  Synthetic
gaatgtcctgaaatgcccggtgattcaattttaattagcgatatttgtccacttaatcatgaacatttttgtggt

SEQ ID NO: 304799 - DNA, 75 bp, Artificial Sequence
  Synthetic
caattttaattagcgatatttgtccacttaatcatgaacatttttgtggtggtatacacatacctaaacaagaga

SEQ ID NO: 304800 - DNA, 75 bp, Artificial Sequence
  Synthetic
acacgccgcagcagataagataatatggccttgtggactaaaatcaatgaaaatcaatgacagaaaaattgaagg

SEQ ID NO: 304801 - DNA, 75 bp, Artificial Sequence
  Synthetic
tggccttgtggactaaaatcaatgaaaatcaatgacagaaaaattgaaggctatacattcgtcaaatgtcgttgc

SEQ ID NO: 304802 - DNA, 75 bp, Artificial Sequence
  Synthetic
ctggagagagaaacttcttttttatcacatgttgtgccaatgacaccgctgcagttaagttgggaaagactgatg

SEQ ID NO: 304803 - DNA, 75 bp, Artificial Sequence
  Synthetic
cacatgttgtgccaatgacaccgctgcagttaagttgggaaagactgatggagacaaatgtcaaaactgttcaaa

SEQ ID NO: 304804 - DNA, 75 bp, Artificial Sequence
  Synthetic
ctaggatttaactcagatgtaagtcaatataaaacgcgattcttctgtcctgcatgtactccaattcgcgactta

SEQ ID NO: 304805 - DNA, 75 bp, Artificial Sequence
  Synthetic
aatataaaacgcgattcttctgtcctgcatgtactccaattcgcgacttagtatcaaatatgactagatttgggt

SEQ ID NO: 304806 - DNA, 75 bp, Artificial Sequence
  Synthetic
tactgatatgctaaaaaattatgagtggaaaaggaatcttacaaacaatagtgaaatcgcgtttcgcgcccttaa

SEQ ID NO: 304807 - DNA, 75 bp, Artificial Sequence
  Synthetic
tggaaaaggaatcttacaaacaatagtgaaatcgcgtttcgcgcccttaattcgccttttattcagacttccata

SEQ ID NO: 304808 - DNA, 75 bp, Artificial Sequence
  Synthetic
acgtgaattcaatgacagttaccgagcttgttgcttcagtgaatagaacatggaatactgaatttaagataattc

SEQ ID NO: 304809 - DNA, 75 bp, Artificial Sequence
  Synthetic
gcttgttgcttcagtgaatagaacatggaatactgaatttaagataattccaattaaccgcacgaaagtgctttt

SEQ ID NO: 304810 - DNA, 75 bp, Artificial Sequence
  Synthetic
atcatatttcatgacaacgatcatttacataatcaaatactattgacattaactgactggcatttcctatagact

SEQ ID NO: 304811 - DNA, 75 bp, Artificial Sequence
  Synthetic
aactgactggcatttcctatagactgatggttccagacatctaacctatcctcactacatatctaaataaaaacc

SEQ ID NO: 304812 - DNA, 75 bp, Artificial Sequence
  Synthetic
ggtataattacgtttgattcagatagtacttcgggttactgagaaacgaacgtaatggccctggacgcgctagct

SEQ ID NO: 304813 - DNA, 75 bp, Artificial Sequence
  Synthetic
aataacaaccaagtttgaagaagcactcgatgattgcgggatgaaggtggacgactggagagaggcatattataa

SEQ ID NO: 304814 - DNA, 75 bp, Artificial Sequence
  Synthetic
ggtgcagatcgcaaattcagattgttgtctagttttgaaattggaaataaagatgggcatactattctagttcca

SEQ ID NO: 304815 - DNA, 75 bp, Artificial Sequence
  Synthetic
agatgggcatactattctagttccaaagacgagaaatgctgaaatactcctagttaactctacatcagatttaaa

SEQ ID NO: 304816 - DNA, 75 bp, Artificial Sequence
  Synthetic
gttactagattggttgaagagaatgaacaattgcgtaaacaaattaaacatttaagagaacaacaaacttctaaa

SEQ ID NO: 304817 - DNA, 75 bp, Artificial Sequence
  Synthetic
attggtcgaaagagaaaaagaaacggttaataaaatgtttctcgagtgtagcagaattaatcagaggttaaaaaa

SEQ ID NO: 304818 - DNA, 75 bp, Artificial Sequence
  Synthetic
gttaataaaatgtttctcgagtgtagcagaattaatcagaggttaaaaaaacagattcagatgtgtgaagaagaa

SEQ ID NO: 304819 - DNA, 75 bp, Artificial Sequence
  Synthetic
actctcatcatagagaggagactttaatcatgaaacgagaaatttacagattgcaaatggagaacgtgacattaa

SEQ ID NO: 304820 - DNA, 75 bp, Artificial Sequence
  Synthetic
atacgaggactggccaatagagctggactagttgtcgatgaagtagattcaggtaatgagacgtctgaccagtca

SEQ ID NO: 304821 - DNA, 75 bp, Artificial Sequence
  Synthetic
catgatgaatccaggggaggacgaacggattcctagaggaggcgaaaatcctagaagacaggccagaatgttaga

SEQ ID NO: 304822 - DNA, 75 bp, Artificial Sequence
  Synthetic
ctctttttcctttatttgtagacgcgacgcttgaccagggataagtatttggattgaccaaccaaagtaataaaa

SEQ ID NO: 304823 - DNA, 75 bp, Artificial Sequence
  Synthetic
ggcaataaaatggcttcattgccgcttctcgtccttgctgctgcggtcaatgctcaactcaacattgttccttct

SEQ ID NO: 304824 - DNA, 75 bp, Artificial Sequence
  Synthetic
ttctcgtccttgctgctgcggtcaatgctcaactcaacattgttccttctgtacatcctgaagtgtgtgtgcttt

SEQ ID NO: 304825 - DNA, 75 bp, Artificial Sequence
  Synthetic
atgctgatgaccatcaatctgatgcgaataagtttaatggtaattttactcaaatattccattcatataactcaa

SEQ ID NO: 304826 - DNA, 75 bp, Artificial Sequence
  Synthetic
gttttccttcagtccactaacaattgttcaaaatataacgctaataagattcaccatatcaaattgcctcgtgga

SEQ ID NO: 304827 - DNA, 75 bp, Artificial Sequence
  Synthetic
actcaactttctgatacatacttcgaaatatccactggcggaacgtacgaagttacagacgtacctgaattcact

SEQ ID NO: 304828 - DNA, 75 bp, Artificial Sequence
  Synthetic
aaatatccactggcggaacgtacgaagttacagacgtacctgaattcactcagatgggatacacattccattcaa

SEQ ID NO: 304829 - DNA, 75 bp, Artificial Sequence
  Synthetic
aatttctagtgaagcttggttgaactatcatttattttatagagattatgatgtatctggagtcataagtaaaca

SEQ ID NO: 304830 - DNA, 75 bp, Artificial Sequence
  Synthetic
ggttttaaaacctttgcgcaagttttatacaaaatattagatctattttttaacagtaagagaaacgttgaaccg

SEQ ID NO: 304831 - DNA, 75 bp, Artificial Sequence
  Synthetic
taacagtaagagaaacgttgaaccgcgtgcataaagaggactaggtgaaagggagggaaccaaacgactagccga

SEQ ID NO: 304832 - DNA, 75 bp, Artificial Sequence
  Synthetic
ggcaattaaaagtccagttatggcggaaagtagtaatatgcaagatttatttgtgcaagcgacatacgaggagat

SEQ ID NO: 304833 - DNA, 75 bp, Artificial Sequence
  Synthetic
ttgtgcaagcgacatacgaggagattctaaaattggctggcagcgttaatcatgaacagattagagaaaccatat

SEQ ID NO: 304834 - DNA, 75 bp, Artificial Sequence
  Synthetic
tctaaaattggctggcagcgttaatcatgaacagattagagaaaccatatcatcttcatcaccgcagaagatatt

SEQ ID NO: 304835 - DNA, 75 bp, Artificial Sequence
  Synthetic
gcgttgttaactactttaatagtgaagaaaaaaggaacaaaattcctaactacaaaaatgcagtcgaatattgta

SEQ ID NO: 304836 - DNA, 75 bp, Artificial Sequence
  Synthetic
aagcaaatcaaactgtgaaaacaatttgtgatgaagttcttcatcaacgaaaagttattgaaaaactacaatgtt

SEQ ID NO: 304837 - DNA, 75 bp, Artificial Sequence
  Synthetic
ttgtgatgaagttcttcatcaacgaaaagttattgaaaaactacaatgtttagataagatgtgcttagaaattga

SEQ ID NO: 304838 - DNA, 75 bp, Artificial Sequence
  Synthetic
tagataagatgtgcttagaaattgaaaaactacgttatgacatagagcgtttccaagggatggacgtaactaaag

SEQ ID NO: 304839 - DNA, 75 bp, Artificial Sequence
  Synthetic
aatgattgacatagacagcaaagttaaagaggtggagaagtcatgcgacagacgtatacgcgattatgattggaa

SEQ ID NO: 304840 - DNA, 75 bp, Artificial Sequence
  Synthetic
gacgtatacgcgattatgattggaaaatcgccacactaactgctcatccaacacaacaatttccaactcatatag

SEQ ID NO: 304841 - DNA, 75 bp, Artificial Sequence
  Synthetic
cgatgctgagactcaaatcatacagcaacatatgaataaacaggcaagagtaaaattaaattcgcgtaacagact

SEQ ID NO: 304842 - DNA, 75 bp, Artificial Sequence
  Synthetic
ttaggatctgtgaagcagctaggagacgatctctctgtagttgcttctccccaactgatcaaactgataaggacc

SEQ ID NO: 304843 - DNA, 75 bp, Artificial Sequence
  Synthetic
ggcacaatatggactcctttcaatttttcagttggttactgaaggatattgaaaggaatctactgtacaccagtt

SEQ ID NO: 304844 - DNA, 75 bp, Artificial Sequence
  Synthetic
tttcagttggttactgaaggatattgaaaggaatctactgtacaccagtttggtatatacaagtccaagaattgc

SEQ ID NO: 304845 - DNA, 75 bp, Artificial Sequence
  Synthetic
gaaaggaatctactgtacaccagtttggtatatacaagtccaagaattgcaatagttcgatatgaagaaagtgaa

SEQ ID NO: 304846 - DNA, 75 bp, Artificial Sequence
  Synthetic
aaactaacgttttatctccagaggaaattctgagcaagatcaaagataagctagattctttatcatgtattcatg

SEQ ID NO: 304847 - DNA, 75 bp, Artificial Sequence
  Synthetic
aattctgagcaagatcaaagataagctagattctttatcatgtattcatgacaaaattgaagaactgttacgcat

SEQ ID NO: 304848 - DNA, 75 bp, Artificial Sequence
  Synthetic
gacaaatctgataagaggaacataattttaacctggttgagcagaactataacagacttggggaaacatgttgag

SEQ ID NO: 304849 - DNA, 75 bp, Artificial Sequence
  Synthetic
ttttaacctggttgagcagaactataacagacttggggaaacatgttgagtatgattctatcaagttgattgagc

SEQ ID NO: 304850 - DNA, 75 bp, Artificial Sequence
  Synthetic
taatgctaacttcctacgaccttatcattataatattccaattaatgaatatcttcgagataacgaaattgagtt

SEQ ID NO: 304851 - DNA, 75 bp, Artificial Sequence
  Synthetic
cattataatattccaattaatgaatatcttcgagataacgaaattgagttgttagacactggtgataataaatgg

SEQ ID NO: 304852 - DNA, 75 bp, Artificial Sequence
  Synthetic
tccctaatttctatcatcgtacgcatactctagtgggatctattctttatgcaattaattccagactggacaaat

SEQ ID NO: 304853 - DNA, 75 bp, Artificial Sequence
  Synthetic
tactctagtgggatctattctttatgcaattaattccagactggacaaatattctactgatcaaaagcgtgcttt

SEQ ID NO: 304854 - DNA, 75 bp, Artificial Sequence
  Synthetic
aaatgcttttctgaaggttatctcgagatgtctagagatagaaaatggaatcatacattggatgagttgagaaac

SEQ ID NO: 304855 - DNA, 75 bp, Artificial Sequence
  Synthetic
agatgtctagagatagaaaatggaatcatacattggatgagttgagaaactcaagatttcatttatacaacgcaa

SEQ ID NO: 304856 - DNA, 75 bp, Artificial Sequence
  Synthetic
gatttcgttagctcattctgatcacattgatttggagttcctatgtcaaatcattaccgtgtatagcataattcc

SEQ ID NO: 304857 - DNA, 75 bp, Artificial Sequence
  Synthetic
attgatttggagttcctatgtcaaatcattaccgtgtatagcataattccagctaacgcagcaaaattactttcg

SEQ ID NO: 304858 - DNA, 75 bp, Artificial Sequence
  Synthetic
tcgtgacttttagctcgcatcaagtggcatcaactggtaacgcctccgaatgctctcctactactattcaaaaca

SEQ ID NO: 304859 - DNA, 75 bp, Artificial Sequence
  Synthetic
ggcatcaactggtaacgcctccgaatgctctcctactactattcaaaacaacgtttacgttgacaaagctcaata

SEQ ID NO: 304860 - DNA, 75 bp, Artificial Sequence
  Synthetic
tctgaccctcttaatgcctctaaattattacgtctgatgaatagcaatctaaagacttcaattgaacaattttca

SEQ ID NO: 304861 - DNA, 75 bp, Artificial Sequence
  Synthetic
tattacgtctgatgaatagcaatctaaagacttcaattgaacaattttcactaatttttaattgtttttcagcta

SEQ ID NO: 304862 - DNA, 75 bp, Artificial Sequence
  Synthetic
taatgctcaagatgccataacagatcaggttacagctacatacacatcagacattgatcgagaaatgtatgataa

SEQ ID NO: 304863 - DNA, 75 bp, Artificial Sequence
  Synthetic
caggttacagctacatacacatcagacattgatcgagaaatgtatgataattactactataggttgaagaatatg

SEQ ID NO: 304864 - DNA, 75 bp, Artificial Sequence
  Synthetic
ttgaagatcatattgctaaacagtatgttgacgttacagccgaatccctttcagctttggccaattcatcaaatg

SEQ ID NO: 304865 - DNA, 75 bp, Artificial Sequence
  Synthetic
tgttgacgttacagccgaatccctttcagctttggccaattcatcaaatggattctctaaagaagtgacttttat

SEQ ID NO: 304866 - DNA, 75 bp, Artificial Sequence
  Synthetic
aaaattctgcacttagataatgatttgctagctgaagattacaatgatttaggaaaagcattatctcatggaata

SEQ ID NO: 304867 - DNA, 75 bp, Artificial Sequence
  Synthetic
tgctagctgaagattacaatgatttaggaaaagcattatctcatggaataccaatgggtacgagaaacgttcccg

SEQ ID NO: 304868 - DNA, 75 bp, Artificial Sequence
  Synthetic
tctcccatggcaggtggcggctatacaacacactatagctgagtcgttgtacaaacgagcaaagaagggttcgta

SEQ ID NO: 304869 - DNA, 75 bp, Artificial Sequence
  Synthetic
caacacactatagctgagtcgttgtacaaacgagcaaagaagggttcgtatcaagggtcattcgctgaagcttat

SEQ ID NO: 304870 - DNA, 75 bp, Artificial Sequence
  Synthetic
atggagtattagctgaggatacctctaaagctaccaaaatcatattatacactgatgtatctcagtgggacgcca

SEQ ID NO: 304871 - DNA, 75 bp, Artificial Sequence
  Synthetic
taaagctaccaaaatcatattatacactgatgtatctcagtgggacgccagtcaacataataccgaaccataccg

SEQ ID NO: 304872 - DNA, 75 bp, Artificial Sequence
  Synthetic
gaagcgagatctgaaatgaaatggctgtattctgatgagcctattgtattaaatatgaacgttcttgattcaatg

SEQ ID NO: 304873 - DNA, 75 bp, Artificial Sequence
  Synthetic
tgtattctgatgagcctattgtattaaatatgaacgttcttgattcaatgataaaaatccaagagtatcttttaa

SEQ ID NO: 304874 - DNA, 75 bp, Artificial Sequence
  Synthetic
aggctcacaacgtccactaaaaataataagatatcatggtgttgcatcgggtgaaaaaacaaccaaaataggcaa

SEQ ID NO: 304875 - DNA, 75 bp, Artificial Sequence
  Synthetic
ataagatatcatggtgttgcatcgggtgaaaaaacaaccaaaataggcaactcgttcgcaaatgtagcactaata

SEQ ID NO: 304876 - DNA, 75 bp, Artificial Sequence
  Synthetic
aagaaattccagatatagaagttacacatctaagagtagatggagacgataatgtagtgtcattaactacgtcat

SEQ ID NO: 304877 - DNA, 75 bp, Artificial Sequence
  Synthetic
acatctaagagtagatggagacgataatgtagtgtcattaactacgtcatgtcaaatatcaaagttgcaagaaac

SEQ ID NO: 304878 - DNA, 75 bp, Artificial Sequence
  Synthetic
aatgctagagttaaagcacttgcttcatatacaggtctagagatggcaaaaagattcatagtatgtggaaaaata

SEQ ID NO: 304879 - DNA, 75 bp, Artificial Sequence
  Synthetic
catatacaggtctagagatggcaaaaagattcatagtatgtggaaaaatattcgaaagaggggcaattcccattt

SEQ ID NO: 304880 - DNA, 75 bp, Artificial Sequence
  Synthetic
cgatgtgtcaatacaatccatgtgcggatcatccatttattcgtctgccgttaatgcgtaccgtgggtttggcga

SEQ ID NO: 304881 - DNA, 75 bp, Artificial Sequence
  Synthetic
ggatcatccatttattcgtctgccgttaatgcgtaccgtgggtttggcgattcatattttgcgttcatgcaagat

SEQ ID NO: 304882 - DNA, 75 bp, Artificial Sequence
  Synthetic
taaggataactggaagattaagggtgttgttgtcaccagtaactttgtatgcaactggtccgctcagctttgaaa

SEQ ID NO: 304883 - DNA, 75 bp, Artificial Sequence
  Synthetic
gttgttgtcaccagtaactttgtatgcaactggtccgctcagctttgaaataactcctcagggattaggaggcag

SEQ ID NO: 304884 - DNA, 75 bp, Artificial Sequence
  Synthetic
aaacttttcacattatttaagctgttaactcaaactgtatctgtttcagttactccagaagaaattaagaagtat

SEQ ID NO: 304885 - DNA, 75 bp, Artificial Sequence
  Synthetic
taactcaaactgtatctgtttcagttactccagaagaaattaagaagtattctaacacgcctcaatttaaaaaac

SEQ ID NO: 304886 - DNA, 75 bp, Artificial Sequence
  Synthetic
gcaaatgaagttacacactgaagctgcagcattgtcaagaataatgattgataaagaagaacaaaaaacattagg

SEQ ID NO: 304887 - DNA, 75 bp, Artificial Sequence
  Synthetic
gcagcattgtcaagaataatgattgataaagaagaacaaaaaacattaggagtgccaaatgttcagagtcaaaag

SEQ ID NO: 304888 - DNA, 75 bp, Artificial Sequence
  Synthetic
ttaacattctcggtgttccagaacagagtggtatatccccgaaagggtattacccagaagaactctattctctcg

SEQ ID NO: 304889 - DNA, 75 bp, Artificial Sequence
  Synthetic
gagtggtatatccccgaaagggtattacccagaagaactctattctctcgttgtcaaacattcaaccatcaaatt

SEQ ID NO: 304890 - DNA, 75 bp, Artificial Sequence
  Synthetic
atatatcgtgtaaataacaaagctgtagagttattacgtgcccaattgggggtaaggatatctgactcaaaacca

SEQ ID NO: 304891 - DNA, 75 bp, Artificial Sequence
  Synthetic
tagagttattacgtgcccaattgggggtaaggatatctgactcaaaaccaatcgccaaaccatccaatcatttgt

SEQ ID NO: 304892 - DNA, 75 bp, Artificial Sequence
  Synthetic
aatcaaactgtcacctagcgatttgttaaaacaatccagaaaatatgatttgtccacgtacaaaggtaagagaac

SEQ ID NO: 304893 - DNA, 75 bp, Artificial Sequence
  Synthetic
ttaaaacaatccagaaaatatgatttgtccacgtacaaaggtaagagaacatatctgcttgatctaggtctcaca

SEQ ID NO: 304894 - DNA, 75 bp, Artificial Sequence
  Synthetic
cttcaaaattactttttagagatcttttactatccaaatatgacgagctatattcgacgccaggatttggtgcca

SEQ ID NO: 304895 - DNA, 75 bp, Artificial Sequence
  Synthetic
tttactatccaaatatgacgagctatattcgacgccaggatttggtgccacacaactaacgacaatcccgttaaa

SEQ ID NO: 304896 - DNA, 75 bp, Artificial Sequence
  Synthetic
tccataagattgaatttaccttctcatttgtatgagattgtcatgttgttattgttatatgaatatgtacactat

SEQ ID NO: 304897 - DNA, 75 bp, Artificial Sequence
  Synthetic
atttgtatgagattgtcatgttgttattgttatatgaatatgtacactatgtattcatgtcccacaaaactttta

SEQ ID NO: 304898 - DNA, 75 bp, Artificial Sequence
  Synthetic
agaagaatctgcgcgattaactaaactcgtgctacatatgttagatgatatacaactggatcaagtgtcattttc

SEQ ID NO: 304899 - DNA, 75 bp, Artificial Sequence
  Synthetic
ctcgtgctacatatgttagatgatatacaactggatcaagtgtcattttcagatgacgcttggtagatcataact

SEQ ID NO: 304900 - DNA, 75 bp, Artificial Sequence
  Synthetic
gtcaatcaataagaaaagatgatgatagaccagttaaaacgaaagaccgatactgttataaagcggaacttaaca

SEQ ID NO: 304901 - DNA, 75 bp, Artificial Sequence
  Synthetic
aggattttcacttggccaatctgatttacacattgatcctacacagtttataatgtattctggaacaatttctaa

SEQ ID NO: 304902 - DNA, 75 bp, Artificial Sequence
  Synthetic
ttacacattgatcctacacagtttataatgtattctggaacaatttctaatgggataagttatgttaatcaagca

SEQ ID NO: 304903 - DNA, 75 bp, Artificial Sequence
  Synthetic
taatgtattctggaacaatttctaatgggataagttatgttaatcaagcaccaagttgcggtacagttttatcat

SEQ ID NO: 304904 - DNA, 75 bp, Artificial Sequence
  Synthetic
tttaatcgagaatctacatattgaaccgtacaaagtcgaagttttaaaaattgaacatgttggtaacgtctcaag

SEQ ID NO: 304905 - DNA, 75 bp, Artificial Sequence
  Synthetic
ccgtacaaagtcgaagttttaaaaattgaacatgttggtaacgtctcaagagccacgttgttgtcggatatcgtg

SEQ ID NO: 304906 - DNA, 75 bp, Artificial Sequence
  Synthetic
tgctgctctacggattcactaaacttggtgtacagggtttaactggagacgttgtatctgttgaaacgaaaagaa

SEQ ID NO: 304907 - DNA, 75 bp, Artificial Sequence
  Synthetic
tacctacaccgacacagacaaatctccttactattgaagattcaatgcagtgttttgcgtgggatatgaactgtg

SEQ ID NO: 304908 - DNA, 75 bp, Artificial Sequence
  Synthetic
ttcacgcttaataatatacgagcaggaagacggcttttggaaaatagtgaccgagactttgtctataaaattaaa

SEQ ID NO: 304909 - DNA, 75 bp, Artificial Sequence
  Synthetic
caattacatatgttaatccatcaggaaaggctggtttacagcaagactggagaccagcaacagattacaatggtc

SEQ ID NO: 304910 - DNA, 75 bp, Artificial Sequence
  Synthetic
cggattttcagtttggtattatgaggacaaatggcaaattaatcaggccatatatgctaagaattttcaatcaga

SEQ ID NO: 304911 - DNA, 75 bp, Artificial Sequence
  Synthetic
gacaaatggcaaattaatcaggccatatatgctaagaattttcaatcagatacacaagcacagggatgtctggag

SEQ ID NO: 304912 - DNA, 75 bp, Artificial Sequence
  Synthetic
tgaattacataccagcatttgctgaaattcgcaacaaaccaggaaaagtaaactatgcatatttgaatggtggat

SEQ ID NO: 304913 - DNA, 75 bp, Artificial Sequence
  Synthetic
aattcgcaacaaaccaggaaaagtaaactatgcatatttgaatggtggatttgctcaagtggacgcttctggtta

SEQ ID NO: 304914 - DNA, 75 bp, Artificial Sequence
  Synthetic
ttcgtatgcactggagagaaattttacgcgtcagataataatacgagagtcgacgacaaaatcacacctttcatt

SEQ ID NO: 304915 - DNA, 75 bp, Artificial Sequence
  Synthetic
acgcgtcagataataatacgagagtcgacgacaaaatcacacctttcatttcatatataggtgactattacactt

SEQ ID NO: 304916 - DNA, 75 bp, Artificial Sequence
  Synthetic
aggttgttgtgctggatttgctgctggttacgatgatgtatctccagaacatgatataactgtaagctacaccgt

SEQ ID NO: 304917 - DNA, 75 bp, Artificial Sequence
  Synthetic
ggttacgatgatgtatctccagaacatgatataactgtaagctacaccgtaatgaaaccttctgatccagatttt

SEQ ID NO: 304918 - DNA, 75 bp, Artificial Sequence
  Synthetic
agagtattactagtgatttagaagtgtctattaggaatctacaagatcaaataaattcaattatagctgaaatga

SEQ ID NO: 304919 - DNA, 75 bp, Artificial Sequence
  Synthetic
ttttacggctataaccaatttaggtgagttacctggattgttttcaaatattacaaaagtgtttagcaaaacgaa

SEQ ID NO: 304920 - DNA, 75 bp, Artificial Sequence
  Synthetic
agaaaaaaaacttcgccaatgccgatagcagccacttctataattgataaaactactgttgacgtgccaaatttg

SEQ ID NO: 304921 - DNA, 75 bp, Artificial Sequence
  Synthetic
tagcagccacttctataattgataaaactactgttgacgtgccaaatttgactatagttaataaaatgccagaag

SEQ ID NO: 304922 - DNA, 75 bp, Artificial Sequence
  Synthetic
ttcaatgagaacgaaaaaattaattgaacaaaaaaaacatgatttcagtacgtttacaatagctactgaagtcaa

SEQ ID NO: 304923 - DNA, 75 bp, Artificial Sequence
  Synthetic
acttccatacatatcaaaagctaccaacttttcagatcaatttatgacaagtataaactctagaggaataactat

SEQ ID NO: 304924 - DNA, 75 bp, Artificial Sequence
  Synthetic
aacttttcagatcaatttatgacaagtataaactctagaggaataactatagggaaatcagatataattcaatat

SEQ ID NO: 304925 - DNA, 75 bp, Artificial Sequence
  Synthetic
cgatgaatagaaaaaacgcacatatcatcaattataaaattgacccggatttagcgcacgaagtcctctcacaga

SEQ ID NO: 304926 - DNA, 75 bp, Artificial Sequence
  Synthetic
catcaattataaaattgacccggatttagcgcacgaagtcctctcacagatgtcaacgaattcaacgcgatcatt

SEQ ID NO: 304927 - DNA, 75 bp, Artificial Sequence
  Synthetic
ctgcatgtaaataactcatttgacacaccgacctatggtcagttagttgagagaatattagatgatggtcaactt

SEQ ID NO: 304928 - DNA, 75 bp, Artificial Sequence
  Synthetic
caccgacctatggtcagttagttgagagaatattagatgatggtcaacttttggacatactaggaaaattaaatc

SEQ ID NO: 304929 - DNA, 75 bp, Artificial Sequence
  Synthetic
cgaatttctacatcgaatacagcatcaactacgtgagtattgatagtagtacgcttatgttgcaaatacatataa

SEQ ID NO: 304930 - DNA, 75 bp, Artificial Sequence
  Synthetic
ggaaacgttgtactgactactcactacccagagatggcagaagcgtctgagttcaactttaccacaaagagaaag

SEQ ID NO: 304931 - DNA, 75 bp, Artificial Sequence
  Synthetic
gattgaagaaaaatctgatgttgacttggttgattcagcctcagtttattcacaagaatctgccagaagtaacta

SEQ ID NO: 304932 - DNA, 75 bp, Artificial Sequence
  Synthetic
ttggttgattcagcctcagtttattcacaagaatctgccagaagtaactatagtgatgcttacgataagttaaaa

SEQ ID NO: 304933 - DNA, 75 bp, Artificial Sequence
  Synthetic
atgacgcgaagtataggaattttgaattttctgaagatgaagaagtttacagaccatcaagtaaagcgtcagaca

SEQ ID NO: 304934 - DNA, 75 bp, Artificial Sequence
  Synthetic
attttctgaagatgaagaagtttacagaccatcaagtaaagcgtcagacaaatcatatagagaaatgaaacgtaa

SEQ ID NO: 304935 - DNA, 75 bp, Artificial Sequence
  Synthetic
tccattttagaaaaattgtcagagttaaatctcgagattgagaagataaaacaaatgaaccaaccagtcacaatc

SEQ ID NO: 304936 - DNA, 75 bp, Artificial Sequence
  Synthetic
taaatctcgagattgagaagataaaacaaatgaaccaaccagtcacaatcgatgcagcatttaacatgattcttc

SEQ ID NO: 304937 - DNA, 75 bp, Artificial Sequence
  Synthetic
gcagaaacaggctttaataaacgcaattattaactctatgaactagactgtgatctacacctgtcatctactggg

SEQ ID NO: 304938 - DNA, 75 bp, Artificial Sequence
  Synthetic
attattaactctatgaactagactgtgatctacacctgtcatctactggggtcaacctcttgagttatatttaaa

SEQ ID NO: 304939 - DNA, 75 bp, Artificial Sequence
  Synthetic
gtgcttcaagcatggatctgattgagacggtaaatgcatgcattagattgcagaaaagaatattgaacttagctc

SEQ ID NO: 304940 - DNA, 75 bp, Artificial Sequence
  Synthetic
gacggtaaatgcatgcattagattgcagaaaagaatattgaacttagctccaaacacaaatttaaatacagcggg

SEQ ID NO: 304941 - DNA, 75 bp, Artificial Sequence
  Synthetic
acagagtactctgaatgattacaatgcaattgcatcaaggtgtacaggaaaaacgtatgcattgcttgatcaaac

SEQ ID NO: 304942 - DNA, 75 bp, Artificial Sequence
  Synthetic
tccactatatgctgatgttattgagcaagtgacacatagaccacagatgaatatgacagggggtaacattagagc

SEQ ID NO: 304943 - DNA, 75 bp, Artificial Sequence
  Synthetic
ggagttataaatgttgtgtatatcccaaccgcgggtacaatactaataccaatgccgaatgggagaaatagagaa

SEQ ID NO: 304944 - DNA, 75 bp, Artificial Sequence
  Synthetic
attcagattcagaatttccccttggaacatgcagaaagatcaagatggtctaggaacagtgcacatgactaactg

SEQ ID NO: 304945 - DNA, 75 bp, Artificial Sequence
  Synthetic
cagtctttccagaaacttcatttgttaacaaacccaacgtcgactggaacattcagagtttattaacatctaaca

SEQ ID NO: 304946 - DNA, 75 bp, Artificial Sequence
  Synthetic
atgggaagtaggcaatccagcttgcagtcgcagacacatcgcactgacattaattcacacaactcgaatatttac

SEQ ID NO: 304947 - DNA, 75 bp, Artificial Sequence
  Synthetic
agtcgcagacacatcgcactgacattaattcacacaactcgaatatttacctccagagtgcgtcatttgctgagt

SEQ ID NO: 304948 - DNA, 75 bp, Artificial Sequence
  Synthetic
taattcacacaactcgaatatttacctccagagtgcgtcatttgctgagttcaaaacttaccatctgttaatcac

SEQ ID NO: 304949 - DNA, 75 bp, Artificial Sequence
  Synthetic
aagactgaaaaatggacctcgtaaaatttatcgcacaggcaaagtacaagaaggatcttcttccaatttacctaa

SEQ ID NO: 304950 - DNA, 75 bp, Artificial Sequence
  Synthetic
gtctaaaaaaccacaaaaattagaactcatcaagcataacaatccattccgtgaagtgccacagctcgccggaga

SEQ ID NO: 304951 - DNA, 75 bp, Artificial Sequence
  Synthetic
ctcatcaagcataacaatccattccgtgaagtgccacagctcgccggagaatctcttctattggaagatgtctgt

SEQ ID NO: 304952 - DNA, 75 bp, Artificial Sequence
  Synthetic
gtggtgtacacattccaaaacagtttaatatgtcaccaaacggaagaatcgtgtacatcacaagtgacaaaatcg

SEQ ID NO: 304953 - DNA, 75 bp, Artificial Sequence
  Synthetic
taatatgtcaccaaacggaagaatcgtgtacatcacaagtgacaaaatcgtatggccatgtggtttggaatctat

SEQ ID NO: 304954 - DNA, 75 bp, Artificial Sequence
  Synthetic
ggctctgcgtttgtcaaatgtagatgcggacaaccatatccaacgatcatagatcagcaatcgacttttttcttt

SEQ ID NO: 304955 - DNA, 75 bp, Artificial Sequence
  Synthetic
aatcagtaaaagttggattgagtgaaaagttcaactgtttaaattgcaacagaagcgtgcgttggtttagtccag

SEQ ID NO: 304956 - DNA, 75 bp, Artificial Sequence
  Synthetic
aaagttcaactgtttaaattgcaacagaagcgtgcgttggtttagtccaggaagaggcctgaggaccgtacatca

SEQ ID NO: 304957 - DNA, 75 bp, Artificial Sequence
  Synthetic
atattaccttccaagccaattatgcccagcatgtatgccataccgcgatttggttgccacaatgtctttactgaa

SEQ ID NO: 304958 - DNA, 75 bp, Artificial Sequence
  Synthetic
ccagcatgtatgccataccgcgatttggttgccacaatgtctttactgaacaaagtaaaatttcttggtgctgat

SEQ ID NO: 304959 - DNA, 75 bp, Artificial Sequence
  Synthetic
agtggaagagacaattgcagaacaattgtgagtccgcttttagatcattcaactctccacagttagcacacagaa

SEQ ID NO: 304960 - DNA, 75 bp, Artificial Sequence
  Synthetic
ttgtgagtccgcttttagatcattcaactctccacagttagcacacagaattgcaccatgtgaaagaattaattc

SEQ ID NO: 304961 - DNA, 75 bp, Artificial Sequence
  Synthetic
gagactgtttcatcagtgaacagaagacagcataacaaaatagaaatcacaccaatatgcagaggaaaagtcgca

SEQ ID NO: 304962 - DNA, 75 bp, Artificial Sequence
  Synthetic
ttatcgactttcaagataatgccgagttacactgttcagttaacgcgctattgcttccttggaagcttatctgaa

SEQ ID NO: 304963 - DNA, 75 bp, Artificial Sequence
  Synthetic
acgcttcaagcatggatgtgattgaaacagttaacgcatgcatcaaattgcaaaaaagagttctaagtttagcac

SEQ ID NO: 304964 - DNA, 75 bp, Artificial Sequence
  Synthetic
acgcttcaagcatggatgtgattgaaacagttaacgcatgcatctaattgcaaaaaagagttctaagtttagcac

SEQ ID NO: 304965 - DNA, 75 bp, Artificial Sequence
  Synthetic
acgcttcaagcatggatgtgattgaaacagttaacgcatgcatccaattgcaaaaaagagttctaagtttagcac

SEQ ID NO: 304966 - DNA, 75 bp, Artificial Sequence
  Synthetic
acgcttcaagcatggatgtgattgaaacagttaacgcatgcatcgaattgcaaaaaagagttctaagtttagcac

SEQ ID NO: 304967 - DNA, 75 bp, Artificial Sequence
  Synthetic
aacagttaacgcatgcatcaaattgcaaaaaagagttctaagtttagcaccaaatacgaatttgaatacatccgg

SEQ ID NO: 304968 - DNA, 75 bp, Artificial Sequence
  Synthetic
aacagttaacgcatgcatctaattgcaaaaaagagttctaagtttagcaccaaatacgaatttgaatacatccgg

SEQ ID NO: 304969 - DNA, 75 bp, Artificial Sequence
  Synthetic
aacagttaacgcatgcatccaattgcaaaaaagagttctaagtttagcaccaaatacgaatttgaatacatccgg

SEQ ID NO: 304970 - DNA, 75 bp, Artificial Sequence
  Synthetic
aacagttaacgcatgcatcgaattgcaaaaaagagttctaagtttagcaccaaatacgaatttgaatacatccgg

SEQ ID NO: 304971 - DNA, 75 bp, Artificial Sequence
  Synthetic
caaaaaagagttctaagtttagcaccaaatacgaatttgaatacatccggtcaaagcactctaaatgattacaac

SEQ ID NO: 304972 - DNA, 75 bp, Artificial Sequence
  Synthetic
aaacgtatgctatgttagatcaaactgcagttctaactccttttactatcaatgctccaatcatctctctttcag

SEQ ID NO: 304973 - DNA, 75 bp, Artificial Sequence
  Synthetic
tgcagttctaactccttttactatcaatgctccaatcatctctctttcagtccgcatttctacagacgattatga

SEQ ID NO: 304974 - DNA, 75 bp, Artificial Sequence
  Synthetic
atcttagatgtgttagccgctgctattagatcagaggggtcaagacctgtaagggcaatagaaagacgcgttctt

SEQ ID NO: 304975 - DNA, 75 bp, Artificial Sequence
  Synthetic
aagggcaatagaaagacgcgttcttgatccggctgttaaacagttggtagaagacctaaaattaaaaagcctcac

SEQ ID NO: 304976 - DNA, 75 bp, Artificial Sequence
  Synthetic
gctgctgtagatactgccgtaattcaaccagaaatcattcaaactgaaaatccattatatgctgatatcattgaa

SEQ ID NO: 304977 - DNA, 75 bp, Artificial Sequence
  Synthetic
caagttgtaaatagaccacaaatgaacatgactggcggaaatattagggccactttgggaagatggtcaggcaat

SEQ ID NO: 304978 - DNA, 75 bp, Artificial Sequence
  Synthetic
acatgactggcggaaatattagggccactttgggaagatggtcaggcaataaaggagtaattacgtgtatgtcag

SEQ ID NO: 304979 - DNA, 75 bp, Artificial Sequence
  Synthetic
cgttgattttaaagctagaactactggaattattaatattgtatatgtgccaaccgcaggaactatattaatacc

SEQ ID NO: 304980 - DNA, 75 bp, Artificial Sequence
  Synthetic
ggaattattaatattgtatatgtgccaaccgcaggaactatattaatacccatgccaaatgcaagaaacagagaa

SEQ ID NO: 304981 - DNA, 75 bp, Artificial Sequence
  Synthetic
aaatgatggctgagaactttgctattgactttatggatgatgatgctatagttcagactgaaacaggagttggag

SEQ ID NO: 304982 - DNA, 75 bp, Artificial Sequence
  Synthetic
gttcagactgaaacaggagttggagtgtattctttcccaatgtgcaaccgcattagatttagaatctctccatgg

SEQ ID NO: 304983 - DNA, 75 bp, Artificial Sequence
  Synthetic
ctatcaacatctatctaaatgcgcaccgaaatcacagtacatgctggacacaattttccctgaaacgtcattcgt

SEQ ID NO: 304984 - DNA, 75 bp, Artificial Sequence
  Synthetic
ccgaaatcacagtacatgctggacacaattttccctgaaacgtcattcgtgaacaaaccaaacgtggactggaac

SEQ ID NO: 304985 - DNA, 75 bp, Artificial Sequence
  Synthetic
tccaaaaagtatggtgtcaaaaaatagcaattctggtgtctgcatatgctgcgaaagtctgatccggcgtcggct

SEQ ID NO: 304986 - DNA, 75 bp, Artificial Sequence
  Synthetic
tagcaattctggtgtctgcatatgctgcgaaagtctgatccggcgtcggcttccaaaggaagtgcttcgagaggt

SEQ ID NO: 304987 - DNA, 75 bp, Artificial Sequence
  Synthetic
acgcttcaagcatggatctgattgaaacagttaatgcatgcatcaaattgcaaaaaagagttttgagtttagcgc

SEQ ID NO: 304988 - DNA, 75 bp, Artificial Sequence
  Synthetic
aacagttaatgcatgcatcaaattgcaaaaaagagttttgagtttagcgccaaacacgaatttgaatacatccgg

SEQ ID NO: 304989 - DNA, 75 bp, Artificial Sequence
  Synthetic
gcattagcttcaagatgcaatggaaaaacatatgctctgctcgatcaaactgctgtcttaactcctttcactatc

SEQ ID NO: 304990 - DNA, 75 bp, Artificial Sequence
  Synthetic
aaacatatgctctgctcgatcaaactgctgtcttaactcctttcactatcaatgctccaatcatttctctttcag

SEQ ID NO: 304991 - DNA, 75 bp, Artificial Sequence
  Synthetic
aagagcaatagaaagacgcgttcttgatccagctgtcaaacagctggtggaagaccttaaactgaaaagtcttac

SEQ ID NO: 304992 - DNA, 75 bp, Artificial Sequence
  Synthetic
gctgccgtggacaccgccgtaattcaaccagaaatcatccaaaccgaaaatccattatacgctgatattattgag

SEQ ID NO: 304993 - DNA, 75 bp, Artificial Sequence
  Synthetic
aaccagaaatcatccaaaccgaaaatccattatacgctgatattattgagcaagttgtaaatagaccacaaatga

SEQ ID NO: 304994 - DNA, 75 bp, Artificial Sequence
  Synthetic
tactctgggaagatggtcaggcaacaaaggagtagttacgtgtatgtcaggaatggattccgaacatagatttac

SEQ ID NO: 304995 - DNA, 75 bp, Artificial Sequence
  Synthetic
aaaggagtagttacgtgtatgtcaggaatggattccgaacatagatttactgttgatctcaaagctagaactact

SEQ ID NO: 304996 - DNA, 75 bp, Artificial Sequence
  Synthetic
caactgcaggaactatactgatacccatgccaaatgcaagaaatagggaaggtaaattaatagacgtatcagcag

SEQ ID NO: 304997 - DNA, 75 bp, Artificial Sequence
  Synthetic
catgccaaatgcaagaaatagggaaggtaaattaatagacgtatcagcagaaatgatggctgaaaattttgccat

SEQ ID NO: 304998 - DNA, 75 bp, Artificial Sequence
  Synthetic
gttcaaactgaaacaggagttggagtatattccttcccactgtgcaatcgctttagatttagaatctctccatgg

SEQ ID NO: 304999 - DNA, 75 bp, Artificial Sequence
  Synthetic
tatattccttcccactgtgcaatcgctttagatttagaatctctccatgggacatgcaaaaagatcaagatggtc

SEQ ID NO: 305000 - DNA, 75 bp, Artificial Sequence
  Synthetic
ggcacaagggacagctgctagacaaccagctatatcttttatgttcgagactcgtgatacatttacccaaggcga

SEQ ID NO: 305001 - DNA, 75 bp, Artificial Sequence
  Synthetic
cctaaatcacaatatatgctggacacgatctttcctgaaacatcattcgtaaacaaaccaaatgtagactggaat

SEQ ID NO: 305002 - DNA, 75 bp, Artificial Sequence
  Synthetic
cgatctttcctgaaacatcattcgtaaacaaaccaaatgtagactggaatattcagaatttactcacttcgaaca

SEQ ID NO: 305003 - DNA, 75 bp, Artificial Sequence
  Synthetic
acgcttcaagcatggatctgattgagacagtgaatgcatgcattaggttgcagaaaagaattttaaatttagctc

SEQ ID NO: 305004 - DNA, 75 bp, Artificial Sequence
  Synthetic
gacagtgaatgcatgcattaggttgcagaaaagaattttaaatttagctccaaatacaaatttgaataccgcggg

SEQ ID NO: 305005 - DNA, 75 bp, Artificial Sequence
  Synthetic
cagaaaagaattttaaatttagctccaaatacaaatttgaataccgcggggcagagtactctgaatgactataat

SEQ ID NO: 305006 - DNA, 75 bp, Artificial Sequence
  Synthetic
aaacgtatgcattgcttgatcaaacagctgtatatactccatataatataaatgcaccaatcatttcactctccg

SEQ ID NO: 305007 - DNA, 75 bp, Artificial Sequence
  Synthetic
agctgtatatactccatataatataaatgcaccaatcatttcactctccgtacgcatttcaacagatgattatga

SEQ ID NO: 305008 - DNA, 75 bp, Artificial Sequence
  Synthetic
attttggatgtcttagctgcagctatcagaacggagggatctagatacgtcagagtcattgaaaggcgtgtggtc

SEQ ID NO: 305009 - DNA, 75 bp, Artificial Sequence
  Synthetic
tcagaacggagggatctagatacgtcagagtcattgaaaggcgtgtggtcgatccaaccgttagacagctggttg

SEQ ID NO: 305010 - DNA, 75 bp, Artificial Sequence
  Synthetic
ttcagaaatctctattgctaatttggccgcagtagatacagcactcattcaaccagaagtaatagaaacagaaaa

SEQ ID NO: 305011 - DNA, 75 bp, Artificial Sequence
  Synthetic
gccgcagtagatacagcactcattcaaccagaagtaatagaaacagaaaatccattgtatgctgatatcattgag

SEQ ID NO: 305012 - DNA, 75 bp, Artificial Sequence
  Synthetic
acatgacggggggtaacattagagcaacgttaggtagatggtctggtaacaagggagtggttacgtgtatgtcag

SEQ ID NO: 305013 - DNA, 75 bp, Artificial Sequence
  Synthetic
aacgttaggtagatggtctggtaacaagggagtggttacgtgtatgtcaggtatggattcagagcatagattcac

SEQ ID NO: 305014 - DNA, 75 bp, Artificial Sequence
  Synthetic
ggagttataaacattgtgtacactccaactgcgggtactatactaatacctatgccgaatggaagaaatagagaa

SEQ ID NO: 305015 - DNA, 75 bp, Artificial Sequence
  Synthetic
caactgcgggtactatactaatacctatgccgaatggaagaaatagagaaggtaaattgattgacgtgtcggcag

SEQ ID NO: 305016 - DNA, 75 bp, Artificial Sequence
  Synthetic
cgactttatggatgatgatgctatagttcaaactgaaactggagttggagtattttcatttccaatgtgcaatcg

SEQ ID NO: 305017 - DNA, 75 bp, Artificial Sequence
  Synthetic
gttcaaactgaaactggagttggagtattttcatttccaatgtgcaatcgattcaggttcagaatctctccatgg

SEQ ID NO: 305018 - DNA, 75 bp, Artificial Sequence
  Synthetic
tgggaacagtacatatgactaactgggcacagggaacggccgccagacagcctgctatttcttttatgtttgaga

SEQ ID NO: 305019 - DNA, 75 bp, Artificial Sequence
  Synthetic
ggcacagggaacggccgccagacagcctgctatttcttttatgtttgagactcgcagaactttcactgaaagtga

SEQ ID NO: 305020 - DNA, 75 bp, Artificial Sequence
  Synthetic
ccgaaatcgcagtacatattagatacggtctttccagaaacttcgttcgttaataaaccaaatgttgattggaac

SEQ ID NO: 305021 - DNA, 75 bp, Artificial Sequence
  Synthetic
tcctagagcatggatctgatcgaaacagttaacgcttgcgtccgcttgcaaagaagggttcttgacttagctcca

SEQ ID NO: 305022 - DNA, 75 bp, Artificial Sequence
  Synthetic
aatcaactctgaatgactataatgcaacagcttcgcgcgtcaatggtcgtacgtatcctttacttgaccaaactg

SEQ ID NO: 305023 - DNA, 75 bp, Artificial Sequence
  Synthetic
aacagcttcgcgcgtcaatggtcgtacgtatcctttacttgaccaaactgcggttcttacaccgtataccataca

SEQ ID NO: 305024 - DNA, 75 bp, Artificial Sequence
  Synthetic
agaatttcaactgacgattatgaggacatgagaagcggtatggaatcaatacttgattgtcttgccgcagctatt

SEQ ID NO: 305025 - DNA, 75 bp, Artificial Sequence
  Synthetic
acatgagaagcggtatggaatcaatacttgattgtcttgccgcagctattagaactgaaggttccagaccagtgc

SEQ ID NO: 305026 - DNA, 75 bp, Artificial Sequence
  Synthetic
gccagtggtcaaacagttaatcgatgatctaaaacttaagagtttgatatcaaatatctcagttgcaaactttgc

SEQ ID NO: 305027 - DNA, 75 bp, Artificial Sequence
  Synthetic
gatctaaaacttaagagtttgatatcaaatatctcagttgcaaactttgctgctgctgacacttcattaattcag

SEQ ID NO: 305028 - DNA, 75 bp, Artificial Sequence
  Synthetic
ctttccttgttggcataattgaaccgactgtaatgagacaaccagtaaatcttaatggtggaaacgttcgagcag

SEQ ID NO: 305029 - DNA, 75 bp, Artificial Sequence
  Synthetic
gactgtaatgagacaaccagtaaatcttaatggtggaaacgttcgagcagcagttgggagatggtcaggaaataa

SEQ ID NO: 305030 - DNA, 75 bp, Artificial Sequence
  Synthetic
atggaagctgagcacatctttttcgttgaattcaaagccagaacgtgcggagtactaaacgttatgtacatacca

SEQ ID NO: 305031 - DNA, 75 bp, Artificial Sequence
  Synthetic
ttgaattcaaagccagaacgtgcggagtactaaacgttatgtacataccagcaccaggtgtattgatgattccat

SEQ ID NO: 305032 - DNA, 75 bp, Artificial Sequence
  Synthetic
tgtatgtattgatgtttcagcggaaatgaccgccgacgacttcaaaattgattttttcgatgatgacacaattgt

SEQ ID NO: 305033 - DNA, 75 bp, Artificial Sequence
  Synthetic
atgaccgccgacgacttcaaaattgattttttcgatgatgacacaattgtacacacagctaatggtgtaggtatt

SEQ ID NO: 305034 - DNA, 75 bp, Artificial Sequence
  Synthetic
taagatttagagttactccttggactgaacagaaaacacgagatggtcttgatactccgtcgattacgaattgga

SEQ ID NO: 305035 - DNA, 75 bp, Artificial Sequence
  Synthetic
tgaacagaaaacacgagatggtcttgatactccgtcgattacgaattggaacaatggaaacgctccgcgtcaacc

SEQ ID NO: 305036 - DNA, 75 bp, Artificial Sequence
  Synthetic
agacgcacatttactgaaaatgactataaattcgtttcaagatgcacgccaaaggtacagtacgttcttgacaat

SEQ ID NO: 305037 - DNA, 75 bp, Artificial Sequence
  Synthetic
ataaattcgtttcaagatgcacgccaaaggtacagtacgttcttgacaattacttcccagagacctcattcgtga

SEQ ID NO: 305038 - DNA, 75 bp, Artificial Sequence
  Synthetic
tcaggagatgttaactacagatactaacaccgtatggtcacgaaaaatagcaatgttggtcgcagcctttgctgc

SEQ ID NO: 305039 - DNA, 75 bp, Artificial Sequence
  Synthetic
ctgctaagatctaatctgccctgggtccgggagccggattgctttagaggatgaaaaaaatagcaataaaaaccc

SEQ ID NO: 305040 - DNA, 75 bp, Artificial Sequence
  Synthetic
gcttcaagcatggatctgatcgaaacagttaatgcatgcatcagattgcaaaaaagaatactagctctagcccca

SEQ ID NO: 305041 - DNA, 75 bp, Artificial Sequence
  Synthetic
cagttaatgcatgcatcagattgcaaaaaagaatactagctctagccccaaatacgaatctaaatactgcaggac

SEQ ID NO: 305042 - DNA, 75 bp, Artificial Sequence
  Synthetic
aaaaagaatactagctctagccccaaatacgaatctaaatactgcaggacaaagtactctgaatgattacaatgc

SEQ ID NO: 305043 - DNA, 75 bp, Artificial Sequence
  Synthetic
tcatacgcattacttgatcagacagctgtatataccccatataatataaatgctccgattatctcactctcagta

SEQ ID NO: 305044 - DNA, 75 bp, Artificial Sequence
  Synthetic
ctgtatataccccatataatataaatgctccgattatctcactctcagtacgcatttctacagatgattatgatg

SEQ ID NO: 305045 - DNA, 75 bp, Artificial Sequence
  Synthetic
tttggatgtcttagctgcagctataagaacagaaggatctagatatgttagagttattgaaagacgtgtggtcga

SEQ ID NO: 305046 - DNA, 75 bp, Artificial Sequence
  Synthetic
agaacagaaggatctagatatgttagagttattgaaagacgtgtggtcgatccgaccgttcgacagctagttgag

SEQ ID NO: 305047 - DNA, 75 bp, Artificial Sequence
  Synthetic
cagaaatttctatcgctaacttagctgctgtagatacagcgctcattcaacctgaaataattgaaacagagaatc

SEQ ID NO: 305048 - DNA, 75 bp, Artificial Sequence
  Synthetic
tgctgtagatacagcgctcattcaacctgaaataattgaaacagagaatccattatacgctgatattattgagca

SEQ ID NO: 305049 - DNA, 75 bp, Artificial Sequence
  Synthetic
atgacaggaggtaacatcagagcgacattaggtagatggtctggtaataaaggagtgattacgtgtatgtcaggc

SEQ ID NO: 305050 - DNA, 75 bp, Artificial Sequence
  Synthetic
cattaggtagatggtctggtaataaaggagtgattacgtgtatgtcaggcatggattctgaacataggtttacag

SEQ ID NO: 305051 - DNA, 75 bp, Artificial Sequence
  Synthetic
agtgattaatgttgtatacacaccgactgcaggtactatattaatacctatgccgaatggaagaaacagagaagg

SEQ ID NO: 305052 - DNA, 75 bp, Artificial Sequence
  Synthetic
actgcaggtactatattaatacctatgccgaatggaagaaacagagaaggtaagttaatcgacgtgtcagcagaa

SEQ ID NO: 305053 - DNA, 75 bp, Artificial Sequence
  Synthetic
atttcatggacgatgatgctatagtccagactgaaactggagttggagtgttctcatttccgatgtgcaatcgtc

SEQ ID NO: 305054 - DNA, 75 bp, Artificial Sequence
  Synthetic
ccagactgaaactggagttggagtgttctcatttccgatgtgcaatcgtctcagatttagaatttctccatggaa

SEQ ID NO: 305055 - DNA, 75 bp, Artificial Sequence
  Synthetic
ggaacagtgcatatgaccaactgggcacaaggaactgctgctaggcagccagcgatttcctttatgtttgaaact

SEQ ID NO: 305056 - DNA, 75 bp, Artificial Sequence
  Synthetic
cacaaggaactgctgctaggcagccagcgatttcctttatgtttgaaactcgcagaacctttactgaaggtgatt

SEQ ID NO: 305057 - DNA, 75 bp, Artificial Sequence
  Synthetic
taagtcgcaatacatgttggatacaatctttcccgaaacctctttcgtcaacaaaccaaatgttgattggaacat

SEQ ID NO: 305058 - DNA, 75 bp, Artificial Sequence
  Synthetic
cagaaagtatggtgtcaaaagatagcaatgctggtgtcttcatatgctgctaagatctgatctggcgtcagcttc

SEQ ID NO: 305059 - DNA, 75 bp, Artificial Sequence
  Synthetic
tagcaatgctggtgtcttcatatgctgctaagatctgatctggcgtcagcttccaaaggaagtgcttcgagaggt

SEQ ID NO: 305060 - DNA, 75 bp, Artificial Sequence
  Synthetic
atgggaagtaggcagtccagcttgcaatcgcagacgcctcgtactgatattaattcacataattcaaacattttc

SEQ ID NO: 305061 - DNA, 75 bp, Artificial Sequence
  Synthetic
aatcgcagacgcctcgtactgatattaattcacataattcaaacattttcctccagagggcagctactgctgaat

SEQ ID NO: 305062 - DNA, 75 bp, Artificial Sequence
  Synthetic
taattcacataattcaaacattttcctccagagggcagctactgctgaatttaggactcaacatatattgattac

SEQ ID NO: 305063 - DNA, 75 bp, Artificial Sequence
  Synthetic
ttattagctttccttatctcaggtttggtgtgtaattgttacctgctacaaaggttaagaaatggatctcgtaaa

SEQ ID NO: 305064 - DNA, 75 bp, Artificial Sequence
  Synthetic
tggtgtgtaattgttacctgctacaaaggttaagaaatggatctcgtaaaatttatcgcacaagcaaagtacaag

SEQ ID NO: 305065 - DNA, 75 bp, Artificial Sequence
  Synthetic
acaatccgttcgacccgaccactttgtctaagaaaccattaaaactgaagctcattaggtacaacaacccattcc

SEQ ID NO: 305066 - DNA, 75 bp, Artificial Sequence
  Synthetic
gtctaagaaaccattaaaactgaagctcattaggtacaacaacccattccgtgaggttccccagctcgcaggaga

SEQ ID NO: 305067 - DNA, 75 bp, Artificial Sequence
  Synthetic
ccttacaaccatgaacatttctgtggcggagtacacattccaaagcagttcaatatgtcaccaaaaggaaggatt

SEQ ID NO: 305068 - DNA, 75 bp, Artificial Sequence
  Synthetic
gcggagtacacattccaaagcagttcaatatgtcaccaaaaggaaggatttgttatattacaagtgacaagatcg

SEQ ID NO: 305069 - DNA, 75 bp, Artificial Sequence
  Synthetic
tatcattgatggaaaagaatacaccggttccgcatttgttaaatgcaggtgtgggcaaccatatccaacaatcat

SEQ ID NO: 305070 - DNA, 75 bp, Artificial Sequence
  Synthetic
ggttccgcatttgttaaatgcaggtgtgggcaaccatatccaacaatcattgaacaaccatcaactttcttcttc

SEQ ID NO: 305071 - DNA, 75 bp, Artificial Sequence
  Synthetic
agtcagtaaagattggattaagtgagaagtttaattgtttaaattgcaacaagagcgtgcgttggttcagcccag

SEQ ID NO: 305072 - DNA, 75 bp, Artificial Sequence
  Synthetic
gaagtttaattgtttaaattgcaacaagagcgtgcgttggttcagcccaggaagagggctaaggactacgcgtca

SEQ ID NO: 305073 - DNA, 75 bp, Artificial Sequence
  Synthetic
ccagcatgcatgccataccgcgacatcgtcgcctcaatgtctttactaaataaagtggagttccttggtgctgat

SEQ ID NO: 305074 - DNA, 75 bp, Artificial Sequence
  Synthetic
tcgtcgcctcaatgtctttactaaataaagtggagttccttggtgctgattttggtcagatgcgtgctgattttg

SEQ ID NO: 305075 - DNA, 75 bp, Artificial Sequence
  Synthetic
ctgtgaatccgcctttaggtcgttcaactctccacaattagcgcacagagtcacgccatataaaaggattgattc

SEQ ID NO: 305076 - DNA, 75 bp, Artificial Sequence
  Synthetic
aactctccacaattagcgcacagagtcacgccatataaaaggattgattcaaatctcactttgaataccattact

SEQ ID NO: 305077 - DNA, 75 bp, Artificial Sequence
  Synthetic
gacagcacaataagattgaaattacaccgatatgcagagggaaagtcacagttagcgatggatatagacgatgca

SEQ ID NO: 305078 - DNA, 75 bp, Artificial Sequence
  Synthetic
ttcttgactttcaagacaatgctgaattacactgttcagttaatatgctattgcttcgctggaagcttatctgaa

SEQ ID NO: 305079 - DNA, 75 bp, Artificial Sequence
  Synthetic
caactgcaggcacaatactcatcccaatgccaactggaggtaatagagaaggaaaactaattgatgtttctgcag

SEQ ID NO: 305080 - DNA, 75 bp, Artificial Sequence
  Synthetic
cacaaaaagcatggagtcaaaaaattgcaatgttagtgtctgcgttctcagcgaagatctgattctgcactggct

SEQ ID NO: 305081 - DNA, 75 bp, Artificial Sequence
  Synthetic
acgcttcaagcatggatctgatagaaacagttaatgcttgcattaaattgcaaagaaggattctagacttagcac

SEQ ID NO: 305082 - DNA, 75 bp, Artificial Sequence
  Synthetic
aacagttaatgcttgcattaaattgcaaagaaggattctagacttagcaccaaatacgaatttaaacacatctgg

SEQ ID NO: 305083 - DNA, 75 bp, Artificial Sequence
  Synthetic
caaagaaggattctagacttagcaccaaatacgaatttaaacacatctggccaaagtactctgaacgactacaat

SEQ ID NO: 305084 - DNA, 75 bp, Artificial Sequence
  Synthetic
gaacatatgctctgcttgaccaaactgcagttctaactccttttactattactgccccaattatttctctttcag

SEQ ID NO: 305085 - DNA, 75 bp, Artificial Sequence
  Synthetic
tgcagttctaactccttttactattactgccccaattatttctctttcagttcgtatatcaacagatgattatga

SEQ ID NO: 305086 - DNA, 75 bp, Artificial Sequence
  Synthetic
attttagacgtgctcgccgccgccattagaacagaaggatctagacctgtaagagtaatagaaagacgcattatg

SEQ ID NO: 305087 - DNA, 75 bp, Artificial Sequence
  Synthetic
ttagaacagaaggatctagacctgtaagagtaatagaaagacgcattatggacccagctgttaggcaattggtgg

SEQ ID NO: 305088 - DNA, 75 bp, Artificial Sequence
  Synthetic
gtctaatgtttccatcgcgaacttagcagctatggatactgctctaattcaaccagaaattattcaaactgaaaa

SEQ ID NO: 305089 - DNA, 75 bp, Artificial Sequence
  Synthetic
gcagctatggatactgctctaattcaaccagaaattattcaaactgaaaatccattgtacgctgatattattgag

SEQ ID NO: 305090 - DNA, 75 bp, Artificial Sequence
  Synthetic
acatgactggcgggaacattagagctactctaggaagatggtcaggcaataaaggagtggtcacatgtatgtctg

SEQ ID NO: 305091 - DNA, 75 bp, Artificial Sequence
  Synthetic
tactctaggaagatggtcaggcaataaaggagtggtcacatgtatgtctggaatggattctgaacatcgatttac

SEQ ID NO: 305092 - DNA, 75 bp, Artificial Sequence
  Synthetic
ggaataatcaacatcgtatatgtaccaactgctggaactatactaatacctatgccaaatgcaaggaatagagaa

SEQ ID NO: 305093 - DNA, 75 bp, Artificial Sequence
  Synthetic
caactgctggaactatactaatacctatgccaaatgcaaggaatagagaaggaaaactgattgatgtttcggcgg

SEQ ID NO: 305094 - DNA, 75 bp, Artificial Sequence
  Synthetic
tgattttatggatgatgatgctatagttcaaactgaaacaggagttggagttttctcctttccaatgtgcaatcg

SEQ ID NO: 305095 - DNA, 75 bp, Artificial Sequence
  Synthetic
gttcaaactgaaacaggagttggagttttctcctttccaatgtgcaatcgcttcagatttagaatttctccatgg

SEQ ID NO: 305096 - DNA, 75 bp, Artificial Sequence
  Synthetic
ttggtacggttcatatgacaaactgggcacaaggaactgctgctagacagccagctatttctttcatgtttgaaa

SEQ ID NO: 305097 - DNA, 75 bp, Artificial Sequence
  Synthetic
ggcacaaggaactgctgctagacagccagctatttctttcatgtttgaaactcgtgatacgtttacagaaggtga

SEQ ID NO: 305098 - DNA, 75 bp, Artificial Sequence
  Synthetic
cctaaatctcagtacatgctggacacaatatttcctgaaacctcattcgtgaacaagccaaatgtagattggaac

SEQ ID NO: 305099 - DNA, 75 bp, Artificial Sequence
  Synthetic
ttcagaaagcgtggtgtcaaaagatagcaattctggtgtctgcatttgctgcgaaaatctgatccggcgtcagct

SEQ ID NO: 305100 - DNA, 75 bp, Artificial Sequence
  Synthetic
tagcaattctggtgtctgcatttgctgcgaaaatctgatccggcgtcagcttccaaaggaagtgcttcgaaaggt

SEQ ID NO: 305101 - DNA, 75 bp, Artificial Sequence
  Synthetic
gtgctacaagcatggatctgatcgaaacggtgaacgcatgcatcaaactgcaaaagagaatattgaacttagcac

SEQ ID NO: 305102 - DNA, 75 bp, Artificial Sequence
  Synthetic
acgcttcaagcatggatctgattgaaacagttaatgcgtgcatcaacttgcagaaaagagttctaaatttagcgc

SEQ ID NO: 305103 - DNA, 75 bp, Artificial Sequence
  Synthetic
aacagttaatgcgtgcatcaacttgcagaaaagagttctaaatttagcgccaaacacaaatttgaacacatccgg

SEQ ID NO: 305104 - DNA, 75 bp, Artificial Sequence
  Synthetic
cagaaaagagttctaaatttagcgccaaacacaaatttgaacacatccggtcaaagcattttaaatgattataat

SEQ ID NO: 305105 - DNA, 75 bp, Artificial Sequence
  Synthetic
gaacatatgctctgcttgatcaaaccgcggttcttactccttttactattaatgctccaatcatctctctttcag

SEQ ID NO: 305106 - DNA, 75 bp, Artificial Sequence
  Synthetic
cgcggttcttactccttttactattaatgctccaatcatctctctttcagttcgtatatctactgatgactatga

SEQ ID NO: 305107 - DNA, 75 bp, Artificial Sequence
  Synthetic
attttagatgtgctcgctgcagctatcagaacagagggatctagacctgtgagagcgatagagagacgtgtactc

SEQ ID NO: 305108 - DNA, 75 bp, Artificial Sequence
  Synthetic
tcagaacagagggatctagacctgtgagagcgatagagagacgtgtactcgatccagccgttagacagttggtag

SEQ ID NO: 305109 - DNA, 75 bp, Artificial Sequence
  Synthetic
ttctaacatctcaattgcaaatctagcggctgtagacaccgctgtaatcgaaccagaaattatccagactgaaaa

SEQ ID NO: 305110 - DNA, 75 bp, Artificial Sequence
  Synthetic
gcggctgtagacaccgctgtaatcgaaccagaaattatccagactgaaaatccattatatgctgatatcattgag

SEQ ID NO: 305111 - DNA, 75 bp, Artificial Sequence
  Synthetic
atatgaccggcgggaacataagagccacattgggaagatggtcaggcaataagggagtagtaacatgtatgtcag

SEQ ID NO: 305112 - DNA, 75 bp, Artificial Sequence
  Synthetic
cacattgggaagatggtcaggcaataagggagtagtaacatgtatgtcagggatggattccgaacatagattcac

SEQ ID NO: 305113 - DNA, 75 bp, Artificial Sequence
  Synthetic
ggaataattaatatagtatatgtgccaactgctgggactatactattacccatgccaaacgcaaggaacagagaa

SEQ ID NO: 305114 - DNA, 75 bp, Artificial Sequence
  Synthetic
caactgctgggactatactattacccatgccaaacgcaaggaacagagaaggtaaattaattgatgtttcagcgg

SEQ ID NO: 305115 - DNA, 75 bp, Artificial Sequence
  Synthetic
tgactttatggatgatgatgccattgtccaaacggaaacaggagttggagtattttcatttccaatgtgtaatcg

SEQ ID NO: 305116 - DNA, 75 bp, Artificial Sequence
  Synthetic
gtccaaacggaaacaggagttggagtattttcatttccaatgtgtaatcgtttcagatttagaatttctccatgg

SEQ ID NO: 305117 - DNA, 75 bp, Artificial Sequence
  Synthetic
ttggtacagttcacatgacaaattgggcccaaggtacagctactagacaaccagccatctccttcatgttcgaga

SEQ ID NO: 305118 - DNA, 75 bp, Artificial Sequence
  Synthetic
ggcccaaggtacagctactagacaaccagccatctccttcatgttcgagactcgcgataccttcactcaaggtga

SEQ ID NO: 305119 - DNA, 75 bp, Artificial Sequence
  Synthetic
cctaaatcacaatacatattagatacaattttccctgaaacttcatttgtcaatagaccaaatgtggactggaat

SEQ ID NO: 305120 - DNA, 75 bp, Artificial Sequence
  Synthetic
ctcaaaaagtatggtgtcaaaagatagcaattttggtgtccgcatatgctgcgaaagtctgatccggcgtcagct

SEQ ID NO: 305121 - DNA, 75 bp, Artificial Sequence
  Synthetic
tagcaattttggtgtccgcatatgctgcgaaagtctgatccggcgtcagcttccaaaggaagtgcttcgaaaggt

SEQ ID NO: 305122 - DNA, 75 bp, Artificial Sequence
  Synthetic
acgcttcaagcatggatctgattgagacggtaaatgcatgcattagattgcagaaaagaatattgaacttagctc

SEQ ID NO: 305123 - DNA, 75 bp, Artificial Sequence
  Synthetic
tcaagcatggatctgattgaaacagttaatgcatgcgttagattgcagaaaagaattttagacttagctccaaat

SEQ ID NO: 305124 - DNA, 75 bp, Artificial Sequence
  Synthetic
gcactctgaatgattataacgcgttagcttctagatgtactggaagaacgtatgctttacttgaccaaacagcgg

SEQ ID NO: 305125 - DNA, 75 bp, Artificial Sequence
  Synthetic
agcttctagatgtactggaagaacgtatgctttacttgaccaaacagcggtcttcaccccctttactattaatgc

SEQ ID NO: 305126 - DNA, 75 bp, Artificial Sequence
  Synthetic
atatccacagatgattacgatgacatgagatctggaataaattctgttttagacgtccttgctgctgctattaga

SEQ ID NO: 305127 - DNA, 75 bp, Artificial Sequence
  Synthetic
tgagatctggaataaattctgttttagacgtccttgctgctgctattagaacggaagggtccaggcctgtgagag

SEQ ID NO: 305128 - DNA, 75 bp, Artificial Sequence
  Synthetic
agctgttagacagctagtggaagatctaaaattaaaaagtcttgtatcaagtatctctattgcaaacctagcagc

SEQ ID NO: 305129 - DNA, 75 bp, Artificial Sequence
  Synthetic
ctaaaattaaaaagtcttgtatcaagtatctctattgcaaacctagcagctgtagatactgctctgattcaaccg

SEQ ID NO: 305130 - DNA, 75 bp, Artificial Sequence
  Synthetic
tatatgctgatattattgaacaagttgttaacaggccacaaatgaacatgacaggcggaaacattagagctactt

SEQ ID NO: 305131 - DNA, 75 bp, Artificial Sequence
  Synthetic
tgttaacaggccacaaatgaacatgacaggcggaaacattagagctactttaggtagatggtcaggcaataaggg

SEQ ID NO: 305132 - DNA, 75 bp, Artificial Sequence
  Synthetic
gattcagaacataggttcactgttgatttgaaagcgagaaccactggaataattaatattgtatatgtgccaact

SEQ ID NO: 305133 - DNA, 75 bp, Artificial Sequence
  Synthetic
atttgaaagcgagaaccactggaataattaatattgtatatgtgccaactgctggcactattttaataccaatgc

SEQ ID NO: 305134 - DNA, 75 bp, Artificial Sequence
  Synthetic
gttaattgatgtttcagcagaaatgatggctgacaactttgctattgatttcatggaggatgacgctatagttca

SEQ ID NO: 305135 - DNA, 75 bp, Artificial Sequence
  Synthetic
atggctgacaactttgctattgatttcatggaggatgacgctatagttcagactgaaactggagttggagttttt

SEQ ID NO: 305136 - DNA, 75 bp, Artificial Sequence
  Synthetic
ggttcagaatttctccatgggatatgcaaaaagatcaagaaggtcttggtacagtccacatgacaaactgggcac

SEQ ID NO: 305137 - DNA, 75 bp, Artificial Sequence
  Synthetic
gcaaaaagatcaagaaggtcttggtacagtccacatgacaaactgggcacagggaaccgccgcaagacagccagc

SEQ ID NO: 305138 - DNA, 75 bp, Artificial Sequence
  Synthetic
gatacattcactgaaggtgactaccaacatttatctaaatgcacacctaaatcacaatacatgttagacacaatt

SEQ ID NO: 305139 - DNA, 75 bp, Artificial Sequence
  Synthetic
tttcctgaaacttcatttgtgaataagccaaatgtagattggaatgttcagagtttgcttacctcaactgttcag

SEQ ID NO: 305140 - DNA, 75 bp, Artificial Sequence
  Synthetic
tgctggtgtctgcatatgctgcgaaagtctgatccggcgtcagcttccaaaggaagtgcttcgagaggtgtgaaa

SEQ ID NO: 305141 - DNA, 75 bp, Artificial Sequence
  Synthetic
atgggaaataggcaatccagcttgcaatcgcagacacatcgcactgatattaactcgcacaattcaaacatttac

SEQ ID NO: 305142 - DNA, 75 bp, Artificial Sequence
  Synthetic
aatcgcagacacatcgcactgatattaactcgcacaattcaaacatttaccttcagagtgcatctttagcggagt

SEQ ID NO: 305143 - DNA, 75 bp, Artificial Sequence
  Synthetic
taactcgcacaattcaaacatttaccttcagagtgcatctttagcggagtttaagacatctcatatattgattac

SEQ ID NO: 305144 - DNA, 75 bp, Artificial Sequence
  Synthetic
ttgttcgcctttcttgtttcaagtttagtgtgtaattgttatctactgcgaaggttaagacatggacctcgtgaa

SEQ ID NO: 305145 - DNA, 75 bp, Artificial Sequence
  Synthetic
tagtgtgtaattgttatctactgcgaaggttaagacatggacctcgtgaagtttatcgcacaggcaaagtacaag

SEQ ID NO: 305146 - DNA, 75 bp, Artificial Sequence
  Synthetic
acaatacattcgatccgacaaccttgtctaagaagcctttaaagttagaactcattaagtacaacaatccatttc

SEQ ID NO: 305147 - DNA, 75 bp, Artificial Sequence
  Synthetic
gtctaagaagcctttaaagttagaactcattaagtacaacaatccatttcgcgaagtgccccaacttgctggaga

SEQ ID NO: 305148 - DNA, 75 bp, Artificial Sequence
  Synthetic
ccttacaatcatgaacacttctgtggtggaattcatattccaaaacaattcaacatgtcaccaaaagggagaatt

SEQ ID NO: 305149 - DNA, 75 bp, Artificial Sequence
  Synthetic
gtggaattcatattccaaaacaattcaacatgtcaccaaaagggagaattaattatatcacaagtgataagatcg

SEQ ID NO: 305150 - DNA, 75 bp, Artificial Sequence
  Synthetic
cgtcattgacggaatgaaatacaccggttctgcatttgttaagtgcagatgcgggcagccgtatccgacgattat

SEQ ID NO: 305151 - DNA, 75 bp, Artificial Sequence
  Synthetic
ggttctgcatttgttaagtgcagatgcgggcagccgtatccgacgattatagaacaatcatcaacattcttcttt

SEQ ID NO: 305152 - DNA, 75 bp, Artificial Sequence
  Synthetic
agtcagtaaaagttggactaagtgaaaaaatcaactgtttaaattgtaataggagcgtgcgttggtttagcccag

SEQ ID NO: 305153 - DNA, 75 bp, Artificial Sequence
  Synthetic
aaaaatcaactgtttaaattgtaataggagcgtgcgttggtttagcccaggaagaggcatacgaacaacacatca

SEQ ID NO: 305154 - DNA, 75 bp, Artificial Sequence
  Synthetic
ccagcatgcatgccattccgtgacatcgtctctacaatgtcactgctgaataaagtagaattccttggtgctgat

SEQ ID NO: 305155 - DNA, 75 bp, Artificial Sequence
  Synthetic
tcgtctctacaatgtcactgctgaataaagtagaattccttggtgctgattttagtcagatgcgtgctgattttg

SEQ ID NO: 305156 - DNA, 75 bp, Artificial Sequence
  Synthetic
ctgtgaatctgctttcagatcgttcaattctccacaattagcacacagaatcgcaccatatgaaagaatcaattc

SEQ ID NO: 305157 - DNA, 75 bp, Artificial Sequence
  Synthetic
aattctccacaattagcacacagaatcgcaccatatgaaagaatcaattctaatctcactcttaacaccattact

SEQ ID NO: 305158 - DNA, 75 bp, Artificial Sequence
  Synthetic
gacagcataataagatagagattgcaccaatatgcagaggaaaggtagcagtttgcgatgggtacagacgatgca

SEQ ID NO: 305159 - DNA, 75 bp, Artificial Sequence
  Synthetic
ttatcgatttcaatgacaacgctgagttacattgctcaattaacatgctgttgctcaactggaagcttatctgaa

SEQ ID NO: 305160 - DNA, 75 bp, Artificial Sequence
  Synthetic
tcctagagcatggatctgatcgaaacagttaacgcttgcgtccgcttgcagagaagagttcttgacttagctcca

SEQ ID NO: 305161 - DNA, 75 bp, Artificial Sequence
  Synthetic
agtcaaccttgaatgattacaatgcgacagcttcacgtgtcaatggtcgtacgtatcccttacttgatcagactg

SEQ ID NO: 305162 - DNA, 75 bp, Artificial Sequence
  Synthetic
gacagcttcacgtgtcaatggtcgtacgtatcccttacttgatcagactgcagttcttacaccatacaccattca

SEQ ID NO: 305163 - DNA, 75 bp, Artificial Sequence
  Synthetic
aggatttcaactgacgattatgaagatatgcggagcggtatggaatcaatacttgattgtcttgctgcggctatc

SEQ ID NO: 305164 - DNA, 75 bp, Artificial Sequence
  Synthetic
atatgcggagcggtatggaatcaatacttgattgtcttgctgcggctatcagaactgaaggttccagaccagtac

SEQ ID NO: 305165 - DNA, 75 bp, Artificial Sequence
  Synthetic
accagtggtaaaacagctaattgacgacctaaagcttaagagcctaatatcaaacatttcagttgcaaacttcgc

SEQ ID NO: 305166 - DNA, 75 bp, Artificial Sequence
  Synthetic
gacctaaagcttaagagcctaatatcaaacatttcagttgcaaacttcgccgccgctgatacctcattaatccag

SEQ ID NO: 305167 - DNA, 75 bp, Artificial Sequence
  Synthetic
ccttcctcgtcggtataatcgaacagactgtaatgagacagccagttaatcttaatggtggaaatattcgagcag

SEQ ID NO: 305168 - DNA, 75 bp, Artificial Sequence
  Synthetic
gactgtaatgagacagccagttaatcttaatggtggaaatattcgagcagtagtcggaagatggtcaggaaataa

SEQ ID NO: 305169 - DNA, 75 bp, Artificial Sequence
  Synthetic
atggaagctgagcacatttttttcgttgaatttaaagctagaacgtgtggagtattaaatgttatatacatacca

SEQ ID NO: 305170 - DNA, 75 bp, Artificial Sequence
  Synthetic
ttgaatttaaagctagaacgtgtggagtattaaatgttatatacataccagcgccaggcgtattaatgattccac

SEQ ID NO: 305171 - DNA, 75 bp, Artificial Sequence
  Synthetic
cgtatgcattgatgtttcagcagaaatgacagctgatgactttaaaatcgactttttcgatgatgacactattgt

SEQ ID NO: 305172 - DNA, 75 bp, Artificial Sequence
  Synthetic
atgacagctgatgactttaaaatcgactttttcgatgatgacactattgtgcatacagcaaacggtgtgggtatt

SEQ ID NO: 305173 - DNA, 75 bp, Artificial Sequence
  Synthetic
taagatttagagttactccttggactgaacagaagacgcgagacggtctggataccccatcaattacgaactgga

SEQ ID NO: 305174 - DNA, 75 bp, Artificial Sequence
  Synthetic
tgaacagaagacgcgagacggtctggataccccatcaattacgaactggaataacggaaacgctccacgtcagcc

SEQ ID NO: 305175 - DNA, 75 bp, Artificial Sequence
  Synthetic
agacgcacgttcactgaaaatgattacaaattcgtttcaagatgcacaccaaaggtacagtacgttctcgacaac

SEQ ID NO: 305176 - DNA, 75 bp, Artificial Sequence
  Synthetic
tactttccagagacatcattcgtgaatagacctcagattgaatggaacattcaggagatgttgactacagataca

SEQ ID NO: 305177 - DNA, 75 bp, Artificial Sequence
  Synthetic
tgctaagatctgatctgccctgggtccgggagccggattgctttagaggatgaaaaaaatagcaataaaaaaccc

SEQ ID NO: 305178 - DNA, 75 bp, Artificial Sequence
  Synthetic
ggcacaatatggactcctttcagttcttcgagtggctattgagggacattgaaaggaatctactttataccagtc

SEQ ID NO: 305179 - DNA, 75 bp, Artificial Sequence
  Synthetic
cttcgagtggctattgagggacattgaaaggaatctactttataccagtcttgtatacactaatcctaagatcgc

SEQ ID NO: 305180 - DNA, 75 bp, Artificial Sequence
  Synthetic
gaaaggaatctactttataccagtcttgtatacactaatcctaagatcgctatagtgcgatatgaaccaagcgaa

SEQ ID NO: 305181 - DNA, 75 bp, Artificial Sequence
  Synthetic
agttgaacacggactcaccaaacgaattattattgacgttgaagaagacattggacgaatgctcaactctagacg

SEQ ID NO: 305182 - DNA, 75 bp, Artificial Sequence
  Synthetic
attattattgacgttgaagaagacattggacgaatgctcaactctagacgaaaaaattgaaacattactaaggat

SEQ ID NO: 305183 - DNA, 75 bp, Artificial Sequence
  Synthetic
gataaatcagataaaaggaatatcatacgttcttggctgtcaactacgatcaatagactaaatgtggaagagtat

SEQ ID NO: 305184 - DNA, 75 bp, Artificial Sequence
  Synthetic
tacgttcttggctgtcaactacgatcaatagactaaatgtggaagagtatgcatcaattcaagaaattgaactgc

SEQ ID NO: 305185 - DNA, 75 bp, Artificial Sequence
  Synthetic
cgcgaagtctttgcgaccatatcattacaacattcccatcaatgaatatctaagggataacgaaattgaggttct

SEQ ID NO: 305186 - DNA, 75 bp, Artificial Sequence
  Synthetic
tacaacattcccatcaatgaatatctaagggataacgaaattgaggttctcgacacgggtgacaataggtggaag

SEQ ID NO: 305187 - DNA, 75 bp, Artificial Sequence
  Synthetic
ctaacttttaccacagaacgcacactttaattggtgcaatacttttcgctgtgacttcaagattggaaatctaca

SEQ ID NO: 305188 - DNA, 75 bp, Artificial Sequence
  Synthetic
tttaattggtgcaatacttttcgctgtgacttcaagattggaaatctacagctatgagcaaaagaaagcccttcg

SEQ ID NO: 305189 - DNA, 75 bp, Artificial Sequence
  Synthetic
tgttacaatgagggatatctcgagatgtctcgagacagaaaatggtctcatactcttccggagttacgaacgtta

SEQ ID NO: 305190 - DNA, 75 bp, Artificial Sequence
  Synthetic
tgtctcgagacagaaaatggtctcatactcttccggagttacgaacgttaacatttagactgtataactcgaaag

SEQ ID NO: 305191 - DNA, 75 bp, Artificial Sequence
  Synthetic
ctcattggtgcacgcaaaccctattgactatgaatttctttgtcaagtggtggcagtataccaaatcataccagc

SEQ ID NO: 305192 - DNA, 75 bp, Artificial Sequence
  Synthetic
gactatgaatttctttgtcaagtggtggcagtataccaaatcataccagccaacgccgccaaattactttccaca

SEQ ID NO: 305193 - DNA, 75 bp, Artificial Sequence
  Synthetic
ccactttcagctcaaatcaggtagcatcaactggcaatgcatcagaatgcgcaccactacaaattgagaataata

SEQ ID NO: 305194 - DNA, 75 bp, Artificial Sequence
  Synthetic
atcaactggcaatgcatcagaatgcgcaccactacaaattgagaataatatatatgtatcagaggcccaaaagaa

SEQ ID NO: 305195 - DNA, 75 bp, Artificial Sequence
  Synthetic
gacccgttgaacaaatcaagaatgctaaagctaatgaatgaaaacttgaacacaacactggataaattctcactt

SEQ ID NO: 305196 - DNA, 75 bp, Artificial Sequence
  Synthetic
taaagctaatgaatgaaaacttgaacacaacactggataaattctcacttatattcaactgtttttcatcaacat

SEQ ID NO: 305197 - DNA, 75 bp, Artificial Sequence
  Synthetic
cgctcaagatgcaattacggatcaagtaacggcgacgtacacatcgaacgttaacagagaaatgtatgattcata

SEQ ID NO: 305198 - DNA, 75 bp, Artificial Sequence
  Synthetic
gtaacggcgacgtacacatcgaacgttaacagagaaatgtatgattcatactactacaaattgaaacagatgtta

SEQ ID NO: 305199 - DNA, 75 bp, Artificial Sequence
  Synthetic
aagatcacgttgcgaaacaatataaggatgtcacagctgaatctctttctgcactcgccaattcgtcaaacggat

SEQ ID NO: 305200 - DNA, 75 bp, Artificial Sequence
  Synthetic
ggatgtcacagctgaatctctttctgcactcgccaattcgtcaaacggattctcgaaagaagtgaaatttataga

SEQ ID NO: 305201 - DNA, 75 bp, Artificial Sequence
  Synthetic
attctgcatctggacaacgatttaattaccaacgattattcggatttgtctaaagcactatcacatggcataccg

SEQ ID NO: 305202 - DNA, 75 bp, Artificial Sequence
  Synthetic
ttaccaacgattattcggatttgtctaaagcactatcacatggcataccgatgggaacccgcaacgtgcctgcgc

SEQ ID NO: 305203 - DNA, 75 bp, Artificial Sequence
  Synthetic
gccttggcaagtagcagctgtgcagcacacaattgcagaatcgctatataaaagagccaagaaaggagcatatca

SEQ ID NO: 305204 - DNA, 75 bp, Artificial Sequence
  Synthetic
cacacaattgcagaatcgctatataaaagagccaagaaaggagcatatcaaggatccttcgccgaagcatatacg

SEQ ID NO: 305205 - DNA, 75 bp, Artificial Sequence
  Synthetic
gcgtactggctgaagacacttcaaaagctacaaagataatcttatacaccgatgtatcgcagtgggacgcgagcc

SEQ ID NO: 305206 - DNA, 75 bp, Artificial Sequence
  Synthetic
agctacaaagataatcttatacaccgatgtatcgcagtgggacgcgagccaacataacactgaaccctacagatc

SEQ ID NO: 305207 - DNA, 75 bp, Artificial Sequence
  Synthetic
gcgagggctgaattgaaatggcgttacgatgatgaaccaaaggttcttgaaatgaatgtgctggattcaatgata

SEQ ID NO: 305208 - DNA, 75 bp, Artificial Sequence
  Synthetic
acgatgatgaaccaaaggttcttgaaatgaatgtgctggattcaatgataaaaattcaagaatatctgctaaatt

SEQ ID NO: 305209 - DNA, 75 bp, Artificial Sequence
  Synthetic
atctcaacgcccaacaaagattataagatatcatggcgtcgcttcaggtgaaaaaacgacaaagattggcaattc

SEQ ID NO: 305210 - DNA, 75 bp, Artificial Sequence
  Synthetic
agatatcatggcgtcgcttcaggtgaaaaaacgacaaagattggcaattcgtttgccaatgtagccctaatagaa

SEQ ID NO: 305211 - DNA, 75 bp, Artificial Sequence
  Synthetic
atataccagacctggagatctcccatctgcgcgtggatggtgatgacaacgtagtctcaatcaacacctcatgta

SEQ ID NO: 305212 - DNA, 75 bp, Artificial Sequence
  Synthetic
tctgcgcgtggatggtgatgacaacgtagtctcaatcaacacctcatgtaccatcgacagactccaaaggattat

SEQ ID NO: 305213 - DNA, 75 bp, Artificial Sequence
  Synthetic
gcacgtgtaaaagcactagcttcatacacaggactggagatggcaaaacgctttatcatctgtgggaaaatcttt

SEQ ID NO: 305214 - DNA, 75 bp, Artificial Sequence
  Synthetic
acacaggactggagatggcaaaacgctttatcatctgtgggaaaatctttgagaggggcgcgattccaatattta

SEQ ID NO: 305215 - DNA, 75 bp, Artificial Sequence
  Synthetic
cgtgtccatccaatctatgtgtggctcatctatatactcatcagctgtcaatgcataccgtggatttggcgatgc

SEQ ID NO: 305216 - DNA, 75 bp, Artificial Sequence
  Synthetic
tcatctatatactcatcagctgtcaatgcataccgtggatttggcgatgcgtatttttcattcatgcaagatgtc

SEQ ID NO: 305217 - DNA, 75 bp, Artificial Sequence
  Synthetic
gaataactggaagattgagggtactgatgtcgccggtcaccttatacgccacgggtccattaagtttcgaaatta

SEQ ID NO: 305218 - DNA, 75 bp, Artificial Sequence
  Synthetic
gatgtcgccggtcaccttatacgccacgggtccattaagtttcgaaattacgcctcaagggttgggaggaaggtg

SEQ ID NO: 305219 - DNA, 75 bp, Artificial Sequence
  Synthetic
ttgttcactctttttaaaatgctaacccagacagctgctgtttccataactccagatgaaataaagaaatatgca

SEQ ID NO: 305220 - DNA, 75 bp, Artificial Sequence
  Synthetic
cccagacagctgctgtttccataactccagatgaaataaagaaatatgcagagactgtgcaattcaaaaaaagaa

SEQ ID NO: 305221 - DNA, 75 bp, Artificial Sequence
  Synthetic
gagaaaattgttagtgccagcgaaagcattagcacgcataatagttgacaaagaacaacagaaaacgttgggggt

SEQ ID NO: 305222 - DNA, 75 bp, Artificial Sequence
  Synthetic
gcattagcacgcataatagttgacaaagaacaacagaaaacgttgggggtgccaaatgtacaaagccagaaaaat

SEQ ID NO: 305223 - DNA, 75 bp, Artificial Sequence
  Synthetic
aaatactaggagtgccagagaggaatgatatagtggccaaaggttattacccagaagaactatattcactgataa

SEQ ID NO: 305224 - DNA, 75 bp, Artificial Sequence
  Synthetic
tgatatagtggccaaaggttattacccagaagaactatattcactgataattagtcattcagtggtcgtctatac

SEQ ID NO: 305225 - DNA, 75 bp, Artificial Sequence
  Synthetic
tatcgtgttaattgtgaacctgtggaactattgaggtcacagcttggtatacggatagctgattcaaaaccaatc

SEQ ID NO: 305226 - DNA, 75 bp, Artificial Sequence
  Synthetic
aactattgaggtcacagcttggtatacggatagctgattcaaaaccaatcgctaagcctacaaatcatctatatg

SEQ ID NO: 305227 - DNA, 75 bp, Artificial Sequence
  Synthetic
taaaatatcaccttcagatttactaacacaagcgaaaaaatacgacctgtcaacttacaaagggaaaagagacta

SEQ ID NO: 305228 - DNA, 75 bp, Artificial Sequence
  Synthetic
acacaagcgaaaaaatacgacctgtcaacttacaaagggaaaagagactacttaagtgatctaggtctagtcggc

SEQ ID NO: 305229 - DNA, 75 bp, Artificial Sequence
  Synthetic
caaagatgttatttcgggatctgctcatgtcgaaatacgacgacttgtattcaacaccaggatttggagccactc

SEQ ID NO: 305230 - DNA, 75 bp, Artificial Sequence
  Synthetic
catgtcgaaatacgacgacttgtattcaacaccaggatttggagccactcagcttacaacaatcccacttgacgt

SEQ ID NO: 305231 - DNA, 75 bp, Artificial Sequence
  Synthetic
ataagacttggtttgccaccacatctgtatgaggtagtgatgctgcttttattatatgaatacatacattacgta

SEQ ID NO: 305232 - DNA, 75 bp, Artificial Sequence
  Synthetic
tgtatgaggtagtgatgctgcttttattatatgaatacatacattacgtattctcatgcaaaagaacattcacag

SEQ ID NO: 305233 - DNA, 75 bp, Artificial Sequence
  Synthetic
gcagtcagcagtaatcaccaagaacataattctaatgctagataacatacagctggatcaagtgtcgttttctga

SEQ ID NO: 305234 - DNA, 75 bp, Artificial Sequence
  Synthetic
ataattctaatgctagataacatacagctggatcaagtgtcgttttctgacgacgcttggtagatcatactaaat

SEQ ID NO: 305235 - DNA, 75 bp, Artificial Sequence
  Synthetic
ggattaaataacccaactgacgcttcaagcatggatctgattgaaacagttaatgcgtgcatcaatttgcaaaag

SEQ ID NO: 305236 - DNA, 75 bp, Artificial Sequence
  Synthetic
caagcatggatctgattgaaacagttaatgcgtgcatcaatttgcaaaagagaatcttaagtttagcgccaaaca

SEQ ID NO: 305237 - DNA, 75 bp, Artificial Sequence
  Synthetic
taatgcgtgcatcaatttgcaaaagagaatcttaagtttagcgccaaacacgaatctaaatacatctggtcaaag

SEQ ID NO: 305238 - DNA, 75 bp, Artificial Sequence
  Synthetic
gcttcaagatgtactgggagaacatacgctttgctagaccaaactgcagtcctcactccatttacaattaatgct

SEQ ID NO: 305239 - DNA, 75 bp, Artificial Sequence
  Synthetic
acgctttgctagaccaaactgcagtcctcactccatttacaattaatgctccgatcatttctctttcagtccgca

SEQ ID NO: 305240 - DNA, 75 bp, Artificial Sequence
  Synthetic
gagatctggaataaactctatattggatgtacttgccgcagccatcagaacagagggatctagacctgtaagggt

SEQ ID NO: 305241 - DNA, 75 bp, Artificial Sequence
  Synthetic
gatgtacttgccgcagccatcagaacagagggatctagacctgtaagggtaatagagagacgcgtcctcgatcca

SEQ ID NO: 305242 - DNA, 75 bp, Artificial Sequence
  Synthetic
tgaagctgaaaagtcttgtatccaacatctcaattgctaatttagcggccgtggacaccgcattaattcaaccag

SEQ ID NO: 305243 - DNA, 75 bp, Artificial Sequence
  Synthetic
catctcaattgctaatttagcggccgtggacaccgcattaattcaaccagaaatcattcaaactgagaatccgtt

SEQ ID NO: 305244 - DNA, 75 bp, Artificial Sequence
  Synthetic
gtaaatagaccacaaatgaatatgactggcggaaacataagggccactctggggaggtggtcgggtaataaagga

SEQ ID NO: 305245 - DNA, 75 bp, Artificial Sequence
  Synthetic
ctggcggaaacataagggccactctggggaggtggtcgggtaataaaggagtggttacatgtatgtctggaatgg

SEQ ID NO: 305246 - DNA, 75 bp, Artificial Sequence
  Synthetic
tctcaaggccagaaccactggagtaatcaatgttgtatatatgccaactgccggaacaattttaataccaatgcc

SEQ ID NO: 305247 - DNA, 75 bp, Artificial Sequence
  Synthetic
atcaatgttgtatatatgccaactgccggaacaattttaataccaatgccaaatgcaagaaatcgagaaggcaaa

SEQ ID NO: 305248 - DNA, 75 bp, Artificial Sequence
  Synthetic
tggctgatgacttcgccattgactttatggatgacgatgccatagttcaaaccgagacgggagttggagtctttt

SEQ ID NO: 305249 - DNA, 75 bp, Artificial Sequence
  Synthetic
tatggatgacgatgccatagttcaaaccgagacgggagttggagtcttttcctttccaatgtgtaatcgcttcag

SEQ ID NO: 305250 - DNA, 75 bp, Artificial Sequence
  Synthetic
caaaaagaccaagagggtcttggtacagttcatatgacaaattgggcacaggggaccgccgccagacaaccagcc

SEQ ID NO: 305251 - DNA, 75 bp, Artificial Sequence
  Synthetic
cagttcatatgacaaattgggcacaggggaccgccgccagacaaccagccatttctttcatgttcgaaactcgtg

SEQ ID NO: 305252 - DNA, 75 bp, Artificial Sequence
  Synthetic
acatttatctaagtgcacacccaaagcgcaatatatgttagatacgattttccctgaaacctcgtttgtgaacaa

SEQ ID NO: 305253 - DNA, 75 bp, Artificial Sequence
  Synthetic
gcgcaatatatgttagatacgattttccctgaaacctcgtttgtgaacaagccaaacgtagattggaacattcag

SEQ ID NO: 305254 - DNA, 75 bp, Artificial Sequence
  Synthetic
aggtatggtgtcaaaaaatagcaattttggtgtccgcatttgctgcgaaaatctgattcggcgtcagcttccaaa

SEQ ID NO: 305255 - DNA, 75 bp, Artificial Sequence
  Synthetic
tttggtgtccgcatttgctgcgaaaatctgattcggcgtcagcttccaaaggaagtgcttcgagaggtgtgaaaa

SEQ ID NO: 305256 - DNA, 75 bp, Artificial Sequence
  Synthetic
acgcttcaagcatggatctgattgaaacagtgaatgcgtgcgtggcattgcaaaaaaaaatatatgatctagcgc

SEQ ID NO: 305257 - DNA, 75 bp, Artificial Sequence
  Synthetic
gtacttgacgtgttggcggctgcaattagaaccgaaggctcaagaccagtacgcgtaattgaaagacgtgtcctt

SEQ ID NO: 305258 - DNA, 75 bp, Artificial Sequence
  Synthetic
caggtggtccacagaccaaacatgaatatgactggtggaaatattagagctactctaggcagatggtcgggtaat

SEQ ID NO: 305259 - DNA, 75 bp, Artificial Sequence
  Synthetic
tactctaggcagatggtcgggtaataaaggcgtgattacctgcatgtcgggtatggactcaaagcatagattcac

SEQ ID NO: 305260 - DNA, 75 bp, Artificial Sequence
  Synthetic
tactctaggcagatggtcgggtaataaaggcgtgattacctgcatgtcgggtatggactcatagcatagattcac

SEQ ID NO: 305261 - DNA, 75 bp, Artificial Sequence
  Synthetic
tactctaggcagatggtcgggtaataaaggcgtgattacctgcatgtcgggtatggactcacagcatagattcac

SEQ ID NO: 305262 - DNA, 75 bp, Artificial Sequence
  Synthetic
tactctaggcagatggtcgggtaataaaggcgtgattacctgcatgtcgggtatggactcagagcatagattcac

SEQ ID NO: 305263 - DNA, 75 bp, Artificial Sequence
  Synthetic
caacggctggtacaatactcattccaatgccgaatggaagaaacagagaaggaaaacgcattgatgtttcagggg

SEQ ID NO: 305264 - DNA, 75 bp, Artificial Sequence
  Synthetic
tgattgtatggaagaggatgccataatacagaccgaaactggagtcggtgtcttttctttcccaatgtgcaatag

SEQ ID NO: 305265 - DNA, 75 bp, Artificial Sequence
  Synthetic
atacagaccgaaactggagtcggtgtcttttctttcccaatgtgcaatagaataagatttagaataaatccatgg

SEQ ID NO: 305266 - DNA, 75 bp, Artificial Sequence
  Synthetic
taggaacggtacacatggcaaactgggctcaagggactgcaacaaggcagccagctgtatcatttttattcgaaa

SEQ ID NO: 305267 - DNA, 75 bp, Artificial Sequence
  Synthetic
ttatcaacatttgtcgaggtgtacccctaaagcacaacatatgttagacacagtgtttccggaatcatcatttat

SEQ ID NO: 305268 - DNA, 75 bp, Artificial Sequence
  Synthetic
cctaaagcacaacatatgttagacacagtgtttccggaatcatcatttataaacaaacctcccgcagaatggaac

SEQ ID NO: 305269 - DNA, 75 bp, Artificial Sequence
  Synthetic
cgatatgaaatctggaatggattcaattttggatgtggtagctgctgccattagatcagaaggatctagacctgt

SEQ ID NO: 305270 - DNA, 75 bp, Artificial Sequence
  Synthetic
atgggaaataggcaatccagcttgcaatcgcagacacatcgaaccgatattaattcacataactcacagatttac

SEQ ID NO: 305271 - DNA, 75 bp, Artificial Sequence
  Synthetic
aatcgcagacacatcgaaccgatattaattcacataactcacagatttaccttcaaagtgcctcctccgccaact

SEQ ID NO: 305272 - DNA, 75 bp, Artificial Sequence
  Synthetic
taattcacataactcacagatttaccttcaaagtgcctcctccgccaactttacaactcaacacatactggtgat

SEQ ID NO: 305273 - DNA, 75 bp, Artificial Sequence
  Synthetic
ctactcgcctttcttatttcaagtttggtgtgcaactgttatctattgtcaagactaagaaatggacctcgtaag

SEQ ID NO: 305274 - DNA, 75 bp, Artificial Sequence
  Synthetic
tggtgtgcaactgttatctattgtcaagactaagaaatggacctcgtaaggtttatcgcacaagcaaagcaaaag

SEQ ID NO: 305275 - DNA, 75 bp, Artificial Sequence
  Synthetic
acaattcgtttgatccaacaaccttgtctaaaaaacctttgaaattagaacttattagatacaataatccatttc

SEQ ID NO: 305276 - DNA, 75 bp, Artificial Sequence
  Synthetic
gtctaaaaaacctttgaaattagaacttattagatacaataatccatttcgtgaggtgccttcacttgctgggga

SEQ ID NO: 305277 - DNA, 75 bp, Artificial Sequence
  Synthetic
ccttacaaccatgaacacttctgtggtggtatacatattccaaaacaatttaacatgtcaccaaaaggaagaatc

SEQ ID NO: 305278 - DNA, 75 bp, Artificial Sequence
  Synthetic
gtggtatacatattccaaaacaatttaacatgtcaccaaaaggaagaatcagtcatattacaagcgaaaaaatcg

SEQ ID NO: 305279 - DNA, 75 bp, Artificial Sequence
  Synthetic
cattattgatggaagagaatatactggctccgcatttgtcaaatgtagatgtggacagcagtatccaacaattat

SEQ ID NO: 305280 - DNA, 75 bp, Artificial Sequence
  Synthetic
ggctccgcatttgtcaaatgtagatgtggacagcagtatccaacaattatagatcagcagtcaacttttttcttt

SEQ ID NO: 305281 - DNA, 75 bp, Artificial Sequence
  Synthetic
aatcagtgaaaattggattaagtgaaaaattcaactgtatgaattgtaacaggagtgtacgctggtttagtccag

SEQ ID NO: 305282 - DNA, 75 bp, Artificial Sequence
  Synthetic
aaaattcaactgtatgaattgtaacaggagtgtacgctggtttagtccaggaagaggcttacagacaacgcatca

SEQ ID NO: 305283 - DNA, 75 bp, Artificial Sequence
  Synthetic
ccagcatgtatgccatttcgtgacatcgttgcctcaatgtctttgctgaatagagtaaaattccttggtgctgat

SEQ ID NO: 305284 - DNA, 75 bp, Artificial Sequence
  Synthetic
tcgttgcctcaatgtctttgctgaatagagtaaaattccttggtgctgattttgatcagatgcgcactgacttcg

SEQ ID NO: 305285 - DNA, 75 bp, Artificial Sequence
  Synthetic
ctgtgagtctgccttcagatcattcaattctccacaactagcgcatagagtcacgccacatgaaagagttgaaac

SEQ ID NO: 305286 - DNA, 75 bp, Artificial Sequence
  Synthetic
aattctccacaactagcgcatagagtcacgccacatgaaagagttgaaacgaacctcactataaacaccgtcact

SEQ ID NO: 305287 - DNA, 75 bp, Artificial Sequence
  Synthetic
aacagcataataaaatagagattacacccgtatgcagaggaaaggtcgcagttaaagatggatacagacgatgca

SEQ ID NO: 305288 - DNA, 75 bp, Artificial Sequence
  Synthetic
ttattgactttcaggacaatgctgaactataccgctcagtcaacatgctgctgcttagctggaagcttatttgaa

SEQ ID NO: 305289 - DNA, 75 bp, Artificial Sequence
  Synthetic
acgcttcaagcatggatctgattgaaacagttaatgcatgtatcaaattgcaaaaaagagttctaagtttagcgc

SEQ ID NO: 305290 - DNA, 75 bp, Artificial Sequence
  Synthetic
aacagttaatgcatgtatcaaattgcaaaaaagagttctaagtttagcgccaaacacgaatttaaatacatccgg

SEQ ID NO: 305291 - DNA, 75 bp, Artificial Sequence
  Synthetic
caaaaaagagttctaagtttagcgccaaacacgaatttaaatacatccggtcaaagcactctgaatgattataac

SEQ ID NO: 305292 - DNA, 75 bp, Artificial Sequence
  Synthetic
aaacatacgctttgctcgatcaaactgctgttttaactcccttcaccatcaatgccccaattatttctctttcag

SEQ ID NO: 305293 - DNA, 75 bp, Artificial Sequence
  Synthetic
tgctgttttaactcccttcaccatcaatgccccaattatttctctttcagttcgcatttctacagatgattatga

SEQ ID NO: 305294 - DNA, 75 bp, Artificial Sequence
  Synthetic
attttggacgtggtagccgctgccattagatcagaagggtctagacctgtaagagcaatagaaagacgtgttctt

SEQ ID NO: 305295 - DNA, 75 bp, Artificial Sequence
  Synthetic
ttagatcagaagggtctagacctgtaagagcaatagaaagacgtgttcttgatccagctgttaaacagctagtgg

SEQ ID NO: 305296 - DNA, 75 bp, Artificial Sequence
  Synthetic
ttctgatatctctattgcaaacttagctgccgtagacacagccgtaattcaaccagaaataatccaaactgaaaa

SEQ ID NO: 305297 - DNA, 75 bp, Artificial Sequence
  Synthetic
gctgccgtagacacagccgtaattcaaccagaaataatccaaactgaaaatccattatacgccgatattattgag

SEQ ID NO: 305298 - DNA, 75 bp, Artificial Sequence
  Synthetic
acatgactggcggaaatattagagctactttaggaagatggtcaggtaacaaaggagtagtcacatgtatgtcag

SEQ ID NO: 305299 - DNA, 75 bp, Artificial Sequence
  Synthetic
tactttaggaagatggtcaggtaacaaaggagtagtcacatgtatgtcaggaatggattctgaacatagattcac

SEQ ID NO: 305300 - DNA, 75 bp, Artificial Sequence
  Synthetic
ggaataatcaatattgtatatgtgccaacagcaggaactatactaatacctatgccaaatgcaagaaacagggag

SEQ ID NO: 305301 - DNA, 75 bp, Artificial Sequence
  Synthetic
caacagcaggaactatactaatacctatgccaaatgcaagaaacagggagggaaaattaatcgacgtatctgcag

SEQ ID NO: 305302 - DNA, 75 bp, Artificial Sequence
  Synthetic
tgatttcatggatgatgatgccatagtccaaactgaaacaggagttggagtatattccttcccaatgtgtaatcg

SEQ ID NO: 305303 - DNA, 75 bp, Artificial Sequence
  Synthetic
gtccaaactgaaacaggagttggagtatattccttcccaatgtgtaatcgctttagatttagaatttctccatgg

SEQ ID NO: 305304 - DNA, 75 bp, Artificial Sequence
  Synthetic
ttggaacagttcacatgacaaattgggcgcaggggacagccgctaggcaaccagctatatcttttatgttcgaga

SEQ ID NO: 305305 - DNA, 75 bp, Artificial Sequence
  Synthetic
ttatcaacatttatccaaatgtgcacctaaatcacaatacatgctggacacgatttttcccgagacatcattcgt

SEQ ID NO: 305306 - DNA, 75 bp, Artificial Sequence
  Synthetic
cctaaatcacaatacatgctggacacgatttttcccgagacatcattcgtgaataaaccaaatgtagactggaac

SEQ ID NO: 305307 - DNA, 75 bp, Artificial Sequence
  Synthetic
atgggaaataggcaatccagcttgcaatcgcagacacacagaaccgatatcaactcacataattcaaacatttat

SEQ ID NO: 305308 - DNA, 75 bp, Artificial Sequence
  Synthetic
aatcgcagacacacagaaccgatatcaactcacataattcaaacatttatcttcaaagtgcatcttttgctgagt

SEQ ID NO: 305309 - DNA, 75 bp, Artificial Sequence
  Synthetic
caactcacataattcaaacatttatcttcaaagtgcatcttttgctgagttcaaaacatatcatttactaatcac

SEQ ID NO: 305310 - DNA, 75 bp, Artificial Sequence
  Synthetic
ctgttcgcattccttatttcgagcttagtgtgtaactgttatttactacgaagattaagaaatggacctcgtaaa

SEQ ID NO: 305311 - DNA, 75 bp, Artificial Sequence
  Synthetic
tagtgtgtaactgttatttactacgaagattaagaaatggacctcgtaaagtttatcgcgcaggcaaaatgcaag

SEQ ID NO: 305312 - DNA, 75 bp, Artificial Sequence
  Synthetic
acaattcattcaacccaacaactttgtctaaaaaacctcaaaaaattgaacttattaaatacaataatccatttc

SEQ ID NO: 305313 - DNA, 75 bp, Artificial Sequence
  Synthetic
gtctaaaaaacctcaaaaaattgaacttattaaatacaataatccatttcgtgaagtaccccaacttgctggaga

SEQ ID NO: 305314 - DNA, 75 bp, Artificial Sequence
  Synthetic
ccttataatcatgaacatttttgtggtggtatacatattccaaaacagtttaacatgtcaccgaaaggaagaatc

SEQ ID NO: 305315 - DNA, 75 bp, Artificial Sequence
  Synthetic
gtggtatacatattccaaaacagtttaacatgtcaccgaaaggaagaatcaatcacatcacaagtgaaaagatcg

SEQ ID NO: 305316 - DNA, 75 bp, Artificial Sequence
  Synthetic
cattattgatggaaagaaatacactggctcagcgtttgttaagtgcagatgtggacaaccgtatccaacaattat

SEQ ID NO: 305317 - DNA, 75 bp, Artificial Sequence
  Synthetic
ggctcagcgtttgttaagtgcagatgtggacaaccgtatccaacaattatagatcaaatgtcaacttttttcttc

SEQ ID NO: 305318 - DNA, 75 bp, Artificial Sequence
  Synthetic
aatcagtgaaagtcggactaagtgagaaatttaactgtctgaactgcaacaggagcgtgcgctggtttagtccag

SEQ ID NO: 305319 - DNA, 75 bp, Artificial Sequence
  Synthetic
gaaatttaactgtctgaactgcaacaggagcgtgcgctggtttagtccaggaagaggcattcgaacggcgcacca

SEQ ID NO: 305320 - DNA, 75 bp, Artificial Sequence
  Synthetic
ccagcatgcatgccatttcgtgatatcgttgcttcaatgtcgttgctgaacaaagtagaatttgtgggcgcagac

SEQ ID NO: 305321 - DNA, 75 bp, Artificial Sequence
  Synthetic
tcgttgcttcaatgtcgttgctgaacaaagtagaatttgtgggcgcagactttgatcagatgcgcgctgattttg

SEQ ID NO: 305322 - DNA, 75 bp, Artificial Sequence
  Synthetic
ctgtgagtccgcctttagatcattcaattctccacaattagcacacagagtcaaaccacatgaaagagttgccac

SEQ ID NO: 305323 - DNA, 75 bp, Artificial Sequence
  Synthetic
aattctccacaattagcacacagagtcaaaccacatgaaagagttgccacaaataccactctgaatacaattact

SEQ ID NO: 305324 - DNA, 75 bp, Artificial Sequence
  Synthetic
gacggcatagcaaaatagagattacaccaatatgtagaggaaaagtcgcaatttgcgacgggtatagaagatgca

SEQ ID NO: 305325 - DNA, 75 bp, Artificial Sequence
  Synthetic
ttattaattttcaagacaacgctcaactgcattgttcaatctgcacgctactgcttcgttggaagcttatttgaa

SEQ ID NO: 305326 - DNA, 75 bp, Artificial Sequence
  Synthetic
taattcacacaactcgaatatttacctccagagtgcgtcatttgctgagttcaaaactcaccatatgttaatcac

SEQ ID NO: 305327 - DNA, 75 bp, Artificial Sequence
  Synthetic
aaggatcttctcccaatttacctaaacaattcattcgacccgaccactttgtctaaaaaaccacaaaaattggaa

SEQ ID NO: 305328 - DNA, 75 bp, Artificial Sequence
  Synthetic
gcggacaaccatatccaacgatcattgatcagcaatcgacttttttctttttgacctgttgttcaaatgacacca

SEQ ID NO: 305329 - DNA, 75 bp, Artificial Sequence
  Synthetic
acgcttcaagcatggatctgattgaaacagttaatgcatgcatcaaattgcaaagaagggttctaagtttagcac

SEQ ID NO: 305330 - DNA, 75 bp, Artificial Sequence
  Synthetic
aacagttaatgcatgcatcaaattgcaaagaagggttctaagtttagcaccaaatacgaatttgaacacatccgg

SEQ ID NO: 305331 - DNA, 75 bp, Artificial Sequence
  Synthetic
caaagaagggttctaagtttagcaccaaatacgaatttgaacacatccggtcaaagcactctaaatgattacaac

SEQ ID NO: 305332 - DNA, 75 bp, Artificial Sequence
  Synthetic
aaacgtatgcaatgctagatcaaactgcagttctaactcctcttactatcaatgctccaattatttctctatcag

SEQ ID NO: 305333 - DNA, 75 bp, Artificial Sequence
  Synthetic
tgcagttctaactcctcttactatcaatgctccaattatttctctatcagtccgcatttctacagatgattatga

SEQ ID NO: 305334 - DNA, 75 bp, Artificial Sequence
  Synthetic
atcttagatgtgttagccgctgccattagatcagaggggtccagacctgtaagagcaatagaaagacgcgtcctt

SEQ ID NO: 305335 - DNA, 75 bp, Artificial Sequence
  Synthetic
ttagatcagaggggtccagacctgtaagagcaatagaaagacgcgtccttgatccggccgttaaacagttggtgg

SEQ ID NO: 305336 - DNA, 75 bp, Artificial Sequence
  Synthetic
tccattatatgctgatatcattgaacaagttgtaaatagaccgcaaatgaacatgactggcggaaacattagagc

SEQ ID NO: 305337 - DNA, 75 bp, Artificial Sequence
  Synthetic
tactttgggaagatggtcaggcaataaaggagtaattacgtgtatgtcaggaatggactctgaacatagattcac

SEQ ID NO: 305338 - DNA, 75 bp, Artificial Sequence
  Synthetic
aaaggagtaattacgtgtatgtcaggaatggactctgaacatagattcactgttgattttaaagctagaactact

SEQ ID NO: 305339 - DNA, 75 bp, Artificial Sequence
  Synthetic
gaatggactctgaacatagattcactgttgattttaaagctagaactactggaataattaatattgtatatgtac

SEQ ID NO: 305340 - DNA, 75 bp, Artificial Sequence
  Synthetic
aatgccaaacgcaagaaatagagaaggtaaattaattgacgtttcagcggaaatgatggctgagaactttgctat

SEQ ID NO: 305341 - DNA, 75 bp, Artificial Sequence
  Synthetic
aaatgatggctgagaactttgctattgactttatggatgacgatgccatagttcagactgaaacaggagttggag

SEQ ID NO: 305342 - DNA, 75 bp, Artificial Sequence
  Synthetic
ctatcaacatctatctaaatgtgcaccaaaatcacagtacatgctggacacagttttccctgaaacgtcattcgt

SEQ ID NO: 305343 - DNA, 75 bp, Artificial Sequence
  Synthetic
ccaaaatcacagtacatgctggacacagttttccctgaaacgtcattcgtaaacaaaccaaacgtggactggaac

SEQ ID NO: 305344 - DNA, 75 bp, Artificial Sequence
  Synthetic
gtattaattagtccaaccgacgcttaaagcatggatctgattgaaacagttaatgcatgcgttagattgcaaaaa

SEQ ID NO: 305345 - DNA, 75 bp, Artificial Sequence
  Synthetic
aaagcatggatctgattgaaacagttaatgcatgcgttagattgcaaaaaagaattttagacttagccccaaata

SEQ ID NO: 305346 - DNA, 75 bp, Artificial Sequence
  Synthetic
taatgcatgcgttagattgcaaaaaagaattttagacttagccccaaatacaaatctaaacacatctggtcaaag

SEQ ID NO: 305347 - DNA, 75 bp, Artificial Sequence
  Synthetic
gcttcgagatgcactgggagaacatacgcattgcttgatcaaaccgcaatctttactcccttcactatcaatgct

SEQ ID NO: 305348 - DNA, 75 bp, Artificial Sequence
  Synthetic
acgcattgcttgatcaaaccgcaatctttactcccttcactatcaatgctccaatcatctctatttcagttcgta

SEQ ID NO: 305349 - DNA, 75 bp, Artificial Sequence
  Synthetic
gaggtctgggataaattctattttagacatacttgccgcagctatcagaacggaaggatctaggcctgtgagagt

SEQ ID NO: 305350 - DNA, 75 bp, Artificial Sequence
  Synthetic
gacatacttgccgcagctatcagaacggaaggatctaggcctgtgagagtaatagaaagacgtgtttttgacccc

SEQ ID NO: 305351 - DNA, 75 bp, Artificial Sequence
  Synthetic
taaaactgaaaagtcttgtatcaaatatttcaattgcgaacttagcggctgtagatactgctctaatacaaccgg

SEQ ID NO: 305352 - DNA, 75 bp, Artificial Sequence
  Synthetic
tatttcaattgcgaacttagcggctgtagatactgctctaatacaaccggaaatcatccaaactgaaaatccatt

SEQ ID NO: 305353 - DNA, 75 bp, Artificial Sequence
  Synthetic
gtaaatagaccgcaaatgaacatgacaggcggaaatatcagagctaccctaggcagatggtcaggtaataaagga

SEQ ID NO: 305354 - DNA, 75 bp, Artificial Sequence
  Synthetic
caggcggaaatatcagagctaccctaggcagatggtcaggtaataaaggagtagttacatgcatgtctggaatgg

SEQ ID NO: 305355 - DNA, 75 bp, Artificial Sequence
  Synthetic
tctcaaagcaagaacaactggaataattaatattgtatatgtaccaactgctggcactatattaataccaatgcc

SEQ ID NO: 305356 - DNA, 75 bp, Artificial Sequence
  Synthetic
attaatattgtatatgtaccaactgctggcactatattaataccaatgccaaatgcaaggaatagagaagggaaa

SEQ ID NO: 305357 - DNA, 75 bp, Artificial Sequence
  Synthetic
tggctgacaatttcgctattgattttatggatgatgatgctatagttcaaactgaaactggagttggagtctttt

SEQ ID NO: 305358 - DNA, 75 bp, Artificial Sequence
  Synthetic
tatggatgatgatgctatagttcaaactgaaactggagttggagtcttttccttcccaatgtgtaatcgtttcag

SEQ ID NO: 305359 - DNA, 75 bp, Artificial Sequence
  Synthetic
caaaaagatcaggaaggtcttggcacagtccatatgacaaactgggcacaaggaactgccgcgagacagccagcc

SEQ ID NO: 305360 - DNA, 75 bp, Artificial Sequence
  Synthetic
cagtccatatgacaaactgggcacaaggaactgccgcgagacagccagccatctcttttctatttgagactcgtg

SEQ ID NO: 305361 - DNA, 75 bp, Artificial Sequence
  Synthetic
acatttatctaagtgcacacctaaatcacagtacatgttggatacagtttttcctgagacttcattcgtaaataa

SEQ ID NO: 305362 - DNA, 75 bp, Artificial Sequence
  Synthetic
tcacagtacatgttggatacagtttttcctgagacttcattcgtaaataaaccaaatacagattggaacattcag

SEQ ID NO: 305363 - DNA, 75 bp, Artificial Sequence
  Synthetic
aagcatggtgtcagaaaatcgcaatgctagtgtctgcatatgctgcgaaagtctgatccggcgtcagcttccaaa

SEQ ID NO: 305364 - DNA, 75 bp, Artificial Sequence
  Synthetic
aacgcgccaatcatttcactctctgtgcgtatttcaacagatgattacgatgacatgagatcaggaattaattct

SEQ ID NO: 305365 - DNA, 75 bp, Artificial Sequence
  Synthetic
aaaatcctctttatgcagacataattgaacagatagttcatagaccaaatataggtatgactggtggaaatatta

SEQ ID NO: 305366 - DNA, 75 bp, Artificial Sequence
  Synthetic
cattattcagactgaaactggagttggagtgtattcatttccaatgtgcaataggattagattcagaataaatcc

SEQ ID NO: 305367 - DNA, 75 bp, Artificial Sequence
  Synthetic
ggagtgtattcatttccaatgtgcaataggattagattcagaataaatccatggaacagtcaaaaggatgatgac

SEQ ID NO: 305368 - DNA, 75 bp, Artificial Sequence
  Synthetic
attgggctcaaggaactgctccgaaacagccagctatatcttttatgtttgaaactcgtcgaacgttcacggaag

SEQ ID NO: 305369 - DNA, 75 bp, Artificial Sequence
  Synthetic
aaatagcaatgcttgtcgctgcgttcgctgctaagatctagatcgacaccggattccaaaaagggattgcttcga

SEQ ID NO: 305370 - DNA, 75 bp, Artificial Sequence
  Synthetic
cgctgctaagatctagatcgacaccggattccaaaaagggattgcttcgaaaggtgcgaaaaaatgagcaataaa

SEQ ID NO: 305371 - DNA, 75 bp, Artificial Sequence
  Synthetic
acacatcagaacagttccatatcatgaacttgctgatgctatcaaatcattcgctcgtaaagataaagagacgct

SEQ ID NO: 305372 - DNA, 75 bp, Artificial Sequence
  Synthetic
agtagacggctggaaacgttgtactgactactcactacctagagatggcagaagcgtctgagttcaactttacca

SEQ ID NO: 305373 - DNA, 75 bp, Artificial Sequence
  Synthetic
gactactcactacctagagatggcagaagcgtctgagttcaactttaccacaaaaagaaagcaaaaaataatgag

SEQ ID NO: 305374 - DNA, 75 bp, Artificial Sequence
  Synthetic
aaacaaaaaaggattgaagaaaaatctgatgttgacttggttgattcagcctcagtttattcacaagaatctgcc

SEQ ID NO: 305375 - DNA, 75 bp, Artificial Sequence
  Synthetic
aggaattttgaattttctgaagatgaggaagtttacagaccatcaagtaaaacgtcagacaaatcatatagagaa

SEQ ID NO: 305376 - DNA, 75 bp, Artificial Sequence
  Synthetic
aggaagtttacagaccatcaagtaaaacgtcagacaaatcatatagagaaatgaaacgtaaatacgatagtacta

SEQ ID NO: 305377 - DNA, 75 bp, Artificial Sequence
  Synthetic
gttgtcagagttaaatctcgagattgagaagataaagcaaatgaaccaaccagtcacaatcgatgcagcctttaa

SEQ ID NO: 305378 - DNA, 75 bp, Artificial Sequence
  Synthetic
gagaagataaagcaaatgaaccaaccagtcacaatcgatgcagcctttaacatgattcttcgaaacgttgacaat

SEQ ID NO: 305379 - DNA, 75 bp, Artificial Sequence
  Synthetic
taataaacgcaatcattaattctatgaactagactgtgatctacacctgtcatctactagggtcaacctcttgag

SEQ ID NO: 305380 - DNA, 75 bp, Artificial Sequence
  Synthetic
ggtcactgagaaacgaacgtaatggccctggacgcgctagcttcaatcttggagactgtattgcgcaaatgcggt

SEQ ID NO: 305381 - DNA, 75 bp, Artificial Sequence
  Synthetic
ttccaaagagaatgacagcaacgaccatggcatctcaaattatgaattttgaaattgaaaatctgcaactgagga

SEQ ID NO: 305382 - DNA, 75 bp, Artificial Sequence
  Synthetic
atgactgagaaaatgaaattggtcgaaagagaaaaagaaacggttaataaaatgtttctcgagtgtagcagaatt

SEQ ID NO: 305383 - DNA, 75 bp, Artificial Sequence
  Synthetic
atcatagcaataaaattatacgaggactggccaatagagctggactagttgtcgatgaagtagattcaggtaatg

SEQ ID NO: 305384 - DNA, 75 bp, Artificial Sequence
  Synthetic
actggccaatagagctggactagttgtcgatgaagtagattcaggtaatgaaacatctgaccaatcagatgaatc

SEQ ID NO: 305385 - DNA, 75 bp, Artificial Sequence
  Synthetic
gaatcagatttagaggacatgatgaatccaggggaggacgaacggattcctagaggaggcgaaaatcctagaaga

SEQ ID NO: 305386 - DNA, 75 bp, Artificial Sequence
  Synthetic
aagaaatggaacgatttcatgaagacatggaaattttaaacttaaactttgatctagacatgtagacctcttttt

SEQ ID NO: 305387 - DNA, 75 bp, Artificial Sequence
  Synthetic
gatctagacatgtagacctctttttcctttattttgtagacgcgacgctcgaccagggataagtatttggattga

SEQ ID NO: 305388 - DNA, 75 bp, Artificial Sequence
  Synthetic
attgtttcctacttcagttatttttaactgtgaggaaggttataagtttggtggttgtagacatcttcttaataa

SEQ ID NO: 305389 - DNA, 75 bp, Artificial Sequence
  Synthetic
tactcttcacattagcgatggtatgttcagttacggtgttaatagcatacaaaattggattcctcgtgggtggat

SEQ ID NO: 305390 - DNA, 75 bp, Artificial Sequence
  Synthetic
aattattggttgactcttgttcatctcaaaccatccgtgaaatgaataaaatgagaccaggaacatatcccagga

SEQ ID NO: 305391 - DNA, 75 bp, Artificial Sequence
  Synthetic
tcaaaccatccgtgaaatgaataaaatgagaccaggaacatatcccaggatggagcgcgttgaggaggaatttac

SEQ ID NO: 305392 - DNA, 75 bp, Artificial Sequence
  Synthetic
acaattggaatgtgaattacattggacctgaattcgaatcatttaaagagatcataaatcttcttacagataaaa

SEQ ID NO: 305393 - DNA, 75 bp, Artificial Sequence
  Synthetic
atcataaatcttcttacagataaaaattacacagggaaattcgttacattcaccttcaattcgtcaaaaaaacac

SEQ ID NO: 305394 - DNA, 75 bp, Artificial Sequence
  Synthetic
aaatgttgtagatcatcttcctgtgattcagaagaattcaataatatttgggtacatgttatcgtccaaagagtg

SEQ ID NO: 305395 - DNA, 75 bp, Artificial Sequence
  Synthetic
catatgatgatgattcaaacgtgtggacagtatcgatcatggggaacaagttgggtacaacctacaatgaagacg

SEQ ID NO: 305396 - DNA, 75 bp, Artificial Sequence
  Synthetic
tggatgttgaagttgtttctgaagctgttttcctacaatttggcaagcacagagcttttatatctgatatgtatc

SEQ ID NO: 305397 - DNA, 75 bp, Artificial Sequence
  Synthetic
tgttttcctacaatttggcaagcacagagcttttatatctgatatgtatcaacatttaatttcattcagatttaa

SEQ ID NO: 305398 - DNA, 75 bp, Artificial Sequence
  Synthetic
tacattaatcgtcaattaacattaagtaccgacttatcattaattaagcaaaataattttgaaggattttctgga

SEQ ID NO: 305399 - DNA, 75 bp, Artificial Sequence
  Synthetic
gtaccgacttatcattaattaagcaaaataattttgaaggattttctggacatttaattgctgttgagaagtact

SEQ ID NO: 305400 - DNA, 75 bp, Artificial Sequence
  Synthetic
ctgtaatatacttcgttcaatggatattccgtgtcagcagcatcgaccatacattatgcacatgacagtcaaaac

SEQ ID NO: 305401 - DNA, 75 bp, Artificial Sequence
  Synthetic
cgagagcaatgtgcccgatgtaatcataattaacaggaatgatttaattatcaaagaaattaagcgctgagcgga

SEQ ID NO: 305402 - DNA, 75 bp, Artificial Sequence
  Synthetic
aattaaaagtccagttatggcggaaagtagtaatatgcaagatctatttgtgcaagcgacatacgaggaaattct

SEQ ID NO: 305403 - DNA, 75 bp, Artificial Sequence
  Synthetic
aattaaattcgcgtaacagactttaggatctgtgaagcagctaggagacgatctctctgtagttgtttctcccca

SEQ ID NO: 305404 - DNA, 75 bp, Artificial Sequence
  Synthetic
ataaaatggcttcattgctgcttctcgtccttgctgctgcggccaatgctcaactcaacattgttccttctgtac

SEQ ID NO: 305405 - DNA, 75 bp, Artificial Sequence
  Synthetic
tcatcttatgatgtaattgatataatgtctagatatgatctcagttcttgtagtatattagctatcgatgtattt

SEQ ID NO: 305406 - DNA, 75 bp, Artificial Sequence
  Synthetic
aaaatataacgctaataagattcaccatatcaaattgcctcgtggagaagagtggttttcatattcaaagaatct

SEQ ID NO: 305407 - DNA, 75 bp, Artificial Sequence
  Synthetic
ttaataggaatgtactgtgatactcaactttctgatacatacttcgaaatatccactggcggaacgtacgaagtt

SEQ ID NO: 305408 - DNA, 75 bp, Artificial Sequence
  Synthetic
agtaagagaaacgttgaaccgcgcgcataaagaggactaggtgaaagggagggaaccgaacgactagccgaagct

SEQ ID NO: 305409 - DNA, 75 bp, Artificial Sequence
  Synthetic
atgttaacgtatttacgcagagagtggcagtcatttggggagactgtcactatcaaaaatactttcaatgctcaa

SEQ ID NO: 305410 - DNA, 75 bp, Artificial Sequence
  Synthetic
gcaacagctctttaatcgagaatttacatattgaaccgtacaaagtcgaagttttaaaaattgaacatgttggtg

SEQ ID NO: 305411 - DNA, 75 bp, Artificial Sequence
  Synthetic
acatattgaaccgtacaaagtcgaagttttaaaaattgaacatgttggtgacgtctcaagagccacgttattgtc

SEQ ID NO: 305412 - DNA, 75 bp, Artificial Sequence
  Synthetic
caaaagaaattgctgctctacggattcacccaatctggtgtacagggtttgactggagacgtagtatccgttgaa

SEQ ID NO: 305413 - DNA, 75 bp, Artificial Sequence
  Synthetic
acgaaaagaatacctacaccgacacagacaaatctccttactattgaagattcaatacagtgttttacgtgggat

SEQ ID NO: 305414 - DNA, 75 bp, Artificial Sequence
  Synthetic
ttacggaacaatgggaggtgcttttaaaaattggcttgttgactcgggatttgaaaagtatcaatatgattatgt

SEQ ID NO: 305415 - DNA, 75 bp, Artificial Sequence
  Synthetic
aatgcacacacaatcacatatgttaatccatcaggaaaggccggtctgcagcaagactggagaccagcgacagat

SEQ ID NO: 305416 - DNA, 75 bp, Artificial Sequence
  Synthetic
ccaatgccgatagcagccacttccataattgataagactactgttgacgtaccaaatttgactatagttaataaa

SEQ ID NO: 305417 - DNA, 75 bp, Artificial Sequence
  Synthetic
attttttctgcgatgaatagaaagaacgcccatatcatcaattataaaattgatccggatttagcacacgaagtt

SEQ ID NO: 305418 - DNA, 75 bp, Artificial Sequence
  Synthetic
acgcccatatcatcaattataaaattgatccggatttagcacacgaagttctatcacagatgtcgacgaattcaa

SEQ ID NO: 305419 - DNA, 75 bp, Artificial Sequence
  Synthetic
acgtaaacaactgcatataaataactcatttgatacgccgacctatggtcagttagttgagaggatattggatga

SEQ ID NO: 305420 - DNA, 75 bp, Artificial Sequence
  Synthetic
tcatttgatacgccgacctatggtcagttagttgagaggatattggatgatggtcagcttttggacatactagga

SEQ ID NO: 305421 - DNA, 75 bp, Artificial Sequence
  Synthetic
acgcttcaagcatggatctgattgaaacagtcaatgcatgcattaagttgcaaaaaaagattttagatttagctc

SEQ ID NO: 305422 - DNA, 75 bp, Artificial Sequence
  Synthetic
acgcttcaagcatggatctgattgaaacagtcaatgcatgcattaagttgcaaaaaatgattttagatttagctc

SEQ ID NO: 305423 - DNA, 75 bp, Artificial Sequence
  Synthetic
acgcttcaagcatggatctgattgaaacagtcaatgcatgcattaagttgcaaaaaacgattttagatttagctc

SEQ ID NO: 305424 - DNA, 75 bp, Artificial Sequence
  Synthetic
acgcttcaagcatggatctgattgaaacagtcaatgcatgcattaagttgcaaaaaaggattttagatttagctc

SEQ ID NO: 305425 - DNA, 75 bp, Artificial Sequence
  Synthetic
aacagtcaatgcatgcattaagttgcaaaaaaagattttagatttagctccaaacacgaatttgaatacgtctgg

SEQ ID NO: 305426 - DNA, 75 bp, Artificial Sequence
  Synthetic
aacagtcaatgcatgcattaagttgcaaaaaatgattttagatttagctccaaacacgaatttgaatacgtctgg

SEQ ID NO: 305427 - DNA, 75 bp, Artificial Sequence
  Synthetic
aacagtcaatgcatgcattaagttgcaaaaaacgattttagatttagctccaaacacgaatttgaatacgtctgg

SEQ ID NO: 305428 - DNA, 75 bp, Artificial Sequence
  Synthetic
aacagtcaatgcatgcattaagttgcaaaaaaggattttagatttagctccaaacacgaatttgaatacgtctgg

SEQ ID NO: 305429 - DNA, 75 bp, Artificial Sequence
  Synthetic
caaaaaaagattttagatttagctccaaacacgaatttgaatacgtctggccagagtactctgaatgattacaat

SEQ ID NO: 305430 - DNA, 75 bp, Artificial Sequence
  Synthetic
caaaaaatgattttagatttagctccaaacacgaatttgaatacgtctggccagagtactctgaatgattacaat

SEQ ID NO: 305431 - DNA, 75 bp, Artificial Sequence
  Synthetic
caaaaaacgattttagatttagctccaaacacgaatttgaatacgtctggccagagtactctgaatgattacaat

SEQ ID NO: 305432 - DNA, 75 bp, Artificial Sequence
  Synthetic
caaaaaaggattttagatttagctccaaacacgaatttgaatacgtctggccagagtactctgaatgattacaat

SEQ ID NO: 305433 - DNA, 75 bp, Artificial Sequence
  Synthetic
gaacatacacaatactagatcaaactgcagtttttactccattcactatcaatgctccaatcatttccatttcag

SEQ ID NO: 305434 - DNA, 75 bp, Artificial Sequence
  Synthetic
gaacatacacattactagatcaaactgcagtttttactccattcactatcaatgctccaatcatttccatttcag

SEQ ID NO: 305435 - DNA, 75 bp, Artificial Sequence
  Synthetic
gaacatacacactactagatcaaactgcagtttttactccattcactatcaatgctccaatcatttccatttcag

SEQ ID NO: 305436 - DNA, 75 bp, Artificial Sequence
  Synthetic
gaacatacacagtactagatcaaactgcagtttttactccattcactatcaatgctccaatcatttccatttcag

SEQ ID NO: 305437 - DNA, 75 bp, Artificial Sequence
  Synthetic
gaacatactcaatactagatcaaactgcagtttttactccattcactatcaatgctccaatcatttccatttcag

SEQ ID NO: 305438 - DNA, 75 bp, Artificial Sequence
  Synthetic
gaacatactcattactagatcaaactgcagtttttactccattcactatcaatgctccaatcatttccatttcag

SEQ ID NO: 305439 - DNA, 75 bp, Artificial Sequence
  Synthetic
gaacatactcactactagatcaaactgcagtttttactccattcactatcaatgctccaatcatttccatttcag

SEQ ID NO: 305440 - DNA, 75 bp, Artificial Sequence
  Synthetic
gaacatactcagtactagatcaaactgcagtttttactccattcactatcaatgctccaatcatttccatttcag

SEQ ID NO: 305441 - DNA, 75 bp, Artificial Sequence
  Synthetic
gaacatacccaatactagatcaaactgcagtttttactccattcactatcaatgctccaatcatttccatttcag

SEQ ID NO: 305442 - DNA, 75 bp, Artificial Sequence
  Synthetic
gaacatacccattactagatcaaactgcagtttttactccattcactatcaatgctccaatcatttccatttcag

SEQ ID NO: 305443 - DNA, 75 bp, Artificial Sequence
  Synthetic
gaacatacccactactagatcaaactgcagtttttactccattcactatcaatgctccaatcatttccatttcag

SEQ ID NO: 305444 - DNA, 75 bp, Artificial Sequence
  Synthetic
gaacatacccagtactagatcaaactgcagtttttactccattcactatcaatgctccaatcatttccatttcag

SEQ ID NO: 305445 - DNA, 75 bp, Artificial Sequence
  Synthetic
gaacatacgcaatactagatcaaactgcagtttttactccattcactatcaatgctccaatcatttccatttcag

SEQ ID NO: 305446 - DNA, 75 bp, Artificial Sequence
  Synthetic
gaacatacgcattactagatcaaactgcagtttttactccattcactatcaatgctccaatcatttccatttcag

SEQ ID NO: 305447 - DNA, 75 bp, Artificial Sequence
  Synthetic
gaacatacgcactactagatcaaactgcagtttttactccattcactatcaatgctccaatcatttccatttcag

SEQ ID NO: 305448 - DNA, 75 bp, Artificial Sequence
  Synthetic
gaacatacgcagtactagatcaaactgcagtttttactccattcactatcaatgctccaatcatttccatttcag

SEQ ID NO: 305449 - DNA, 75 bp, Artificial Sequence
  Synthetic
tgcagtttttactccattcactatcaatgctccaatcatttccatttcagttcgtatatctacagatgattatga

SEQ ID NO: 305450 - DNA, 75 bp, Artificial Sequence
  Synthetic
attttagatgtacttgctgctgctatcagaacggaaggatcaagacctgtaagagtaatagaaagacgcgttctt

SEQ ID NO: 305451 - DNA, 75 bp, Artificial Sequence
  Synthetic
gatccagctgtcagacagctggtagaagacttaaaactgaaaagtcttgtgtctagtatctcaactgcaaatcta

SEQ ID NO: 305452 - DNA, 75 bp, Artificial Sequence
  Synthetic
agccagaaattatccaaaccgaaaatccattatatgctgacattattgaacaagtcgtgaataggccacaaatga

SEQ ID NO: 305453 - DNA, 75 bp, Artificial Sequence
  Synthetic
caagtcgtgaataggccacaaatgaatatgaccggtggaaatattagagccactttaggcagatggtcaggtaat

SEQ ID NO: 305454 - DNA, 75 bp, Artificial Sequence
  Synthetic
gaatggattcagagcatagatttactgtcgatctcaaagcaagaactactggaataattaatattgtatacgtac

SEQ ID NO: 305455 - DNA, 75 bp, Artificial Sequence
  Synthetic
tgtcgatctcaaagcaagaactactggaataattaatattgtatacgtacccaccgctggaactatactaatacc

SEQ ID NO: 305456 - DNA, 75 bp, Artificial Sequence
  Synthetic
tgtcgatctcaaagcaagaactactggaataattaatattgtatacgtacccaccgctggaactattctaatacc

SEQ ID NO: 305457 - DNA, 75 bp, Artificial Sequence
  Synthetic
tgtcgatctcaaagcaagaactactggaataattaatattgtatacgtacccaccgctggaactatcctaatacc

SEQ ID NO: 305458 - DNA, 75 bp, Artificial Sequence
  Synthetic
tgtcgatctcaaagcaagaactactggaataattaatattgtatacgtacccaccgctggaactatgctaatacc

SEQ ID NO: 305459 - DNA, 75 bp, Artificial Sequence
  Synthetic
ggaaaattaattgatgtttcagcggagatgatggctgacaatttcgccattgattttatggacgatgacgctata

SEQ ID NO: 305460 - DNA, 75 bp, Artificial Sequence
  Synthetic
tcttttctttcccaatgtgtaatcgctttagattcagaatttctccatgggatatgcaaaaagatcaggaaggtc

SEQ ID NO: 305461 - DNA, 75 bp, Artificial Sequence
  Synthetic
ggcacagggaactgctgcaagacagccagccatctctttcatgttcgaaactcgtgacacattcactgaaggtga

SEQ ID NO: 305462 - DNA, 75 bp, Artificial Sequence
  Synthetic
cctaaatcacaatacatgttggacacagttttccccgaaacttcgttcgtgaacaaaccaaatgtagactggaat

SEQ ID NO: 305463 - DNA, 75 bp, Artificial Sequence
  Synthetic
cagttttccccgaaacttcgttcgtgaacaaaccaaatgtagactggaatattcagagtttactcacttcaacta

SEQ ID NO: 305464 - DNA, 75 bp, Artificial Sequence
  Synthetic
caaaaaagaatatatgacttagcaccgaataccaatcttaatacagcggggcagagtactcttaatgactacaac

SEQ ID NO: 305465 - DNA, 75 bp, Artificial Sequence
  Synthetic
gaacatatcctctacatgacttaactgctgtactaactccactaactattcacgcaccaattatatccctctcag

SEQ ID NO: 305466 - DNA, 75 bp, Artificial Sequence
  Synthetic
tgctgtactaactccactaactattcacgcaccaattatatccctctcagtacgtatttctactgatgactatga

SEQ ID NO: 305467 - DNA, 75 bp, Artificial Sequence
  Synthetic
gtgcttgacgtgttagcagcggcaatcagaactgaaggttcgagaccagtacgtgtgattgaaaggcgtgtgctc

SEQ ID NO: 305468 - DNA, 75 bp, Artificial Sequence
  Synthetic
tcagaactgaaggttcgagaccagtacgtgtgattgaaaggcgtgtgctcgatccagttgtcaaacaaatgattg

SEQ ID NO: 305469 - DNA, 75 bp, Artificial Sequence
  Synthetic
tcagaactgaaggttcgagaccagtacgtgtgattgaaaggcgtgtgctcgatccagttgtcaaacaattgattg

SEQ ID NO: 305470 - DNA, 75 bp, Artificial Sequence
  Synthetic
tcagaactgaaggttcgagaccagtacgtgtgattgaaaggcgtgtgctcgatccagttgtcaaacaactgattg

SEQ ID NO: 305471 - DNA, 75 bp, Artificial Sequence
  Synthetic
tcagaactgaaggttcgagaccagtacgtgtgattgaaaggcgtgtgctcgatccagttgtcaaacaagtgattg

SEQ ID NO: 305472 - DNA, 75 bp, Artificial Sequence
  Synthetic
atcagaaatatctatagcaaacttagccgctgtagacactgcgatgatccaacctgaattaattgaaactgaaaa

SEQ ID NO: 305473 - DNA, 75 bp, Artificial Sequence
  Synthetic
atcagaaatatctttagcaaacttagccgctgtagacactgcgatgatccaacctgaattaattgaaactgaaaa

SEQ ID NO: 305474 - DNA, 75 bp, Artificial Sequence
  Synthetic
atcagaaatatctctagcaaacttagccgctgtagacactgcgatgatccaacctgaattaattgaaactgaaaa

SEQ ID NO: 305475 - DNA, 75 bp, Artificial Sequence
  Synthetic
atcagaaatatctgtagcaaacttagccgctgtagacactgcgatgatccaacctgaattaattgaaactgaaaa

SEQ ID NO: 305476 - DNA, 75 bp, Artificial Sequence
  Synthetic
gccgctgtagacactgcgatgatccaacctgaattaattgaaactgaaaacccactattcgccgacattattgag

SEQ ID NO: 305477 - DNA, 75 bp, Artificial Sequence
  Synthetic
atatgactggtggaaacatcaaagccactctaggtaaatggtcgggtaataaaggtgtcattacttgtatgtcag

SEQ ID NO: 305478 - DNA, 75 bp, Artificial Sequence
  Synthetic
atatgactggtggaaacatcaaagccactctaggtatatggtcgggtaataaaggtgtcattacttgtatgtcag

SEQ ID NO: 305479 - DNA, 75 bp, Artificial Sequence
  Synthetic
atatgactggtggaaacatcaaagccactctaggtacatggtcgggtaataaaggtgtcattacttgtatgtcag

SEQ ID NO: 305480 - DNA, 75 bp, Artificial Sequence
  Synthetic
atatgactggtggaaacatcaaagccactctaggtagatggtcgggtaataaaggtgtcattacttgtatgtcag

SEQ ID NO: 305481 - DNA, 75 bp, Artificial Sequence
  Synthetic
atatgactggtggaaacatcatagccactctaggtaaatggtcgggtaataaaggtgtcattacttgtatgtcag

SEQ ID NO: 305482 - DNA, 75 bp, Artificial Sequence
  Synthetic
atatgactggtggaaacatcatagccactctaggtatatggtcgggtaataaaggtgtcattacttgtatgtcag

SEQ ID NO: 305483 - DNA, 75 bp, Artificial Sequence
  Synthetic
atatgactggtggaaacatcatagccactctaggtacatggtcgggtaataaaggtgtcattacttgtatgtcag

SEQ ID NO: 305484 - DNA, 75 bp, Artificial Sequence
  Synthetic
atatgactggtggaaacatcatagccactctaggtagatggtcgggtaataaaggtgtcattacttgtatgtcag

SEQ ID NO: 305485 - DNA, 75 bp, Artificial Sequence
  Synthetic
atatgactggtggaaacatcacagccactctaggtaaatggtcgggtaataaaggtgtcattacttgtatgtcag

SEQ ID NO: 305486 - DNA, 75 bp, Artificial Sequence
  Synthetic
atatgactggtggaaacatcacagccactctaggtatatggtcgggtaataaaggtgtcattacttgtatgtcag

SEQ ID NO: 305487 - DNA, 75 bp, Artificial Sequence
  Synthetic
atatgactggtggaaacatcacagccactctaggtacatggtcgggtaataaaggtgtcattacttgtatgtcag

SEQ ID NO: 305488 - DNA, 75 bp, Artificial Sequence
  Synthetic
atatgactggtggaaacatcacagccactctaggtagatggtcgggtaataaaggtgtcattacttgtatgtcag

SEQ ID NO: 305489 - DNA, 75 bp, Artificial Sequence
  Synthetic
atatgactggtggaaacatcagagccactctaggtaaatggtcgggtaataaaggtgtcattacttgtatgtcag

SEQ ID NO: 305490 - DNA, 75 bp, Artificial Sequence
  Synthetic
atatgactggtggaaacatcagagccactctaggtatatggtcgggtaataaaggtgtcattacttgtatgtcag

SEQ ID NO: 305491 - DNA, 75 bp, Artificial Sequence
  Synthetic
atatgactggtggaaacatcagagccactctaggtacatggtcgggtaataaaggtgtcattacttgtatgtcag

SEQ ID NO: 305492 - DNA, 75 bp, Artificial Sequence
  Synthetic
atatgactggtggaaacatcagagccactctaggtagatggtcgggtaataaaggtgtcattacttgtatgtcag

SEQ ID NO: 305493 - DNA, 75 bp, Artificial Sequence
  Synthetic
cactctaggtaaatggtcgggtaataaaggtgtcattacttgtatgtcaggcatggactcagaacacagattcac

SEQ ID NO: 305494 - DNA, 75 bp, Artificial Sequence
  Synthetic
cactctaggtatatggtcgggtaataaaggtgtcattacttgtatgtcaggcatggactcagaacacagattcac

SEQ ID NO: 305495 - DNA, 75 bp, Artificial Sequence
  Synthetic
cactctaggtacatggtcgggtaataaaggtgtcattacttgtatgtcaggcatggactcagaacacagattcac

SEQ ID NO: 305496 - DNA, 75 bp, Artificial Sequence
  Synthetic
cactctaggtagatggtcgggtaataaaggtgtcattacttgtatgtcaggcatggactcagaacacagattcac

SEQ ID NO: 305497 - DNA, 75 bp, Artificial Sequence
  Synthetic
ggcgtattaaatatcgtatacgtaccagcagctggcacgatactcattccaatgccaaatggaagaacaagagaa

SEQ ID NO: 305498 - DNA, 75 bp, Artificial Sequence
  Synthetic
ggcgtattaaatatcgtttacgtaccagcagctggcacgatactcattccaatgccaaatggaagaacaagagaa

SEQ ID NO: 305499 - DNA, 75 bp, Artificial Sequence
  Synthetic
ggcgtattaaatatcgtctacgtaccagcagctggcacgatactcattccaatgccaaatggaagaacaagagaa

SEQ ID NO: 305500 - DNA, 75 bp, Artificial Sequence
  Synthetic
ggcgtattaaatatcgtgtacgtaccagcagctggcacgatactcattccaatgccaaatggaagaacaagagaa

SEQ ID NO: 305501 - DNA, 75 bp, Artificial Sequence
  Synthetic
cagcagctggcacgatactcattccaatgccaaatggaagaacaagagaagggaaacttattgatgtctcagccg

SEQ ID NO: 305502 - DNA, 75 bp, Artificial Sequence
  Synthetic
tgacttcatggaagacgatgctataatacaaaccgaaactggagttggtgttttctctttaccaatgtgcaatag

SEQ ID NO: 305503 - DNA, 75 bp, Artificial Sequence
  Synthetic
tgacttcatggaagacgatgctataatacaaaccgaaactggagttggtgttttctcttttccaatgtgcaatag

SEQ ID NO: 305504 - DNA, 75 bp, Artificial Sequence
  Synthetic
tgacttcatggaagacgatgctataatacaaaccgaaactggagttggtgttttctctttcccaatgtgcaatag

SEQ ID NO: 305505 - DNA, 75 bp, Artificial Sequence
  Synthetic
tgacttcatggaagacgatgctataatacaaaccgaaactggagttggtgttttctctttgccaatgtgcaatag

SEQ ID NO: 305506 - DNA, 75 bp, Artificial Sequence
  Synthetic
atacaaaccgaaactggagttggtgttttctctttaccaatgtgcaatagaataaggtttaggatcaatccatgg

SEQ ID NO: 305507 - DNA, 75 bp, Artificial Sequence
  Synthetic
atacaaaccgaaactggagttggtgttttctcttttccaatgtgcaatagaataaggtttaggatcaatccatgg

SEQ ID NO: 305508 - DNA, 75 bp, Artificial Sequence
  Synthetic
atacaaaccgaaactggagttggtgttttctctttcccaatgtgcaatagaataaggtttaggatcaatccatgg

SEQ ID NO: 305509 - DNA, 75 bp, Artificial Sequence
  Synthetic
atacaaaccgaaactggagttggtgttttctctttgccaatgtgcaatagaataaggtttaggatcaatccatgg

SEQ ID NO: 305510 - DNA, 75 bp, Artificial Sequence
  Synthetic
taggaacggtacgtatgacaaactgggctcagggaaatgcagcgagacaaccagcagtatcatttctctttgaaa

SEQ ID NO: 305511 - DNA, 75 bp, Artificial Sequence
  Synthetic
taggaacggtacgtatgacaaactgggctcagggaaatgcagcgagacaaccagctgtatcatttctctttgaaa

SEQ ID NO: 305512 - DNA, 75 bp, Artificial Sequence
  Synthetic
taggaacggtacgtatgacaaactgggctcagggaaatgcagcgagacaaccagccgtatcatttctctttgaaa

SEQ ID NO: 305513 - DNA, 75 bp, Artificial Sequence
  Synthetic
taggaacggtacgtatgacaaactgggctcagggaaatgcagcgagacaaccagcggtatcatttctctttgaaa

SEQ ID NO: 305514 - DNA, 75 bp, Artificial Sequence
  Synthetic
ggctcagggaaatgcagcgagacaaccagcagtatcatttctctttgaaactagaagaacatttactgagggcga

SEQ ID NO: 305515 - DNA, 75 bp, Artificial Sequence
  Synthetic
ggctcagggaaatgcagcgagacaaccagctgtatcatttctctttgaaactagaagaacatttactgagggcga

SEQ ID NO: 305516 - DNA, 75 bp, Artificial Sequence
  Synthetic
ggctcagggaaatgcagcgagacaaccagccgtatcatttctctttgaaactagaagaacatttactgagggcga

SEQ ID NO: 305517 - DNA, 75 bp, Artificial Sequence
  Synthetic
ggctcagggaaatgcagcgagacaaccagcggtatcatttctctttgaaactagaagaacatttactgagggcga

SEQ ID NO: 305518 - DNA, 75 bp, Artificial Sequence
  Synthetic
cctaaggcacaatacatgctagatactgtatttccagaatcatcatttataaataagcccccaacagaatggaac

SEQ ID NO: 305519 - DNA, 75 bp, Artificial Sequence
  Synthetic
ctgtatttccagaatcatcatttataaataagcccccaacagaatggaacatacagagtttactaacttcaagca

SEQ ID NO: 305520 - DNA, 75 bp, Artificial Sequence
  Synthetic
tagcaatgctagtgtctgcgtttgctgccaaagtctgatccggcgtcagctcccaaagggagtgcttcgaaaggt

SEQ ID NO: 305521 - DNA, 75 bp, Artificial Sequence
  Synthetic
acgcttcaagcatggatctgattgaaacagtcaatgcatgcattaaattgcaaaaaaggattttagatttagctc

SEQ ID NO: 305522 - DNA, 75 bp, Artificial Sequence
  Synthetic
aacagtcaatgcatgcattaaattgcaaaaaaggattttagatttagctccaaacacgaatttgaatacatctgg

SEQ ID NO: 305523 - DNA, 75 bp, Artificial Sequence
  Synthetic
caaaaaaggattttagatttagctccaaacacgaatttgaatacatctggtcagagtactctgaacgactacaat

SEQ ID NO: 305524 - DNA, 75 bp, Artificial Sequence
  Synthetic
gaacatacgcattgttggatcaaaccgcggttttttctccattcactatcaatgctccaattatttccatttcag

SEQ ID NO: 305525 - DNA, 75 bp, Artificial Sequence
  Synthetic
cgcggttttttctccattcactatcaatgctccaattatttccatttcagttcgcatatccacagatgattatga

SEQ ID NO: 305526 - DNA, 75 bp, Artificial Sequence
  Synthetic
attttagatgtactcgccgctgccattagaacagagggatcaagacctgtaagagtaatagaaaggcgtgttctt

SEQ ID NO: 305527 - DNA, 75 bp, Artificial Sequence
  Synthetic
gatccaactgttaggcagctggtagaggacttaaaactgaaaagtcttgtgtctagtatctcaactgcaaatcta

SEQ ID NO: 305528 - DNA, 75 bp, Artificial Sequence
  Synthetic
tgtcgatctcaaagcaagaactactggaataattaacattgtatacgtaccaactgctggaactatactagtacc

SEQ ID NO: 305529 - DNA, 75 bp, Artificial Sequence
  Synthetic
ggaaagttaattgatgtttcagcggagatgatggctgacaatttcaccattgattttatggacgatgatgctata

SEQ ID NO: 305530 - DNA, 75 bp, Artificial Sequence
  Synthetic
ggaaagttaattgatgtttcagcggagatgatggctgacaatttctccattgattttatggacgatgatgctata

SEQ ID NO: 305531 - DNA, 75 bp, Artificial Sequence
  Synthetic
ggaaagttaattgatgtttcagcggagatgatggctgacaatttccccattgattttatggacgatgatgctata

SEQ ID NO: 305532 - DNA, 75 bp, Artificial Sequence
  Synthetic
ggaaagttaattgatgtttcagcggagatgatggctgacaatttcgccattgattttatggacgatgatgctata

SEQ ID NO: 305533 - DNA, 75 bp, Artificial Sequence
  Synthetic
tcttttctttcccaatgtgtaaccgttttagattcagaatttctccatgggatatgcaaaaagatcaagaaggtc

SEQ ID NO: 305534 - DNA, 75 bp, Artificial Sequence
  Synthetic
tcgcgattctagtgtctgcatatgctgcaaaagtctgatccggcgtcagcttccaaaggaagtgcttcgagaggt

SEQ ID NO: 305535 - DNA, 75 bp, Artificial Sequence
  Synthetic
acgcttcaagcatggatctgattgaaacagttaatgcatgcgttaggttgcagaaaagaattctaaatttagcgc

SEQ ID NO: 305536 - DNA, 75 bp, Artificial Sequence
  Synthetic
cagaaaagaattctaaatttagcgccaaatacaaatttgaatacatccggccaaagcactctgaatgactacaac

SEQ ID NO: 305537 - DNA, 75 bp, Artificial Sequence
  Synthetic
gaacatatgcttttctcgatcaaaccgctgttcttacccctttcaccattagtgctccaattatttcactttcag

SEQ ID NO: 305538 - DNA, 75 bp, Artificial Sequence
  Synthetic
cgctgttcttacccctttcaccattagtgctccaattatttcactttcagtacgtatatccacagatgattacga

SEQ ID NO: 305539 - DNA, 75 bp, Artificial Sequence
  Synthetic
attctagatgtgctcgctgctgctattagaacggaaggatctagaccagtaagagcgatagaaagacgtgttctt

SEQ ID NO: 305540 - DNA, 75 bp, Artificial Sequence
  Synthetic
ttagaacggaaggatctagaccagtaagagcgatagaaagacgtgttcttgaaccagccgttaagcagttggtag

SEQ ID NO: 305541 - DNA, 75 bp, Artificial Sequence
  Synthetic
ttccgatatctctgttgcaaacctagcagctgtagatactgccgtaattcagccagaaattattcagactgagaa

SEQ ID NO: 305542 - DNA, 75 bp, Artificial Sequence
  Synthetic
caagttgtaaacaggccacaaatgaatatgactggcgggaacataagggctactttaggaagatggtcaggtaat

SEQ ID NO: 305543 - DNA, 75 bp, Artificial Sequence
  Synthetic
gaatggattctgaacacagattcaccgttgatcttaaggctagaactactggaataattaacatcgtatatgtgc

SEQ ID NO: 305544 - DNA, 75 bp, Artificial Sequence
  Synthetic
tatgccaaatggaagaaatagagaaggcaagttaattgatgtttcagcagaaatgatggctgagaattttgccat

SEQ ID NO: 305545 - DNA, 75 bp, Artificial Sequence
  Synthetic
ggcaagttaattgatgtttcagcagaaatgatggctgagaattttgccatcgatttcatggacgatgatgccata

SEQ ID NO: 305546 - DNA, 75 bp, Artificial Sequence
  Synthetic
tctattctttcccaatgtgtaaccgcattagatttagaatttctccatgggatatgcaaaaggatcaagatggtc

SEQ ID NO: 305547 - DNA, 75 bp, Artificial Sequence
  Synthetic
cattagatttagaatttctccatgggatatgcaaaaggatcaagatggtctaggcacagttcacatgacgaactg

SEQ ID NO: 305548 - DNA, 75 bp, Artificial Sequence
  Synthetic
ccagccatttcttttatgtttgaaacccgcgacacctttactcaaggtgactaccaacatttatctaaatgtaca

SEQ ID NO: 305549 - DNA, 75 bp, Artificial Sequence
  Synthetic
cccgcgacacctttactcaaggtgactaccaacatttatctaaatgtacacccaaatcacagtatgtgttggata

SEQ ID NO: 305550 - DNA, 75 bp, Artificial Sequence
  Synthetic
gaacaagccgaacattgattggaacattcagagtttacttacttccaccactcaaccagtatggtgtaagaaaat

SEQ ID NO: 305551 - DNA, 75 bp, Artificial Sequence
  Synthetic
tagcaatcctagtgtctgcatatgctgcgaaaatctgatccggcgtcagcttccaaaggaagtgcttcgagaggt

SEQ ID NO: 305552 - DNA, 75 bp, Artificial Sequence
  Synthetic
ggtataatacaggtgtgtcatctatgcaagtctgggaaacctatgggaagcaggcaatctagtttgcagtcacag

SEQ ID NO: 305553 - DNA, 75 bp, Artificial Sequence
  Synthetic
gcaagtctgggaaacctatgggaagcaggcaatctagtttgcagtcacagactcaccgaactgacataaattcac

SEQ ID NO: 305554 - DNA, 75 bp, Artificial Sequence
  Synthetic
caggcaatctagtttgcagtcacagactcaccgaactgacataaattcacatcattcgaatatttacttgcaagg

SEQ ID NO: 305555 - DNA, 75 bp, Artificial Sequence
  Synthetic
cagcatatcatagttacagttggtgctgctttactggcactgctgttagcatctttaattttcagtttaatttgt

SEQ ID NO: 305556 - DNA, 75 bp, Artificial Sequence
  Synthetic
ctgctttactggcactgctgttagcatctttaattttcagtttaatttgtaactgctacctattgtcaagactcc

SEQ ID NO: 305557 - DNA, 75 bp, Artificial Sequence
  Synthetic
aacacgcgaaatacaagaaagatttgattccaacctatcaaaatcacttgtttgatccaactgcgttatccaaaa

SEQ ID NO: 305558 - DNA, 75 bp, Artificial Sequence
  Synthetic
gattccaacctatcaaaatcacttgtttgatccaactgcgttatccaaaaagccactaaaagttgagtgtgtcaa

SEQ ID NO: 305559 - DNA, 75 bp, Artificial Sequence
  Synthetic
ccacacctggctggcgaatcaattctgttggaagatgtgtgtccactacaccacgagcacttttgcggcgcggtg

SEQ ID NO: 305560 - DNA, 75 bp, Artificial Sequence
  Synthetic
tgttggaagatgtgtgtccactacaccacgagcacttttgcggcgcggtgcacattccgaagcaaacgaacctga

SEQ ID NO: 305561 - DNA, 75 bp, Artificial Sequence
  Synthetic
tacagcagataaaatagcatggccatgtggattagaatctattataatcgatgggaaagtaataaatggatccgc

SEQ ID NO: 305562 - DNA, 75 bp, Artificial Sequence
  Synthetic
tgtggattagaatctattataatcgatgggaaagtaataaatggatccgccttcgtaaaatgtagatgcggccaa

SEQ ID NO: 305563 - DNA, 75 bp, Artificial Sequence
  Synthetic
cttcagaattcttttttctaacatgctgttcaaatgacacaaagtcaattaaaattggattgtgcgagaaatata

SEQ ID NO: 305564 - DNA, 75 bp, Artificial Sequence
  Synthetic
ctgttcaaatgacacaaagtcaattaaaattggattgtgcgagaaatataagtgtttgaattgcgctaaagatat

SEQ ID NO: 305565 - DNA, 75 bp, Artificial Sequence
  Synthetic
atttttacaacacaccagtattatttaccaagtcaaacttgcccttcttgtactccattcagagataccgtcgca

SEQ ID NO: 305566 - DNA, 75 bp, Artificial Sequence
  Synthetic
taccaagtcaaacttgcccttcttgtactccattcagagataccgtcgcagtaatgtcccttctgaacaaagtta

SEQ ID NO: 305567 - DNA, 75 bp, Artificial Sequence
  Synthetic
aatgcgtgaagattatgattggaaaagacagctagagaataactgtgaatcagcgttcaggtcttttaactcgcc

SEQ ID NO: 305568 - DNA, 75 bp, Artificial Sequence
  Synthetic
agacagctagagaataactgtgaatcagcgttcaggtcttttaactcgccacagctagctcacaggattacaacc

SEQ ID NO: 305569 - DNA, 75 bp, Artificial Sequence
  Synthetic
caatgcataccataacagaaacgctcagctcagtcaacagacgctggcacaatcagataaagattacaccagttc

SEQ ID NO: 305570 - DNA, 75 bp, Artificial Sequence
  Synthetic
cagctcagtcaacagacgctggcacaatcagataaagattacaccagttcacagaggaaaagtgatagtgagtga

SEQ ID NO: 305571 - DNA, 75 bp, Artificial Sequence
  Synthetic
ttcactgacaatgctgacttatactgctccttcaacatgttgctcctgcaatggaagcttgcttgaacatggaat

SEQ ID NO: 305572 - DNA, 75 bp, Artificial Sequence
  Synthetic
atggaagcttgcttgaacatggaatgagagttccagatctctaaccagacgtagatttccactttacctaaaaaa

SEQ ID NO: 305573 - DNA, 75 bp, Artificial Sequence
  Synthetic
aacagttaacgcatgcatcaaattgcaaaaaaaagttctaagtttagcaccgaacacgaacttaaacacatccgg

SEQ ID NO: 305574 - DNA, 75 bp, Artificial Sequence
  Synthetic
gcattggcttcaagatgcaatggaaaaacatatgccatgttagatcaaactgcagttctaactccttttactatc

SEQ ID NO: 305575 - DNA, 75 bp, Artificial Sequence
  Synthetic
aaatgatggctgagaacttcgccattgactttatggatgacgatgctataattcaaactgaaacaggagttggag

SEQ ID NO: 305576 - DNA, 75 bp, Artificial Sequence
  Synthetic
catcagattcagaatttctccatgggatatgcagaaagatcaagaaggtcttggtacagttcatatgacaaactg

SEQ ID NO: 305577 - DNA, 75 bp, Artificial Sequence
  Synthetic
ttggtacagttcatatgacaaactgggcacagggaacagctgctagacagccagctgtatctttcatgtttgaga

SEQ ID NO: 305578 - DNA, 75 bp, Artificial Sequence
  Synthetic
ctatcagcacctatccaagtgtgcaccaaaatcacagtacatgctagacacaattttccctgaaacgtcatttgt

SEQ ID NO: 305579 - DNA, 75 bp, Artificial Sequence
  Synthetic
ggattaaatagcccaactgacgcttcaagcatggatctgattgaaacagtaaatgcatgcgttgcattgcagaag

SEQ ID NO: 305580 - DNA, 75 bp, Artificial Sequence
  Synthetic
caaatttgaatacagcaggacagagtgttcttaatgactacaatgctctggcatcaagaataactggtaaaactt

SEQ ID NO: 305581 - DNA, 75 bp, Artificial Sequence
  Synthetic
tgttcttaatgactacaatgctctggcatcaagaataactggtaaaacttatgcattgcttgatcttactgcagt

SEQ ID NO: 305582 - DNA, 75 bp, Artificial Sequence
  Synthetic
ccaattatttcgctatcagtaaggatctcaactgacgattatgacgacatgagatcaggaataaactctatactc

SEQ ID NO: 305583 - DNA, 75 bp, Artificial Sequence
  Synthetic
tctcaactgacgattatgacgacatgagatcaggaataaactctatactcgacgtacttgctgcagccatcagaa

SEQ ID NO: 305584 - DNA, 75 bp, Artificial Sequence
  Synthetic
aattgaaagacgcgtccatgacccagcagtaagacagttggtggaagatctcaaaatgaaaagtttagtgtcaga

SEQ ID NO: 305585 - DNA, 75 bp, Artificial Sequence
  Synthetic
gcagtaagacagttggtggaagatctcaaaatgaaaagtttagtgtcagatatatcattagctaacctcgctgca

SEQ ID NO: 305586 - DNA, 75 bp, Artificial Sequence
  Synthetic
aggtaattgaaaccgaaaatccgctgtatgctgacatcattgaacaagtggttcacagagcaaacatgaatatga

SEQ ID NO: 305587 - DNA, 75 bp, Artificial Sequence
  Synthetic
gtatgctgacatcattgaacaagtggttcacagagcaaacatgaatatgacaggaggaaacataagagcgacttt

SEQ ID NO: 305588 - DNA, 75 bp, Artificial Sequence
  Synthetic
gtaattacctgtatgtcaggtatggattcagagcataggtttatagttgaactcaaagcaagaacaactggcatt

SEQ ID NO: 305589 - DNA, 75 bp, Artificial Sequence
  Synthetic
attcagagcataggtttatagttgaactcaaagcaagaacaactggcattataaacattgtctacgttccaacag

SEQ ID NO: 305590 - DNA, 75 bp, Artificial Sequence
  Synthetic
aaatgggagatcgagagaagggaaactcattgacgtttcagcagaaatgatggcagataatttcgccattgattt

SEQ ID NO: 305591 - DNA, 75 bp, Artificial Sequence
  Synthetic
ctcattgacgtttcagcagaaatgatggcagataatttcgccattgattttatggaagatgatgctatagtacgg

SEQ ID NO: 305592 - DNA, 75 bp, Artificial Sequence
  Synthetic
ctttcccaatgtgcaacaggataaggtttcgaataagcccatgggacatgcagaaagatcaggaaggcttgggaa

SEQ ID NO: 305593 - DNA, 75 bp, Artificial Sequence
  Synthetic
gtttcgaataagcccatgggacatgcagaaagatcaggaaggcttgggaaccgttcatatgacaaactgggcaca

SEQ ID NO: 305594 - DNA, 75 bp, Artificial Sequence
  Synthetic
gtatcttttctattcgaaactaggagaacatttactgagggtgattaccagcatctatccagatgcactccaaaa

SEQ ID NO: 305595 - DNA, 75 bp, Artificial Sequence
  Synthetic
gaacatttactgagggtgattaccagcatctatccagatgcactccaaaagctcagcatgcactggacaccatat

SEQ ID NO: 305596 - DNA, 75 bp, Artificial Sequence
  Synthetic
acccgatgttgactggaacgttcaaagtttacttacatcaagcaccaataaagcttgggctcaaaagatagcaat

SEQ ID NO: 305597 - DNA, 75 bp, Artificial Sequence
  Synthetic
gctagtatccgcatttgctgctaaagtctgatccggcgtcagcttccaaaggaagtgcttcgagaggagcgaaaa

SEQ ID NO: 305598 - DNA, 75 bp, Artificial Sequence
  Synthetic
acgctgtgagcatggatctgattgaaacagtaaacgcatgcgttgcattgcaaaaaagaatattaaatttagcac

SEQ ID NO: 305599 - DNA, 75 bp, Artificial Sequence
  Synthetic
aacagtaaacgcatgcgttgcattgcaaaaaagaatattaaatttagcaccaaatacaaatttaagtacatcagg

SEQ ID NO: 305600 - DNA, 75 bp, Artificial Sequence
  Synthetic
caaaaaagaatattaaatttagcaccaaatacaaatttaagtacatcaggtcaaagtacactcaatgattataat

SEQ ID NO: 305601 - DNA, 75 bp, Artificial Sequence
  Synthetic
gaacttatgctttctatgaccaaacagcggtattaacgccaattaccattaacactccaatcatttcgttgtcag

SEQ ID NO: 305602 - DNA, 75 bp, Artificial Sequence
  Synthetic
agcggtattaacgccaattaccattaacactccaatcatttcgttgtcagtgcgcatttctacagatgactatga

SEQ ID NO: 305603 - DNA, 75 bp, Artificial Sequence
  Synthetic
atcttggacgcactcgcagcggcaataagaactgaaggtgtgcggcctacccgcgcgattgagagacgtgtgctg

SEQ ID NO: 305604 - DNA, 75 bp, Artificial Sequence
  Synthetic
taagaactgaaggtgtgcggcctacccgcgcgattgagagacgtgtgctggacccagctgtcaaacagctagttg

SEQ ID NO: 305605 - DNA, 75 bp, Artificial Sequence
  Synthetic
ttcagaaatctcagtcgctaaccttgctgccgttgatacagccttcatccaacctgagatcatagaaacagaaaa

SEQ ID NO: 305606 - DNA, 75 bp, Artificial Sequence
  Synthetic
gctgccgttgatacagccttcatccaacctgagatcatagaaacagaaaatccgttatatgcagatatcattgaa

SEQ ID NO: 305607 - DNA, 75 bp, Artificial Sequence
  Synthetic
acatgacgggaggaaacataagagcaaccttgggtagatggtcaggcaacaaaggggtagtgacatgtatgtccg

SEQ ID NO: 305608 - DNA, 75 bp, Artificial Sequence
  Synthetic
aaccttgggtagatggtcaggcaacaaaggggtagtgacatgtatgtccggaatggactcagagcatagattcac

SEQ ID NO: 305609 - DNA, 75 bp, Artificial Sequence
  Synthetic
ggtattattaacattctttatataccaaccgcgggaactattctcattccaatgccaaacggaagaccaagagaa

SEQ ID NO: 305610 - DNA, 75 bp, Artificial Sequence
  Synthetic
caaccgcgggaactattctcattccaatgccaaacggaagaccaagagaaggaaagttgattgacgtttctgccg

SEQ ID NO: 305611 - DNA, 75 bp, Artificial Sequence
  Synthetic
agattttatggatgatgatgcaattcttcaaactgaaactggtgttggagtattctcatttccaatgtgtaacaa

SEQ ID NO: 305612 - DNA, 75 bp, Artificial Sequence
  Synthetic
cttcaaactgaaactggtgttggagtattctcatttccaatgtgtaacaaaataagatttaggataaatccgtgg

SEQ ID NO: 305613 - DNA, 75 bp, Artificial Sequence
  Synthetic
taggaacagtacacatgactaattgggcacaaggaaatgcaactagacaacctgctatatcattcttatttgaaa

SEQ ID NO: 305614 - DNA, 75 bp, Artificial Sequence
  Synthetic
ggcacaaggaaatgcaactagacaacctgctatatcattcttatttgaaacgcgaaggacttttacagaaggtga

SEQ ID NO: 305615 - DNA, 75 bp, Artificial Sequence
  Synthetic
ccaaaggctcaatttacacttgacacagtatttcccgagacatctttcattgttaaacctgatgttgaatggaac

SEQ ID NO: 305616 - DNA, 75 bp, Artificial Sequence
  Synthetic
accagccagtatggtgtaggaaaatagcaatgttagtgtctgcatttgctgctaaagtctgatccggcgtcagct

SEQ ID NO: 305617 - DNA, 75 bp, Artificial Sequence
  Synthetic
ggattaaataacccaactgacgcttcaagcatggatctgattgaaacagttaatgcatgcatcaagttgcagaaa

SEQ ID NO: 305618 - DNA, 75 bp, Artificial Sequence
  Synthetic
caagcatggatctgattgaaacagttaatgcatgcatcaagttgcagaaaagagttttaagtttagcgccaaaca

SEQ ID NO: 305619 - DNA, 75 bp, Artificial Sequence
  Synthetic
taatgcatgcatcaagttgcagaaaagagttttaagtttagcgccaaacacgaatttaaacacgtctggccaaag

SEQ ID NO: 305620 - DNA, 75 bp, Artificial Sequence
  Synthetic
gcttcaagatgtaatggaaggacatatgctctgcttgatcaaactgccgttctcacccccttcactgtcaacgct

SEQ ID NO: 305621 - DNA, 75 bp, Artificial Sequence
  Synthetic
atgctctgcttgatcaaactgccgttctcacccccttcactgtcaacgctccaatcatttccctatcagtccgta

SEQ ID NO: 305622 - DNA, 75 bp, Artificial Sequence
  Synthetic
gagatctggaatgaattcaattctagatgtgcttgctgctgctatccgaacggaaggatctagacctgtcagagc

SEQ ID NO: 305623 - DNA, 75 bp, Artificial Sequence
  Synthetic
gatgtgcttgctgctgctatccgaacggaaggatctagacctgtcagagcaatagaaagacgtgtacttgaccca

SEQ ID NO: 305624 - DNA, 75 bp, Artificial Sequence
  Synthetic
taaaactaaaaagtctcacttctgacatttcaatcgcaaatttggcagccgtggatactgctataatccaaccgg

SEQ ID NO: 305625 - DNA, 75 bp, Artificial Sequence
  Synthetic
catttcaatcgcaaatttggcagccgtggatactgctataatccaaccggaagttattcagactgaaaatccgtt

SEQ ID NO: 305626 - DNA, 75 bp, Artificial Sequence
  Synthetic
gtaaacagaccgcaaatgaacatgactggcggaaacattagggctactctgggaagatggtcaggtaataaagga

SEQ ID NO: 305627 - DNA, 75 bp, Artificial Sequence
  Synthetic
ctggcggaaacattagggctactctgggaagatggtcaggtaataaaggagtagtaacgtgcatgtcaggtatgg

SEQ ID NO: 305628 - DNA, 75 bp, Artificial Sequence
  Synthetic
tctcaaagctagaacaactgggataattaacattgtgtatataccacctgcagggactatattaatacccatgcc

SEQ ID NO: 305629 - DNA, 75 bp, Artificial Sequence
  Synthetic
attaacattgtgtatataccacctgcagggactatattaatacccatgccaaatgcaagaaatagagaaggtaaa

SEQ ID NO: 305630 - DNA, 75 bp, Artificial Sequence
  Synthetic
tggctgaagattttgctattgattttatggacgatgatgctattattcagacagagacaggagttggagtctatt

SEQ ID NO: 305631 - DNA, 75 bp, Artificial Sequence
  Synthetic
tatggacgatgatgctattattcagacagagacaggagttggagtctattcttttccaatgtgtaatcgctttag

SEQ ID NO: 305632 - DNA, 75 bp, Artificial Sequence
  Synthetic
cagaaagatcaggatggtcttggtacagtccatatgacaaactgggcgcaggggacagctgctagacaaccagct

SEQ ID NO: 305633 - DNA, 75 bp, Artificial Sequence
  Synthetic
cagtccatatgacaaactgggcgcaggggacagctgctagacaaccagctatatcctttatgtttgaaactcgtg

SEQ ID NO: 305634 - DNA, 75 bp, Artificial Sequence
  Synthetic
gcatctatctagatgtgcacctaagtcacaatatatgttggacacaatttttccagatacatcattcgtaaatag

SEQ ID NO: 305635 - DNA, 75 bp, Artificial Sequence
  Synthetic
ttccagatacatcattcgtaaataggccaaacgtggattggaatattcaaagcttactcacttctaccgtccaaa

SEQ ID NO: 305636 - DNA, 75 bp, Artificial Sequence
  Synthetic
tctggtgtctgcatatgctgcgagagtctgatccggcgtcagcttccaaaggaagtgcttcgagaggtgtgaaaa

SEQ ID NO: 305637 - DNA, 75 bp, Artificial Sequence
  Synthetic
tcaagcatggatctgatcgaaacagtgaacgcatgcgtaaaattgcaaaagcgagtacttggtttggctccaaat

SEQ ID NO: 305638 - DNA, 75 bp, Artificial Sequence
  Synthetic
atgggaaataggcaatccagcttgcaatcgcagacacacagaactgacattaactcacaccattcgaacatctac

SEQ ID NO: 305639 - DNA, 75 bp, Artificial Sequence
  Synthetic
aatcgcagacacacagaactgacattaactcacaccattcgaacatctaccttcaaagtgcatcttttgctgagt

SEQ ID NO: 305640 - DNA, 75 bp, Artificial Sequence
  Synthetic
taactcacaccattcgaacatctaccttcaaagtgcatcttttgctgagttcaaaacctaccatttattgatcac

SEQ ID NO: 305641 - DNA, 75 bp, Artificial Sequence
  Synthetic
ctgttcgcattcctcatttcaagcttagtgtgtaattgctatttactacgaaggctaagaaatggacctcgtaaa

SEQ ID NO: 305642 - DNA, 75 bp, Artificial Sequence
  Synthetic
tagtgtgtaattgctatttactacgaaggctaagaaatggacctcgtaaagtttatcgcgcaggcaaagtacaag

SEQ ID NO: 305643 - DNA, 75 bp, Artificial Sequence
  Synthetic
acaatttattcgatccgacaactttgtctaaaaaacccaaaaagatagaactcattaaatacaataatccgtttc

SEQ ID NO: 305644 - DNA, 75 bp, Artificial Sequence
  Synthetic
gtctaaaaaacccaaaaagatagaactcattaaatacaataatccgtttcatgaagtacctcaacttgctggaga

SEQ ID NO: 305645 - DNA, 75 bp, Artificial Sequence
  Synthetic
ccttacaatcatgagcacttttgtggtggtatacacattccaaaacagtttaacatgtcaccaaaaggaagaatc

SEQ ID NO: 305646 - DNA, 75 bp, Artificial Sequence
  Synthetic
gtggtatacacattccaaaacagtttaacatgtcaccaaaaggaagaatcaattacattacaggcgataagatcg

SEQ ID NO: 305647 - DNA, 75 bp, Artificial Sequence
  Synthetic
cattattgatggaaaaaaatacacgggttcagcatttgttaagtgcagatgtggccagccatatccaacaattat

SEQ ID NO: 305648 - DNA, 75 bp, Artificial Sequence
  Synthetic
ggttcagcatttgttaagtgcagatgtggccagccatatccaacaattatagatcaaatgtcaacgttcttcttt

SEQ ID NO: 305649 - DNA, 75 bp, Artificial Sequence
  Synthetic
aatcagtgaagattggaccaagtgaaaaattcaactgtctaaactgcaatagaagtgtgcgttggtttagtccgg

SEQ ID NO: 305650 - DNA, 75 bp, Artificial Sequence
  Synthetic
aaaattcaactgtctaaactgcaatagaagtgtgcgttggtttagtccggggagaggcattcgaacgacacgcca

SEQ ID NO: 305651 - DNA, 75 bp, Artificial Sequence
  Synthetic
ccagcatgcatgccgtttcgtgatattgtcgctacaatgtctctgctgaacaaagtagaatttcttggtgctgat

SEQ ID NO: 305652 - DNA, 75 bp, Artificial Sequence
  Synthetic
ttgtcgctacaatgtctctgctgaacaaagtagaatttcttggtgctgattttgatcaaatgcgtactgattttg

SEQ ID NO: 305653 - DNA, 75 bp, Artificial Sequence
  Synthetic
ctgtgaatctgcctttagatcattcaattctccacagctggcacacagagttacgccgtatgaaagaatagaccc

SEQ ID NO: 305654 - DNA, 75 bp, Artificial Sequence
  Synthetic
aattctccacagctggcacacagagttacgccgtatgaaagaatagacccaaatctcactctgaatacagttact

SEQ ID NO: 305655 - DNA, 75 bp, Artificial Sequence
  Synthetic
gacagcctaacaaaatagagattacaccaatatgcagagggaaaattacaatttgcgatggatatagaagatgca

SEQ ID NO: 305656 - DNA, 75 bp, Artificial Sequence
  Synthetic
ttctcgattttcaggacaacgctcaactgcattgttcaatctgcacgctattgcttcgctggaagctcatttgaa

SEQ ID NO: 305657 - DNA, 75 bp, Artificial Sequence
  Synthetic
acgcttcaagcatggatctgattgagacagtaaacgcatgcgttgcattacaaaaaagaatatatgatttagcac

SEQ ID NO: 305658 - DNA, 75 bp, Artificial Sequence
  Synthetic
gacagtaaacgcatgcgttgcattacaaaaaagaatatatgatttagcaccgaataccaatcttaacacagcggg

SEQ ID NO: 305659 - DNA, 75 bp, Artificial Sequence
  Synthetic
caaaaaagaatatatgatttagcaccgaataccaatcttaacacagcgggacagagtactcttaacgattacaac

SEQ ID NO: 305660 - DNA, 75 bp, Artificial Sequence
  Synthetic
gaacatatcctttacatgacctgactgcggtactaactccgctaactattcatgcaccaatcatctcactttcag

SEQ ID NO: 305661 - DNA, 75 bp, Artificial Sequence
  Synthetic
tgcggtactaactccgctaactattcatgcaccaatcatctcactttcagtgcgtatttccactgacgactatga

SEQ ID NO: 305662 - DNA, 75 bp, Artificial Sequence
  Synthetic
gtgcttgacgtactagcagcggcaatcagaactgaaggttcaagaccagtgcgcgtaattgaaagacgtgttctt

SEQ ID NO: 305663 - DNA, 75 bp, Artificial Sequence
  Synthetic
gtgcttgacgttctagcagcggcaatcagaactgaaggttcaagaccagtgcgcgtaattgaaagacgtgttctt

SEQ ID NO: 305664 - DNA, 75 bp, Artificial Sequence
  Synthetic
gtgcttgacgtcctagcagcggcaatcagaactgaaggttcaagaccagtgcgcgtaattgaaagacgtgttctt

SEQ ID NO: 305665 - DNA, 75 bp, Artificial Sequence
  Synthetic
gtgcttgacgtgctagcagcggcaatcagaactgaaggttcaagaccagtgcgcgtaattgaaagacgtgttctt

SEQ ID NO: 305666 - DNA, 75 bp, Artificial Sequence
  Synthetic
tcagaactgaaggttcaagaccagtgcgcgtaattgaaagacgtgttcttgacccagttgttagacaattggttg

SEQ ID NO: 305667 - DNA, 75 bp, Artificial Sequence
  Synthetic
ctcagaaatatccctggcaaacctagctgctgtagatactgccatgatccaacccgaattaattgaaactgaaaa

SEQ ID NO: 305668 - DNA, 75 bp, Artificial Sequence
  Synthetic
gctgctgtagatactgccatgatccaacccgaattaattgaaactgaaaacccactgttcgctgacattattgag

SEQ ID NO: 305669 - DNA, 75 bp, Artificial Sequence
  Synthetic
atatgactggtggaaatatcagggccactttgggtagatggtcaggcaataaaggtgtaattacttgtatgtcag

SEQ ID NO: 305670 - DNA, 75 bp, Artificial Sequence
  Synthetic
cactttgggtagatggtcaggcaataaaggtgtaattacttgtatgtcaggcatggactcagaacatagatttac

SEQ ID NO: 305671 - DNA, 75 bp, Artificial Sequence
  Synthetic
ggtgtactaaatatcgtctacgtaccaacagctggcacaatgctcattccaatgccaaatggaagaaccagagag

SEQ ID NO: 305672 - DNA, 75 bp, Artificial Sequence
  Synthetic
caacagctggcacaatgctcattccaatgccaaatggaagaaccagagagggaaaacttatcgatgtctcagctg

SEQ ID NO: 305673 - DNA, 75 bp, Artificial Sequence
  Synthetic
cgacttcatggaagacgacgctataatacagactgaaaccggagtcggtgtgttttcttttccaatgtgtaacag

SEQ ID NO: 305674 - DNA, 75 bp, Artificial Sequence
  Synthetic
atacagactgaaaccggagtcggtgtgttttcttttccaatgtgtaacaggataaggttcagaatcaatccatgg

SEQ ID NO: 305675 - DNA, 75 bp, Artificial Sequence
  Synthetic
taggaacggtacacatgacaaactgggctcagggaaatgcaacaagacagccagctgtatcgtttctctttgaaa

SEQ ID NO: 305676 - DNA, 75 bp, Artificial Sequence
  Synthetic
ggctcagggaaatgcaacaagacagccagctgtatcgtttctctttgaaactagaagaacttttaccgagggtga

SEQ ID NO: 305677 - DNA, 75 bp, Artificial Sequence
  Synthetic
cctaaggcgcagtatatgttagacactgtttttccagaatcgtcatttataaacaagcctccaacagaatggaac

SEQ ID NO: 305678 - DNA, 75 bp, Artificial Sequence
  Synthetic
atacagagtttactcacttcaagcaatcaaaaagtgtggggacaaaaaatagcaatgctagtgtctgcgtttgct

SEQ ID NO: 305679 - DNA, 75 bp, Artificial Sequence
  Synthetic
gtgcttcaagcatggatctgattgaaacagttaacgcatgcatcaaattgcaaaaaaaagttctaagtttagcac

SEQ ID NO: 305680 - DNA, 75 bp, Artificial Sequence
  Synthetic
taattcacacaactcgaatattttcctccagagtgcatcatttgctgagttcaaaacttaccatctgttaatcac

SEQ ID NO: 305681 - DNA, 75 bp, Artificial Sequence
  Synthetic
tggtgtgtaattgttacttgctacgaagactgaaaaatggacctcgtaaaatttatcgcacaggcaaagtacaag

SEQ ID NO: 305682 - DNA, 75 bp, Artificial Sequence
  Synthetic
ggaaatattcagcgatggcgctgccactgcttctcgctcttgccgttagcgttcgagcacaactgagcattacac

SEQ ID NO: 305683 - DNA, 75 bp, Artificial Sequence
  Synthetic
actgcttctcgctcttgccgttagcgttcgagcacaactgagcattacaccagaaacaagtccagaagtatgtat

SEQ ID NO: 305684 - DNA, 75 bp, Artificial Sequence
  Synthetic
gttcgagcacaactgagcattacaccagaaacaagtccagaagtatgtatattatatgctaatgatttcgactca

SEQ ID NO: 305685 - DNA, 75 bp, Artificial Sequence
  Synthetic
ttaccaatatatttgaaacgtacaattcagtaactgtgtccttctttgaatacgacaaatcaaactatgatgtaa

SEQ ID NO: 305686 - DNA, 75 bp, Artificial Sequence
  Synthetic
ttcagtaactgtgtccttctttgaatacgacaaatcaaactatgatgtaattgatattctaacaaagaatgatta

SEQ ID NO: 305687 - DNA, 75 bp, Artificial Sequence
  Synthetic
gatgctattaaatcggatatggattttataactttcctgcaatccgaaaacgaatgttcaaaatacaccccaagt

SEQ ID NO: 305688 - DNA, 75 bp, Artificial Sequence
  Synthetic
ttataactttcctgcaatccgaaaacgaatgttcaaaatacaccccaagtaaaaaacattatttaaaactttctg

SEQ ID NO: 305689 - DNA, 75 bp, Artificial Sequence
  Synthetic
aaaatatctcagtttctgtcctctgtctgatagcctacttggaatatattgtgatacccagttggaagatacata

SEQ ID NO: 305690 - DNA, 75 bp, Artificial Sequence
  Synthetic
tctgatagcctacttggaatatattgtgatacccagttggaagatacatacttcccattatctacgaacagcgcg

SEQ ID NO: 305691 - DNA, 75 bp, Artificial Sequence
  Synthetic
ttactgaggcagggtatgttttttattctagtgatccattctacgtctgtagacgagttaatgaaggaaaatggt

SEQ ID NO: 305692 - DNA, 75 bp, Artificial Sequence
  Synthetic
ttctagtgatccattctacgtctgtagacgagttaatgaaggaaaatggttgaactatcagttattctatcgtga

SEQ ID NO: 305693 - DNA, 75 bp, Artificial Sequence
  Synthetic
agagcggttaattggggaaatgtgtggtcaaacttcaaaactttcgcgcagattgtttacaaagtattagacatc

SEQ ID NO: 305694 - DNA, 75 bp, Artificial Sequence
  Synthetic
ttgaaacgcgagcgtaaagagagctaggcgaaagggagggagccaaacgagtagccgaagccaataaaaaacccc

SEQ ID NO: 305695 - DNA, 75 bp, Artificial Sequence
  Synthetic
acgcttcaagcatggatctgattgaaacagttaacgcatgcatcaaattgcaaaaaagagttctaagtttagcac

SEQ ID NO: 305696 - DNA, 75 bp, Artificial Sequence
  Synthetic
aacagttaacgcatgcatcaaattgcaaaaaagagttctaagtttagcaccgaatacgaatttgaatacatccgg

SEQ ID NO: 305697 - DNA, 75 bp, Artificial Sequence
  Synthetic
gcattagcttcaagatgcaacggaaaaacatacgctatgttagatcaaactgcagttctaactcctttaactatc

SEQ ID NO: 305698 - DNA, 75 bp, Artificial Sequence
  Synthetic
aaacatacgctatgttagatcaaactgcagttctaactcctttaactatcaatgctccaatcatctcactttcag

SEQ ID NO: 305699 - DNA, 75 bp, Artificial Sequence
  Synthetic
agacatgaagtccggaatggactccatcttagacgtgctagccgccgccattaggtcagaggggtcaagacctgt

SEQ ID NO: 305700 - DNA, 75 bp, Artificial Sequence
  Synthetic
atcttagacgtgctagccgccgccattaggtcagaggggtcaagacctgtgagagctatagaaagacgcgttctt

SEQ ID NO: 305701 - DNA, 75 bp, Artificial Sequence
  Synthetic
aagacttaaaactaaaaagtctcacatctgatatttccattgcaaacttagctgctgtagatactgcagtaattc

SEQ ID NO: 305702 - DNA, 75 bp, Artificial Sequence
  Synthetic
atctgatatttccattgcaaacttagctgctgtagatactgcagtaattcaaccagaaattattcaaactgaaaa

SEQ ID NO: 305703 - DNA, 75 bp, Artificial Sequence
  Synthetic
tgttgatttcaaagctagaactactggaataattaatattgtgtatgtgccaaccgcagggtctatattaatacc

SEQ ID NO: 305704 - DNA, 75 bp, Artificial Sequence
  Synthetic
ggaataattaatattgtgtatgtgccaaccgcagggtctatattaatacccatgccaaatgcaagaaacagagaa

SEQ ID NO: 305705 - DNA, 75 bp, Artificial Sequence
  Synthetic
tgactttatggatgatgatgctatagttcagactgaaacaggagttggagtatattcctttccaatgtgcaaccg

SEQ ID NO: 305706 - DNA, 75 bp, Artificial Sequence
  Synthetic
gatatgcagaaagatcaagaaggtcttggtacggttcatatgacaaactgggcacagggtaccgctgccagacag

SEQ ID NO: 305707 - DNA, 75 bp, Artificial Sequence
  Synthetic
ttggtacggttcatatgacaaactgggcacagggtaccgctgccagacagccagctatatctttcatgtttgaaa

SEQ ID NO: 305708 - DNA, 75 bp, Artificial Sequence
  Synthetic
ctatcagcatctatctaaatgcgcaccaaaatcacagtacatactggacacaatattccccgaaacgtcattcgt

SEQ ID NO: 305709 - DNA, 75 bp, Artificial Sequence
  Synthetic
ccaaaatcacagtacatactggacacaatattccccgaaacgtcattcgtaaacaaaccaaacgtggactggaac

SEQ ID NO: 305710 - DNA, 75 bp, Artificial Sequence
  Synthetic
tccaaaaagtatggtgtcaaaaaatagcaattctggtgtctgcatacgctgcgaaggtctgatccggcgtcggct

SEQ ID NO: 305711 - DNA, 75 bp, Artificial Sequence
  Synthetic
tagcaattctggtgtctgcatacgctgcgaaggtctgatccggcgtcggcttccaaaggaagtgcttcgagaggt

SEQ ID NO: 305712 - DNA, 75 bp, Artificial Sequence
  Synthetic
ggtataataatagtgtaccctctgtgcaagtctgggaaacctatggggagcagccaatccagtttgcaatctcag

SEQ ID NO: 305713 - DNA, 75 bp, Artificial Sequence
  Synthetic
gcaagtctgggaaacctatggggagcagccaatccagtttgcaatctcagatacacagtacaaatatccattccc

SEQ ID NO: 305714 - DNA, 75 bp, Artificial Sequence
  Synthetic
cagccaatccagtttgcaatctcagatacacagtacaaatatccattcccaacactcaagcatacatttgcaggg

SEQ ID NO: 305715 - DNA, 75 bp, Artificial Sequence
  Synthetic
caacatatcattgttaccgttggggccgtagtaatagcattactattaactacattgatattcagctgtgtttgt

SEQ ID NO: 305716 - DNA, 75 bp, Artificial Sequence
  Synthetic
ccgtagtaatagcattactattaactacattgatattcagctgtgtttgtaattgttatctgtattcaaaactga

SEQ ID NO: 305717 - DNA, 75 bp, Artificial Sequence
  Synthetic
aaacagcaaaggggaagaaagacatcgtaccactgtacaaagaccgcaacttcgatcagacatgcttgtctaaga

SEQ ID NO: 305718 - DNA, 75 bp, Artificial Sequence
  Synthetic
cgtaccactgtacaaagaccgcaacttcgatcagacatgcttgtctaagaaacctgaaaaaaccacaaagatact

SEQ ID NO: 305719 - DNA, 75 bp, Artificial Sequence
  Synthetic
ccgcatgtggcgggtgagtcgatcttaatcgaagatgtgtgtccatttaatcatgaacatttttgtggtgccgtc

SEQ ID NO: 305720 - DNA, 75 bp, Artificial Sequence
  Synthetic
taatcgaagatgtgtgtccatttaatcatgaacatttttgtggtgccgtccacatcccagcgcaaagcaacatga

SEQ ID NO: 305721 - DNA, 75 bp, Artificial Sequence
  Synthetic
aacagcagaaaaaattgtttggccaagtggtgtgaaatccattatagttgaaaataaagttattaacggatctgt

SEQ ID NO: 305722 - DNA, 75 bp, Artificial Sequence
  Synthetic
agtggtgtgaaatccattatagttgaaaataaagttattaacggatctgtgtttgtgaagtgtaggtgtgatcaa

SEQ ID NO: 305723 - DNA, 75 bp, Artificial Sequence
  Synthetic
aatcagacttctttttcctcacatgctgctctaatgacaccaagtcaattcaattgtgtgttaatgagcgatacg

SEQ ID NO: 305724 - DNA, 75 bp, Artificial Sequence
  Synthetic
ctgctctaatgacaccaagtcaattcaattgtgtgttaatgagcgatacgattgtccaagctgtggaaaaaagtt

SEQ ID NO: 305725 - DNA, 75 bp, Artificial Sequence
  Synthetic
tgttgacaaaaacaaaattttatttgccggcgcaaatttgtccatcttgctcaccattcagagacttggtatcaa

SEQ ID NO: 305726 - DNA, 75 bp, Artificial Sequence
  Synthetic
gccggcgcaaatttgtccatcttgctcaccattcagagacttggtatcaactatgtcattactgaataaagttga

SEQ ID NO: 305727 - DNA, 75 bp, Artificial Sequence
  Synthetic
atgcgaaataactatgggtggaagcatgctatagaaaatatttgtgaacaagcttttagagctttaaatttcaca

SEQ ID NO: 305728 - DNA, 75 bp, Artificial Sequence
  Synthetic
atgctatagaaaatatttgtgaacaagcttttagagctttaaatttcacacatatacttagtagaattttcattc

SEQ ID NO: 305729 - DNA, 75 bp, Artificial Sequence
  Synthetic
aataaatacattgactgaagtcgtgagttttttcaatcgagaatggccatacaacataacaataactccaatttc

SEQ ID NO: 305730 - DNA, 75 bp, Artificial Sequence
  Synthetic
agttttttcaatcgagaatggccatacaacataacaataactccaatttcaaggggtaaagtagctgtatccaac

SEQ ID NO: 305731 - DNA, 75 bp, Artificial Sequence
  Synthetic
tttcaactaatgatgaactttttttaattattaacaagaaattgctgcaatggaggcttgcttgatcatagaatg

SEQ ID NO: 305732 - DNA, 75 bp, Artificial Sequence
  Synthetic
tggaggcttgcttgatcatagaatgagagttccagatctctaaccagacacagtcgatcactatattgaataccc

SEQ ID NO: 305733 - DNA, 75 bp, Artificial Sequence
  Synthetic
ggaataaaagagacaggtagtggctggaaacgctactctgtccgcactctgccctgaaatgtctgaagcgtctga

SEQ ID NO: 305734 - DNA, 75 bp, Artificial Sequence
  Synthetic
ggaaacgctactctgtccgcactctgccctgaaatgtctgaagcgtctgaatttaggtttccaagtggaaataga

SEQ ID NO: 305735 - DNA, 75 bp, Artificial Sequence
  Synthetic
gccctgaaatgtctgaagcgtctgaatttaggtttccaagtggaaatagaaagagagataaagtaagcaaagtga

SEQ ID NO: 305736 - DNA, 75 bp, Artificial Sequence
  Synthetic
cgcatcaactaagagtgacagtgaatcttcaagccgcggtgacgtaacgtcagtgtattcagctgaaactactaa

SEQ ID NO: 305737 - DNA, 75 bp, Artificial Sequence
  Synthetic
tcttcaagccgcggtgacgtaacgtcagtgtattcagctgaaactactaactcagaatatgaggaggcatataac

SEQ ID NO: 305738 - DNA, 75 bp, Artificial Sequence
  Synthetic
aagaaagtaatgattcttgctgtttggatgattcgtttccatcaaccgaaaccacaaaaaaaacaagatcagaga

SEQ ID NO: 305739 - DNA, 75 bp, Artificial Sequence
  Synthetic
ggatgattcgtttccatcaaccgaaaccacaaaaaaaacaagatcagagaaaattactgaagttagatatgaaca

SEQ ID NO: 305740 - DNA, 75 bp, Artificial Sequence
  Synthetic
aaactatctgaactgacgttggaacttgagaagctcaaaactgcaacacaacctgttggcgtacatcccgcgttc

SEQ ID NO: 305741 - DNA, 75 bp, Artificial Sequence
  Synthetic
ttgagaagctcaaaactgcaacacaacctgttggcgtacatcccgcgttcaaccaaatattgagaaatgttgaca

SEQ ID NO: 305742 - DNA, 75 bp, Artificial Sequence
  Synthetic
actggtgaacgccctcgttaattcaatgaactaacctaatcagattgtggtttccaccggatattgacaggggtc

SEQ ID NO: 305743 - DNA, 75 bp, Artificial Sequence
  Synthetic
atgaactaacctaatcagattgtggtttccaccggatattgacaggggtcaacccttagtgctggaataataccc

SEQ ID NO: 305744 - DNA, 75 bp, Artificial Sequence
  Synthetic
gtgcttcaagcatggatctgattgaaacagtaaacgcatgcgttgcattgcaaaaaagaatatacgacttagcac

SEQ ID NO: 305745 - DNA, 75 bp, Artificial Sequence
  Synthetic
aacagtaaacgcatgcgttgcattgcaaaaaagaatatacgacttagcaccaaacaccaatcttaacacagcagg

SEQ ID NO: 305746 - DNA, 75 bp, Artificial Sequence
  Synthetic
caaaaaagaatatacgacttagcaccaaacaccaatcttaacacagcagggcaaagtactcttaatgactataat

SEQ ID NO: 305747 - DNA, 75 bp, Artificial Sequence
  Synthetic
agacgtatcctttgcatgacttgactgcggtactaactccattaactattcacgcaccaatcatatccctttcag

SEQ ID NO: 305748 - DNA, 75 bp, Artificial Sequence
  Synthetic
tgcggtactaactccattaactattcacgcaccaatcatatccctttcagtacgtatttccactgatgactatga

SEQ ID NO: 305749 - DNA, 75 bp, Artificial Sequence
  Synthetic
gtgcttgacgtgctagcagcggcaatcagaactgaaggttctagaccagtgcgtgtgattgaaagacgtgtcctt

SEQ ID NO: 305750 - DNA, 75 bp, Artificial Sequence
  Synthetic
tcagaactgaaggttctagaccagtgcgtgtgattgaaagacgtgtccttgatccagttgtcaagcaattggttg

SEQ ID NO: 305751 - DNA, 75 bp, Artificial Sequence
  Synthetic
gtcagaaatatctctagcaaacctagccgctgtggacactgcaatgatccaacctgaattaattgaaactgaaaa

SEQ ID NO: 305752 - DNA, 75 bp, Artificial Sequence
  Synthetic
gccgctgtggacactgcaatgatccaacctgaattaattgaaactgaaaacccactattcgccgacattattgag

SEQ ID NO: 305753 - DNA, 75 bp, Artificial Sequence
  Synthetic
acatgaccggtggaaatattagagccactctaggcagatggtcaggtaacaaaggtgtaattacttgtatgtcag

SEQ ID NO: 305754 - DNA, 75 bp, Artificial Sequence
  Synthetic
cactctaggcagatggtcaggtaacaaaggtgtaattacttgtatgtcaggcatggactcagaacatagattcac

SEQ ID NO: 305755 - DNA, 75 bp, Artificial Sequence
  Synthetic
ggcgtactaaatatcgtctacgtaccggcagctggtacaatactcattccaatgccaaatggaagaacaagagaa

SEQ ID NO: 305756 - DNA, 75 bp, Artificial Sequence
  Synthetic
cggcagctggtacaatactcattccaatgccaaatggaagaacaagagaagggaaacttattgatgtctcagctg

SEQ ID NO: 305757 - DNA, 75 bp, Artificial Sequence
  Synthetic
cgattttatggaagacaacgctataatacagactgaaaccggagtcggtgttttctcttttcccatgtgcaacag

SEQ ID NO: 305758 - DNA, 75 bp, Artificial Sequence
  Synthetic
atacagactgaaaccggagtcggtgttttctcttttcccatgtgcaacagaataagatttaggatcagtccatgg

SEQ ID NO: 305759 - DNA, 75 bp, Artificial Sequence
  Synthetic
taggaacggtgcgcatgacaaattgggctcagggaaatgcagtgaggcaaccagctgtgtcatttctttttgaaa

SEQ ID NO: 305760 - DNA, 75 bp, Artificial Sequence
  Synthetic
ggctcagggaaatgcagtgaggcaaccagctgtgtcatttctttttgaaactagaagaacgttcactgagggtga

SEQ ID NO: 305761 - DNA, 75 bp, Artificial Sequence
  Synthetic
cctaaggcgcagtatatgctagacactacgtttccagagtcatcatttataaataagccaccaacagaatggaat

SEQ ID NO: 305762 - DNA, 75 bp, Artificial Sequence
  Synthetic
cagacaagctagcccgtttcgcccagcgattggaggatagaaaagatgtgttgcacaagaatttttctaaagcca

SEQ ID NO: 305763 - DNA, 75 bp, Artificial Sequence
  Synthetic
ggcgatcaagccgacttttgccactgagggaaaatgtaatgttgtaagagccactgatgattcaatgatactaga

SEQ ID NO: 305764 - DNA, 75 bp, Artificial Sequence
  Synthetic
aattgaagatgtgattttgaaagcaaaaatttttgaaaagaaaagaagctgaacgtgttaaatccgctgaaatgg

SEQ ID NO: 305765 - DNA, 75 bp, Artificial Sequence
  Synthetic
taattcacacaactcgaatatttacctccagagtgcgtctgttgctgagttcaaaacttaccatatgttaatcac

SEQ ID NO: 305766 - DNA, 75 bp, Artificial Sequence
  Synthetic
ttgtttgccttcctcatttcaagtttggtgtgtaattgttacttgctacgaagactgaaaaatggacctcgtaaa

SEQ ID NO: 305767 - DNA, 75 bp, Artificial Sequence
  Synthetic
ggctccgcgtttgtcaaatgtagatgcggacaaccatatccaacaatcattgaacagccatcgacttttttcttt

SEQ ID NO: 305768 - DNA, 75 bp, Artificial Sequence
  Synthetic
aatcagtaaaaattggattaagcgaaaagttcaactgtctaaattgcaacagaagcgtgcgttggtttagtccag

SEQ ID NO: 305769 - DNA, 75 bp, Artificial Sequence
  Synthetic
aacagtcaatgcatgcatcaaactgcaaaagagagttttaagtttagcaccaaacacgaacttaaatacatccgg

SEQ ID NO: 305770 - DNA, 75 bp, Artificial Sequence
  Synthetic
gcgttagcatcaaggtgcaatggaagaacatacgcgttgctcgatcaaactgcagtccttacccctttcaccatc

SEQ ID NO: 305771 - DNA, 75 bp, Artificial Sequence
  Synthetic
gaacatacgcgttgctcgatcaaactgcagtccttacccctttcaccatcaacgcttcaatcatctctctttcag

SEQ ID NO: 305772 - DNA, 75 bp, Artificial Sequence
  Synthetic
cgatatgaagtctggaatggattctattttagatgtgatagccgctgctattagaacagaaggatctaggcctgt

SEQ ID NO: 305773 - DNA, 75 bp, Artificial Sequence
  Synthetic
attttagatgtgatagccgctgctattagaacagaaggatctaggcctgtaagggcgatagagagacgtgtcctt

SEQ ID NO: 305774 - DNA, 75 bp, Artificial Sequence
  Synthetic
aagatctaaaactgaaaagtcttacttctgatatctccattgccaacttggctgctgtagacactgccataattc

SEQ ID NO: 305775 - DNA, 75 bp, Artificial Sequence
  Synthetic
ttctgatatctccattgccaacttggctgctgtagacactgccataattcaaccagaaatcatccagactgaaaa

SEQ ID NO: 305776 - DNA, 75 bp, Artificial Sequence
  Synthetic
aatgccaaacgcaagaaatagggaaggtaaattaattgacgtttctgcagaaatgatggccgaaaactttgccat

SEQ ID NO: 305777 - DNA, 75 bp, Artificial Sequence
  Synthetic
ggcacaggggacagccgctaggcagccagccatctctttcatgttcgaaactcgcgacactttcacccaaggtga

SEQ ID NO: 305778 - DNA, 75 bp, Artificial Sequence
  Synthetic
ccagccatctctttcatgttcgaaactcgcgacactttcacccaaggtgattatcagcatttatctaaatgcgca

SEQ ID NO: 305779 - DNA, 75 bp, Artificial Sequence
  Synthetic
caattttccctgaaacatcgtttgtaaacaaaccaaatgtagactggaacattcaaagtctacttacttcaacta

SEQ ID NO: 305780 - DNA, 75 bp, Artificial Sequence
  Synthetic
ttgcaattctggtgtccgcatatgctgctaaagtctgatccggcgtcagcttccaaaggaagtgcttcgagaggt

SEQ ID NO: 305781 - DNA, 75 bp, Artificial Sequence
  Synthetic
acgcttcaagcatggatctgattgaaacagtaaatgcgtgcgttaggttgcagaaaagaattctaaatttagcgc

SEQ ID NO: 305782 - DNA, 75 bp, Artificial Sequence
  Synthetic
acgcttcaagcatggatctgattgaaacagttaatgcgtgcgttaggttgcagaaaagaattctaaatttagcgc

SEQ ID NO: 305783 - DNA, 75 bp, Artificial Sequence
  Synthetic
acgcttcaagcatggatctgattgaaacagtcaatgcgtgcgttaggttgcagaaaagaattctaaatttagcgc

SEQ ID NO: 305784 - DNA, 75 bp, Artificial Sequence
  Synthetic
acgcttcaagcatggatctgattgaaacagtgaatgcgtgcgttaggttgcagaaaagaattctaaatttagcgc

SEQ ID NO: 305785 - DNA, 75 bp, Artificial Sequence
  Synthetic
cgctgttcttacccctttcaccattaatgctccaattatttcactttcagtccgtatatccacagatgattacga

SEQ ID NO: 305786 - DNA, 75 bp, Artificial Sequence
  Synthetic
attctagatgtgctcgctgccgccattagaacagaaggatctagaccagtgagagcaatagaaagacgtgttctc

SEQ ID NO: 305787 - DNA, 75 bp, Artificial Sequence
  Synthetic
ttagaacagaaggatctagaccagtgagagcaatagaaagacgtgttctcgaaccggctgttaggcagctggtag

SEQ ID NO: 305788 - DNA, 75 bp, Artificial Sequence
  Synthetic
ttccgatatctctgttgcaaatctagcagctgtggatactgccgtaattcaaccagaaattattcaaactgagaa

SEQ ID NO: 305789 - DNA, 75 bp, Artificial Sequence
  Synthetic
ttccgatatctctgttgcaaatctagcagctgtggatactgccgtaattcaaccagaaattattcatactgagaa

SEQ ID NO: 305790 - DNA, 75 bp, Artificial Sequence
  Synthetic
ttccgatatctctgttgcaaatctagcagctgtggatactgccgtaattcaaccagaaattattcacactgagaa

SEQ ID NO: 305791 - DNA, 75 bp, Artificial Sequence
  Synthetic
ttccgatatctctgttgcaaatctagcagctgtggatactgccgtaattcaaccagaaattattcagactgagaa

SEQ ID NO: 305792 - DNA, 75 bp, Artificial Sequence
  Synthetic
caagttgtaaacagaccacaaatgaatatgactggcggaaacataaaagctactttaggaagatggtcaggcaat

SEQ ID NO: 305793 - DNA, 75 bp, Artificial Sequence
  Synthetic
caagttgtaaacagaccacaaatgaatatgactggcggaaacataatagctactttaggaagatggtcaggcaat

SEQ ID NO: 305794 - DNA, 75 bp, Artificial Sequence
  Synthetic
caagttgtaaacagaccacaaatgaatatgactggcggaaacataacagctactttaggaagatggtcaggcaat

SEQ ID NO: 305795 - DNA, 75 bp, Artificial Sequence
  Synthetic
caagttgtaaacagaccacaaatgaatatgactggcggaaacataagagctactttaggaagatggtcaggcaat

SEQ ID NO: 305796 - DNA, 75 bp, Artificial Sequence
  Synthetic
tatgccaaatggaagaaatagagaaggcaaattaatcgatgtttcagcagagatgatggctgaaaattttgccat

SEQ ID NO: 305797 - DNA, 75 bp, Artificial Sequence
  Synthetic
ggcaaattaatcgatgtttcagcagagatgatggctgaaaattttgccatcgatttcatggatgatgacaccata

SEQ ID NO: 305798 - DNA, 75 bp, Artificial Sequence
  Synthetic
cattagatttagaatttctccatgggatatgcaaaaggatcaagatggtctaggcacggttcacatgacaaactg

SEQ ID NO: 305799 - DNA, 75 bp, Artificial Sequence
  Synthetic
cattagatttagaatttctccatgggatatgcaaaaggatcaagatggtctaggcacggttcacatgactaactg

SEQ ID NO: 305800 - DNA, 75 bp, Artificial Sequence
  Synthetic
cattagatttagaatttctccatgggatatgcaaaaggatcaagatggtctaggcacggttcacatgaccaactg

SEQ ID NO: 305801 - DNA, 75 bp, Artificial Sequence
  Synthetic
cattagatttagaatttctccatgggatatgcaaaaggatcaagatggtctaggcacggttcacatgacgaactg

SEQ ID NO: 305802 - DNA, 75 bp, Artificial Sequence
  Synthetic
ccagcaatttcttttatgttagaaacccgtgatacctttactcaaggtgactaccaacatttatctaaatgtaca

SEQ ID NO: 305803 - DNA, 75 bp, Artificial Sequence
  Synthetic
ccagcaatttcttttatgtttgaaacccgtgatacctttactcaaggtgactaccaacatttatctaaatgtaca

SEQ ID NO: 305804 - DNA, 75 bp, Artificial Sequence
  Synthetic
ccagcaatttcttttatgttcgaaacccgtgatacctttactcaaggtgactaccaacatttatctaaatgtaca

SEQ ID NO: 305805 - DNA, 75 bp, Artificial Sequence
  Synthetic
ccagcaatttcttttatgttggaaacccgtgatacctttactcaaggtgactaccaacatttatctaaatgtaca

SEQ ID NO: 305806 - DNA, 75 bp, Artificial Sequence
  Synthetic
cccgtgatacctttactcaaggtgactaccaacatttatctaaatgtacacctaaatcacaatatgtgttagata

SEQ ID NO: 305807 - DNA, 75 bp, Artificial Sequence
  Synthetic
gaacaaaccaaaccttgattggaacattcagagtttacttacttccactactcaaccagtatggtgtaaaaaaat

SEQ ID NO: 305808 - DNA, 75 bp, Artificial Sequence
  Synthetic
gaacaaaccaaaccttgattggaacattcagagtttacttacttccactactcaaccagtatggtgttaaaaaat

SEQ ID NO: 305809 - DNA, 75 bp, Artificial Sequence
  Synthetic
gaacaaaccaaaccttgattggaacattcagagtttacttacttccactactcaaccagtatggtgtcaaaaaat

SEQ ID NO: 305810 - DNA, 75 bp, Artificial Sequence
  Synthetic
gaacaaaccaaaccttgattggaacattcagagtttacttacttccactactcaaccagtatggtgtgaaaaaat

SEQ ID NO: 305811 - DNA, 75 bp, Artificial Sequence
  Synthetic
gaacaaaccaaaccttgattggaactttcagagtttacttacttccactactcaaccagtatggtgtaaaaaaat

SEQ ID NO: 305812 - DNA, 75 bp, Artificial Sequence
  Synthetic
gaacaaaccaaaccttgattggaactttcagagtttacttacttccactactcaaccagtatggtgttaaaaaat

SEQ ID NO: 305813 - DNA, 75 bp, Artificial Sequence
  Synthetic
gaacaaaccaaaccttgattggaactttcagagtttacttacttccactactcaaccagtatggtgtcaaaaaat

SEQ ID NO: 305814 - DNA, 75 bp, Artificial Sequence
  Synthetic
gaacaaaccaaaccttgattggaactttcagagtttacttacttccactactcaaccagtatggtgtgaaaaaat

SEQ ID NO: 305815 - DNA, 75 bp, Artificial Sequence
  Synthetic
gaacaaaccaaaccttgattggaaccttcagagtttacttacttccactactcaaccagtatggtgtaaaaaaat

SEQ ID NO: 305816 - DNA, 75 bp, Artificial Sequence
  Synthetic
gaacaaaccaaaccttgattggaaccttcagagtttacttacttccactactcaaccagtatggtgttaaaaaat

SEQ ID NO: 305817 - DNA, 75 bp, Artificial Sequence
  Synthetic
gaacaaaccaaaccttgattggaaccttcagagtttacttacttccactactcaaccagtatggtgtcaaaaaat

SEQ ID NO: 305818 - DNA, 75 bp, Artificial Sequence
  Synthetic
gaacaaaccaaaccttgattggaaccttcagagtttacttacttccactactcaaccagtatggtgtgaaaaaat

SEQ ID NO: 305819 - DNA, 75 bp, Artificial Sequence
  Synthetic
gaacaaaccaaaccttgattggaacgttcagagtttacttacttccactactcaaccagtatggtgtaaaaaaat

SEQ ID NO: 305820 - DNA, 75 bp, Artificial Sequence
  Synthetic
gaacaaaccaaaccttgattggaacgttcagagtttacttacttccactactcaaccagtatggtgttaaaaaat

SEQ ID NO: 305821 - DNA, 75 bp, Artificial Sequence
  Synthetic
gaacaaaccaaaccttgattggaacgttcagagtttacttacttccactactcaaccagtatggtgtcaaaaaat

SEQ ID NO: 305822 - DNA, 75 bp, Artificial Sequence
  Synthetic
gaacaaaccaaaccttgattggaacgttcagagtttacttacttccactactcaaccagtatggtgtgaaaaaat

SEQ ID NO: 305823 - DNA, 75 bp, Artificial Sequence
  Synthetic
gaacaatccaaaccttgattggaacattcagagtttacttacttccactactcaaccagtatggtgtaaaaaaat

SEQ ID NO: 305824 - DNA, 75 bp, Artificial Sequence
  Synthetic
gaacaatccaaaccttgattggaacattcagagtttacttacttccactactcaaccagtatggtgttaaaaaat

SEQ ID NO: 305825 - DNA, 75 bp, Artificial Sequence
  Synthetic
gaacaatccaaaccttgattggaacattcagagtttacttacttccactactcaaccagtatggtgtcaaaaaat

SEQ ID NO: 305826 - DNA, 75 bp, Artificial Sequence
  Synthetic
gaacaatccaaaccttgattggaacattcagagtttacttacttccactactcaaccagtatggtgtgaaaaaat

SEQ ID NO: 305827 - DNA, 75 bp, Artificial Sequence
  Synthetic
gaacaatccaaaccttgattggaactttcagagtttacttacttccactactcaaccagtatggtgtaaaaaaat

SEQ ID NO: 305828 - DNA, 75 bp, Artificial Sequence
  Synthetic
gaacaatccaaaccttgattggaactttcagagtttacttacttccactactcaaccagtatggtgttaaaaaat

SEQ ID NO: 305829 - DNA, 75 bp, Artificial Sequence
  Synthetic
gaacaatccaaaccttgattggaactttcagagtttacttacttccactactcaaccagtatggtgtcaaaaaat

SEQ ID NO: 305830 - DNA, 75 bp, Artificial Sequence
  Synthetic
gaacaatccaaaccttgattggaactttcagagtttacttacttccactactcaaccagtatggtgtgaaaaaat

SEQ ID NO: 305831 - DNA, 75 bp, Artificial Sequence
  Synthetic
gaacaatccaaaccttgattggaaccttcagagtttacttacttccactactcaaccagtatggtgtaaaaaaat

SEQ ID NO: 305832 - DNA, 75 bp, Artificial Sequence
  Synthetic
gaacaatccaaaccttgattggaaccttcagagtttacttacttccactactcaaccagtatggtgttaaaaaat

SEQ ID NO: 305833 - DNA, 75 bp, Artificial Sequence
  Synthetic
gaacaatccaaaccttgattggaaccttcagagtttacttacttccactactcaaccagtatggtgtcaaaaaat

SEQ ID NO: 305834 - DNA, 75 bp, Artificial Sequence
  Synthetic
gaacaatccaaaccttgattggaaccttcagagtttacttacttccactactcaaccagtatggtgtgaaaaaat

SEQ ID NO: 305835 - DNA, 75 bp, Artificial Sequence
  Synthetic
gaacaatccaaaccttgattggaacgttcagagtttacttacttccactactcaaccagtatggtgtaaaaaaat

SEQ ID NO: 305836 - DNA, 75 bp, Artificial Sequence
  Synthetic
gaacaatccaaaccttgattggaacgttcagagtttacttacttccactactcaaccagtatggtgttaaaaaat

SEQ ID NO: 305837 - DNA, 75 bp, Artificial Sequence
  Synthetic
gaacaatccaaaccttgattggaacgttcagagtttacttacttccactactcaaccagtatggtgtcaaaaaat

SEQ ID NO: 305838 - DNA, 75 bp, Artificial Sequence
  Synthetic
gaacaatccaaaccttgattggaacgttcagagtttacttacttccactactcaaccagtatggtgtgaaaaaat

SEQ ID NO: 305839 - DNA, 75 bp, Artificial Sequence
  Synthetic
gaacaacccaaaccttgattggaacattcagagtttacttacttccactactcaaccagtatggtgtaaaaaaat

SEQ ID NO: 305840 - DNA, 75 bp, Artificial Sequence
  Synthetic
gaacaacccaaaccttgattggaacattcagagtttacttacttccactactcaaccagtatggtgttaaaaaat

SEQ ID NO: 305841 - DNA, 75 bp, Artificial Sequence
  Synthetic
gaacaacccaaaccttgattggaacattcagagtttacttacttccactactcaaccagtatggtgtcaaaaaat

SEQ ID NO: 305842 - DNA, 75 bp, Artificial Sequence
  Synthetic
gaacaacccaaaccttgattggaacattcagagtttacttacttccactactcaaccagtatggtgtgaaaaaat

SEQ ID NO: 305843 - DNA, 75 bp, Artificial Sequence
  Synthetic
gaacaacccaaaccttgattggaactttcagagtttacttacttccactactcaaccagtatggtgtaaaaaaat

SEQ ID NO: 305844 - DNA, 75 bp, Artificial Sequence
  Synthetic
gaacaacccaaaccttgattggaactttcagagtttacttacttccactactcaaccagtatggtgttaaaaaat

SEQ ID NO: 305845 - DNA, 75 bp, Artificial Sequence
  Synthetic
gaacaacccaaaccttgattggaactttcagagtttacttacttccactactcaaccagtatggtgtcaaaaaat

SEQ ID NO: 305846 - DNA, 75 bp, Artificial Sequence
  Synthetic
gaacaacccaaaccttgattggaactttcagagtttacttacttccactactcaaccagtatggtgtgaaaaaat

SEQ ID NO: 305847 - DNA, 75 bp, Artificial Sequence
  Synthetic
gaacaacccaaaccttgattggaaccttcagagtttacttacttccactactcaaccagtatggtgtaaaaaaat

SEQ ID NO: 305848 - DNA, 75 bp, Artificial Sequence
  Synthetic
gaacaacccaaaccttgattggaaccttcagagtttacttacttccactactcaaccagtatggtgttaaaaaat

SEQ ID NO: 305849 - DNA, 75 bp, Artificial Sequence
  Synthetic
gaacaacccaaaccttgattggaaccttcagagtttacttacttccactactcaaccagtatggtgtcaaaaaat

SEQ ID NO: 305850 - DNA, 75 bp, Artificial Sequence
  Synthetic
gaacaacccaaaccttgattggaaccttcagagtttacttacttccactactcaaccagtatggtgtgaaaaaat

SEQ ID NO: 305851 - DNA, 75 bp, Artificial Sequence
  Synthetic
gaacaacccaaaccttgattggaacgttcagagtttacttacttccactactcaaccagtatggtgtaaaaaaat

SEQ ID NO: 305852 - DNA, 75 bp, Artificial Sequence
  Synthetic
gaacaacccaaaccttgattggaacgttcagagtttacttacttccactactcaaccagtatggtgttaaaaaat

SEQ ID NO: 305853 - DNA, 75 bp, Artificial Sequence
  Synthetic
gaacaacccaaaccttgattggaacgttcagagtttacttacttccactactcaaccagtatggtgtcaaaaaat

SEQ ID NO: 305854 - DNA, 75 bp, Artificial Sequence
  Synthetic
gaacaacccaaaccttgattggaacgttcagagtttacttacttccactactcaaccagtatggtgtgaaaaaat

SEQ ID NO: 305855 - DNA, 75 bp, Artificial Sequence
  Synthetic
gaacaagccaaaccttgattggaacattcagagtttacttacttccactactcaaccagtatggtgtaaaaaaat

SEQ ID NO: 305856 - DNA, 75 bp, Artificial Sequence
  Synthetic
gaacaagccaaaccttgattggaacattcagagtttacttacttccactactcaaccagtatggtgttaaaaaat

SEQ ID NO: 305857 - DNA, 75 bp, Artificial Sequence
  Synthetic
gaacaagccaaaccttgattggaacattcagagtttacttacttccactactcaaccagtatggtgtcaaaaaat

SEQ ID NO: 305858 - DNA, 75 bp, Artificial Sequence
  Synthetic
gaacaagccaaaccttgattggaacattcagagtttacttacttccactactcaaccagtatggtgtgaaaaaat

SEQ ID NO: 305859 - DNA, 75 bp, Artificial Sequence
  Synthetic
gaacaagccaaaccttgattggaactttcagagtttacttacttccactactcaaccagtatggtgtaaaaaaat

SEQ ID NO: 305860 - DNA, 75 bp, Artificial Sequence
  Synthetic
gaacaagccaaaccttgattggaactttcagagtttacttacttccactactcaaccagtatggtgttaaaaaat

SEQ ID NO: 305861 - DNA, 75 bp, Artificial Sequence
  Synthetic
gaacaagccaaaccttgattggaactttcagagtttacttacttccactactcaaccagtatggtgtcaaaaaat

SEQ ID NO: 305862 - DNA, 75 bp, Artificial Sequence
  Synthetic
gaacaagccaaaccttgattggaactttcagagtttacttacttccactactcaaccagtatggtgtgaaaaaat

SEQ ID NO: 305863 - DNA, 75 bp, Artificial Sequence
  Synthetic
gaacaagccaaaccttgattggaaccttcagagtttacttacttccactactcaaccagtatggtgtaaaaaaat

SEQ ID NO: 305864 - DNA, 75 bp, Artificial Sequence
  Synthetic
gaacaagccaaaccttgattggaaccttcagagtttacttacttccactactcaaccagtatggtgttaaaaaat

SEQ ID NO: 305865 - DNA, 75 bp, Artificial Sequence
  Synthetic
gaacaagccaaaccttgattggaaccttcagagtttacttacttccactactcaaccagtatggtgtcaaaaaat

SEQ ID NO: 305866 - DNA, 75 bp, Artificial Sequence
  Synthetic
gaacaagccaaaccttgattggaaccttcagagtttacttacttccactactcaaccagtatggtgtgaaaaaat

SEQ ID NO: 305867 - DNA, 75 bp, Artificial Sequence
  Synthetic
gaacaagccaaaccttgattggaacgttcagagtttacttacttccactactcaaccagtatggtgtaaaaaaat

SEQ ID NO: 305868 - DNA, 75 bp, Artificial Sequence
  Synthetic
gaacaagccaaaccttgattggaacgttcagagtttacttacttccactactcaaccagtatggtgttaaaaaat

SEQ ID NO: 305869 - DNA, 75 bp, Artificial Sequence
  Synthetic
gaacaagccaaaccttgattggaacgttcagagtttacttacttccactactcaaccagtatggtgtcaaaaaat

SEQ ID NO: 305870 - DNA, 75 bp, Artificial Sequence
  Synthetic
gaacaagccaaaccttgattggaacgttcagagtttacttacttccactactcaaccagtatggtgtgaaaaaat

SEQ ID NO: 305871 - DNA, 75 bp, Artificial Sequence
  Synthetic
tagcaattctagtgtctgcatatgctgcaaaaatctgatccggcgtcagcttccaaaggaagtgcttcgagaggt

SEQ ID NO: 305872 - DNA, 75 bp, Artificial Sequence
  Synthetic
tagcaattctagtgtctgcatatgctgctaaaatctgatccggcgtcagcttccaaaggaagtgcttcgagaggt

SEQ ID NO: 305873 - DNA, 75 bp, Artificial Sequence
  Synthetic
tagcaattctagtgtctgcatatgctgccaaaatctgatccggcgtcagcttccaaaggaagtgcttcgagaggt

SEQ ID NO: 305874 - DNA, 75 bp, Artificial Sequence
  Synthetic
tagcaattctagtgtctgcatatgctgcgaaaatctgatccggcgtcagcttccaaaggaagtgcttcgagaggt

SEQ ID NO: 305875 - DNA, 75 bp, Artificial Sequence
  Synthetic
aacagttaatgcgtgcatcaaattgcaaaaaagagttttgagtttagcgccaaatacgaatttgaatacatctgg

SEQ ID NO: 305876 - DNA, 75 bp, Artificial Sequence
  Synthetic
gcattggcttcaagatgcaatggaaaaacatatgctttgctcgaccaaactgctgtcttaactccctttactatc

SEQ ID NO: 305877 - DNA, 75 bp, Artificial Sequence
  Synthetic
aaacatatgctttgctcgaccaaactgctgtcttaactccctttactatcaatgccccaattatttctctttcag

SEQ ID NO: 305878 - DNA, 75 bp, Artificial Sequence
  Synthetic
ttagatcagaaggatctagacctgtaagagcaatagaaagacgcgttcttgatccagctgtcagacagctggtgg

SEQ ID NO: 305879 - DNA, 75 bp, Artificial Sequence
  Synthetic
aagagcaatagaaagacgcgttcttgatccagctgtcagacagctggtggaggaccttaaactgaaaagtcttac

SEQ ID NO: 305880 - DNA, 75 bp, Artificial Sequence
  Synthetic
gctgccgtagacaccgccgtaattcaaccagaaatcatccaaaccgaaaatccactatacgctgatattattgag

SEQ ID NO: 305881 - DNA, 75 bp, Artificial Sequence
  Synthetic
aaccagaaatcatccaaaccgaaaatccactatacgctgatattattgagcaagtcgtgaatagaccacaaatga

SEQ ID NO: 305882 - DNA, 75 bp, Artificial Sequence
  Synthetic
aaaggagtagttacatgtatgtcaggaatggattctgaacatagatttactgttgatcttaaagctagaactact

SEQ ID NO: 305883 - DNA, 75 bp, Artificial Sequence
  Synthetic
cgaccgcaggaactatactaatacctatgccgaatgcgagaaatagggagggtaaattaatcgacgtgtcagcgg

SEQ ID NO: 305884 - DNA, 75 bp, Artificial Sequence
  Synthetic
tatgccgaatgcgagaaatagggagggtaaattaatcgacgtgtcagcggaaatgatggctgaaaattttgccat

SEQ ID NO: 305885 - DNA, 75 bp, Artificial Sequence
  Synthetic
gttcaaactgaaactggagttggagtattttccttcccaatgtgtaatcgcttcaggtttagaatttctccatgg

SEQ ID NO: 305886 - DNA, 75 bp, Artificial Sequence
  Synthetic
tattttccttcccaatgtgtaatcgcttcaggtttagaatttctccatgggatatgcaaaaagatcaagatggtc

SEQ ID NO: 305887 - DNA, 75 bp, Artificial Sequence
  Synthetic
ggcacaggggacagccgctagacaaccagctatatcttttatgttcgagactcgtgacacattcacacagggtga

SEQ ID NO: 305888 - DNA, 75 bp, Artificial Sequence
  Synthetic
cctaaatcacaatacatgttggacacgatctttcctgaaacatcattcataaacaaaccaaatatagactggaac

SEQ ID NO: 305889 - DNA, 75 bp, Artificial Sequence
  Synthetic
cgatctttcctgaaacatcattcataaacaaaccaaatatagactggaacattcagagtttactcacttcgaaca

SEQ ID NO: 305890 - DNA, 75 bp, Artificial Sequence
  Synthetic
ggtggttacatgtatgtctggaatggattcagaacacagattcactgttgatcttaaagcaagaactactggaat

SEQ ID NO: 305891 - DNA, 75 bp, Artificial Sequence
  Synthetic
gattcagaacacagattcactgttgatcttaaagcaagaactactggaataattaatattgtgtacgtaccaact

SEQ ID NO: 305892 - DNA, 75 bp, Artificial Sequence
  Synthetic
caaatgccagaaatagagaaggaaaattagttgacgtctcggcagaaatgatggctgataatttcgctattgatt

SEQ ID NO: 305893 - DNA, 75 bp, Artificial Sequence
  Synthetic
attagttgacgtctcggcagaaatgatggctgataatttcgctattgatttcatggatgatgatgctatagttca

SEQ ID NO: 305894 - DNA, 75 bp, Artificial Sequence
  Synthetic
tctttcccaatgtgtaatcgctttagatttagaatttctccgtgggatatgcaaaaagatcaggaaggtcttggc

SEQ ID NO: 305895 - DNA, 75 bp, Artificial Sequence
  Synthetic
gatttagaatttctccgtgggatatgcaaaaagatcaggaaggtcttggcacggttcacatgacaaattgggcac

SEQ ID NO: 305896 - DNA, 75 bp, Artificial Sequence
  Synthetic
catctctttcatgtttgaaactcgtgatacattcactgaaggtgactaccaacacttatctaaatgcacacctaa

SEQ ID NO: 305897 - DNA, 75 bp, Artificial Sequence
  Synthetic
tttccagaaacttcgtttgtgaataagccaaatgtagattggaacattcagagtctactcacttcgactgttcaa

SEQ ID NO: 305898 - DNA, 75 bp, Artificial Sequence
  Synthetic
acgcttcaagcatggatctgatcgaaacagttaatgcatgcatcaaattgcagaagagagttctaagtttagcgc

SEQ ID NO: 305899 - DNA, 75 bp, Artificial Sequence
  Synthetic
aacagttaatgcatgcatcaaattgcagaagagagttctaagtttagcgccaaacacgaatttgaatacatatgg

SEQ ID NO: 305900 - DNA, 75 bp, Artificial Sequence
  Synthetic
cagaagagagttctaagtttagcgccaaacacgaatttgaatacatatggccaaagcactctgaatgattacaat

SEQ ID NO: 305901 - DNA, 75 bp, Artificial Sequence
  Synthetic
ggacatatgcttttctggatcaaactgcggttctcactcctttcaccatcaatgctccaattatttctctttcag

SEQ ID NO: 305902 - DNA, 75 bp, Artificial Sequence
  Synthetic
tgcggttctcactcctttcaccatcaatgctccaattatttctctttcagtccgtatatctacagacgattatga

SEQ ID NO: 305903 - DNA, 75 bp, Artificial Sequence
  Synthetic
gttctagatgtgcttgccgctgccattaggacagaaggatctagaccagtgagagcaatagaaagacgtgttctt

SEQ ID NO: 305904 - DNA, 75 bp, Artificial Sequence
  Synthetic
ttaggacagaaggatctagaccagtgagagcaatagaaagacgtgttcttgaaccagctgttaggcagttggtag

SEQ ID NO: 305905 - DNA, 75 bp, Artificial Sequence
  Synthetic
ttctgatatttcagttgcgaatctggctgccgtagatactgctgtaattcaaccagaaatcattcagactgagaa

SEQ ID NO: 305906 - DNA, 75 bp, Artificial Sequence
  Synthetic
gctgccgtagatactgctgtaattcaaccagaaatcattcagactgagaatccattatatgctgacatcatcgaa

SEQ ID NO: 305907 - DNA, 75 bp, Artificial Sequence
  Synthetic
atatgactggcggaaacattagagccactttaggaagatggtcaggtaacaaaggagtagttacatgcatgtcag

SEQ ID NO: 305908 - DNA, 75 bp, Artificial Sequence
  Synthetic
cactttaggaagatggtcaggtaacaaaggagtagttacatgcatgtcaggaatggattcagaacatagatttac

SEQ ID NO: 305909 - DNA, 75 bp, Artificial Sequence
  Synthetic
ggaataatcaacattgtttacataccagctgctggtactatgttaatacctatgccaaatggaagaaatagggaa

SEQ ID NO: 305910 - DNA, 75 bp, Artificial Sequence
  Synthetic
ggaaaattaatcgatgtctcagcagagatgatggctgataactttgccattgatttcatggatgatgatgccata

SEQ ID NO: 305911 - DNA, 75 bp, Artificial Sequence
  Synthetic
tattagatttagaatttctccatgggatatggataaagatcaagaaggcttgggaacagttcatatgacaaactg

SEQ ID NO: 305912 - DNA, 75 bp, Artificial Sequence
  Synthetic
ccagctatttcctttatgttcgaaactcgagacacatttactcaaggtgactatcagcatttatctaaatgtaca

SEQ ID NO: 305913 - DNA, 75 bp, Artificial Sequence
  Synthetic
caattttccctgaaacttcgttcataaataaaccgaacgttgattggaacattcagagtttacttacttccacca

SEQ ID NO: 305914 - DNA, 75 bp, Artificial Sequence
  Synthetic
acgcttcaagcatggatctgattgaaacagtgaatgcatgtgttgcattgcaaagaagaatatatgacttagcac

SEQ ID NO: 305915 - DNA, 75 bp, Artificial Sequence
  Synthetic
aacagtgaatgcatgtgttgcattgcaaagaagaatatatgacttagcaccaaataccaatcttaatacggcggg

SEQ ID NO: 305916 - DNA, 75 bp, Artificial Sequence
  Synthetic
caaagaagaatatatgacttagcaccaaataccaatcttaatacggcggggcaaagtaccctcaacgattacaac

SEQ ID NO: 305917 - DNA, 75 bp, Artificial Sequence
  Synthetic
gaacatatcctctacatgatctcactgcggtactaactccactaaccattcacgctcccatcatttcactctcgg

SEQ ID NO: 305918 - DNA, 75 bp, Artificial Sequence
  Synthetic
tgcggtactaactccactaaccattcacgctcccatcatttcactctcggtacgtatttctactgatgactatga

SEQ ID NO: 305919 - DNA, 75 bp, Artificial Sequence
  Synthetic
attcttgatgtgctagctgcggcaatcagaactgaaggttcgagaccagtgcgcgtaattgaaagacgcgttctt

SEQ ID NO: 305920 - DNA, 75 bp, Artificial Sequence
  Synthetic
tcagaactgaaggttcgagaccagtgcgcgtaattgaaagacgcgttcttgatccagttgtcaaacaattgattg

SEQ ID NO: 305921 - DNA, 75 bp, Artificial Sequence
  Synthetic
gtcagagatatctctagcaaacctagctgccgtagacactgctatgatccagcctgaactaattgaaactgagaa

SEQ ID NO: 305922 - DNA, 75 bp, Artificial Sequence
  Synthetic
gctgccgtagacactgctatgatccagcctgaactaattgaaactgagaacccactatttgccgaaattattgag

SEQ ID NO: 305923 - DNA, 75 bp, Artificial Sequence
  Synthetic
gctgccgtagacactgctatgatccagcctgaactaattgaaactgagaacccactatttgccgatattattgag

SEQ ID NO: 305924 - DNA, 75 bp, Artificial Sequence
  Synthetic
gctgccgtagacactgctatgatccagcctgaactaattgaaactgagaacccactatttgccgacattattgag

SEQ ID NO: 305925 - DNA, 75 bp, Artificial Sequence
  Synthetic
gctgccgtagacactgctatgatccagcctgaactaattgaaactgagaacccactatttgccgagattattgag

SEQ ID NO: 305926 - DNA, 75 bp, Artificial Sequence
  Synthetic
aaatgacaggtggaaacatcagagctactctaggtagatggtcaggaaataaaggtgtaattacttgcatgtcag

SEQ ID NO: 305927 - DNA, 75 bp, Artificial Sequence
  Synthetic
aaatgacaggtggaaacatcagagctactctaggtagatggtcaggaaataaaggtgtaattacttgcatgtctg

SEQ ID NO: 305928 - DNA, 75 bp, Artificial Sequence
  Synthetic
aaatgacaggtggaaacatcagagctactctaggtagatggtcaggaaataaaggtgtaattacttgcatgtccg

SEQ ID NO: 305929 - DNA, 75 bp, Artificial Sequence
  Synthetic
aaatgacaggtggaaacatcagagctactctaggtagatggtcaggaaataaaggtgtaattacttgcatgtcgg

SEQ ID NO: 305930 - DNA, 75 bp, Artificial Sequence
  Synthetic
aaatgacaggtggaaacatcagagctactctaggtagatggtcaggtaataaaggtgtaattacttgcatgtcag

SEQ ID NO: 305931 - DNA, 75 bp, Artificial Sequence
  Synthetic
aaatgacaggtggaaacatcagagctactctaggtagatggtcaggtaataaaggtgtaattacttgcatgtctg

SEQ ID NO: 305932 - DNA, 75 bp, Artificial Sequence
  Synthetic
aaatgacaggtggaaacatcagagctactctaggtagatggtcaggtaataaaggtgtaattacttgcatgtccg

SEQ ID NO: 305933 - DNA, 75 bp, Artificial Sequence
  Synthetic
aaatgacaggtggaaacatcagagctactctaggtagatggtcaggtaataaaggtgtaattacttgcatgtcgg

SEQ ID NO: 305934 - DNA, 75 bp, Artificial Sequence
  Synthetic
aaatgacaggtggaaacatcagagctactctaggtagatggtcaggcaataaaggtgtaattacttgcatgtcag

SEQ ID NO: 305935 - DNA, 75 bp, Artificial Sequence
  Synthetic
aaatgacaggtggaaacatcagagctactctaggtagatggtcaggcaataaaggtgtaattacttgcatgtctg

SEQ ID NO: 305936 - DNA, 75 bp, Artificial Sequence
  Synthetic
aaatgacaggtggaaacatcagagctactctaggtagatggtcaggcaataaaggtgtaattacttgcatgtccg

SEQ ID NO: 305937 - DNA, 75 bp, Artificial Sequence
  Synthetic
aaatgacaggtggaaacatcagagctactctaggtagatggtcaggcaataaaggtgtaattacttgcatgtcgg

SEQ ID NO: 305938 - DNA, 75 bp, Artificial Sequence
  Synthetic
aaatgacaggtggaaacatcagagctactctaggtagatggtcagggaataaaggtgtaattacttgcatgtcag

SEQ ID NO: 305939 - DNA, 75 bp, Artificial Sequence
  Synthetic
aaatgacaggtggaaacatcagagctactctaggtagatggtcagggaataaaggtgtaattacttgcatgtctg

SEQ ID NO: 305940 - DNA, 75 bp, Artificial Sequence
  Synthetic
aaatgacaggtggaaacatcagagctactctaggtagatggtcagggaataaaggtgtaattacttgcatgtccg

SEQ ID NO: 305941 - DNA, 75 bp, Artificial Sequence
  Synthetic
aaatgacaggtggaaacatcagagctactctaggtagatggtcagggaataaaggtgtaattacttgcatgtcgg

SEQ ID NO: 305942 - DNA, 75 bp, Artificial Sequence
  Synthetic
aaatgactggtggaaacatcagagctactctaggtagatggtcaggaaataaaggtgtaattacttgcatgtcag

SEQ ID NO: 305943 - DNA, 75 bp, Artificial Sequence
  Synthetic
aaatgactggtggaaacatcagagctactctaggtagatggtcaggaaataaaggtgtaattacttgcatgtctg

SEQ ID NO: 305944 - DNA, 75 bp, Artificial Sequence
  Synthetic
aaatgactggtggaaacatcagagctactctaggtagatggtcaggaaataaaggtgtaattacttgcatgtccg

SEQ ID NO: 305945 - DNA, 75 bp, Artificial Sequence
  Synthetic
aaatgactggtggaaacatcagagctactctaggtagatggtcaggaaataaaggtgtaattacttgcatgtcgg

SEQ ID NO: 305946 - DNA, 75 bp, Artificial Sequence
  Synthetic
aaatgactggtggaaacatcagagctactctaggtagatggtcaggtaataaaggtgtaattacttgcatgtcag

SEQ ID NO: 305947 - DNA, 75 bp, Artificial Sequence
  Synthetic
aaatgactggtggaaacatcagagctactctaggtagatggtcaggtaataaaggtgtaattacttgcatgtctg

SEQ ID NO: 305948 - DNA, 75 bp, Artificial Sequence
  Synthetic
aaatgactggtggaaacatcagagctactctaggtagatggtcaggtaataaaggtgtaattacttgcatgtccg

SEQ ID NO: 305949 - DNA, 75 bp, Artificial Sequence
  Synthetic
aaatgactggtggaaacatcagagctactctaggtagatggtcaggtaataaaggtgtaattacttgcatgtcgg

SEQ ID NO: 305950 - DNA, 75 bp, Artificial Sequence
  Synthetic
aaatgactggtggaaacatcagagctactctaggtagatggtcaggcaataaaggtgtaattacttgcatgtcag

SEQ ID NO: 305951 - DNA, 75 bp, Artificial Sequence
  Synthetic
aaatgactggtggaaacatcagagctactctaggtagatggtcaggcaataaaggtgtaattacttgcatgtctg

SEQ ID NO: 305952 - DNA, 75 bp, Artificial Sequence
  Synthetic
aaatgactggtggaaacatcagagctactctaggtagatggtcaggcaataaaggtgtaattacttgcatgtccg

SEQ ID NO: 305953 - DNA, 75 bp, Artificial Sequence
  Synthetic
aaatgactggtggaaacatcagagctactctaggtagatggtcaggcaataaaggtgtaattacttgcatgtcgg

SEQ ID NO: 305954 - DNA, 75 bp, Artificial Sequence
  Synthetic
aaatgactggtggaaacatcagagctactctaggtagatggtcagggaataaaggtgtaattacttgcatgtcag

SEQ ID NO: 305955 - DNA, 75 bp, Artificial Sequence
  Synthetic
aaatgactggtggaaacatcagagctactctaggtagatggtcagggaataaaggtgtaattacttgcatgtctg

SEQ ID NO: 305956 - DNA, 75 bp, Artificial Sequence
  Synthetic
aaatgactggtggaaacatcagagctactctaggtagatggtcagggaataaaggtgtaattacttgcatgtccg

SEQ ID NO: 305957 - DNA, 75 bp, Artificial Sequence
  Synthetic
aaatgactggtggaaacatcagagctactctaggtagatggtcagggaataaaggtgtaattacttgcatgtcgg

SEQ ID NO: 305958 - DNA, 75 bp, Artificial Sequence
  Synthetic
aaatgaccggtggaaacatcagagctactctaggtagatggtcaggaaataaaggtgtaattacttgcatgtcag

SEQ ID NO: 305959 - DNA, 75 bp, Artificial Sequence
  Synthetic
aaatgaccggtggaaacatcagagctactctaggtagatggtcaggaaataaaggtgtaattacttgcatgtctg

SEQ ID NO: 305960 - DNA, 75 bp, Artificial Sequence
  Synthetic
aaatgaccggtggaaacatcagagctactctaggtagatggtcaggaaataaaggtgtaattacttgcatgtccg

SEQ ID NO: 305961 - DNA, 75 bp, Artificial Sequence
  Synthetic
aaatgaccggtggaaacatcagagctactctaggtagatggtcaggaaataaaggtgtaattacttgcatgtcgg

SEQ ID NO: 305962 - DNA, 75 bp, Artificial Sequence
  Synthetic
aaatgaccggtggaaacatcagagctactctaggtagatggtcaggtaataaaggtgtaattacttgcatgtcag

SEQ ID NO: 305963 - DNA, 75 bp, Artificial Sequence
  Synthetic
aaatgaccggtggaaacatcagagctactctaggtagatggtcaggtaataaaggtgtaattacttgcatgtctg

SEQ ID NO: 305964 - DNA, 75 bp, Artificial Sequence
  Synthetic
aaatgaccggtggaaacatcagagctactctaggtagatggtcaggtaataaaggtgtaattacttgcatgtccg

SEQ ID NO: 305965 - DNA, 75 bp, Artificial Sequence
  Synthetic
aaatgaccggtggaaacatcagagctactctaggtagatggtcaggtaataaaggtgtaattacttgcatgtcgg

SEQ ID NO: 305966 - DNA, 75 bp, Artificial Sequence
  Synthetic
aaatgaccggtggaaacatcagagctactctaggtagatggtcaggcaataaaggtgtaattacttgcatgtcag

SEQ ID NO: 305967 - DNA, 75 bp, Artificial Sequence
  Synthetic
aaatgaccggtggaaacatcagagctactctaggtagatggtcaggcaataaaggtgtaattacttgcatgtctg

SEQ ID NO: 305968 - DNA, 75 bp, Artificial Sequence
  Synthetic
aaatgaccggtggaaacatcagagctactctaggtagatggtcaggcaataaaggtgtaattacttgcatgtccg

SEQ ID NO: 305969 - DNA, 75 bp, Artificial Sequence
  Synthetic
aaatgaccggtggaaacatcagagctactctaggtagatggtcaggcaataaaggtgtaattacttgcatgtcgg

SEQ ID NO: 305970 - DNA, 75 bp, Artificial Sequence
  Synthetic
aaatgaccggtggaaacatcagagctactctaggtagatggtcagggaataaaggtgtaattacttgcatgtcag

SEQ ID NO: 305971 - DNA, 75 bp, Artificial Sequence
  Synthetic
aaatgaccggtggaaacatcagagctactctaggtagatggtcagggaataaaggtgtaattacttgcatgtctg

SEQ ID NO: 305972 - DNA, 75 bp, Artificial Sequence
  Synthetic
aaatgaccggtggaaacatcagagctactctaggtagatggtcagggaataaaggtgtaattacttgcatgtccg

SEQ ID NO: 305973 - DNA, 75 bp, Artificial Sequence
  Synthetic
aaatgaccggtggaaacatcagagctactctaggtagatggtcagggaataaaggtgtaattacttgcatgtcgg

SEQ ID NO: 305974 - DNA, 75 bp, Artificial Sequence
  Synthetic
aaatgacgggtggaaacatcagagctactctaggtagatggtcaggaaataaaggtgtaattacttgcatgtcag

SEQ ID NO: 305975 - DNA, 75 bp, Artificial Sequence
  Synthetic
aaatgacgggtggaaacatcagagctactctaggtagatggtcaggaaataaaggtgtaattacttgcatgtctg

SEQ ID NO: 305976 - DNA, 75 bp, Artificial Sequence
  Synthetic
aaatgacgggtggaaacatcagagctactctaggtagatggtcaggaaataaaggtgtaattacttgcatgtccg

SEQ ID NO: 305977 - DNA, 75 bp, Artificial Sequence
  Synthetic
aaatgacgggtggaaacatcagagctactctaggtagatggtcaggaaataaaggtgtaattacttgcatgtcgg

SEQ ID NO: 305978 - DNA, 75 bp, Artificial Sequence
  Synthetic
aaatgacgggtggaaacatcagagctactctaggtagatggtcaggtaataaaggtgtaattacttgcatgtcag

SEQ ID NO: 305979 - DNA, 75 bp, Artificial Sequence
  Synthetic
aaatgacgggtggaaacatcagagctactctaggtagatggtcaggtaataaaggtgtaattacttgcatgtctg

SEQ ID NO: 305980 - DNA, 75 bp, Artificial Sequence
  Synthetic
aaatgacgggtggaaacatcagagctactctaggtagatggtcaggtaataaaggtgtaattacttgcatgtccg

SEQ ID NO: 305981 - DNA, 75 bp, Artificial Sequence
  Synthetic
aaatgacgggtggaaacatcagagctactctaggtagatggtcaggtaataaaggtgtaattacttgcatgtcgg

SEQ ID NO: 305982 - DNA, 75 bp, Artificial Sequence
  Synthetic
aaatgacgggtggaaacatcagagctactctaggtagatggtcaggcaataaaggtgtaattacttgcatgtcag

SEQ ID NO: 305983 - DNA, 75 bp, Artificial Sequence
  Synthetic
aaatgacgggtggaaacatcagagctactctaggtagatggtcaggcaataaaggtgtaattacttgcatgtctg

SEQ ID NO: 305984 - DNA, 75 bp, Artificial Sequence
  Synthetic
aaatgacgggtggaaacatcagagctactctaggtagatggtcaggcaataaaggtgtaattacttgcatgtccg

SEQ ID NO: 305985 - DNA, 75 bp, Artificial Sequence
  Synthetic
aaatgacgggtggaaacatcagagctactctaggtagatggtcaggcaataaaggtgtaattacttgcatgtcgg

SEQ ID NO: 305986 - DNA, 75 bp, Artificial Sequence
  Synthetic
aaatgacgggtggaaacatcagagctactctaggtagatggtcagggaataaaggtgtaattacttgcatgtcag

SEQ ID NO: 305987 - DNA, 75 bp, Artificial Sequence
  Synthetic
aaatgacgggtggaaacatcagagctactctaggtagatggtcagggaataaaggtgtaattacttgcatgtctg

SEQ ID NO: 305988 - DNA, 75 bp, Artificial Sequence
  Synthetic
aaatgacgggtggaaacatcagagctactctaggtagatggtcagggaataaaggtgtaattacttgcatgtccg

SEQ ID NO: 305989 - DNA, 75 bp, Artificial Sequence
  Synthetic
aaatgacgggtggaaacatcagagctactctaggtagatggtcagggaataaaggtgtaattacttgcatgtcgg

SEQ ID NO: 305990 - DNA, 75 bp, Artificial Sequence
  Synthetic
tactctaggtagatggtcaggaaataaaggtgtaattacttgcatgtcaggcatggattcagaacatagattcat

SEQ ID NO: 305991 - DNA, 75 bp, Artificial Sequence
  Synthetic
tactctaggtagatggtcaggaaataaaggtgtaattacttgcatgtcaggcatggattcagaacattgattcat

SEQ ID NO: 305992 - DNA, 75 bp, Artificial Sequence
  Synthetic
tactctaggtagatggtcaggaaataaaggtgtaattacttgcatgtcaggcatggattcagaacatcgattcat

SEQ ID NO: 305993 - DNA, 75 bp, Artificial Sequence
  Synthetic
tactctaggtagatggtcaggaaataaaggtgtaattacttgcatgtcaggcatggattcagaacatggattcat

SEQ ID NO: 305994 - DNA, 75 bp, Artificial Sequence
  Synthetic
tactctaggtagatggtcaggaaataaaggtgtaattacttgcatgtctggcatggattcagaacatagattcat

SEQ ID NO: 305995 - DNA, 75 bp, Artificial Sequence
  Synthetic
tactctaggtagatggtcaggaaataaaggtgtaattacttgcatgtctggcatggattcagaacattgattcat

SEQ ID NO: 305996 - DNA, 75 bp, Artificial Sequence
  Synthetic
tactctaggtagatggtcaggaaataaaggtgtaattacttgcatgtctggcatggattcagaacatcgattcat

SEQ ID NO: 305997 - DNA, 75 bp, Artificial Sequence
  Synthetic
tactctaggtagatggtcaggaaataaaggtgtaattacttgcatgtctggcatggattcagaacatggattcat

SEQ ID NO: 305998 - DNA, 75 bp, Artificial Sequence
  Synthetic
tactctaggtagatggtcaggaaataaaggtgtaattacttgcatgtccggcatggattcagaacatagattcat

SEQ ID NO: 305999 - DNA, 75 bp, Artificial Sequence
  Synthetic
tactctaggtagatggtcaggaaataaaggtgtaattacttgcatgtccggcatggattcagaacattgattcat

SEQ ID NO: 306000 - DNA, 75 bp, Artificial Sequence
  Synthetic
tactctaggtagatggtcaggaaataaaggtgtaattacttgcatgtccggcatggattcagaacatcgattcat

SEQ ID NO: 306001 - DNA, 75 bp, Artificial Sequence
  Synthetic
tactctaggtagatggtcaggaaataaaggtgtaattacttgcatgtccggcatggattcagaacatggattcat

SEQ ID NO: 306002 - DNA, 75 bp, Artificial Sequence
  Synthetic
tactctaggtagatggtcaggaaataaaggtgtaattacttgcatgtcgggcatggattcagaacatagattcat

SEQ ID NO: 306003 - DNA, 75 bp, Artificial Sequence
  Synthetic
tactctaggtagatggtcaggaaataaaggtgtaattacttgcatgtcgggcatggattcagaacattgattcat

SEQ ID NO: 306004 - DNA, 75 bp, Artificial Sequence
  Synthetic
tactctaggtagatggtcaggaaataaaggtgtaattacttgcatgtcgggcatggattcagaacatcgattcat

SEQ ID NO: 306005 - DNA, 75 bp, Artificial Sequence
  Synthetic
tactctaggtagatggtcaggaaataaaggtgtaattacttgcatgtcgggcatggattcagaacatggattcat

SEQ ID NO: 306006 - DNA, 75 bp, Artificial Sequence
  Synthetic
tactctaggtagatggtcaggtaataaaggtgtaattacttgcatgtcaggcatggattcagaacatagattcat

SEQ ID NO: 306007 - DNA, 75 bp, Artificial Sequence
  Synthetic
tactctaggtagatggtcaggtaataaaggtgtaattacttgcatgtcaggcatggattcagaacattgattcat

SEQ ID NO: 306008 - DNA, 75 bp, Artificial Sequence
  Synthetic
tactctaggtagatggtcaggtaataaaggtgtaattacttgcatgtcaggcatggattcagaacatcgattcat

SEQ ID NO: 306009 - DNA, 75 bp, Artificial Sequence
  Synthetic
tactctaggtagatggtcaggtaataaaggtgtaattacttgcatgtcaggcatggattcagaacatggattcat

SEQ ID NO: 306010 - DNA, 75 bp, Artificial Sequence
  Synthetic
tactctaggtagatggtcaggtaataaaggtgtaattacttgcatgtctggcatggattcagaacatagattcat

SEQ ID NO: 306011 - DNA, 75 bp, Artificial Sequence
  Synthetic
tactctaggtagatggtcaggtaataaaggtgtaattacttgcatgtctggcatggattcagaacattgattcat

SEQ ID NO: 306012 - DNA, 75 bp, Artificial Sequence
  Synthetic
tactctaggtagatggtcaggtaataaaggtgtaattacttgcatgtctggcatggattcagaacatcgattcat

SEQ ID NO: 306013 - DNA, 75 bp, Artificial Sequence
  Synthetic
tactctaggtagatggtcaggtaataaaggtgtaattacttgcatgtctggcatggattcagaacatggattcat

SEQ ID NO: 306014 - DNA, 75 bp, Artificial Sequence
  Synthetic
tactctaggtagatggtcaggtaataaaggtgtaattacttgcatgtccggcatggattcagaacatagattcat

SEQ ID NO: 306015 - DNA, 75 bp, Artificial Sequence
  Synthetic
tactctaggtagatggtcaggtaataaaggtgtaattacttgcatgtccggcatggattcagaacattgattcat

SEQ ID NO: 306016 - DNA, 75 bp, Artificial Sequence
  Synthetic
tactctaggtagatggtcaggtaataaaggtgtaattacttgcatgtccggcatggattcagaacatcgattcat

SEQ ID NO: 306017 - DNA, 75 bp, Artificial Sequence
  Synthetic
tactctaggtagatggtcaggtaataaaggtgtaattacttgcatgtccggcatggattcagaacatggattcat

SEQ ID NO: 306018 - DNA, 75 bp, Artificial Sequence
  Synthetic
tactctaggtagatggtcaggtaataaaggtgtaattacttgcatgtcgggcatggattcagaacatagattcat

SEQ ID NO: 306019 - DNA, 75 bp, Artificial Sequence
  Synthetic
tactctaggtagatggtcaggtaataaaggtgtaattacttgcatgtcgggcatggattcagaacattgattcat

SEQ ID NO: 306020 - DNA, 75 bp, Artificial Sequence
  Synthetic
tactctaggtagatggtcaggtaataaaggtgtaattacttgcatgtcgggcatggattcagaacatcgattcat

SEQ ID NO: 306021 - DNA, 75 bp, Artificial Sequence
  Synthetic
tactctaggtagatggtcaggtaataaaggtgtaattacttgcatgtcgggcatggattcagaacatggattcat

SEQ ID NO: 306022 - DNA, 75 bp, Artificial Sequence
  Synthetic
tactctaggtagatggtcaggcaataaaggtgtaattacttgcatgtcaggcatggattcagaacatagattcat

SEQ ID NO: 306023 - DNA, 75 bp, Artificial Sequence
  Synthetic
tactctaggtagatggtcaggcaataaaggtgtaattacttgcatgtcaggcatggattcagaacattgattcat

SEQ ID NO: 306024 - DNA, 75 bp, Artificial Sequence
  Synthetic
tactctaggtagatggtcaggcaataaaggtgtaattacttgcatgtcaggcatggattcagaacatcgattcat

SEQ ID NO: 306025 - DNA, 75 bp, Artificial Sequence
  Synthetic
tactctaggtagatggtcaggcaataaaggtgtaattacttgcatgtcaggcatggattcagaacatggattcat

SEQ ID NO: 306026 - DNA, 75 bp, Artificial Sequence
  Synthetic
tactctaggtagatggtcaggcaataaaggtgtaattacttgcatgtctggcatggattcagaacatagattcat

SEQ ID NO: 306027 - DNA, 75 bp, Artificial Sequence
  Synthetic
tactctaggtagatggtcaggcaataaaggtgtaattacttgcatgtctggcatggattcagaacattgattcat

SEQ ID NO: 306028 - DNA, 75 bp, Artificial Sequence
  Synthetic
tactctaggtagatggtcaggcaataaaggtgtaattacttgcatgtctggcatggattcagaacatcgattcat

SEQ ID NO: 306029 - DNA, 75 bp, Artificial Sequence
  Synthetic
tactctaggtagatggtcaggcaataaaggtgtaattacttgcatgtctggcatggattcagaacatggattcat

SEQ ID NO: 306030 - DNA, 75 bp, Artificial Sequence
  Synthetic
tactctaggtagatggtcaggcaataaaggtgtaattacttgcatgtccggcatggattcagaacatagattcat

SEQ ID NO: 306031 - DNA, 75 bp, Artificial Sequence
  Synthetic
tactctaggtagatggtcaggcaataaaggtgtaattacttgcatgtccggcatggattcagaacattgattcat

SEQ ID NO: 306032 - DNA, 75 bp, Artificial Sequence
  Synthetic
tactctaggtagatggtcaggcaataaaggtgtaattacttgcatgtccggcatggattcagaacatcgattcat

SEQ ID NO: 306033 - DNA, 75 bp, Artificial Sequence
  Synthetic
tactctaggtagatggtcaggcaataaaggtgtaattacttgcatgtccggcatggattcagaacatggattcat

SEQ ID NO: 306034 - DNA, 75 bp, Artificial Sequence
  Synthetic
tactctaggtagatggtcaggcaataaaggtgtaattacttgcatgtcgggcatggattcagaacatagattcat

SEQ ID NO: 306035 - DNA, 75 bp, Artificial Sequence
  Synthetic
tactctaggtagatggtcaggcaataaaggtgtaattacttgcatgtcgggcatggattcagaacattgattcat

SEQ ID NO: 306036 - DNA, 75 bp, Artificial Sequence
  Synthetic
tactctaggtagatggtcaggcaataaaggtgtaattacttgcatgtcgggcatggattcagaacatcgattcat

SEQ ID NO: 306037 - DNA, 75 bp, Artificial Sequence
  Synthetic
tactctaggtagatggtcaggcaataaaggtgtaattacttgcatgtcgggcatggattcagaacatggattcat

SEQ ID NO: 306038 - DNA, 75 bp, Artificial Sequence
  Synthetic
tactctaggtagatggtcagggaataaaggtgtaattacttgcatgtcaggcatggattcagaacatagattcat

SEQ ID NO: 306039 - DNA, 75 bp, Artificial Sequence
  Synthetic
tactctaggtagatggtcagggaataaaggtgtaattacttgcatgtcaggcatggattcagaacattgattcat

SEQ ID NO: 306040 - DNA, 75 bp, Artificial Sequence
  Synthetic
tactctaggtagatggtcagggaataaaggtgtaattacttgcatgtcaggcatggattcagaacatcgattcat

SEQ ID NO: 306041 - DNA, 75 bp, Artificial Sequence
  Synthetic
tactctaggtagatggtcagggaataaaggtgtaattacttgcatgtcaggcatggattcagaacatggattcat

SEQ ID NO: 306042 - DNA, 75 bp, Artificial Sequence
  Synthetic
tactctaggtagatggtcagggaataaaggtgtaattacttgcatgtctggcatggattcagaacatagattcat

SEQ ID NO: 306043 - DNA, 75 bp, Artificial Sequence
  Synthetic
tactctaggtagatggtcagggaataaaggtgtaattacttgcatgtctggcatggattcagaacattgattcat

SEQ ID NO: 306044 - DNA, 75 bp, Artificial Sequence
  Synthetic
tactctaggtagatggtcagggaataaaggtgtaattacttgcatgtctggcatggattcagaacatcgattcat

SEQ ID NO: 306045 - DNA, 75 bp, Artificial Sequence
  Synthetic
tactctaggtagatggtcagggaataaaggtgtaattacttgcatgtctggcatggattcagaacatggattcat

SEQ ID NO: 306046 - DNA, 75 bp, Artificial Sequence
  Synthetic
tactctaggtagatggtcagggaataaaggtgtaattacttgcatgtccggcatggattcagaacatagattcat

SEQ ID NO: 306047 - DNA, 75 bp, Artificial Sequence
  Synthetic
tactctaggtagatggtcagggaataaaggtgtaattacttgcatgtccggcatggattcagaacattgattcat

SEQ ID NO: 306048 - DNA, 75 bp, Artificial Sequence
  Synthetic
tactctaggtagatggtcagggaataaaggtgtaattacttgcatgtccggcatggattcagaacatcgattcat

SEQ ID NO: 306049 - DNA, 75 bp, Artificial Sequence
  Synthetic
tactctaggtagatggtcagggaataaaggtgtaattacttgcatgtccggcatggattcagaacatggattcat

SEQ ID NO: 306050 - DNA, 75 bp, Artificial Sequence
  Synthetic
tactctaggtagatggtcagggaataaaggtgtaattacttgcatgtcgggcatggattcagaacatagattcat

SEQ ID NO: 306051 - DNA, 75 bp, Artificial Sequence
  Synthetic
tactctaggtagatggtcagggaataaaggtgtaattacttgcatgtcgggcatggattcagaacattgattcat

SEQ ID NO: 306052 - DNA, 75 bp, Artificial Sequence
  Synthetic
tactctaggtagatggtcagggaataaaggtgtaattacttgcatgtcgggcatggattcagaacatcgattcat

SEQ ID NO: 306053 - DNA, 75 bp, Artificial Sequence
  Synthetic
tactctaggtagatggtcagggaataaaggtgtaattacttgcatgtcgggcatggattcagaacatggattcat

SEQ ID NO: 306054 - DNA, 75 bp, Artificial Sequence
  Synthetic
ggtgtactaaatatcgtttacgtaccaacagccggcacgatgctcattccaatgccaaatggaagaaccagagaa

SEQ ID NO: 306055 - DNA, 75 bp, Artificial Sequence
  Synthetic
caacagccggcacgatgctcattccaatgccaaatggaagaaccagagaagggaaactcatcgacgtttcagctg

SEQ ID NO: 306056 - DNA, 75 bp, Artificial Sequence
  Synthetic
tgatttcatggaagatgatgctataatacagaccgaaaccggagttggtgttttttcttttccaatgtgtaacag

SEQ ID NO: 306057 - DNA, 75 bp, Artificial Sequence
  Synthetic
atacagaccgaaaccggagttggtgttttttcttttccaatgtgtaacagaataaggttaagaatcaatccatgg

SEQ ID NO: 306058 - DNA, 75 bp, Artificial Sequence
  Synthetic
atacagaccgaaaccggagttggtgttttttcttttccaatgtgtaacagaataaggttaagaatcattccatgg

SEQ ID NO: 306059 - DNA, 75 bp, Artificial Sequence
  Synthetic
atacagaccgaaaccggagttggtgttttttcttttccaatgtgtaacagaataaggttaagaatcactccatgg

SEQ ID NO: 306060 - DNA, 75 bp, Artificial Sequence
  Synthetic
atacagaccgaaaccggagttggtgttttttcttttccaatgtgtaacagaataaggttaagaatcagtccatgg

SEQ ID NO: 306061 - DNA, 75 bp, Artificial Sequence
  Synthetic
atacagaccgaaaccggagttggtgttttttcttttccaatgtgtaacagaataaggtttagaatcaatccatgg

SEQ ID NO: 306062 - DNA, 75 bp, Artificial Sequence
  Synthetic
atacagaccgaaaccggagttggtgttttttcttttccaatgtgtaacagaataaggtttagaatcattccatgg

SEQ ID NO: 306063 - DNA, 75 bp, Artificial Sequence
  Synthetic
atacagaccgaaaccggagttggtgttttttcttttccaatgtgtaacagaataaggtttagaatcactccatgg

SEQ ID NO: 306064 - DNA, 75 bp, Artificial Sequence
  Synthetic
atacagaccgaaaccggagttggtgttttttcttttccaatgtgtaacagaataaggtttagaatcagtccatgg

SEQ ID NO: 306065 - DNA, 75 bp, Artificial Sequence
  Synthetic
atacagaccgaaaccggagttggtgttttttcttttccaatgtgtaacagaataaggttcagaatcaatccatgg

SEQ ID NO: 306066 - DNA, 75 bp, Artificial Sequence
  Synthetic
atacagaccgaaaccggagttggtgttttttcttttccaatgtgtaacagaataaggttcagaatcattccatgg

SEQ ID NO: 306067 - DNA, 75 bp, Artificial Sequence
  Synthetic
atacagaccgaaaccggagttggtgttttttcttttccaatgtgtaacagaataaggttcagaatcactccatgg

SEQ ID NO: 306068 - DNA, 75 bp, Artificial Sequence
  Synthetic
atacagaccgaaaccggagttggtgttttttcttttccaatgtgtaacagaataaggttcagaatcagtccatgg

SEQ ID NO: 306069 - DNA, 75 bp, Artificial Sequence
  Synthetic
atacagaccgaaaccggagttggtgttttttcttttccaatgtgtaacagaataaggttgagaatcaatccatgg

SEQ ID NO: 306070 - DNA, 75 bp, Artificial Sequence
  Synthetic
atacagaccgaaaccggagttggtgttttttcttttccaatgtgtaacagaataaggttgagaatcattccatgg

SEQ ID NO: 306071 - DNA, 75 bp, Artificial Sequence
  Synthetic
atacagaccgaaaccggagttggtgttttttcttttccaatgtgtaacagaataaggttgagaatcactccatgg

SEQ ID NO: 306072 - DNA, 75 bp, Artificial Sequence
  Synthetic
atacagaccgaaaccggagttggtgttttttcttttccaatgtgtaacagaataaggttgagaatcagtccatgg

SEQ ID NO: 306073 - DNA, 75 bp, Artificial Sequence
  Synthetic
tgggaacggtaaaaatgacaaattgggctcagggaaatgcaacaaaacaaccagctgtgtcatttctattcgaga

SEQ ID NO: 306074 - DNA, 75 bp, Artificial Sequence
  Synthetic
tgggaacggtaaaaatgacaaattgggctcagggaaatgcaacaaaacaaccagctgtgtcatttcttttcgaga

SEQ ID NO: 306075 - DNA, 75 bp, Artificial Sequence
  Synthetic
tgggaacggtaaaaatgacaaattgggctcagggaaatgcaacaaaacaaccagctgtgtcatttctcttcgaga

SEQ ID NO: 306076 - DNA, 75 bp, Artificial Sequence
  Synthetic
tgggaacggtaaaaatgacaaattgggctcagggaaatgcaacaaaacaaccagctgtgtcatttctgttcgaga

SEQ ID NO: 306077 - DNA, 75 bp, Artificial Sequence
  Synthetic
tgggaacggtaaaaatgacaaattgggctcagggaaatgcaacaaaacatccagctgtgtcatttctattcgaga

SEQ ID NO: 306078 - DNA, 75 bp, Artificial Sequence
  Synthetic
tgggaacggtaaaaatgacaaattgggctcagggaaatgcaacaaaacatccagctgtgtcatttcttttcgaga

SEQ ID NO: 306079 - DNA, 75 bp, Artificial Sequence
  Synthetic
tgggaacggtaaaaatgacaaattgggctcagggaaatgcaacaaaacatccagctgtgtcatttctcttcgaga

SEQ ID NO: 306080 - DNA, 75 bp, Artificial Sequence
  Synthetic
tgggaacggtaaaaatgacaaattgggctcagggaaatgcaacaaaacatccagctgtgtcatttctgttcgaga

SEQ ID NO: 306081 - DNA, 75 bp, Artificial Sequence
  Synthetic
tgggaacggtaaaaatgacaaattgggctcagggaaatgcaacaaaacacccagctgtgtcatttctattcgaga

SEQ ID NO: 306082 - DNA, 75 bp, Artificial Sequence
  Synthetic
tgggaacggtaaaaatgacaaattgggctcagggaaatgcaacaaaacacccagctgtgtcatttcttttcgaga

SEQ ID NO: 306083 - DNA, 75 bp, Artificial Sequence
  Synthetic
tgggaacggtaaaaatgacaaattgggctcagggaaatgcaacaaaacacccagctgtgtcatttctcttcgaga

SEQ ID NO: 306084 - DNA, 75 bp, Artificial Sequence
  Synthetic
tgggaacggtaaaaatgacaaattgggctcagggaaatgcaacaaaacacccagctgtgtcatttctgttcgaga

SEQ ID NO: 306085 - DNA, 75 bp, Artificial Sequence
  Synthetic
tgggaacggtaaaaatgacaaattgggctcagggaaatgcaacaaaacagccagctgtgtcatttctattcgaga

SEQ ID NO: 306086 - DNA, 75 bp, Artificial Sequence
  Synthetic
tgggaacggtaaaaatgacaaattgggctcagggaaatgcaacaaaacagccagctgtgtcatttcttttcgaga

SEQ ID NO: 306087 - DNA, 75 bp, Artificial Sequence
  Synthetic
tgggaacggtaaaaatgacaaattgggctcagggaaatgcaacaaaacagccagctgtgtcatttctcttcgaga

SEQ ID NO: 306088 - DNA, 75 bp, Artificial Sequence
  Synthetic
tgggaacggtaaaaatgacaaattgggctcagggaaatgcaacaaaacagccagctgtgtcatttctgttcgaga

SEQ ID NO: 306089 - DNA, 75 bp, Artificial Sequence
  Synthetic
tgggaacggtaaatatgacaaattgggctcagggaaatgcaacaaaacaaccagctgtgtcatttctattcgaga

SEQ ID NO: 306090 - DNA, 75 bp, Artificial Sequence
  Synthetic
tgggaacggtaaatatgacaaattgggctcagggaaatgcaacaaaacaaccagctgtgtcatttcttttcgaga

SEQ ID NO: 306091 - DNA, 75 bp, Artificial Sequence
  Synthetic
tgggaacggtaaatatgacaaattgggctcagggaaatgcaacaaaacaaccagctgtgtcatttctcttcgaga

SEQ ID NO: 306092 - DNA, 75 bp, Artificial Sequence
  Synthetic
tgggaacggtaaatatgacaaattgggctcagggaaatgcaacaaaacaaccagctgtgtcatttctgttcgaga

SEQ ID NO: 306093 - DNA, 75 bp, Artificial Sequence
  Synthetic
tgggaacggtaaatatgacaaattgggctcagggaaatgcaacaaaacatccagctgtgtcatttctattcgaga

SEQ ID NO: 306094 - DNA, 75 bp, Artificial Sequence
  Synthetic
tgggaacggtaaatatgacaaattgggctcagggaaatgcaacaaaacatccagctgtgtcatttcttttcgaga

SEQ ID NO: 306095 - DNA, 75 bp, Artificial Sequence
  Synthetic
tgggaacggtaaatatgacaaattgggctcagggaaatgcaacaaaacatccagctgtgtcatttctcttcgaga

SEQ ID NO: 306096 - DNA, 75 bp, Artificial Sequence
  Synthetic
tgggaacggtaaatatgacaaattgggctcagggaaatgcaacaaaacatccagctgtgtcatttctgttcgaga

SEQ ID NO: 306097 - DNA, 75 bp, Artificial Sequence
  Synthetic
tgggaacggtaaatatgacaaattgggctcagggaaatgcaacaaaacacccagctgtgtcatttctattcgaga

SEQ ID NO: 306098 - DNA, 75 bp, Artificial Sequence
  Synthetic
tgggaacggtaaatatgacaaattgggctcagggaaatgcaacaaaacacccagctgtgtcatttcttttcgaga

SEQ ID NO: 306099 - DNA, 75 bp, Artificial Sequence
  Synthetic
tgggaacggtaaatatgacaaattgggctcagggaaatgcaacaaaacacccagctgtgtcatttctcttcgaga

SEQ ID NO: 306100 - DNA, 75 bp, Artificial Sequence
  Synthetic
tgggaacggtaaatatgacaaattgggctcagggaaatgcaacaaaacacccagctgtgtcatttctgttcgaga

SEQ ID NO: 306101 - DNA, 75 bp, Artificial Sequence
  Synthetic
tgggaacggtaaatatgacaaattgggctcagggaaatgcaacaaaacagccagctgtgtcatttctattcgaga

SEQ ID NO: 306102 - DNA, 75 bp, Artificial Sequence
  Synthetic
tgggaacggtaaatatgacaaattgggctcagggaaatgcaacaaaacagccagctgtgtcatttcttttcgaga

SEQ ID NO: 306103 - DNA, 75 bp, Artificial Sequence
  Synthetic
tgggaacggtaaatatgacaaattgggctcagggaaatgcaacaaaacagccagctgtgtcatttctcttcgaga

SEQ ID NO: 306104 - DNA, 75 bp, Artificial Sequence
  Synthetic
tgggaacggtaaatatgacaaattgggctcagggaaatgcaacaaaacagccagctgtgtcatttctgttcgaga

SEQ ID NO: 306105 - DNA, 75 bp, Artificial Sequence
  Synthetic
tgggaacggtaaacatgacaaattgggctcagggaaatgcaacaaaacaaccagctgtgtcatttctattcgaga

SEQ ID NO: 306106 - DNA, 75 bp, Artificial Sequence
  Synthetic
tgggaacggtaaacatgacaaattgggctcagggaaatgcaacaaaacaaccagctgtgtcatttcttttcgaga

SEQ ID NO: 306107 - DNA, 75 bp, Artificial Sequence
  Synthetic
tgggaacggtaaacatgacaaattgggctcagggaaatgcaacaaaacaaccagctgtgtcatttctcttcgaga

SEQ ID NO: 306108 - DNA, 75 bp, Artificial Sequence
  Synthetic
tgggaacggtaaacatgacaaattgggctcagggaaatgcaacaaaacaaccagctgtgtcatttctgttcgaga

SEQ ID NO: 306109 - DNA, 75 bp, Artificial Sequence
  Synthetic
tgggaacggtaaacatgacaaattgggctcagggaaatgcaacaaaacatccagctgtgtcatttctattcgaga

SEQ ID NO: 306110 - DNA, 75 bp, Artificial Sequence
  Synthetic
tgggaacggtaaacatgacaaattgggctcagggaaatgcaacaaaacatccagctgtgtcatttcttttcgaga

SEQ ID NO: 306111 - DNA, 75 bp, Artificial Sequence
  Synthetic
tgggaacggtaaacatgacaaattgggctcagggaaatgcaacaaaacatccagctgtgtcatttctcttcgaga

SEQ ID NO: 306112 - DNA, 75 bp, Artificial Sequence
  Synthetic
tgggaacggtaaacatgacaaattgggctcagggaaatgcaacaaaacatccagctgtgtcatttctgttcgaga

SEQ ID NO: 306113 - DNA, 75 bp, Artificial Sequence
  Synthetic
tgggaacggtaaacatgacaaattgggctcagggaaatgcaacaaaacacccagctgtgtcatttctattcgaga

SEQ ID NO: 306114 - DNA, 75 bp, Artificial Sequence
  Synthetic
tgggaacggtaaacatgacaaattgggctcagggaaatgcaacaaaacacccagctgtgtcatttcttttcgaga

SEQ ID NO: 306115 - DNA, 75 bp, Artificial Sequence
  Synthetic
tgggaacggtaaacatgacaaattgggctcagggaaatgcaacaaaacacccagctgtgtcatttctcttcgaga

SEQ ID NO: 306116 - DNA, 75 bp, Artificial Sequence
  Synthetic
tgggaacggtaaacatgacaaattgggctcagggaaatgcaacaaaacacccagctgtgtcatttctgttcgaga

SEQ ID NO: 306117 - DNA, 75 bp, Artificial Sequence
  Synthetic
tgggaacggtaaacatgacaaattgggctcagggaaatgcaacaaaacagccagctgtgtcatttctattcgaga

SEQ ID NO: 306118 - DNA, 75 bp, Artificial Sequence
  Synthetic
tgggaacggtaaacatgacaaattgggctcagggaaatgcaacaaaacagccagctgtgtcatttcttttcgaga

SEQ ID NO: 306119 - DNA, 75 bp, Artificial Sequence
  Synthetic
tgggaacggtaaacatgacaaattgggctcagggaaatgcaacaaaacagccagctgtgtcatttctcttcgaga

SEQ ID NO: 306120 - DNA, 75 bp, Artificial Sequence
  Synthetic
tgggaacggtaaacatgacaaattgggctcagggaaatgcaacaaaacagccagctgtgtcatttctgttcgaga

SEQ ID NO: 306121 - DNA, 75 bp, Artificial Sequence
  Synthetic
tgggaacggtaaagatgacaaattgggctcagggaaatgcaacaaaacaaccagctgtgtcatttctattcgaga

SEQ ID NO: 306122 - DNA, 75 bp, Artificial Sequence
  Synthetic
tgggaacggtaaagatgacaaattgggctcagggaaatgcaacaaaacaaccagctgtgtcatttcttttcgaga

SEQ ID NO: 306123 - DNA, 75 bp, Artificial Sequence
  Synthetic
tgggaacggtaaagatgacaaattgggctcagggaaatgcaacaaaacaaccagctgtgtcatttctcttcgaga

SEQ ID NO: 306124 - DNA, 75 bp, Artificial Sequence
  Synthetic
tgggaacggtaaagatgacaaattgggctcagggaaatgcaacaaaacaaccagctgtgtcatttctgttcgaga

SEQ ID NO: 306125 - DNA, 75 bp, Artificial Sequence
  Synthetic
tgggaacggtaaagatgacaaattgggctcagggaaatgcaacaaaacatccagctgtgtcatttctattcgaga

SEQ ID NO: 306126 - DNA, 75 bp, Artificial Sequence
  Synthetic
tgggaacggtaaagatgacaaattgggctcagggaaatgcaacaaaacatccagctgtgtcatttcttttcgaga

SEQ ID NO: 306127 - DNA, 75 bp, Artificial Sequence
  Synthetic
tgggaacggtaaagatgacaaattgggctcagggaaatgcaacaaaacatccagctgtgtcatttctcttcgaga

SEQ ID NO: 306128 - DNA, 75 bp, Artificial Sequence
  Synthetic
tgggaacggtaaagatgacaaattgggctcagggaaatgcaacaaaacatccagctgtgtcatttctgttcgaga

SEQ ID NO: 306129 - DNA, 75 bp, Artificial Sequence
  Synthetic
tgggaacggtaaagatgacaaattgggctcagggaaatgcaacaaaacacccagctgtgtcatttctattcgaga

SEQ ID NO: 306130 - DNA, 75 bp, Artificial Sequence
  Synthetic
tgggaacggtaaagatgacaaattgggctcagggaaatgcaacaaaacacccagctgtgtcatttcttttcgaga

SEQ ID NO: 306131 - DNA, 75 bp, Artificial Sequence
  Synthetic
tgggaacggtaaagatgacaaattgggctcagggaaatgcaacaaaacacccagctgtgtcatttctcttcgaga

SEQ ID NO: 306132 - DNA, 75 bp, Artificial Sequence
  Synthetic
tgggaacggtaaagatgacaaattgggctcagggaaatgcaacaaaacacccagctgtgtcatttctgttcgaga

SEQ ID NO: 306133 - DNA, 75 bp, Artificial Sequence
  Synthetic
tgggaacggtaaagatgacaaattgggctcagggaaatgcaacaaaacagccagctgtgtcatttctattcgaga

SEQ ID NO: 306134 - DNA, 75 bp, Artificial Sequence
  Synthetic
tgggaacggtaaagatgacaaattgggctcagggaaatgcaacaaaacagccagctgtgtcatttcttttcgaga

SEQ ID NO: 306135 - DNA, 75 bp, Artificial Sequence
  Synthetic
tgggaacggtaaagatgacaaattgggctcagggaaatgcaacaaaacagccagctgtgtcatttctcttcgaga

SEQ ID NO: 306136 - DNA, 75 bp, Artificial Sequence
  Synthetic
tgggaacggtaaagatgacaaattgggctcagggaaatgcaacaaaacagccagctgtgtcatttctgttcgaga

SEQ ID NO: 306137 - DNA, 75 bp, Artificial Sequence
  Synthetic
ggctcagggaaatgcaacaaaacatccagctgtgtcatttcttttcgagactagaagaacattcactgagagtga

SEQ ID NO: 306138 - DNA, 75 bp, Artificial Sequence
  Synthetic
ggctcagggaaatgcaacaaaacatccagctgtgtcatttcttttcgagactagaagaacattcactgagtgtga

SEQ ID NO: 306139 - DNA, 75 bp, Artificial Sequence
  Synthetic
ggctcagggaaatgcaacaaaacatccagctgtgtcatttcttttcgagactagaagaacattcactgagcgtga

SEQ ID NO: 306140 - DNA, 75 bp, Artificial Sequence
  Synthetic
ggctcagggaaatgcaacaaaacatccagctgtgtcatttcttttcgagactagaagaacattcactgagggtga

SEQ ID NO: 306141 - DNA, 75 bp, Artificial Sequence
  Synthetic
ggctcagggaaatgcaacaaaacatccagctgtgtcatttcttttcgagactagaagatcattcactgagagtga

SEQ ID NO: 306142 - DNA, 75 bp, Artificial Sequence
  Synthetic
ggctcagggaaatgcaacaaaacatccagctgtgtcatttcttttcgagactagaagatcattcactgagtgtga

SEQ ID NO: 306143 - DNA, 75 bp, Artificial Sequence
  Synthetic
ggctcagggaaatgcaacaaaacatccagctgtgtcatttcttttcgagactagaagatcattcactgagcgtga

SEQ ID NO: 306144 - DNA, 75 bp, Artificial Sequence
  Synthetic
ggctcagggaaatgcaacaaaacatccagctgtgtcatttcttttcgagactagaagatcattcactgagggtga

SEQ ID NO: 306145 - DNA, 75 bp, Artificial Sequence
  Synthetic
ggctcagggaaatgcaacaaaacatccagctgtgtcatttcttttcgagactagaagaccattcactgagagtga

SEQ ID NO: 306146 - DNA, 75 bp, Artificial Sequence
  Synthetic
ggctcagggaaatgcaacaaaacatccagctgtgtcatttcttttcgagactagaagaccattcactgagtgtga

SEQ ID NO: 306147 - DNA, 75 bp, Artificial Sequence
  Synthetic
ggctcagggaaatgcaacaaaacatccagctgtgtcatttcttttcgagactagaagaccattcactgagcgtga

SEQ ID NO: 306148 - DNA, 75 bp, Artificial Sequence
  Synthetic
ggctcagggaaatgcaacaaaacatccagctgtgtcatttcttttcgagactagaagaccattcactgagggtga

SEQ ID NO: 306149 - DNA, 75 bp, Artificial Sequence
  Synthetic
ggctcagggaaatgcaacaaaacatccagctgtgtcatttcttttcgagactagaagagcattcactgagagtga

SEQ ID NO: 306150 - DNA, 75 bp, Artificial Sequence
  Synthetic
ggctcagggaaatgcaacaaaacatccagctgtgtcatttcttttcgagactagaagagcattcactgagtgtga

SEQ ID NO: 306151 - DNA, 75 bp, Artificial Sequence
  Synthetic
ggctcagggaaatgcaacaaaacatccagctgtgtcatttcttttcgagactagaagagcattcactgagcgtga

SEQ ID NO: 306152 - DNA, 75 bp, Artificial Sequence
  Synthetic
ggctcagggaaatgcaacaaaacatccagctgtgtcatttcttttcgagactagaagagcattcactgagggtga

SEQ ID NO: 306153 - DNA, 75 bp, Artificial Sequence
  Synthetic
ggctcagggaaatgcaacaatacatccagctgtgtcatttcttttcgagactagaagaacattcactgagagtga

SEQ ID NO: 306154 - DNA, 75 bp, Artificial Sequence
  Synthetic
ggctcagggaaatgcaacaatacatccagctgtgtcatttcttttcgagactagaagaacattcactgagtgtga

SEQ ID NO: 306155 - DNA, 75 bp, Artificial Sequence
  Synthetic
ggctcagggaaatgcaacaatacatccagctgtgtcatttcttttcgagactagaagaacattcactgagcgtga

SEQ ID NO: 306156 - DNA, 75 bp, Artificial Sequence
  Synthetic
ggctcagggaaatgcaacaatacatccagctgtgtcatttcttttcgagactagaagaacattcactgagggtga

SEQ ID NO: 306157 - DNA, 75 bp, Artificial Sequence
  Synthetic
ggctcagggaaatgcaacaatacatccagctgtgtcatttcttttcgagactagaagatcattcactgagagtga

SEQ ID NO: 306158 - DNA, 75 bp, Artificial Sequence
  Synthetic
ggctcagggaaatgcaacaatacatccagctgtgtcatttcttttcgagactagaagatcattcactgagtgtga

SEQ ID NO: 306159 - DNA, 75 bp, Artificial Sequence
  Synthetic
ggctcagggaaatgcaacaatacatccagctgtgtcatttcttttcgagactagaagatcattcactgagcgtga

SEQ ID NO: 306160 - DNA, 75 bp, Artificial Sequence
  Synthetic
ggctcagggaaatgcaacaatacatccagctgtgtcatttcttttcgagactagaagatcattcactgagggtga

SEQ ID NO: 306161 - DNA, 75 bp, Artificial Sequence
  Synthetic
ggctcagggaaatgcaacaatacatccagctgtgtcatttcttttcgagactagaagaccattcactgagagtga

SEQ ID NO: 306162 - DNA, 75 bp, Artificial Sequence
  Synthetic
ggctcagggaaatgcaacaatacatccagctgtgtcatttcttttcgagactagaagaccattcactgagtgtga

SEQ ID NO: 306163 - DNA, 75 bp, Artificial Sequence
  Synthetic
ggctcagggaaatgcaacaatacatccagctgtgtcatttcttttcgagactagaagaccattcactgagcgtga

SEQ ID NO: 306164 - DNA, 75 bp, Artificial Sequence
  Synthetic
ggctcagggaaatgcaacaatacatccagctgtgtcatttcttttcgagactagaagaccattcactgagggtga

SEQ ID NO: 306165 - DNA, 75 bp, Artificial Sequence
  Synthetic
ggctcagggaaatgcaacaatacatccagctgtgtcatttcttttcgagactagaagagcattcactgagagtga

SEQ ID NO: 306166 - DNA, 75 bp, Artificial Sequence
  Synthetic
ggctcagggaaatgcaacaatacatccagctgtgtcatttcttttcgagactagaagagcattcactgagtgtga

SEQ ID NO: 306167 - DNA, 75 bp, Artificial Sequence
  Synthetic
ggctcagggaaatgcaacaatacatccagctgtgtcatttcttttcgagactagaagagcattcactgagcgtga

SEQ ID NO: 306168 - DNA, 75 bp, Artificial Sequence
  Synthetic
ggctcagggaaatgcaacaatacatccagctgtgtcatttcttttcgagactagaagagcattcactgagggtga

SEQ ID NO: 306169 - DNA, 75 bp, Artificial Sequence
  Synthetic
ggctcagggaaatgcaacaacacatccagctgtgtcatttcttttcgagactagaagaacattcactgagagtga

SEQ ID NO: 306170 - DNA, 75 bp, Artificial Sequence
  Synthetic
ggctcagggaaatgcaacaacacatccagctgtgtcatttcttttcgagactagaagaacattcactgagtgtga

SEQ ID NO: 306171 - DNA, 75 bp, Artificial Sequence
  Synthetic
ggctcagggaaatgcaacaacacatccagctgtgtcatttcttttcgagactagaagaacattcactgagcgtga

SEQ ID NO: 306172 - DNA, 75 bp, Artificial Sequence
  Synthetic
ggctcagggaaatgcaacaacacatccagctgtgtcatttcttttcgagactagaagaacattcactgagggtga

SEQ ID NO: 306173 - DNA, 75 bp, Artificial Sequence
  Synthetic
ggctcagggaaatgcaacaacacatccagctgtgtcatttcttttcgagactagaagatcattcactgagagtga

SEQ ID NO: 306174 - DNA, 75 bp, Artificial Sequence
  Synthetic
ggctcagggaaatgcaacaacacatccagctgtgtcatttcttttcgagactagaagatcattcactgagtgtga

SEQ ID NO: 306175 - DNA, 75 bp, Artificial Sequence
  Synthetic
ggctcagggaaatgcaacaacacatccagctgtgtcatttcttttcgagactagaagatcattcactgagcgtga

SEQ ID NO: 306176 - DNA, 75 bp, Artificial Sequence
  Synthetic
ggctcagggaaatgcaacaacacatccagctgtgtcatttcttttcgagactagaagatcattcactgagggtga

SEQ ID NO: 306177 - DNA, 75 bp, Artificial Sequence
  Synthetic
ggctcagggaaatgcaacaacacatccagctgtgtcatttcttttcgagactagaagaccattcactgagagtga

SEQ ID NO: 306178 - DNA, 75 bp, Artificial Sequence
  Synthetic
ggctcagggaaatgcaacaacacatccagctgtgtcatttcttttcgagactagaagaccattcactgagtgtga

SEQ ID NO: 306179 - DNA, 75 bp, Artificial Sequence
  Synthetic
ggctcagggaaatgcaacaacacatccagctgtgtcatttcttttcgagactagaagaccattcactgagcgtga

SEQ ID NO: 306180 - DNA, 75 bp, Artificial Sequence
  Synthetic
ggctcagggaaatgcaacaacacatccagctgtgtcatttcttttcgagactagaagaccattcactgagggtga

SEQ ID NO: 306181 - DNA, 75 bp, Artificial Sequence
  Synthetic
ggctcagggaaatgcaacaacacatccagctgtgtcatttcttttcgagactagaagagcattcactgagagtga

SEQ ID NO: 306182 - DNA, 75 bp, Artificial Sequence
  Synthetic
ggctcagggaaatgcaacaacacatccagctgtgtcatttcttttcgagactagaagagcattcactgagtgtga

SEQ ID NO: 306183 - DNA, 75 bp, Artificial Sequence
  Synthetic
ggctcagggaaatgcaacaacacatccagctgtgtcatttcttttcgagactagaagagcattcactgagcgtga

SEQ ID NO: 306184 - DNA, 75 bp, Artificial Sequence
  Synthetic
ggctcagggaaatgcaacaacacatccagctgtgtcatttcttttcgagactagaagagcattcactgagggtga

SEQ ID NO: 306185 - DNA, 75 bp, Artificial Sequence
  Synthetic
ggctcagggaaatgcaacaagacatccagctgtgtcatttcttttcgagactagaagaacattcactgagagtga

SEQ ID NO: 306186 - DNA, 75 bp, Artificial Sequence
  Synthetic
ggctcagggaaatgcaacaagacatccagctgtgtcatttcttttcgagactagaagaacattcactgagtgtga

SEQ ID NO: 306187 - DNA, 75 bp, Artificial Sequence
  Synthetic
ggctcagggaaatgcaacaagacatccagctgtgtcatttcttttcgagactagaagaacattcactgagcgtga

SEQ ID NO: 306188 - DNA, 75 bp, Artificial Sequence
  Synthetic
ggctcagggaaatgcaacaagacatccagctgtgtcatttcttttcgagactagaagaacattcactgagggtga

SEQ ID NO: 306189 - DNA, 75 bp, Artificial Sequence
  Synthetic
ggctcagggaaatgcaacaagacatccagctgtgtcatttcttttcgagactagaagatcattcactgagagtga

SEQ ID NO: 306190 - DNA, 75 bp, Artificial Sequence
  Synthetic
ggctcagggaaatgcaacaagacatccagctgtgtcatttcttttcgagactagaagatcattcactgagtgtga

SEQ ID NO: 306191 - DNA, 75 bp, Artificial Sequence
  Synthetic
ggctcagggaaatgcaacaagacatccagctgtgtcatttcttttcgagactagaagatcattcactgagcgtga

SEQ ID NO: 306192 - DNA, 75 bp, Artificial Sequence
  Synthetic
ggctcagggaaatgcaacaagacatccagctgtgtcatttcttttcgagactagaagatcattcactgagggtga

SEQ ID NO: 306193 - DNA, 75 bp, Artificial Sequence
  Synthetic
ggctcagggaaatgcaacaagacatccagctgtgtcatttcttttcgagactagaagaccattcactgagagtga

SEQ ID NO: 306194 - DNA, 75 bp, Artificial Sequence
  Synthetic
ggctcagggaaatgcaacaagacatccagctgtgtcatttcttttcgagactagaagaccattcactgagtgtga

SEQ ID NO: 306195 - DNA, 75 bp, Artificial Sequence
  Synthetic
ggctcagggaaatgcaacaagacatccagctgtgtcatttcttttcgagactagaagaccattcactgagcgtga

SEQ ID NO: 306196 - DNA, 75 bp, Artificial Sequence
  Synthetic
ggctcagggaaatgcaacaagacatccagctgtgtcatttcttttcgagactagaagaccattcactgagggtga

SEQ ID NO: 306197 - DNA, 75 bp, Artificial Sequence
  Synthetic
ggctcagggaaatgcaacaagacatccagctgtgtcatttcttttcgagactagaagagcattcactgagagtga

SEQ ID NO: 306198 - DNA, 75 bp, Artificial Sequence
  Synthetic
ggctcagggaaatgcaacaagacatccagctgtgtcatttcttttcgagactagaagagcattcactgagtgtga

SEQ ID NO: 306199 - DNA, 75 bp, Artificial Sequence
  Synthetic
ggctcagggaaatgcaacaagacatccagctgtgtcatttcttttcgagactagaagagcattcactgagcgtga

SEQ ID NO: 306200 - DNA, 75 bp, Artificial Sequence
  Synthetic
ggctcagggaaatgcaacaagacatccagctgtgtcatttcttttcgagactagaagagcattcactgagggtga

SEQ ID NO: 306201 - DNA, 75 bp, Artificial Sequence
  Synthetic
cctaaagcgcagtacatgttagacactgtattcccagaatcgtcatttacaaataagccccctacagaatggaac

SEQ ID NO: 306202 - DNA, 75 bp, Artificial Sequence
  Synthetic
cctaatgcgcagtacatgttagacactgtattcccagaatcgtcatttacaaataagccccctacagaatggaac

SEQ ID NO: 306203 - DNA, 75 bp, Artificial Sequence
  Synthetic
cctaacgcgcagtacatgttagacactgtattcccagaatcgtcatttacaaataagccccctacagaatggaac

SEQ ID NO: 306204 - DNA, 75 bp, Artificial Sequence
  Synthetic
cctaaggcgcagtacatgttagacactgtattcccagaatcgtcatttacaaataagccccctacagaatggaac

SEQ ID NO: 306205 - DNA, 75 bp, Artificial Sequence
  Synthetic
atcaaaaagtgtggggacaaaagatagcgatgctagtatctgcgtttgctgctaaaatctgatccggcgtcagct

SEQ ID NO: 306206 - DNA, 75 bp, Artificial Sequence
  Synthetic
atcaaaaagtgtggggacaaaagatagcgatgctagtttctgcgtttgctgctaaaatctgatccggcgtcagct

SEQ ID NO: 306207 - DNA, 75 bp, Artificial Sequence
  Synthetic
atcaaaaagtgtggggacaaaagatagcgatgctagtctctgcgtttgctgctaaaatctgatccggcgtcagct

SEQ ID NO: 306208 - DNA, 75 bp, Artificial Sequence
  Synthetic
atcaaaaagtgtggggacaaaagatagcgatgctagtgtctgcgtttgctgctaaaatctgatccggcgtcagct

SEQ ID NO: 306209 - DNA, 75 bp, Artificial Sequence
  Synthetic
atcataaagtgtggggacaaaagatagcgatgctagtatctgcgtttgctgctaaaatctgatccggcgtcagct

SEQ ID NO: 306210 - DNA, 75 bp, Artificial Sequence
  Synthetic
atcataaagtgtggggacaaaagatagcgatgctagtttctgcgtttgctgctaaaatctgatccggcgtcagct

SEQ ID NO: 306211 - DNA, 75 bp, Artificial Sequence
  Synthetic
atcataaagtgtggggacaaaagatagcgatgctagtctctgcgtttgctgctaaaatctgatccggcgtcagct

SEQ ID NO: 306212 - DNA, 75 bp, Artificial Sequence
  Synthetic
atcataaagtgtggggacaaaagatagcgatgctagtgtctgcgtttgctgctaaaatctgatccggcgtcagct

SEQ ID NO: 306213 - DNA, 75 bp, Artificial Sequence
  Synthetic
atcacaaagtgtggggacaaaagatagcgatgctagtatctgcgtttgctgctaaaatctgatccggcgtcagct

SEQ ID NO: 306214 - DNA, 75 bp, Artificial Sequence
  Synthetic
atcacaaagtgtggggacaaaagatagcgatgctagtttctgcgtttgctgctaaaatctgatccggcgtcagct

SEQ ID NO: 306215 - DNA, 75 bp, Artificial Sequence
  Synthetic
atcacaaagtgtggggacaaaagatagcgatgctagtctctgcgtttgctgctaaaatctgatccggcgtcagct

SEQ ID NO: 306216 - DNA, 75 bp, Artificial Sequence
  Synthetic
atcacaaagtgtggggacaaaagatagcgatgctagtgtctgcgtttgctgctaaaatctgatccggcgtcagct

SEQ ID NO: 306217 - DNA, 75 bp, Artificial Sequence
  Synthetic
atcagaaagtgtggggacaaaagatagcgatgctagtatctgcgtttgctgctaaaatctgatccggcgtcagct

SEQ ID NO: 306218 - DNA, 75 bp, Artificial Sequence
  Synthetic
atcagaaagtgtggggacaaaagatagcgatgctagtttctgcgtttgctgctaaaatctgatccggcgtcagct

SEQ ID NO: 306219 - DNA, 75 bp, Artificial Sequence
  Synthetic
atcagaaagtgtggggacaaaagatagcgatgctagtctctgcgtttgctgctaaaatctgatccggcgtcagct

SEQ ID NO: 306220 - DNA, 75 bp, Artificial Sequence
  Synthetic
atcagaaagtgtggggacaaaagatagcgatgctagtgtctgcgtttgctgctaaaatctgatccggcgtcagct

SEQ ID NO: 306221 - DNA, 75 bp, Artificial Sequence
  Synthetic
tagcgatgctagtatctgcgtttgctgctaaaatctgatccggcgtcagctccaaaaaggagtgcttcgagaggt

SEQ ID NO: 306222 - DNA, 75 bp, Artificial Sequence
  Synthetic
tagcgatgctagtttctgcgtttgctgctaaaatctgatccggcgtcagctccaaaaaggagtgcttcgagaggt

SEQ ID NO: 306223 - DNA, 75 bp, Artificial Sequence
  Synthetic
tagcgatgctagtctctgcgtttgctgctaaaatctgatccggcgtcagctccaaaaaggagtgcttcgagaggt

SEQ ID NO: 306224 - DNA, 75 bp, Artificial Sequence
  Synthetic
tagcgatgctagtgtctgcgtttgctgctaaaatctgatccggcgtcagctccaaaaaggagtgcttcgagaggt

SEQ ID NO: 306225 - DNA, 75 bp, Artificial Sequence
  Synthetic
acgcttcaagcatggatctgattgaaacagttaatgcatgcatcaaattgcaaaaaagagtcttaagtttagcac

SEQ ID NO: 306226 - DNA, 75 bp, Artificial Sequence
  Synthetic
aacagttaatgcatgcatcaaattgcaaaaaagagtcttaagtttagcaccaaatacaaatttaaacacatccgg

SEQ ID NO: 306227 - DNA, 75 bp, Artificial Sequence
  Synthetic
caaaaaagagtcttaagtttagcaccaaatacaaatttaaacacatccggtcaaagtactctgaatgattacaac

SEQ ID NO: 306228 - DNA, 75 bp, Artificial Sequence
  Synthetic
agacgtacgctttactcgatcaaactgctgtcttgactccttttaccatcaatgccccaattatctcactttcag

SEQ ID NO: 306229 - DNA, 75 bp, Artificial Sequence
  Synthetic
tgctgtcttgactccttttaccatcaatgccccaattatctcactttcagtccgcatctctactgatgattatga

SEQ ID NO: 306230 - DNA, 75 bp, Artificial Sequence
  Synthetic
gttctggatgtagtagctgctgccattagatcagaaggatctagacctgtaagggcaatagaaagacgcgttctt

SEQ ID NO: 306231 - DNA, 75 bp, Artificial Sequence
  Synthetic
ttagatcagaaggatctagacctgtaagggcaatagaaagacgcgttcttgatccagctgtcagacagctggtag

SEQ ID NO: 306232 - DNA, 75 bp, Artificial Sequence
  Synthetic
ttctgatatttcaattgcgaatttggccgccgtggacaccgccgtaatccaaccagaaatcatccaaactgaaaa

SEQ ID NO: 306233 - DNA, 75 bp, Artificial Sequence
  Synthetic
gccgccgtggacaccgccgtaatccaaccagaaatcatccaaactgaaaatccattatacgctgatatcattgaa

SEQ ID NO: 306234 - DNA, 75 bp, Artificial Sequence
  Synthetic
acatgaccggcggaaatattagagctactttaggaagatggtcaggcaacaaaggagtagttacatgtatgtcag

SEQ ID NO: 306235 - DNA, 75 bp, Artificial Sequence
  Synthetic
tactttaggaagatggtcaggcaacaaaggagtagttacatgtatgtcaggaatggattctgaacataggttcac

SEQ ID NO: 306236 - DNA, 75 bp, Artificial Sequence
  Synthetic
ggaataatcaacatcgtgtacgtgccaaccgcagggactatattaatacctatgccaaatgcaagaaatagggag

SEQ ID NO: 306237 - DNA, 75 bp, Artificial Sequence
  Synthetic
caaccgcagggactatattaatacctatgccaaatgcaagaaatagggagggtaaactaatcgacgtgtcagcgg

SEQ ID NO: 306238 - DNA, 75 bp, Artificial Sequence
  Synthetic
tgatttcatggatgatgatgctataatccaaactgaaacaggagttggagtatattcatttccaatgtgcaaccg

SEQ ID NO: 306239 - DNA, 75 bp, Artificial Sequence
  Synthetic
atccaaactgaaacaggagttggagtatattcatttccaatgtgcaaccgctttagatttagaatttctccatgg

SEQ ID NO: 306240 - DNA, 75 bp, Artificial Sequence
  Synthetic
taggcacagtccatatgacaaactgggcacaggggacagccgctagacaaccagctatatcttttatgtttgaaa

SEQ ID NO: 306241 - DNA, 75 bp, Artificial Sequence
  Synthetic
ggcacaggggacagccgctagacaaccagctatatcttttatgtttgaaactcgtgatacatttacccagggcga

SEQ ID NO: 306242 - DNA, 75 bp, Artificial Sequence
  Synthetic
cctaaatcacaatacatgctggatacgatttttcctgaaacatcattcgtgaataaaccaaatgtagactggaat

SEQ ID NO: 306243 - DNA, 75 bp, Artificial Sequence
  Synthetic
tccaaaaagtgtggtgtcaaaaaatagcaattctggtgtccgcatacgctgctaaagtctgatccggcgtcagct

SEQ ID NO: 306244 - DNA, 75 bp, Artificial Sequence
  Synthetic
tagcaattctggtgtccgcatacgctgctaaagtctgatccggcgtcagcttccaaaggaagtgcttcgagaggt

SEQ ID NO: 306245 - DNA, 75 bp, Artificial Sequence
  Synthetic
ggtattaattagtccaaccagggttgcaagcatggatctgatcgaaacagtgaacgcatgcgtccaattgcagaa

SEQ ID NO: 306246 - DNA, 75 bp, Artificial Sequence
  Synthetic
gcaagcatggatctgatcgaaacagtgaacgcatgcgtccaattgcagaagcgtattcttttacttgctccaaat

SEQ ID NO: 306247 - DNA, 75 bp, Artificial Sequence
  Synthetic
tgaacgcatgcgtccaattgcagaagcgtattcttttacttgctccaaatacgaacctcaacattgagggtcaat

SEQ ID NO: 306248 - DNA, 75 bp, Artificial Sequence
  Synthetic
cgcttctcgtgttaacggaaaaacatatccacttcttgatcaaacggcaattctaacgccttataccattcatgc

SEQ ID NO: 306249 - DNA, 75 bp, Artificial Sequence
  Synthetic
tatccacttcttgatcaaacggcaattctaacgccttataccattcatgcccccattgttgcattggcagtgaga

SEQ ID NO: 306250 - DNA, 75 bp, Artificial Sequence
  Synthetic
tgcgaagtggaattgaatcaataattgattgtctagcggctgctattcgtacagaaggatcaagaccagttagag

SEQ ID NO: 306251 - DNA, 75 bp, Artificial Sequence
  Synthetic
tgattgtctagcggctgctattcgtacagaaggatcaagaccagttagagtaattgaacgaagagtcgtcgagcc

SEQ ID NO: 306252 - DNA, 75 bp, Artificial Sequence
  Synthetic
ttgaaattaaaaagcctcgtttctgaaatttccatcgcaaactttgcagccacagacacagcattaattcaacct

SEQ ID NO: 306253 - DNA, 75 bp, Artificial Sequence
  Synthetic
aaatttccatcgcaaactttgcagccacagacacagcattaattcaacctgaagtagttgaggcagaaaatccac

SEQ ID NO: 306254 - DNA, 75 bp, Artificial Sequence
  Synthetic
agtagttcgacagccagcaacactaaatggaggtaatgttagagcagctttggggaggtggtctggcaacaaagg

SEQ ID NO: 306255 - DNA, 75 bp, Artificial Sequence
  Synthetic
aatggaggtaatgttagagcagctttggggaggtggtctggcaacaaaggctcaattacatgtatttcaggaatg

SEQ ID NO: 306256 - DNA, 75 bp, Artificial Sequence
  Synthetic
aatttaaaactcgtacatgcggtgttcttaatataatttataccccagctccaggcgtaatgttaattcctatgc

SEQ ID NO: 306257 - DNA, 75 bp, Artificial Sequence
  Synthetic
tcttaatataatttataccccagctccaggcgtaatgttaattcctatgcctcaaggacgtaatagagagagcgt

SEQ ID NO: 306258 - DNA, 75 bp, Artificial Sequence
  Synthetic
acagctgacgactttataatcgaattttttgatggtaacaccattgtacataccgaaagaggcgtaggaattttc

SEQ ID NO: 306259 - DNA, 75 bp, Artificial Sequence
  Synthetic
tttttgatggtaacaccattgtacataccgaaagaggcgtaggaattttctcatttccaatgtgcgacaggatta

SEQ ID NO: 306260 - DNA, 75 bp, Artificial Sequence
  Synthetic
gcaaaagacgcaggataatctcgacacaccttcaatggctacttgggcaaatggaacagctcctcgacaaccagg

SEQ ID NO: 306261 - DNA, 75 bp, Artificial Sequence
  Synthetic
acaccttcaatggctacttgggcaaatggaacagctcctcgacaaccaggaatctctttcatgtttgaagttaga

SEQ ID NO: 306262 - DNA, 75 bp, Artificial Sequence
  Synthetic
aatttctttctcgttgcacaccaaaagttcagtatgtacttgatactaattttccagagacatcatttatcaaca

SEQ ID NO: 306263 - DNA, 75 bp, Artificial Sequence
  Synthetic
agttcagtatgtacttgatactaattttccagagacatcatttatcaacagacctcaagttgagtggaatataca

SEQ ID NO: 306264 - DNA, 75 bp, Artificial Sequence
  Synthetic
acagtatgggcccgcaagatagcaatgctcgtcgcctcgtttgctgccaagatctgattcgccctgaacccggga

SEQ ID NO: 306265 - DNA, 75 bp, Artificial Sequence
  Synthetic
tgctcgtcgcctcgtttgctgccaagatctgattcgccctgaacccgggagccgggttgcttcgagaggatgaaa

SEQ ID NO: 306266 - DNA, 75 bp, Artificial Sequence
  Synthetic
gattacattaacacattagtgcaaacgatgacgcctagacatcgggctgtatatcctgaaggttggatgttgaga

SEQ ID NO: 306267 - DNA, 75 bp, Artificial Sequence
  Synthetic
attataactctagtgatatacagttgtattaaatattctgatgctcaactgtttgcaaatgacatatattatgat

SEQ ID NO: 306268 - DNA, 75 bp, Artificial Sequence
  Synthetic
gtattaaatattctgatgctcaactgtttgcaaatgacatatattatgatggaaatattgagactgtagttaacg

SEQ ID NO: 306269 - DNA, 75 bp, Artificial Sequence
  Synthetic
ggccttggaagtccaggacagggtaaagcggacggtcttttgaacgatgataattatgcatcaatattggcaact

SEQ ID NO: 306270 - DNA, 75 bp, Artificial Sequence
  Synthetic
aagcggacggtcttttgaacgatgataattatgcatcaatattggcaactttgtttgaaacaaaagggttcccaa

SEQ ID NO: 306271 - DNA, 75 bp, Artificial Sequence
  Synthetic
tcaatagatatgacatgttcttataatatagttctgatacatgataatctggctgattctgagactattgaacag

SEQ ID NO: 306272 - DNA, 75 bp, Artificial Sequence
  Synthetic
caaataatacacaaagattcatttatcatggaagattgaagagaccaatctctaatgtactaatgaaagttgaag

SEQ ID NO: 306273 - DNA, 75 bp, Artificial Sequence
  Synthetic
atatagttctgatacatgataatctggctgattctgagactattgaacaggtagctgaatggatacttaatgtat

SEQ ID NO: 306274 - DNA, 75 bp, Artificial Sequence
  Synthetic
caaactacgtggttgttcaatccagtacaagtaatgaacggaacatttacaattgagttttataacaatggccag

SEQ ID NO: 306275 - DNA, 75 bp, Artificial Sequence
  Synthetic
aatgacaacatatgggctgcattcggtaatgattgtgatatatcggtttgtccattggatacatcagcgaacgga

SEQ ID NO: 306276 - DNA, 75 bp, Artificial Sequence
  Synthetic
ttagttgatatggttagaaatatgggaatagcaactgtcagaacttttgattcatataggattacaatagatatg

SEQ ID NO: 306277 - DNA, 75 bp, Artificial Sequence
  Synthetic
ttcatataggattacaatagatatgattagaccagctgctatgacccagtatgtacagcaattgttccctgttgg

SEQ ID NO: 306278 - DNA, 75 bp, Artificial Sequence
  Synthetic
attagaccagctgctatgacccagtatgtacagcaattgttccctgttggtggaccatactctcatcaagctgcc

SEQ ID NO: 306279 - DNA, 75 bp, Artificial Sequence
  Synthetic
tacagaagtagcactattaaatgtagttgataatgtaagacacagaattcagatgaatcaagctacatgtagaat

SEQ ID NO: 306280 - DNA, 75 bp, Artificial Sequence
  Synthetic
gttgataatgtaagacacagaattcagatgaatcaagctacatgtagaattaagaattgtatgaaaggtgaagaa

SEQ ID NO: 306281 - DNA, 75 bp, Artificial Sequence
  Synthetic
atagttgccaatacgagaagggattcagcgatgccagctggaacggttttccaaccaggatttccatgggaacag

SEQ ID NO: 306282 - DNA, 75 bp, Artificial Sequence
  Synthetic
atctttattcaatcaatggcgcctagacatagggctatatatccagaaggatggatgctgagatacgcgtaaaca

SEQ ID NO: 306283 - DNA, 75 bp, Artificial Sequence
  Synthetic
ttcgcccttgcatttaaaatctcattcacgatggacgtgctattctcaattgcaaagaccgtttcagacttaaaa

SEQ ID NO: 306284 - DNA, 75 bp, Artificial Sequence
  Synthetic
tagcaacctggtcttctttttaaatggtttgtacaacattgtacaccgtttgcgtaattctctgcatactactaa

SEQ ID NO: 306285 - DNA, 75 bp, Artificial Sequence
  Synthetic
tgcaaagaccgtttcagacttaaaaaagaaagttgtagttggtactatctatactaatgtagaagatataattca

SEQ ID NO: 306286 - DNA, 75 bp, Artificial Sequence
  Synthetic
aagaaagttgtagttggtactatctatactaatgtagaagatataattcaacaaactaatgaattgatcagaact

SEQ ID NO: 306287 - DNA, 75 bp, Artificial Sequence
  Synthetic
cttgttgcttttgtaatatcaagctgtattggactgtctaatgctcagttttttgctaatgacatgctttatgat

SEQ ID NO: 306288 - DNA, 75 bp, Artificial Sequence
  Synthetic
agaatggaattttcagttgccacaattaggtacaacacttttaaacttagatgataactatgttcaagctactag

SEQ ID NO: 306289 - DNA, 75 bp, Artificial Sequence
  Synthetic
ttaggtacaacacttttaaacttagatgataactatgttcaagctactagaagtgtaattgattatttagcctca

SEQ ID NO: 306290 - DNA, 75 bp, Artificial Sequence
  Synthetic
tggaatgcaacctcaatctccaacactcatagctctatcctcatcaaaatttaagactattaattttaataacag

SEQ ID NO: 306291 - DNA, 75 bp, Artificial Sequence
  Synthetic
ctcatagctctatcctcatcaaaatttaagactattaattttaataacagttcacagtcaatcaaaaattggagt

SEQ ID NO: 306292 - DNA, 75 bp, Artificial Sequence
  Synthetic
atatacattatttcttagaaagatgttccatttattaactgatgcattagctgttgttataattgtatccgtatg

SEQ ID NO: 306293 - DNA, 75 bp, Artificial Sequence
  Synthetic
gtttgaatatagaaattcatacatccttcaacgcgctaatccacagtttggaaatgtaatgggattaagatatta

SEQ ID NO: 306294 - DNA, 75 bp, Artificial Sequence
  Synthetic
cttcaacgcgctaatccacagtttggaaatgtaatgggattaagatattacactgctagtaacacttgccagatt

SEQ ID NO: 306295 - DNA, 75 bp, Artificial Sequence
  Synthetic
gtgaagattgtgatgttgcggtgtgtccactagatacaacaatgaatggtatcggatgtacaccagctagtacgg

SEQ ID NO: 306296 - DNA, 75 bp, Artificial Sequence
  Synthetic
ctttatttacaatggaagacttaaaagaccaatttctaatgtcttaatgaaagttgaagccggcgctccaaatat

SEQ ID NO: 306297 - DNA, 75 bp, Artificial Sequence
  Synthetic
atcggatgtacaccagctagtacggaaacatatgaagtactgtcaaatgacactcagctggcccttatagatgta

SEQ ID NO: 306298 - DNA, 75 bp, Artificial Sequence
  Synthetic
ttatgtatttactttccaaacgctgcaattggttcaccaggtccaggtaaggctgatggtttattgaatgacaat

SEQ ID NO: 306299 - DNA, 75 bp, Artificial Sequence
  Synthetic
agaccaatttctaatgtcttaatgaaagttgaagccggcgctccaaatattagtaatataacagttttacctgat

SEQ ID NO: 306300 - DNA, 75 bp, Artificial Sequence
  Synthetic
aaggaattgtgtgaaaggtgaagcaagacttaacacagcaattgtgaggatttcaaactcatctagttttgacaa

SEQ ID NO: 306301 - DNA, 75 bp, Artificial Sequence
  Synthetic
aacgtttactattgaattctataataacggccagttagttgacatgattagaaatatgggagtggttactgttag

SEQ ID NO: 306302 - DNA, 75 bp, Artificial Sequence
  Synthetic
tttcaaactcatctagttttgacaattcattgtcaccattgaacaatgggcagaagacaagatctttcaaaatca

SEQ ID NO: 306303 - DNA, 75 bp, Artificial Sequence
  Synthetic
aacggccagttagttgacatgattagaaatatgggagtggttactgttagaacatttgatacatatagaatcaca

SEQ ID NO: 306304 - DNA, 75 bp, Artificial Sequence
  Synthetic
tagccgaatgggtattaaatgtttggcaatgtgatgacatgaatttggatatttacacttatgagcagataaaca

SEQ ID NO: 306305 - DNA, 75 bp, Artificial Sequence
  Synthetic
tccacaaggtgggccttaccaacatcaagctgcatatatgctgacacttagtatactggatgctacaactgaatc

SEQ ID NO: 306306 - DNA, 75 bp, Artificial Sequence
  Synthetic
ctacactataattgattacattaatatattcatacaatccatgacacctaggcacagagccatttatcctgaagg

SEQ ID NO: 306307 - DNA, 75 bp, Artificial Sequence
  Synthetic
gctgtctgacaaactggtcttctttttaaatggtttgtacaactttgtacacagtttgcgctattctttgcattc

SEQ ID NO: 306308 - DNA, 75 bp, Artificial Sequence
  Synthetic
ccattagacacaacaatgaatgggataggttgttcaccagcaagtacagaaacatatgaggtagtatctaataat

SEQ ID NO: 306309 - DNA, 75 bp, Artificial Sequence
  Synthetic
aacatatgaggtagtatctaataatactcaattggcacttattgatgtagttgacgacgttaaacatagaattca

SEQ ID NO: 306310 - DNA, 75 bp, Artificial Sequence
  Synthetic
gaaaatgttccacctattaactgatgcattagttattgttttaattgtatctacatgtgctgggtatgctaatgg

SEQ ID NO: 306311 - DNA, 75 bp, Artificial Sequence
  Synthetic
tgggaacaaacgttatccaactacactgttgctcaagaagataacttagaaagacttttgttgattgcgtctgtg

SEQ ID NO: 306312 - DNA, 75 bp, Artificial Sequence
  Synthetic
tgaatcattatgtatttattttccaaatgctgcaattggttcaccaggtccaggtaaggcagatggtttattgaa

SEQ ID NO: 306313 - DNA, 75 bp, Artificial Sequence
  Synthetic
ttgcgtaggggcaaatgcgcatgatgtggatgatccccaggaggatgaaatgtgaactatgtggctaagggcgaa

SEQ ID NO: 306314 - DNA, 75 bp, Artificial Sequence
  Synthetic
aggatcaatggcgtcctcactttatcagcaactaatctcacaaaattattattcaactggtaatgaaattttgtt

SEQ ID NO: 306315 - DNA, 75 bp, Artificial Sequence
  Synthetic
cagcaactaatctcacaaaattattattcaactggtaatgaaattttgttggataaacagactaacaggaaaact

SEQ ID NO: 306316 - DNA, 75 bp, Artificial Sequence
  Synthetic
ggagtggggagcagggtcaacatttgaatctacatttagatcatcaaatataactggcccacacaccaacacagt

SEQ ID NO: 306317 - DNA, 75 bp, Artificial Sequence
  Synthetic
gaacaaatagctgaatgggtattgaacgcttggcaatgcgatgacatgaatttggatatatatacttatgaacag

SEQ ID NO: 306318 - DNA, 75 bp, Artificial Sequence
  Synthetic
tctgatatttggttattgtatcaaaaaccattggatataactacaccaatcagattattaaaacatggaccagaa

SEQ ID NO: 306319 - DNA, 75 bp, Artificial Sequence
  Synthetic
cgtctgtccattagatacaacaatgaatgggattggttgttcaccagctagtacagaaacgtatgaggtagtgtc

SEQ ID NO: 306320 - DNA, 75 bp, Artificial Sequence
  Synthetic
tactgtaacatcaatatattattcaacaatatctaatcctaataatactgttacgttaacatcagattcattagt

SEQ ID NO: 306321 - DNA, 75 bp, Artificial Sequence
  Synthetic
acaatatctaatcctaataatactgttacgttaacatcagattcattagttctgttttggaatgagggtcaaacg

SEQ ID NO: 306322 - DNA, 75 bp, Artificial Sequence
  Synthetic
gaattcaaatgtcatcaactttaaaccagttacaatgtagattgaaaaactgtattaagggtgaaccacgattaa

SEQ ID NO: 306323 - DNA, 75 bp, Artificial Sequence
  Synthetic
aattaaaccatcaagaggtacgcgtgtggatatttgtatgtctgatatggaaaatacagatagcaccagttttaa

SEQ ID NO: 306324 - DNA, 75 bp, Artificial Sequence
  Synthetic
cgcgaacattcaaaattaatgctaaaaaatggtggaagatcttttacaccataattgattatattaatacattgg

SEQ ID NO: 306325 - DNA, 75 bp, Artificial Sequence
  Synthetic
tcaacatgtatgttgaatattatttagcaagtaatgatccataccatgaacttaaagagttacaaagaccaacaa

SEQ ID NO: 306326 - DNA, 75 bp, Artificial Sequence
  Synthetic
ttaaatggtttgtacaacattgtacactatttgcgcagttctctgcatcttgttaatgtatacattgtttctcag

SEQ ID NO: 306327 - DNA, 75 bp, Artificial Sequence
  Synthetic
aatgtagatgaagtagtaagtaaagattcattatggcaagaaatgagatatgtaagggatataactttagaatgt

SEQ ID NO: 306328 - DNA, 75 bp, Artificial Sequence
  Synthetic
attcattatggcaagaaatgagatatgtaagggatataactttagaatgtaagatagagtcagaagtaatcaaag

SEQ ID NO: 306329 - DNA, 75 bp, Artificial Sequence
  Synthetic
caacatgtactgggtgggctaacggtcagttatttactaatgatgtctcatatgatggaaatattgaaggcgtaa

SEQ ID NO: 306330 - DNA, 75 bp, Artificial Sequence
  Synthetic
tcagttatttactaatgatgtctcatatgatggaaatattgaaggcgtaataaatgtaacaaacccatttaatgt

SEQ ID NO: 306331 - DNA, 75 bp, Artificial Sequence
  Synthetic
catacatactcatatgatagagcaggtgaaagtgtcactgctcacgtaacagtgagcttcaataatatgaaggaa

SEQ ID NO: 306332 - DNA, 75 bp, Artificial Sequence
  Synthetic
ttgtcaactgatagaaaaatggatgaagtttcgcacgttggaatttaattcgctttcgattcaagaatgatgatg

SEQ ID NO: 306333 - DNA, 75 bp, Artificial Sequence
  Synthetic
caggtaaagacgatggtaagttaaatgataacaattacgcacaaacattagcaacattatttgaaacgaaaggat

SEQ ID NO: 306334 - DNA, 75 bp, Artificial Sequence
  Synthetic
cggattttaaaataaatagatttgacgtgatggatattgacacatatatgtatattgactattgggatgattcag

SEQ ID NO: 306335 - DNA, 75 bp, Artificial Sequence
  Synthetic
tgataacaattacgcacaaacattagcaacattatttgaaacgaaaggatttccaaaaggttcagtgatactcaa

SEQ ID NO: 306336 - DNA, 75 bp, Artificial Sequence
  Synthetic
ggatttttttattataaagaaatgtcttattcctttcgtattcctgttggagtacatcctagaataaattcatct

SEQ ID NO: 306337 - DNA, 75 bp, Artificial Sequence
  Synthetic
catacaatttagttattattcctgatgaaccaaacaattctgaagcaattgaacaaatagctgagtggatattaa

SEQ ID NO: 306338 - DNA, 75 bp, Artificial Sequence
  Synthetic
ggaatagagttcacatatgagaaatgcatgttatctcaacagttcactgatcaacttgcattgaattccatgaga

SEQ ID NO: 306339 - DNA, 75 bp, Artificial Sequence
  Synthetic
catttggtgaagattgcgacatatctgtttgtccattagatacgacaatgaatggaatcggctgttcaccagcta

SEQ ID NO: 306340 - DNA, 75 bp, Artificial Sequence
  Synthetic
gacatacgtcaagaactgttggaacgctatcatttatatctttgataccaagcaatccaaattaccaaacaccta

SEQ ID NO: 306341 - DNA, 75 bp, Artificial Sequence
  Synthetic
gacgtggttgacaatgttaaatatagaatacaaatgtcttcaagtgtgaatcaactccaatgtaaactaaaaaat

SEQ ID NO: 306342 - DNA, 75 bp, Artificial Sequence
  Synthetic
gaatacaaatgtcttcaagtgtgaatcaactccaatgtaaactaaaaaattgtatcaaaggcgagccacgactaa

SEQ ID NO: 306343 - DNA, 75 bp, Artificial Sequence
  Synthetic
atgtccaagcgatcacgctccttagattctgctgccttttattaccgagtctagaattaacctaagttagaactg

SEQ ID NO: 306344 - DNA, 75 bp, Artificial Sequence
  Synthetic
ctagttcagtagctttaggtgatattatgtctttagctatgtcgccattaactttttctaacttgcttgaatctg

SEQ ID NO: 306345 - DNA, 75 bp, Artificial Sequence
  Synthetic
tcacctttaaataatggacagatggcacgatcatttaaaattaacgcaaaaaaatggtggaaaattttctatacg

SEQ ID NO: 306346 - DNA, 75 bp, Artificial Sequence
  Synthetic
atagttgattatattaatacatttatacaaacaatgacgcccagacacagggccatatatcctgaaggttggatg

SEQ ID NO: 306347 - DNA, 75 bp, Artificial Sequence
  Synthetic
cccaatagatcatacagaatgattgaaaataatacgatatatgaagcaactcccagcagagtattttcatatgat

SEQ ID NO: 306348 - DNA, 75 bp, Artificial Sequence
  Synthetic
ggcttcaaaatcaccggtaatatctgcaattgtagattttgcaactctaaaagcgatgagagagacatatggaac

SEQ ID NO: 306349 - DNA, 75 bp, Artificial Sequence
  Synthetic
gtggcttcagactctccaacaatactatcatttataaataacaataatccattgataagaaatagaatagaagag

SEQ ID NO: 306350 - DNA, 75 bp, Artificial Sequence
  Synthetic
tatcatttataaataacaataatccattgataagaaatagaatagaagagttattaagacaatgtagaatataaa

SEQ ID NO: 306351 - DNA, 75 bp, Artificial Sequence
  Synthetic
atggtttgtacgacattgtacactgtttgcgttatactctgcatcctttttatatacacgttgttatttaggaaa

SEQ ID NO: 306352 - DNA, 75 bp, Artificial Sequence
  Synthetic
tatatacacgttgttatttaggaaaatgttccacctaataactgatgcattaattataacttttataatatctaa

SEQ ID NO: 306353 - DNA, 75 bp, Artificial Sequence
  Synthetic
atgttccacctaataactgatgcattaattataacttttataatatctaactgtactggatggacacatggtcaa

SEQ ID NO: 306354 - DNA, 75 bp, Artificial Sequence
  Synthetic
atgtaagaatatagtgattacgtctaaatcagccattgataaaatgagaaaaagtaataatttggaacataacac

SEQ ID NO: 306355 - DNA, 75 bp, Artificial Sequence
  Synthetic
tttacagaccaagtcgcgcttaactcaatgaggttcatctttagagtaacggcagcaaatggatggtttataaca

SEQ ID NO: 306356 - DNA, 75 bp, Artificial Sequence
  Synthetic
tgcaactgatccattcagcgtagaatctttgtgcatatattttccaaatgcagttgtaggatcacagggacctgg

SEQ ID NO: 306357 - DNA, 75 bp, Artificial Sequence
  Synthetic
tctttgtgcatatattttccaaatgcagttgtaggatcacagggacctggacaaacgaatggttatctaaatgat

SEQ ID NO: 306358 - DNA, 75 bp, Artificial Sequence
  Synthetic
caatgaggttcatctttagagtaacggcagcaaatggatggtttataacatcaggcgacataaatactagacgta

SEQ ID NO: 306359 - DNA, 75 bp, Artificial Sequence
  Synthetic
taacagtttacatgatgataatgttaaatggagaatgagtgaatctattcgtcgagaaaagaaacatgaaatgaa

SEQ ID NO: 306360 - DNA, 75 bp, Artificial Sequence
  Synthetic
gttggtacaatttcatttatatcgttaattccaagcaacccgaactaccaaacaccaattgcttcatctagcaca

SEQ ID NO: 306361 - DNA, 75 bp, Artificial Sequence
  Synthetic
caagggttcagtgatactcaaaacatatactaaaacttcagacttcattaattcagtggaaatgacttgttcata

SEQ ID NO: 306362 - DNA, 75 bp, Artificial Sequence
  Synthetic
taattccaagcaacccgaactaccaaacaccaattgcttcatctagcacagtcagaatggatctagaacgtaaaa

SEQ ID NO: 306363 - DNA, 75 bp, Artificial Sequence
  Synthetic
agtgacatattatctttagcaacttcaccattaacttttgctaacctgcttgagtcggttcctgctatcacttcg

SEQ ID NO: 306364 - DNA, 75 bp, Artificial Sequence
  Synthetic
ttggagatgtgatgatatggatttaaacatatatacttacgaacaaacaggaatagataatctatgggctgcatt

SEQ ID NO: 306365 - DNA, 75 bp, Artificial Sequence
  Synthetic
caccattaacttttgctaacctgcttgagtcggttcctgctatcacttcgtcaattaaagatgttgctgccaatg

SEQ ID NO: 306366 - DNA, 75 bp, Artificial Sequence
  Synthetic
ggattggatgttcgcctgcgagtacagagacatatgaagtgttgtcaaatgatacacaattagcattaattaatg

SEQ ID NO: 306367 - DNA, 75 bp, Artificial Sequence
  Synthetic
aattacaaacagttcattataggagatttattggaagatgtaacaagtatatcaagaaataatggcgttatgaat

SEQ ID NO: 306368 - DNA, 75 bp, Artificial Sequence
  Synthetic
agagacatatgaagtgttgtcaaatgatacacaattagcattaattaatgttgtggataatgtgaaacatagaat

SEQ ID NO: 306369 - DNA, 75 bp, Artificial Sequence
  Synthetic
atttattggaagatgtaacaagtatatcaagaaataatggcgttatgaattttgatgatcttacttcagcaatga

SEQ ID NO: 306370 - DNA, 75 bp, Artificial Sequence
  Synthetic
caagactaaacaccgcgatagtgagaatttcaacatcatcaagttttgacaattcactgtctccattgaacaatg

SEQ ID NO: 306371 - DNA, 75 bp, Artificial Sequence
  Synthetic
gaaattgtagcgcgatcagcagatgattttatacctaacagatcttatagaatgatagaaaataatattgttcat

SEQ ID NO: 306372 - DNA, 75 bp, Artificial Sequence
  Synthetic
attttatacctaacagatcttatagaatgatagaaaataatattgttcatgaaattacgccaaataggacgtttt

SEQ ID NO: 306373 - DNA, 75 bp, Artificial Sequence
  Synthetic
aaatgctaagaaatggtggacaatattttacacaataattgactatattaacacaattgtacagacaatgacgcc

SEQ ID NO: 306374 - DNA, 75 bp, Artificial Sequence
  Synthetic
atgcagttagcatcaaaatctccagtgatatcggcgatagttgactttgcaacattaaaatctatgagagacacg

SEQ ID NO: 306375 - DNA, 75 bp, Artificial Sequence
  Synthetic
acacaattgtacagacaatgacgcctagacatagggccatttatccagaaggttggatgctgagatacgcgtaaa

SEQ ID NO: 306376 - DNA, 75 bp, Artificial Sequence
  Synthetic
cacaatattatcgttcgttgatagcaataatccactaataacaaataggattaaagatctattgaaacaatgtag

SEQ ID NO: 306377 - DNA, 75 bp, Artificial Sequence
  Synthetic
aataatccactaataacaaataggattaaagatctattgaaacaatgtagaatataaatagtgaggagaccagct

SEQ ID NO: 306378 - DNA, 75 bp, Artificial Sequence
  Synthetic
tatagatttcttttacttattgttattgtatcaccatttgttaaaacacaaaattatggaattaatttaccaatt

SEQ ID NO: 306379 - DNA, 75 bp, Artificial Sequence
  Synthetic
gtccaagatgataagcagaaatagacgtagaaacactcaacagaaagatgctgaaaaggaaaagcagacagaaaa

SEQ ID NO: 306380 - DNA, 75 bp, Artificial Sequence
  Synthetic
tcaattcgtcacagcaagagacattcttaacttcaacgctatgcttatattatcctaccgaagcatcaactcaaa

SEQ ID NO: 306381 - DNA, 75 bp, Artificial Sequence
  Synthetic
actcattgtggcaagaagtccaatacgtacgtgatataactttgcaatgtaaaatattatctgaaattgtaaaag

SEQ ID NO: 306382 - DNA, 75 bp, Artificial Sequence
  Synthetic
catacatattcatatactagagcaggagaaaatgttaatgctcatgtgactataagtttcaataatgtaaaagaa

SEQ ID NO: 306383 - DNA, 75 bp, Artificial Sequence
  Synthetic
gggtggccaactggatcagtctactttaaagaatataccgatatcgcttcattctcaattgatccacaactttat

SEQ ID NO: 306384 - DNA, 75 bp, Artificial Sequence
  Synthetic
acaatagttgctgagaataaagtggaaattgaagaagtggttaaaaagtatattccatcatactcaactgacaag

SEQ ID NO: 306385 - DNA, 75 bp, Artificial Sequence
  Synthetic
tattccatcatactcaactgacaagctaatagttaaaaattatcgaaattcaagaatcaagtgtcaaacatacaa

SEQ ID NO: 306386 - DNA, 75 bp, Artificial Sequence
  Synthetic
catgtctgaattggctgatttgattctaaacgaatggctatgtaatccgatggatataacattatactattatca

SEQ ID NO: 306387 - DNA, 75 bp, Artificial Sequence
  Synthetic
gactttaggaataggttgtactactacaaacaaagcaacatttgaagaagtggccacaaatgagaaattagtaat

SEQ ID NO: 306388 - DNA, 75 bp, Artificial Sequence
  Synthetic
aactgatgttgttgatggtgtgaaccataaacttgatgtaactacaaatacttgtacaatcagaaattgtaagaa

SEQ ID NO: 306389 - DNA, 75 bp, Artificial Sequence
  Synthetic
attaggaccaagagaaaatgtagcgattgtacaagttggtggttcagaagtgttagatattacagcggatccaac

SEQ ID NO: 306390 - DNA, 75 bp, Artificial Sequence
  Synthetic
attgtacaagttggtggttcagaagtgttagatattacagcggatccaactactgcgccacaaactgaacgtatg

SEQ ID NO: 306391 - DNA, 75 bp, Artificial Sequence
  Synthetic
ttatattaatcagattgtacaagttatgtccaaaagatcacgatcattaaattcagcagctttttattatagagt

SEQ ID NO: 306392 - DNA, 75 bp, Artificial Sequence
  Synthetic
atgtccaaaagatcacgatcattaaattcagcagctttttattatagagtctgatatatcttacgttagaattgt

SEQ ID NO: 306393 - DNA, 75 bp, Artificial Sequence
  Synthetic
gtttgtacgacattgtacactgtctgcgcagttctctgcattctttttatttatatgttattattcagaaaaatg

SEQ ID NO: 306394 - DNA, 75 bp, Artificial Sequence
  Synthetic
aacacatgctgattacgtttcagctagaagatttgtacctgatttaactgagttagttgatgctgaaaaacagat

SEQ ID NO: 306395 - DNA, 75 bp, Artificial Sequence
  Synthetic
agaagatttgtacctgatttaactgagttagttgatgctgaaaaacagatgaaagaaatgttacagtgcaagttg

SEQ ID NO: 306396 - DNA, 75 bp, Artificial Sequence
  Synthetic
tattggatggtcacagggtcaaatgttcgttgatgatatatattataatggaaacgttgaaacaatagtgaatgc

SEQ ID NO: 306397 - DNA, 75 bp, Artificial Sequence
  Synthetic
gaaacgttgaaacaatagtgaatgcaactgatccttttgatgtcagatctctatgtatatactttccaaatgcag

SEQ ID NO: 306398 - DNA, 75 bp, Artificial Sequence
  Synthetic
ttgtaggctctcaaggtcctggtaaaacagatggaaaactgaatgatggtaattacgctcaaactatcgcagcat

SEQ ID NO: 306399 - DNA, 75 bp, Artificial Sequence
  Synthetic
aattacgctcaaactatcgcagcattatttgaaacaaaaggctttccaagaggatcaatagtgcttaaaacatat

SEQ ID NO: 306400 - DNA, 75 bp, Artificial Sequence
  Synthetic
tatttgaaacaaaaggctttccaagaggatcaatagtgcttaaaacatatacaaaggtctctgattttatagatt

SEQ ID NO: 306401 - DNA, 75 bp, Artificial Sequence
  Synthetic
agtgattcggaagctatagagcgaatagcagaatggatattgaatgtttggagatgtgatgatatgaacttagat

SEQ ID NO: 306402 - DNA, 75 bp, Artificial Sequence
  Synthetic
ccattagacacaacaatgaatggaattggttgttcaccagctagtacagaaacatatgaagtgttatcaaatgac

SEQ ID NO: 306403 - DNA, 75 bp, Artificial Sequence
  Synthetic
actgtttgcgttatactctgcattcttttcatttacatgttattatttagaaaaatgttccacttaataactgat

SEQ ID NO: 306404 - DNA, 75 bp, Artificial Sequence
  Synthetic
aatgaacactgctaaatgtaaattaaagaattgtattaaaggtgaagctagactgaacactgcacttattagaat

SEQ ID NO: 306405 - DNA, 75 bp, Artificial Sequence
  Synthetic
tcaaatgttcattgatgatatacattacgaaggaaatattgaaacgatcattaatgcaactgatccattcagtgt

SEQ ID NO: 306406 - DNA, 75 bp, Artificial Sequence
  Synthetic
tacgaaggaaatattgaaacgatcattaatgcaactgatccattcagtgtagaatcgttatgcatctattttcca

SEQ ID NO: 306407 - DNA, 75 bp, Artificial Sequence
  Synthetic
aaactacacgaacattcaaaataaatgcaaaaaaatggtggacaatattctacactatagttgattatattaata

SEQ ID NO: 306408 - DNA, 75 bp, Artificial Sequence
  Synthetic
tgcaaaaaaatggtggacaatattctacactatagttgattatattaatacaattatacaaactatgactccgag

SEQ ID NO: 306409 - DNA, 75 bp, Artificial Sequence
  Synthetic
tgatggtaattacgctcagacaattgctgctctatttgaaacaaaaggatttcctaaaggttcagtaatactaaa

SEQ ID NO: 306410 - DNA, 75 bp, Artificial Sequence
  Synthetic
tacactatagttgattatattaatacaattatacaaactatgactccgagacatcgggccgtttatccagaaggt

SEQ ID NO: 306411 - DNA, 75 bp, Artificial Sequence
  Synthetic
gctgctctatttgaaacaaaaggatttcctaaaggttcagtaatactaaagacatatactaagacttcagatttc

SEQ ID NO: 306412 - DNA, 75 bp, Artificial Sequence
  Synthetic
gatgtacttttttctatagcgaaaactgtgtcagatcttaaaaagaaagttgtagttggaacaatttatactaat

SEQ ID NO: 306413 - DNA, 75 bp, Artificial Sequence
  Synthetic
gtagaagatgttgtacaacagacgaatgaattgattagaactttgaatggaaatatttttcatactggtggcatt

SEQ ID NO: 306414 - DNA, 75 bp, Artificial Sequence
  Synthetic
tgatccaaataaattagaaacaatcgaacaaactgtagaatggattttaaacgtttggagatgtgatgacatgga

SEQ ID NO: 306415 - DNA, 75 bp, Artificial Sequence
  Synthetic
gaacaaactgtagaatggattttaaacgtttggagatgtgatgacatggatttgaatatttatacttatgaacaa

SEQ ID NO: 306416 - DNA, 75 bp, Artificial Sequence
  Synthetic
aactttattaaatttagatgataattatgttcaatcaactagaggcataattgattttttatcatcttttataga

SEQ ID NO: 306417 - DNA, 75 bp, Artificial Sequence
  Synthetic
tgtttgtccattggatactacaatgaacggaattggatgttcgccagcaagtacggaaacgtatgaagtagtatc

SEQ ID NO: 306418 - DNA, 75 bp, Artificial Sequence
  Synthetic
aacggaattggatgttcgccagcaagtacggaaacgtatgaagtagtatctaataatacagaattagcattaatt

SEQ ID NO: 306419 - DNA, 75 bp, Artificial Sequence
  Synthetic
agctgtatgtgatgatgaaattgttagagaagcttcaagaaatggtatgcaacctcaatcaccagctcttatatt

SEQ ID NO: 306420 - DNA, 75 bp, Artificial Sequence
  Synthetic
attaattttaataatagttctcaatctatcaaaaattggaatgctcaatcaagacgtgagaatcctgtatatgag

SEQ ID NO: 306421 - DNA, 75 bp, Artificial Sequence
  Synthetic
taagttgaaaaattgcgtcaaaggtgaagagcgactaaatacggcagttataagagtttcaacgtcatcaagttt

SEQ ID NO: 306422 - DNA, 75 bp, Artificial Sequence
  Synthetic
ataatggcagactaaaaagacccatatcaaatgttttaatgaaaatagaagctggtgctccaaatataagcaacc

SEQ ID NO: 306423 - DNA, 75 bp, Artificial Sequence
  Synthetic
tgtttctgatcttaaagagaaggttgtagttggtataatttatacaaatgtggaagatattgtgcaacagacaaa

SEQ ID NO: 306424 - DNA, 75 bp, Artificial Sequence
  Synthetic
ccaatcaatgccgtgtcttatgatggtgcgagaattatgcaggaaacatgaactgattaattatatcatcttgtg

SEQ ID NO: 306425 - DNA, 75 bp, Artificial Sequence
  Synthetic
actaattgatatggttcgaaatatgggaatagttactgtaagaacttttgattcttatagaataacaattgacat

SEQ ID NO: 306426 - DNA, 75 bp, Artificial Sequence
  Synthetic
ggaatagttactgtaagaacttttgattcttatagaataacaattgacatgattagaccagctgctatgactcaa

SEQ ID NO: 306427 - DNA, 75 bp, Artificial Sequence
  Synthetic
tttatgattttgaaaatgtaacttatcaaaataattacttcgccacagataaatttaaaaaagacatagagcaat

SEQ ID NO: 306428 - DNA, 75 bp, Artificial Sequence
  Synthetic
gattagaccagctgctatgactcaatacgttcaacgaatttttccacaaggtggaccttatcattttcaggctac

SEQ ID NO: 306429 - DNA, 75 bp, Artificial Sequence
  Synthetic
tgattatttatcttcttttattgaatcagtctgtgatgatgaaattgttcgagaagcatcaagaaatggaatgca

SEQ ID NO: 306430 - DNA, 75 bp, Artificial Sequence
  Synthetic
tcagtctgtgatgatgaaattgttcgagaagcatcaagaaatggaatgcaacctcaatctccgacactcatagca

SEQ ID NO: 306431 - DNA, 75 bp, Artificial Sequence
  Synthetic
gaaaaggaaaaaatactgttagatagagtgcctgctgaagaaagatgtttaatttcaaaattagtattcgcatat

SEQ ID NO: 306432 - DNA, 75 bp, Artificial Sequence
  Synthetic
gagtgcctgctgaagaaagatgtttaatttcaaaattagtattcgcatatggaaaacatggaaatgtagaaaata

SEQ ID NO: 306433 - DNA, 75 bp, Artificial Sequence
  Synthetic
tacgttcaacgaatttttccacaaggtggaccttatcattttcaggctacatatatgttaacattaagtatatta

SEQ ID NO: 306434 - DNA, 75 bp, Artificial Sequence
  Synthetic
tattaaaaattggagtgctcaatcaagacgtgaaactccagtttatgagtatagaaatccgatggtgtttgaata

SEQ ID NO: 306435 - DNA, 75 bp, Artificial Sequence
  Synthetic
gcaacaccgcagtttggaaatgttatgggactgagatattatacagccagcaatatatgtcagatcgcagcattc

SEQ ID NO: 306436 - DNA, 75 bp, Artificial Sequence
  Synthetic
ccatgtagcatgaatcacgactgggtttagtccatgcttgcataggggcaaatatgcatgatatggatgatcccc

SEQ ID NO: 306437 - DNA, 75 bp, Artificial Sequence
  Synthetic
tctaatgttctaatgaaaatagaggcaggtgctccaaacataaacaatccgaccattttgcctgatcctacaaat

SEQ ID NO: 306438 - DNA, 75 bp, Artificial Sequence
  Synthetic
cattgagttttataataatggtcagttggttgatatggttagaaacatgggaatagtaactgttagaacatttga

SEQ ID NO: 306439 - DNA, 75 bp, Artificial Sequence
  Synthetic
cacatatagaataataattgacatgattagaccggcggccatgactcaatacatacaacagattttcccaagagg

SEQ ID NO: 306440 - DNA, 75 bp, Artificial Sequence
  Synthetic
attattgcaaacgttagaagagattcagcaatgccagctggaactgtttttcagccaggatttccatgggagcaa

SEQ ID NO: 306441 - DNA, 75 bp, Artificial Sequence
  Synthetic
ggcaatttgttgctacaagtgacccacaaggatggatctcatcgaaacgattaatgcagttgttgaactgcaaga

SEQ ID NO: 306442 - DNA, 75 bp, Artificial Sequence
  Synthetic
aagtagaatgaaaatttgcatgtcaggaatggaaaattttaataatgattcatttaattgggagaattggaatca

SEQ ID NO: 306443 - DNA, 75 bp, Artificial Sequence
  Synthetic
ttaatgcagttgttgaactgcaagaaagagttcgaaatctatcaccaaacacaaatatctatcaggatggacaaa

SEQ ID NO: 306444 - DNA, 75 bp, Artificial Sequence
  Synthetic
aagagttcgaaatctatcaccaaacacaaatatctatcaggatggacaaacaactattaatgattataatgctat

SEQ ID NO: 306445 - DNA, 75 bp, Artificial Sequence
  Synthetic
aactttcaccttttcaggtgcatatgccaattattccactagcaactgttttatctacagatgaccacgagtcta

SEQ ID NO: 306446 - DNA, 75 bp, Artificial Sequence
  Synthetic
gccaattattccactagcaactgttttatctacagatgaccacgagtctatggtcgcagggattgagtctctgtt

SEQ ID NO: 306447 - DNA, 75 bp, Artificial Sequence
  Synthetic
ctcttgttacaaagtcagttgaaccagaagtactaaggttagtactagacattgggattaagtcgcaggtatcaa

SEQ ID NO: 306448 - DNA, 75 bp, Artificial Sequence
  Synthetic
agaagtactaaggttagtactagacattgggattaagtcgcaggtatcaaagaatccattggcaaatatgcttca

SEQ ID NO: 306449 - DNA, 75 bp, Artificial Sequence
  Synthetic
ttgcaaatttgagagttaatttacttgcaccaggtggagcaacaaacaacactggcggaggataccacgcacttg

SEQ ID NO: 306450 - DNA, 75 bp, Artificial Sequence
  Synthetic
tgcaccaggtggagcaacaaacaacactggcggaggataccacgcacttgtaggaagagccactggaaagatggc

SEQ ID NO: 306451 - DNA, 75 bp, Artificial Sequence
  Synthetic
ggatttcagtattcttattcgtcagagatgtcatattattttcagatacctgtaggatcatatcctggattacat

SEQ ID NO: 306452 - DNA, 75 bp, Artificial Sequence
  Synthetic
acatgaaagtaccatgctcaggagtaatgacagccatatacttgcctgcaccgggtgaattacaattatctctag

SEQ ID NO: 306453 - DNA, 75 bp, Artificial Sequence
  Synthetic
aatgacagccatatacttgcctgcaccgggtgaattacaattatctctagggaatcagcctccaaataatatacc

SEQ ID NO: 306454 - DNA, 75 bp, Artificial Sequence
  Synthetic
tccgatttcaatttacattgggtgggagaattgttgctacagtagatcgtactggaactttcaatttcccgctat

SEQ ID NO: 306455 - DNA, 75 bp, Artificial Sequence
  Synthetic
gagaattgttgctacagtagatcgtactggaactttcaatttcccgctatgtgatagagttaatgtaatgattga

SEQ ID NO: 306456 - DNA, 75 bp, Artificial Sequence
  Synthetic
tggaactatttcatttatttctttaataccaagtaatccgaactaccaaactccaatagcttcatctagtactgt

SEQ ID NO: 306457 - DNA, 75 bp, Artificial Sequence
  Synthetic
ggcctgctggcactgcacagagacaaccaactgtttcacttatgattactataccatccgccgtctctcttactg

SEQ ID NO: 306458 - DNA, 75 bp, Artificial Sequence
  Synthetic
accaactgtttcacttatgattactataccatccgccgtctctcttactgattatgataccaattcaccatacct

SEQ ID NO: 306459 - DNA, 75 bp, Artificial Sequence
  Synthetic
ttaatacaccaccaaacgttctttggactatgaattcactattatcaaaagcaccaccacaattagtccattggt

SEQ ID NO: 306460 - DNA, 75 bp, Artificial Sequence
  Synthetic
agcctattcatgcaagatctaagatgagatctggtcacgcactgggatccagtgttccgtagtagtatttcaaat

SEQ ID NO: 306461 - DNA, 75 bp, Artificial Sequence
  Synthetic
ggcattttgttcatcaaagtcacgatggagcacgcgacagatatgcctgtaattaatgaagtcgaatttaacgat

SEQ ID NO: 306462 - DNA, 75 bp, Artificial Sequence
  Synthetic
aattaatgaagtcgaatttaacgattcgattattgattcgcagatcgtagaggaacttggagaattactcacaga

SEQ ID NO: 306463 - DNA, 75 bp, Artificial Sequence
  Synthetic
tcgattattgattcgcagatcgtagaggaacttggagaattactcacagacccagccaaagtttttaacttactt

SEQ ID NO: 306464 - DNA, 75 bp, Artificial Sequence
  Synthetic
aatagtatcacgctcagctgacaattttatttcaaatagatcttatagaatgatagaaaataatactgttcatga

SEQ ID NO: 306465 - DNA, 75 bp, Artificial Sequence
  Synthetic
cgcaattcatttcgtaatgcttgtcgtttcattctgtggaattagagcacaatcaacgaaaatcctatattgtgt

SEQ ID NO: 306466 - DNA, 75 bp, Artificial Sequence
  Synthetic
gtttcattctgtggaattagagcacaatcaacgaaaatcctatattgtgtaaaaatgcttttttggaaagttaag

SEQ ID NO: 306467 - DNA, 75 bp, Artificial Sequence
  Synthetic
tattgatgaaataattaaaagtaaaataagtgaatattctaaatcaattgaaacgatgatagctcactataacaa

SEQ ID NO: 306468 - DNA, 75 bp, Artificial Sequence
  Synthetic
ataagtgaatattctaaatcaattgaaacgatgatagctcactataacaataaatgtgcacgaaatgaagatgct

SEQ ID NO: 306469 - DNA, 75 bp, Artificial Sequence
  Synthetic
taatccactcatacggaatagaattactaatctaataaatcaatgtaaattgtaaacagtgatgagatctcaata

SEQ ID NO: 306470 - DNA, 75 bp, Artificial Sequence
  Synthetic
ggcatttaaaaaagaagaagctgtctgacaaactggtcttctttttaaatggtttgtacaacattgtacactgtt

SEQ ID NO: 306471 - DNA, 75 bp, Artificial Sequence
  Synthetic
taacataaaaattgctgaaatggaaagacgttatgatgaattacgttggaggtgtgaaacattagctaaccataa

SEQ ID NO: 306472 - DNA, 75 bp, Artificial Sequence
  Synthetic
agacgttatgatgaattacgttggaggtgtgaaacattagctaaccataacatgaataacataatgttatcacag

SEQ ID NO: 306473 - DNA, 75 bp, Artificial Sequence
  Synthetic
tttatatattattgtttagaaaaatgttccacctaataactgatgctttaatagtgatgcttattttatctaatt

SEQ ID NO: 306474 - DNA, 75 bp, Artificial Sequence
  Synthetic
aattgtacagtactcccgtgactgatgtgtcgcttgcactaccatggatggaaacatagcttggtagtgttcacc

SEQ ID NO: 306475 - DNA, 75 bp, Artificial Sequence
  Synthetic
ggcactttaaacgccatgtcactaaaaagctttctgattgctctggagaacccaggtgaagggtctcaagagaaa

SEQ ID NO: 306476 - DNA, 75 bp, Artificial Sequence
  Synthetic
cccaggtgaagggtctcaagagaaattagatcgcgagacactacatagtctatccactcgagagaagagaaaaga

SEQ ID NO: 306477 - DNA, 75 bp, Artificial Sequence
  Synthetic
ttagatcgcgagacactacatagtctatccactcgagagaagagaaaagaagatgcaataccatcttcaacatat

SEQ ID NO: 306478 - DNA, 75 bp, Artificial Sequence
  Synthetic
taattatgcacagactatcgccactttatttgaaacaaaaggattcccaaaaggttcaataatacttaaaacata

SEQ ID NO: 306479 - DNA, 75 bp, Artificial Sequence
  Synthetic
gactatcttaagctgtggcgtatgctatggaatgttaaaacgatgaattcaccatattcgaagaattcaatgttt

SEQ ID NO: 306480 - DNA, 75 bp, Artificial Sequence
  Synthetic
agaatacagaacgagattttcagaatatccatttgacctagtagaaggttcaacacataatgacacattaacgat

SEQ ID NO: 306481 - DNA, 75 bp, Artificial Sequence
  Synthetic
tatccatttgacctagtagaaggttcaacacataatgacacattaacgatggaactagcaagaattgaatttagt

SEQ ID NO: 306482 - DNA, 75 bp, Artificial Sequence
  Synthetic
atatagttatcattcctgatagcccaaatgattcagaatctattgaacagatagcagaatggattttaaatgttt

SEQ ID NO: 306483 - DNA, 75 bp, Artificial Sequence
  Synthetic
tgcgaagactgtttcagatctcaaaaagaaagttgtagttggtacgatttactctaatgtggaagatattataca

SEQ ID NO: 306484 - DNA, 75 bp, Artificial Sequence
  Synthetic
tatggaatgttaaaacgatgaattcaccatattcgaagaattcaatgtttgatgagtaagagaagtggattgcat

SEQ ID NO: 306485 - DNA, 75 bp, Artificial Sequence
  Synthetic
acagtatcagaatggtttacgtctaaatgtttcagtactaccaaatgataagaataatcaaaacgttattggaag

SEQ ID NO: 306486 - DNA, 75 bp, Artificial Sequence
  Synthetic
aatgtttcagtactaccaaatgataagaataatcaaaacgttattggaagatatgagtccgatgatctgagattc

SEQ ID NO: 306487 - DNA, 75 bp, Artificial Sequence
  Synthetic
gtggaattggaacacagcctcaaaaagaatggaattttcaacttcctcaattgggtacaactctattgaatttag

SEQ ID NO: 306488 - DNA, 75 bp, Artificial Sequence
  Synthetic
tccattagatactacaagtaatggaatcggatgttcaccagctagtacagaaacttatgaagttgtatcaaatga

SEQ ID NO: 306489 - DNA, 75 bp, Artificial Sequence
  Synthetic
agaatggaattttcaacttcctcaattgggtacaactctattgaatttagatgataattatgttcaagcaactag

SEQ ID NO: 306490 - DNA, 75 bp, Artificial Sequence
  Synthetic
aaacttatgaagttgtatcaaatgacacccaattggcattaattaatgttgtggataatgttagacatagaatac

SEQ ID NO: 306491 - DNA, 75 bp, Artificial Sequence
  Synthetic
atctaataatgttttcaactattccgcaggtacaaattctaatccacccattggatttgaaactatcgttgcaat

SEQ ID NO: 306492 - DNA, 75 bp, Artificial Sequence
  Synthetic
gcaggtacaaattctaatccacccattggatttgaaactatcgttgcaattttcagaacgaatacacctgcaaca

SEQ ID NO: 306493 - DNA, 75 bp, Artificial Sequence
  Synthetic
aaatagttagagaggcctcaagaaatggaatgcaacctcagtctccagctcttataacacttgcatcatcaagat

SEQ ID NO: 306494 - DNA, 75 bp, Artificial Sequence
  Synthetic
tggaatgcaacctcagtctccagctcttataacacttgcatcatcaagatttaagaccattaattttaataatag

SEQ ID NO: 306495 - DNA, 75 bp, Artificial Sequence
  Synthetic
aacagctaccattgaatccagcttaacccaccgcacttcagcgctacaggcagaagatatttcaccgacaactgt

SEQ ID NO: 306496 - DNA, 75 bp, Artificial Sequence
  Synthetic
ttcattgtcaccattaaataacggccaaacaacaagatcatttaaaataaatgcaaagaaatggtggactatatt

SEQ ID NO: 306497 - DNA, 75 bp, Artificial Sequence
  Synthetic
tttatgaatacaagaaccctatggtctttgaatatagaaattcatacattcttcaacgggctgatccacagtatg

SEQ ID NO: 306498 - DNA, 75 bp, Artificial Sequence
  Synthetic
acccaccgcacttcagcgctacaggcagaagatatttcaccgacaactgtcactaacagattagcgcgttatttc

SEQ ID NO: 306499 - DNA, 75 bp, Artificial Sequence
  Synthetic
ctttgaatatagaaattcatacattcttcaacgggctgatccacagtatggcaatgttatgggattaaggtatta

SEQ ID NO: 306500 - DNA, 75 bp, Artificial Sequence
  Synthetic
aatcgtgatatctgaatcaaaagacggattttggaaagtcaaaacagagaatttttcgattcaattgaaagtagc

SEQ ID NO: 306501 - DNA, 75 bp, Artificial Sequence
  Synthetic
gacaaactggtcttctttttaaatggtttgtacaactttgtacacagtttgcgcaattctttgcatcttattaat

SEQ ID NO: 306502 - DNA, 75 bp, Artificial Sequence
  Synthetic
gcgcaattctttgcatcttattaatatatacattattttttaggaaaatgttccatctattaactgatgcattag

SEQ ID NO: 306503 - DNA, 75 bp, Artificial Sequence
  Synthetic
aaaatgcacaaaataatacacaacgtttcatttataatggaaggctaaaaagaccaatttcaaatgttttaatga

SEQ ID NO: 306504 - DNA, 75 bp, Artificial Sequence
  Synthetic
ggattttggaaagtcaaaacagagaatttttcgattcaattgaaagtagcttttgaaggatatggagtcatgggt

SEQ ID NO: 306505 - DNA, 75 bp, Artificial Sequence
  Synthetic
tttcatttataatggaaggctaaaaagaccaatttcaaatgttttaatgaaagttgaagctggcgctccaaacgt

SEQ ID NO: 306506 - DNA, 75 bp, Artificial Sequence
  Synthetic
aaactatgaatatgaacgagatggaaaaactgtgtatgcaacgacagtcactacaccaaaaccaacaaggaaatg

SEQ ID NO: 306507 - DNA, 75 bp, Artificial Sequence
  Synthetic
ttcactaatgatatttcgtatgacggaaatattgaaggtgtgataaatgcgacaaatccttttaatgttgagtca

SEQ ID NO: 306508 - DNA, 75 bp, Artificial Sequence
  Synthetic
acaatccagtgcagacaatgaatggagcttttactattgaattttacaataacggtcaactagttgatatggtca

SEQ ID NO: 306509 - DNA, 75 bp, Artificial Sequence
  Synthetic
gaaatattgaaggtgtgataaatgcgacaaatccttttaatgttgagtcattatgtatttattttccaaatgctg

SEQ ID NO: 306510 - DNA, 75 bp, Artificial Sequence
  Synthetic
aaaactgtgtatgcaacgacagtcactacaccaaaaccaacaaggaaatgtggtcagcataaaccatattttggg

SEQ ID NO: 306511 - DNA, 75 bp, Artificial Sequence
  Synthetic
aaacgtatactatactgagagagactggacattagcaaatgcaatatatgcgaaaaacttcgcaacagacttcaa

SEQ ID NO: 306512 - DNA, 75 bp, Artificial Sequence
  Synthetic
cttgacatgataagaccagcagccatgacacaatatgttcaaagactctttccacaaggtgggccatatccttac

SEQ ID NO: 306513 - DNA, 75 bp, Artificial Sequence
  Synthetic
aattatgcacagacactggcgacattatttgaaacaaaaggatttccgaaaggatctgtgatcttcaaaacatat

SEQ ID NO: 306514 - DNA, 75 bp, Artificial Sequence
  Synthetic
tggacattagcaaatgcaatatatgcgaaaaacttcgcaacagacttcaaccaaacatttacggttaccgctgaa

SEQ ID NO: 306515 - DNA, 75 bp, Artificial Sequence
  Synthetic
tgacacaatatgttcaaagactctttccacaaggtgggccatatccttaccaggctgcatatatgttgactttaa

SEQ ID NO: 306516 - DNA, 75 bp, Artificial Sequence
  Synthetic
ttccccaggtattgcaacaataggactcaaaagtggtggatttggccagattgatacttcgaattacacaggtat

SEQ ID NO: 306517 - DNA, 75 bp, Artificial Sequence
  Synthetic
aaaaattcagaagcaattgaacaaatagccgaatgggtattaaatgtttggcaatgtgatgacatgaatttggat

SEQ ID NO: 306518 - DNA, 75 bp, Artificial Sequence
  Synthetic
tagccgaatgggtattaaatgtttggcaatgtgatgacatgaatttggatatttatacctatgaacagataaata

SEQ ID NO: 306519 - DNA, 75 bp, Artificial Sequence
  Synthetic
ctcaaaagtggtggatttggccagattgatacttcgaattacacaggtatggctctttcttttaggtttatttgt

SEQ ID NO: 306520 - DNA, 75 bp, Artificial Sequence
  Synthetic
atttatacctatgaacagataaataaagataatctgtgggtagcattcggtgaagattgtgacgtatctgtttgt

SEQ ID NO: 306521 - DNA, 75 bp, Artificial Sequence
  Synthetic
aacgtttgcatctgctggatttttgtcttactactgtcagaatggaacatgtcctgttgaagctgacgcaatctc

SEQ ID NO: 306522 - DNA, 75 bp, Artificial Sequence
  Synthetic
tcttactactgtcagaatggaacatgtcctgttgaagctgacgcaatctcaggttttggttcatgctatgcccgt

SEQ ID NO: 306523 - DNA, 75 bp, Artificial Sequence
  Synthetic
aagcaactaatctcacagaattattattcaactggaactgatattttactagatcaacaaacaaataaaacaact

SEQ ID NO: 306524 - DNA, 75 bp, Artificial Sequence
  Synthetic
aatgtcatcaactttaaatcaattgcagtgtaaattaaaaaattgtgttaagggcgagccacgattgaacactgc

SEQ ID NO: 306525 - DNA, 75 bp, Artificial Sequence
  Synthetic
tgacccagaatttgttactggtggtacggattatgcgcagactgtaacagctaaagttgaggaatcaatcattgc

SEQ ID NO: 306526 - DNA, 75 bp, Artificial Sequence
  Synthetic
gtcatggggagctggaacgacttttaaatctgcatttactgcagaggaaattacaggaccaaatacaagtgatat

SEQ ID NO: 306527 - DNA, 75 bp, Artificial Sequence
  Synthetic
acggattatgcgcagactgtaacagctaaagttgaggaatcaatcattgcattgcgcaatgaagtcaataatata

SEQ ID NO: 306528 - DNA, 75 bp, Artificial Sequence
  Synthetic
aaatctgcatttactgcagaggaaattacaggaccaaatacaagtgatatagatttaaataatttaacaaatgcg

SEQ ID NO: 306529 - DNA, 75 bp, Artificial Sequence
  Synthetic
atctatggccatgtcatttccacagataatcgaaggagttatcagcgctacaagatcagttatgaaagctttcca

SEQ ID NO: 306530 - DNA, 75 bp, Artificial Sequence
  Synthetic
tggaagattttttatactataattgattacattaatacattggtacaaacaatgacgcctagacatcgggctata

SEQ ID NO: 306531 - DNA, 75 bp, Artificial Sequence
  Synthetic
actaggtcctaataattatgatagtatatatgcagcattcgaattgtggtatggcaaggcaaacactgtaattaa

SEQ ID NO: 306532 - DNA, 75 bp, Artificial Sequence
  Synthetic
gttcaagattaatgcaaaaaaatggtggaagattttttatactataattgattacattaatacattggtacaaac

SEQ ID NO: 306533 - DNA, 75 bp, Artificial Sequence
  Synthetic
ataatcgaaggagttatcagcgctacaagatcagttatgaaagctttccagaaagtaaagggtagggtgaacgga

SEQ ID NO: 306534 - DNA, 75 bp, Artificial Sequence
  Synthetic
atatatgcagcattcgaattgtggtatggcaaggcaaacactgtaattaaatcaatatattatgcatcagcgcaa

SEQ ID NO: 306535 - DNA, 75 bp, Artificial Sequence
  Synthetic
atcaattatttccgagacgccaacattcgccgattcagtaagagtcaactcaagacatccatcgcttgcaaatat

SEQ ID NO: 306536 - DNA, 75 bp, Artificial Sequence
  Synthetic
aagagaaagtagaagatgttaataaaaatgaaatgaaagaatcaaataatgacgaaaaacaagtcattacagagg

SEQ ID NO: 306537 - DNA, 75 bp, Artificial Sequence
  Synthetic
taatgttggttatactagtttaactaagcaaatagttagatttaattggaatatgggaggcatattagttagacc

SEQ ID NO: 306538 - DNA, 75 bp, Artificial Sequence
  Synthetic
ttcgccgattcagtaagagtcaactcaagacatccatcgcttgcaaatatgctttcagatgatcaaacatttacc

SEQ ID NO: 306539 - DNA, 75 bp, Artificial Sequence
  Synthetic
aagcaaatagttagatttaattggaatatgggaggcatattagttagaccaacagcagataatagagtagatgta

SEQ ID NO: 306540 - DNA, 75 bp, Artificial Sequence
  Synthetic
attacattaatacattggtacaaacaatgacgcctagacatcgggctatatatcctgaaggttggatgctaagat

SEQ ID NO: 306541 - DNA, 75 bp, Artificial Sequence
  Synthetic
atatattcaaccaaccatcacaactagaatcattaattcaactcctccagcaattgttccagctgatgctattat

SEQ ID NO: 306542 - DNA, 75 bp, Artificial Sequence
  Synthetic
ctggaaatgtagttttccacgtagtaatatcaatatgtacactgaatattatttagcaaatgttgacccgtataa

SEQ ID NO: 306543 - DNA, 75 bp, Artificial Sequence
  Synthetic
attgaatacgattgtggctgataataaagttgagattgatgaggtggttaaaaagtacattccatcatacaccac

SEQ ID NO: 306544 - DNA, 75 bp, Artificial Sequence
  Synthetic
agaatcattaattcaactcctccagcaattgttccagctgatgctattatttactcagacattaagaaaatatct

SEQ ID NO: 306545 - DNA, 75 bp, Artificial Sequence
  Synthetic
aatatcaatatgtacactgaatattatttagcaaatgttgacccgtataatcaattaaaatcattagatcaggtt

SEQ ID NO: 306546 - DNA, 75 bp, Artificial Sequence
  Synthetic
aattagaaatacaatatcaatattagacaataccaaacatcttgcagaatatgctgtggatccagatgtaatcga

SEQ ID NO: 306547 - DNA, 75 bp, Artificial Sequence
  Synthetic
accaattaatattgatgaagttgtaagtaaagattcattgtggcaagaaatgagatacgctagagatataacaca

SEQ ID NO: 306548 - DNA, 75 bp, Artificial Sequence
  Synthetic
gacaataccaaacatcttgcagaatatgctgtggatccagatgtaatcgacttcgttctttccaaaatggcaggt

SEQ ID NO: 306549 - DNA, 75 bp, Artificial Sequence
  Synthetic
tatgatgtgaatggagaaagaaaactatcaactaggtggtattggaagttgttgaaagatgatttaccagctggt

SEQ ID NO: 306550 - DNA, 75 bp, Artificial Sequence
  Synthetic
agtaaagattcattgtggcaagaaatgagatacgctagagatataacacaaaaatgtaagatagaatcagagatt

SEQ ID NO: 306551 - DNA, 75 bp, Artificial Sequence
  Synthetic
ctcagtaaattcagactcttttgttaagtattcatatcatgatttagtagaaaaacttctaaatgacagacagct

SEQ ID NO: 306552 - DNA, 75 bp, Artificial Sequence
  Synthetic
tgttaattatgtttataaatataccagatcaggtgaggaggtaaatgcacacgtcacaataagctttaataatat

SEQ ID NO: 306553 - DNA, 75 bp, Artificial Sequence
  Synthetic
agatcaggtgaggaggtaaatgcacacgtcacaataagctttaataatatgaaagagaggtcatatggtgggtca

SEQ ID NO: 306554 - DNA, 75 bp, Artificial Sequence
  Synthetic
actcagctgaagctggaaagatagttgatgaaaaatcgaaagaaattttggttgaaatctatcaagatcagatga

SEQ ID NO: 306555 - DNA, 75 bp, Artificial Sequence
  Synthetic
gttgaaaagcaactagatttagctaaagagttcacagaactacttaaaaatgcattcacatagactatagtggca

SEQ ID NO: 306556 - DNA, 75 bp, Artificial Sequence
  Synthetic
atatatgtatatcgattactgggatgactcagatatatttaaaaatatggtatatgtacgtgatctgagagccaa

SEQ ID NO: 306557 - DNA, 75 bp, Artificial Sequence
  Synthetic
gactcagatatatttaaaaatatggtatatgtacgtgatctgagagccaatatgggtgattttttctattactca

SEQ ID NO: 306558 - DNA, 75 bp, Artificial Sequence
  Synthetic
cagagggacatatcagaagatatatggcggatttgcgacataaaatatcaggtgaagcaaacaccgcaaaatacc

SEQ ID NO: 306559 - DNA, 75 bp, Artificial Sequence
  Synthetic
ggtgaagcaaacaccgcaaaatacccagcaattttacatccagttgatgaagaattaaataaatattttcttgaa

SEQ ID NO: 306560 - DNA, 75 bp, Artificial Sequence
  Synthetic
agaattaaataaatattttcttgaacatcaattgattcaacctttaaccacaagaaacattacggaattaattcc

SEQ ID NO: 306561 - DNA, 75 bp, Artificial Sequence
  Synthetic
catcaattgattcaacctttaaccacaagaaacattacggaattaattccaacccaattatatcacgatccaaat

SEQ ID NO: 306562 - DNA, 75 bp, Artificial Sequence
  Synthetic
ttcatctggagtacagttcacatacgaaaaatgtttactgtctcaacaatttactgacatggttgcattgaattc

SEQ ID NO: 306563 - DNA, 75 bp, Artificial Sequence
  Synthetic
gaaaaatgtttactgtctcaacaatttactgacatggttgcattgaattcgatgagatttatatttaaggtaaca

SEQ ID NO: 306564 - DNA, 75 bp, Artificial Sequence
  Synthetic
cagcaattttacatccagttgatgaagaattaaataaatattttcttgaacatcaattgattcaacctttaacca

SEQ ID NO: 306565 - DNA, 75 bp, Artificial Sequence
  Synthetic
tgcatctggaaccggatttgcatactctaatggttatatttctgaaactgttggaaatatttcatttatatcatt

SEQ ID NO: 306566 - DNA, 75 bp, Artificial Sequence
  Synthetic
tctaatggttatatttctgaaactgttggaaatatttcatttatatcattgattccaagtaatccaaattatcaa

SEQ ID NO: 306567 - DNA, 75 bp, Artificial Sequence
  Synthetic
cctgatttgactgagctagtggatgctgaaaaacaaataaaagaaatggctgctcatttgcagcttgaagcaatt

SEQ ID NO: 306568 - DNA, 75 bp, Artificial Sequence
  Synthetic
ctgaaaaacaaataaaagaaatggctgctcatttgcagcttgaagcaattacggtgcaggttgagtcacaattct

SEQ ID NO: 306569 - DNA, 75 bp, Artificial Sequence
  Synthetic
tgtctggcataaatgccgcatcagctaatgaagcatttaaatttataataggcacggttttatcagcacgatcaa

SEQ ID NO: 306570 - DNA, 75 bp, Artificial Sequence
  Synthetic
aaatgacttgcgaaatgattttaatagtttagctaattcggttgcattaggagatataatgtcattagctatgtc

SEQ ID NO: 306571 - DNA, 75 bp, Artificial Sequence
  Synthetic
agtttagctaattcggttgcattaggagatataatgtcattagctatgtcgcctttaacattcgccaatttactt

SEQ ID NO: 306572 - DNA, 75 bp, Artificial Sequence
  Synthetic
ctatatgtctttagcttcatgcatgtacttgataacaataatgcctgccgaaattttcttaagagaatcgttagt

SEQ ID NO: 306573 - DNA, 75 bp, Artificial Sequence
  Synthetic
tatgaagaaattcaggaatacaaaaatgtttaaaagagcaactaaaacaaagtataaagaatatatcattggaga

SEQ ID NO: 306574 - DNA, 75 bp, Artificial Sequence
  Synthetic
atgtttaaaagagcaactaaaacaaagtataaagaatatatcattggagatttgttagaagatgtaacaaacgtg

SEQ ID NO: 306575 - DNA, 75 bp, Artificial Sequence
  Synthetic
tagcacaaatgcattatcaagctggtgaagtacgcacaccatttgaactagcagaaatacaagttgcaaataggc

SEQ ID NO: 306576 - DNA, 75 bp, Artificial Sequence
  Synthetic
tgaagtacgcacaccatttgaactagcagaaatacaagttgcaaataggccaattagacaatggcttcatcactg

SEQ ID NO: 306577 - DNA, 75 bp, Artificial Sequence
  Synthetic
ggtttcgaccacaaataaattgcaattgacagatattgacacattctcagagatcgttgttaggtctgcagatga

SEQ ID NO: 306578 - DNA, 75 bp, Artificial Sequence
  Synthetic
caattagacaatggcttcatcactgtaacactctacagtttggaagacaagtgactgaaggagtcatccatctaa

SEQ ID NO: 306579 - DNA, 75 bp, Artificial Sequence
  Synthetic
ttgacagatattgacacattctcagagatcgttgttaggtctgcagatgatttcatacctaatagatcgtatagg

SEQ ID NO: 306580 - DNA, 75 bp, Artificial Sequence
  Synthetic
ccaaccaggatttccatgggaacagacgttgtccaactacacggttgctcaagaggataatttggaaagattgtt

SEQ ID NO: 306581 - DNA, 75 bp, Artificial Sequence
  Synthetic
ttacgacttaaaaacattacaacaaacggattttgatatggatagattcatgcaattagcctcggaatcaccagt

SEQ ID NO: 306582 - DNA, 75 bp, Artificial Sequence
  Synthetic
tatatcagccataattgattttgctacattaaaagcaatgagagacacgtatggggttagtacagatataatgta

SEQ ID NO: 306583 - DNA, 75 bp, Artificial Sequence
  Synthetic
tattcaagcaacatcaataacttcattgctgatgcttatatctaatagaacagtaattccagatccatcatcatt

SEQ ID NO: 306584 - DNA, 75 bp, Artificial Sequence
  Synthetic
aactagtgcgatggactttataatctacagatttcttttacttattgttattgtatcaccatttgttaaaacaca

SEQ ID NO: 306585 - DNA, 75 bp, Artificial Sequence
  Synthetic
ggtttgtacaacattgtacactgtttgcgcaattctctgcatcctattaatatatacattgcttcttagaaaaat

SEQ ID NO: 306586 - DNA, 75 bp, Artificial Sequence
  Synthetic
cttaacttcaacgttatgcttatattatcctacagaagcatcaactcaaattggagacaccgaatggaagaatac

SEQ ID NO: 306587 - DNA, 75 bp, Artificial Sequence
  Synthetic
atgctggatgggctaacggtcaattatttaccgacgatatttcgtatgatggaaatgttgaaggtgttgtaaatg

SEQ ID NO: 306588 - DNA, 75 bp, Artificial Sequence
  Synthetic
tatcctacagaagcatcaactcaaattggagacaccgaatggaagaatactctgtctcaattattcttgactaag

SEQ ID NO: 306589 - DNA, 75 bp, Artificial Sequence
  Synthetic
tgactagatttgtttcaaagttatatatatttgatgctccaaaaattccgcctgatcaaatgtatagactaagaa

SEQ ID NO: 306590 - DNA, 75 bp, Artificial Sequence
  Synthetic
cgacaaacccttttaatatcgaatcattatgtatttattttccaaacgctgcaataggttcaccaggtccaggca

SEQ ID NO: 306591 - DNA, 75 bp, Artificial Sequence
  Synthetic
ttatttgaaacgaaaggatttccaaaaggatcagtgatctttaaaacatatactagaacttcagacttcataaat

SEQ ID NO: 306592 - DNA, 75 bp, Artificial Sequence; identical to SEQ ID NO: 301831
  Synthetic

SEQ ID NO: 306593 - DNA, 75 bp, Artificial Sequence
  Synthetic
atttagttattatacctgatgaaccaaataattctgaagcaattgaacaaatagctgaatggatattacatgttt

SEQ ID NO: 306594 - DNA, 75 bp, Artificial Sequence
  Synthetic
agagataacttatgggcggcatttggtgaagattgtgatatatctgtatgcccattagatacaacaatgaatgga

SEQ ID NO: 306595 - DNA, 75 bp, Artificial Sequence
  Synthetic
gtgaagattgtgatatatctgtatgcccattagatacaacaatgaatggaattggttgttcaccagctagtacag

SEQ ID NO: 306596 - DNA, 75 bp, Artificial Sequence
  Synthetic
caacttcaacattcagtttcaatgttggaatccaacttattttttgttgtgtacaatgacttgttcaaatatgta

SEQ ID NO: 306597 - DNA, 75 bp, Artificial Sequence
  Synthetic
gttgataacgttaaacatagaattcagatgtcatcaactatgaatcaactccaatgtaaattaaaaaattgtatt

SEQ ID NO: 306598 - DNA, 75 bp, Artificial Sequence
  Synthetic
gtacaatgacttgttcaaatatgtaaaaacgacaacagtgttgccaataaatgccgtttcatttgacggtgcaag

SEQ ID NO: 306599 - DNA, 75 bp, Artificial Sequence
  Synthetic
agatgtcatcaactatgaatcaactccaatgtaaattaaaaaattgtattaaaggcgaatcacgattgaataccg

SEQ ID NO: 306600 - DNA, 75 bp, Artificial Sequence
  Synthetic
cagatcactttgctccacgaagcgatggagttcatcaatcaaactttcttctctgagaacaatgaaagtaaaatg

SEQ ID NO: 306601 - DNA, 75 bp, Artificial Sequence
  Synthetic
ctaaatgacggacagatgacacgatcatttagaatcaatgcaaaaaaatggtggaaaattttctataccattatt

SEQ ID NO: 306602 - DNA, 75 bp, Artificial Sequence
  Synthetic
gacgtgattccatatgttttgggaatagtgctcgcattgacaaatggaaatcgtgttttgaagataattaatttt

SEQ ID NO: 306603 - DNA, 75 bp, Artificial Sequence
  Synthetic
gattatattaacacattcatacaaacaatgacgcccagacatcgggctgtataccctgaaggttggatgttgaga

SEQ ID NO: 306604 - DNA, 75 bp, Artificial Sequence
  Synthetic
tcgtgttttgaagataattaattttattattactttgtttaagaagatggtcatcactattaacgttgcaattag

SEQ ID NO: 306605 - DNA, 75 bp, Artificial Sequence
  Synthetic
tagtgctcgcattgacaaatggaaatcgtgttttgaagataattaattttattattactttgtttaagaagatgg

SEQ ID NO: 306606 - DNA, 75 bp, Artificial Sequence
  Synthetic
ataaagaagttgaagaagtgatgacacaaattcgtgaaatgagaattcatttgactgcactttttaacagtatcc

SEQ ID NO: 306607 - DNA, 75 bp, Artificial Sequence
  Synthetic
acaaaagtctctgattttatagattcagtagaaatgacatgttcatataatatagttataatccctgatagttca

SEQ ID NO: 306608 - DNA, 75 bp, Artificial Sequence
  Synthetic
gtttgtacaactttgtacactgtttacgcaattctttgcatcttgttaatatatacgttatttctaagaaaaatg

SEQ ID NO: 306609 - DNA, 75 bp, Artificial Sequence
  Synthetic
gaagtttgtctatgaactcactgagcttcctgctggtggacagccgccattctgtccatttctagcgagtggaga

SEQ ID NO: 306610 - DNA, 75 bp, Artificial Sequence
  Synthetic
tgttggatacactaatggtcaattattcactaatgatatttcatatgaaggaaatattgaaggtgtaataaatac

SEQ ID NO: 306611 - DNA, 75 bp, Artificial Sequence
  Synthetic
tgacaaactggtcttctttttaaatggtttgtacaacattgtacaccgtttgcgtaattctctgcattctactaa

SEQ ID NO: 306612 - DNA, 75 bp, Artificial Sequence
  Synthetic
ttatgcatttattttccaaatgctgcgatcggttcaccaagtccgggtaaggctgacggtttattgaatgataat

SEQ ID NO: 306613 - DNA, 75 bp, Artificial Sequence
  Synthetic
tgtatatactactgttcagaaaaatgattcatctcctaattgacatgtcacttatcgcttttgtaatatcaagtt

SEQ ID NO: 306614 - DNA, 75 bp, Artificial Sequence
  Synthetic
tggataacataaaacatcgtattcaaatgaacaccgctagctgtaaattaaagaattgtattaaaggtgaaccta

SEQ ID NO: 306615 - DNA, 75 bp, Artificial Sequence
  Synthetic
aagaattgtattaaaggtgaacctagactgaataccgcacttattagaatctctacatcatcaagttttgataat

SEQ ID NO: 306616 - DNA, 75 bp, Artificial Sequence
  Synthetic
tctttgtatttactttccaaattctgcagtggggcaacctggtccagggaagagtgatggtttgattaatgacaa

SEQ ID NO: 306617 - DNA, 75 bp, Artificial Sequence
  Synthetic
gcaatgtgatgacatgaatttggatatctatacctatgaacagataaacaaagataacctatgggcagcgttcgg

SEQ ID NO: 306618 - DNA, 75 bp, Artificial Sequence
  Synthetic
tacactatagttgattatattaatactattatacaaactatggctccgaggcatcgggccatttacccagaaggt

SEQ ID NO: 306619 - DNA, 75 bp, Artificial Sequence
  Synthetic
taggatgttcaccagctaatacagaaacatatgaagtggtatctaacgatactcagttagcgctcattgacgttg

SEQ ID NO: 306620 - DNA, 75 bp, Artificial Sequence
  Synthetic
agctaattctgaaacaattgaacaagtagctgagtgggtccttaatgtgtggaaatgtgacaatatgaatgtaga

SEQ ID NO: 306621 - DNA, 75 bp, Artificial Sequence
  Synthetic
aacatatgaagtggtatctaacgatactcagttagcgctcattgacgttgttgataacgtgaaacataggattca

SEQ ID NO: 306622 - DNA, 75 bp, Artificial Sequence
  Synthetic
ggaaatgtgacaatatgaatgtagatatttatacttatgaacaagtggggaaagacaacttttgggcggcatttg

SEQ ID NO: 306623 - DNA, 75 bp, Artificial Sequence
  Synthetic
gtgaagattgtgatgttgcggtatgtccactagacaccacaatgaatggtatcggatgtacgccagcaagtacgg

SEQ ID NO: 306624 - DNA, 75 bp, Artificial Sequence
  Synthetic
aaggtgagccacgactgaacactgcaattataagaatttctacatcatcaagttttgataactcattatcacctc

SEQ ID NO: 306625 - DNA, 75 bp, Artificial Sequence
  Synthetic
gtggataatgtaaaacatagaatacaactaaatcaagtcacatgcaaactgagaaattgtgtgaaaggtgaagca

SEQ ID NO: 306626 - DNA, 75 bp, Artificial Sequence
  Synthetic
ttcattgtcaccattgaataatgggcagaagacaagatcctttaaaattaatgcaaagaagtggtggaaaatatt

SEQ ID NO: 306627 - DNA, 75 bp, Artificial Sequence
  Synthetic
cagaagacaagatcctttaaaattaatgcaaagaagtggtggaaaatattctatactataattgattacattaat

SEQ ID NO: 306628 - DNA, 75 bp, Artificial Sequence
  Synthetic
gcatttaaaatctcattcacaatggatgtgctgttctccattgcgaaaacggtttcagagcttaaaaagagagtg

SEQ ID NO: 306629 - DNA, 75 bp, Artificial Sequence
  Synthetic
ttgaagacataattcaacagactaatgagttgattagaactttgaatggaagtacgttccatactggtggcattg

SEQ ID NO: 306630 - DNA, 75 bp, Artificial Sequence
  Synthetic
caatctcaactgatcataagaaggagaaatccaagaaggataaaagtaggaaacactacccaagaattgaagcag

SEQ ID NO: 306631 - DNA, 75 bp, Artificial Sequence
  Synthetic
aaatgcaagaattgtaaatataaaaagaagtatttcgcacttagaatgaggatgaagcaagtcgcaatgcaattg

SEQ ID NO: 306632 - DNA, 75 bp, Artificial Sequence
  Synthetic
agaagtatttcgcacttagaatgaggatgaagcaagtcgcaatgcaattgatcgaagatttgtgatgtcatcttg

SEQ ID NO: 306633 - DNA, 75 bp, Artificial Sequence
  Synthetic
tatcaaaaattggagcgctcaatctagacgtgagaatccagtttatgaatataagaatccaatggtttttgaata

SEQ ID NO: 306634 - DNA, 75 bp, Artificial Sequence
  Synthetic
gaatgaacagtacatttcaccagatgcaaaagcactcaataaatacatactgtcgaagtctccagaggatattgg

SEQ ID NO: 306635 - DNA, 75 bp, Artificial Sequence
  Synthetic
gcagatccacagtttggaaatgctatgggattgagatattatacaacaagtaatacttgtcaaattgcagcattt

SEQ ID NO: 306636 - DNA, 75 bp, Artificial Sequence
  Synthetic
ccattcaccagcttttcgattagatcgaatgcagttaagacaaatgcagatgctgacgtatttatggattcatta

SEQ ID NO: 306637 - DNA, 75 bp, Artificial Sequence
  Synthetic
taatacttgtcaaattgcagcatttgattctactatggctgagaatgcaccaaataatacacaaagattcattta

SEQ ID NO: 306638 - DNA, 75 bp, Artificial Sequence
  Synthetic
ctggcgctccaaatgttaataacccaacaatactaccagatccaactaaccaaactacgtggttgttcaatccag

SEQ ID NO: 306639 - DNA, 75 bp, Artificial Sequence
  Synthetic
tctctactgatcataaaaaggagaaatccaaaaaagacaaaagtaggaaacactatccaagaattgaagcagact

SEQ ID NO: 306640 - DNA, 75 bp, Artificial Sequence
  Synthetic
tccagagacttttcccacaaggcggaccatatccctaccaagctgcatatatgctgactttaagtatactcgatg

SEQ ID NO: 306641 - DNA, 75 bp, Artificial Sequence
  Synthetic
atgtagataagctagagatctaaccaatctctatgtggactactcaccatgtagcatgattcacgaatgggttta

SEQ ID NO: 306642 - DNA, 75 bp, Artificial Sequence
  Synthetic
gctgtctgacaaactggtcttctttttaaatggtttgtacaacgttgtacactatttgcgcgattctttgcatct

SEQ ID NO: 306643 - DNA, 75 bp, Artificial Sequence
  Synthetic
actatttgcgcgattctttgcatcttatcactatatacactatttcttagaaaaatgttccatctattgactgat

SEQ ID NO: 306644 - DNA, 75 bp, Artificial Sequence
  Synthetic
gtgatgtagataagctagagatctaaaaagtctctatgtggactacacaccatgtagcatgattcacgaatgggt

SEQ ID NO: 306645 - DNA, 75 bp, Artificial Sequence
  Synthetic
catgtagcatgattcacgaatgggtttagtctacgcttgcgtaggggcaaatgcgcatgatgtagatgatcccca

SEQ ID NO: 306646 - DNA, 75 bp, Artificial Sequence
  Synthetic
acatttgctgttgttctaattgtatctgtatgtgctggatacactaatggtcaattattcacaaatgatatttta

SEQ ID NO: 306647 - DNA, 75 bp, Artificial Sequence
  Synthetic
aggtgtgtcaacatggctagttcatacagagagatgctttactggtttggaaagaatgttgacagaaaattgccg

SEQ ID NO: 306648 - DNA, 75 bp, Artificial Sequence
  Synthetic
acagagagatgctttactggtttggaaagaatgttgacagaaaattgccgagtgtgaatactaatggatggagaa

SEQ ID NO: 306649 - DNA, 75 bp, Artificial Sequence
  Synthetic
aaagaatgttgacagaaaattgccgagtgtgaatactaatggatggagaaagaggagaagtaagaagaatggagt

SEQ ID NO: 306650 - DNA, 75 bp, Artificial Sequence
  Synthetic
aactatgcacagacactagcaacattatttgaaacaaaaggatttccgaaaggatctgtaatctttaaaacatat

SEQ ID NO: 306651 - DNA, 75 bp, Artificial Sequence
  Synthetic
caggtaaggccgatggtttattgaatgataatagctacgcacagactcttgcgacattatttgaaacaaaagggt

SEQ ID NO: 306652 - DNA, 75 bp, Artificial Sequence
  Synthetic
agattgtctgtttgtaatgcttgcggaattaagcatgtgtgtgaaaattgcgtgtcatcagaatgttttctagaa

SEQ ID NO: 306653 - DNA, 75 bp, Artificial Sequence
  Synthetic
catataatttagttatcattcctgatgaaccaaaaaattctgaagcaattgaacaaatagtcgaatgggtattaa

SEQ ID NO: 306654 - DNA, 75 bp, Artificial Sequence
  Synthetic
gagtcagatggttttgattgaatcatggattgcatataagaactattttttgacgaaattcaattataaatattc

SEQ ID NO: 306655 - DNA, 75 bp, Artificial Sequence
  Synthetic
tggattgcatataagaactattttttgacgaaattcaattataaatattcaacacaagcaaaaatactggatatg

SEQ ID NO: 306656 - DNA, 75 bp, Artificial Sequence
  Synthetic
aacacaagcaaaaatactggatatgaacaagaaccagaaatttcaactaaatgaagggaagaaaaaagcgctatc

SEQ ID NO: 306657 - DNA, 75 bp, Artificial Sequence
  Synthetic
ataagtaaggataacctatgggcagcatttggtgaagattgtgatgtatctgtttgcccattagatacgacaatg

SEQ ID NO: 306658 - DNA, 75 bp, Artificial Sequence
  Synthetic
catttggtgaagattgtgatgtatctgtttgcccattagatacgacaatgaatgggataggttgttcaccagcta

SEQ ID NO: 306659 - DNA, 75 bp, Artificial Sequence
  Synthetic
tgtaccaatcactgcacaatattttaaattctcactttttgggaaaattcatatccattttgggacaattttgac

SEQ ID NO: 306660 - DNA, 75 bp, Artificial Sequence
  Synthetic
aaattctcactttttgggaaaattcatatccattttgggacaattttgactaataaaattcaaccttggttgcaa

SEQ ID NO: 306661 - DNA, 75 bp, Artificial Sequence
  Synthetic
taataaaattcaaccttggttgcaactatctgaattgaatattggctatttacaatcattgaatgttgatagatg

SEQ ID NO: 306662 - DNA, 75 bp, Artificial Sequence
  Synthetic
gacgtagttgataatgttaaacatagaatccaaatgtcatcaaccgtaaatcaattgcagtgtaaattgaaaaat

SEQ ID NO: 306663 - DNA, 75 bp, Artificial Sequence
  Synthetic
atcgtcaagttttgataattcactatcacctctaaataacggacaaacaacacgaacgttcagaattaatgcgaa

SEQ ID NO: 306664 - DNA, 75 bp, Artificial Sequence
  Synthetic
aaaatacctgtgccacaaagtttagctatgaaatattttctcaaatcaattgacacagaattgttttactatgca

SEQ ID NO: 306665 - DNA, 75 bp, Artificial Sequence
  Synthetic
ggctttaaaagagagaatttccgcccggacatcggatagctcattttaatgtatggtattgaatataccacagtt

SEQ ID NO: 306666 - DNA, 75 bp, Artificial Sequence
  Synthetic
catgtccgagatggaaccaaggattgaggatctttagtgtgtctacaatagatatagtttttagaagacaattta

SEQ ID NO: 306667 - DNA, 75 bp, Artificial Sequence
  Synthetic
gaggatctttagtgtgtctacaatagatatagtttttagaagacaatttatgaatgagatagtggaatggtttga

SEQ ID NO: 306668 - DNA, 75 bp, Artificial Sequence
  Synthetic
ttgcagatacaaaatggacagaaacattgtcgcagttgttttggacagggggatggccaacagggtcagtttatt

SEQ ID NO: 306669 - DNA, 75 bp, Artificial Sequence
  Synthetic
attgttttcacagtacataggtgtgcattatgattttataactgattgtgtttgtgatgagtcagcaattgccat

SEQ ID NO: 306670 - DNA, 75 bp, Artificial Sequence
  Synthetic
tttgtgatgagtcagcaattgccatatttaagaaagagattgaagaatatatcgagaatggtaagagaataacac

SEQ ID NO: 306671 - DNA, 75 bp, Artificial Sequence
  Synthetic
atttaagaaagagattgaagaatatatcgagaatggtaagagaataacactgaattcaattctaccagaagagca

SEQ ID NO: 306672 - DNA, 75 bp, Artificial Sequence
  Synthetic
gtttgtacaacattgtacactgtttgcgcaattctttgcatcttattaacatacacattgtttctaagaaagatg

SEQ ID NO: 306673 - DNA, 75 bp, Artificial Sequence
  Synthetic
ttgatatggcattgcttagaattagatctcaaagtatgggcgtgctgtgatcctctatgtcctgtgtctgatcgc

SEQ ID NO: 306674 - DNA, 75 bp, Artificial Sequence
  Synthetic
tgctggatggactaatggtcaattgtttactaatgatatttcatacaatggaaacattgaaggtgtgattaacgt

SEQ ID NO: 306675 - DNA, 75 bp, Artificial Sequence
  Synthetic
ggctttaaaaattgcgacaatgtccgatttcggaattaatcttgatgccatttgcgacaatgtcagaagaaattt

SEQ ID NO: 306676 - DNA, 75 bp, Artificial Sequence
  Synthetic
tttactaatgatatttcatacaatggaaacattgaaggtgtgattaacgtaacaaatccatttgatgttgaatcg

SEQ ID NO: 306677 - DNA, 75 bp, Artificial Sequence
  Synthetic
tggattttgttgatgaagatgaattgagcacgtactttaattcaaaaacatccgtgacacaatcagattcttgtt

SEQ ID NO: 306678 - DNA, 75 bp, Artificial Sequence
  Synthetic
agctgatggtttaataaatgataataattacgcacaaacgctagcaacattatttgaaacgaaaggatttccaag

SEQ ID NO: 306679 - DNA, 75 bp, Artificial Sequence
  Synthetic
agctgatggtttattaaatgataataattacgcacaaacgctagcaacattatttgaaacgaaaggatttccaag

SEQ ID NO: 306680 - DNA, 75 bp, Artificial Sequence
  Synthetic
agctgatggtttactaaatgataataattacgcacaaacgctagcaacattatttgaaacgaaaggatttccaag

SEQ ID NO: 306681 - DNA, 75 bp, Artificial Sequence
  Synthetic
agctgatggtttagtaaatgataataattacgcacaaacgctagcaacattatttgaaacgaaaggatttccaag

SEQ ID NO: 306682 - DNA, 75 bp, Artificial Sequence
  Synthetic
aattacgcacaaacgctagcaacattatttgaaacgaaaggatttccaagagggtcagtagtgtttaaaacatat

SEQ ID NO: 306683 - DNA, 75 bp, Artificial Sequence
  Synthetic
aaatgatgaaaaagatgaatgataattcaaaattaggagatggtcctattaatgttagtaatattattagtaagg

SEQ ID NO: 306684 - DNA, 75 bp, Artificial Sequence
  Synthetic
tttagttattattccagatgaacctaataactctgaatcaattgaacagatagccgaatggatattaaatgtttg

SEQ ID NO: 306685 - DNA, 75 bp, Artificial Sequence
  Synthetic
aataactctgaatcaattgaacagatagccgaatggatattaaatgtttggcagtgtgatgatatgaatttggag

SEQ ID NO: 306686 - DNA, 75 bp, Artificial Sequence
  Synthetic
atgaagtggatgatggacagtcatgatggaataagtgtaaatggaggtctgaacttttcaaaatcaaaaaataaa

SEQ ID NO: 306687 - DNA, 75 bp, Artificial Sequence
  Synthetic
ccattagatacaactatgaatgggattggttgttcaccagccagcacagaaacgtatgaggtggtgtcaaataat

SEQ ID NO: 306688 - DNA, 75 bp, Artificial Sequence
  Synthetic
gatgtcttcaaccttaaatcaacttcaatgtagattaaaaaactgcgtcaaaggtgaatcgcgattgaatactgc

SEQ ID NO: 306689 - DNA, 75 bp, Artificial Sequence
  Synthetic
gattataagaatttcaacatcatctagttttgataattcattatcacctctaaaccatggacaaacaacacggtc

SEQ ID NO: 306690 - DNA, 75 bp, Artificial Sequence
  Synthetic
ggcttttaaattgcacgtcggtcccagctgatcactggtgccatggccgagctagcctgtttcgtttccttctca

SEQ ID NO: 306691 - DNA, 75 bp, Artificial Sequence
  Synthetic
gctagcctgtttcgtttccttctcattggctgaagataaagtgaaatggtttccaattaataagaaagctataaa

SEQ ID NO: 306692 - DNA, 75 bp, Artificial Sequence
  Synthetic
aaggagcagagaagtaactactatgatactgttatgtatggtatcgcaccacccccagagtttagaaatagattt

SEQ ID NO: 306693 - DNA, 75 bp, Artificial Sequence
  Synthetic
atactgttatgtatggtatcgcaccacccccagagtttagaaatagatttaagacaaatgaaaggaatggaatta

SEQ ID NO: 306694 - DNA, 75 bp, Artificial Sequence
  Synthetic
ctttagcgagttcagttgcattgggtgatatactttctctcgctatgtcaccgttaacattttccaatctattag

SEQ ID NO: 306695 - DNA, 75 bp, Artificial Sequence
  Synthetic
ttgaatatggtatctatgcccactgagaaattctcttttgatttggtgaaaactgtaattcaagtcagacatctc

SEQ ID NO: 306696 - DNA, 75 bp, Artificial Sequence
  Synthetic
ttattggaagacgttactaatgttgctaggaataataattcattgaactatagtgatattacttcggccatgatg

SEQ ID NO: 306697 - DNA, 75 bp, Artificial Sequence
  Synthetic
attacatgaatcataaaattctacctttgatggctgatgaatataagattacaatcaatactaaggctgatattc

SEQ ID NO: 306698 - DNA, 75 bp, Artificial Sequence
  Synthetic
agcatatattagatataactttaataaatacgcagtgatttcacatggtaaacgtcattggagattggtcttgca

SEQ ID NO: 306699 - DNA, 75 bp, Artificial Sequence
  Synthetic
tcatacggaatagaattactaatctaataaatcaatgcaaattgtaaacagtgatgagatctcaataatgtggct

SEQ ID NO: 306700 - DNA, 75 bp, Artificial Sequence
  Synthetic
ttggacaattgtgtggtggtacaacatttgatgtagcaaaaacgtcactatatagtatcaaaacgtcaaaagtgg

SEQ ID NO: 306701 - DNA, 75 bp, Artificial Sequence
  Synthetic
atggcgcagtccacagtcgtagatggggactacgacactcttgctagtgactatcttaggtttgtttatgacttt

SEQ ID NO: 306702 - DNA, 75 bp, Artificial Sequence
  Synthetic
tatggcactaaagacgctttgacacatgcagcgcagaaggacgttaaaccatatgagaataatattatcacttct

SEQ ID NO: 306703 - DNA, 75 bp, Artificial Sequence
  Synthetic
gaaatatttaaagatgaatcagaatatactgatacatatatggatccagctataaatacatcatgtcagtcaaat

SEQ ID NO: 306704 - DNA, 75 bp, Artificial Sequence
  Synthetic
tgcgaaaactgtttcagatctcaagaagaaagttgtagttggtacaatttatactaatgtggaagatattataca

SEQ ID NO: 306705 - DNA, 75 bp, Artificial Sequence
  Synthetic
tgtcaggcaatcatgttcacaatttcacgaatgaaattatatgacactaaaaacgcatctagattggagaagttg

SEQ ID NO: 306706 - DNA, 75 bp, Artificial Sequence
  Synthetic
ataaatacggcatgccaagacataatgtgagatatcgttatgaatggcagactatgcgagataaaccgtaccatt

SEQ ID NO: 306707 - DNA, 75 bp, Artificial Sequence
  Synthetic
gtgggattggaacacagcctcaaaaagaatggaattttcaactccctcaacttggtacaactctattaaatttag

SEQ ID NO: 306708 - DNA, 75 bp, Artificial Sequence
  Synthetic
agaatggaattttcaactccctcaacttggtacaactctattaaatttagatgataattatgttcaagcagctag

SEQ ID NO: 306709 - DNA, 75 bp, Artificial Sequence
  Synthetic
tgtgagatatcgttatgaatggcagactatgcgagataaaccgtaccatttagcagcatggataaattcaagtat

SEQ ID NO: 306710 - DNA, 75 bp, Artificial Sequence
  Synthetic
tgagatgatagcatgtgttgttgatcaccatacatacatgatagcaaaagaattgatagtaaaatctttcacgaa

SEQ ID NO: 306711 - DNA, 75 bp, Artificial Sequence
  Synthetic
aattgatagtaaaatctttcacgaatagaacatctctagcgaaattagtgtcatcacctatgacagtattaacgg

SEQ ID NO: 306712 - DNA, 75 bp, Artificial Sequence
  Synthetic
aaatagttagagaagcttcaaggaatggaatgcaacctcagtccccaactcttataacacttgcatcatcacggt

SEQ ID NO: 306713 - DNA, 75 bp, Artificial Sequence
  Synthetic
cttataacacttgcatcatcacggttcaaaactattaattttaataatagttctcaatctattaagaattggagt

SEQ ID NO: 306714 - DNA, 75 bp, Artificial Sequence
  Synthetic
gaatattcaaataaaaccattaattatttaatatcagaagagatgtcagaagattttatgcaggccatagaacaa

SEQ ID NO: 306715 - DNA, 75 bp, Artificial Sequence
  Synthetic
agattttatgcaggccatagaacaactaagaaatgaaggtctgaaatacatacctgattattatgaaaaatggtt

SEQ ID NO: 306716 - DNA, 75 bp, Artificial Sequence
  Synthetic
cttcaacgagctgatccgcaatatgggaatgtcatgggagtgagatattatacagctggtaacatgtgtcaactt

SEQ ID NO: 306717 - DNA, 75 bp, Artificial Sequence
  Synthetic
tagatcacctgacccgttgatgtttccgaatatagctttaatatactcattcagttttcatgtaggatataggaa

SEQ ID NO: 306718 - DNA, 75 bp, Artificial Sequence
  Synthetic
tttcatttataatggaagacttaagagaccaatttccaatgttctgatgaaaattgaagctggcgctccaaatat

SEQ ID NO: 306719 - DNA, 75 bp, Artificial Sequence
  Synthetic
agacagcttggagaactacgtaatgaatttaactcactgtctcaacaaattgcaatgtctcaacttatagattta

SEQ ID NO: 306720 - DNA, 75 bp, Artificial Sequence
  Synthetic
gatcagattacagttacgtatgatgataatgtgaacgtggaaatgtataaagaatattcggaacgtattgagaat

SEQ ID NO: 306721 - DNA, 75 bp, Artificial Sequence
  Synthetic
ccaacgaaccgaacgacatggttatacaatccagtgcagataatgaatggagcgtttacaattgaattttataat

SEQ ID NO: 306722 - DNA, 75 bp, Artificial Sequence
  Synthetic
tgacacaatatgttcagagactttttccacaaggtgggccatatccttatcaagccgcatatatgttaaccttaa

SEQ ID NO: 306723 - DNA, 75 bp, Artificial Sequence
  Synthetic
tgctgcagtactaaaaactaaaatagataaatcaacacaaattgcaccaaatacgttaccagatattgtcacaga

SEQ ID NO: 306724 - DNA, 75 bp, Artificial Sequence
  Synthetic
tgtactatgtgattcacattcagttgactattcaattgttgctaatgttagaagagattcagcaatgccagctgg

SEQ ID NO: 306725 - DNA, 75 bp, Artificial Sequence
  Synthetic
gaagagattcagcaatgccagctggaacagtatttcagccaggttttccatgggaacagactctatccaactaca

SEQ ID NO: 306726 - DNA, 75 bp, Artificial Sequence
  Synthetic
aagagaatggtgatgtagataagctagagatctaaccaatctctatgtggactactcatcatgtagcatgattca

SEQ ID NO: 306727 - DNA, 75 bp, Artificial Sequence
  Synthetic
aggatcaatggcgtcctcactatacaagcaactaatctcacagaattattattcaactggaaatgatattttact

SEQ ID NO: 306728 - DNA, 75 bp, Artificial Sequence
  Synthetic
tcttatgtattaatagataagaaagcaattcagtatggagctaccgcttcaggtgagaaacagactaaaattatg

SEQ ID NO: 306729 - DNA, 75 bp, Artificial Sequence
  Synthetic
caattcagtatggagctaccgcttcaggtgagaaacagactaaaattatgaactcaatagctaataaagctctca

SEQ ID NO: 306730 - DNA, 75 bp, Artificial Sequence
  Synthetic
attcatacacacaattaccaccaacatcatggggagcgggagcgactttcaaatctgcattcagtgcagaggaaa

SEQ ID NO: 306731 - DNA, 75 bp, Artificial Sequence
  Synthetic
atcatggggagcgggagcgactttcaaatctgcattcagtgcagaggaaattacaggaccaaatacaggtgatat

SEQ ID NO: 306732 - DNA, 75 bp, Artificial Sequence
  Synthetic
atgataagggttgatggggatgataattatgcgatagtgcgatttccaactgcaataactgaaaaattattgtca

SEQ ID NO: 306733 - DNA, 75 bp, Artificial Sequence
  Synthetic
attatgcgatagtgcgatttccaactgcaataactgaaaaattattgtcagagtttacatcaaaattaaggtcat

SEQ ID NO: 306734 - DNA, 75 bp, Artificial Sequence
  Synthetic
aatggctggatcctgtatgataaaccggatagtacgaaacggttattaaaactaggacctgacacttatgatagt

SEQ ID NO: 306735 - DNA, 75 bp, Artificial Sequence
  Synthetic
attattcagaaatgaacgtaaaagttaaagctctagcttctctaactggatgtgagattgctaaaaggtatatag

SEQ ID NO: 306736 - DNA, 75 bp, Artificial Sequence
  Synthetic
tgtgagattgctaaaaggtatatagctggaggaatgttattttttcgtgctggagtgaacatactaaaccatgaa

SEQ ID NO: 306737 - DNA, 75 bp, Artificial Sequence
  Synthetic
ctggaggaatgttattttttcgtgctggagtgaacatactaaaccatgaaaaaaggaatcaagattcatcatatg

SEQ ID NO: 306738 - DNA, 75 bp, Artificial Sequence
  Synthetic
atcagtatattatgcatcagcacaaaattctgaaaagactgtaacagtacaatatgattcactagtattgttctt

SEQ ID NO: 306739 - DNA, 75 bp, Artificial Sequence
  Synthetic
aattctgaaaagactgtaacagtacaatatgattcactagtattgttctttaatgttggttatactggtttgact

SEQ ID NO: 306740 - DNA, 75 bp, Artificial Sequence
  Synthetic
ctatatagtgaatgcattacgaggtctgacgatgtctcgtattttcattctgacaaaaatttgtcaaatgacatc

SEQ ID NO: 306741 - DNA, 75 bp, Artificial Sequence
  Synthetic
aactgctgatggtagagtagatatctgtatggctgacatgaatgattttaatggcgacagttttaattgggaggt

SEQ ID NO: 306742 - DNA, 75 bp, Artificial Sequence
  Synthetic
aatatcaatatgtatactgaatattatttagcaaacgttgatccgtatagtcaaataaaagcgttaaatcagctc

SEQ ID NO: 306743 - DNA, 75 bp, Artificial Sequence
  Synthetic
taaggctaaatcaaaaatagctgataacattgcgaaatcaccacaatttaaatcatatgttgagtttctaaatag

SEQ ID NO: 306744 - DNA, 75 bp, Artificial Sequence
  Synthetic
cattaacatgtatactgaatattacttagcaaacgttgatccgtatggtcagctaaaatcattaaaccagctaac

SEQ ID NO: 306745 - DNA, 75 bp, Artificial Sequence
  Synthetic
ttagcaaacgttgatccgtatggtcagctaaaatcattaaaccagctaactataaaaagtatagaacttgaaatg

SEQ ID NO: 306746 - DNA, 75 bp, Artificial Sequence
  Synthetic
ctgagaaagcaaagctaaacagttacgcacctatagcattagaaaagagacgcgatcaattcacaatgatggttt

SEQ ID NO: 306747 - DNA, 75 bp, Artificial Sequence
  Synthetic
cgcacctatagcattagaaaagagacgcgatcaattcacaatgatggtttctttcttacaaaacccaacgacatt

SEQ ID NO: 306748 - DNA, 75 bp, Artificial Sequence
  Synthetic
ctttcttacaaaacccaacgacatttaaaagtgaggatgttatcacaattaatgatatattatattttatatcaa

SEQ ID NO: 306749 - DNA, 75 bp, Artificial Sequence
  Synthetic
taaagattcattatggcaagaaatgagatatgccagagatataacattaaaatgtaaaatagaatcagagattac

SEQ ID NO: 306750 - DNA, 75 bp, Artificial Sequence
  Synthetic
agatcaggtgaagaagtgaacgcacatgtcacaataagttttaataacatgaaagagagatcgtacggtggatca

SEQ ID NO: 306751 - DNA, 75 bp, Artificial Sequence
  Synthetic
agatatgccagagatataacattaaaatgtaaaatagaatcagagattaccaaaggtggtggttggggatatgat

SEQ ID NO: 306752 - DNA, 75 bp, Artificial Sequence
  Synthetic
tatgtacgtgatttaacggctaatataggagattttttccattataaagagatgtcatattactttaatattcct

SEQ ID NO: 306753 - DNA, 75 bp, Artificial Sequence
  Synthetic
ttcatctggggtgcaattcacatatgaaaagtgtttgttgtcacaacaatttactgatatggttgcactgaattc

SEQ ID NO: 306754 - DNA, 75 bp, Artificial Sequence
  Synthetic
acatatattggtgcccagatgtataagcatgacagatttaagatattacaagcgtacatttataatttattatca

SEQ ID NO: 306755 - DNA, 75 bp, Artificial Sequence
  Synthetic
gaaaagtgtttgttgtcacaacaatttactgatatggttgcactgaattcaatgagatttatattcaaagtgaca

SEQ ID NO: 306756 - DNA, 75 bp, Artificial Sequence
  Synthetic
catctggagtacgatctatgtatgaacgctgtttgttgtcacagcaatttacagatcaagtggcattaaattcaa

SEQ ID NO: 306757 - DNA, 75 bp, Artificial Sequence
  Synthetic
cgcatctggaactggatttgcatactctaatggttatgtttctgaaactgttggaaatatttcatttatatcact

SEQ ID NO: 306758 - DNA, 75 bp, Artificial Sequence
  Synthetic
gctaaaactccaacagccgtatttatgatagatttagccttaagattaaaagtgataaatcattgcgttgaaaag

SEQ ID NO: 306759 - DNA, 75 bp, Artificial Sequence
  Synthetic
ggtaacataaatacaagacgcatagcttcaggaacaggattcgcttatgcagatggctatgtttctcagactgtt

SEQ ID NO: 306760 - DNA, 75 bp, Artificial Sequence
  Synthetic
ttggaaatatttcatttatatcactggttccaagtaatccgaattatcaaactccaattgcgtcatcaagcacag

SEQ ID NO: 306761 - DNA, 75 bp, Artificial Sequence
  Synthetic
cttcaggaacaggattcgcttatgcagatggctatgtttctcagactgttggaaatatttcatttatatcactaa

SEQ ID NO: 306762 - DNA, 75 bp, Artificial Sequence
  Synthetic
atgctagtaaaactgattatctgaagctgtggcgaatgctgtggaaagttaagacaatgaattcaccttattcaa

SEQ ID NO: 306763 - DNA, 75 bp, Artificial Sequence
  Synthetic
caattagccagttcagttgcattaggagatataatgtcattggccatgtcacctttaacatttgctaatctactt

SEQ ID NO: 306764 - DNA, 75 bp, Artificial Sequence
  Synthetic
tcaggatcaatggcgtcctcactttatcgtcagctaatatctcaaaactattattcaactggaaatgaaatactg

SEQ ID NO: 306765 - DNA, 75 bp, Artificial Sequence
  Synthetic
ttaagacaatgaattcaccttattcaaaaaattctatatttgatgagtgagagtgatggattgcatattgtggct

SEQ ID NO: 306766 - DNA, 75 bp, Artificial Sequence
  Synthetic
ttattcaactggaaatgaaatactgcttgatcagcagacaaataaaacaactattgattatgtagatactggaaa

SEQ ID NO: 306767 - DNA, 75 bp, Artificial Sequence
  Synthetic
ctgttaaagatgttgctgcgaatgttatgaaaaaattcaggaacacaaaaatgtttaaaagggcaaccaaaacaa

SEQ ID NO: 306768 - DNA, 75 bp, Artificial Sequence
  Synthetic
cttgatcagcagacaaataaaacaactattgattatgtagatactggaaattacacgtatgcacaattaccgcca

SEQ ID NO: 306769 - DNA, 75 bp, Artificial Sequence
  Synthetic
tatgaaaaaattcaggaacacaaaaatgtttaaaagggcaaccaaaacaaggtataaagagtacattattgggga

SEQ ID NO: 306770 - DNA, 75 bp, Artificial Sequence
  Synthetic
acgatttgcggaatgattttaatcaactagcaagttctgtggcactaagtgatattttatcgcttgcaacatctc

SEQ ID NO: 306771 - DNA, 75 bp, Artificial Sequence
  Synthetic
tgaaaagatttagaaatacaaaaatgtttaaaaaagctgctaaaccgagatatagagaatttatcattggagact

SEQ ID NO: 306772 - DNA, 75 bp, Artificial Sequence
  Synthetic
aataactggaccacacacaaatacaactataaactggagtgatttaataaattcaaatgtatgggtgctgtacca

SEQ ID NO: 306773 - DNA, 75 bp, Artificial Sequence
  Synthetic
ttgatgacattacttcagctatgatgatttcaactacaaataaattacaactaacagatattgacaccttttcag

SEQ ID NO: 306774 - DNA, 75 bp, Artificial Sequence
  Synthetic
actataaactggagtgatttaataaattcaaatgtatgggtgctgtaccaaaaaccaacaaatacaatcaaacta

SEQ ID NO: 306775 - DNA, 75 bp, Artificial Sequence
  Synthetic
gatttcaactacaaataaattacaactaacagatattgacaccttttcagaaatcgttgttaggtctgcagatga

SEQ ID NO: 306776 - DNA, 75 bp, Artificial Sequence
  Synthetic
gatgatcttacatcagcagtaatgatatcgactacaaataaaatgcaacttactgacatagacacattatcggaa

SEQ ID NO: 306777 - DNA, 75 bp, Artificial Sequence
  Synthetic
gtggtatggaaaagcaaacacaacagttacatcagattattattcaagcctgacaaattctgaaaaaagtgttac

SEQ ID NO: 306778 - DNA, 75 bp, Artificial Sequence
  Synthetic
aagcaacgccaactagagtattctcgtatgacttaaaaacactacagcaaacggatttcgatatggataaattca

SEQ ID NO: 306779 - DNA, 75 bp, Artificial Sequence
  Synthetic
gttacatcagattattattcaagcctgacaaattctgaaaaaagtgttacagtgaatcatgactcattagtacta

SEQ ID NO: 306780 - DNA, 75 bp, Artificial Sequence
  Synthetic
aatagagaatggtgtagtacatgaagcaacacaaagtggagtgttctcatatgatcttgctacacttcaacagcg

SEQ ID NO: 306781 - DNA, 75 bp, Artificial Sequence
  Synthetic
tatatcggctataattgattttgccacgctaaaagcaatgagagacacatatggaattagtacagatgtaatgta

SEQ ID NO: 306782 - DNA, 75 bp, Artificial Sequence
  Synthetic
ttggaatatgggtggcatgctaattaaaccaacaagtagtagcagagtagacgtgtgtatggccaatatgaatga

SEQ ID NO: 306783 - DNA, 75 bp, Artificial Sequence
  Synthetic
aaaccaacaagtagtagcagagtagacgtgtgtatggccaatatgaatgattttactgatagctttaattgggaa

SEQ ID NO: 306784 - DNA, 75 bp, Artificial Sequence
  Synthetic
tatctgcaatagttgattttgctacattgaaagcaatgagggatacatatggaattggaactgacgtattatacc

SEQ ID NO: 306785 - DNA, 75 bp, Artificial Sequence
  Synthetic
gtatgcagattactatttggcaagtgtagacccatataatcaactgaaagcattgcagcaaccagtaataacaac

SEQ ID NO: 306786 - DNA, 75 bp, Artificial Sequence
  Synthetic
aacccattaataaggaatagaattgaggaactattaagacagtgtagaatctaataagtgaggagaccagcttga

SEQ ID NO: 306787 - DNA, 75 bp, Artificial Sequence
  Synthetic
gtagacccatataatcaactgaaagcattgcagcaaccagtaataacaactgttgaaataaaaatgatgaaaatc

SEQ ID NO: 306788 - DNA, 75 bp, Artificial Sequence
  Synthetic
ggtttgtacgacattgtacactgtttgcgtaattctctgcattctttttatttatattctgctgtttagaaaaat

SEQ ID NO: 306789 - DNA, 75 bp, Artificial Sequence
  Synthetic
atggcaggaggtaagatatgttagagatataacgcttcaatgcaaaattgaatctgaagttgttaaaggtggtgg

SEQ ID NO: 306790 - DNA, 75 bp, Artificial Sequence
  Synthetic
gtataggatggtcacagggacagatgtttgttgacgatatgtattataatggaaatgttgaaacaatagtgaatg

SEQ ID NO: 306791 - DNA, 75 bp, Artificial Sequence
  Synthetic
gatataacgcttcaatgcaaaattgaatctgaagttgttaaaggtggtggatggggttatgattatactagcgta

SEQ ID NO: 306792 - DNA, 75 bp, Artificial Sequence
  Synthetic
gtttgttgacgatatgtattataatggaaatgttgaaacaatagtgaatgctacggatccatttgatgtccgatc

SEQ ID NO: 306793 - DNA, 75 bp, Artificial Sequence
  Synthetic
agttaacgctcacgttacagtcagttttaacaatatgaaagaacgctcgtatggaggatcattgcctactgattt

SEQ ID NO: 306794 - DNA, 75 bp, Artificial Sequence
  Synthetic
aggcagacgggtatctgaatgatggtaactacgctcaaactatcgcgacgttatttgaaacaaaaggttttccga

SEQ ID NO: 306795 - DNA, 75 bp, Artificial Sequence
  Synthetic
tttaacaatatgaaagaacgctcgtatggaggatcattgcctactgatttcaaaataggacggtttgatataata

SEQ ID NO: 306796 - DNA, 75 bp, Artificial Sequence
  Synthetic
taactacgctcaaactatcgcgacgttatttgaaacaaaaggttttccgagaggatcaataatacttaagacata

SEQ ID NO: 306797 - DNA, 75 bp, Artificial Sequence
  Synthetic
caaaaatatggtatatgtacgtgatttgagagctgatatgggtagttttaattattcttcaaatatgtcatatta

SEQ ID NO: 306798 - DNA, 75 bp, Artificial Sequence
  Synthetic
atatagttataatacctgacagctcaactaaatcagaagatatagaaagaatagctgagtggatattgaatgtct

SEQ ID NO: 306799 - DNA, 75 bp, Artificial Sequence
  Synthetic
ttgagagctgatatgggtagttttaattattcttcaaatatgtcatattacttcagaattcctgttgggcaatat

SEQ ID NO: 306800 - DNA, 75 bp, Artificial Sequence
  Synthetic
aactaaatcagaagatatagaaagaatagctgagtggatattgaatgtctggaaatgtgatgatatgaatttgga

SEQ ID NO: 306801 - DNA, 75 bp, Artificial Sequence
  Synthetic
gtctcaacaatttacagatcaagtagcgctcaattcgatgagatttgtgtttagagtgacatcatcagacggttg

SEQ ID NO: 306802 - DNA, 75 bp, Artificial Sequence
  Synthetic
gtaatgactgtgatatatcagtctgtccgttagatacaacgatgaatggaattggttgttcaccagctagcactg

SEQ ID NO: 306803 - DNA, 75 bp, Artificial Sequence
  Synthetic
gcgctcaattcgatgagatttgtgtttagagtgacatcatcagacggttggtttatgacagcggggaatataaat

SEQ ID NO: 306804 - DNA, 75 bp, Artificial Sequence
  Synthetic
tccgttagatacaacgatgaatggaattggttgttcaccagctagcactgaaacatatgaagtattgtcaaatga

SEQ ID NO: 306805 - DNA, 75 bp, Artificial Sequence
  Synthetic
tactgaaactgtcggaacagtttcatttatatcactagttccaagcaatccaaattaccagactccaatagcttc

SEQ ID NO: 306806 - DNA, 75 bp, Artificial Sequence
  Synthetic
aaatgaatacagctagctgtaaattaaagaattgcgtcaaaggtgaacctagattaaacaccgcacttatcagaa

SEQ ID NO: 306807 - DNA, 75 bp, Artificial Sequence
  Synthetic
gagcgaaagattaatgacttacgtaatgatttcaatgaattagctagttcagtagcactgagtgatatactatcc

SEQ ID NO: 306808 - DNA, 75 bp, Artificial Sequence
  Synthetic
ttcgttatcgccgctgaatgatggacaaacaacgcgaacgtttaagataaatgcaaaaaaatggtggacaatatt

SEQ ID NO: 306809 - DNA, 75 bp, Artificial Sequence
  Synthetic
gcagcaaacgttatgaaaaaatttaaaacaacgaaaatgtttaaaaaagctgcaaaaccaaaatataaggaatat

SEQ ID NO: 306810 - DNA, 75 bp, Artificial Sequence
  Synthetic
tttgatatacttgatactgattcatatgtatatattgattattgggatgattcagaaatatttaaaaatatggta

SEQ ID NO: 306811 - DNA, 75 bp, Artificial Sequence
  Synthetic
agcaatggattttgatgatatcacatctgcagtgatggtttcaacgacaaacagattgcaactcacggatgtgga

SEQ ID NO: 306812 - DNA, 75 bp, Artificial Sequence
  Synthetic
tctgcagtgatggtttcaacgacaaacagattgcaactcacggatgtggatacgctatcagagattgtagctaga

SEQ ID NO: 306813 - DNA, 75 bp, Artificial Sequence
  Synthetic
tatggtgcacgaagcgacacctaatagagtcttctcctatgatttggccaccttgcagcagagagattttgacat

SEQ ID NO: 306814 - DNA, 75 bp, Artificial Sequence
  Synthetic
agagtcttctcctatgatttggccaccttgcagcagagagattttgacatggaaaaattcatgcagcttgcatca

SEQ ID NO: 306815 - DNA, 75 bp, Artificial Sequence
  Synthetic
gagagatacatatggagttagtacagatattatgtataaattggtggcatcagatgctccaacgatattatcatt

SEQ ID NO: 306816 - DNA, 75 bp, Artificial Sequence
  Synthetic
cattaataacaacaatccgctgataagaaatagaatagagggactaatcagacagtgtagaatataaaaagtgag

SEQ ID NO: 306817 - DNA, 75 bp, Artificial Sequence
  Synthetic
cgttcattgcaatccagttcactgatgcaatgagggtattggggctttttgaacgcgggaataatctgaacttcg

SEQ ID NO: 306818 - DNA, 75 bp, Artificial Sequence
  Synthetic
gaacgcgggaataatctgaacttcgcagacacatatgtttatacatggaataaacaatactcgtttcatgaaaac

SEQ ID NO: 306819 - DNA, 75 bp, Artificial Sequence
  Synthetic
atactgtcatatatggtattgcaccacccccagaatttagaaatagatttaagacaaatgaaaggaatggaatta

SEQ ID NO: 306820 - DNA, 75 bp, Artificial Sequence
  Synthetic
tcatcgaatttcacatatgattggcaaaacaaaattgtatattttcatgaatatacatattataaaaataatgaa

SEQ ID NO: 306821 - DNA, 75 bp, Artificial Sequence
  Synthetic
aaaacaaaattgtatattttcatgaatatacatattataaaaataatgaatttattgtaagtgatgagttctggt

SEQ ID NO: 306822 - DNA, 75 bp, Artificial Sequence
  Synthetic
tgttaaaatgaaagttaaagctgtcatgattgcgtgtaatttagtgaatgaaattgaaataacacctctaactga

SEQ ID NO: 306823 - DNA, 75 bp, Artificial Sequence
  Synthetic
gccgtacaaagtgttattttttgaacgtggaatgagaaagttatatgaaggtgaagagtatatattatataatac

SEQ ID NO: 306824 - DNA, 75 bp, Artificial Sequence
  Synthetic
aaatacatatatgaaaaagatgtgataatgtccggtaatgattactctaaattatatgacactaaaagttttaaa

SEQ ID NO: 306825 - DNA, 75 bp, Artificial Sequence
  Synthetic
attatatgacactaaaagttttaaaaacttcgtacattttatgagattactcagaatgcggtttgccgtaccatt

SEQ ID NO: 306826 - DNA, 75 bp, Artificial Sequence
  Synthetic
gaatacacattgggctgagaaatgagtcaattccacaagcgttagataatatacatcatcattggataaattatt

SEQ ID NO: 306827 - DNA, 75 bp, Artificial Sequence
  Synthetic
atacatcatcattggataaattattcagcgaacggaatgagagtgtcagaactaaaaggatcaggaagctactct

SEQ ID NO: 306828 - DNA, 75 bp, Artificial Sequence
  Synthetic
actaaaaggatcaggaagctactctgaaaaaaagattagtgaatttgacatagggcagtttaagaactacatgaa

SEQ ID NO: 306829 - DNA, 75 bp, Artificial Sequence
  Synthetic
gtacgataattggagctgctccaggatactggataccttcaatgaaaaaatattttaatatagtcacttatgacg

SEQ ID NO: 306830 - DNA, 75 bp, Artificial Sequence
  Synthetic
atgtccaagcgatcacgctccttagattctgctgccttttattacccagtctaaaaatatcttaagttaaaattg

SEQ ID NO: 306831 - DNA, 75 bp, Artificial Sequence
  Synthetic
gatatagccagtgttaaaacgaatggagtttatatagatgtgaggtcagactttaaaaattatgattggaagaaa

SEQ ID NO: 306832 - DNA, 75 bp, Artificial Sequence
  Synthetic
gagtttatatagatgtgaggtcagactttaaaaattatgattggaagaaaagaagacaactggttgaggaagaaa

SEQ ID NO: 306833 - DNA, 75 bp, Artificial Sequence
  Synthetic
atattttgtgcacttcccaactacgtacaggagaagtgagtattatctgttagttgataaacaaactgtaaaaag

SEQ ID NO: 306834 - DNA, 75 bp, Artificial Sequence
  Synthetic
tagttgataaacaaactgtaaaaagaccgaaagttaaaatcactaaatcattagcttacagtgcaataaatacaa

SEQ ID NO: 306835 - DNA, 75 bp, Artificial Sequence
  Synthetic
tattttctgataatgtgttcatttctggaaaatactcactaaaaggaaaaactgaaggagtgttagcattatatt

SEQ ID NO: 306836 - DNA, 75 bp, Artificial Sequence
  Synthetic
aaataaaattattgattttaagacaaatgctgattatacatttttgccatcagatttccaatgttcaatcaaaac

SEQ ID NO: 306837 - DNA, 75 bp, Artificial Sequence
  Synthetic
ggcagatttgcgacataaaatatcaggtgaagcaaacaccgcaaaatacccagcaattttacacccagttgatga

SEQ ID NO: 306838 - DNA, 75 bp, Artificial Sequence
  Synthetic
gctggtgtctttggctatgcaataacaaaagatttgaagtcggatgggaataatcatatttatatcattccaaac

SEQ ID NO: 306839 - DNA, 75 bp, Artificial Sequence
  Synthetic
tagatattcacattctaagaggttttcagagtctgcaactactatgtcaggatatttatttagagatatggttag

SEQ ID NO: 306840 - DNA, 75 bp, Artificial Sequence
  Synthetic
atgtttttaacgcaatagcacattatagatttgattatacttatgatatcgtaggatggcttaaactacataaaa

SEQ ID NO: 306841 - DNA, 75 bp, Artificial Sequence
  Synthetic
accttattgtatccggcgttaggattagcacaaatgcattatcaagctggtgaaatacgcacaccatttgaacta

SEQ ID NO: 306842 - DNA, 75 bp, Artificial Sequence
  Synthetic
ggcttttaaaagcacttgctggaaatggctactcaggcttccgttgagtggatattcaatgttgcagggtcagct

SEQ ID NO: 306843 - DNA, 75 bp, Artificial Sequence
  Synthetic
gatattcaatgttgcagggtcagctgcttcagcttctctggctaaatcgatcaaggatgcaggaggaagtgagga

SEQ ID NO: 306844 - DNA, 75 bp, Artificial Sequence
  Synthetic
attaacacaataatacaaacaatgactcctagacatagggccatttatccagaaggttggatgctaagatatgcg

SEQ ID NO: 306845 - DNA, 75 bp, Artificial Sequence
  Synthetic
tagctgagagaaatgaagaatggcacacgaatttggctacaattagaagactagatttagaattggcagaattga

SEQ ID NO: 306846 - DNA, 75 bp, Artificial Sequence
  Synthetic
cagctactttcaaatagaaccgcacaaatagcagatttaactaggttgattgcttataattacaccacattatca

SEQ ID NO: 306847 - DNA, 75 bp, Artificial Sequence
  Synthetic
tgtatcagaacttaaaaagaaagttgtggttggtactatttacactaatgtagaagacataattcaacaaactaa

SEQ ID NO: 306848 - DNA, 75 bp, Artificial Sequence
  Synthetic
gcatttaaaatctcattcacaatggacgtgttgttttcaattgcgaaaactgtatcagaacttaaaaagaaagtt

SEQ ID NO: 306849 - DNA, 75 bp, Artificial Sequence
  Synthetic
gtggttggtactatttacactaatgtagaagacataattcaacaaactaatgaattaattaggactttgaatggt

SEQ ID NO: 306850 - DNA, 75 bp, Artificial Sequence
  Synthetic
tcaatgttctcggtaacgagagaggaaggtagatcatcaaacgtagtaatgttgaaacaaaatgcagtgaaaatg

SEQ ID NO: 306851 - DNA, 75 bp, Artificial Sequence
  Synthetic
gttgaaacaaaatgcagtgaaaatgattgaggagggtaaattgaaaattaaggttgagaaaaatgaaaattatac

SEQ ID NO: 306852 - DNA, 75 bp, Artificial Sequence
  Synthetic
ttttcaactaccacagttaggtacgacacttttgaatttggatgataactatgttcaggcgactagaggtgttat

SEQ ID NO: 306853 - DNA, 75 bp, Artificial Sequence
  Synthetic
attgaggagggtaaattgaaaattaaggttgagaaaaatgaaaattatactgaatcattaaagaataaaattgaa

SEQ ID NO: 306854 - DNA, 75 bp, Artificial Sequence
  Synthetic
acacttttgaatttggatgataactatgttcaggcgactagaggtgttattgattacctggcttcattcatagaa

SEQ ID NO: 306855 - DNA, 75 bp, Artificial Sequence
  Synthetic
gttagattggatggtgattcttgttcttacaactcaactgctgcttttgtttcaacaattatgggtacaccaatt

SEQ ID NO: 306856 - DNA, 75 bp, Artificial Sequence
  Synthetic
gcctcagtcaccttcacttattgcactatcttcatcaaagtttaagactattaatttcaataacagctcacaatc

SEQ ID NO: 306857 - DNA, 75 bp, Artificial Sequence
  Synthetic
ctatcttcatcaaagtttaagactattaatttcaataacagctcacaatccattaaaaattggagtgctcaatca

SEQ ID NO: 306858 - DNA, 75 bp, Artificial Sequence
  Synthetic
aaaatgtatgatgaatcaaataagccactctttgatgtagggaaatacataaacccaaaacacgtaattgataaa

SEQ ID NO: 306859 - DNA, 75 bp, Artificial Sequence
  Synthetic
taggaattcatacattctccagcgtgctaatccgcagtttggaaatgtaatgggattgagatattatacaactag

SEQ ID NO: 306860 - DNA, 75 bp, Artificial Sequence
  Synthetic
gctaatccgcagtttggaaatgtaatgggattgagatattatacaactagtaacacttgtcaaatcgcagctttt

SEQ ID NO: 306861 - DNA, 75 bp, Artificial Sequence
  Synthetic
atcaccagatttcgatgcatggaatgagaacagtaatttaaaaattgttagtgttaatgattgtcatgcaatttg

SEQ ID NO: 306862 - DNA, 75 bp, Artificial Sequence
  Synthetic
taacactgatgggttgcagattataaacattgaggaaattgaaaaaactggagattattcagctataacaaatgc

SEQ ID NO: 306863 - DNA, 75 bp, Artificial Sequence
  Synthetic
gagaacagtaatttaaaaattgttagtgttaatgattgtcatgcaatttgtgtctttaagtttgagaatgagtgg

SEQ ID NO: 306864 - DNA, 75 bp, Artificial Sequence
  Synthetic
gagattattcagctataacaaatgcactgttgcgtgatattccaattgttttaagaggtgcaattccatatgtta

SEQ ID NO: 306865 - DNA, 75 bp, Artificial Sequence
  Synthetic
taatggaagacttaagagaccaatttctaatgtgttaatgaaagttgaagctggtgctcagaacatcagtagtcc

SEQ ID NO: 306866 - DNA, 75 bp, Artificial Sequence
  Synthetic
tctaatgtgttaatgaaagttgaagctggtgctcagaacatcagtagtccgacagtcctacctgatccaacaaat

SEQ ID NO: 306867 - DNA, 75 bp, Artificial Sequence
  Synthetic
cagattgacagaattctaatttccggagatattgagctaaatccaggtcctaacgctcttattaaattgaatgac

SEQ ID NO: 306868 - DNA, 75 bp, Artificial Sequence
  Synthetic
tattgaattttataacaatggacaactagttgatatgatcagaaatatgggagtagttactgttagaatgtttga

SEQ ID NO: 306869 - DNA, 75 bp, Artificial Sequence
  Synthetic
ttatatgtacttttaatgttaatttagatgatgacggatcaattatgtacatttgttacttgaaagttgggtcgg

SEQ ID NO: 306870 - DNA, 75 bp, Artificial Sequence
  Synthetic
atgttcagagaacattcccacaaggtggtccttatccataccaagctgcatatatgttgacactcagtgtattag

SEQ ID NO: 306871 - DNA, 75 bp, Artificial Sequence
  Synthetic
acattatccaactacactgttgctcaagaagataatttagaaagacttctactagttgcgtccgtgaagagaatg

SEQ ID NO: 306872 - DNA, 75 bp, Artificial Sequence
  Synthetic
tgtttctgatcttaaagaaaaggttgtagttggtacaatttatacaaatgtagaggatattgtgcaacagactaa

SEQ ID NO: 306873 - DNA, 75 bp, Artificial Sequence
  Synthetic
gttaaacatgaaacaagagatatacataaagaagttgaagaagtgatgacacaaattcgtgaaatgagaattcat

SEQ ID NO: 306874 - DNA, 75 bp, Artificial Sequence
  Synthetic
gaacacaaccgcagaaagaatggaaatttcaacttccacaactaggaacaactcttttaaatcttgacgataatt

SEQ ID NO: 306875 - DNA, 75 bp, Artificial Sequence
  Synthetic
gatcgatggcgtcttcactttatcatcaattaatctctcagaattattattcaactgggaatgagattctaaaag

SEQ ID NO: 306876 - DNA, 75 bp, Artificial Sequence
  Synthetic
aagaatgagatgagagcacatgcaagtgtaaacacttcaaaacagcaacttagtaacacgtctggactggagatg

SEQ ID NO: 306877 - DNA, 75 bp, Artificial Sequence
  Synthetic
tgcgtaattctctgcattctactaatgtatatactactgttcagaaaaatgattcatcttttaattgacatgtca

SEQ ID NO: 306878 - DNA, 75 bp, Artificial Sequence
  Synthetic
tcaactgggaatgagattctaaaagatctacagacaactaagactactgttgactatgtgaatgtcggaaattat

SEQ ID NO: 306879 - DNA, 75 bp, Artificial Sequence
  Synthetic
tcagtctgtgatgatgaaattgttcgagaagcttcaagaaacggaatgcaacctcaatctccaacactcatagca

SEQ ID NO: 306880 - DNA, 75 bp, Artificial Sequence
  Synthetic
atctacagacaactaagactactgttgactatgtgaatgtcggaaattatacatatgctcagttgccaccaacaa

SEQ ID NO: 306881 - DNA, 75 bp, Artificial Sequence
  Synthetic
acaggaccgcacacaaatagagtgatagagtggaataatttattaaattctgatcagtggttactatttccaaaa

SEQ ID NO: 306882 - DNA, 75 bp, Artificial Sequence
  Synthetic
tagagtggaataatttattaaattctgatcagtggttactatttccaaaacccattgatacagttaaactactta

SEQ ID NO: 306883 - DNA, 75 bp, Artificial Sequence
  Synthetic
tattaaaaattggagcgctcaatcaagacgtgaaactccagtttatgaatatagaaatcctatggtgtttgaata

SEQ ID NO: 306884 - DNA, 75 bp, Artificial Sequence
  Synthetic
agacgtgaaactccagtttatgaatatagaaatcctatggtgtttgaatataggaattcatatatgcttcagcgc

SEQ ID NO: 306885 - DNA, 75 bp, Artificial Sequence
  Synthetic
agagtgatggtttgattaatgacaataattatgctcaaacactagcagttctttttgaaacaaaaggatttccaa

SEQ ID NO: 306886 - DNA, 75 bp, Artificial Sequence
  Synthetic
ctttttgaaacaaaaggatttccaaaagggtcggtgaattttaacacttatactaaaatatctgactttataaat

SEQ ID NO: 306887 - DNA, 75 bp, Artificial Sequence
  Synthetic
tatgggaaagctaatactacggtaatatcagagcactattcatcattaagtgataatcaagtgcatgtaactagt

SEQ ID NO: 306888 - DNA, 75 bp, Artificial Sequence
  Synthetic
gcaacaccacaattcggaaatgttatgggactaagatattatacagccagtaatatatgtcagatcgcagcattt

SEQ ID NO: 306889 - DNA, 75 bp, Artificial Sequence
  Synthetic
tatcagagcactattcatcattaagtgataatcaagtgcatgtaactagtgactcattagtattattttggaatg

SEQ ID NO: 306890 - DNA, 75 bp, Artificial Sequence
  Synthetic
taatggcagacttaagagaccaatttctaatgttctaatgaagatagaggcaggtgctccaaatataaacaatcc

SEQ ID NO: 306891 - DNA, 75 bp, Artificial Sequence
  Synthetic
ggtggaatattaattaaaccatcaactcaaaagcctagattagttgtgtgcatggctaacatgaccaatttcaat

SEQ ID NO: 306892 - DNA, 75 bp, Artificial Sequence
  Synthetic
tctaatgttctaatgaagatagaggcaggtgctccaaatataaacaatccaaccatcttacctgaccccgcaaat

SEQ ID NO: 306893 - DNA, 75 bp, Artificial Sequence
  Synthetic
ctcaaaagcctagattagttgtgtgcatggctaacatgaccaatttcaatagtgataattttaattgggaagaat

SEQ ID NO: 306894 - DNA, 75 bp, Artificial Sequence
  Synthetic
tattgaattttataataatggtcaactggttgacatggttaggagtatgggaatagtaactgttagggcatttga

SEQ ID NO: 306895 - DNA, 75 bp, Artificial Sequence
  Synthetic
tattatctagctagtagtgatccatataatcaactgaaagaattacaacaaccaactattaccacattcgaaatg

SEQ ID NO: 306896 - DNA, 75 bp, Artificial Sequence
  Synthetic
cacatatagaataataattgacatgattagaccagcagctatgactcaatatatacaacagatttttccaagagg

SEQ ID NO: 306897 - DNA, 75 bp, Artificial Sequence
  Synthetic
agaatgatgcaagtaactagagatggaaaaatcaatgttaatgaagtagtaagtaaagattcattatggcaagaa

SEQ ID NO: 306898 - DNA, 75 bp, Artificial Sequence
  Synthetic
tattaaaggtggtggatggggatatgattatacgagtataagatttaaaaccactaatcatacgtattcgtacac

SEQ ID NO: 306899 - DNA, 75 bp, Artificial Sequence
  Synthetic
attattgcgaacgttagaagagattcagcaatgccagctgggactgtttttcaaccaggatttccatgggaacaa

SEQ ID NO: 306900 - DNA, 75 bp, Artificial Sequence
  Synthetic
gattatacgagtataagatttaaaaccactaatcatacgtattcgtacactagagctggtgaaaatgtaagtgcc

SEQ ID NO: 306901 - DNA, 75 bp, Artificial Sequence
  Synthetic
gttagttgcatctgtgaagagaatggtgctgtagataagtaagagatctaaacaatctctatacggactacgcac

SEQ ID NO: 306902 - DNA, 75 bp, Artificial Sequence
  Synthetic
actaccaactgattttaaaataggtaaatttgatataatcgatgttgactcttatatgtatatagattactggga

SEQ ID NO: 306903 - DNA, 75 bp, Artificial Sequence
  Synthetic
aaatttgatataatcgatgttgactcttatatgtatatagattactgggatgattcagaaatttttaaaaacatg

SEQ ID NO: 306904 - DNA, 75 bp, Artificial Sequence
  Synthetic
catgtagcatgattcacgaatgggtttagtccacgcttgcgtaggggcaaatgcgcatgatgtggatgatcccca

SEQ ID NO: 306905 - DNA, 75 bp, Artificial Sequence
  Synthetic
agagatgtcatattattttaacattcctgttggagtacatcccagaataaattcatctggaataggatttacata

SEQ ID NO: 306906 - DNA, 75 bp, Artificial Sequence
  Synthetic
tgttgaactatatattaaaatcaataaccagagttatggactatatactctatcgttttttactttttgttgtta

SEQ ID NO: 306907 - DNA, 75 bp, Artificial Sequence
  Synthetic
caatgagatttgtatttaaagtaacgtctgcaaatggatggtttatgacctcaggtggtccgaatactagacgta

SEQ ID NO: 306908 - DNA, 75 bp, Artificial Sequence
  Synthetic
acgggatcaatggatacgaactatcaaaacgtgtctaatcctgaaccatttctaacatcaacactatgcctgtat

SEQ ID NO: 306909 - DNA, 75 bp, Artificial Sequence
  Synthetic
tcaacgatctacgtaatgatttcaatcaactagctagttcagtagctttaggtgatattatgtccttagctatgt

SEQ ID NO: 306910 - DNA, 75 bp, Artificial Sequence
  Synthetic
tatatgcttacacttagtgtgctggatgccacgacagaatctgttttgtgcgactctcattcagtcgattattca

SEQ ID NO: 306911 - DNA, 75 bp, Artificial Sequence
  Synthetic
tgtgactataacattgtactaatgaagtataatgctaattcagaattagatatgtcagagttagctgacttgata

SEQ ID NO: 306912 - DNA, 75 bp, Artificial Sequence
  Synthetic
agtataatgctaattcagaattagatatgtcagagttagctgacttgatacttaatgagtggctttgtaatccaa

SEQ ID NO: 306913 - DNA, 75 bp, Artificial Sequence
  Synthetic
gatgtttaagaaagctacaaaacctaagtataaagaatttataattggtgatttacttgaggatgtaacaaatgt

SEQ ID NO: 306914 - DNA, 75 bp, Artificial Sequence; identical to SEQ ID NO: 297350
  Synthetic

SEQ ID NO: 306915 - DNA, 75 bp, Artificial Sequence
  Synthetic
tgacttcaactaccaataaattacaattaacagacgtagatacactgtcagagattgttgttagatccgctgacg

SEQ ID NO: 306916 - DNA, 75 bp, Artificial Sequence
  Synthetic
attaacagacgtagatacactgtcagagattgttgttagatccgctgacgatttcatacccaatagatcatatag

SEQ ID NO: 306917 - DNA, 75 bp, Artificial Sequence
  Synthetic
ttgcaacagctgaaaaattggcaataacagatgttgtagatggagtgaattataaaataaatgtgacaacgacta

SEQ ID NO: 306918 - DNA, 75 bp, Artificial Sequence
  Synthetic
tataaaataaatgtgacaacgactacatgtactattagaaattgtaaaaagttggggccacgtgagaatgtcgca

SEQ ID NO: 306919 - DNA, 75 bp, Artificial Sequence; identical to SEQ ID NO: 302986
  Synthetic

SEQ ID NO: 306920 - DNA, 75 bp, Artificial Sequence
  Synthetic
catatgatttggtaactatgcaacagcgagacttcgatatggataaattcattcaattagcttcaaaatcaccag

SEQ ID NO: 306921 - DNA, 75 bp, Artificial Sequence
  Synthetic
gcgagacttcgatatggataaattcattcaattagcttcaaaatcaccagtaatatctgcaatcgtagattttgc

SEQ ID NO: 306922 - DNA, 75 bp, Artificial Sequence
  Synthetic
atgagaataaattggaaaaagtggtggcaagtcttttacactgtcgttgattatgtaaatcaaataatccaagca

SEQ ID NO: 306923 - DNA, 75 bp, Artificial Sequence
  Synthetic
ttatgtaaatcaaataatccaagcaatgtccaagagatcacgatcactagattcagcagcgttttactacagaat

SEQ ID NO: 306924 - DNA, 75 bp, Artificial Sequence
  Synthetic
aacaatactatcattcataaataacaataatccattgataagaaatagaatagaggagttattaagacaatgtag

SEQ ID NO: 306925 - DNA, 75 bp, Artificial Sequence
  Synthetic
atgtccaagagatcacgatcactagattcagcagcgttttactacagaatttgaatgtcattgagattagagttg

SEQ ID NO: 306926 - DNA, 75 bp, Artificial Sequence
  Synthetic
aataatccattgataagaaatagaatagaggagttattaagacaatgtagaatataagaagtgaggagaccagct

SEQ ID NO: 306927 - DNA, 75 bp, Artificial Sequence
  Synthetic
tggctatcggatagctcatttttatgtatggtattgaatataccacagttctaacttttttgatatcgcttgtat

SEQ ID NO: 306928 - DNA, 75 bp, Artificial Sequence; identical to SEQ ID NO: 298674
  Synthetic

SEQ ID NO: 306929 - DNA, 75 bp, Artificial Sequence; identical to SEQ ID NO: 298675
  Synthetic

SEQ ID NO: 306930 - DNA, 75 bp, Artificial Sequence
  Synthetic
actgtttgcgtaattctctgtatcctgtttatctatacgttgttgtttagaaaaatgttccaccttataacagat

SEQ ID NO: 306931 - DNA, 75 bp, Artificial Sequence
  Synthetic
ttgtcttaattgtttggatgaatgcagattgtctgtttgtgatgcttgtgggattaagcacgtgtgtgaaaattg

SEQ ID NO: 306932 - DNA, 75 bp, Artificial Sequence
  Synthetic
gctgtctgacaaactggtcttctttttaaatggtttgtacgacattgtacactgtttgcgtaattctctgtatcc

SEQ ID NO: 306933 - DNA, 75 bp, Artificial Sequence
  Synthetic
tgtttatctatacgttgttgtttagaaaaatgttccaccttataacagatgcattcgtcataacatttgttatat

SEQ ID NO: 306934 - DNA, 75 bp, Artificial Sequence
  Synthetic
aaattacggaattaatttaccaataactggatctatggatacgccatatatgaattcaactacaagtgaaacatt

SEQ ID NO: 306935 - DNA, 75 bp, Artificial Sequence
  Synthetic
tatgatggaaatgttgaaacagtagtaaatgctaccaatccctttgatgttaaatcattatgtatatattttcca

SEQ ID NO: 306936 - DNA, 75 bp, Artificial Sequence
  Synthetic
taaatgctaccaatccctttgatgttaaatcattatgtatatattttccaaacgcagttgtgggttcccaaggtc

SEQ ID NO: 306937 - DNA, 75 bp, Artificial Sequence
  Synthetic
tgacgaagttcaattataaatattcaacacaagcaaaaatactggatatgaacaagaatcagaagtttcaactaa

SEQ ID NO: 306938 - DNA, 75 bp, Artificial Sequence
  Synthetic
ttgcagatacaaaatggacagaaacattgtcgcagttgtttttaacaaaaggatggccaacagggtcagtttatt

SEQ ID NO: 306939 - DNA, 75 bp, Artificial Sequence
  Synthetic
gcagcattgtttgaaacaaaaggctttccaaaaggatcaattgtactcaaaacatatacaaaagtttcagacttc

SEQ ID NO: 306940 - DNA, 75 bp, Artificial Sequence
  Synthetic
aacatatacaaaagtttcagacttcatagattcagtggagatgacgtgttcatacaacatagttatcatacctga

SEQ ID NO: 306941 - DNA, 75 bp, Artificial Sequence
  Synthetic
tgcgactataatattgtactaatgaaatatgatggaaatttacagttagacatgtctgaattggctgatttaata

SEQ ID NO: 306942 - DNA, 75 bp, Artificial Sequence
  Synthetic
aatatgatggaaatttacagttagacatgtctgaattggctgatttaatattgaatgaatggctatgtaatccaa

SEQ ID NO: 306943 - DNA, 75 bp, Artificial Sequence
  Synthetic
agttttgctgtgaacgtcatgcgaactgcttgcattacaaagatagcatgtaagagaccaataagtgaaggtgat

SEQ ID NO: 306944 - DNA, 75 bp, Artificial Sequence
  Synthetic
atatcaatgggtacatcatgtacgattaaagtatgtcctctaaatacgcagactctcgggataggatgttcgact

SEQ ID NO: 306945 - DNA, 75 bp, Artificial Sequence
  Synthetic
ttaaagtatgtcctctaaatacgcagactctcgggataggatgttcgactacagacataaattcatttgaaacag

SEQ ID NO: 306946 - DNA, 75 bp, Artificial Sequence
  Synthetic
cttagatatttatacttatgagcagactggaatagacaatctatgggctgcctttggtaatgattgtgatatatc

SEQ ID NO: 306947 - DNA, 75 bp, Artificial Sequence
  Synthetic
gtacggaaacatatgaagtgttgtcaaataatactcaactagcattacttaatgtagtagataatgtaaagcacc

SEQ ID NO: 306948 - DNA, 75 bp, Artificial Sequence
  Synthetic
aaataatactcaactagcattacttaatgtagtagataatgtaaagcaccgtattcaaatgaatacagctaactg

SEQ ID NO: 306949 - DNA, 75 bp, Artificial Sequence
  Synthetic
cataaattagacgtaacaacaagtacatgtactataagaaattgtaaaaaacttggaccaagagaaaatgtcgct

SEQ ID NO: 306950 - DNA, 75 bp, Artificial Sequence
  Synthetic
catgtactataagaaattgtaaaaaacttggaccaagagaaaatgtcgctgtaattcaggtaggaggtccaaaca

SEQ ID NO: 306951 - DNA, 75 bp, Artificial Sequence
  Synthetic
taagaatttctacgtcatcaagttttgataattcattatcaccattgaatgatggacaaacaacacgcacattta

SEQ ID NO: 306952 - DNA, 75 bp, Artificial Sequence
  Synthetic
atgcgtataaattggaagagatggtggcaagtcttttatacaatagttgattatgtcaatcaaattgtacaagtc

SEQ ID NO: 306953 - DNA, 75 bp, Artificial Sequence; identical to SEQ ID NO: 298688
  Synthetic

SEQ ID NO: 306954 - DNA, 75 bp, Artificial Sequence
  Synthetic
tttgtgatgagtcagcaattgccatgtttaagaaagagattgaagaatatattgagaatggtaaaaaaataacat

SEQ ID NO: 306955 - DNA, 75 bp, Artificial Sequence
  Synthetic
actatgactccgagacatcgggccatttatccagaaggttggatgctgagatacgcgtaaacaagatcatgtggc

SEQ ID NO: 306956 - DNA, 75 bp, Artificial Sequence
  Synthetic
ggcatttaaaaaagaagaagctgtctgacaaactggtcttctttttaaatggtttgtacgacattgtacactgtt

SEQ ID NO: 306957 - DNA, 75 bp, Artificial Sequence
  Synthetic
tgcgccattctcttcattcttttcatttatatattattatttagaaaaatgttccacctaataactgatacttta

SEQ ID NO: 306958 - DNA, 75 bp, Artificial Sequence
  Synthetic
tttatatattattatttagaaaaatgttccacctaataactgatactttaatagtgatacttattttatctaatt

SEQ ID NO: 306959 - DNA, 75 bp, Artificial Sequence
  Synthetic
gttccacctaataactgatactttaatagtgatacttattttatctaattgtgtagagtggtcacaatgtcaaat

SEQ ID NO: 306960 - DNA, 75 bp, Artificial Sequence
  Synthetic
ctactgatccttttaatgttgaatctttatgtatttattttccaaatgcagttgtaggatcacaaggaccaggta

SEQ ID NO: 306961 - DNA, 75 bp, Artificial Sequence
  Synthetic
tttatgtatttattttccaaatgcagttgtaggatcacaaggaccaggtaaatctgatggacatttgaatgatgg

SEQ ID NO: 306962 - DNA, 75 bp, Artificial Sequence
  Synthetic
tataaatacatcatgtcagtcaaattgtcaggccatcatgttcacaatttcacgaatgaaattatatgacattaa

SEQ ID NO: 306963 - DNA, 75 bp, Artificial Sequence
  Synthetic
ataaacaatttatgggctgcatttggtagtgactgcgatatatctgtctgtccattagatactacaagtaatgga

SEQ ID NO: 306964 - DNA, 75 bp, Artificial Sequence
  Synthetic
cacataatctaaatatattaaccatctacacatgaccctctatgagcacaatagttaaaagctaacactgtcaaa

SEQ ID NO: 306965 - DNA, 75 bp, Artificial Sequence
  Synthetic
aaaaaattgtattaagggtgaggctcggctgaatactgcactaataaggatttcaacatcatcaagttttgataa

SEQ ID NO: 306966 - DNA, 75 bp, Artificial Sequence
  Synthetic
tattactacagaaaatcttgaactggaatattcagataaaaccattaattatttaatatcagaagagatgtcaga

SEQ ID NO: 306967 - DNA, 75 bp, Artificial Sequence
  Synthetic
tagatcacctgacccgttgacgtttccaaatatagctttaatatactcatttagttttcatgtaggatataggaa

SEQ ID NO: 306968 - DNA, 75 bp, Artificial Sequence
  Synthetic
ggctttaaaagagagaatttccgactggctgccggatagctaatttttatgtatggtattgaatataccacagtt

SEQ ID NO: 306969 - DNA, 75 bp, Artificial Sequence
  Synthetic
atgtccaagcgatcacgctccttagattctgctgccttttattaccgagtctagatatatcttaagttagaattg

SEQ ID NO: 306970 - DNA, 75 bp, Artificial Sequence
  Synthetic
ctatcaatgtcatctgcttcaaacggtgtgttgaaggaaatagattttggaggacagaaagtgaggtctaccaag

SEQ ID NO: 306971 - DNA, 75 bp, Artificial Sequence
  Synthetic
tgtataatgggaggtatacaacagatataccgccagtggatgagaggagtccgattcctttaggtagaagggatg

SEQ ID NO: 306972 - DNA, 75 bp, Artificial Sequence
  Synthetic
ggtaacgttgagactatcataaattctactgatccttttaatgttgaatctttatgtatttattttccaaatgca

SEQ ID NO: 306973 - DNA, 75 bp, Artificial Sequence
  Synthetic
aacacatttatacaaacaatgacgcctagacatcgggctatataccctgaaggttggatgctgagatacgcgtaa

SEQ ID NO: 306974 - DNA, 75 bp, Artificial Sequence
  Synthetic
tggctagcggttagctccttttaatgtatggtattgaatataccacaactctaacttttttgatattgcttgtat

SEQ ID NO: 306975 - DNA, 75 bp, Artificial Sequence
  Synthetic
gctgtctgacaaactggtcttctttttaaatggtttgtacgacgttgtacactgtttgcgcaattctctgcattc

SEQ ID NO: 306976 - DNA, 75 bp, Artificial Sequence
  Synthetic
ttaaatggtttgtacgacgttgtacactgtttgcgcaattctctgcattctttttatttatatgttgttgttcag

SEQ ID NO: 306977 - DNA, 75 bp, Artificial Sequence
  Synthetic
ctgtttcctatgaaatccattttagccttgaattcaactttcaaagtgtttgatgaagtggactatgttattaat

SEQ ID NO: 306978 - DNA, 75 bp, Artificial Sequence
  Synthetic
ctaattgtattggatggtcacaaggtcaaatgttcactgatgatatacattatgatggaaacgttgagacaataa

SEQ ID NO: 306979 - DNA, 75 bp, Artificial Sequence
  Synthetic
aatgcagttgtaggttctcaagggcccggcaagacagatggatatctaaatgatggcaattatgctcaaactatt

SEQ ID NO: 306980 - DNA, 75 bp, Artificial Sequence
  Synthetic
aacatacacaaaggtctcagattttatagattcagtggaaatgacatgttcatataatatagttataatacctga

SEQ ID NO: 306981 - DNA, 75 bp, Artificial Sequence
  Synthetic
catataatatagttataatacctgatagttcagctaaattggaagaaatagaacgaatcgcagaatggattttga

SEQ ID NO: 306982 - DNA, 75 bp, Artificial Sequence
  Synthetic
acaatgccactgctaccatcagctattaaacgaacgttacattattttggattaagaacacataattatgatatt

SEQ ID NO: 306983 - DNA, 75 bp, Artificial Sequence
  Synthetic
actgggatagacaatttgtgggctgcttttgggagtgattgcgacatatcagtctgtccgttagatacgacaatg

SEQ ID NO: 306984 - DNA, 75 bp, Artificial Sequence
  Synthetic
cttttgggagtgattgcgacatatcagtctgtccgttagatacgacaatgaatggaattggctgctcaccggcta

SEQ ID NO: 306985 - DNA, 75 bp, Artificial Sequence
  Synthetic
aacgtagtagataatataaagcaccggattcaaatgaatacggcgaactgcaagttaaagaactgtattaaaggt

SEQ ID NO: 306986 - DNA, 75 bp, Artificial Sequence
  Synthetic
ggattcaaatgaatacggcgaactgcaagttaaagaactgtattaaaggtgaagccagactgaatactgcgttaa

SEQ ID NO: 306987 - DNA, 75 bp, Artificial Sequence
  Synthetic
caatcatgtcattcacactccaatggctaagactccaacagccgtatttatgatagatttagccttaagattaaa

SEQ ID NO: 306988 - DNA, 75 bp, Artificial Sequence
  Synthetic
gatggccaaacaacacgatcattcagaataaatgcaaaaaaatggtggacaatattttatactataattgattac

SEQ ID NO: 306989 - DNA, 75 bp, Artificial Sequence
  Synthetic
agagatgcctgactatgttatgcttcgtgacatggcggtagataatccatattcagccgaggctggaaagatagt

SEQ ID NO: 306990 - DNA, 75 bp, Artificial Sequence
  Synthetic
atcaatacaatcatacaaaatatgactccaaggcatcgagccatttatccagaagggtggatgctgagatacgcg

SEQ ID NO: 306991 - DNA, 75 bp, Artificial Sequence
  Synthetic
catcaattgattcaacctctaaccacaagaaacatcacagaattaatcccaacccaactgtaccacgatccaaat

SEQ ID NO: 306992 - DNA, 75 bp, Artificial Sequence
  Synthetic
tggctatcggatagctccttttaatgtatggtattgaatataccacagttctaacttttttgatatcgcttgtat

SEQ ID NO: 306993 - DNA, 75 bp, Artificial Sequence
  Synthetic
tcttaacaaattcacgatttgttccaccttatctggtacaagatcgaataggattacacgatggatttgaatcaa

SEQ ID NO: 306994 - DNA, 75 bp, Artificial Sequence
  Synthetic
accttatctggtacaagatcgaataggattacacgatggatttgaatcaatatgggacacgaaaacacatgctga

SEQ ID NO: 306995 - DNA, 75 bp, Artificial Sequence
  Synthetic
ctgaatggcaatacttttcatactggtggaattggaacacagcctcagaaagaatggaccttccagctaccacag

SEQ ID NO: 306996 - DNA, 75 bp, Artificial Sequence
  Synthetic
ttttggaatgaaggctcaacagcgttaagcaacgaagtgataaatttttcctggaatgttggtggcgtgttaatt

SEQ ID NO: 306997 - DNA, 75 bp, Artificial Sequence
  Synthetic
aggtgtgattgattatttagcttcatttatagaggcagtgtgtgatgatgaaatagtcagagaagcatctagaaa

SEQ ID NO: 306998 - DNA, 75 bp, Artificial Sequence
  Synthetic
aaatagtcagagaagcatctagaaatggaatgcaaccacaatctccagctcttataacactatcctctccaaaat

SEQ ID NO: 306999 - DNA, 75 bp, Artificial Sequence
  Synthetic
ttttaatagtgatagcttcaattgggaagaatggacacataattttcctcgcagtgagagcatgaacatttatac

SEQ ID NO: 307000 - DNA, 75 bp, Artificial Sequence
  Synthetic
ttctcagtctattaaaaattggagcgctcaatcaaggcgtgaaaatccagtctatgaatacaaaaatccaatggt

SEQ ID NO: 307001 - DNA, 75 bp, Artificial Sequence
  Synthetic
gctcaatcaaggcgtgaaaatccagtctatgaatacaaaaatccaatggtatttgaatacaggaattcatatatt

SEQ ID NO: 307002 - DNA, 75 bp, Artificial Sequence
  Synthetic
tacttctgggaatacgtgccaagttgcagcctttgactcaacgtttgctgagaatgcgccaaataacactcagcg

SEQ ID NO: 307003 - DNA, 75 bp, Artificial Sequence
  Synthetic
gcagcctttgactcaacgtttgctgagaatgcgccaaataacactcagcgcttcatttataatgggaggcttaaa

SEQ ID NO: 307004 - DNA, 75 bp, Artificial Sequence
  Synthetic
taacaatccaactgttttgcctgatccaacaaaccagacgacgtggttgtttaatcctgtgcaagtgatgaatgg

SEQ ID NO: 307005 - DNA, 75 bp, Artificial Sequence
  Synthetic
ccaacaaaccagacgacgtggttgtttaatcctgtgcaagtgatgaatggaactttcactattgaattttataat

SEQ ID NO: 307006 - DNA, 75 bp, Artificial Sequence
  Synthetic
aacatttgattcatatagaatcacagttgatgtgattagaccagcagctatgacgcaatatgtccagagactgtt

SEQ ID NO: 307007 - DNA, 75 bp, Artificial Sequence
  Synthetic
gttgatgtgattagaccagcagctatgacgcaatatgtccagagactgtttccgcaaggtggtccttatactcat

SEQ ID NO: 307008 - DNA, 75 bp, Artificial Sequence
  Synthetic
tacaaacaaaaaatgttgatgctagtgactagatttgtttcaaagttgtatatatttgatgctccaaaaattcca

SEQ ID NO: 307009 - DNA, 75 bp, Artificial Sequence
  Synthetic
agttctatgcgattcacattctgttgattattcaattgttgcaaatgttagaagagattcagctatgcctgcagg

SEQ ID NO: 307010 - DNA, 75 bp, Artificial Sequence
  Synthetic
aactgttttccaacctggatttccatgggaacaaactctttccaactacacagtcgcacaagaagataatttaga

SEQ ID NO: 307011 - DNA, 75 bp, Artificial Sequence
  Synthetic
cgaatgattcagttattgacgtcttatcaaagttggatacaactgttttcgctagcattgtaaaggacagagata

SEQ ID NO: 307012 - DNA, 75 bp, Artificial Sequence
  Synthetic
tatatacactatttcttaggaagatgttccatctattaactgatgcgttagctgttattctaatcatatctgcat

SEQ ID NO: 307013 - DNA, 75 bp, Artificial Sequence
  Synthetic
ttataaggcaagatcacaacaatttcagcttcaacattcagtttcaatgttggaatctaacttattctttgttgt

SEQ ID NO: 307014 - DNA, 75 bp, Artificial Sequence
  Synthetic
ggaaatattgaaggtgttataaatatgacaaatccattcaatgttgagtcattatgtatttattttccaaacgct

SEQ ID NO: 307015 - DNA, 75 bp, Artificial Sequence
  Synthetic
atgatgataacactaaatggagaatgagcgagtcaattcgccgagaaaagaaaaatgagatgagaacacatgcaa

SEQ ID NO: 307016 - DNA, 75 bp, Artificial Sequence
  Synthetic
aaacatacgaggtggtgtctaatgatactcaattggcacttattgatgtagttgataacgttaaacataggattc

SEQ ID NO: 307017 - DNA, 75 bp, Artificial Sequence
  Synthetic
agagtgatggtttgattaatgacaataattatgcccaaacactagcggttctttttgaaacaaaaggatttccta

SEQ ID NO: 307018 - DNA, 75 bp, Artificial Sequence
  Synthetic
tagttgataaacaaactgtaaaaaaaccgaaagttaaaatgactaaatcactagcttacagcgcaataaatacaa

SEQ ID NO: 307019 - DNA, 75 bp, Artificial Sequence
  Synthetic
ctactgatccctttaatgttgaatctttatgtatttattttccaaatgcagttgtaggatcacaaggaccaggta

SEQ ID NO: 307020 - DNA, 75 bp, Artificial Sequence
  Synthetic
agctaattctgaaacgattgaacaagtagctgagtgggttctcaacgtatggaaatgtgataatatgaatgtaga

SEQ ID NO: 307021 - DNA, 75 bp, Artificial Sequence
  Synthetic
aaatgattcagaatctattgaacagatagcagaatggattttaaatgtttggagatgtgatgacatgaatttgga

SEQ ID NO: 307022 - DNA, 75 bp, Artificial Sequence
  Synthetic
atagcagaatggattttaaatgtttggagatgtgatgacatgaatttggaaatttatacttatgaacaaattgga

SEQ ID NO: 307023 - DNA, 75 bp, Artificial Sequence
  Synthetic
gctgtctgacaaactggtcttctttttaaatggtttgtacaacattgtgcactgtttgcgtaattcttagtgtcc

SEQ ID NO: 307024 - DNA, 75 bp, Artificial Sequence
  Synthetic
actgtttgcgtaattcttagtgtcctattgatgtacattctagttttcagaaaaatggtccaccttatcactgat

SEQ ID NO: 307025 - DNA, 75 bp, Artificial Sequence
  Synthetic
tattgatgtacattctagttttcagaaaaatggtccaccttatcactgatacagtaattataactttagttatat

SEQ ID NO: 307026 - DNA, 75 bp, Artificial Sequence
  Synthetic
aacaagaaccagaaatttcaactaaatgaagggaagaaacaagcgctatctgtaccaatcactgcacaatatttt

SEQ ID NO: 307027 - DNA, 75 bp, Artificial Sequence
  Synthetic
tataatggaaatattgagacagtaattaatggtactaatccgtttgatgttaattccttatgtatatattttcca

SEQ ID NO: 307028 - DNA, 75 bp, Artificial Sequence
  Synthetic
ttaatggtactaatccgtttgatgttaattccttatgtatatattttccagcgtcagccgttggaagtccaggac

SEQ ID NO: 307029 - DNA, 75 bp, Artificial Sequence
  Synthetic
ctagatttagaattggcagaattgaaactaatgttgtcaaatctaggaatgaaaagagaagaaagagtgttgaat

SEQ ID NO: 307030 - DNA, 75 bp, Artificial Sequence
  Synthetic
gcaactttgtttgaaacaaaagggtttccaaaaggttcagttaattttataacatacgcaagacctgtagatttt

SEQ ID NO: 307031 - DNA, 75 bp, Artificial Sequence
  Synthetic
ttccaaaaggttcagttaattttataacatacgcaagacctgtagattttgtcaattcaatagatatgacatgtt

SEQ ID NO: 307032 - DNA, 75 bp, Artificial Sequence
  Synthetic
gaacaggtagctgagtggatacttaatgtgtggaagtgtgatgaaatgaatttagatatatatacatatgaacaa

SEQ ID NO: 307033 - DNA, 75 bp, Artificial Sequence
  Synthetic
gatatagtctttagaagacaatttatgaatgagatagtagaatggtttgaattgttttcacagtacataggtatg

SEQ ID NO: 307034 - DNA, 75 bp, Artificial Sequence
  Synthetic
atagggaataataacatatgggctgctttcggtgatgactgtgacatatcggtttgtccattagatacatcagcg

SEQ ID NO: 307035 - DNA, 75 bp, Artificial Sequence
  Synthetic
cgctttggacgcaatgactggtgaagttagattggatggtgattcttgttcttacaactcaactgctgcttttgt

SEQ ID NO: 307036 - DNA, 75 bp, Artificial Sequence
  Synthetic
taataatacagaaatagcattattaaatgtggttgataatgtacgacacagaattcaaatgaatcaagctaaatg

SEQ ID NO: 307037 - DNA, 75 bp, Artificial Sequence
  Synthetic
gaagaaaggttgaataccgcaatagtgagaatttccaattcgtcaagttttgataattcattatctccactaaac

SEQ ID NO: 307038 - DNA, 75 bp, Artificial Sequence
  Synthetic
tgataattcattatctccactaaacaatggacagaacacaagatccttcagaatcaacgcgatgaaatggtggaa

SEQ ID NO: 307039 - DNA, 75 bp, Artificial Sequence
  Synthetic
tggtgttttgatgatggtaggctaagaaagtatgatggtattggcaatccattaattgttgcaaattcaaagttc

SEQ ID NO: 307040 - DNA, 75 bp, Artificial Sequence
  Synthetic
caaatgatctaaatgtgaaacattcaattatagcagaagctgtggtatgcgacgaatctgtacatgtgtctgcgg

SEQ ID NO: 307041 - DNA, 75 bp, Artificial Sequence
  Synthetic
tcaatggcacctagacatagggctatatatccagaagggtggatgctgagatacgcgtaaacaagatcatgtggc

SEQ ID NO: 307042 - DNA, 75 bp, Artificial Sequence
  Synthetic
ttatatgtatttttaatgttaatttagatgatgatggatcaattatgtacatctgttacttgaaagttgggtcag

SEQ ID NO: 307043 - DNA, 75 bp, Artificial Sequence
  Synthetic
ttgtggtgatagtaatatctaattgtgtaggatggacacaaggtcaaatgttcattgatgatatgcattatgaag

SEQ ID NO: 307044 - DNA, 75 bp, Artificial Sequence
  Synthetic
agaaatgtttgaagatgaagatgtagatgaatgcacttgtagaaattgcccatataaagaaaaataccttaaact

SEQ ID NO: 307045 - DNA, 75 bp, Artificial Sequence
  Synthetic
ttgtaggatcacaggggcctggtcaaacaaatggctatttgaatgatggtaattatgctcagacaattgctactt

SEQ ID NO: 307046 - DNA, 75 bp, Artificial Sequence
  Synthetic
ttgaagatataattcaacagactaatgagttgattagaactttgaatggaagtacgttccatactggtggcattg

SEQ ID NO: 307047 - DNA, 75 bp, Artificial Sequence
  Synthetic
gctaaaacttcagattttatcagctctgtagagatgacatgctcatataatatagttataatacctgataatcca

SEQ ID NO: 307048 - DNA, 75 bp, Artificial Sequence
  Synthetic
ctgtagagatgacatgctcatataatatagttataatacctgataatccagacaagtcagaagcaatcgaacaaa

SEQ ID NO: 307049 - DNA, 75 bp, Artificial Sequence
  Synthetic
atttatacttatgaacagattggggtagagaatctatgggctgcttttggtgatgattgtgatatttccgtttgt

SEQ ID NO: 307050 - DNA, 75 bp, Artificial Sequence
  Synthetic
tagagaatctatgggctgcttttggtgatgattgtgatatttccgtttgtccattagataccacaatgaatggaa

SEQ ID NO: 307051 - DNA, 75 bp, Artificial Sequence
  Synthetic
accgagttagcattaattaatgttgtgaataatgtaaaacatagaattcagatgaatactggtcattgtaagttg

SEQ ID NO: 307052 - DNA, 75 bp, Artificial Sequence
  Synthetic
gattaaacacggcgattataagaatttcaaaatcatcaagttttgataattcgctgtcaccaatgaataacggcc

SEQ ID NO: 307053 - DNA, 75 bp, Artificial Sequence
  Synthetic
tggctagcggatagctccttttaatgtatggtattgaatataccacagttctattctacttgatatcattcgttc

SEQ ID NO: 307054 - DNA, 75 bp, Artificial Sequence
  Synthetic
tacagagtagcattcatagttgtgacactatcaatgctatctaacgcacagaattacgggataaatttaccaatt

SEQ ID NO: 307055 - DNA, 75 bp, Artificial Sequence
  Synthetic
cactatcaatgctatctaacgcacagaattacgggataaatttaccaattactggatctatggatacagcgtaca

SEQ ID NO: 307056 - DNA, 75 bp, Artificial Sequence
  Synthetic
tatccaaccgaggcttcaacgcaaattaacgataatgaatggaaagatactttgtctcaactatttttgactaaa

SEQ ID NO: 307057 - DNA, 75 bp, Artificial Sequence
  Synthetic
ttaacgataatgaatggaaagatactttgtctcaactatttttgactaaaggatggcctacaggttcagtttatt

SEQ ID NO: 307058 - DNA, 75 bp, Artificial Sequence
  Synthetic
gggactacgacactcttgctagtgattatcttagatttgtttatgattttgacgacgtcacgtatcagaacaact

SEQ ID NO: 307059 - DNA, 75 bp, Artificial Sequence
  Synthetic
tgtgattataacattgttttagttagatttactgctggacaagaattagatatatctgagttggcagatttaata

SEQ ID NO: 307060 - DNA, 75 bp, Artificial Sequence
  Synthetic
gatttactgctggacaagaattagatatatctgagttggcagatttaatactaaatgaatggttatgcaatccaa

SEQ ID NO: 307061 - DNA, 75 bp, Artificial Sequence
  Synthetic
atctcaatgggatcgtcgtgtactattaaagtatgtccattgaacacgcagactttgggaattggatgccaaaca

SEQ ID NO: 307062 - DNA, 75 bp, Artificial Sequence
  Synthetic
ttaaagtatgtccattgaacacgcagactttgggaattggatgccaaacaacaaatgtaggcacttttgaagtgg

SEQ ID NO: 307063 - DNA, 75 bp, Artificial Sequence
  Synthetic
cataaactagatgtaacttcaacaacatgtacaatacgaaattgtaataaattaggaccaagagaaaatgtagca

SEQ ID NO: 307064 - DNA, 75 bp, Artificial Sequence
  Synthetic
catgtacaatacgaaattgtaataaattaggaccaagagaaaatgtagcaataatacaagttggcggttctgacg

SEQ ID NO: 307065 - DNA, 75 bp, Artificial Sequence
  Synthetic
aaacgcatctagattggagaagttgttttctattgtagccgctacaataaataaatacggcatgccaagacataa

SEQ ID NO: 307066 - DNA, 75 bp, Artificial Sequence
  Synthetic
atgcgtgtgaattggaaaagatggtggcaagatttttacactgtagtcgattatattaatcaaatagtacaagtg

SEQ ID NO: 307067 - DNA, 75 bp, Artificial Sequence
  Synthetic
atgcgtgtgaattggaaaagatggtggcaagttttttacactgtagtcgattatattaatcaaatagtacaagtg

SEQ ID NO: 307068 - DNA, 75 bp, Artificial Sequence
  Synthetic
atgcgtgtgaattggaaaagatggtggcaagctttttacactgtagtcgattatattaatcaaatagtacaagtg

SEQ ID NO: 307069 - DNA, 75 bp, Artificial Sequence
  Synthetic
atgcgtgtgaattggaaaagatggtggcaaggtttttacactgtagtcgattatattaatcaaatagtacaagtg

SEQ ID NO: 307070 - DNA, 75 bp, Artificial Sequence
  Synthetic
ggctttaaaaattgcgacaatgtctgattttggaattaatcttgatgccatttgcgacaatgttaaaaaaggtaa

SEQ ID NO: 307071 - DNA, 75 bp, Artificial Sequence
  Synthetic
atgtccaaaagatcaagatcactagattcatcttccttttattatagagtgtagagtgttcttagattagaattg

SEQ ID NO: 307072 - DNA, 75 bp, Artificial Sequence
  Synthetic
gacaaactggtcttctttttaaatggtttgtacaactttgtacactgtttgcgcagttctctgcatcttattgat

SEQ ID NO: 307073 - DNA, 75 bp, Artificial Sequence
  Synthetic
gcgcagttctctgcatcttattgatatatacattatttcttcggaagatgttccatctgttgactgatgcgttag

SEQ ID NO: 307074 - DNA, 75 bp, Artificial Sequence
  Synthetic
atatacattatttcttcggaagatgttccatctgttgactgatgcgttagttgtcgttctaatcatatctacatg

SEQ ID NO: 307075 - DNA, 75 bp, Artificial Sequence
  Synthetic
atgctattcaggagaaagatgaaactgttccgcaaatagaccatcgtattatgaagtggatgttggattctcacg

SEQ ID NO: 307076 - DNA, 75 bp, Artificial Sequence
  Synthetic
tcagttttcatgtaggatataggaaacaagcgctgtctgatgccgtgtatgaccagattacagttacgtatgatg

SEQ ID NO: 307077 - DNA, 75 bp, Artificial Sequence
  Synthetic
gtgaaagaaacagaaaatgagattactgaaatgaaatcaaagacaaatttattagttaacgcttcagtagacatt

SEQ ID NO: 307078 - DNA, 75 bp, Artificial Sequence
  Synthetic
aggatccgtcatcttcaaaacatatacaaaaacatcagattttataagttcagtggaaatgacttgttcatataa

SEQ ID NO: 307079 - DNA, 75 bp, Artificial Sequence
  Synthetic
aggacagaaagtgaggtctacaaagaagaacatgcatgtaattgatgacatgtataatgggaggtatacaacaga

SEQ ID NO: 307080 - DNA, 75 bp, Artificial Sequence
  Synthetic
aacgtattaatcgatatgatcaatgaaatgtagtcgagtacttgcccgtactgcatcaggtgactgaaatcagca

SEQ ID NO: 307081 - DNA, 75 bp, Artificial Sequence
  Synthetic
aagataatctgtgggcagcatttggtgaagattgtgacatatctgtttgtccattagatacaacaatgaatggaa

SEQ ID NO: 307082 - DNA, 75 bp, Artificial Sequence
  Synthetic
actcaattgacgcttattgatgtagttgataatgttaaacatagaattcagatgtcatcaactctaaatcaacta

SEQ ID NO: 307083 - DNA, 75 bp, Artificial Sequence
  Synthetic
aattataagaatttctacatcatcaagtttcgataattcattatcacccctaaataatggacagacaacacgaac

SEQ ID NO: 307084 - DNA, 75 bp, Artificial Sequence
  Synthetic
aatacattagtacaaacaatgacgcccagacatcgggctatatatcctgaaggttggatgctgagatacgcgtaa

SEQ ID NO: 307085 - DNA, 75 bp, Artificial Sequence
  Synthetic
ccttgaattcaactttcaaagtattcgatgaagtggattatgttattaattacccgatctcaaatttattcattc

SEQ ID NO: 307086 - DNA, 75 bp, Artificial Sequence
  Synthetic
gatcgatggcgtcttcactttatcagcaattaatctctcagaattattattctattggaaatgacatattgttag

SEQ ID NO: 307087 - DNA, 75 bp, Artificial Sequence
  Synthetic
tctattggaaatgacatattgttagatcaacaaacaactaaaactactatagattatgttgatgtaggtaattat

SEQ ID NO: 307088 - DNA, 75 bp, Artificial Sequence
  Synthetic
atcaacaaacaactaaaactactatagattatgttgatgtaggtaattatacatatacacaattacctccaacta

SEQ ID NO: 307089 - DNA, 75 bp, Artificial Sequence
  Synthetic
actggaccgattataggtacgaatgttgacttagataatttgccaaatgctagtatatggttgttatatcaaaag

SEQ ID NO: 307090 - DNA, 75 bp, Artificial Sequence
  Synthetic
ttgacttagataatttgccaaatgctagtatatggttgttatatcaaaagccaaatattaaaacaaaattactta

SEQ ID NO: 307091 - DNA, 75 bp, Artificial Sequence
  Synthetic
aaccatgttgtgtgctaaagtggaaaaagatcagaggagtaattattatgatactatactatatggtgtggcacc

SEQ ID NO: 307092 - DNA, 75 bp, Artificial Sequence
  Synthetic
tatggcaaagctaacgatactataacatcagattattactcaacattaaccaataacagtgtcacattatctact

SEQ ID NO: 307093 - DNA, 75 bp, Artificial Sequence
  Synthetic
catcagattattactcaacattaaccaataacagtgtcacattatctactgattcattagtattattttggaacg

SEQ ID NO: 307094 - DNA, 75 bp, Artificial Sequence
  Synthetic
attatgagtcagaacaatataccgaaatagctaatctgttagcagatgtattgaatatggtgtctatgccaaccg

SEQ ID NO: 307095 - DNA, 75 bp, Artificial Sequence
  Synthetic
cactcctggtatcgaagaattatatgagattgtgaataagagtgctaatgaaataagaagctattttgcgtcatt

SEQ ID NO: 307096 - DNA, 75 bp, Artificial Sequence
  Synthetic
ttgaatatggtgtctatgccaaccgaaaaatttcaatttgacatagttaaaacagtagtgcaagttaggcatctt

SEQ ID NO: 307097 - DNA, 75 bp, Artificial Sequence
  Synthetic
ggtggcatattaattaaaacgacgaataatagtagagcagatatatgtatggctaatatgagaaattttaacgat

SEQ ID NO: 307098 - DNA, 75 bp, Artificial Sequence
  Synthetic
ataatagtagagcagatatatgtatggctaatatgagaaattttaacgatgatgttttctattgggaagaatgga

SEQ ID NO: 307099 - DNA, 75 bp, Artificial Sequence
  Synthetic
tgtaaaattaagagtaaaagcagttatgattgcatgtaatttagtaaatgaaactgaaactactccattgacaga

SEQ ID NO: 307100 - DNA, 75 bp, Artificial Sequence
  Synthetic
gctaatgaagatccatatggtcagctcaaactattgcaacagccaacaacaactattagaatgaatatgatgaaa

SEQ ID NO: 307101 - DNA, 75 bp, Artificial Sequence
  Synthetic
tcaaactattgcaacagccaacaacaactattagaatgaatatgatgaaagttagtagaaatggactaattaata

SEQ ID NO: 307102 - DNA, 75 bp, Artificial Sequence
  Synthetic
ggcttatattagatataattttaataaatttgcagctatatctcatggcaaacggcattggagacttgttcttca

SEQ ID NO: 307103 - DNA, 75 bp, Artificial Sequence
  Synthetic
agagatataacgcttgaatgtaaaatagagtctgaagttattaaaggtggtggatggggttatgattacactagt

SEQ ID NO: 307104 - DNA, 75 bp, Artificial Sequence
  Synthetic
tagagtctgaagttattaaaggtggtggatggggttatgattacactagtatatcatttaaaacagtaaatcaca

SEQ ID NO: 307105 - DNA, 75 bp, Artificial Sequence
  Synthetic
agctttaacaatatgaaagaaagatcatatggtggttcattgccaactgactttaaaataaaacggtttgaaatt

SEQ ID NO: 307106 - DNA, 75 bp, Artificial Sequence
  Synthetic
catatggtggttcattgccaactgactttaaaataaaacggtttgaaattatggatattggtacttacatgtata

SEQ ID NO: 307107 - DNA, 75 bp, Artificial Sequence
  Synthetic
gatttaaatgctaatattggtagtttcttttattatgctgaaatgtcatactattttaaaattcctgtaggtgca

SEQ ID NO: 307108 - DNA, 75 bp, Artificial Sequence
  Synthetic
ttttggaatgaaggctcaacagcattaagtaacaaagtgatcaatttttcctggaatgttggtggcgtgttaatt

SEQ ID NO: 307109 - DNA, 75 bp, Artificial Sequence
  Synthetic
catccaggattacattcgtcaggagtaaggtttgtatatgaaaaatgtcttttatcacaacaattcactgaccaa

SEQ ID NO: 307110 - DNA, 75 bp, Artificial Sequence
  Synthetic
ttggttcatgacgtcaggtaatattaatactagacggatagcatcaggaactggattcgcatatgcagacgggca

SEQ ID NO: 307111 - DNA, 75 bp, Artificial Sequence
  Synthetic
agaggtaaggtacgttagagatataacacttcagtgtaaaattgagtctgaagttgttaaaggtggtggatgggg

SEQ ID NO: 307112 - DNA, 75 bp, Artificial Sequence
  Synthetic
atccaaattatcagacaccaatagcatcatcaagcacagtcaggatggatttagaaaggaaaataaatgacttac

SEQ ID NO: 307113 - DNA, 75 bp, Artificial Sequence
  Synthetic
atcatcaagcacagtcaggatggatttagaaaggaaaataaatgacttacgtaatgactttaaacaactagctaa

SEQ ID NO: 307114 - DNA, 75 bp, Artificial Sequence
  Synthetic
ttagaaaggaaaataaatgacttacgtaatgactttaaacaactagctaattcagttgctttaggtgacattcta

SEQ ID NO: 307115 - DNA, 75 bp, Artificial Sequence
  Synthetic
tgctataacttcatcagttaaagatgttgcagccaatgtaatgaaaaaattcagaaataccaagatgtttaaaaa

SEQ ID NO: 307116 - DNA, 75 bp, Artificial Sequence
  Synthetic
atgtaacgaatgttgcaagaaattcaaagagcatgaattttgatgatattacatctgctgtgatggtgtcaacta

SEQ ID NO: 307117 - DNA, 75 bp, Artificial Sequence
  Synthetic
ttgcattcatcaggagtaagatttacatatgagaggagtctattatctcaacaatttactgatcaggtagcgctt

SEQ ID NO: 307118 - DNA, 75 bp, Artificial Sequence
  Synthetic
agatcagctgataattttatccctaatagatcatacagaatgatagaagacggtattgtgtatgaagcgacacca

SEQ ID NO: 307119 - DNA, 75 bp, Artificial Sequence
  Synthetic
atagatcatacagaatgatagaagacggtattgtgtatgaagcgacaccaaaacgaactttctcgtatgatcttg

SEQ ID NO: 307120 - DNA, 75 bp, Artificial Sequence
  Synthetic
tctaaatcaccagtaatatctgcaatagtagattttgcaacattaaagactatgagagaaacatatggtgtagga

SEQ ID NO: 307121 - DNA, 75 bp, Artificial Sequence
  Synthetic
atttatcgataataacaacccgttgattaaaaatagaattgaggaactattaagacaatgtagattatagacggt

SEQ ID NO: 307122 - DNA, 75 bp, Artificial Sequence
  Synthetic
gctgtctgacaaactggtcttctttttaaatggtttgtacaacattgtgcactgtttgcgtgatccttagtatcc

SEQ ID NO: 307123 - DNA, 75 bp, Artificial Sequence
  Synthetic
actgtttgcgtgatccttagtatcctattagtgtatattctaatttttagaaaaatgttccaccttattattgat

SEQ ID NO: 307124 - DNA, 75 bp, Artificial Sequence
  Synthetic
ggcttttaaaagcacttgctggaaatggcgactcaggcttccgttgaatggatttttaacgtagctggatcagct

SEQ ID NO: 307125 - DNA, 75 bp, Artificial Sequence
  Synthetic
tattagtgtatattctaatttttagaaaaatgttccaccttattattgatacagcagttatcactttaattgtat

SEQ ID NO: 307126 - DNA, 75 bp, Artificial Sequence
  Synthetic
gatttttaacgtagctggatcagctgcttcgtcttctttagatagagcgatcaaggatgcaggagggagtgaaag

SEQ ID NO: 307127 - DNA, 75 bp, Artificial Sequence
  Synthetic
cttctcaaaatatgttatcacaaaattctatgataattataaagattgcattgatgattctggtgtgtataatgc

SEQ ID NO: 307128 - DNA, 75 bp, Artificial Sequence
  Synthetic
tatgatggaaatattgagacggtagttaatggtactaatccatttggcattgattctttatgcatatattttcca

SEQ ID NO: 307129 - DNA, 75 bp, Artificial Sequence
  Synthetic
ttgatgattctggtgtgtataatgcatgcataggtagagctaagactatagataaagcattaaataatccaaaag

SEQ ID NO: 307130 - DNA, 75 bp, Artificial Sequence
  Synthetic
ttaatggtactaatccatttggcattgattctttatgcatatattttccagcatcagctgttggaagtccaggac

SEQ ID NO: 307131 - DNA, 75 bp, Artificial Sequence
  Synthetic
ccaccaccataattatatatctagacaaagaaattgtaaaccaggtgaatgaagcattcgatcttttgaattcaa

SEQ ID NO: 307132 - DNA, 75 bp, Artificial Sequence
  Synthetic
tacaaatgtagcaacaatcagtagacttgatttagagttagcagaattaaaattgatgttatctaatctaggaat

SEQ ID NO: 307133 - DNA, 75 bp, Artificial Sequence
  Synthetic
gcagctttatttgaaacgaaaggatttccgaagggttcagttaattttatcacatatgctagacctgtagatttt

SEQ ID NO: 307134 - DNA, 75 bp, Artificial Sequence
  Synthetic
ttccgaagggttcagttaattttatcacatatgctagacctgtagattttattacttcaatagatatgacttgtt

SEQ ID NO: 307135 - DNA, 75 bp, Artificial Sequence
  Synthetic
tcaatgttctctgtggtgagagaaaaaggcagatcatcaaacgtaattatgatgaaacaaaatgcagtgaaaatg

SEQ ID NO: 307136 - DNA, 75 bp, Artificial Sequence
  Synthetic
gatgaaacaaaatgcagtgaaaatgattgaagaaggaaagttcaaaattaaagtggaaagaaatgaaacatatac

SEQ ID NO: 307137 - DNA, 75 bp, Artificial Sequence
  Synthetic
gaacagatagttgaatggattctaaatgtatggaggtgtgatgaagtgaatttagatatatacacatatgaacaa

SEQ ID NO: 307138 - DNA, 75 bp, Artificial Sequence
  Synthetic
aagtggaaagaaatgaaacatatactgaatcactaaaaaataaaatagaagaattggaatgtataatagatgcat

SEQ ID NO: 307139 - DNA, 75 bp, Artificial Sequence
  Synthetic
atgtatggaggtgtgatgaagtgaatttagatatatacacatatgaacaagtgggaaatgacaacatatgggctg

SEQ ID NO: 307140 - DNA, 75 bp, Artificial Sequence
  Synthetic
tgatttagatgcaatgaacggtgaggttaaattggacggaaattcatgttcatataattcaactgctgcttttgt

SEQ ID NO: 307141 - DNA, 75 bp, Artificial Sequence
  Synthetic
aatggaataggatgcattcctgctagtttagacacttatgaagtaatatcaaataatacagaggtagcactatta

SEQ ID NO: 307142 - DNA, 75 bp, Artificial Sequence
  Synthetic
gtttagacacttatgaagtaatatcaaataatacagaggtagcactattaaatgtggttgataatgtaagacata

SEQ ID NO: 307143 - DNA, 75 bp, Artificial Sequence
  Synthetic
ctttgtttgatgtgggaaattatatgaatccaaaaaccattatcgaaaaaatgattgaattagaaattccaattt

SEQ ID NO: 307144 - DNA, 75 bp, Artificial Sequence
  Synthetic
gaatccaaaaaccattatcgaaaaaatgattgaattagaaattccaattttcaaatcagattataggaatgatga

SEQ ID NO: 307145 - DNA, 75 bp, Artificial Sequence
  Synthetic
gaagaaagattgaatactgcaatagtgcgaatttctaattcctctagtttcgataattcattatctccattgaat

SEQ ID NO: 307146 - DNA, 75 bp, Artificial Sequence
  Synthetic
aatattttacactatagttgattatgtaaacatatttattcagtcaatggcacctagacacagagccatatatcc

SEQ ID NO: 307147 - DNA, 75 bp, Artificial Sequence
  Synthetic
gtaaacatatttattcagtcaatggcacctagacacagagccatatatccagaaggatggatgctaaggtacgcg

SEQ ID NO: 307148 - DNA, 75 bp, Artificial Sequence
  Synthetic
gcatttaaaatctcattcacaatggacgtgtttttttccattgcgaagactgtctcagatcttaaaaagaaagtt

SEQ ID NO: 307149 - DNA, 75 bp, Artificial Sequence
  Synthetic
tctgattgtcgcaaattcgaaatttcagattgataaaattttaatttccggagatatcgaattaaatcctggacc

SEQ ID NO: 307150 - DNA, 75 bp, Artificial Sequence
  Synthetic
tgtctcagatcttaaaaagaaagttgtagttggtactatttatacaaatgtagaagatataatccagcagactaa

SEQ ID NO: 307151 - DNA, 75 bp, Artificial Sequence
  Synthetic
tgaattgattagaactttaaatggtaacacatttcatactggtggaattggaacacaacctcagaaagagtggaa

SEQ ID NO: 307152 - DNA, 75 bp, Artificial Sequence
  Synthetic
cagaagcaattggtagtgggaaatctaagaagaaagctaaaagaattgcagcatatgacattcttgatcaacttg

SEQ ID NO: 307153 - DNA, 75 bp, Artificial Sequence
  Synthetic
tagctgagagaaatgaggactggcacacaaatttggctacgattagaagactagatttagaattggcagagttga

SEQ ID NO: 307154 - DNA, 75 bp, Artificial Sequence
  Synthetic
tgattatttggcctcattcatagaagctgtgtgtgatgacgaaattgtcagagaagcatcaagaaatggaatgca

SEQ ID NO: 307155 - DNA, 75 bp, Artificial Sequence
  Synthetic
acggagcactgagttaccgacttgactgtctgacagcaagtaaaaggtcaatggcagactgcttacagtgtggct

SEQ ID NO: 307156 - DNA, 75 bp, Artificial Sequence
  Synthetic
ttaattttaacaatagttcacaatccattaagaattggagtgctcagtcaagacgtgaaaatccagtttatgaat

SEQ ID NO: 307157 - DNA, 75 bp, Artificial Sequence
  Synthetic
cattaagaattggagtgctcagtcaagacgtgaaaatccagtttatgaatacagaaatccaatggtatttgaata

SEQ ID NO: 307158 - DNA, 75 bp, Artificial Sequence
  Synthetic
tgctggatacactaatagtcaattgtatactgatgatatatcgtacaacggtaatattgaaggtgtaataaatgc

SEQ ID NO: 307159 - DNA, 75 bp, Artificial Sequence
  Synthetic
tgggattgagatactacacagccagtaacgtctgtcagattgcagcttttgattcaactctcgctgaaaatgctc

SEQ ID NO: 307160 - DNA, 75 bp, Artificial Sequence
  Synthetic
cgccttagatgcaatgactggcgaagttaaactggatggtgattcttgttcctacaactcaactgctgcttttgt

SEQ ID NO: 307161 - DNA, 75 bp, Artificial Sequence
  Synthetic
taacgtctgtcagattgcagcttttgattcaactctcgctgaaaatgctcctaatggtactcagcggtttatcta

SEQ ID NO: 307162 - DNA, 75 bp, Artificial Sequence
  Synthetic
gttaaactggatggtgattcttgttcctacaactcaactgctgcttttgtttcaacaatcatgggcacaccaatc

SEQ ID NO: 307163 - DNA, 75 bp, Artificial Sequence
  Synthetic
caattggttcaccaggtccaggtaaggctgacggtttattgaatgataacaattacgcacagacgctggcaactt

SEQ ID NO: 307164 - DNA, 75 bp, Artificial Sequence
  Synthetic
ggctgacggtttattgaatgataacaattacgcacagacgctggcaactttgtttgaaacaaagggatttccaag

SEQ ID NO: 307165 - DNA, 75 bp, Artificial Sequence
  Synthetic
caggtgctccaaatattaacaatccaacaatactacctgatccagcaaatcagacaacatggttattcaatccgg

SEQ ID NO: 307166 - DNA, 75 bp, Artificial Sequence
  Synthetic
aaacccaaaacacgtcattgataaaatgattgaatcagagattccaatttttaaatcagattacagaaataatga

SEQ ID NO: 307167 - DNA, 75 bp, Artificial Sequence
  Synthetic
aacaatactacctgatccagcaaatcagacaacatggttattcaatccggtgcagataatgaatggaacattcac

SEQ ID NO: 307168 - DNA, 75 bp, Artificial Sequence
  Synthetic
ttaaatcagattacagaaataatgaatcaccggattttgataagtggaatgagaaaagcaatttgaaaattgtta

SEQ ID NO: 307169 - DNA, 75 bp, Artificial Sequence
  Synthetic
gagtggttactgtcagaacatttgatacttatagaatcacgattgatatgatcagaccagcagccatgacacagt

SEQ ID NO: 307170 - DNA, 75 bp, Artificial Sequence
  Synthetic
tggcccatatcaacatcaagctgcatacatgatgacactcagtatattagatgctacaacagaatcagttatgtg

SEQ ID NO: 307171 - DNA, 75 bp, Artificial Sequence
  Synthetic
cagattgacagaattttaatttctggagatgtcgagctaaatccaggtcctaacgctcttattaaattgaatgac

SEQ ID NO: 307172 - DNA, 75 bp, Artificial Sequence
  Synthetic
agatgatgatggatcaattatgtacatttgttacttgaaagttgggtcagcagaagctactgggaatggatgctc

SEQ ID NO: 307173 - DNA, 75 bp, Artificial Sequence
  Synthetic
ttgataacgttaaacataggattcaaatgtcatcaactttaaatcaattacagtgtaggttaaaaaattgtgtta

SEQ ID NO: 307174 - DNA, 75 bp, Artificial Sequence
  Synthetic
cagaagctactgggaatggatgctcaaaaaaagaagcgaaaagaagagcagcagtgagcatacttgatcagcttg

SEQ ID NO: 307175 - DNA, 75 bp, Artificial Sequence
  Synthetic
aatgtcatcaactttaaatcaattacagtgtaggttaaaaaattgtgttaagggtgagccacgattaaacactgc

SEQ ID NO: 307176 - DNA, 75 bp, Artificial Sequence
  Synthetic
taaataatggacagacaacacgaacattcaagattaatgcaaaaaaatggtggaagattttttatactataattg

SEQ ID NO: 307177 - DNA, 75 bp, Artificial Sequence
  Synthetic
attatattaatactctagtacaaacaatgacgcctagacaccgggctatatatcctgaaggttggatgctgagat

SEQ ID NO: 307178 - DNA, 75 bp, Artificial Sequence
  Synthetic
ggctttaaatttttcagatcactttgctctaggaagcaatggagttcatcaatcaaactttcttctctgactatg

SEQ ID NO: 307179 - DNA, 75 bp, Artificial Sequence
  Synthetic
aatcaaactttcttctctgactatgttgaagggaaaatagatactgttccatacgttttaggaatcattctcgcg

SEQ ID NO: 307180 - DNA, 75 bp, Artificial Sequence
  Synthetic
actcaggaaattactcatcacatcgaaaaacgtgattaacaaattcaagactgaaaataatgctactcatcaaaa

SEQ ID NO: 307181 - DNA, 75 bp, Artificial Sequence
  Synthetic
aaaaacgtgattaacaaattcaagactgaaaataatgctactcatcaaaacaacgatattcataaagaatatgaa

SEQ ID NO: 307182 - DNA, 75 bp, Artificial Sequence
  Synthetic
taatagtatacataaagacaatatggagtggagaatgagtgaatcaattcgcagagaaaagaagcgtgaaatgaa

SEQ ID NO: 307183 - DNA, 75 bp, Artificial Sequence
  Synthetic
tatgtgacacgtctggattagagacggaagtttgtctatgaatcttctgcgcttcctgctggtggacagccgcca

SEQ ID NO: 307184 - DNA, 75 bp, Artificial Sequence
  Synthetic
ggaagtttgtctatgaatcttctgcgcttcctgctggtggacagccgccattctgtccatttctagcgagtagag

SEQ ID NO: 307185 - DNA, 75 bp, Artificial Sequence
  Synthetic
ttctgtccatttctagcgagtagagaaaaacatcgtacccaagacgctgagttgaggatcgatgaagatgtgaaa

SEQ ID NO: 307186 - DNA, 75 bp, Artificial Sequence
  Synthetic
gatcaatggcgtcttcactttatcatcaattaatttctcagaattattattcaactggaaatgaaattttaaaag

SEQ ID NO: 307187 - DNA, 75 bp, Artificial Sequence
  Synthetic
tcaactggaaatgaaattttaaaagatctacagacaactaaaactactgttgattatgtaaatgctggaaattat

SEQ ID NO: 307188 - DNA, 75 bp, Artificial Sequence
  Synthetic
atctacagacaactaaaactactgttgattatgtaaatgctggaaattatacatatgctcagctgccaccaacaa

SEQ ID NO: 307189 - DNA, 75 bp, Artificial Sequence
  Synthetic
acaggaccacatacaaatggaataatagaatggaataatttgttaagttccaatcaatggttgctgtttcagaaa

SEQ ID NO: 307190 - DNA, 75 bp, Artificial Sequence
  Synthetic
tagaatggaataatttgttaagttccaatcaatggttgctgtttcagaaacctattaatacagtaaaattactaa

SEQ ID NO: 307191 - DNA, 75 bp, Artificial Sequence
  Synthetic
ttaaatggtttgtacgacgttgtacactgtttgcgcaatcctctgcattcttttcatttatatgttattgtttag

SEQ ID NO: 307192 - DNA, 75 bp, Artificial Sequence
  Synthetic
tatgggaaagctaattctacggtaacgtcagaacattattcatcattaagtggcagtcaagtgcatgtaaatagt

SEQ ID NO: 307193 - DNA, 75 bp, Artificial Sequence
  Synthetic
cgtcagaacattattcatcattaagtggcagtcaagtgcatgtaaatagtgactcattgatactattttggaacg

SEQ ID NO: 307194 - DNA, 75 bp, Artificial Sequence
  Synthetic
caaattgtatcggatggtcacagggacagttatttaccgatgacatgcattataacggaaatgttgagactataa

SEQ ID NO: 307195 - DNA, 75 bp, Artificial Sequence
  Synthetic
acagttatttaccgatgacatgcattataacggaaatgttgagactataattaatgctacagacacttttgaagt

SEQ ID NO: 307196 - DNA, 75 bp, Artificial Sequence
  Synthetic
ggcggaatattaattaagccatcaactcaaaaacctagattagtaatatgtatggctaacatgacaaattttaat

SEQ ID NO: 307197 - DNA, 75 bp, Artificial Sequence
  Synthetic
tatggctaacatgacaaattttaatagtgataatttcaattgggaagagtggtatctcacattaccccgtagtaa

SEQ ID NO: 307198 - DNA, 75 bp, Artificial Sequence
  Synthetic
caggtaaaacagacggacatttgaatgatggtaactacgcccagacaattgcagctctatttgaaacaaaaggat

SEQ ID NO: 307199 - DNA, 75 bp, Artificial Sequence
  Synthetic
tgatggtaactacgcccagacaattgcagctctatttgaaacaaaaggatttccaaaaggatcaataatacttaa

SEQ ID NO: 307200 - DNA, 75 bp, Artificial Sequence
  Synthetic
ataatcaactaaaggaattacaacgaccaaccattaccacatttgaaatgagaatgatgcaagtaactaaagatg

SEQ ID NO: 307201 - DNA, 75 bp, Artificial Sequence
  Synthetic
cttacaatatagttataataccagatagtcccactaattcagaagctatagaacaaatagcagaatggattctta

SEQ ID NO: 307202 - DNA, 75 bp, Artificial Sequence
  Synthetic
tagtcccactaattcagaagctatagaacaaatagcagaatggattcttaatacttggagatgtgatgatatgaa

SEQ ID NO: 307203 - DNA, 75 bp, Artificial Sequence
  Synthetic
aagtaaagattcattatggcaagaagtgagatatgcgagagacataacactgcaatgtaaaatagaatcagaggt

SEQ ID NO: 307204 - DNA, 75 bp, Artificial Sequence
  Synthetic
tgcaatgtaaaatagaatcagaggttattaaaggcggtggatggggatatgattacacaagtataagatttaaaa

SEQ ID NO: 307205 - DNA, 75 bp, Artificial Sequence
  Synthetic
cctttggtagtgattgtgatatatctgtttgtcctttggatactacgatgaatggaattggctgttcaccagcta

SEQ ID NO: 307206 - DNA, 75 bp, Artificial Sequence
  Synthetic
tgtttgtcctttggatactacgatgaatggaattggctgttcaccagctagcacagagacatacgaagtgctatc

SEQ ID NO: 307207 - DNA, 75 bp, Artificial Sequence
  Synthetic
catgttactattagcttcaataatttaaaagagagatcatatggaggctcattaccaactgactttaaaataggt

SEQ ID NO: 307208 - DNA, 75 bp, Artificial Sequence
  Synthetic
taaaagagagatcatatggaggctcattaccaactgactttaaaataggtaaatttgatataatagatgttgata

SEQ ID NO: 307209 - DNA, 75 bp, Artificial Sequence
  Synthetic
gaattcagatgaatactgctaactgtaaattaaaaaattgtgttaagggtgaagctaggttaaatactgcattaa

SEQ ID NO: 307210 - DNA, 75 bp, Artificial Sequence
  Synthetic
taaattaaaaaattgtgttaagggtgaagctaggttaaatactgcattaataagagtttcgacatcttcaagttt

SEQ ID NO: 307211 - DNA, 75 bp, Artificial Sequence
  Synthetic
aaataaatgcaaagaaatggtggaatatattttacactataattgattacattaacacaataatacaaactatgg

SEQ ID NO: 307212 - DNA, 75 bp, Artificial Sequence
  Synthetic
attcatcaggagtaaggtttgcatatgaaagatgtcttttatcgcagcaattcactgaccaagttacgcttaact

SEQ ID NO: 307213 - DNA, 75 bp, Artificial Sequence
  Synthetic
attaacacaataatacaaactatggcccctagacatagggctatttatccagaagggtggatgctgaggtatgcg

SEQ ID NO: 307214 - DNA, 75 bp, Artificial Sequence
  Synthetic
gctgtctgacaaactggtcttctttttaaatggtttgtgcaacattgtacactgtttgcgtagttctttgcatct

SEQ ID NO: 307215 - DNA, 75 bp, Artificial Sequence
  Synthetic
actgtttgcgtagttctttgcatcttattaatatatacattatttcttagaaagatgttccatctattaactgat

SEQ ID NO: 307216 - DNA, 75 bp, Artificial Sequence
  Synthetic
tattaatatatacattatttcttagaaagatgttccatctattaactgatgcactagttgttattctgattatat

SEQ ID NO: 307217 - DNA, 75 bp, Artificial Sequence
  Synthetic
tatgatggaaatattgagggtgtgataaatgtgacaaatccttttaatgttgaatcattatgcatttattttcca

SEQ ID NO: 307218 - DNA, 75 bp, Artificial Sequence
  Synthetic
taaatgtgacaaatccttttaatgttgaatcattatgcatttattttccaaacgctgcaataggttcgccaggtc

SEQ ID NO: 307219 - DNA, 75 bp, Artificial Sequence
  Synthetic
gtcaggatggatttagaaaggaaaataaatgatttacgtaatgactttaatcaactagctaattcagtcgcgtta

SEQ ID NO: 307220 - DNA, 75 bp, Artificial Sequence
  Synthetic
tttgtcgcaattatttctaaccaaaggatggccaactggttctgtctatcttaaaagttatacagatattgcaac

SEQ ID NO: 307221 - DNA, 75 bp, Artificial Sequence
  Synthetic
gcaacattatttgaaacaaaagggtttccaaaaggatcagtaatctttaaaacatactctaaaacttcggatttt

SEQ ID NO: 307222 - DNA, 75 bp, Artificial Sequence
  Synthetic
tgaatctgtgcctgtcattgcttcatcagttaaagatgttgcagccaatgtaatgaagaaatttagaaacacaaa

SEQ ID NO: 307223 - DNA, 75 bp, Artificial Sequence
  Synthetic
ataaactcagtagaaatgacttgttcatataatctggttattattcccgataaaccggatgattctgaagcaatt

SEQ ID NO: 307224 - DNA, 75 bp, Artificial Sequence
  Synthetic
atttgttggaagacgtaacgaatgtcgcaagaaattcaagtagtatgaattttgatgatattacatccgctgtga

SEQ ID NO: 307225 - DNA, 75 bp, Artificial Sequence
  Synthetic
cgcaagaaattcaagtagtatgaattttgatgatattacatccgctgtgatggtgtcaactactaataaattaca

SEQ ID NO: 307226 - DNA, 75 bp, Artificial Sequence
  Synthetic
tgttgaactatatattaaaatcaataaccagagttatggactatataatctatagttttttactttttgttgttg

SEQ ID NO: 307227 - DNA, 75 bp, Artificial Sequence
  Synthetic
gtgaataaagataatttatgggcagcatttggtgaagattgtgacatatctgtttgtcctctagacacaacgatg

SEQ ID NO: 307228 - DNA, 75 bp, Artificial Sequence
  Synthetic
attttatccctaatagatcatacagaatgatagaagatggtattgtgtatgaagcaacaccaaaacgaacttttt

SEQ ID NO: 307229 - DNA, 75 bp, Artificial Sequence
  Synthetic
aaataatactcaactagcgctaattaatgtagttgataatgttaaacatagagtacaaatgtcgtcaagtgtgaa

SEQ ID NO: 307230 - DNA, 75 bp, Artificial Sequence
  Synthetic
aatgtagttgataatgttaaacatagagtacaaatgtcgtcaagtgtgaaccaactccaatgtagattgaaaaat

SEQ ID NO: 307231 - DNA, 75 bp, Artificial Sequence
  Synthetic
gatcaatggcgtcttcactttaccatcaattaatctctcagaattactattcaactgggaatgagattttaaaag

SEQ ID NO: 307232 - DNA, 75 bp, Artificial Sequence
  Synthetic
atgcaactggcatctaaatcaccagtaatatctgcaatagtagattttgcaacattaaaggctatgagagaaaca

SEQ ID NO: 307233 - DNA, 75 bp, Artificial Sequence
  Synthetic
atgtccaagagatcacgatcactagattcagcagccgtttactacagaatctaaatatatcttaagttagaactg

SEQ ID NO: 307234 - DNA, 75 bp, Artificial Sequence
  Synthetic
taatatctgcaatagtagattttgcaacattaaaggctatgagagaaacatatggtttaggaacagatataatat

SEQ ID NO: 307235 - DNA, 75 bp, Artificial Sequence
  Synthetic
atcatcaagttttgataactcactatcgcctctaaacaacggacagatgacacgatcatttaagatcaatgcaaa

SEQ ID NO: 307236 - DNA, 75 bp, Artificial Sequence
  Synthetic
acatatgctcagctgccaccaacaaaatggggagctggagctaccttcgaatcagcgttcagtgctgcagaaata

SEQ ID NO: 307237 - DNA, 75 bp, Artificial Sequence
  Synthetic
aacaatccgttgattagaagcaggattgaagaactattaagacaatgtagattatagacggtgaggagaccagct

SEQ ID NO: 307238 - DNA, 75 bp, Artificial Sequence
  Synthetic
atagatgattatattaacacaattatacaaacgatgacgcccagacatcgggctatataccctgaaggttggatg

SEQ ID NO: 307239 - DNA, 75 bp, Artificial Sequence
  Synthetic
atagttgattatattaacacaattatacaaacgatgacgcccagacatcgggctatataccctgaaggttggatg

SEQ ID NO: 307240 - DNA, 75 bp, Artificial Sequence
  Synthetic
atagctgattatattaacacaattatacaaacgatgacgcccagacatcgggctatataccctgaaggttggatg

SEQ ID NO: 307241 - DNA, 75 bp, Artificial Sequence
  Synthetic
ataggtgattatattaacacaattatacaaacgatgacgcccagacatcgggctatataccctgaaggttggatg

SEQ ID NO: 307242 - DNA, 75 bp, Artificial Sequence
  Synthetic
gcatttaaaatctcattcacaatggacgtactattttccattgcgaagactgtctcagatcttaagaagaaagtt

SEQ ID NO: 307243 - DNA, 75 bp, Artificial Sequence
  Synthetic
tgatcaatggttactgttttcaaaacctattgatacagttaaattactaaagcatggaccacgaacatatgataa

SEQ ID NO: 307244 - DNA, 75 bp, Artificial Sequence
  Synthetic
tgtctcagatcttaagaagaaagttgtagttggtactatttacacaaatgtagaagatataatccagcaaactaa

SEQ ID NO: 307245 - DNA, 75 bp, Artificial Sequence
  Synthetic
gtagttggtactatttacacaaatgtagaagatataatccagcaaactaatgagttgattagaactttaaatggc

SEQ ID NO: 307246 - DNA, 75 bp, Artificial Sequence
  Synthetic
cctattgatacagttaaattactaaagcatggaccacgaacatatgataacactttagcagcgtgtgaattatgg

SEQ ID NO: 307247 - DNA, 75 bp, Artificial Sequence
  Synthetic
tgatagtcaagtgcgtgtaaatagtgactcattggtactattttggaatgcaggtggaacggtatttgataaaca

SEQ ID NO: 307248 - DNA, 75 bp, Artificial Sequence
  Synthetic
ttttcaactaccacagttgggtacaacgcttttgaatttagatgataactatgttcaagcgactagaagtattat

SEQ ID NO: 307249 - DNA, 75 bp, Artificial Sequence
  Synthetic
acgcttttgaatttagatgataactatgttcaagcgactagaagtattattgattatctggcatcatttatagaa

SEQ ID NO: 307250 - DNA, 75 bp, Artificial Sequence
  Synthetic
ctcaaaaacctagattagtcatatgcatggctaatatgacaaatttcaataatagtaattttaattgggaagagt

SEQ ID NO: 307251 - DNA, 75 bp, Artificial Sequence
  Synthetic
catggctaatatgacaaatttcaataatagtaattttaattgggaagagtggcgtttaacattaccccgtagtaa

SEQ ID NO: 307252 - DNA, 75 bp, Artificial Sequence
  Synthetic
acctcaatctcctgcacttatagcattatcttcatcagaatttaagacaattaattttaataatagttcgcaatc

SEQ ID NO: 307253 - DNA, 75 bp, Artificial Sequence
  Synthetic
ttatcttcatcagaatttaagacaattaattttaataatagttcgcaatctattaagaattggagtgctcaatca

SEQ ID NO: 307254 - DNA, 75 bp, Artificial Sequence
  Synthetic
ggcttttaaacgaagtcttcgacatggaggttctgtactcactgtcaaaaactttgaaggatgctagggataaaa

SEQ ID NO: 307255 - DNA, 75 bp, Artificial Sequence
  Synthetic
actttgaaggatgctagggataaaattgttgaaggtacgctatactcaaatgtaagtgatttaattcaacagttt

SEQ ID NO: 307256 - DNA, 75 bp, Artificial Sequence
  Synthetic
ttgttgaaggtacgctatactcaaatgtaagtgatttaattcaacagtttaatcaaatgatagtcactatgaatg

SEQ ID NO: 307257 - DNA, 75 bp, Artificial Sequence
  Synthetic
tagaaattcatatattcttcagcgtgctaatgcacaatatggaaatgtaatgggattgagatattacacggccag

SEQ ID NO: 307258 - DNA, 75 bp, Artificial Sequence
  Synthetic
gctaatgcacaatatggaaatgtaatgggattgagatattacacggccagtaatgtctgtcagatcgcagctttt

SEQ ID NO: 307259 - DNA, 75 bp, Artificial Sequence
  Synthetic
acttttaattttggattacttggtactactttacttaatctagatgcaaactatgttgaaaacgctagaactacc

SEQ ID NO: 307260 - DNA, 75 bp, Artificial Sequence
  Synthetic
tgcaatgtaaaatagagtcagaggttatcaaaggcggcggatggggatatgattatacaagcataaggtttagga

SEQ ID NO: 307261 - DNA, 75 bp, Artificial Sequence
  Synthetic
taatggaaggcttaaaagaccaatttctaatgttttgatgaaaattgaggcgggtgctccaaatattaataaccc

SEQ ID NO: 307262 - DNA, 75 bp, Artificial Sequence
  Synthetic
tctaatgttttgatgaaaattgaggcgggtgctccaaatattaataacccaacaatactgcctgatccaacaaat

SEQ ID NO: 307263 - DNA, 75 bp, Artificial Sequence
  Synthetic
ctactttacttaatctagatgcaaactatgttgaaaacgctagaactaccatcgaatactttattgattttatag

SEQ ID NO: 307264 - DNA, 75 bp, Artificial Sequence
  Synthetic
gctccacaatctgaagcactaagaaagctgtcaggtatcaaatttaaaagaattaattttgataattcatctgat

SEQ ID NO: 307265 - DNA, 75 bp, Artificial Sequence
  Synthetic
agctgtcaggtatcaaatttaaaagaattaattttgataattcatctgattatattgagaattggaatttacaga

SEQ ID NO: 307266 - DNA, 75 bp, Artificial Sequence
  Synthetic
tattgaattttataacaatgggcagttggtcgatttgattagaactatgggagtggttactgttagacaatttga

SEQ ID NO: 307267 - DNA, 75 bp, Artificial Sequence
  Synthetic
tattcagcatcattcactttaaatcggtcacagccagcacatgataatttgatgggaactatgtggattaatgct

SEQ ID NO: 307268 - DNA, 75 bp, Artificial Sequence
  Synthetic
attagaccagcagctatgacacaatatgtgcaaagactgttcccacaaggtggtccatatcagcatcaagctgca

SEQ ID NO: 307269 - DNA, 75 bp, Artificial Sequence
  Synthetic
ggtcacagccagcacatgataatttgatgggaactatgtggattaatgctggatcagaaattcaagtagctggat

SEQ ID NO: 307270 - DNA, 75 bp, Artificial Sequence
  Synthetic
tgattcacattcagtagattattcaattgttgcaaacgtcagaagagattcagcaatgccagctggaacagtatt

SEQ ID NO: 307271 - DNA, 75 bp, Artificial Sequence
  Synthetic
cacgttgtgccactaagacgtgctctcacaacagctacaattaccttattaccagatgctgaaagattcagtttt

SEQ ID NO: 307272 - DNA, 75 bp, Artificial Sequence
  Synthetic
cagcaatgccagctggaacagtatttcaaccaggttttccatgggagcaaacattatccaactacactgtagcac

SEQ ID NO: 307273 - DNA, 75 bp, Artificial Sequence
  Synthetic
tcacaacagctacaattaccttattaccagatgctgaaagattcagttttccgagagtgatcaattcagctgacg

SEQ ID NO: 307274 - DNA, 75 bp, Artificial Sequence
  Synthetic
tagcttcaggaacgggattcgcttatgcagatggttatgtttctcagactgttggaaatatttcatttatatcat

SEQ ID NO: 307275 - DNA, 75 bp, Artificial Sequence
  Synthetic
gaggttgaatttctattgaatgggcaaataattaacacatatcaagcgaggtttggaactatcatagctagaaat

SEQ ID NO: 307276 - DNA, 75 bp, Artificial Sequence
  Synthetic
accaatctctatgtggactacacatcatgtagcatgattcacgaatgggtttagttcacgcttgcgtaggggcaa

SEQ ID NO: 307277 - DNA, 75 bp, Artificial Sequence
  Synthetic
gtaagaatggatctagaaaggaaaataaacgatttacggaatgattttaatcaactagcaagttctgtggcacta

SEQ ID NO: 307278 - DNA, 75 bp, Artificial Sequence
  Synthetic
ggtttgtacgacattgtacactgtttgcgtaattctctgcattctttttgtttatatgttgttattcagaaagat

SEQ ID NO: 307279 - DNA, 75 bp, Artificial Sequence
  Synthetic
accagcagtagcaaacctatttccgcaagcaccaccattcatatttcatgccacagttggacttacattacgtat

SEQ ID NO: 307280 - DNA, 75 bp, Artificial Sequence
  Synthetic
gtattggatggtcgcaaggtcagatgtttgttgatgacatacattacaatggtaatgttgaaacaatagtaaatg

SEQ ID NO: 307281 - DNA, 75 bp, Artificial Sequence
  Synthetic
tcagttaaagatgttgctgcaaatgttatgaaaagatttagaaatacaaaaatgttcaaaaaagccgctaaacca

SEQ ID NO: 307282 - DNA, 75 bp, Artificial Sequence
  Synthetic
gtttgttgatgacatacattacaatggtaatgttgaaacaatagtaaatgctacggatccttttgatgttagatc

SEQ ID NO: 307283 - DNA, 75 bp, Artificial Sequence
  Synthetic
ggaatatgctataccagtaggaccagtatttccaccaggtatgaattggacagaattaattaccaattattcacc

SEQ ID NO: 307284 - DNA, 75 bp, Artificial Sequence
  Synthetic
agctaaaaattcaaactcaataaattttgacgatcttacgtcagcagtaatgatatcgactacaaataaattgca

SEQ ID NO: 307285 - DNA, 75 bp, Artificial Sequence
  Synthetic
agacagatgggtatctaaatgatggcaattatgctcaaaccattgcagcattatttgaaacaaagggtttcccaa

SEQ ID NO: 307286 - DNA, 75 bp, Artificial Sequence
  Synthetic
caattatgctcaaaccattgcagcattatttgaaacaaagggtttcccaagaggatcaatagtactaaagacata

SEQ ID NO: 307287 - DNA, 75 bp, Artificial Sequence
  Synthetic
gcatgttgattaagtgaggaccagactaaccacctggtatccaatcttaatcggcatgtagctatgtcaagtcac

SEQ ID NO: 307288 - DNA, 75 bp, Artificial Sequence
  Synthetic
tttgacgatcttacgtcagcagtaatgatatcgactacaaataaattgcaacttaccgacgtagacacattatca

SEQ ID NO: 307289 - DNA, 75 bp, Artificial Sequence
  Synthetic
aataatagaaaatggcgtagtacatgaagcaacacaaagtagagtattctcatatgatcttgttacacttcaaca

SEQ ID NO: 307290 - DNA, 75 bp, Artificial Sequence
  Synthetic
atatagttataatacctgatagtcaaactaattcagagtccatagaacgaatagcagaatggatattgaatgttt

SEQ ID NO: 307291 - DNA, 75 bp, Artificial Sequence
  Synthetic
tcagactctgcaagtaagggtatgatttcatactcgctacgcagagtaactgtttgaatgatgtagtgagaggat

SEQ ID NO: 307292 - DNA, 75 bp, Artificial Sequence
  Synthetic
aactaattcagagtccatagaacgaatagcagaatggatattgaatgtttggagatgtgataatatgaatttgga

SEQ ID NO: 307293 - DNA, 75 bp, Artificial Sequence
  Synthetic
gtagtgattgtgatgtatccgtctgtccattagatacgacaatgaatggaatcggctgctcaccagctagtaccg

SEQ ID NO: 307294 - DNA, 75 bp, Artificial Sequence
  Synthetic
aataacccattaataagaaatagaattgaggaactattaagacaatgcaggatctaataagtgaggggaccagct

SEQ ID NO: 307295 - DNA, 75 bp, Artificial Sequence
  Synthetic
cactcaattagcattgcttaacgtagtagataacgtaaaacatcgtattcaaatgaatacagctagctgtaaatt

SEQ ID NO: 307296 - DNA, 75 bp, Artificial Sequence
  Synthetic
tatctacatcatcgagttttgataattcattgtcaccattaaatgatggacaaacaacacgatcatttagaataa

SEQ ID NO: 307297 - DNA, 75 bp, Artificial Sequence
  Synthetic
acaattatacaaactatgactccgagacatcgggctatttatccagagggctggatgctgagatacgcgtaaaca

SEQ ID NO: 307298 - DNA, 75 bp, Artificial Sequence
  Synthetic
gtttgtacaactttgtacactgtttacgcaattctttgcatcttattaatatatacgctatttctcagaaaaatg

SEQ ID NO: 307299 - DNA, 75 bp, Artificial Sequence
  Synthetic
gcaactaatttcacagaattactattcaactggaaatgatatcttattagatcagcaaacaaataagacgactgt

SEQ ID NO: 307300 - DNA, 75 bp, Artificial Sequence
  Synthetic
tactggatacactaatggtcaattgttcactaatgatatttcatacgacggaaatattgagggtgtgataaatac

SEQ ID NO: 307301 - DNA, 75 bp, Artificial Sequence
  Synthetic
catggggagcaggaatgacttttaaatctgcattcaatgcggaggaaattacaggacctagtacaggtgatatag

SEQ ID NO: 307302 - DNA, 75 bp, Artificial Sequence
  Synthetic
acaggacctagtacaggtgatatagatttaactaatttaccaaacgcaaatggatggatattgtatgataaacca

SEQ ID NO: 307303 - DNA, 75 bp, Artificial Sequence
  Synthetic
caatcggttcaccaggtccaggtaaggatgatggtttattgaatgataataactatgcacagacattggccacat

SEQ ID NO: 307304 - DNA, 75 bp, Artificial Sequence
  Synthetic
aggatctgtgatctttaaaacatatacaaaaacatcagatttcataaattcagtagaaatgacttgttcatataa

SEQ ID NO: 307305 - DNA, 75 bp, Artificial Sequence
  Synthetic
gtatgctgcattcgaattatggtatggcaaagcgaatactgtagttagatcaatatattatgcatcagcacaaaa

SEQ ID NO: 307306 - DNA, 75 bp, Artificial Sequence
  Synthetic
acaaaaacatcagatttcataaattcagtagaaatgacttgttcatataatttagtcatcattcctgatgaacca

SEQ ID NO: 307307 - DNA, 75 bp, Artificial Sequence
  Synthetic
ggcaaagcgaatactgtagttagatcaatatattatgcatcagcacaaaactctgaaaatactgcaacagtacag

SEQ ID NO: 307308 - DNA, 75 bp, Artificial Sequence
  Synthetic
aaaaattcagaagcgattgaacaaatagccgaatggatactaaatgtttggcaatgtgatgacatgaatttggat

SEQ ID NO: 307309 - DNA, 75 bp, Artificial Sequence
  Synthetic
gcaaatagttaaattcaactggaatatgggaggtatattaattagaccaaccgctgatggtagagtggatatctg

SEQ ID NO: 307310 - DNA, 75 bp, Artificial Sequence
  Synthetic
ccgctgatggtagagtggatatctgtatggctgacatgaatgattttaacagtgatagctttaattgggaagtct

SEQ ID NO: 307311 - DNA, 75 bp, Artificial Sequence
  Synthetic
tattaacatgtatactgaatattacttggcaaacgttgatccatacagtcaactaaaatcattaaaccagctaac

SEQ ID NO: 307312 - DNA, 75 bp, Artificial Sequence
  Synthetic
ttggcaaacgttgatccatacagtcaactaaaatcattaaaccagctaactataaaaagtatagaacttggaatg

SEQ ID NO: 307313 - DNA, 75 bp, Artificial Sequence
  Synthetic
ttgatagcgttaaacatagaattcaaatgtcatcaagtttgaatcaattaaagtgtaaattaaaaaattgtgtta

SEQ ID NO: 307314 - DNA, 75 bp, Artificial Sequence
  Synthetic
caaagattcattatggcaagaaatgagatatgccagaggtataacattaaaatgcaaaatagaatcagagattat

SEQ ID NO: 307315 - DNA, 75 bp, Artificial Sequence
  Synthetic
agtttcgataactcattatcacctctaaataatggacaaacaacacgaacattcaaaattaatgcaaaaaaatgg

SEQ ID NO: 307316 - DNA, 75 bp, Artificial Sequence
  Synthetic
agatatgccagaggtataacattaaaatgcaaaatagaatcagagattattaaaggtggtggttgggggtatgat

SEQ ID NO: 307317 - DNA, 75 bp, Artificial Sequence
  Synthetic
gtcgggtgaagaagtaagtgcacatgtcacaataagttttaataatatgaaagagagatcatatggtgggtcact

SEQ ID NO: 307318 - DNA, 75 bp, Artificial Sequence
  Synthetic
gacaaactggtcttctttttaaatggtttgtacaactttgtacactgtttgcgcaattctttgcatcttattaat

SEQ ID NO: 307319 - DNA, 75 bp, Artificial Sequence
  Synthetic
aagagagatcatatggtgggtcactaccaactgattttaaaattaaaagatttgatgtaattgataatgacactt

SEQ ID NO: 307320 - DNA, 75 bp, Artificial Sequence
  Synthetic
ttcagatatatttaaaaatatggtatatgtacgcgatctgagagcaaatatgggtgactttttctattatgcaga

SEQ ID NO: 307321 - DNA, 75 bp, Artificial Sequence
  Synthetic
gagataggaaaagagaaacaactagagactataattgacaaagaagtaaaggaagacaaagattctataaaagaa

SEQ ID NO: 307322 - DNA, 75 bp, Artificial Sequence
  Synthetic
tgggtgactttttctattatgcagaaatgtggcatcgatttcagattccagttggtacgtatccaggattgcatt

SEQ ID NO: 307323 - DNA, 75 bp, Artificial Sequence
  Synthetic
aatatattccatcatataatactgacagcctcattgttaaaaaattaactgaaatccaggaatcgagcgccaaaa

SEQ ID NO: 307324 - DNA, 75 bp, Artificial Sequence
  Synthetic
gacataaatggtgagaaaaaattatcgactagatggtattggaaattgctcaaagatgatttacctgctggtgat

SEQ ID NO: 307325 - DNA, 75 bp, Artificial Sequence
  Synthetic
aatgcccgattacataatgcttcgtgatatggcagtggataacccatattcagcagaagcaggtaaaatcgtaga

SEQ ID NO: 307326 - DNA, 75 bp, Artificial Sequence
  Synthetic
gttaaagatgttgctgcaaatgttatgaaaaaattcagaaatacaaaaatgtttaaaagagcaaccaaaataaaa

SEQ ID NO: 307327 - DNA, 75 bp, Artificial Sequence
  Synthetic
aaggatatattagaagatatatgtctgaattaagacataaaatatctggagaaacaaatactgcaaaatacccag

SEQ ID NO: 307328 - DNA, 75 bp, Artificial Sequence
  Synthetic
acgagacgtgaataaaatgaattttgacgatattacttcagccatgatggtttcaactacaaataaattacaatt

SEQ ID NO: 307329 - DNA, 75 bp, Artificial Sequence
  Synthetic
gacgatattacttcagccatgatggtttcaactacaaataaattacaattgacagatattgacacctttttcgga

SEQ ID NO: 307330 - DNA, 75 bp, Artificial Sequence
  Synthetic
cagttaattcaaccattaactacaagaaacattgcagaattaattccaactcaattatatcatgatccaaattac

SEQ ID NO: 307331 - DNA, 75 bp, Artificial Sequence
  Synthetic
gatagaaaatgggatagtacatgaagcaacgccaactagggtgttctcttatgatttgaaaacgttacagcaaac

SEQ ID NO: 307332 - DNA, 75 bp, Artificial Sequence
  Synthetic
ttacatgatggatttgaatcaatatgggattcaaaaactcatgctgattacgtttcagctagaagatttatacct

SEQ ID NO: 307333 - DNA, 75 bp, Artificial Sequence
  Synthetic
tatcggctataattgactttgctacgttaaaagcaatgagagatacatatggagttagtacagatgtaatgtaca

SEQ ID NO: 307334 - DNA, 75 bp, Artificial Sequence
  Synthetic
tcagttttatctaccagaacaatagctgtagaattcataacctcaaactatatgtcattagcatcatgtatgtat

SEQ ID NO: 307335 - DNA, 75 bp, Artificial Sequence
  Synthetic
ctgtagaattcataacctcaaactatatgtcattagcatcatgtatgtatttaatgactattatgccatcagaga

SEQ ID NO: 307336 - DNA, 75 bp, Artificial Sequence
  Synthetic
ttaaatggtttgtacaactttgtacacagtttgcgcgattctttgcatcctgttactatatacattgtttcttag

SEQ ID NO: 307337 - DNA, 75 bp, Artificial Sequence
  Synthetic
ctacatgtgctgggtacgctaatggtcaattattcactaatgatatttcatatgacggaaatattgaaggtgtga

SEQ ID NO: 307338 - DNA, 75 bp, Artificial Sequence
  Synthetic
cttatttatccagctctaggtttagcgcaaatgcattatcaagcaggtgaagtgaggactccattcgaattagct

SEQ ID NO: 307339 - DNA, 75 bp, Artificial Sequence
  Synthetic
cgcaaatgcattatcaagcaggtgaagtgaggactccattcgaattagctgagatgcaagtagctaataggtcta

SEQ ID NO: 307340 - DNA, 75 bp, Artificial Sequence
  Synthetic
ttagacaatggttacatcattgtaatacacttcaatttggtagacaaataacggaagggataattcatctacgat

SEQ ID NO: 307341 - DNA, 75 bp, Artificial Sequence
  Synthetic
acggaagggataattcatctacgatttactaatgatatcatgacaggtaggatagtgaacttattttcaacaatg

SEQ ID NO: 307342 - DNA, 75 bp, Artificial Sequence
  Synthetic
aagatctgtacaaagagcattacaacttttatcaaatagaacagctcaaatagcagatttaaccagattaatagt

SEQ ID NO: 307343 - DNA, 75 bp, Artificial Sequence
  Synthetic
tgtttgtccattggatacaacaatgaatgggattggttgttcgccagctagtacagaaacatatgaagtagtgtc

SEQ ID NO: 307344 - DNA, 75 bp, Artificial Sequence
  Synthetic
tttcttacaaattataatgagcaaattgataatgtggtagcggaaataatggccgcatatagattgaatttatat

SEQ ID NO: 307345 - DNA, 75 bp, Artificial Sequence
  Synthetic
tcagttacaatgtaaattgaaaaactgtattaagggtgaaccacgattaaacactgcaattataagagtttccac

SEQ ID NO: 307346 - DNA, 75 bp, Artificial Sequence
  Synthetic
ataattgattatattaatacattggtacaaacaatggcgcctagacatcgggctatatatcctgaaggttggatg

SEQ ID NO: 307347 - DNA, 75 bp, Artificial Sequence
  Synthetic
gggtgtgttgttatcttatacaccaatgcctttaacttacgttgaagatgtcgggttaacaaatgtaattaatga

SEQ ID NO: 307348 - DNA, 75 bp, Artificial Sequence
  Synthetic
aaaggtgcgattccatatgtcactaactcatcagtaattgatgttttatctaaagtggataccacagtgttcgca

SEQ ID NO: 307349 - DNA, 75 bp, Artificial Sequence
  Synthetic
aattaattcagattcatccgaatattatttagtacataataataaatggacaccaacaacaactacagcagtata

SEQ ID NO: 307350 - DNA, 75 bp, Artificial Sequence
  Synthetic
tatttagtacataataataaatggacaccaacaacaactacagcagtatataaagctagatctcaacaatttgat

SEQ ID NO: 307351 - DNA, 75 bp, Artificial Sequence
  Synthetic
aagtacttactttaactcaaaagcatctgtgacacaatcagactcatgttcgaatgatttagcaatgaaacattc

SEQ ID NO: 307352 - DNA, 75 bp, Artificial Sequence
  Synthetic
taatgatttatttaaatacattaaaaccactacagttctgccgataaatgctgtctcttatgatggtgcaagaat

SEQ ID NO: 307353 - DNA, 75 bp, Artificial Sequence
  Synthetic
ctgtctcttatgatggtgcaagaattatgcaagaaacataaatgattgtatagtatcatcttgtgacgacctcaa

SEQ ID NO: 307354 - DNA, 75 bp, Artificial Sequence
  Synthetic
agcggtatcagacatattcgaagatgaagatattgagggatgtatttgtaaaaattgtccatatagagaaaagta

SEQ ID NO: 307355 - DNA, 75 bp, Artificial Sequence
  Synthetic
atgttgctttaaacagaattgaatcgcaacaaatggatgtgctatgatcctccaaaatctgtgtctgatcgcaac

SEQ ID NO: 307356 - DNA, 75 bp, Artificial Sequence
  Synthetic
acaattgtacaatcaatgactcccagacatcgggcgatttatccagaagggtggatgttgaggtatgcgtaaaca

SEQ ID NO: 307357 - DNA, 75 bp, Artificial Sequence
  Synthetic
gctgtctgacaaactggtcttctttttaaatggtttgtacgacgttgtacactgtttgcgcgatcttatgcattc

SEQ ID NO: 307358 - DNA, 75 bp, Artificial Sequence
  Synthetic
actgtttgcgcgatcttatgcattcttttcatctatatgctattatttagaaaaatgttccacctaataactgat

SEQ ID NO: 307359 - DNA, 75 bp, Artificial Sequence
  Synthetic
gctttcattgtggtgattattatatcaaactgcattggatggtcacaaggtcaattatttactgatgatatatat

SEQ ID NO: 307360 - DNA, 75 bp, Artificial Sequence
  Synthetic
atactatactatatggtgtggccccccccccggagtttagaaatagatttaaaacgaatgaaaggtatggtttag

SEQ ID NO: 307361 - DNA, 75 bp, Artificial Sequence
  Synthetic
caaatctctatgtatctattttccaaacgcagttgtaggatcccaaggtccaggcaagacagatggatacttaaa

SEQ ID NO: 307362 - DNA, 75 bp, Artificial Sequence
  Synthetic
aacgcagttgtaggatcccaaggtccaggcaagacagatggatacttaaatgatggtaattatgctcaaacgatt

SEQ ID NO: 307363 - DNA, 75 bp, Artificial Sequence
  Synthetic
gacatatactaaagtttcagactttatagactcagttgaaatgacatgttcatacaacatagctataatacctga

SEQ ID NO: 307364 - DNA, 75 bp, Artificial Sequence
  Synthetic
atagactcagttgaaatgacatgttcatacaacatagctataatacctgatagtttaactaactcagaagatatt

SEQ ID NO: 307365 - DNA, 75 bp, Artificial Sequence
  Synthetic
cttagatatttatacttatgaacagactggaatagataacttgtgggccgcttttggcagtgactgtgacatatc

SEQ ID NO: 307366 - DNA, 75 bp, Artificial Sequence
  Synthetic
actggaatagataacttgtgggccgcttttggcagtgactgtgacatatctgtttgtccattagatactactatg

SEQ ID NO: 307367 - DNA, 75 bp, Artificial Sequence
  Synthetic
aaataatacacaacttgcattaattaacgttgtagataacataaaacatagaattcagatgaatactgccagctg

SEQ ID NO: 307368 - DNA, 75 bp, Artificial Sequence
  Synthetic
taagaatttctacatcatcaagttttgataattcattatcaccattaaatgatggccaaacaactcgatcattta

SEQ ID NO: 307369 - DNA, 75 bp, Artificial Sequence
  Synthetic
tgataattcattatcaccattaaatgatggccaaacaactcgatcatttagaataaatgcaaagaaatggtggac

SEQ ID NO: 307370 - DNA, 75 bp, Artificial Sequence
  Synthetic
ttatgtatttattttccaaaagcagttgtaggatcacaggggcctggtcaaacaaatggttatttgaatgacggt

SEQ ID NO: 307371 - DNA, 75 bp, Artificial Sequence
  Synthetic
gttccacctaataactgatactttaatagtgatacttattttatctaattgtgtagagtggtcacaaggtcagat

SEQ ID NO: 307372 - DNA, 75 bp, Artificial Sequence
  Synthetic
agatgaacactgctcaatgtaaattaaaaaattgtattaagggtgaggctcgactgaatactgcactaataagaa

SEQ ID NO: 307373 - DNA, 75 bp, Artificial Sequence
  Synthetic
acaattgtacaagcaatgactcccagacatcgggcgatttatccagaagggtggatgttgaggtatgcgtaaaca

SEQ ID NO: 307374 - DNA, 75 bp, Artificial Sequence
  Synthetic
atgtccaagcgatcacgctccttagattctgctgccttttattaccgagtctagaaatatcttaaattagagttg

SEQ ID NO: 307375 - DNA, 75 bp, Artificial Sequence
  Synthetic
ttgcacatgcaaaatggacagaaccattgtctcagttgtttttaacaaaaggatgcccaacagggttagtttatt

SEQ ID NO: 307376 - DNA, 75 bp, Artificial Sequence
  Synthetic
ggaacacagcctcagaaagagtggaattttcagctgccacaattgggtacaactttattaaatttagatgataat

SEQ ID NO: 307377 - DNA, 75 bp, Artificial Sequence
  Synthetic
tgtaaagtttgtccatgtgattattgtggaatacggcacaagtgtgaaaattgcttaaactcagactgttttatg

SEQ ID NO: 307378 - DNA, 75 bp, Artificial Sequence
  Synthetic
gtgaaagaaacagaaaatgagattactgaaatgaaatcaaagacaaacttattagttaacgcttcagtagggatt

SEQ ID NO: 307379 - DNA, 75 bp, Artificial Sequence
  Synthetic
gtatactaattaaaccaataaattcaagtagaatgagaatttgcatgtcaggaatggaaaattttaataatgatt

SEQ ID NO: 307380 - DNA, 75 bp, Artificial Sequence
  Synthetic
cgagtttccaagaagtaatcctggtattaatattaatatgtatactgagtattttctggcaagtagtgatccata

SEQ ID NO: 307381 - DNA, 75 bp, Artificial Sequence
  Synthetic
aaatttgcagctatatctcatggcaaacggcattggaggcttgttcttcattctcagttgatgtctcatgcagaa

SEQ ID NO: 307382 - DNA, 75 bp, Artificial Sequence
  Synthetic
catacatattcatacattagagcaggagaaaatgttaatgctcatgtaactataagttttaataatgtaaaagaa

SEQ ID NO: 307383 - DNA, 75 bp, Artificial Sequence
  Synthetic
ttggtcaattatgtggtggtactacattcgaagttgctaaaacatcactatatagcataaaaccatcaaaaactg

SEQ ID NO: 307384 - DNA, 75 bp, Artificial Sequence
  Synthetic
atgaaaaaatttagaagtactaaaatgttcaaaaaagcagcaaaacaaaattatcgggagtttgtcattggagac

SEQ ID NO: 307385 - DNA, 75 bp, Artificial Sequence
  Synthetic
ctattttgtcatttattaatcagaataatccactcatacggaatagaattactaatctaataaatcaatgcagat

SEQ ID NO: 307386 - DNA, 75 bp, Artificial Sequence
  Synthetic
taatccactcatacggaatagaattactaatctaataaatcaatgcagattgtaaacagtgatgagatctcataa

SEQ ID NO: 307387 - DNA, 75 bp, Artificial Sequence
  Synthetic
caatgactcccagacatcgggcaatttatccagaagggtggatgttgaggtatgcgtaaacaagatcatgtggct

SEQ ID NO: 307388 - DNA, 75 bp, Artificial Sequence
  Synthetic
gtgtgaatgactgtcatgcaatatgcatatttaagtttgagaataactggtggtgttttgatgatggaagattaa

SEQ ID NO: 307389 - DNA, 75 bp, Artificial Sequence
  Synthetic
aaactgtttcagatctcaaaaagaaagttgtagttggtacaatttataccaatgtggaagatatcattcaacaga

SEQ ID NO: 307390 - DNA, 75 bp, Artificial Sequence
  Synthetic
attggaacacagcctcaaaaagagtggaacttccaacttcctcaactgggtacaactctgttaaatttagatgat

SEQ ID NO: 307391 - DNA, 75 bp, Artificial Sequence
  Synthetic
ggaacttccaacttcctcaactgggtacaactctgttaaatttagatgataattatgtccaggcaactagaagtg

SEQ ID NO: 307392 - DNA, 75 bp, Artificial Sequence
  Synthetic
gttagagaggcttcaagaaatggaatgcaacctcagtctccaactcttatagcacttgcatcatcaaaatttaag

SEQ ID NO: 307393 - DNA, 75 bp, Artificial Sequence
  Synthetic
agcacttgcatcatcaaaatttaagactattaattttaataacagatctcaatctattaagaattggcgtgctca

SEQ ID NO: 307394 - DNA, 75 bp, Artificial Sequence
  Synthetic
atagaaattcatatattcttcaacgtgctaatccacaatatggaaacttcatgggattgaggtattatacagcta

SEQ ID NO: 307395 - DNA, 75 bp, Artificial Sequence
  Synthetic
tgctaatccacaatatggaaacttcatgggattgaggtattatacagctagtaatacatgtcaacttgcagcttt

SEQ ID NO: 307396 - DNA, 75 bp, Artificial Sequence
  Synthetic
ttcgcccttgcatttaaaatctcattcacaatggacgtgctgttttccattgcaaagactgtctcagagcttaag

SEQ ID NO: 307397 - DNA, 75 bp, Artificial Sequence
  Synthetic
tgcaaagactgtctcagagcttaagaagaaagttgtagttggtactatttatacaaatgtggaagatataatcca

SEQ ID NO: 307398 - DNA, 75 bp, Artificial Sequence
  Synthetic
acaatggaagacttaagagaccaatttctaatgttttaatgaaaattgaagctggtgctccaaatattaataatt

SEQ ID NO: 307399 - DNA, 75 bp, Artificial Sequence
  Synthetic
acagactaatgaattaattagaactttaaatggcaacacatttcatactggtggaattggaacacaacctcaaaa

SEQ ID NO: 307400 - DNA, 75 bp, Artificial Sequence
  Synthetic
ttctaatgttttaatgaaaattgaagctggtgctccaaatattaataattcgacaatcttacctgacccaacaaa

SEQ ID NO: 307401 - DNA, 75 bp, Artificial Sequence
  Synthetic
atgataattatgttcaagcaaccagaagtattattgattatttggcctcattcatagaagctgtgtgtgatgacg

SEQ ID NO: 307402 - DNA, 75 bp, Artificial Sequence
  Synthetic
ccatcgaattttataataacggtcagctagttgacatggtcaggaacatgggagtggtcaccgttagaacatttg

SEQ ID NO: 307403 - DNA, 75 bp, Artificial Sequence
  Synthetic
aagtattattgattatttggcctcattcatagaagctgtgtgtgatgacgaaattgttagggaagcgtcaagaaa

SEQ ID NO: 307404 - DNA, 75 bp, Artificial Sequence
  Synthetic
tcaaaactattaattttaacaatagctcacaatctattaagaattggagtgctcaatctagacgtgaaaatccag

SEQ ID NO: 307405 - DNA, 75 bp, Artificial Sequence
  Synthetic
ctcacaatctattaagaattggagtgctcaatctagacgtgaaaatccagtttatgaatataaaaatccaatggt

SEQ ID NO: 307406 - DNA, 75 bp, Artificial Sequence
  Synthetic
gcggaccatatccctaccaagctgcatatatgctgactttaagtatactcgatgctactacagaatcagtactat

SEQ ID NO: 307407 - DNA, 75 bp, Artificial Sequence
  Synthetic
gcaacgtaatggggttaagatattacacggccggcaatatttgtcaaattgcagcttttgattcaactctagctg

SEQ ID NO: 307408 - DNA, 75 bp, Artificial Sequence
  Synthetic
gcagcttttgattcaactctagctgaaaatgctccaaatggcactcagagatttatatataatggaagacttaaa

SEQ ID NO: 307409 - DNA, 75 bp, Artificial Sequence
  Synthetic
ccatgtagcatgattcacgtatgggtttagtccatgcttgagtaggggcaaatgcgcatgacgtggacgatcccc

SEQ ID NO: 307410 - DNA, 75 bp, Artificial Sequence
  Synthetic
taataatccaacaatactacctgatccagcaaaccagacaacatggttatttaatccagtgcagataatgaacgg

SEQ ID NO: 307411 - DNA, 75 bp, Artificial Sequence
  Synthetic
aatggacagttagttgatttgattagaaatatgggagtggttactgttagaacatttgacacgtatagaattacg

SEQ ID NO: 307412 - DNA, 75 bp, Artificial Sequence
  Synthetic
tccacagggtggtccatatcagcatcaggctgcgtatatgatgacactcagtatattagatgctacaacggaatc

SEQ ID NO: 307413 - DNA, 75 bp, Artificial Sequence
  Synthetic
caggctgcgtatatgatgacactcagtatattagatgctacaacggaatcagtaatgtgtgattcacattcagta

SEQ ID NO: 307414 - DNA, 75 bp, Artificial Sequence
  Synthetic
ctagcggttagctctttttaatgtatggtattgaatataccacaattctgaccattttgatatcaattatactac

SEQ ID NO: 307415 - DNA, 75 bp, Artificial Sequence
  Synthetic
accattttgatatcaattatactactgaactatatattgaaaactgtaaccagtactatggactatataatttat

SEQ ID NO: 307416 - DNA, 75 bp, Artificial Sequence
  Synthetic
agcagtatttcaaccaggcttcccatgggaacagacattatccaactacactgttgctcaggaagataatttaga

SEQ ID NO: 307417 - DNA, 75 bp, Artificial Sequence
  Synthetic
tgaactatatattgaaaactgtaaccagtactatggactatataatttatagatttttattacttattgccttga

SEQ ID NO: 307418 - DNA, 75 bp, Artificial Sequence
  Synthetic
ggatcaatggatgctgtttatgccaattcaacaagcgagaaaccatttttgacatcaacactatgcatatactat

SEQ ID NO: 307419 - DNA, 75 bp, Artificial Sequence
  Synthetic
attcaacaagcgagaaaccatttttgacatcaacactatgcatatactatccaacagaagctaaaaatgaaatct

SEQ ID NO: 307420 - DNA, 75 bp, Artificial Sequence
  Synthetic
aggatcaatggcgtcctcactttatcaacaattgatctcacaaaactattattccactggtaatgagattatatt

SEQ ID NO: 307421 - DNA, 75 bp, Artificial Sequence
  Synthetic
attccactggtaatgagattatattggacaaacagactactagaaataataaagagtatgtagaagcaggaaatt

SEQ ID NO: 307422 - DNA, 75 bp, Artificial Sequence
  Synthetic
tggcccaccggatcagtctattttaaggattatactaatattgctgcattctcaattaatccacagctatattgt

SEQ ID NO: 307423 - DNA, 75 bp, Artificial Sequence
  Synthetic
aggattatactaatattgctgcattctcaattaatccacagctatattgtgactacaatgtagtgttgatgaaat

SEQ ID NO: 307424 - DNA, 75 bp, Artificial Sequence
  Synthetic
gaatccacatttaaatcgtctgatataactggcccacatagtaatacggtaatagagtggggtaatttaataaat

SEQ ID NO: 307425 - DNA, 75 bp, Artificial Sequence
  Synthetic
taactggcccacatagtaatacggtaatagagtggggtaatttaataaattctgatgtttgggtgttatatcaaa

SEQ ID NO: 307426 - DNA, 75 bp, Artificial Sequence
  Synthetic
aatgaatggttgtgcaaccctatggacatatcactatattattatcaacagagtagtgaatcgaataaatggata

SEQ ID NO: 307427 - DNA, 75 bp, Artificial Sequence
  Synthetic
acatatcactatattattatcaacagagtagtgaatcgaataaatggatatcaatgggaaatgactgtactgtaa

SEQ ID NO: 307428 - DNA, 75 bp, Artificial Sequence
  Synthetic
aactatggtatggtaaagcaggtcataccgtaacatcaatatattattcatcgatatctaatcctaataatactg

SEQ ID NO: 307429 - DNA, 75 bp, Artificial Sequence
  Synthetic
gaggtgaatacatttgaaacagttgcacaatccgaaaaattggcaataacagatgttgttaacggcgttaatcac

SEQ ID NO: 307430 - DNA, 75 bp, Artificial Sequence
  Synthetic
cacaatccgaaaaattggcaataacagatgttgttaacggcgttaatcacaaaattagcatctcgacaaatactt

SEQ ID NO: 307431 - DNA, 75 bp, Artificial Sequence
  Synthetic
gtactggaaaaacgaatagttaactttaattggaatatgggtggtatattagtcagaccatcaaggggtacacga

SEQ ID NO: 307432 - DNA, 75 bp, Artificial Sequence
  Synthetic
ttaattggaatatgggtggtatattagtcagaccatcaaggggtacacgagtggacatttgtatggccgatatga

SEQ ID NO: 307433 - DNA, 75 bp, Artificial Sequence
  Synthetic
attcaagttggtgggccaaatgcattagatattactgctgatccaacaactgctccacagattcagagaatcatg

SEQ ID NO: 307434 - DNA, 75 bp, Artificial Sequence
  Synthetic
ccgcgtagcagtagtggcgctgatgtcaatatgtattttgaatattatttagcaagcagtgatccataccaagag

SEQ ID NO: 307435 - DNA, 75 bp, Artificial Sequence
  Synthetic
cattgatcaaattataaaagttatgtccaaacgctcaagatcactagattcggctgctttctactatagaattta

SEQ ID NO: 307436 - DNA, 75 bp, Artificial Sequence
  Synthetic
tcaatatgtattttgaatattatttagcaagcagtgatccataccaagagattaaagagttgcaagaaccagtta

SEQ ID NO: 307437 - DNA, 75 bp, Artificial Sequence
  Synthetic
gctgtctgacaaactggtcttctttttaaatggtttgtacgacattgtacactgtttgcgtagttctttgcattc

SEQ ID NO: 307438 - DNA, 75 bp, Artificial Sequence
  Synthetic
ttaaatggtttgtacgacattgtacactgtttgcgtagttctttgcattctttttatttacatgctatttttcag

SEQ ID NO: 307439 - DNA, 75 bp, Artificial Sequence
  Synthetic
aacgtaaatgaggtcgtaagcaaagattcattatggcaagaaatgagatatgttagggatataactctagagtgt

SEQ ID NO: 307440 - DNA, 75 bp, Artificial Sequence
  Synthetic
attcattatggcaagaaatgagatatgttagggatataactctagagtgtaaaatacaatcagaagtaattaaag

SEQ ID NO: 307441 - DNA, 75 bp, Artificial Sequence
  Synthetic
ctaattgtattggatggtcacaaggtcaaatgttcgctgatgatatacattataatggaaatgttgaaacgatag

SEQ ID NO: 307442 - DNA, 75 bp, Artificial Sequence
  Synthetic
catacatattcatatgagagggcaggtgaaatagtcaacgctcacgtcacagtaagtttcaacagtatgaaagaa

SEQ ID NO: 307443 - DNA, 75 bp, Artificial Sequence
  Synthetic
gtgaaatagtcaacgctcacgtcacagtaagtttcaacagtatgaaagaaaggtcttatgggggagctctaccaa

SEQ ID NO: 307444 - DNA, 75 bp, Artificial Sequence
  Synthetic
ctggtaagacagatggatatctaaatgatggtaattacgctcaaactattgcagcattatttgaaacaaaaggtt

SEQ ID NO: 307445 - DNA, 75 bp, Artificial Sequence
  Synthetic
tacattgattattgggacgactcagatatgtttaaaaatatggtgtacgtacgtgatttgagagcagacgttaat

SEQ ID NO: 307446 - DNA, 75 bp, Artificial Sequence
  Synthetic
atatgtttaaaaatatggtgtacgtacgtgatttgagagcagacgttaatggattcttttattataaagagatgt

SEQ ID NO: 307447 - DNA, 75 bp, Artificial Sequence
  Synthetic
atagactcagtagagatgacatgctcatataatatagttataatacctgacagtgcagctaattcagaagctata

SEQ ID NO: 307448 - DNA, 75 bp, Artificial Sequence
  Synthetic
ggagtgggattcacatatgaaaaatgcatgttatcccaacagttcaccgatcaagttgcgttaaattctatgaga

SEQ ID NO: 307449 - DNA, 75 bp, Artificial Sequence
  Synthetic
tttagatatttatacatatgaacaaactggaacagataacctatgggctgcttttggtaatgattgtgatgtatc

SEQ ID NO: 307450 - DNA, 75 bp, Artificial Sequence
  Synthetic
actggaacagataacctatgggctgcttttggtaatgattgtgatgtatccgtctgcccgttagacacaacaatg

SEQ ID NO: 307451 - DNA, 75 bp, Artificial Sequence
  Synthetic
gcatgttatcccaacagttcaccgatcaagttgcgttaaattctatgagatttgtatttaaagtgacatctgcaa

SEQ ID NO: 307452 - DNA, 75 bp, Artificial Sequence
  Synthetic
ggaacgggattcgcttattcagatggacatgtatctagaactgttggaacattatcattcatatctctgattcca

SEQ ID NO: 307453 - DNA, 75 bp, Artificial Sequence
  Synthetic
aaatgatactcaattggcattgctcaatgtagtagataacgtaaaacaccgtattcaaatgaatacagctagttg

SEQ ID NO: 307454 - DNA, 75 bp, Artificial Sequence
  Synthetic
gacatgtatctagaactgttggaacattatcattcatatctctgattccaagtaatccaaattatcaaacaccca

SEQ ID NO: 307455 - DNA, 75 bp, Artificial Sequence
  Synthetic
taagttaaagaattgcatcaaaggtgaagctagattaaataccgcactcatcagaatctctacgtcatcaagttt

SEQ ID NO: 307456 - DNA, 75 bp, Artificial Sequence
  Synthetic
ttacgtaatgacttcaatcaactagccagttcagtagccctaggtgatattatgtctttagctatgtcaccattg

SEQ ID NO: 307457 - DNA, 75 bp, Artificial Sequence
  Synthetic
ccagttcagtagccctaggtgatattatgtctttagctatgtcaccattgactttcgctaacctgcttgaatctg

SEQ ID NO: 307458 - DNA, 75 bp, Artificial Sequence
  Synthetic
attaatacaattatacaaactatggctccgagacatcgggccatctatccggaagggtggatgctgagatacgcg

SEQ ID NO: 307459 - DNA, 75 bp, Artificial Sequence
  Synthetic
aaatttagaaatacaaagatgtttaagaaagccacaaaatccaaatataaagaatttataattggtgatttactt

SEQ ID NO: 307460 - DNA, 75 bp, Artificial Sequence
  Synthetic
agaatttataattggtgatttacttgaagatgtaacaaatgtgacaagaaattccagtactatgaatttcgatga

SEQ ID NO: 307461 - DNA, 75 bp, Artificial Sequence
  Synthetic
tgttagatctgcagatgactttatacctactagatcatacagaatgattgaaaataacacggtatatgaagcaac

SEQ ID NO: 307462 - DNA, 75 bp, Artificial Sequence
  Synthetic
ttgatatggataaatttattcaactagcttcaaaatcgccagtgatatctgcaattgtagattttgcaactttga

SEQ ID NO: 307463 - DNA, 75 bp, Artificial Sequence
  Synthetic
agcttcaaaatcgccagtgatatctgcaattgtagattttgcaactttgaaagcgatgagagaaacatatggtac

SEQ ID NO: 307464 - DNA, 75 bp, Artificial Sequence
  Synthetic
gtttgtacaacattgtacactgtttgcgcaattctttgcatcttgttagtatacacaatattactaagaaaaatg

SEQ ID NO: 307465 - DNA, 75 bp, Artificial Sequence
  Synthetic
tatcatttataaatgataataatccattaataagaaatagaatagaagagttgttgagacaatgtaggatataaa

SEQ ID NO: 307466 - DNA, 75 bp, Artificial Sequence
  Synthetic
tgctgggtgggccaacggtcaattgtttactaatgatatttcatatgacggaaatatcgaaggcgtaattaacac

SEQ ID NO: 307467 - DNA, 75 bp, Artificial Sequence
  Synthetic
tttactaatgatatttcatatgacggaaatatcgaaggcgtaattaacacaacaaatccgtttgatgttgaatcg

SEQ ID NO: 307468 - DNA, 75 bp, Artificial Sequence
  Synthetic
ggtttgtacaacattgtacactgtttgcgcaattctctgcatcttattcatatatacattgtttcttagaaagat

SEQ ID NO: 307469 - DNA, 75 bp, Artificial Sequence
  Synthetic
agacgatggtttgttaaacgataataattatgcacaaacgttagcgacattatttgaaacgaaaggatttccgaa

SEQ ID NO: 307470 - DNA, 75 bp, Artificial Sequence
  Synthetic
atgctggatgggctaacggtcagttattcaccagcgatatttcatatgacgggaatattgaaggtgtaataaatg

SEQ ID NO: 307471 - DNA, 75 bp, Artificial Sequence
  Synthetic
tagcagaatggatattgaatgtttggcaatgtgatgacatgaatttggacatttatacttatgaacagataaata

SEQ ID NO: 307472 - DNA, 75 bp, Artificial Sequence
  Synthetic
tagcagaatggatattgaatgtttggcattgtgatgacatgaatttggacatttatacttatgaacagataaata

SEQ ID NO: 307473 - DNA, 75 bp, Artificial Sequence
  Synthetic
tagcagaatggatattgaatgtttggcactgtgatgacatgaatttggacatttatacttatgaacagataaata

SEQ ID NO: 307474 - DNA, 75 bp, Artificial Sequence
  Synthetic
tagcagaatggatattgaatgtttggcagtgtgatgacatgaatttggacatttatacttatgaacagataaata

SEQ ID NO: 307475 - DNA, 75 bp, Artificial Sequence
  Synthetic
tagcagaatggttattgaatgtttggcaatgtgatgacatgaatttggacatttatacttatgaacagataaata

SEQ ID NO: 307476 - DNA, 75 bp, Artificial Sequence
  Synthetic
tagcagaatggttattgaatgtttggcattgtgatgacatgaatttggacatttatacttatgaacagataaata

SEQ ID NO: 307477 - DNA, 75 bp, Artificial Sequence
  Synthetic
tagcagaatggttattgaatgtttggcactgtgatgacatgaatttggacatttatacttatgaacagataaata

SEQ ID NO: 307478 - DNA, 75 bp, Artificial Sequence
  Synthetic
tagcagaatggttattgaatgtttggcagtgtgatgacatgaatttggacatttatacttatgaacagataaata

SEQ ID NO: 307479 - DNA, 75 bp, Artificial Sequence
  Synthetic
tagcagaatggctattgaatgtttggcaatgtgatgacatgaatttggacatttatacttatgaacagataaata

SEQ ID NO: 307480 - DNA, 75 bp, Artificial Sequence
  Synthetic
tagcagaatggctattgaatgtttggcattgtgatgacatgaatttggacatttatacttatgaacagataaata

SEQ ID NO: 307481 - DNA, 75 bp, Artificial Sequence
  Synthetic
tagcagaatggctattgaatgtttggcactgtgatgacatgaatttggacatttatacttatgaacagataaata

SEQ ID NO: 307482 - DNA, 75 bp, Artificial Sequence
  Synthetic
tagcagaatggctattgaatgtttggcagtgtgatgacatgaatttggacatttatacttatgaacagataaata

SEQ ID NO: 307483 - DNA, 75 bp, Artificial Sequence
  Synthetic
tagcagaatgggtattgaatgtttggcaatgtgatgacatgaatttggacatttatacttatgaacagataaata

SEQ ID NO: 307484 - DNA, 75 bp, Artificial Sequence
  Synthetic
tagcagaatgggtattgaatgtttggcattgtgatgacatgaatttggacatttatacttatgaacagataaata

SEQ ID NO: 307485 - DNA, 75 bp, Artificial Sequence
  Synthetic
tagcagaatgggtattgaatgtttggcactgtgatgacatgaatttggacatttatacttatgaacagataaata

SEQ ID NO: 307486 - DNA, 75 bp, Artificial Sequence
  Synthetic
tagcagaatgggtattgaatgtttggcagtgtgatgacatgaatttggacatttatacttatgaacagataaata

SEQ ID NO: 307487 - DNA, 75 bp, Artificial Sequence
  Synthetic
tagctgaatggatattgaatgtttggcaatgtgatgacatgaatttggacatttatacttatgaacagataaata

SEQ ID NO: 307488 - DNA, 75 bp, Artificial Sequence
  Synthetic
tagctgaatggatattgaatgtttggcattgtgatgacatgaatttggacatttatacttatgaacagataaata

SEQ ID NO: 307489 - DNA, 75 bp, Artificial Sequence
  Synthetic
tagctgaatggatattgaatgtttggcactgtgatgacatgaatttggacatttatacttatgaacagataaata

SEQ ID NO: 307490 - DNA, 75 bp, Artificial Sequence
  Synthetic
tagctgaatggatattgaatgtttggcagtgtgatgacatgaatttggacatttatacttatgaacagataaata

SEQ ID NO: 307491 - DNA, 75 bp, Artificial Sequence
  Synthetic
tagctgaatggttattgaatgtttggcaatgtgatgacatgaatttggacatttatacttatgaacagataaata

SEQ ID NO: 307492 - DNA, 75 bp, Artificial Sequence
  Synthetic
tagctgaatggttattgaatgtttggcattgtgatgacatgaatttggacatttatacttatgaacagataaata

SEQ ID NO: 307493 - DNA, 75 bp, Artificial Sequence
  Synthetic
tagctgaatggttattgaatgtttggcactgtgatgacatgaatttggacatttatacttatgaacagataaata

SEQ ID NO: 307494 - DNA, 75 bp, Artificial Sequence
  Synthetic
tagctgaatggttattgaatgtttggcagtgtgatgacatgaatttggacatttatacttatgaacagataaata

SEQ ID NO: 307495 - DNA, 75 bp, Artificial Sequence
  Synthetic
tagctgaatggctattgaatgtttggcaatgtgatgacatgaatttggacatttatacttatgaacagataaata

SEQ ID NO: 307496 - DNA, 75 bp, Artificial Sequence
  Synthetic
tagctgaatggctattgaatgtttggcattgtgatgacatgaatttggacatttatacttatgaacagataaata

SEQ ID NO: 307497 - DNA, 75 bp, Artificial Sequence
  Synthetic
tagctgaatggctattgaatgtttggcactgtgatgacatgaatttggacatttatacttatgaacagataaata

SEQ ID NO: 307498 - DNA, 75 bp, Artificial Sequence
  Synthetic
tagctgaatggctattgaatgtttggcagtgtgatgacatgaatttggacatttatacttatgaacagataaata

SEQ ID NO: 307499 - DNA, 75 bp, Artificial Sequence
  Synthetic
tagctgaatgggtattgaatgtttggcaatgtgatgacatgaatttggacatttatacttatgaacagataaata

SEQ ID NO: 307500 - DNA, 75 bp, Artificial Sequence
  Synthetic
tagctgaatgggtattgaatgtttggcattgtgatgacatgaatttggacatttatacttatgaacagataaata

SEQ ID NO: 307501 - DNA, 75 bp, Artificial Sequence
  Synthetic
tagctgaatgggtattgaatgtttggcactgtgatgacatgaatttggacatttatacttatgaacagataaata

SEQ ID NO: 307502 - DNA, 75 bp, Artificial Sequence
  Synthetic
tagctgaatgggtattgaatgtttggcagtgtgatgacatgaatttggacatttatacttatgaacagataaata

SEQ ID NO: 307503 - DNA, 75 bp, Artificial Sequence
  Synthetic
tagccgaatggatattgaatgtttggcaatgtgatgacatgaatttggacatttatacttatgaacagataaata

SEQ ID NO: 307504 - DNA, 75 bp, Artificial Sequence
  Synthetic
tagccgaatggatattgaatgtttggcattgtgatgacatgaatttggacatttatacttatgaacagataaata

SEQ ID NO: 307505 - DNA, 75 bp, Artificial Sequence
  Synthetic
tagccgaatggatattgaatgtttggcactgtgatgacatgaatttggacatttatacttatgaacagataaata

SEQ ID NO: 307506 - DNA, 75 bp, Artificial Sequence
  Synthetic
tagccgaatggatattgaatgtttggcagtgtgatgacatgaatttggacatttatacttatgaacagataaata

SEQ ID NO: 307507 - DNA, 75 bp, Artificial Sequence
  Synthetic
tagccgaatggttattgaatgtttggcaatgtgatgacatgaatttggacatttatacttatgaacagataaata

SEQ ID NO: 307508 - DNA, 75 bp, Artificial Sequence
  Synthetic
tagccgaatggttattgaatgtttggcattgtgatgacatgaatttggacatttatacttatgaacagataaata

SEQ ID NO: 307509 - DNA, 75 bp, Artificial Sequence
  Synthetic
tagccgaatggttattgaatgtttggcactgtgatgacatgaatttggacatttatacttatgaacagataaata

SEQ ID NO: 307510 - DNA, 75 bp, Artificial Sequence
  Synthetic
tagccgaatggttattgaatgtttggcagtgtgatgacatgaatttggacatttatacttatgaacagataaata

SEQ ID NO: 307511 - DNA, 75 bp, Artificial Sequence
  Synthetic
tagccgaatggctattgaatgtttggcaatgtgatgacatgaatttggacatttatacttatgaacagataaata

SEQ ID NO: 307512 - DNA, 75 bp, Artificial Sequence
  Synthetic
tagccgaatggctattgaatgtttggcattgtgatgacatgaatttggacatttatacttatgaacagataaata

SEQ ID NO: 307513 - DNA, 75 bp, Artificial Sequence
  Synthetic
tagccgaatggctattgaatgtttggcactgtgatgacatgaatttggacatttatacttatgaacagataaata

SEQ ID NO: 307514 - DNA, 75 bp, Artificial Sequence
  Synthetic
tagccgaatggctattgaatgtttggcagtgtgatgacatgaatttggacatttatacttatgaacagataaata

SEQ ID NO: 307515 - DNA, 75 bp, Artificial Sequence
  Synthetic
tagccgaatgggtattgaatgtttggcaatgtgatgacatgaatttggacatttatacttatgaacagataaata

SEQ ID NO: 307516 - DNA, 75 bp, Artificial Sequence
  Synthetic
tagccgaatgggtattgaatgtttggcattgtgatgacatgaatttggacatttatacttatgaacagataaata

SEQ ID NO: 307517 - DNA, 75 bp, Artificial Sequence
  Synthetic
tagccgaatgggtattgaatgtttggcactgtgatgacatgaatttggacatttatacttatgaacagataaata

SEQ ID NO: 307518 - DNA, 75 bp, Artificial Sequence
  Synthetic
tagccgaatgggtattgaatgtttggcagtgtgatgacatgaatttggacatttatacttatgaacagataaata

SEQ ID NO: 307519 - DNA, 75 bp, Artificial Sequence
  Synthetic
tagcggaatggatattgaatgtttggcaatgtgatgacatgaatttggacatttatacttatgaacagataaata

SEQ ID NO: 307520 - DNA, 75 bp, Artificial Sequence
  Synthetic
tagcggaatggatattgaatgtttggcattgtgatgacatgaatttggacatttatacttatgaacagataaata

SEQ ID NO: 307521 - DNA, 75 bp, Artificial Sequence
  Synthetic
tagcggaatggatattgaatgtttggcactgtgatgacatgaatttggacatttatacttatgaacagataaata

SEQ ID NO: 307522 - DNA, 75 bp, Artificial Sequence
  Synthetic
tagcggaatggatattgaatgtttggcagtgtgatgacatgaatttggacatttatacttatgaacagataaata

SEQ ID NO: 307523 - DNA, 75 bp, Artificial Sequence
  Synthetic
tagcggaatggttattgaatgtttggcaatgtgatgacatgaatttggacatttatacttatgaacagataaata

SEQ ID NO: 307524 - DNA, 75 bp, Artificial Sequence
  Synthetic
tagcggaatggttattgaatgtttggcattgtgatgacatgaatttggacatttatacttatgaacagataaata

SEQ ID NO: 307525 - DNA, 75 bp, Artificial Sequence
  Synthetic
tagcggaatggttattgaatgtttggcactgtgatgacatgaatttggacatttatacttatgaacagataaata

SEQ ID NO: 307526 - DNA, 75 bp, Artificial Sequence
  Synthetic
tagcggaatggttattgaatgtttggcagtgtgatgacatgaatttggacatttatacttatgaacagataaata

SEQ ID NO: 307527 - DNA, 75 bp, Artificial Sequence
  Synthetic
tagcggaatggctattgaatgtttggcaatgtgatgacatgaatttggacatttatacttatgaacagataaata

SEQ ID NO: 307528 - DNA, 75 bp, Artificial Sequence
  Synthetic
tagcggaatggctattgaatgtttggcattgtgatgacatgaatttggacatttatacttatgaacagataaata

SEQ ID NO: 307529 - DNA, 75 bp, Artificial Sequence
  Synthetic
tagcggaatggctattgaatgtttggcactgtgatgacatgaatttggacatttatacttatgaacagataaata

SEQ ID NO: 307530 - DNA, 75 bp, Artificial Sequence
  Synthetic
tagcggaatggctattgaatgtttggcagtgtgatgacatgaatttggacatttatacttatgaacagataaata

SEQ ID NO: 307531 - DNA, 75 bp, Artificial Sequence
  Synthetic
tagcggaatgggtattgaatgtttggcaatgtgatgacatgaatttggacatttatacttatgaacagataaata

SEQ ID NO: 307532 - DNA, 75 bp, Artificial Sequence
  Synthetic
tagcggaatgggtattgaatgtttggcattgtgatgacatgaatttggacatttatacttatgaacagataaata

SEQ ID NO: 307533 - DNA, 75 bp, Artificial Sequence
  Synthetic
tagcggaatgggtattgaatgtttggcactgtgatgacatgaatttggacatttatacttatgaacagataaata

SEQ ID NO: 307534 - DNA, 75 bp, Artificial Sequence
  Synthetic
tagcggaatgggtattgaatgtttggcagtgtgatgacatgaatttggacatttatacttatgaacagataaata

SEQ ID NO: 307535 - DNA, 75 bp, Artificial Sequence
  Synthetic
gcgataggttcaccaggtccaggtaaagctgacggtctgctaaatgacaataactatgcacaaacattagcaaca

SEQ ID NO: 307536 - DNA, 75 bp, Artificial Sequence
  Synthetic
aagctgacggtctgctaaatgacaataactatgcacaaacattagcaacactatttgaaacaaaaggatttccaa

SEQ ID NO: 307537 - DNA, 75 bp, Artificial Sequence
  Synthetic
taggttgctcgccagctagtacagaaacatatgaggtggtgtctaacgatactcaactggcactcattgacgtgg

SEQ ID NO: 307538 - DNA, 75 bp, Artificial Sequence
  Synthetic
tcagtagaaatgacttgttcatataatttagttattattcctgatgaaccaaataattctgaagctattgaacaa

SEQ ID NO: 307539 - DNA, 75 bp, Artificial Sequence
  Synthetic
atcggctgttcaccagctagtacagaaacatatgaggtggtgtctaataacactcagttagcacttattaatgta

SEQ ID NO: 307540 - DNA, 75 bp, Artificial Sequence
  Synthetic
aaacatatgaggtggtgtctaataacactcagttagcacttattaatgtagttgataatgttaaatatagaatcc

SEQ ID NO: 307541 - DNA, 75 bp, Artificial Sequence
  Synthetic
attacattaatacattggtacaaacaatgacccctagacatcgggctatatatcctcatggttggatgctaagat

SEQ ID NO: 307542 - DNA, 75 bp, Artificial Sequence
  Synthetic
atcagatttaataaattcagtagaaatgacttgttcatataatttagtaattattcctgatgaacccaaaaattc

SEQ ID NO: 307543 - DNA, 75 bp, Artificial Sequence
  Synthetic
atcagatttaataaattcagtagaaatgacttgttcatataatttagtaattattcctgatgaacccaataattc

SEQ ID NO: 307544 - DNA, 75 bp, Artificial Sequence
  Synthetic
atcagatttaataaattcagtagaaatgacttgttcatataatttagtaattattcctgatgaacccaacaattc

SEQ ID NO: 307545 - DNA, 75 bp, Artificial Sequence
  Synthetic
atcagatttaataaattcagtagaaatgacttgttcatataatttagtaattattcctgatgaacccaagaattc

SEQ ID NO: 307546 - DNA, 75 bp, Artificial Sequence
  Synthetic
atcagatttaataaattcagtagaaatgacttgttcatataatttagttattattcctgatgaacccaaaaattc

SEQ ID NO: 307547 - DNA, 75 bp, Artificial Sequence
  Synthetic
atcagatttaataaattcagtagaaatgacttgttcatataatttagttattattcctgatgaacccaataattc

SEQ ID NO: 307548 - DNA, 75 bp, Artificial Sequence
  Synthetic
atcagatttaataaattcagtagaaatgacttgttcatataatttagttattattcctgatgaacccaacaattc

SEQ ID NO: 307549 - DNA, 75 bp, Artificial Sequence
  Synthetic
atcagatttaataaattcagtagaaatgacttgttcatataatttagttattattcctgatgaacccaagaattc

SEQ ID NO: 307550 - DNA, 75 bp, Artificial Sequence
  Synthetic
atcagatttaataaattcagtagaaatgacttgttcatataatttagtcattattcctgatgaacccaaaaattc

SEQ ID NO: 307551 - DNA, 75 bp, Artificial Sequence
  Synthetic
atcagatttaataaattcagtagaaatgacttgttcatataatttagtcattattcctgatgaacccaataattc

SEQ ID NO: 307552 - DNA, 75 bp, Artificial Sequence
  Synthetic
atcagatttaataaattcagtagaaatgacttgttcatataatttagtcattattcctgatgaacccaacaattc

SEQ ID NO: 307553 - DNA, 75 bp, Artificial Sequence
  Synthetic
atcagatttaataaattcagtagaaatgacttgttcatataatttagtcattattcctgatgaacccaagaattc

SEQ ID NO: 307554 - DNA, 75 bp, Artificial Sequence
  Synthetic
atcagatttaataaattcagtagaaatgacttgttcatataatttagtgattattcctgatgaacccaaaaattc

SEQ ID NO: 307555 - DNA, 75 bp, Artificial Sequence
  Synthetic
atcagatttaataaattcagtagaaatgacttgttcatataatttagtgattattcctgatgaacccaataattc

SEQ ID NO: 307556 - DNA, 75 bp, Artificial Sequence
  Synthetic
atcagatttaataaattcagtagaaatgacttgttcatataatttagtgattattcctgatgaacccaacaattc

SEQ ID NO: 307557 - DNA, 75 bp, Artificial Sequence
  Synthetic
atcagatttaataaattcagtagaaatgacttgttcatataatttagtgattattcctgatgaacccaagaattc

SEQ ID NO: 307558 - DNA, 75 bp, Artificial Sequence
  Synthetic
ttcagatttaataaattcagtagaaatgacttgttcatataatttagtaattattcctgatgaacccaaaaattc

SEQ ID NO: 307559 - DNA, 75 bp, Artificial Sequence
  Synthetic
ttcagatttaataaattcagtagaaatgacttgttcatataatttagtaattattcctgatgaacccaataattc

SEQ ID NO: 307560 - DNA, 75 bp, Artificial Sequence
  Synthetic
ttcagatttaataaattcagtagaaatgacttgttcatataatttagtaattattcctgatgaacccaacaattc

SEQ ID NO: 307561 - DNA, 75 bp, Artificial Sequence
  Synthetic
ttcagatttaataaattcagtagaaatgacttgttcatataatttagtaattattcctgatgaacccaagaattc

SEQ ID NO: 307562 - DNA, 75 bp, Artificial Sequence
  Synthetic
ttcagatttaataaattcagtagaaatgacttgttcatataatttagttattattcctgatgaacccaaaaattc

SEQ ID NO: 307563 - DNA, 75 bp, Artificial Sequence
  Synthetic
ttcagatttaataaattcagtagaaatgacttgttcatataatttagttattattcctgatgaacccaataattc

SEQ ID NO: 307564 - DNA, 75 bp, Artificial Sequence
  Synthetic
ttcagatttaataaattcagtagaaatgacttgttcatataatttagttattattcctgatgaacccaacaattc

SEQ ID NO: 307565 - DNA, 75 bp, Artificial Sequence
  Synthetic
ttcagatttaataaattcagtagaaatgacttgttcatataatttagttattattcctgatgaacccaagaattc

SEQ ID NO: 307566 - DNA, 75 bp, Artificial Sequence
  Synthetic
ttcagatttaataaattcagtagaaatgacttgttcatataatttagtcattattcctgatgaacccaaaaattc

SEQ ID NO: 307567 - DNA, 75 bp, Artificial Sequence
  Synthetic
ttcagatttaataaattcagtagaaatgacttgttcatataatttagtcattattcctgatgaacccaataattc

SEQ ID NO: 307568 - DNA, 75 bp, Artificial Sequence
  Synthetic
ttcagatttaataaattcagtagaaatgacttgttcatataatttagtcattattcctgatgaacccaacaattc

SEQ ID NO: 307569 - DNA, 75 bp, Artificial Sequence
  Synthetic
ttcagatttaataaattcagtagaaatgacttgttcatataatttagtcattattcctgatgaacccaagaattc

SEQ ID NO: 307570 - DNA, 75 bp, Artificial Sequence
  Synthetic
ttcagatttaataaattcagtagaaatgacttgttcatataatttagtgattattcctgatgaacccaaaaattc

SEQ ID NO: 307571 - DNA, 75 bp, Artificial Sequence
  Synthetic
ttcagatttaataaattcagtagaaatgacttgttcatataatttagtgattattcctgatgaacccaataattc

SEQ ID NO: 307572 - DNA, 75 bp, Artificial Sequence
  Synthetic
ttcagatttaataaattcagtagaaatgacttgttcatataatttagtgattattcctgatgaacccaacaattc

SEQ ID NO: 307573 - DNA, 75 bp, Artificial Sequence
  Synthetic
ttcagatttaataaattcagtagaaatgacttgttcatataatttagtgattattcctgatgaacccaagaattc

SEQ ID NO: 307574 - DNA, 75 bp, Artificial Sequence
  Synthetic
ctcagatttaataaattcagtagaaatgacttgttcatataatttagtaattattcctgatgaacccaaaaattc

SEQ ID NO: 307575 - DNA, 75 bp, Artificial Sequence
  Synthetic
ctcagatttaataaattcagtagaaatgacttgttcatataatttagtaattattcctgatgaacccaataattc

SEQ ID NO: 307576 - DNA, 75 bp, Artificial Sequence
  Synthetic
ctcagatttaataaattcagtagaaatgacttgttcatataatttagtaattattcctgatgaacccaacaattc

SEQ ID NO: 307577 - DNA, 75 bp, Artificial Sequence
  Synthetic
ctcagatttaataaattcagtagaaatgacttgttcatataatttagtaattattcctgatgaacccaagaattc

SEQ ID NO: 307578 - DNA, 75 bp, Artificial Sequence
  Synthetic
ctcagatttaataaattcagtagaaatgacttgttcatataatttagttattattcctgatgaacccaaaaattc

SEQ ID NO: 307579 - DNA, 75 bp, Artificial Sequence
  Synthetic
ctcagatttaataaattcagtagaaatgacttgttcatataatttagttattattcctgatgaacccaataattc

SEQ ID NO: 307580 - DNA, 75 bp, Artificial Sequence
  Synthetic
ctcagatttaataaattcagtagaaatgacttgttcatataatttagttattattcctgatgaacccaacaattc

SEQ ID NO: 307581 - DNA, 75 bp, Artificial Sequence
  Synthetic
ctcagatttaataaattcagtagaaatgacttgttcatataatttagttattattcctgatgaacccaagaattc

SEQ ID NO: 307582 - DNA, 75 bp, Artificial Sequence
  Synthetic
ctcagatttaataaattcagtagaaatgacttgttcatataatttagtcattattcctgatgaacccaaaaattc

SEQ ID NO: 307583 - DNA, 75 bp, Artificial Sequence
  Synthetic
ctcagatttaataaattcagtagaaatgacttgttcatataatttagtcattattcctgatgaacccaataattc

SEQ ID NO: 307584 - DNA, 75 bp, Artificial Sequence
  Synthetic
ctcagatttaataaattcagtagaaatgacttgttcatataatttagtcattattcctgatgaacccaacaattc

SEQ ID NO: 307585 - DNA, 75 bp, Artificial Sequence
  Synthetic
ctcagatttaataaattcagtagaaatgacttgttcatataatttagtcattattcctgatgaacccaagaattc

SEQ ID NO: 307586 - DNA, 75 bp, Artificial Sequence
  Synthetic
ctcagatttaataaattcagtagaaatgacttgttcatataatttagtgattattcctgatgaacccaaaaattc

SEQ ID NO: 307587 - DNA, 75 bp, Artificial Sequence
  Synthetic
ctcagatttaataaattcagtagaaatgacttgttcatataatttagtgattattcctgatgaacccaataattc

SEQ ID NO: 307588 - DNA, 75 bp, Artificial Sequence
  Synthetic
ctcagatttaataaattcagtagaaatgacttgttcatataatttagtgattattcctgatgaacccaacaattc

SEQ ID NO: 307589 - DNA, 75 bp, Artificial Sequence
  Synthetic
ctcagatttaataaattcagtagaaatgacttgttcatataatttagtgattattcctgatgaacccaagaattc

SEQ ID NO: 307590 - DNA, 75 bp, Artificial Sequence
  Synthetic
gtcagatttaataaattcagtagaaatgacttgttcatataatttagtaattattcctgatgaacccaaaaattc

SEQ ID NO: 307591 - DNA, 75 bp, Artificial Sequence
  Synthetic
gtcagatttaataaattcagtagaaatgacttgttcatataatttagtaattattcctgatgaacccaataattc

SEQ ID NO: 307592 - DNA, 75 bp, Artificial Sequence
  Synthetic
gtcagatttaataaattcagtagaaatgacttgttcatataatttagtaattattcctgatgaacccaacaattc

SEQ ID NO: 307593 - DNA, 75 bp, Artificial Sequence
  Synthetic
gtcagatttaataaattcagtagaaatgacttgttcatataatttagtaattattcctgatgaacccaagaattc

SEQ ID NO: 307594 - DNA, 75 bp, Artificial Sequence
  Synthetic
gtcagatttaataaattcagtagaaatgacttgttcatataatttagttattattcctgatgaacccaaaaattc

SEQ ID NO: 307595 - DNA, 75 bp, Artificial Sequence
  Synthetic
gtcagatttaataaattcagtagaaatgacttgttcatataatttagttattattcctgatgaacccaataattc

SEQ ID NO: 307596 - DNA, 75 bp, Artificial Sequence
  Synthetic
gtcagatttaataaattcagtagaaatgacttgttcatataatttagttattattcctgatgaacccaacaattc

SEQ ID NO: 307597 - DNA, 75 bp, Artificial Sequence
  Synthetic
gtcagatttaataaattcagtagaaatgacttgttcatataatttagttattattcctgatgaacccaagaattc

SEQ ID NO: 307598 - DNA, 75 bp, Artificial Sequence
  Synthetic
gtcagatttaataaattcagtagaaatgacttgttcatataatttagtcattattcctgatgaacccaaaaattc

SEQ ID NO: 307599 - DNA, 75 bp, Artificial Sequence
  Synthetic
gtcagatttaataaattcagtagaaatgacttgttcatataatttagtcattattcctgatgaacccaataattc

SEQ ID NO: 307600 - DNA, 75 bp, Artificial Sequence
  Synthetic
gtcagatttaataaattcagtagaaatgacttgttcatataatttagtcattattcctgatgaacccaacaattc

SEQ ID NO: 307601 - DNA, 75 bp, Artificial Sequence
  Synthetic
gtcagatttaataaattcagtagaaatgacttgttcatataatttagtcattattcctgatgaacccaagaattc

SEQ ID NO: 307602 - DNA, 75 bp, Artificial Sequence
  Synthetic
gtcagatttaataaattcagtagaaatgacttgttcatataatttagtgattattcctgatgaacccaaaaattc

SEQ ID NO: 307603 - DNA, 75 bp, Artificial Sequence
  Synthetic
gtcagatttaataaattcagtagaaatgacttgttcatataatttagtgattattcctgatgaacccaataattc

SEQ ID NO: 307604 - DNA, 75 bp, Artificial Sequence
  Synthetic
gtcagatttaataaattcagtagaaatgacttgttcatataatttagtgattattcctgatgaacccaacaattc

SEQ ID NO: 307605 - DNA, 75 bp, Artificial Sequence
  Synthetic
gtcagatttaataaattcagtagaaatgacttgttcatataatttagtgattattcctgatgaacccaagaattc

SEQ ID NO: 307606 - DNA, 75 bp, Artificial Sequence
  Synthetic
aaaggtgaatcacgattgaatactgcaattataagagtttcaacatcatcaagtttcgataattcactatcacct

SEQ ID NO: 307607 - DNA, 75 bp, Artificial Sequence
  Synthetic
aagtttcgataattcactatcacctctaaataatggacaaatgacacgatcatttaaaattaatgcaaaaaaatg

SEQ ID NO: 307608 - DNA, 75 bp, Artificial Sequence
  Synthetic
gtttgtacaactttgtacactgtttacgcaatcctttgcatcttattaatatatacactatttcttagaaagatg

SEQ ID NO: 307609 - DNA, 75 bp, Artificial Sequence
  Synthetic
tgccggatacgctaacggtcaattgttcactaatgatatttcttatgaaggaaacatcgaaggtgtgataaattc

SEQ ID NO: 307610 - DNA, 75 bp, Artificial Sequence
  Synthetic
caattggctcaccaggtccaggtaaggctgatggtttattaaatgataataactatgcacagatactggcaacat

SEQ ID NO: 307611 - DNA, 75 bp, Artificial Sequence
  Synthetic
tttagtcatcgttcctgatgaaccaaagaattcagaagcaattgaacaaattgctgaatgggtattaaatgtttg

SEQ ID NO: 307612 - DNA, 75 bp, Artificial Sequence
  Synthetic
aagataatctatgggcggcattcggtgaagattgtgatatatctgtttgtccgttagacacaacaatgaatggga

SEQ ID NO: 307613 - DNA, 75 bp, Artificial Sequence
  Synthetic
gacatatgaggtggtgtctaacgatactcaattagcacttattaatgtggttgataacattaaacatagaattca

SEQ ID NO: 307614 - DNA, 75 bp, Artificial Sequence
  Synthetic
tatactataattgattatattaatacattggtacaaacaatgacgcctagacatcgggctatatatcctgaaggt

SEQ ID NO: 307615 - DNA, 75 bp, Artificial Sequence
  Synthetic
aatacattggtacaaacaatgacgcctagacatcgggctatatatcctgaaggttggatgctgagatatgcgtaa

SEQ ID NO: 307616 - DNA, 75 bp, Artificial Sequence
  Synthetic
gacaaactggtcttctttttaaatggtttgtacgacattgtacactgtctgcgcaattctctgcattctttttat

SEQ ID NO: 307617 - DNA, 75 bp, Artificial Sequence
  Synthetic
ctctcagcattgacgtaacgagtcttccctcaatttcttctagtatctttaaaaatgaatcgtcttctacaacgt

SEQ ID NO: 307618 - DNA, 75 bp, Artificial Sequence
  Synthetic
ttggctagcccttagcttcttttaatgtatggtattgaatataccacaattctaatcttcttgacatcgattaca

SEQ ID NO: 307619 - DNA, 75 bp, Artificial Sequence
  Synthetic
tctaatcttcttgacatcgattacattgctaaattatatcttaaaatcaataacaagagtaatggactatataat

SEQ ID NO: 307620 - DNA, 75 bp, Artificial Sequence
  Synthetic
ttgctaaattatatcttaaaatcaataacaagagtaatggactatataatttacagatttctgcttatagtggta

SEQ ID NO: 307621 - DNA, 75 bp, Artificial Sequence
  Synthetic
gaaatccaagaaagataaaagtaggaaacactacccgagaattgaagcagattctgattctgaagattatgtttt

SEQ ID NO: 307622 - DNA, 75 bp, Artificial Sequence
  Synthetic
tacaggttcaatggatactgcatacgcaaattctacgcaaagtgagccatttttaacatcaactctttgtttgta

SEQ ID NO: 307623 - DNA, 75 bp, Artificial Sequence
  Synthetic
gcaaattctacgcaaagtgagccatttttaacatcaactctttgtttgtattatcctgttgaggcatcaaacgaa

SEQ ID NO: 307624 - DNA, 75 bp, Artificial Sequence
  Synthetic
aaaagtatttcgcactaagaatgaggatgaagcaagtcgcaatgcaattgatcgaagatttgtaatgtcaacctg

SEQ ID NO: 307625 - DNA, 75 bp, Artificial Sequence
  Synthetic
aggatggccaacaggatcggtgtactttaaagaatatactgatatagcggctttttcagtagaaccacagctgta

SEQ ID NO: 307626 - DNA, 75 bp, Artificial Sequence
  Synthetic
gatgaagcaagtcgcaatgcaattgatcgaagatttgtaatgtcaacctgagagcacactagggagctccccact

SEQ ID NO: 307627 - DNA, 75 bp, Artificial Sequence; identical to SEQ ID NO: 297037
  Synthetic

SEQ ID NO: 307628 - DNA, 75 bp, Artificial Sequence
  Synthetic
tttaaagaatatactgatatagcggctttttcagtagaaccacagctgtactgtgattataatttagttttaatg

SEQ ID NO: 307629 - DNA, 75 bp, Artificial Sequence
  Synthetic
tcatttggagaacgatagctataaatttattcctttaaatagtttggcaataaaatgtatgttgacagcaaaagt

SEQ ID NO: 307630 - DNA, 75 bp, Artificial Sequence
  Synthetic
actgaacgaatggctgtgcaatcccatggacataacgttgtattattatcagcagactgatgaagcaaataaatg

SEQ ID NO: 307631 - DNA, 75 bp, Artificial Sequence
  Synthetic
tttattcctttaaatagtttggcaataaaatgtatgttgacagcaaaagtagataaaaaggatcaagataaattt

SEQ ID NO: 307632 - DNA, 75 bp, Artificial Sequence
  Synthetic
atggacataacgttgtattattatcagcagactgatgaagcaaataaatggatatcgatgggctcttcttgcaca

SEQ ID NO: 307633 - DNA, 75 bp, Artificial Sequence
  Synthetic
ttataatactaatgataactcaagaggtatgaactttgaaacatctatgtttaataaggtggctattttaatttg

SEQ ID NO: 307634 - DNA, 75 bp, Artificial Sequence
  Synthetic
aactaatccagacacgtttgaaacagttgcgacaacggagaagttggtgattacagatgttgtagatggtgtcaa

SEQ ID NO: 307635 - DNA, 75 bp, Artificial Sequence
  Synthetic
ggtatgaactttgaaacatctatgtttaataaggtggctattttaatttgtgaggcattgaattcaattaaggtt

SEQ ID NO: 307636 - DNA, 75 bp, Artificial Sequence
  Synthetic
gttgcgacaacggagaagttggtgattacagatgttgtagatggtgtcaaccataagttaaacgtcacaacagca

SEQ ID NO: 307637 - DNA, 75 bp, Artificial Sequence
  Synthetic
tttggaaaatttggtattaagaaaagagaatcatcaggatgtactttttcattcaaaagaactactcttaaaagc

SEQ ID NO: 307638 - DNA, 75 bp, Artificial Sequence
  Synthetic
agtcatacaggtaggcggcgcgaatattttagacatcacagctgatccaacaactacaccacagacagagagaat

SEQ ID NO: 307639 - DNA, 75 bp, Artificial Sequence
  Synthetic
gagaatcatcaggatgtactttttcattcaaaagaactactcttaaaagctgttttaatagctattggtcaatca

SEQ ID NO: 307640 - DNA, 75 bp, Artificial Sequence
  Synthetic
aaatgctgcttttactatgtggaaattgacatatctagatcataaactgatgcctattttagatcaaaattttat

SEQ ID NO: 307641 - DNA, 75 bp, Artificial Sequence
  Synthetic
attatgtcaatcaaataattcaaacgatgtccaaaagatctagatcgcttaactcgtcagcgttctattacagag

SEQ ID NO: 307642 - DNA, 75 bp, Artificial Sequence
  Synthetic
ttgacatatctagatcataaactgatgcctattttagatcaaaattttattgaatacaaaattactttgaatgaa

SEQ ID NO: 307643 - DNA, 75 bp, Artificial Sequence
  Synthetic
gtggcaatataatagatttgctataataacacatggtaaaggtcactacagagttgtaaaatattcatcagttgc

SEQ ID NO: 307644 - DNA, 75 bp, Artificial Sequence
  Synthetic
ttccatctattaactgatgcattagctgttgtactaatcatatctgtatgcactggatatactaatggtcagctg

SEQ ID NO: 307645 - DNA, 75 bp, Artificial Sequence
  Synthetic
ataacacatggtaaaggtcactacagagttgtaaaatattcatcagttgctaatcacgcagatagagtattcgct

SEQ ID NO: 307646 - DNA, 75 bp, Artificial Sequence
  Synthetic
agaccaaagaataatttggcagaattggtatgcatttacatcttctatgaaacaaggcaatactcttgatgtatg

SEQ ID NO: 307647 - DNA, 75 bp, Artificial Sequence
  Synthetic
aattatgcacaaatactggcaacattattcgaaacaaaaggatttccaaaagggtctgtaatttttaaaacatat

SEQ ID NO: 307648 - DNA, 75 bp, Artificial Sequence
  Synthetic
tgaagtttcgcacgttggaatttaattcgctttcgattcaagaatgatgatgacggagcaagaatagaaagcgct

SEQ ID NO: 307649 - DNA, 75 bp, Artificial Sequence
  Synthetic
ggcttttaatgcttttcagttgttgatgctcaagatggagtctactcggcagatggtagattctattattaacac

SEQ ID NO: 307650 - DNA, 75 bp, Artificial Sequence
  Synthetic
agatggtagattctattattaacacttcttttgaagctgcagttgttgctgccacttcaacattagaattaatgg

SEQ ID NO: 307651 - DNA, 75 bp, Artificial Sequence
  Synthetic
tagctgaatgggtattaaatgtttggcaatgtgatgatatgaatctggatatttatacctatgaacagataaata

SEQ ID NO: 307652 - DNA, 75 bp, Artificial Sequence
  Synthetic
ttcttttgaagctgcagttgttgctgccacttcaacattagaattaatgggtattcagtatgattacaatgagat

SEQ ID NO: 307653 - DNA, 75 bp, Artificial Sequence
  Synthetic
ttaagaacaaccttttaggcaaagctgcgactattgatcaggcactaaatggaaaatttggttcagctataagga

SEQ ID NO: 307654 - DNA, 75 bp, Artificial Sequence
  Synthetic
taggttgttcaccagctagtacagaaacatacgaggtggtatccaatgacactcaattggcgcttattgatgtgg

SEQ ID NO: 307655 - DNA, 75 bp, Artificial Sequence
  Synthetic
atagaaattggatgactgattctaaaacagtggctaaattggatgaagatgtaaataaactcagaatgactttat

SEQ ID NO: 307656 - DNA, 75 bp, Artificial Sequence
  Synthetic
cagtgtaaattaaaaaattgtgttaaaggtgagccacgactaaatactgcaattataagagtttctacatcatca

SEQ ID NO: 307657 - DNA, 75 bp, Artificial Sequence
  Synthetic
gagagtacttaatgcttgttttagtgtgaaaaggataccagggaaatcatcatcagtcattaaatgcaccaggct

SEQ ID NO: 307658 - DNA, 75 bp, Artificial Sequence
  Synthetic
gtgaaaaggataccagggaaatcatcatcagtcattaaatgcaccaggcttatgaaagataaaatagaacgaggg

SEQ ID NO: 307659 - DNA, 75 bp, Artificial Sequence
  Synthetic
aattataagagtttctacatcatcaagtttcgataattcactatcacctctgaacaatggacagacaacacgaac

SEQ ID NO: 307660 - DNA, 75 bp, Artificial Sequence
  Synthetic
tattgattggaaagctcgttatgatcaattggaaaaaagatttgagtcattaaagcaaagagtcaatgaaaaata

SEQ ID NO: 307661 - DNA, 75 bp, Artificial Sequence
  Synthetic
caattggaaaaaagatttgagtcattaaagcaaagagtcaatgaaaaatataatagttgggtgcaaaaagcgaag

SEQ ID NO: 307662 - DNA, 75 bp, Artificial Sequence
  Synthetic
gctgtctgacaaactggtcttctttttaaatggtttgtacgacgttgtacactgtttgcgcagttctttgcatcc

SEQ ID NO: 307663 - DNA, 75 bp, Artificial Sequence
  Synthetic
actgtttgcgcagttctttgcatcctattaatatatacattgtttcttagaaagatgttccatctattaactgac

SEQ ID NO: 307664 - DNA, 75 bp, Artificial Sequence
  Synthetic
tattaatatatacattgtttcttagaaagatgttccatctattaactgacacactagttgttattctaatcatat

SEQ ID NO: 307665 - DNA, 75 bp, Artificial Sequence
  Synthetic
aaaccaaatagcagatcttcagcaatattgcaataaattagaagctgacctgcaaagcaaaattagttcactagt

SEQ ID NO: 307666 - DNA, 75 bp, Artificial Sequence
  Synthetic
tattgcaataaattagaagctgacctgcaaagcaaaattagttcactagtgtcatcagttgaatggtatctgagg

SEQ ID NO: 307667 - DNA, 75 bp, Artificial Sequence
  Synthetic
tatgatggaaacattgagggtgtaataaatgtgacaaatccttttaacgttgaatcattatgtatttattttcca

SEQ ID NO: 307668 - DNA, 75 bp, Artificial Sequence
  Synthetic
taaatgtgacaaatccttttaacgttgaatcattatgtatttattttccaaacgctgcaataggttcaccaggtc

SEQ ID NO: 307669 - DNA, 75 bp, Artificial Sequence
  Synthetic
ctcgattgatgctattaatcctattaatgctatagacgatcttgaatcattaatcagaaacttaattcaagatta

SEQ ID NO: 307670 - DNA, 75 bp, Artificial Sequence
  Synthetic
taatcagaaacttaattcaagattatgatagaacatttttgatgttgaaaggacttgtaaggcaatgcaactatg

SEQ ID NO: 307671 - DNA, 75 bp, Artificial Sequence
  Synthetic
ttccaaaaggatcagtgatctttaaaacatatactaaaacttcagatttcataaattcagtagaaatgacttgtt

SEQ ID NO: 307672 - DNA, 75 bp, Artificial Sequence
  Synthetic
tctaaatatattaaccatctacacatgaccctctatgagcacaatagttaaaagctaacactgtcaaaaacctaa

SEQ ID NO: 307673 - DNA, 75 bp, Artificial Sequence
  Synthetic
ggctttaaaagagagaatttccggttggctaacggttagctccttttaatgtctggtattgaatataacacagtt

SEQ ID NO: 307674 - DNA, 75 bp, Artificial Sequence
  Synthetic
tttagaaatttatacttatgaacaagtgaataaagataacttatgggcagcatttggtgaagattgtgacatatc

SEQ ID NO: 307675 - DNA, 75 bp, Artificial Sequence
  Synthetic
gtgaataaagataacttatgggcagcatttggtgaagattgtgacatatctgtttgtcctctagacgcaacaatg

SEQ ID NO: 307676 - DNA, 75 bp, Artificial Sequence
  Synthetic
taacaatactcagctagcacttattgacgtagtcgataatgttaaacatagagtacaaatgtcatcgagtgtgaa

SEQ ID NO: 307677 - DNA, 75 bp, Artificial Sequence
  Synthetic
gacgtagtcgataatgttaaacatagagtacaaatgtcatcgagtgtgaatcaactccaatgtagattgaaaaat

SEQ ID NO: 307678 - DNA, 75 bp, Artificial Sequence
  Synthetic
attctcaattgatccccagctttattgcgattacaatgtcatgttaatgaagtatgattcaacgttagagctgaa

SEQ ID NO: 307679 - DNA, 75 bp, Artificial Sequence
  Synthetic
atcatcaagttttgataattcactttcacctctaaataatggacagatgacacgatcattcaagattaatgcaaa

SEQ ID NO: 307680 - DNA, 75 bp, Artificial Sequence
  Synthetic
agtatgattcaacgttagagctgaacatgtctgaattggctgatttgattctagacaactggctatgtaacccga

SEQ ID NO: 307681 - DNA, 75 bp, Artificial Sequence
  Synthetic
ggcttttaaacgaagtcttcgacatggaggttctgtactcattatcaaaaactttgaaagatgctagagataaaa

SEQ ID NO: 307682 - DNA, 75 bp, Artificial Sequence
  Synthetic
ggaggttctgtactcattatcaaaaactttgaaagatgctagagataaaattgttgaaggtacattatattcaaa

SEQ ID NO: 307683 - DNA, 75 bp, Artificial Sequence
  Synthetic
gaaatgaatttcaaacaggagggattggaaatttaccaattagaaattggacttttgactttggattacttggta

SEQ ID NO: 307684 - DNA, 75 bp, Artificial Sequence
  Synthetic
tggaaatttaccaattagaaattggacttttgactttggattacttggtactactttacttaatctagatgcaaa

SEQ ID NO: 307685 - DNA, 75 bp, Artificial Sequence
  Synthetic
ataatgtatgtatggatgaaatagctagagaatcgcaacgaaatggaatagctccacaatctgaagcactaagaa

SEQ ID NO: 307686 - DNA, 75 bp, Artificial Sequence
  Synthetic
tagagaatcgcaacgaaatggaatagctccacaatctgaagcactaagaaagttgtcaggtattaaatttaagag

SEQ ID NO: 307687 - DNA, 75 bp, Artificial Sequence
  Synthetic
atagacgacaacgtaccggattcgtgtttcataaacctaatatacttccatattcagcatcatttactctgaata

SEQ ID NO: 307688 - DNA, 75 bp, Artificial Sequence
  Synthetic
gtttcataaacctaatatacttccatattcagcatcatttactctgaatagatcacagccagcacatgataattt

SEQ ID NO: 307689 - DNA, 75 bp, Artificial Sequence
  Synthetic
tagcgattgtgatatatctgtctgtccattagacacaacaatgaatggaattggttgctcaccagctagtacaga

SEQ ID NO: 307690 - DNA, 75 bp, Artificial Sequence
  Synthetic
ttgattattcgtgcgctttaaacgcaccagcgagtattcagcagtttgaacatgttgttccgctaagacgcgctc

SEQ ID NO: 307691 - DNA, 75 bp, Artificial Sequence
  Synthetic
accagcgagtattcagcagtttgaacatgttgttccgctaagacgcgctctcacgacagctacaattactctatt

SEQ ID NO: 307692 - DNA, 75 bp, Artificial Sequence
  Synthetic
aatgaacaccgctagctgtaaattaaagaattgcattaaaggtgaagctagactgaatacagcacttattagaat

SEQ ID NO: 307693 - DNA, 75 bp, Artificial Sequence
  Synthetic
gtactactacatggtatttcaatccagttattctaagaccaagcaatgtggaagttgaatttctgctgaatgggc

SEQ ID NO: 307694 - DNA, 75 bp, Artificial Sequence
  Synthetic
agttattctaagaccaagcaatgtggaagttgaatttctgctgaatgggcaaataatcaatacatatcaagcacg

SEQ ID NO: 307695 - DNA, 75 bp, Artificial Sequence
  Synthetic
tacactatagttgattatattaatacgattatacaaactatgactccgagacatcgggccatctacccagaaggt

SEQ ID NO: 307696 - DNA, 75 bp, Artificial Sequence
  Synthetic
aattagtaagaccaccaaatatgacaccagcagttgcgaatttatttccgcaagcaccaccatttatatttcatg

SEQ ID NO: 307697 - DNA, 75 bp, Artificial Sequence
  Synthetic
accagcagttgcgaatttatttccgcaagcaccaccatttatatttcatgccacagtcggacttacattgcgaat

SEQ ID NO: 307698 - DNA, 75 bp, Artificial Sequence
  Synthetic
tggcaaatgtgacagcagttcgtcaggaatatgctataccagtaggaccagtatttccaccaggtatgaactgga

SEQ ID NO: 307699 - DNA, 75 bp, Artificial Sequence
  Synthetic
ggaatatgctataccagtaggaccagtatttccaccaggtatgaactggacagagctgattaccaattattcacc

SEQ ID NO: 307700 - DNA, 75 bp, Artificial Sequence
  Synthetic
gcatgttgattaagtgaggaccaggctaactacctggtatccgaccttaatcaatatgtagctatgtcaagtcac

SEQ ID NO: 307701 - DNA, 75 bp, Artificial Sequence
  Synthetic
tcagactctacaagtaagggtatgatttcatactcgctacgtagagtaactgtttgaatggtatagtgagaggat

SEQ ID NO: 307702 - DNA, 75 bp, Artificial Sequence
  Synthetic
ggctataaaatggcttcgctcatttacagacagcttctcacgaattcatatgcagttgatttatcagatgaaatt

SEQ ID NO: 307703 - DNA, 75 bp, Artificial Sequence
  Synthetic
tgcagttgatttatcagatgaaattgaatcaattggatcagaaaaaactcaaagtacaactataaatccaggtcc

SEQ ID NO: 307704 - DNA, 75 bp, Artificial Sequence
  Synthetic
gaatcaattggatcagaaaaaactcaaagtacaactataaatccaggtcctttcgctcaaactaattacgcacca

SEQ ID NO: 307705 - DNA, 75 bp, Artificial Sequence
  Synthetic
gctagatggtccataccaaccaacttcgtttaaacctccaaatgactattggatactagttaattcaaattccag

SEQ ID NO: 307706 - DNA, 75 bp, Artificial Sequence
  Synthetic
tcgtttaaacctccaaatgactattggatactagttaattcaaattccagtggtgtggtgcttgaaggtactaac

SEQ ID NO: 307707 - DNA, 75 bp, Artificial Sequence
  Synthetic
agagagcagacaatactctttgtttggagtggacaagcaaattaccgtagttaacacctctaataaatggaagtt

SEQ ID NO: 307708 - DNA, 75 bp, Artificial Sequence
  Synthetic
ggagtggacaagcaaattaccgtagttaacacctctaataaatggaagtttatggaaatgtttagaaacaatagt

SEQ ID NO: 307709 - DNA, 75 bp, Artificial Sequence
  Synthetic
tggcatattaaagcatggtgggagattatggacatatcatggtgagacaccgaacgctaccaccgattattcaac

SEQ ID NO: 307710 - DNA, 75 bp, Artificial Sequence
  Synthetic
aaagatcagaggagtaattattatgatactatactatatggtgtggcaccaccaccagagtttagaaatagattt

SEQ ID NO: 307711 - DNA, 75 bp, Artificial Sequence
  Synthetic
ttatggacatatcatggtgagacaccgaacgctaccaccgattattcaacaacgtcaaacttaaacgaaattagt

SEQ ID NO: 307712 - DNA, 75 bp, Artificial Sequence
  Synthetic
gtgtactgaatatgtcaatactggattaccaccaatacaaaatactaggaatgtcgtacctttatcattaacttc

SEQ ID NO: 307713 - DNA, 75 bp, Artificial Sequence
  Synthetic
ttaccaccaatacaaaatactaggaatgtcgtacctttatcattaacttcaagaacagttatatataagagagca

SEQ ID NO: 307714 - DNA, 75 bp, Artificial Sequence
  Synthetic
gcaatatagcagagacattataattagatttaaatttaataatagtattataaagttgggtggtttaggttataa

SEQ ID NO: 307715 - DNA, 75 bp, Artificial Sequence
  Synthetic
agatttaaatttaataatagtattataaagttgggtggtttaggttataaatggtctgaagtttctttcaaagca

SEQ ID NO: 307716 - DNA, 75 bp, Artificial Sequence
  Synthetic
cactacttgttcggttaacggtgtgaataattttaattataatggtggttcattacctacggactttaatatatc

SEQ ID NO: 307717 - DNA, 75 bp, Artificial Sequence
  Synthetic
aataattttaattataatggtggttcattacctacggactttaatatatctagatatgaggtaatcaaagaaaat

SEQ ID NO: 307718 - DNA, 75 bp, Artificial Sequence
  Synthetic
ggtgtatgttagatcattagccgctaatttgaattctgttaaatgtacaggaggaaattataattttcggctacc

SEQ ID NO: 307719 - DNA, 75 bp, Artificial Sequence
  Synthetic
cagttgaggacaaatcgttcaagatgataagcagaaacaggcgcagaaataatcaacaaaaagatatagaaaaag

SEQ ID NO: 307720 - DNA, 75 bp, Artificial Sequence
  Synthetic
aatttgaattctgttaaatgtacaggaggaaattataattttcggctaccggttggtgcatggcctgttatgagt

SEQ ID NO: 307721 - DNA, 75 bp, Artificial Sequence
  Synthetic
agaaacaattagagactatagttaacaaagaagttaaggaaaacaaagattctataaaagaagataagctagtag

SEQ ID NO: 307722 - DNA, 75 bp, Artificial Sequence
  Synthetic
cacggattttgtgtctttgaactcactacgatttaggttcagtttgactgtcgaagaaccatctttttcaatact

SEQ ID NO: 307723 - DNA, 75 bp, Artificial Sequence
  Synthetic
ctacgatttaggttcagtttgactgtcgaagaaccatctttttcaatacttcgaactagggtttctaatttatat

SEQ ID NO: 307724 - DNA, 75 bp, Artificial Sequence
  Synthetic
aatattaatttacaaaagaatgatttggttaaagaagtcatgaatatacagaatcaaacattaaatacagtaatt

SEQ ID NO: 307725 - DNA, 75 bp, Artificial Sequence
  Synthetic
tggtagattttcacaaatatcattgattccaactaatgatgattaccaaactccaattatcaattcagtcactgt

SEQ ID NO: 307726 - DNA, 75 bp, Artificial Sequence
  Synthetic
attccaactaatgatgattaccaaactccaattatcaattcagtcactgttaggcaagatcttgagagacaactt

SEQ ID NO: 307727 - DNA, 75 bp, Artificial Sequence
  Synthetic
atataatactgacagcctcattgttaaaaagttaactgaaatccaggaatcaagtgctaaaacatataatacatt

SEQ ID NO: 307728 - DNA, 75 bp, Artificial Sequence
  Synthetic
acagttgatagatttagcattattaccattggatatgttttcaatgttctcagggataaaaagtacagtagacat

SEQ ID NO: 307729 - DNA, 75 bp, Artificial Sequence
  Synthetic
ccattggatatgttttcaatgttctcagggataaaaagtacagtagacatagcgaaatctatggctacaaatgta

SEQ ID NO: 307730 - DNA, 75 bp, Artificial Sequence
  Synthetic
cgattcgttatcaaatgcagcatcatccatatctagaaactcatccattcgatctaatgtgtcatcaatttcagt

SEQ ID NO: 307731 - DNA, 75 bp, Artificial Sequence
  Synthetic
tccatatctagaaactcatccattcgatctaatgtgtcatcaatttcagtgtggacggatgtttcaaaccaaatt

SEQ ID NO: 307732 - DNA, 75 bp, Artificial Sequence
  Synthetic
aagatatatgtctgaattaagacataaaatatctggagagacaaacactgcaaaatacccagctattctacatcc

SEQ ID NO: 307733 - DNA, 75 bp, Artificial Sequence
  Synthetic
tagtaggagacttaggctgaaagaaatgacaacacaaactgaagggatgaactttgacgatatctcagcagctgt

SEQ ID NO: 307734 - DNA, 75 bp, Artificial Sequence
  Synthetic
atgacaacacaaactgaagggatgaactttgacgatatctcagcagctgtattaaaaacgaaaatagatagatca

SEQ ID NO: 307735 - DNA, 75 bp, Artificial Sequence
  Synthetic
cattaactacaaggaacattgcagaattgattccaactcaattatatcatgacccaaattacgtgtttaatattg

SEQ ID NO: 307736 - DNA, 75 bp, Artificial Sequence
  Synthetic
aaagtttattccgcaaaggtcatatcgtgttttgaaagatgatgaagttatggaagctggtgttgatggaaagtt

SEQ ID NO: 307737 - DNA, 75 bp, Artificial Sequence
  Synthetic
cgtgttttgaaagatgatgaagttatggaagctggtgttgatggaaagtttttcgcatataaagttgataccttt

SEQ ID NO: 307738 - DNA, 75 bp, Artificial Sequence
  Synthetic
tccggtaatatctgctataatagattttaaaactttaaaaaacctgaatgataattatggtatcactcgtacaca

SEQ ID NO: 307739 - DNA, 75 bp, Artificial Sequence
  Synthetic
agaaatggctgcacatttacaactggaggctattacggtacaggttgaatcacaatttttagcaggaattagtgc

SEQ ID NO: 307740 - DNA, 75 bp, Artificial Sequence
  Synthetic
atcagaataatccaataatacgaaatagaatagaacagctaatatcgcagtgtagattgtgagagccttctagag

SEQ ID NO: 307741 - DNA, 75 bp, Artificial Sequence
  Synthetic
ggctttaaaagcgagaatttccgtttggctagcggttagctccttttaatgtatggtattgaatataccacagtt

SEQ ID NO: 307742 - DNA, 75 bp, Artificial Sequence
  Synthetic
tggctagcggttagctccttttaatgtatggtattgaatataccacagttttaacctttttgatatcaattatat

SEQ ID NO: 307743 - DNA, 75 bp, Artificial Sequence
  Synthetic
tacagatttctttttattgtatttatattgtcaccatttcttaatgcacaaaattatgggataaatcttccgatt

SEQ ID NO: 307744 - DNA, 75 bp, Artificial Sequence
  Synthetic
tattgtcaccatttcttaatgcacaaaattatgggataaatcttccgattactggatcaatggatactccgtacg

SEQ ID NO: 307745 - DNA, 75 bp, Artificial Sequence
  Synthetic
tatccaattgaagctgcaactgaaattaatgacaattcatggaaagatacactttctcagctatttttaactaaa

SEQ ID NO: 307746 - DNA, 75 bp, Artificial Sequence
  Synthetic
ttaatgacaattcatggaaagatacactttctcagctatttttaactaaagggtggccaacaggatctatttatt

SEQ ID NO: 307747 - DNA, 75 bp, Artificial Sequence
  Synthetic
tgtgattataatctagtattgatgaaatatgatgctgcattgcaattggacatgtcagagttagctgacttaata

SEQ ID NO: 307748 - DNA, 75 bp, Artificial Sequence
  Synthetic
aatatgatgctgcattgcaattggacatgtcagagttagctgacttaatacttaatgagtggctatgtaatccta

SEQ ID NO: 307749 - DNA, 75 bp, Artificial Sequence
  Synthetic
atatgcacttagtaggaactcttactgttgaacgtatacaagccacttctctaacttctttaatgatgttaattt

SEQ ID NO: 307750 - DNA, 75 bp, Artificial Sequence
  Synthetic
atttcaatgggaacgtcttgtactataaaagtatgtccactaaatactcaaacactaggaattggatgtcttact

SEQ ID NO: 307751 - DNA, 75 bp, Artificial Sequence
  Synthetic
taaaagtatgtccactaaatactcaaacactaggaattggatgtcttactactgatacggggacatttgaagaag

SEQ ID NO: 307752 - DNA, 75 bp, Artificial Sequence
  Synthetic
agtaacattaattttcttacaaattataatgaacaaattgataatgtggtagcagaaataatggccgcatataga

SEQ ID NO: 307753 - DNA, 75 bp, Artificial Sequence
  Synthetic
agcagaaataatggccgcatatagattgaatttatatcaacagaaaatgttgatgctcgttaccaggtttgtgtc

SEQ ID NO: 307754 - DNA, 75 bp, Artificial Sequence
  Synthetic
cacaaattaagtgtaacaacggatacttgtacgattaggaactgtaaaaagctagggccaagagaaaacgtagca

SEQ ID NO: 307755 - DNA, 75 bp, Artificial Sequence
  Synthetic
cttgtacgattaggaactgtaaaaagctagggccaagagaaaacgtagcagttatacaggttggtggttcagatg

SEQ ID NO: 307756 - DNA, 75 bp, Artificial Sequence
  Synthetic
gattaagaaaccgattaagaaatattccagttgaaagaagaagagctgacgtattcagaattattatgaataata

SEQ ID NO: 307757 - DNA, 75 bp, Artificial Sequence
  Synthetic
atgcgagtaaactggaaaaaatggtggcaagtgttttatacaatagtcgattacgtaaatcagattgtacaagtg

SEQ ID NO: 307758 - DNA, 75 bp, Artificial Sequence
  Synthetic
atgtccaaaagatcaagatcattgaattctgctgcattttattatagagtatagatatatcttaggttagagttg

SEQ ID NO: 307759 - DNA, 75 bp, Artificial Sequence
  Synthetic
tcacaatggatgtgcttttttccattgcgaagactgtttcagatctcaaaaagaaagttgtagttggtacaattt

SEQ ID NO: 307760 - DNA, 75 bp, Artificial Sequence
  Synthetic
aagaaagttgtagttggtacaatttatactaatgtggaagacattatacaacagacaaatgaattgattagaact

SEQ ID NO: 307761 - DNA, 75 bp, Artificial Sequence
  Synthetic
catatgttactaattcatcagtaattgatgttttatctaaagtagacaccacagtattcgcaagcattgtaaaag

SEQ ID NO: 307762 - DNA, 75 bp, Artificial Sequence
  Synthetic
gtggaattggaacacaacctcaaaaggaatggaattttcagcttcctcaactaggcacaactctattaaatttag

SEQ ID NO: 307763 - DNA, 75 bp, Artificial Sequence
  Synthetic
ggaatggaattttcagcttcctcaactaggcacaactctattaaatttagatgataattatgttcaagcaactag

SEQ ID NO: 307764 - DNA, 75 bp, Artificial Sequence
  Synthetic
aaatggttagagaagcttcaagaaatggaatgcaacctcagtccccgactcttataacacttgcatcatcaagat

SEQ ID NO: 307765 - DNA, 75 bp, Artificial Sequence
  Synthetic
ttttgtggtatatagtgatttatttaaatatattaaaactactacagttctgccaataaatgctgtctcctatga

SEQ ID NO: 307766 - DNA, 75 bp, Artificial Sequence
  Synthetic
cttataacacttgcatcatcaagatttaaaactattaatttcaacaatagttctcaatctattaagaattggagt

SEQ ID NO: 307767 - DNA, 75 bp, Artificial Sequence
  Synthetic
tgccaataaatgctgtctcctatgatggtgcaagaattatgcaagaaacataattaattatatagtatcatcttg

SEQ ID NO: 307768 - DNA, 75 bp, Artificial Sequence
  Synthetic
gcatgcctgcaggtcgactctagaggggatccagatctggctttaaaattttcagatcactttgctctacgaagt

SEQ ID NO: 307769 - DNA, 75 bp, Artificial Sequence
  Synthetic
ctttgaatatagaaactcatacattcttcaacgagctgatccacaatatgggaatgtcatgggagtgaggtatta

SEQ ID NO: 307770 - DNA, 75 bp, Artificial Sequence
  Synthetic
aaaatgcgcaaaacaatactcagcgtttcatttataatggaagacttaagagaccaatctcaaatgttctaatga

SEQ ID NO: 307771 - DNA, 75 bp, Artificial Sequence
  Synthetic
ccaacgaatcgaacaacatggttatacaatccagtgcaggtaatgaatggagcattcacaattgaattttataat

SEQ ID NO: 307772 - DNA, 75 bp, Artificial Sequence
  Synthetic
acaatccagtgcaggtaatgaatggagcattcacaattgaattttataataatggtcaactggttgatatggtta

SEQ ID NO: 307773 - DNA, 75 bp, Artificial Sequence
  Synthetic
cagataagagaaatgcgtattcatatgactgccttgtttaacagtttacatgatgataatgttaaatggagaatg

SEQ ID NO: 307774 - DNA, 75 bp, Artificial Sequence
  Synthetic
gttgatataataagaccagcggctatgacacaatatgttcagagactttttccgcaaggtggaccatatccttat

SEQ ID NO: 307775 - DNA, 75 bp, Artificial Sequence
  Synthetic
tgacacaatatgttcagagactttttccgcaaggtggaccatatccttatcaggctgcatatatgttaaccttaa

SEQ ID NO: 307776 - DNA, 75 bp, Artificial Sequence
  Synthetic
tgaacggacgccataccgttcatttctagcgagtagagaaaaactattgtacccgaaacgctgagttaaggatca

SEQ ID NO: 307777 - DNA, 75 bp, Artificial Sequence
  Synthetic
gactattcgattgttgctaatattaggagagactcagcaatgccagctggaacggtattccagccaggttttcca

SEQ ID NO: 307778 - DNA, 75 bp, Artificial Sequence
  Synthetic
ggagagactcagcaatgccagctggaacggtattccagccaggttttccatgggaacagactctatccaactaca

SEQ ID NO: 307779 - DNA, 75 bp, Artificial Sequence
  Synthetic
aggatcaatggcgtcctcactttatcatcaattgatctctcagaattattattcaactgggaatgagatattaaa

SEQ ID NO: 307780 - DNA, 75 bp, Artificial Sequence
  Synthetic
gttgactatgtagatgctggaaattatacatatgctcaattgccaccaacaaaatggggagctggagctaccttc

SEQ ID NO: 307781 - DNA, 75 bp, Artificial Sequence
  Synthetic
atacatatgctcaattgccaccaacaaaatggggagctggagctaccttcaaatcagtatttagtgctgcggaaa

SEQ ID NO: 307782 - DNA, 75 bp, Artificial Sequence
  Synthetic
tctaatcagtggctactgttttcaaaacctgttgatacaattaaactactaaaacacggaccacaaacgtacgat

SEQ ID NO: 307783 - DNA, 75 bp, Artificial Sequence
  Synthetic
aacctgttgatacaattaaactactaaaacacggaccacaaacgtacgataacactcttgcagcatgtgaattat

SEQ ID NO: 307784 - DNA, 75 bp, Artificial Sequence
  Synthetic
agtgataatcaagtgcgtgtaaatagtgactcattagtactattttggaatgcaggtggaacagtatttgacaaa

SEQ ID NO: 307785 - DNA, 75 bp, Artificial Sequence
  Synthetic
gtgactcattagtactattttggaatgcaggtggaacagtatttgacaaacgagtagttaattttaattggaata

SEQ ID NO: 307786 - DNA, 75 bp, Artificial Sequence
  Synthetic
tgtatggctaatatgactaatttcaatagtgatagctttaattgggaagagtggcattttacattaccacgtagt

SEQ ID NO: 307787 - DNA, 75 bp, Artificial Sequence
  Synthetic
aatacaacaattaatatatatgttgattattatctagctagtagtgatccatacaatcaactaaaagagttgcaa

SEQ ID NO: 307788 - DNA, 75 bp, Artificial Sequence
  Synthetic
tggacaaattaatgtcaatgaagtagtaagtaaagattcattatggcaagaagtgagatatgcaagagacataac

SEQ ID NO: 307789 - DNA, 75 bp, Artificial Sequence
  Synthetic
gtaagtaaagattcattatggcaagaagtgagatatgcaagagacataactctacaatgtaagatagaatcagag

SEQ ID NO: 307790 - DNA, 75 bp, Artificial Sequence
  Synthetic
aaccattaatcatacgtattcgtacactagagctggtgaaaaagtggatgcacatgttactattagttttaataa

SEQ ID NO: 307791 - DNA, 75 bp, Artificial Sequence
  Synthetic
tcgttaccaactgattttaaaataggcaaatttgatataatcgatgctgacacttacatgtatatagattattgg

SEQ ID NO: 307792 - DNA, 75 bp, Artificial Sequence
  Synthetic
taatataggagattttttccattataaagagatgtcatattactttaacatccctgttggagtacatccaggaat

SEQ ID NO: 307793 - DNA, 75 bp, Artificial Sequence
  Synthetic
aaagagatgtcatattactttaacatccctgttggagtacatccaggaatacattcatctggagtacgatttatg

SEQ ID NO: 307794 - DNA, 75 bp, Artificial Sequence
  Synthetic
ctcaatgaggtttatatttagagtgacagctgctaacggttggttcatgacatcgggtaacataaacacaagacg

SEQ ID NO: 307795 - DNA, 75 bp, Artificial Sequence
  Synthetic
catcgggtaacataaacacaagacgcatagcttcaggaacgggattcgcatatgcagatggctacgtttctcaga

SEQ ID NO: 307796 - DNA, 75 bp, Artificial Sequence
  Synthetic
caaactccaatagcgtcatcaagtacagtaaggatggatctagaaaggaagataaatgatttacggaatgatttt

SEQ ID NO: 307797 - DNA, 75 bp, Artificial Sequence
  Synthetic
cagtaaggatggatctagaaaggaagataaatgatttacggaatgattttaatcaactagcaagttctgtggcac

SEQ ID NO: 307798 - DNA, 75 bp, Artificial Sequence
  Synthetic
acacactatccaattacactgttgctcaagaagataatttagaaagattattgttaatcgcatctgtgaagagaa

SEQ ID NO: 307799 - DNA, 75 bp, Artificial Sequence
  Synthetic
ctagaatctgtaccagctgtagcatcatcagttaaagatgtcgctgcaaatgtcatgaaaagatttagaaataca

SEQ ID NO: 307800 - DNA, 75 bp, Artificial Sequence
  Synthetic
tgtcatgaaaagatttagaaatacaaaaatgttcaaaaaagctgccaaaccaaaatatagagaatttattattgg

SEQ ID NO: 307801 - DNA, 75 bp, Artificial Sequence
  Synthetic
acagtaaaaaactcaaactcgatgaattttgatgatcttacatcagcagtgatgatatcaactacaaacaaattg

SEQ ID NO: 307802 - DNA, 75 bp, Artificial Sequence
  Synthetic
gatgatatcaactacaaacaaattgcaacttacagatgtagatacattatcagaaattgttgcaagatcagctga

SEQ ID NO: 307803 - DNA, 75 bp, Artificial Sequence
  Synthetic
atgaagcaacacaaagtggagtgttctcatatgatcttgttacacttcaacagcgaagttttgatatggataaat

SEQ ID NO: 307804 - DNA, 75 bp, Artificial Sequence
  Synthetic
ctcatatgatcttgttacacttcaacagcgaagttttgatatggataaatttttacagctggcatctaaatcacc

SEQ ID NO: 307805 - DNA, 75 bp, Artificial Sequence
  Synthetic
catacggaattgcaactgacgtgctatatcaactagtggcatcagatactccaacacttttatcatttatcaata

SEQ ID NO: 307806 - DNA, 75 bp, Artificial Sequence
  Synthetic
ataataacccattgataaggaatagaattgaggaactattaagacaatgcagaatctaataagtgaggagatcga

SEQ ID NO: 307807 - DNA, 75 bp, Artificial Sequence
  Synthetic
ggtttgtacgacattgtacactgtttgcgtagttctctgcattcttttcatttacatgttattattcagaaaaat

SEQ ID NO: 307808 - DNA, 75 bp, Artificial Sequence
  Synthetic
gtattggatggtcacaaggtcagatgttcgttaatgatatacactatgatgggaatattgaaacaatagttaatg

SEQ ID NO: 307809 - DNA, 75 bp, Artificial Sequence
  Synthetic
gttcgttaatgatatacactatgatgggaatattgaaacaatagttaatgctacagatccatttgatgttagatc

SEQ ID NO: 307810 - DNA, 75 bp, Artificial Sequence
  Synthetic
aaacagatggatacctaaatgacggtaattatgctcagaccatcgcagcattatttgaaacgaaaggttttccga

SEQ ID NO: 307811 - DNA, 75 bp, Artificial Sequence
  Synthetic
taattatgctcagaccatcgcagcattatttgaaacgaaaggttttccgagaggatcaataatactcaaaacgta

SEQ ID NO: 307812 - DNA, 75 bp, Artificial Sequence
  Synthetic
atatagttataatacctgatagtccaactaattcagaagatatagaacgtatagcagaatggatattgaatgttt

SEQ ID NO: 307813 - DNA, 75 bp, Artificial Sequence
  Synthetic
aactaattcagaagatatagaacgtatagcagaatggatattgaatgtttggcgatgtgatgatatgaatttaga

SEQ ID NO: 307814 - DNA, 75 bp, Artificial Sequence
  Synthetic
gcaatgattgtgatatatctgtctgtcctttagacacaacgatgaatggaattggttgctcaccagctagtacag

SEQ ID NO: 307815 - DNA, 75 bp, Artificial Sequence
  Synthetic
gtagataatgtaaaacatcgtattcaaatgaatacggctagttgtaaattgaaaaattgcattaaaggtgaagct

SEQ ID NO: 307816 - DNA, 75 bp, Artificial Sequence
  Synthetic
tgaaatatttttgtaaaaacattaatactgaattgttttattacggtcattcaaagtgtcacgtcgtttcagaat

SEQ ID NO: 307817 - DNA, 75 bp, Artificial Sequence
  Synthetic
acaatcatacaaactatgtctccgagacatcgggcaatctatccagaaggttggatgctgagatatgcgtaaaca

SEQ ID NO: 307818 - DNA, 75 bp, Artificial Sequence
  Synthetic
atgttgctttaaacagaattgaatcgcaacaaatggatttgctgtgatcctctaaaatctgtgtctgatcgcaac

SEQ ID NO: 307819 - DNA, 75 bp, Artificial Sequence
  Synthetic
aaaaaaaatggcgcaatccatagtcgtagatggggactacgacgctcttgctagtagatatcttaaatttgttta

SEQ ID NO: 307820 - DNA, 75 bp, Artificial Sequence
  Synthetic
ctagtagatatcttaaatttgtttatgattttgaaaatgtaacttatcaaaataattacttcgccacggatgaat

SEQ ID NO: 307821 - DNA, 75 bp, Artificial Sequence
  Synthetic
tgattttgaaaatgtaacttatcaaaataattacttcgccacggatgaatttaaaaaggatatagagcagtatct

SEQ ID NO: 307822 - DNA, 75 bp, Artificial Sequence
  Synthetic
tggagaaaatactgttagatagtgtacctgcagaagaaagatgtttaatttcaaaattagtattcgcatatggta

SEQ ID NO: 307823 - DNA, 75 bp, Artificial Sequence
  Synthetic
acctgcagaagaaagatgtttaatttcaaaattagtattcgcatatggtaaacatggaaatgtagaaaataaact

SEQ ID NO: 307824 - DNA, 75 bp, Artificial Sequence
  Synthetic
ctaaaccttatgaaaacaacgtaattacgtctgaaatttttaaagaaaaatcagaatacactgatatatacatgg

SEQ ID NO: 307825 - DNA, 75 bp, Artificial Sequence
  Synthetic
tacgtctgaaatttttaaagaaaaatcagaatacactgatatatacatggacccatcaattaatacatcctgtca

SEQ ID NO: 307826 - DNA, 75 bp, Artificial Sequence
  Synthetic
atattaaaaatgctgccagattagaaaaactatttacgattattgctgctacaattaataaatatggaatgccta

SEQ ID NO: 307827 - DNA, 75 bp, Artificial Sequence
  Synthetic
acaattaataaatatggaatgcctagacataatactcgatatagatatgaatgggaaacgatgaaaaataaacca

SEQ ID NO: 307828 - DNA, 75 bp, Artificial Sequence
  Synthetic
tgtcgatcatcatacttatatgatagccagagaattaattgtaaagtcatttacaaacagaacatcattagcgaa

SEQ ID NO: 307829 - DNA, 75 bp, Artificial Sequence
  Synthetic
ttcaatagtagcaaacgtcagaagagattcagcgatgccagctggaactgtttttcaaccgggatttccatggga

SEQ ID NO: 307830 - DNA, 75 bp, Artificial Sequence
  Synthetic
ttacaaacagaacatcattagcgaaattagtatcatcaccaatgacagtactgacagccatgttaccgatacgag

SEQ ID NO: 307831 - DNA, 75 bp, Artificial Sequence
  Synthetic
attaactatttaatatcaaaagaaatggctgaagattttatgcaagcaataaagcaattaagagatgaaggtttg

SEQ ID NO: 307832 - DNA, 75 bp, Artificial Sequence
  Synthetic
tggctgaagattttatgcaagcaataaagcaattaagagatgaaggtttggaatatataccagattattatgaga

SEQ ID NO: 307833 - DNA, 75 bp, Artificial Sequence
  Synthetic
tactcattcagtttccatgttggttatagaaagcaagcgttgtcagatgctgtatatgatcagattactgtaacg

SEQ ID NO: 307834 - DNA, 75 bp, Artificial Sequence
  Synthetic
cattctctacacctgaaataactggaccacatacgaatacagtaattgaatggagtaacttaataaatactaata

SEQ ID NO: 307835 - DNA, 75 bp, Artificial Sequence
  Synthetic
atagaaagcaagcgttgtcagatgctgtatatgatcagattactgtaacgtatagcgataatgtcaatatggaaa

SEQ ID NO: 307836 - DNA, 75 bp, Artificial Sequence
  Synthetic
aaagataaaatagtacatgaagataaaagattagaagaatacgaattatcagcgttactatcaatgtcatctgca

SEQ ID NO: 307837 - DNA, 75 bp, Artificial Sequence
  Synthetic
aaagattagaagaatacgaattatcagcgttactatcaatgtcatctgcatcaaatggaatactaagagagataa

SEQ ID NO: 307838 - DNA, 75 bp, Artificial Sequence
  Synthetic
gatgatatctatcataaaaaatatacaacagatataccacctgtggacgaaagaaatccaatcccattaggaaga

SEQ ID NO: 307839 - DNA, 75 bp, Artificial Sequence
  Synthetic
caacagatataccacctgtggacgaaagaaatccaatcccattaggaagaagagatgttccaggacgtagaacaa

SEQ ID NO: 307840 - DNA, 75 bp, Artificial Sequence
  Synthetic
gctgaaataatgcttaactatgcaaaacgtgaaagggagtattcagagttttattctcaagcaaatcaagtatta

SEQ ID NO: 307841 - DNA, 75 bp, Artificial Sequence
  Synthetic
aacgtgaaagggagtattcagagttttattctcaagcaaatcaagtattatcgtatggagatgtaactagatatc

SEQ ID NO: 307842 - DNA, 75 bp, Artificial Sequence
  Synthetic
tctcaacataatactaaagtattacgaagatcaataatacgggcaatgaaaagactaaaacagttgacgcataat

SEQ ID NO: 307843 - DNA, 75 bp, Artificial Sequence
  Synthetic
gaagatcaataatacgggcaatgaaaagactaaaacagttgacgcataatataaatatacataaagctattaata

SEQ ID NO: 307844 - DNA, 75 bp, Artificial Sequence
  Synthetic
aaaaaagccattcaatatggtgctacggcatcaggcgaaaaacagactaagatcatgaattcaatagcgaataaa

SEQ ID NO: 307845 - DNA, 75 bp, Artificial Sequence
  Synthetic
cggcatcaggcgaaaaacagactaagatcatgaattcaatagcgaataaagctttaatacagacagttctcggaa

SEQ ID NO: 307846 - DNA, 75 bp, Artificial Sequence
  Synthetic
gatgacaattatgctatagtacgctttcctatcgcaataactgaaacattactgtcagaattcacatcaaaatta

SEQ ID NO: 307847 - DNA, 75 bp, Artificial Sequence
  Synthetic
ttcctatcgcaataactgaaacattactgtcagaattcacatcaaaattaagatcatattactcagaaatgaatg

SEQ ID NO: 307848 - DNA, 75 bp, Artificial Sequence
  Synthetic
tatgtagctggtggaatgttgttttttagagctggtgtgaatatactcaatcatgaaaagagaaaccaagattca

SEQ ID NO: 307849 - DNA, 75 bp, Artificial Sequence
  Synthetic
ttatgataaatgtttgttatctcaacaatttactgattatgcagctttaaattcgttaagattcatattcagagt

SEQ ID NO: 307850 - DNA, 75 bp, Artificial Sequence
  Synthetic
ttagagctggtgtgaatatactcaatcatgaaaagagaaaccaagattcagcatatgatatggcggctacattat

SEQ ID NO: 307851 - DNA, 75 bp, Artificial Sequence
  Synthetic
tttatattaactaaaatatgccagatgacttcaattaaaatcactggtacattgagattgtttccaatgaaatca

SEQ ID NO: 307852 - DNA, 75 bp, Artificial Sequence
  Synthetic
gagtagcatcagggacaggatttgcttattcagacggtcatgtagctaatacagttggaactatttcatttattt

SEQ ID NO: 307853 - DNA, 75 bp, Artificial Sequence
  Synthetic
tgacttcaattaaaatcactggtacattgagattgtttccaatgaaatcaatattggcattgaattcagcattta

SEQ ID NO: 307854 - DNA, 75 bp, Artificial Sequence
  Synthetic
tttatacagttgcaaaggaagctgagttcaattaaagcgaaatctaaaattgctgataatatcgcaaagtcaccg

SEQ ID NO: 307855 - DNA, 75 bp, Artificial Sequence
  Synthetic
gttcaattaaagcgaaatctaaaattgctgataatatcgcaaagtcaccgcaatttaaatcatacgttgaattgc

SEQ ID NO: 307856 - DNA, 75 bp, Artificial Sequence
  Synthetic
cgattgaatgaaaaagcaaaactcaatagttatgcaccaatagcattagaaaaaagacgggatcaatttagtata

SEQ ID NO: 307857 - DNA, 75 bp, Artificial Sequence
  Synthetic
atagttatgcaccaatagcattagaaaaaagacgggatcaatttagtataatggtatcatttctacaaaatccaa

SEQ ID NO: 307858 - DNA, 75 bp, Artificial Sequence
  Synthetic
atatcagggtttatcaagattgattcttcaacagtactaccgaaagaagagaataacacaatgccgctattacct

SEQ ID NO: 307859 - DNA, 75 bp, Artificial Sequence
  Synthetic
tgatataaaaggatcctcatcaactgtgtcaaaaataatcaaacagtattctgtatatactcctggaattgaaga

SEQ ID NO: 307860 - DNA, 75 bp, Artificial Sequence
  Synthetic
gtagatactataagaggttattttgcatcatttaatgtgccaaaggctgatgttgatacctatattagtactcag

SEQ ID NO: 307861 - DNA, 75 bp, Artificial Sequence
  Synthetic
tgttgatacctatattagtactcagatgtataaacatgacagatttaaaatattacaagcttatatttacaattt

SEQ ID NO: 307862 - DNA, 75 bp, Artificial Sequence
  Synthetic
gattttttgatcatgttattcatacaccagtggctaaaacaccaacagctgtttttatgatagatctagcattaa

SEQ ID NO: 307863 - DNA, 75 bp, Artificial Sequence
  Synthetic
accagtggctaaaacaccaacagctgtttttatgatagatctagcattaagattaaagattataaatcactgtat

SEQ ID NO: 307864 - DNA, 75 bp, Artificial Sequence
  Synthetic
tcagtacacgctaataaaactgactatcttaagctgtggcgcatgttatggaatgttaaaacaatgaattcaccg

SEQ ID NO: 307865 - DNA, 75 bp, Artificial Sequence
  Synthetic
atcttaagctgtggcgcatgttatggaatgttaaaacaatgaattcaccgtattcgaaaaattcaatgtttgatg

SEQ ID NO: 307866 - DNA, 75 bp, Artificial Sequence
  Synthetic
aaaaggttcaataatacttaaaacatatacacagacatcagactttataaattcagtagaaatgacatgctctta

SEQ ID NO: 307867 - DNA, 75 bp, Artificial Sequence
  Synthetic
aaatgcaaagaaatggtggactatattttatacaataattgattatattaatacaattgtacaagcaatgactcc

SEQ ID NO: 307868 - DNA, 75 bp, Artificial Sequence
  Synthetic
aatacaattgtacaagcaatgactcccagacatcgtgcgatttatccagaagggtggatgttgaggtatgcgtaa

SEQ ID NO: 307869 - DNA, 75 bp, Artificial Sequence
  Synthetic
aacgagtcttccctcaatttcttctagtatctttaaaaatgaatcatcttctacaacgtcaactctttctggaaa

SEQ ID NO: 307870 - DNA, 75 bp, Artificial Sequence
  Synthetic
taaaatattatctgaaattgtaaaaggtggaggatggggatatgactatactagtgtaacatttaaaacagttaa

SEQ ID NO: 307871 - DNA, 75 bp, Artificial Sequence
  Synthetic
ataaatacatgttgtcgaagtctccagaggatattggaccatctgattctgcttcaaacgatccactcaccagct

SEQ ID NO: 307872 - DNA, 75 bp, Artificial Sequence
  Synthetic
gcttcaaacgatccactcaccagcttttcgattagatcgaatgcagttaagacaaatgcagatgctggcgtgtct

SEQ ID NO: 307873 - DNA, 75 bp, Artificial Sequence
  Synthetic
agtggatttctccttaactaaaggtattaatgttagtgctaatcttgattcatgtatatcaatttcaactgatca

SEQ ID NO: 307874 - DNA, 75 bp, Artificial Sequence
  Synthetic
taaaaaggagaaatccaaaaaagataaaagtaggaaacactacccaaggattgaagcagattctgactctgagga

SEQ ID NO: 307875 - DNA, 75 bp, Artificial Sequence
  Synthetic
ggcttttaaacgaagtcttcaacatggatgtcctgtactccttgtcaaaaactcttaaagatgctagagacaaaa

SEQ ID NO: 307876 - DNA, 75 bp, Artificial Sequence
  Synthetic
actcttaaagatgctagagacaaaattgtcgaaggcacattatactccaatgtgagtgatctaatccaacaattt

SEQ ID NO: 307877 - DNA, 75 bp, Artificial Sequence
  Synthetic
ttgtcgaaggcacattatactccaatgtgagtgatctaatccaacaatttaatcaaatgataattactatgaatg

SEQ ID NO: 307878 - DNA, 75 bp, Artificial Sequence
  Synthetic
aattttgattttggactacttggaacaactctactaaatttagacgctaactacgtagaaatggcccgcaataca

SEQ ID NO: 307879 - DNA, 75 bp, Artificial Sequence
  Synthetic
gctttagcgagttcagttgctttaaatgatatactttccctagctatgtctccattaacattttctaatctgtta

SEQ ID NO: 307880 - DNA, 75 bp, Artificial Sequence
  Synthetic
caactctactaaatttagacgctaactacgtagaaatggcccgcaatacaattgattattttgtagattttgtag

SEQ ID NO: 307881 - DNA, 75 bp, Artificial Sequence
  Synthetic
gcaccacaatcggattcgcttagaaagttgtcaggtattaaatttaagagaataaattttgacaattcatcagaa

SEQ ID NO: 307882 - DNA, 75 bp, Artificial Sequence
  Synthetic
agttgtcaggtattaaatttaagagaataaattttgacaattcatcagaatatatagagaactggaatttgcaaa

SEQ ID NO: 307883 - DNA, 75 bp, Artificial Sequence
  Synthetic
tattcagcgtcatttacattgaacagatcacaaccagctcatgataatttgatgggtacgatgtggcttaatgcg

SEQ ID NO: 307884 - DNA, 75 bp, Artificial Sequence
  Synthetic
gatcacaaccagctcatgataatttgatgggtacgatgtggcttaatgcgggatcagaaattcaggtcgctggat

SEQ ID NO: 307885 - DNA, 75 bp, Artificial Sequence
  Synthetic
catattgtacagctccgaagagtattgactacagctacaataactcttttaccagatgcagaaagatttagtttt

SEQ ID NO: 307886 - DNA, 75 bp, Artificial Sequence
  Synthetic
tgactacagctacaataactcttttaccagatgcagaaagatttagttttccaagagtgattaactcagctgacg

SEQ ID NO: 307887 - DNA, 75 bp, Artificial Sequence
  Synthetic
gaggtagagtttctactaaacgggcagataataaatacttatcaagcaagatttggaacaattatagctagaaac

SEQ ID NO: 307888 - DNA, 75 bp, Artificial Sequence
  Synthetic
agataataaatacttatcaagcaagatttggaacaattatagctagaaactttgatacaatcagattgtcgtttc

SEQ ID NO: 307889 - DNA, 75 bp, Artificial Sequence
  Synthetic
gtgcaatgagggtattggggctttttgaacgcgggaataacttgaattttgcagatacctatgtatatacctgga

SEQ ID NO: 307890 - DNA, 75 bp, Artificial Sequence
  Synthetic
aatgcgcagccgtttgaacatcatgctacagtaggactcacacttagaattgaatctgcagtttgtgaatccgta

SEQ ID NO: 307891 - DNA, 75 bp, Artificial Sequence
  Synthetic
ctacagtaggactcacacttagaattgaatctgcagtttgtgaatccgtacttgccgatgcaagtgaaacgatgc

SEQ ID NO: 307892 - DNA, 75 bp, Artificial Sequence
  Synthetic
gctacgacagtcatattatatctggatgttatagacataaaagaagtcaacaaagcatttgaattattgaactca

SEQ ID NO: 307893 - DNA, 75 bp, Artificial Sequence
  Synthetic
atgttatagacataaaagaagtcaacaaagcatttgaattattgaactcaaatggtataccagcactcattataa

SEQ ID NO: 307894 - DNA, 75 bp, Artificial Sequence
  Synthetic
gttttcccaccaggtatgaattggactgatttgatcactaactattcaccatctagagaggataacttgcagcgt

SEQ ID NO: 307895 - DNA, 75 bp, Artificial Sequence
  Synthetic
ctgatttgatcactaactattcaccatctagagaggataacttgcagcgtgtatttacagtggcttccattagaa

SEQ ID NO: 307896 - DNA, 75 bp, Artificial Sequence
  Synthetic
caacataagatagtgtactttcatgagtatacctattataaaaataatgagtttattgtaagtgatgaattctgg

SEQ ID NO: 307897 - DNA, 75 bp, Artificial Sequence
  Synthetic
agtatacctattataaaaataatgagtttattgtaagtgatgaattctggctatatactaatataaatgagttat

SEQ ID NO: 307898 - DNA, 75 bp, Artificial Sequence
  Synthetic
tgagtatgtagctacgtcaagctgtttgaactctgtaagtaaggatgcgtttacgcattcgctacacagagtaat

SEQ ID NO: 307899 - DNA, 75 bp, Artificial Sequence
  Synthetic
ttgaactctgtaagtaaggatgcgtttacgcattcgctacacagagtaatcactcagatgatgtagtgagaggat

SEQ ID NO: 307900 - DNA, 75 bp, Artificial Sequence
  Synthetic
ggtaaagaatatacattgtataatacagcaacagatgatgacatcttatataaatatatttatgaaaaagattca

SEQ ID NO: 307901 - DNA, 75 bp, Artificial Sequence
  Synthetic
aagatggacaagcttgctgacctcaactacacattgagtgtaatcactttaatgaatgatacattgcattctata

SEQ ID NO: 307902 - DNA, 75 bp, Artificial Sequence
  Synthetic
aatgaatgatacattgcattctataattcaagatccaggaatggcgtattttccatatattgcatctgttttaac

SEQ ID NO: 307903 - DNA, 75 bp, Artificial Sequence
  Synthetic
cagcaacagatgatgacatcttatataaatatatttatgaaaaagattcaattgtgaacagtgctgattataaga

SEQ ID NO: 307904 - DNA, 75 bp, Artificial Sequence
  Synthetic
ttacggatgagatttgcagttccatttgatcaattatcaaatagaattaccagatctcgtgttttctctaaaagc

SEQ ID NO: 307905 - DNA, 75 bp, Artificial Sequence
  Synthetic
tgagaacatcgaaatgttcatataaagtgattaaatactgtatgcttacaattatcaatactctattgaagttgg

SEQ ID NO: 307906 - DNA, 75 bp, Artificial Sequence
  Synthetic
agtgattaaatactgtatgcttacaattatcaatactctattgaagttggctggttataaagaacaggttaccac

SEQ ID NO: 307907 - DNA, 75 bp, Artificial Sequence
  Synthetic
ttgatcaattatcaaatagaattaccagatctcgtgttttctctaaaagcgcaattcacattggattacgtaacg

SEQ ID NO: 307908 - DNA, 75 bp, Artificial Sequence
  Synthetic
tctgcaaatggaatagtgatttcagaattgaaaggattaggaagttactctgaaaaaaagataagtgaatttgat

SEQ ID NO: 307909 - DNA, 75 bp, Artificial Sequence
  Synthetic
gtcaattggaaatgattgataaattaactacacgtgagattgaacaggttgagttactcaaacgtatacacgata

SEQ ID NO: 307910 - DNA, 75 bp, Artificial Sequence
  Synthetic
aactacacgtgagattgaacaggttgagttactcaaacgtatacacgataagttgatgactaggacagttgatgt

SEQ ID NO: 307911 - DNA, 75 bp, Artificial Sequence
  Synthetic
aattgaaaggattaggaagttactctgaaaaaaagataagtgaatttgatattggacaatttaaaaattacatga

SEQ ID NO: 307912 - DNA, 75 bp, Artificial Sequence
  Synthetic
tgtacaataatcggagcagcacctggttattggatttcatcaatgaaaaaatatttcaccatagtaacgtatgat

SEQ ID NO: 307913 - DNA, 75 bp, Artificial Sequence
  Synthetic
gttattggatttcatcaatgaaaaaatatttcaccatagtaacgtatgataacaagaaagttgatagcacagaac

SEQ ID NO: 307914 - DNA, 75 bp, Artificial Sequence
  Synthetic
ctgtcttcggaagcggcggaactctttaccgcaagccccatcggacctgatggttggctgagaagccacagtcaa

SEQ ID NO: 307915 - DNA, 75 bp, Artificial Sequence
  Synthetic
ggcgtttatattgatgtaagatctgactttgaaacaaatgactggcgacagagaagaaaattgatagaagaagaa

SEQ ID NO: 307916 - DNA, 75 bp, Artificial Sequence
  Synthetic
atggcttcgctcatttatagacagttacttacaaattcatacacaactgatttatttgatgaaattaaagaaatt

SEQ ID NO: 307917 - DNA, 75 bp, Artificial Sequence
  Synthetic
actttgaaacaaatgactggcgacagagaagaaaattgatagaagaagaaacgaaaaaatggttggaagtttctt

SEQ ID NO: 307918 - DNA, 75 bp, Artificial Sequence
  Synthetic
tttatttgatgaaattaaagaaattgggtcatcaaaatcgcaagatgttacaataaatcctggaccgtttgctca

SEQ ID NO: 307919 - DNA, 75 bp, Artificial Sequence
  Synthetic
gggtcatcaaaatcgcaagatgttacaataaatcctggaccgtttgctcaaactggatacgctccagtagattgg

SEQ ID NO: 307920 - DNA, 75 bp, Artificial Sequence
  Synthetic
gcaatggatggagagatacctgatggatattttatacattttcccacaacatatcgaaaaagtgaatactattta

SEQ ID NO: 307921 - DNA, 75 bp, Artificial Sequence
  Synthetic
gatattttatacattttcccacaacatatcgaaaaagtgaatactatttacttattgataagcacatcatcagaa

SEQ ID NO: 307922 - DNA, 75 bp, Artificial Sequence
  Synthetic
accatatcaaccaacaacttttaatccaccaatagaatattggacgttattcgctcctaatgacaagggtgtagt

SEQ ID NO: 307923 - DNA, 75 bp, Artificial Sequence
  Synthetic
ccaccaatagaatattggacgttattcgctcctaatgacaagggtgtagttgctgaattgacaaataatacagat

SEQ ID NO: 307924 - DNA, 75 bp, Artificial Sequence
  Synthetic
atatactcagataatgtgttcatttcaggtaagtattcattaagaggtaaaactgaaggcgtattggcgttatat

SEQ ID NO: 307925 - DNA, 75 bp, Artificial Sequence
  Synthetic
caggtaagtattcattaagaggtaaaactgaaggcgtattggcgttatattgtctatcgaatacaatgaatcaaa

SEQ ID NO: 307926 - DNA, 75 bp, Artificial Sequence
  Synthetic
aacatacaccatattcggtcaacagattaacctagtgattgagaatgcatcacatacaaaatggaaatttgctga

SEQ ID NO: 307927 - DNA, 75 bp, Artificial Sequence
  Synthetic
attaacctagtgattgagaatgcatcacatacaaaatggaaatttgctgattttagtagaagaagtcaaaatgat

SEQ ID NO: 307928 - DNA, 75 bp, Artificial Sequence
  Synthetic
gtaagattaaataatacatatgaagttaacaaaataatagattttaaaacaaattttgatcatacttttttaccg

SEQ ID NO: 307929 - DNA, 75 bp, Artificial Sequence
  Synthetic
aatgaaatatggggcaagactatttacgttcactggagatacatcgagtgcggcaccacaagaatttggatatac

SEQ ID NO: 307930 - DNA, 75 bp, Artificial Sequence
  Synthetic
acgttcactggagatacatcgagtgcggcaccacaagaatttggatatacgaccaacaattacagtgcggttgaa

SEQ ID NO: 307931 - DNA, 75 bp, Artificial Sequence
  Synthetic
tgctggaatatttggctatgcaataacaaaagatctgaaatccaatggaaacaatcatatatacattattccaaa

SEQ ID NO: 307932 - DNA, 75 bp, Artificial Sequence
  Synthetic
acaaaagatctgaaatccaatggaaacaatcatatatacattattccaaatgcgagagatgagaataatttcgac

SEQ ID NO: 307933 - DNA, 75 bp, Artificial Sequence
  Synthetic
gtgtaggaattatattaatcatggtcttccaccaatgcagaatactaggaacgtggtatcagtcgcattatcagc

SEQ ID NO: 307934 - DNA, 75 bp, Artificial Sequence
  Synthetic
cttccaccaatgcagaatactaggaacgtggtatcagtcgcattatcagctagagaaatagcaacacaaagagta

SEQ ID NO: 307935 - DNA, 75 bp, Artificial Sequence
  Synthetic
ttcagaatcagcaacaactatgtcaggatacatatttagagatatggttagtggaaaagagaatatgcaggatac

SEQ ID NO: 307936 - DNA, 75 bp, Artificial Sequence
  Synthetic
ggatacatatttagagatatggttagtggaaaagagaatatgcaggatacagatagagataattatgcatctggt

SEQ ID NO: 307937 - DNA, 75 bp, Artificial Sequence
  Synthetic
gcaatataatagagacattacaattagatttaaatttgctaatcaaataatcaaatctggaggactaggctacaa

SEQ ID NO: 307938 - DNA, 75 bp, Artificial Sequence
  Synthetic
agatttaaatttgctaatcaaataatcaaatctggaggactaggctacaaatgggcagagatctcttttagacca

SEQ ID NO: 307939 - DNA, 75 bp, Artificial Sequence
  Synthetic
tataggatggcttagattacataaggctggccaatttaaagttaagtcagatatatataaagaacatacggacga

SEQ ID NO: 307940 - DNA, 75 bp, Artificial Sequence
  Synthetic
caccacatgttcagttaatggagtgaacaattttagttataatggaggttcgttaccaacagattttgttatatc

SEQ ID NO: 307941 - DNA, 75 bp, Artificial Sequence
  Synthetic
gtgataaagttggtgagaaatatgcaaagaaaataatggagatttgggaaattcaagtgtgaggctaatcacctc

SEQ ID NO: 307942 - DNA, 75 bp, Artificial Sequence
  Synthetic
aacaattttagttataatggaggttcgttaccaacagattttgttatatcaagatacgaggttattaaagagaat

SEQ ID NO: 307943 - DNA, 75 bp, Artificial Sequence
  Synthetic
cttccgttgaatggatttttaacgtagctggatcagctgcttcatcttctttagatagagcgatcaaggatgcag

SEQ ID NO: 307944 - DNA, 75 bp, Artificial Sequence
  Synthetic
ggtatatgtaaggtcgttggcagctgatttaaattcaataatatgtagcggtggtagctatagtttcgcattgcc

SEQ ID NO: 307945 - DNA, 75 bp, Artificial Sequence
  Synthetic
gatttaaattcaataatatgtagcggtggtagctatagtttcgcattgccattaggaaattttccagttatgtca

SEQ ID NO: 307946 - DNA, 75 bp, Artificial Sequence
  Synthetic
cacagattttgtatctctcaattcattaagattcaggttcagattagcggttgaagagccaccgttttcaataac

SEQ ID NO: 307947 - DNA, 75 bp, Artificial Sequence
  Synthetic
atgctaaagattttcacgaaataacgggaaggttctctttaatatcgttagtaccgtcaaacgacgattatcaaa

SEQ ID NO: 307948 - DNA, 75 bp, Artificial Sequence
  Synthetic
ggagaattacgtaatgaatttaacgcattatctcaacaaattgcaatgtctcaacttatagatttagcactacta

SEQ ID NO: 307949 - DNA, 75 bp, Artificial Sequence
  Synthetic
cattatctcaacaaattgcaatgtctcaacttatagatttagcactactaccattagatatgttctcgatgttct

SEQ ID NO: 307950 - DNA, 75 bp, Artificial Sequence
  Synthetic
ggaaattcatgttcatataatgcaactgctgcttttgtttcgactattttgggtacacctattaaaatgtataat

SEQ ID NO: 307951 - DNA, 75 bp, Artificial Sequence
  Synthetic
atgaaaaaatttaggaagtcaaatttagctagttcggtttcagcgttaaccgagtccttatcggacgcggcatca

SEQ ID NO: 307952 - DNA, 75 bp, Artificial Sequence
  Synthetic
tagctagttcggtttcagcgttaaccgagtccttatcggacgcggcatcatcaatatctagaggatcaactatta

SEQ ID NO: 307953 - DNA, 75 bp, Artificial Sequence
  Synthetic
gcaaatacaactagtgcaactagttcaataacgacacaaactgccacaatcagtaaacgattaagattgaaggaa

SEQ ID NO: 307954 - DNA, 75 bp, Artificial Sequence
  Synthetic
caataacgacacaaactgccacaatcagtaaacgattaagattgaaggaaatagctacacagaccgatggtatga

SEQ ID NO: 307955 - DNA, 75 bp, Artificial Sequence
  Synthetic
atgcaaattgccccaaatacgctaccagatattgttacagaggcatcagaaaaattcataccaaatagagcgtat

SEQ ID NO: 307956 - DNA, 75 bp, Artificial Sequence
  Synthetic
cagatattgttacagaggcatcagaaaaattcataccaaatagagcgtatcgagttatagataacgatgaagtgt

SEQ ID NO: 307957 - DNA, 75 bp, Artificial Sequence
  Synthetic
gaggaaatacctttcgatgtacaaaaattcgcagacttagttacagattcaccaggtatttcagcaataatagat

SEQ ID NO: 307958 - DNA, 75 bp, Artificial Sequence
  Synthetic
gtagtggaaaatctaagaaggaagctaaaagaattgcagcatatgacattcttgatcaacttggtgtttaaattg

SEQ ID NO: 307959 - DNA, 75 bp, Artificial Sequence
  Synthetic
ggcatataatttattacgatctgatccgcgagtattacgcgagtttatcaatcaagagaatcctataatacgtaa

SEQ ID NO: 307960 - DNA, 75 bp, Artificial Sequence
  Synthetic
ccgcgagtattacgcgagtttatcaatcaagagaatcctataatacgtaatagaattgagaatctaatcatgcaa

SEQ ID NO: 307961 - DNA, 75 bp, Artificial Sequence
  Synthetic
ggctttaaaagagagaatttccgtctggctagcggttagctccttttaatgtatggtattgaatataccacaatt

SEQ ID NO: 307962 - DNA, 75 bp, Artificial Sequence
  Synthetic
tggctagcggttagctccttttaatgtatggtattgaatataccacaattctaatcttcttgatatcgattacat

SEQ ID NO: 307963 - DNA, 75 bp, Artificial Sequence
  Synthetic
tacaggtttttatttatagtagtaatactggccgtcataacaaatgcacaaaattacgggattaatttgccaata

SEQ ID NO: 307964 - DNA, 75 bp, Artificial Sequence
  Synthetic
tactggccgtcataacaaatgcacaaaattacgggattaatttgccaataacaggatcaatggatactgcgtata

SEQ ID NO: 307965 - DNA, 75 bp, Artificial Sequence
  Synthetic
tatccagtcgaagcatcaaatgaaatagccgatactgaatggaagaacacactatcacaactgtttctgactaaa

SEQ ID NO: 307966 - DNA, 75 bp, Artificial Sequence
  Synthetic
aaacatataacaagctgtttagattgtttatgccggtaaagagtcatttgtatgatgtgaatggagaaagaaaac

SEQ ID NO: 307967 - DNA, 75 bp, Artificial Sequence
  Synthetic
tagccgatactgaatggaagaacacactatcacaactgtttctgactaaaggatggccaactggatccgtatatt

SEQ ID NO: 307968 - DNA, 75 bp, Artificial Sequence
  Synthetic
tgtgattacaatctagttttaatgaaatatgattcaacactagaattggacatgtctgagttagcggacctcata

SEQ ID NO: 307969 - DNA, 75 bp, Artificial Sequence
  Synthetic
aatatgattcaacactagaattggacatgtctgagttagcggacctcatattgaacgaatggttatgtaatccga

SEQ ID NO: 307970 - DNA, 75 bp, Artificial Sequence
  Synthetic
atatcgatgggttcatcttgcacggttaaagtgtgtccattgaacatgcagacacttggtattggatgtctaacg

SEQ ID NO: 307971 - DNA, 75 bp, Artificial Sequence
  Synthetic
ttaaagtgtgtccattgaacatgcagacacttggtattggatgtctaacgactgatccaaatacgtttgaaacag

SEQ ID NO: 307972 - DNA, 75 bp, Artificial Sequence
  Synthetic
cacaagctggatgttacaacagcaacttgcactatacgtaactgtaaaaaattgggaccaagggaaaatgtggca

SEQ ID NO: 307973 - DNA, 75 bp, Artificial Sequence
  Synthetic
cttgcactatacgtaactgtaaaaaattgggaccaagggaaaatgtggcagttatacaggtaggtggtgcaaacg

SEQ ID NO: 307974 - DNA, 75 bp, Artificial Sequence
  Synthetic
atgcgagtgaattggaaaaagtggtggcaagtattttacacggttgtagattacgttaatcagataattcaagca

SEQ ID NO: 307975 - DNA, 75 bp, Artificial Sequence
  Synthetic
tgcaatgcaattggccatagtaaacactttattgtatccggcgttaggattagcacaaatgcattatcaagctgg

SEQ ID NO: 307976 - DNA, 75 bp, Artificial Sequence
  Synthetic
atgtccaagagatctaggtcgctaaattcatcagcgttttattacagagtatagatacatcttagattagaattg

SEQ ID NO: 307977 - DNA, 75 bp, Artificial Sequence
  Synthetic
gtttgtacaactttgtacactttttgcgcgattctctgcatcttgttgatatatacactatttcttagaaagatg

SEQ ID NO: 307978 - DNA, 75 bp, Artificial Sequence
  Synthetic
gcgcgattctctgcatcttgttgatatatacactatttcttagaaagatgttccatctattaactgacactttag

SEQ ID NO: 307979 - DNA, 75 bp, Artificial Sequence
  Synthetic
gcgcgattctctgcatcttgttgatatatacactatttcttagaaagatgttccatctattaactgactctttag

SEQ ID NO: 307980 - DNA, 75 bp, Artificial Sequence
  Synthetic
gcgcgattctctgcatcttgttgatatatacactatttcttagaaagatgttccatctattaactgaccctttag

SEQ ID NO: 307981 - DNA, 75 bp, Artificial Sequence
  Synthetic
gcgcgattctctgcatcttgttgatatatacactatttcttagaaagatgttccatctattaactgacgctttag

SEQ ID NO: 307982 - DNA, 75 bp, Artificial Sequence
  Synthetic
ttatgcatttattttccaaatgctgcaattggttcaccaggtccaggtaaagctgatggtttattgaatgataat

SEQ ID NO: 307983 - DNA, 75 bp, Artificial Sequence
  Synthetic
tttagtcatcattcctgatgaaccaaaaaattcagaagacattgaacaaatagccgaatgggtcttgaatgtttg

SEQ ID NO: 307984 - DNA, 75 bp, Artificial Sequence
  Synthetic
aaaaattcagaagacattgaacaaatagccgaatgggtcttgaatgtttggcaatgtgatgatatgaatctggat

SEQ ID NO: 307985 - DNA, 75 bp, Artificial Sequence
  Synthetic
gagattactcagctataacaaatgcactgctgcgtgatattccaattgttctaagaggtgcaattccatatgtta

SEQ ID NO: 307986 - DNA, 75 bp, Artificial Sequence
  Synthetic
gacatatgaggtggtgtctaataatactcaattagcacttattgacgtggttgataacgttaagcacagaattca

SEQ ID NO: 307987 - DNA, 75 bp, Artificial Sequence
  Synthetic
gctagcattgtaaaggacagagatatatcaaaattgaaaccaatcaaatttacaatcaactcagattcttcagaa

SEQ ID NO: 307988 - DNA, 75 bp, Artificial Sequence
  Synthetic
agggggaaccacgactaaacactgcgattataagagtttccacatcatcaagttttgataattcattatcacctc

SEQ ID NO: 307989 - DNA, 75 bp, Artificial Sequence
  Synthetic
ttataaagcaagatcacaacaatttcaacttcaacattcagtttcaatgttggaatccaacttattttttgttgt

SEQ ID NO: 307990 - DNA, 75 bp, Artificial Sequence
  Synthetic
atgcagtttcatttgatggtgcaagaattatgcaggaaacataaaatgattaatcatattatcttgtgacgacct

SEQ ID NO: 307991 - DNA, 75 bp, Artificial Sequence
  Synthetic
attatattaatacattggtacaaacaatgacacccagacatcgggctatatatcctgacggttggatgttgagat

SEQ ID NO: 307992 - DNA, 75 bp, Artificial Sequence
  Synthetic
cagatcactttgctccacgaagcgatggagttcatcaatcaaactttcttctctgagagcaatgagagtagaatg

SEQ ID NO: 307993 - DNA, 75 bp, Artificial Sequence
  Synthetic
gcagtccacagtcgtgatggactacgacactcttgctagcaaataccttaaatttgtttatgattttgaagatgt

SEQ ID NO: 307994 - DNA, 75 bp, Artificial Sequence
  Synthetic
aatttgtttatgattttgaagatgtaacatatcaaaataattacttcgtcacagatgaatacaaatcagatttag

SEQ ID NO: 307995 - DNA, 75 bp, Artificial Sequence
  Synthetic
aacatatcaaaataattacttcgtcacagatgaatacaaatcagatttagaacaatatcttaaatcaatacatga

SEQ ID NO: 307996 - DNA, 75 bp, Artificial Sequence
  Synthetic
tgactaaggtaccaaaagaaaaaagatgcttgatttctaaattagtttttgcatatggaaagcatggaaatgtgg

SEQ ID NO: 307997 - DNA, 75 bp, Artificial Sequence
  Synthetic
atgcttgatttctaaattagtttttgcatatggaaagcatggaaatgtggagaataaactattaaaatatggtac

SEQ ID NO: 307998 - DNA, 75 bp, Artificial Sequence
  Synthetic
ataacataattacatctgaaatttttaaagatgaatctgaatatactgatacatatatggatccagcgattaaca

SEQ ID NO: 307999 - DNA, 75 bp, Artificial Sequence
  Synthetic
taaagatgaatctgaatatactgatacatatatggatccagcgattaacacttcatgccaatcaaattgtcaggc

SEQ ID NO: 308000 - DNA, 75 bp, Artificial Sequence
  Synthetic
caagactagaaaaattatttacaattgtagctgctactattaataaatacggtatgcctagacataacattcgat

SEQ ID NO: 308001 - DNA, 75 bp, Artificial Sequence
  Synthetic
ttgccttaattgtttggatgaatgcagattgtctgtttgtaatgcttgtgggattaagcatgtgtgtgaaaattg

SEQ ID NO: 308002 - DNA, 75 bp, Artificial Sequence
  Synthetic
tgtagctgctactattaataaatacggtatgcctagacataacattcgatacagatacgaatgggaaactatgaa

SEQ ID NO: 308003 - DNA, 75 bp, Artificial Sequence
  Synthetic
gatggttgtcatttgatgacgaaccgagtcagatggttctgattgaatcatggattgcatataagaactattttt

SEQ ID NO: 308004 - DNA, 75 bp, Artificial Sequence
  Synthetic
ttgcatgcgttgttgaccatcatacctatatgattgctagagaactaattgtaaaatcatttacaaatagaacat

SEQ ID NO: 308005 - DNA, 75 bp, Artificial Sequence
  Synthetic
ctatatgattgctagagaactaattgtaaaatcatttacaaatagaacatcattagcgaaattggtatcatcacc

SEQ ID NO: 308006 - DNA, 75 bp, Artificial Sequence
  Synthetic
cagagaatttagaattagaatattctagcaagtcagttaattatttaatatcagaagaaatggctgaagatttca

SEQ ID NO: 308007 - DNA, 75 bp, Artificial Sequence
  Synthetic
tagcaagtcagttaattatttaatatcagaagaaatggctgaagatttcatgaaagctattgaacagttaagaga

SEQ ID NO: 308008 - DNA, 75 bp, Artificial Sequence
  Synthetic
ctgatcctttaacctttcctaatatagccctaatatattcatttagttttcatgtcggttacagaaaacaagctt

SEQ ID NO: 308009 - DNA, 75 bp, Artificial Sequence
  Synthetic
agccctaatatattcatttagttttcatgtcggttacagaaaacaagctttatcggatgcggtatatgaccaaat

SEQ ID NO: 308010 - DNA, 75 bp, Artificial Sequence
  Synthetic
ctgaacgtattgagaatgaaatattcacaattttaaaagataaagtagttcatgaagacaaaagattagaagaat

SEQ ID NO: 308011 - DNA, 75 bp, Artificial Sequence
  Synthetic
cacaattttaaaagataaagtagttcatgaagacaaaagattagaagaatatgaactatcagcgttactttctat

SEQ ID NO: 308012 - DNA, 75 bp, Artificial Sequence
  Synthetic
aggttagatcaacaaagaagaacatgcatgtaattgatgatatgtaccataagcgatatacaacggatataccgc

SEQ ID NO: 308013 - DNA, 75 bp, Artificial Sequence
  Synthetic
gcatgtaattgatgatatgtaccataagcgatatacaacggatataccgccagtggatgaaagaaatccaatccc

SEQ ID NO: 308014 - DNA, 75 bp, Artificial Sequence
  Synthetic
tttgtgatgagtcagcaattaccatatttaagaaagaaattgaagaatatattgagagtggcaagagaataacac

SEQ ID NO: 308015 - DNA, 75 bp, Artificial Sequence
  Synthetic
tgccatatcaatattttattgcacagcattcttttgctgagatgatgcttaaatatgcaaaacgtgaacgagaat

SEQ ID NO: 308016 - DNA, 75 bp, Artificial Sequence
  Synthetic
gcattcttttgctgagatgatgcttaaatatgcaaaacgtgaacgagaatattcagaattctattctcaggcaaa

SEQ ID NO: 308017 - DNA, 75 bp, Artificial Sequence
  Synthetic
tactatgcttcactgatgtatcacaatgggatgcttctcaacataatactagagttctacgaagatcaataataa

SEQ ID NO: 308018 - DNA, 75 bp, Artificial Sequence
  Synthetic
atgggatgcttctcaacataatactagagttctacgaagatcaataataagagcaatggaaagactaaagcagtt

SEQ ID NO: 308019 - DNA, 75 bp, Artificial Sequence
  Synthetic
aaaagaatttagaaaattcatatgtgttaatagataaaaaagccattcagtatggtgcaacagcatcaggtgaaa

SEQ ID NO: 308020 - DNA, 75 bp, Artificial Sequence
  Synthetic
gttaatagataaaaaagccattcagtatggtgcaacagcatcaggtgaaaagcaaactaaaatcatgaattcgat

SEQ ID NO: 308021 - DNA, 75 bp, Artificial Sequence
  Synthetic
acacctttgacgttaaaatgatacgagttgatggagatgacaattatgccattgtgaggtttccaactgctataa

SEQ ID NO: 308022 - DNA, 75 bp, Artificial Sequence
  Synthetic
agttgatggagatgacaattatgccattgtgaggtttccaactgctataactgaaaaattattatcggaattcac

SEQ ID NO: 308023 - DNA, 75 bp, Artificial Sequence
  Synthetic
tagcatcacttacaggatgtgaaatagcaaaaagatacatagctggtggaatgttattcttcagagctggagtga

SEQ ID NO: 308024 - DNA, 75 bp, Artificial Sequence
  Synthetic
agcaaaaagatacatagctggtggaatgttattcttcagagctggagtgaacatattgaatcatgagaagagaaa

SEQ ID NO: 308025 - DNA, 75 bp, Artificial Sequence
  Synthetic
ttaatgctctaagaggacttactatgtctagaactttcatattagttaagatatgccaaatgacatcaatcaaaa

SEQ ID NO: 308026 - DNA, 75 bp, Artificial Sequence
  Synthetic
gtctagaactttcatattagttaagatatgccaaatgacatcaatcaaaattactggtacattgagactatttcc

SEQ ID NO: 308027 - DNA, 75 bp, Artificial Sequence
  Synthetic
tagactatgttattaattacccaatatcagaattgttcatacaactacagcgtaaattgagctcaattaaagcga

SEQ ID NO: 308028 - DNA, 75 bp, Artificial Sequence
  Synthetic
atcagaattgttcatacaactacagcgtaaattgagctcaattaaagcgaaatctaaaattgctgataacatcgc

SEQ ID NO: 308029 - DNA, 75 bp, Artificial Sequence
  Synthetic
agtacgttccatactggtggcattggcacacaacctcagaaagactgggttgttcaacttcctcaactaggcacg

SEQ ID NO: 308030 - DNA, 75 bp, Artificial Sequence
  Synthetic
ctgctgatgagaatccgattgtttcagatggaattaaattaaccgaaaaagctaaacttaatagttatgcaccga

SEQ ID NO: 308031 - DNA, 75 bp, Artificial Sequence
  Synthetic
agatggaattaaattaaccgaaaaagctaaacttaatagttatgcaccgatagcactggaaaaaagacgagatca

SEQ ID NO: 308032 - DNA, 75 bp, Artificial Sequence
  Synthetic
aaactgtagttacaataaatgatgtactctattttatttcagggtttattaaaatcaattcttctgtagcactac

SEQ ID NO: 308033 - DNA, 75 bp, Artificial Sequence
  Synthetic
actctattttatttcagggtttattaaaatcaattcttctgtagcactaccgaaagaagaaaacaatacgatgcc

SEQ ID NO: 308034 - DNA, 75 bp, Artificial Sequence
  Synthetic
cacatgactatgatataaaggggtcatcatcaaccatgtcaaaaataattaaacaatattcagtgtatactcctg

SEQ ID NO: 308035 - DNA, 75 bp, Artificial Sequence
  Synthetic
atcatcaaccatgtcaaaaataattaaacaatattcagtgtatactcctggaattgaagaattatacgaagtagt

SEQ ID NO: 308036 - DNA, 75 bp, Artificial Sequence
  Synthetic
caaaggctgatgtggatacttatattagtacacagatgtataagcatgacagatttaagatactacaagcttata

SEQ ID NO: 308037 - DNA, 75 bp, Artificial Sequence
  Synthetic
tagtacacagatgtataagcatgacagatttaagatactacaagcttatatttacaatttactatcagttaatta

SEQ ID NO: 308038 - DNA, 75 bp, Artificial Sequence
  Synthetic
tcatccatacaccaatggccaaaacaccaactgctgtcttcatgatagatttggcattgagattgaaagtgataa

SEQ ID NO: 308039 - DNA, 75 bp, Artificial Sequence
  Synthetic
aagactgattatttaaaactgtggcgtatgttgtggaacgttaaaacgatgaattcaccatattcaaagaattca

SEQ ID NO: 308040 - DNA, 75 bp, Artificial Sequence
  Synthetic
gtatgttgtggaacgttaaaacgatgaattcaccatattcaaagaattcaatgttcgatgagtaagagagatgga

SEQ ID NO: 308041 - DNA, 75 bp, Artificial Sequence
  Synthetic
gacgaatctgcgcatgtgtctgcggatgcagttcaagaaaaggatgtggttgttccaaaaatggatgaaagtgtt

SEQ ID NO: 308042 - DNA, 75 bp, Artificial Sequence
  Synthetic
tgttccaaaaatggatgaaagtgttatgaaatggatgatggacagtcatgatggaataagtgtaaatggaggtct

SEQ ID NO: 308043 - DNA, 75 bp, Artificial Sequence
  Synthetic
gacaaactggtcttctttttaaatggtttgtacaacattgtacactgtttgcgcaattctttgcatcttattaat

SEQ ID NO: 308044 - DNA, 75 bp, Artificial Sequence
  Synthetic
attaatgaaaatgaaactaaagtaacgtcagaaacaaatgtatcagctcacgtttcagcagggatcaattcgcaa

SEQ ID NO: 308045 - DNA, 75 bp, Artificial Sequence
  Synthetic
tgctggaaatgttaatggtcaattatttactgacgatatttcatatgatggaaacattgaaggtgtaataaatgt

SEQ ID NO: 308046 - DNA, 75 bp, Artificial Sequence
  Synthetic
gaaacattgaaggtgtaataaatgtaacaaatccctttaacgttgaatcattgtgtatttattttccaaacgctg

SEQ ID NO: 308047 - DNA, 75 bp, Artificial Sequence
  Synthetic
aattatgcacagacactagcaacattatttgaaacaaaagggtttccaagaggatcggtaatctttaaaacatat

SEQ ID NO: 308048 - DNA, 75 bp, Artificial Sequence
  Synthetic
tttagttataatccctgacgagccaaataactctgaagcaattgaacaaatagctgaatggatattgaacgtttg

SEQ ID NO: 308049 - DNA, 75 bp, Artificial Sequence
  Synthetic
aagacaatctgtgggcagcatttggtgaagattgcgatatatccgtttgtccattggatacaacaatgaacggaa

SEQ ID NO: 308050 - DNA, 75 bp, Artificial Sequence
  Synthetic
tgaagattgcgatatatccgtttgtccattggatacaacaatgaacggaattggctgttcaccagctagcacaga

SEQ ID NO: 308051 - DNA, 75 bp, Artificial Sequence
  Synthetic
tttgatggctgatgaatataagattacaatcaatactaaggctgagattccagatcgcgatcagactgcttttgc

SEQ ID NO: 308052 - DNA, 75 bp, Artificial Sequence
  Synthetic
gtacatccaggatggaaagcgtgcattggacaattgtgtggtggtacaacatttgatgtagcaaaaacgtcacta

SEQ ID NO: 308053 - DNA, 75 bp, Artificial Sequence
  Synthetic
ttccatctattaactgatgcattaattgttgttctaatcatatctacatgtgctggatattctaatggtcaattg

SEQ ID NO: 308054 - DNA, 75 bp, Artificial Sequence
  Synthetic
atttcgtcacagatgaatttagggcagatttggacacgtatcttaaatcgatccatgatggagaaaaaatatcac

SEQ ID NO: 308055 - DNA, 75 bp, Artificial Sequence
  Synthetic
aaagatcggtgtttaatttcaaaattagtatttgcatatggtaagcacggaaacgtggaaaataaattactaaga

SEQ ID NO: 308056 - DNA, 75 bp, Artificial Sequence
  Synthetic
atatgaaaataatatcattacttctgaaatatttaaagatgaatcagaatatactgatacatatatggatccagc

SEQ ID NO: 308057 - DNA, 75 bp, Artificial Sequence
  Synthetic
tttagtcatcattcctgatgaaccaaaaaactcagaagcaattgaacaaatagccgaatggatattaaatgtgtg

SEQ ID NO: 308058 - DNA, 75 bp, Artificial Sequence
  Synthetic
aagacaatctgtgggcggcattcggtgaagattgtgatatatccgtttgtccattagatacaacaatgaatggaa

SEQ ID NO: 308059 - DNA, 75 bp, Artificial Sequence
  Synthetic
taggctgctcaccagctagtacagaaacgtacgaggtagtgtctaatgatactcaattggcacttatagatgtgg

SEQ ID NO: 308060 - DNA, 75 bp, Artificial Sequence
  Synthetic
gctgtctgacaaactggtcttctttttaaatggtttgtacaacgttgtacactatttgcgcaatcttatgcattc

SEQ ID NO: 308061 - DNA, 75 bp, Artificial Sequence
  Synthetic
ttaaatggtttgtacaacgttgtacactatttgcgcaatcttatgcattctttttatctacatattgctgtttag

SEQ ID NO: 308062 - DNA, 75 bp, Artificial Sequence
  Synthetic
cgaattgtattggatggtcacaaggtcaattatttactgatgatatatattatattgggaatgttgaaactgtag

SEQ ID NO: 308063 - DNA, 75 bp, Artificial Sequence
  Synthetic
aacgcggttgtaggatcacaaggtccaggcaaaacagatggatatttaaatgatggcaattatgctcagacgatt

SEQ ID NO: 308064 - DNA, 75 bp, Artificial Sequence
  Synthetic
caggcaaaacagatggatatttaaatgatggcaattatgctcagacgattgcaactttatttgaaacaaagggat

SEQ ID NO: 308065 - DNA, 75 bp, Artificial Sequence
  Synthetic
ttccaggacgcagaactagagcgatttttatactaccatatcaatattttatagctcaacattcatttgcagaga

SEQ ID NO: 308066 - DNA, 75 bp, Artificial Sequence
  Synthetic
atagattcagtggaaatgacatgttcatataacatagttataatacctgatagtccaactaactcagaagccata

SEQ ID NO: 308067 - DNA, 75 bp, Artificial Sequence
  Synthetic
aatggaattggttgttcgccagcaaatacggaaacatatgaagtgttatcaaatgatacacaacttgcattgatt

SEQ ID NO: 308068 - DNA, 75 bp, Artificial Sequence
  Synthetic
aagcaactgactcacaacgaaaacattcacaaagcaattgacacgtataccaagtctcaggagaatttggaaaac

SEQ ID NO: 308069 - DNA, 75 bp, Artificial Sequence
  Synthetic
atacggaaacatatgaagtgttatcaaatgatacacaacttgcattgattaatgttgtagataatgtaaaacata

SEQ ID NO: 308070 - DNA, 75 bp, Artificial Sequence
  Synthetic
ttcacaaagcaattgacacgtataccaagtctcaggagaatttggaaaactcttacgtactgatagataagaaag

SEQ ID NO: 308071 - DNA, 75 bp, Artificial Sequence
  Synthetic
gaggctagattaaatactgcattaataagaatatctacatcatcaagctttgataattcattatcaccattaaat

SEQ ID NO: 308072 - DNA, 75 bp, Artificial Sequence
  Synthetic
taagaatatctacatcatcaagctttgataattcattatcaccattaaatgacggtcaaacaactaggtcattta

SEQ ID NO: 308073 - DNA, 75 bp, Artificial Sequence
  Synthetic
ggcttttaaaagttctgtttcgagagagcgcgtgcggaaagatggataagcttgcagaccttaattacactttga

SEQ ID NO: 308074 - DNA, 75 bp, Artificial Sequence
  Synthetic
gagcgcgtgcggaaagatggataagcttgcagaccttaattacactttgagcgttattactttaatgaatgacac

SEQ ID NO: 308075 - DNA, 75 bp, Artificial Sequence
  Synthetic
catctgtactgactgtattatttactctacataaggcatcaatacccacaatgaaaattgcgttaaaaacgtcaa

SEQ ID NO: 308076 - DNA, 75 bp, Artificial Sequence
  Synthetic
tctacataaggcatcaatacccacaatgaaaattgcgttaaaaacgtcaaagtgttcgtataaagtaataaagta

SEQ ID NO: 308077 - DNA, 75 bp, Artificial Sequence
  Synthetic
ctttaaactcaactttcaaagtattcgatgaagtggattatgttattaattacccgatctcaaatttattcattc

SEQ ID NO: 308078 - DNA, 75 bp, Artificial Sequence
  Synthetic
aacaggttactacaaaggatgaaattgaacaacagatggacagaatcattaaagagatgagacgtcaactggaaa

SEQ ID NO: 308079 - DNA, 75 bp, Artificial Sequence
  Synthetic
tgaacaacagatggacagaatcattaaagagatgagacgtcaactggaaatgatagataagttgactactcgtga

SEQ ID NO: 308080 - DNA, 75 bp, Artificial Sequence
  Synthetic
aacattgcaaaatcgccacaatttaaatcatacgttgagtttctaaataaatcaatcacagcagatgagaatcct

SEQ ID NO: 308081 - DNA, 75 bp, Artificial Sequence
  Synthetic
ggccagtagacgttattgacatgtcgaaagaatttaatcagaagaatatacgaacgcttgacgaatgggaaagtg

SEQ ID NO: 308082 - DNA, 75 bp, Artificial Sequence
  Synthetic
gaaagaatttaatcagaagaatatacgaacgcttgacgaatgggaaagtggaaaaaatccatacgaaccgtcgga

SEQ ID NO: 308083 - DNA, 75 bp, Artificial Sequence
  Synthetic
cgcacctatagcattagaaaagagacgcgaccagtttacaatgatggtttctttcttacaaaacccaacgacgtt

SEQ ID NO: 308084 - DNA, 75 bp, Artificial Sequence
  Synthetic
cgcgaccagtttacaatgatggtttctttcttacaaaacccaacgacgtttaaaagtgaggacgtcatcacaatt

SEQ ID NO: 308085 - DNA, 75 bp, Artificial Sequence
  Synthetic
gcggcgggactcttcatcgcaaaccacattggacacgatggtttactgacaaaccccagtcaatcatatcgcgtg

SEQ ID NO: 308086 - DNA, 75 bp, Artificial Sequence
  Synthetic
aacattgccagttgaagaaaataatacaatgccactattgccatcagttattaaacgaacgctacattattttgg

SEQ ID NO: 308087 - DNA, 75 bp, Artificial Sequence
  Synthetic
aaaccccagtcaatcatatcgcgtgtagcacagccataatcccgtataacaaatcctgcgaatgttggacgttaa

SEQ ID NO: 308088 - DNA, 75 bp, Artificial Sequence
  Synthetic
acaatgccactattgccatcagttattaaacgaacgctacattattttggattaagaacgcataattatgatatt

SEQ ID NO: 308089 - DNA, 75 bp, Artificial Sequence
  Synthetic
atgtccaagagatcacgatcactagattcagcagcgttttactacagaatctaaatgtcattgaagttagagttg

SEQ ID NO: 308090 - DNA, 75 bp, Artificial Sequence
  Synthetic
aagaaagttgtagttggtacaatttacactaatgtagaagatatcattcaacagacaaatgaattaattagaacg

SEQ ID NO: 308091 - DNA, 75 bp, Artificial Sequence
  Synthetic
ctgaatggtaatacttttcataccggtggaattggaacacaacctcagaaagaatggacttttcaactgccacag

SEQ ID NO: 308092 - DNA, 75 bp, Artificial Sequence
  Synthetic
aagtgtaattgattacttggcttcatttatagaggcagtgtgtgatgatgagatagttagagaagcatctagaaa

SEQ ID NO: 308093 - DNA, 75 bp, Artificial Sequence
  Synthetic
tttatagaggcagtgtgtgatgatgagatagttagagaagcatctagaaatggaatgcaacctcagtccccaacc

SEQ ID NO: 308094 - DNA, 75 bp, Artificial Sequence
  Synthetic
ctctcagtctattaagaattggagtgcccaatcaaggcgcgaaaatccagtttatgaatacagaaatccaatggt

SEQ ID NO: 308095 - DNA, 75 bp, Artificial Sequence
  Synthetic
gcccaatcaaggcgcgaaaatccagtttatgaatacagaaatccaatggtgtttgaatacagaaattcatatatt

SEQ ID NO: 308096 - DNA, 75 bp, Artificial Sequence
  Synthetic
tacttccagcaacacgtgtcaaattgcagcttttgattcaacatttgccgaaaacgcgccaaataacactcaacg

SEQ ID NO: 308097 - DNA, 75 bp, Artificial Sequence
  Synthetic
gcagcttttgattcaacatttgccgaaaacgcgccaaataacactcaacgttttatttacaatggaagacttaaa

SEQ ID NO: 308098 - DNA, 75 bp, Artificial Sequence
  Synthetic
cttaaaaatggaccagaaagttatagttggaaccttgcagcgtttgaattatggtatggaaaggcaaatacaacg

SEQ ID NO: 308099 - DNA, 75 bp, Artificial Sequence
  Synthetic
tagtaattcaactgttttacctgatccaacaaaccagacaacatggttgtttaatccagtgcaagtgatgaatgg

SEQ ID NO: 308100 - DNA, 75 bp, Artificial Sequence
  Synthetic
ccaacaaaccagacaacatggttgtttaatccagtgcaagtgatgaatggaacctttaacattgaattttacaat

SEQ ID NO: 308101 - DNA, 75 bp, Artificial Sequence
  Synthetic
aacatttgactcatatagaataacagttgatatgattagaccagcagccatgactcaatatgttcagaggatatt

SEQ ID NO: 308102 - DNA, 75 bp, Artificial Sequence
  Synthetic
gttgatatgattagaccagcagccatgactcaatatgttcagaggatatttccacaaggtggtccttatgcttat

SEQ ID NO: 308103 - DNA, 75 bp, Artificial Sequence
  Synthetic
cgttttatgtgattctcattctgtcgattattcaattgttgcaaatgttaggagggattcagccatgccagcggg

SEQ ID NO: 308104 - DNA, 75 bp, Artificial Sequence
  Synthetic
acacttcagtgtaaaattgagtctgaagttgttaaaggtggtggatggggttatgactatactagcgtagccttt

SEQ ID NO: 308105 - DNA, 75 bp, Artificial Sequence
  Synthetic
cagttgcacaagaagataatttagaaagacttttattagttgcatccgtgaagagaatggtgttgtagataaact

SEQ ID NO: 308106 - DNA, 75 bp, Artificial Sequence
  Synthetic
aggatcaatggcgtcctcactatataagcagttgatttcacagaattattattctaatggaaatgagattttgat

SEQ ID NO: 308107 - DNA, 75 bp, Artificial Sequence
  Synthetic
attctaatggaaatgagattttgatggatcagcaaacaacaaagactattacagattatgtagatgcaggaaatt

SEQ ID NO: 308108 - DNA, 75 bp, Artificial Sequence
  Synthetic
ggatcagcaaacaacaaagactattacagattatgtagatgcaggaaattacacatacgcacaactaccgccaac

SEQ ID NO: 308109 - DNA, 75 bp, Artificial Sequence
  Synthetic
gggatgactcagaaatctttaaaaatatggtgtatgtgcgtgatttgagatctgatataggtggatttaattact

SEQ ID NO: 308110 - DNA, 75 bp, Artificial Sequence
  Synthetic
tatggtgtatgtgcgtgatttgagatctgatataggtggatttaattactcgtcagccatgtcatactactttag

SEQ ID NO: 308111 - DNA, 75 bp, Artificial Sequence
  Synthetic
taactggtcctcatgcaaatacggttatagagtggagcaacctattaaactctaacgggtggattttgtatgaaa

SEQ ID NO: 308112 - DNA, 75 bp, Artificial Sequence
  Synthetic
tatagagtggagcaacctattaaactctaacgggtggattttgtatgaaaaaccaattgccactactaagctgtt

SEQ ID NO: 308113 - DNA, 75 bp, Artificial Sequence
  Synthetic
acggtaaagccaatacggtagtagaatctgagtattatgcttcactatcggataataaaaagactgtaacagtaa

SEQ ID NO: 308114 - DNA, 75 bp, Artificial Sequence
  Synthetic
atctgagtattatgcttcactatcggataataaaaagactgtaacagtaacatccgattcgttggtgttattctg

SEQ ID NO: 308115 - DNA, 75 bp, Artificial Sequence
  Synthetic
tccttgaatctgttccagcaattgcatcatctgtgaaagatgttgcggcaaacgttatgaaaaagtttaaaacga

SEQ ID NO: 308116 - DNA, 75 bp, Artificial Sequence
  Synthetic
atatgggtggtatactagttaaaccaacacgtggcaatagggtagatatttgtatggcaaatatgaataattttg

SEQ ID NO: 308117 - DNA, 75 bp, Artificial Sequence
  Synthetic
aacacgtggcaatagggtagatatttgtatggcaaatatgaataattttgatgctaataatttcaattgggaaga

SEQ ID NO: 308118 - DNA, 75 bp, Artificial Sequence
  Synthetic
tgcagcttacagatgtagatacactgtcagaaattgtagccagatcagcagatgatttcatacccaatagagcgt

SEQ ID NO: 308119 - DNA, 75 bp, Artificial Sequence
  Synthetic
ataccagttattatcttgctagcgaagatccttataatcagctcaaatcattacaacaaccaactattacaactt

SEQ ID NO: 308120 - DNA, 75 bp, Artificial Sequence
  Synthetic
agatccttataatcagctcaaatcattacaacaaccaactattacaacttttgagatgaaaatggtgaaagttgc

SEQ ID NO: 308121 - DNA, 75 bp, Artificial Sequence
  Synthetic
ggcaagaggtacggtatgctagagatataacgttagaatgcaagattgaatcagaagtagttaaaggtggtggat

SEQ ID NO: 308122 - DNA, 75 bp, Artificial Sequence
  Synthetic
tataacgttagaatgcaagattgaatcagaagtagttaaaggtggtggatggggatatgactatacaagtgtaac

SEQ ID NO: 308123 - DNA, 75 bp, Artificial Sequence
  Synthetic
taaacgcgcatgttaccattagtttcaataacatgaaagaaagatcatatggaggatcactaccaactgacttta

SEQ ID NO: 308124 - DNA, 75 bp, Artificial Sequence
  Synthetic
caataacatgaaagaaagatcatatggaggatcactaccaactgactttaaaataggaaagttcgatgtaataga

SEQ ID NO: 308125 - DNA, 75 bp, Artificial Sequence
  Synthetic
agaacatggtatatgtacgtgacttaagtgctaatattggaagtttcttttattatgcagagatgtcttactatt

SEQ ID NO: 308126 - DNA, 75 bp, Artificial Sequence
  Synthetic
aagtgctaatattggaagtttcttttattatgcagagatgtcttactattttaaaattcccatgggttcatggcc

SEQ ID NO: 308127 - DNA, 75 bp, Artificial Sequence
  Synthetic
ctcagcaattcactgatcaagtggcgcttaattcgatgagatttatatttagagtaacagatgccaacggttggt

SEQ ID NO: 308128 - DNA, 75 bp, Artificial Sequence
  Synthetic
gcttaattcgatgagatttatatttagagtaacagatgccaacggttggtttatgactacaggtaacataaacac

SEQ ID NO: 308129 - DNA, 75 bp, Artificial Sequence
  Synthetic
ctcaaacagttggaaatatttcatttatatcattaataccaagtaatccaaactatcaaacgccaatagcgtcat

SEQ ID NO: 308130 - DNA, 75 bp, Artificial Sequence
  Synthetic
tatatcattaataccaagtaatccaaactatcaaacgccaatagcgtcatcaagcactgttagaatggatttaga

SEQ ID NO: 308131 - DNA, 75 bp, Artificial Sequence
  Synthetic
ttgcattaggcgatattttatctctagcgacttcaccactaactttcgctaatttactcgaatcagtaccagcta

SEQ ID NO: 308132 - DNA, 75 bp, Artificial Sequence
  Synthetic
agcgacttcaccactaactttcgctaatttactcgaatcagtaccagctatcacttcgtcagttaaagacgtcgc

SEQ ID NO: 308133 - DNA, 75 bp, Artificial Sequence
  Synthetic
actgaaggagtgttagcattatattgtttgtcaaatacaataaatccgaaagagaaagtagtgcaatacgcaaat

SEQ ID NO: 308134 - DNA, 75 bp, Artificial Sequence
  Synthetic
cgaaaaccaaatacaaagaattcataattggagatttattagaagatgtgacaaacgttacaagaaattctggat

SEQ ID NO: 308135 - DNA, 75 bp, Artificial Sequence
  Synthetic
aattggagatttattagaagatgtgacaaacgttacaagaaattctggatccatgaattttgatgatataacatc

SEQ ID NO: 308136 - DNA, 75 bp, Artificial Sequence
  Synthetic
cactgtcagagatagttgctagatcagcggataattttataccaaatagatcatacagagtcatagataatggta

SEQ ID NO: 308137 - DNA, 75 bp, Artificial Sequence
  Synthetic
agcggataattttataccaaatagatcatacagagtcatagataatggtattgtatacgaagctacaccaacacg

SEQ ID NO: 308138 - DNA, 75 bp, Artificial Sequence
  Synthetic
ataagttcatgcaattggcctcaaaatcacctgtaatttcttcaatagtgaattttgcaactttaaaagccatga

SEQ ID NO: 308139 - DNA, 75 bp, Artificial Sequence
  Synthetic
gatgctccaacaatattatcattcattgataacaataatccattaattagaagtagaattgaagagttactaagg

SEQ ID NO: 308140 - DNA, 75 bp, Artificial Sequence
  Synthetic
ttgataacaataatccattaattagaagtagaattgaagagttactaaggcagtgcagattgtaaatagtgagga

SEQ ID NO: 308141 - DNA, 75 bp, Artificial Sequence
  Synthetic
ggtttgtacaacattgtacactgtttgcgtgattctctgcattctttttatctatatgttattgttcagaaaaat

SEQ ID NO: 308142 - DNA, 75 bp, Artificial Sequence
  Synthetic
gtgttggatggtcgcaaggtcagatgttcgttgatgatatatattataatggaaatgttgagacgatagttaatg

SEQ ID NO: 308143 - DNA, 75 bp, Artificial Sequence
  Synthetic
attgaggagggtaaattgaaaattaaggttgagaaaaatgaaaattacactgaatcattgaagaataaaattgaa

SEQ ID NO: 308144 - DNA, 75 bp, Artificial Sequence
  Synthetic
gttcgttgatgatatatattataatggaaatgttgagacgatagttaatgctactgatccttttgatgttagatc

SEQ ID NO: 308145 - DNA, 75 bp, Artificial Sequence
  Synthetic
agacagatgggtatctgaatgatggtaattatgctcaaactattgcatcattatttgagacaaaaggctttccaa

SEQ ID NO: 308146 - DNA, 75 bp, Artificial Sequence
  Synthetic
aaacccaaaacacgtaattgataaaatgattgagtcagagattccaatttttaaatcagactacagaaataatga

SEQ ID NO: 308147 - DNA, 75 bp, Artificial Sequence
  Synthetic
tcagtagaaatgacgtgttcgtataatatagttataatacctgacagtccaactaattcggaagcaatagaacag

SEQ ID NO: 308148 - DNA, 75 bp, Artificial Sequence
  Synthetic
atatagttataatacctgacagtccaactaattcggaagcaatagaacagatagcagaatggattttaaacgttt

SEQ ID NO: 308149 - DNA, 75 bp, Artificial Sequence
  Synthetic
atagataatctatgggccgcttttggtagtgattgtgatgtatccgtctgtccattagatacaacaatgaatgga

SEQ ID NO: 308150 - DNA, 75 bp, Artificial Sequence
  Synthetic
gtagtgattgtgatgtatccgtctgtccattagatacaacaatgaatggaattggttgctcaccagctagcacag

SEQ ID NO: 308151 - DNA, 75 bp, Artificial Sequence
  Synthetic
gtggacaacataaagcaccgtattcaaatgaatacagctaagtgtaaattgaagaattgtattaaaggtgaagcc

SEQ ID NO: 308152 - DNA, 75 bp, Artificial Sequence
  Synthetic
ttcattgtcaccgttgaatgatggtcaaacaacgcgatcatttaaaataaatgcaaaaaaatggtggacaatatt

SEQ ID NO: 308153 - DNA, 75 bp, Artificial Sequence
  Synthetic
gcggtaagcatacttgatcagcttggaatgtaaaccattatagtattagctatcatgatatttagtccagaatat

SEQ ID NO: 308154 - DNA, 75 bp, Artificial Sequence
  Synthetic
gctttcattgtggtaactattatatcaaattgtgttggatggtcacaaggtcaattatttactgatgatatatat

SEQ ID NO: 308155 - DNA, 75 bp, Artificial Sequence
  Synthetic
ttcgcccttgcatttaaaatctcattcacgatggatgtacttttttccattgcaaagactgtgtcagatcttaaa

SEQ ID NO: 308156 - DNA, 75 bp, Artificial Sequence
  Synthetic
aacatacagtaaagtttcagattttatagattccgtggaaatgacatgctcatataacatagttataatacctga

SEQ ID NO: 308157 - DNA, 75 bp, Artificial Sequence
  Synthetic
ctgaatggcagtacttttcatactggtggaattggaacacaacctcagaaagaatggactttccaactgtcacag

SEQ ID NO: 308158 - DNA, 75 bp, Artificial Sequence
  Synthetic
tagtccaactaactcagaagctatagagcaaatagcggaatggattcttaatgtttggaaatgtgatgatatgaa

SEQ ID NO: 308159 - DNA, 75 bp, Artificial Sequence
  Synthetic
ttcatagaagcagtgtgtgatgatgaaatagttagagaagcatctagaaatggaatgcagccacaatctccagct

SEQ ID NO: 308160 - DNA, 75 bp, Artificial Sequence
  Synthetic
cctttggtagtgattgtgatatatctgtttgcccattagataccactatgaatggaattggttgttcaccggcaa

SEQ ID NO: 308161 - DNA, 75 bp, Artificial Sequence
  Synthetic
tgtttgcccattagataccactatgaatggaattggttgttcaccggcaagtacggaaacatatgaagtgttatc

SEQ ID NO: 308162 - DNA, 75 bp, Artificial Sequence
  Synthetic
ttctcagtctattaagaattggagtgcccaatcaaggcgcgaaaatccagtctatgaatacaaaaatccaatggt

SEQ ID NO: 308163 - DNA, 75 bp, Artificial Sequence
  Synthetic
gcccaatcaaggcgcgaaaatccagtctatgaatacaaaaatccaatggtattcgaatacagaaactcatatatc

SEQ ID NO: 308164 - DNA, 75 bp, Artificial Sequence
  Synthetic
gaattcagatgaatactgctaaatgtaagataaagaactgtatcaagggtgaagctagattaaatactgcattaa

SEQ ID NO: 308165 - DNA, 75 bp, Artificial Sequence
  Synthetic
tacttctggtaatacatgtcaaattgcagcctttgattcgacgtttgctgagaatgcaccaaataatattcagcg

SEQ ID NO: 308166 - DNA, 75 bp, Artificial Sequence
  Synthetic
tgataattcattgtcaccattaaatgatggtcaaacaactcgatcatttaaaataaatgcaaagaaatggtggac

SEQ ID NO: 308167 - DNA, 75 bp, Artificial Sequence
  Synthetic
gcagcctttgattcgacgtttgctgagaatgcaccaaataatattcagcggttcatctacaatggaaggctgaag

SEQ ID NO: 308168 - DNA, 75 bp, Artificial Sequence
  Synthetic
taataatccgactgttttacctgacccaacaaaccagacgacgtggttgtttaatccagtgcaagtaatgaatgg

SEQ ID NO: 308169 - DNA, 75 bp, Artificial Sequence
  Synthetic
gacaaactggtcttctttttaaatggtttgtacaacattgtacactgtttgcgtagttctctgcattctttttat

SEQ ID NO: 308170 - DNA, 75 bp, Artificial Sequence
  Synthetic
gtttgtacaacattgtacactgtttgcgtagttctctgcattctttttatctatatgttattctttagaaaaatg

SEQ ID NO: 308171 - DNA, 75 bp, Artificial Sequence
  Synthetic
ccaacaaaccagacgacgtggttgtttaatccagtgcaagtaatgaatggaacttttgctattgaattttacaat

SEQ ID NO: 308172 - DNA, 75 bp, Artificial Sequence
  Synthetic
aacatttgattcatatagaatcacagttgatgttattagaccagcagctatgactcaatatgttcagagactatt

SEQ ID NO: 308173 - DNA, 75 bp, Artificial Sequence
  Synthetic
tattggatggtcacaaggtcaaatgtttgctgatgatatatattataatggaaatgttgaaacagtggtgaatgc

SEQ ID NO: 308174 - DNA, 75 bp, Artificial Sequence
  Synthetic
tttgctgatgatatatattataatggaaatgttgaaacagtggtgaatgctacaaatccatttgacgttaagtct

SEQ ID NO: 308175 - DNA, 75 bp, Artificial Sequence
  Synthetic
gttgatgttattagaccagcagctatgactcaatatgttcagagactatttccacaaggtggtccttacgctcac

SEQ ID NO: 308176 - DNA, 75 bp, Artificial Sequence
  Synthetic
cgttctatgtgattcacattctgtcgattattcaattgttgcaaatgttagaagggattcagctatgccagcggg

SEQ ID NO: 308177 - DNA, 75 bp, Artificial Sequence
  Synthetic
gacggatggatatttaaatgatggtaattacgctcaaactattgcagcactatttgaaacaaaaggttttccaag

SEQ ID NO: 308178 - DNA, 75 bp, Artificial Sequence
  Synthetic
acgaaagtttcagattttgtagattcagtagagatgacatgctcatataatatagttataatacctgatagcgca

SEQ ID NO: 308179 - DNA, 75 bp, Artificial Sequence
  Synthetic
aggatcaatggcgtcctcactttatcatcagttaatttctcagaattactattctactggaaatgaaatcttaaa

SEQ ID NO: 308180 - DNA, 75 bp, Artificial Sequence
  Synthetic
gagatgtgatgatatgaatttagatatttacacttatgaacagactgggatagataatctatgggctgcttttgg

SEQ ID NO: 308181 - DNA, 75 bp, Artificial Sequence
  Synthetic
atttacacttatgaacagactgggatagataatctatgggctgcttttggtagtgattgtgacatatctgtctgt

SEQ ID NO: 308182 - DNA, 75 bp, Artificial Sequence
  Synthetic
atacatatgctcagttaccaccaacgaattggggagctggagctacttttgaatcagcttttagtgcggcagaaa

SEQ ID NO: 308183 - DNA, 75 bp, Artificial Sequence
  Synthetic
aacatatgaagtactatcaaatgatactcaactggcactacttaatgtagtagataatgttaaacaccgtattca

SEQ ID NO: 308184 - DNA, 75 bp, Artificial Sequence
  Synthetic
actcaactggcactacttaatgtagtagataatgttaaacaccgtattcagatgaatacagctaagtgtaaattg

SEQ ID NO: 308185 - DNA, 75 bp, Artificial Sequence
  Synthetic
tctgaccagtggttattgtttccaaaacctgttgacacagttaaactattaaaacatggaccacagagttataat

SEQ ID NO: 308186 - DNA, 75 bp, Artificial Sequence
  Synthetic
aacctgttgacacagttaaactattaaaacatggaccacagagttataataatacgttggcggcatttgaattat

SEQ ID NO: 308187 - DNA, 75 bp, Artificial Sequence
  Synthetic
ctccacatcatcaagctttgacaattcattgtcacctttaaacgatggacaaacaacacgaacatttaaaataaa

SEQ ID NO: 308188 - DNA, 75 bp, Artificial Sequence
  Synthetic
aataataataataaacaagttgctgtaactagtgattcattggtgttattttggaatgcaggtggaacagtgtta

SEQ ID NO: 308189 - DNA, 75 bp, Artificial Sequence
  Synthetic
gtttgtacaactttgtacactgtttgcgcaattctctgcatcttgttaatatacacattatttcttagaaagatg

SEQ ID NO: 308190 - DNA, 75 bp, Artificial Sequence
  Synthetic
accgtcatcaaacaaacctagagtatatatatgtatggctaacatgaataatttcaatactgagaattttaattg

SEQ ID NO: 308191 - DNA, 75 bp, Artificial Sequence
  Synthetic
tatatatgtatggctaacatgaataatttcaatactgagaattttaattgggaggagtggaggtttttatcacct

SEQ ID NO: 308192 - DNA, 75 bp, Artificial Sequence
  Synthetic
tactggatacgtgaatggacaattgttcacaactgatatttcgtatgatgggaatatcgaaggtgtgataaacgc

SEQ ID NO: 308193 - DNA, 75 bp, Artificial Sequence
  Synthetic
taacagcgatccatacagacaattgaaagagttgcagcaaccaacaattactatgtttgagatgagaatgatgca

SEQ ID NO: 308194 - DNA, 75 bp, Artificial Sequence
  Synthetic
aaagagttgcagcaaccaacaattactatgtttgagatgagaatgatgcaagtgactaaaaatggacagattaac

SEQ ID NO: 308195 - DNA, 75 bp, Artificial Sequence
  Synthetic
caatcggctcaccaggtccaggtaaagctgatggtttattgaatgacaataactatgcacagacgttagcaacgt

SEQ ID NO: 308196 - DNA, 75 bp, Artificial Sequence
  Synthetic
gagagatataacactccaatgtaagatagaatctgaagtagttaaaggcggtggatgggggtatgattatacaag

SEQ ID NO: 308197 - DNA, 75 bp, Artificial Sequence
  Synthetic
tataagattcaaaactattaatcacacgtactcatataatagagcaggcgagaatgtaaatgcccatgttaccat

SEQ ID NO: 308198 - DNA, 75 bp, Artificial Sequence
  Synthetic
tttagttatcattcctgatgagcctaaaaactcagaagcaattgaacagatagccgaatgggtattaaatgtttg

SEQ ID NO: 308199 - DNA, 75 bp, Artificial Sequence
  Synthetic
attttaaaataggtaaatttgacataatagacattgacacttatatgtatatagattactgggatgattcagaaa

SEQ ID NO: 308200 - DNA, 75 bp, Artificial Sequence
  Synthetic
tgaagattgtgatatatctgtttgtccattagatacaacaatgaatggaataggttgttcaccagccagtacaga

SEQ ID NO: 308201 - DNA, 75 bp, Artificial Sequence
  Synthetic
tttttctattattcacaaatgtcctattattttcagattccagttggagtacatccagggatacattcatctgga

SEQ ID NO: 308202 - DNA, 75 bp, Artificial Sequence
  Synthetic
attattttcagattccagttggagtacatccagggatacattcatctggagtgagatttatgtatgaacgatgcc

SEQ ID NO: 308203 - DNA, 75 bp, Artificial Sequence
  Synthetic
ttgataacgtgaaacacagaattcaaatgtcatcaactgtaaaccaattacagtgtaaactgaagaattgtgtta

SEQ ID NO: 308204 - DNA, 75 bp, Artificial Sequence
  Synthetic
aatgtcatcaactgtaaaccaattacagtgtaaactgaagaattgtgttaaaggtgaaccacggctcaacactgc

SEQ ID NO: 308205 - DNA, 75 bp, Artificial Sequence
  Synthetic
atatttaaagtgacagcagcaaatggttggttcatgacatcgggtaatataaatacaagacgtatagcttcaggg

SEQ ID NO: 308206 - DNA, 75 bp, Artificial Sequence
  Synthetic
gttggttcatgacatcgggtaatataaatacaagacgtatagcttcagggacaggatttgcatatgcgaatggtt

SEQ ID NO: 308207 - DNA, 75 bp, Artificial Sequence
  Synthetic
acgtctctcagacagttggaaatatttcatttatatcattaataccaagtaatccaaattatcaaactccgatag

SEQ ID NO: 308208 - DNA, 75 bp, Artificial Sequence
  Synthetic
catcatctagtacagttaggatggatttggaaagaaaaataaacgatttaagaaatgattttaatcaattagcaa

SEQ ID NO: 308209 - DNA, 75 bp, Artificial Sequence
  Synthetic
agaaatgattttaatcaattagcaagctctgtggcactgggtgatatcctatcactagcaacatctcctttaact

SEQ ID NO: 308210 - DNA, 75 bp, Artificial Sequence
  Synthetic
tgttgctgcaaatgttatgaaacgatttaggaatacaaagatgtttaaaaaagctgctaaaccaaaatatagaga

SEQ ID NO: 308211 - DNA, 75 bp, Artificial Sequence
  Synthetic
atttgtcatcagagatttattagaagatgtaacacatgttacaagaaattcaaattcaatgaattttgatgacat

SEQ ID NO: 308212 - DNA, 75 bp, Artificial Sequence
  Synthetic
ttcgcccttgcatttaaaatctcattcacaatggatgtactattttccattgcgaagactgtatcagatctgaaa

SEQ ID NO: 308213 - DNA, 75 bp, Artificial Sequence
  Synthetic
tgcgaagactgtatcagatctgaaaaagaaagttgtagttggcacaatctacaccaatgtagaagatattattca

SEQ ID NO: 308214 - DNA, 75 bp, Artificial Sequence
  Synthetic
aagaaagttgtagttggcacaatctacaccaatgtagaagatattattcaacagacaaatgaattaattagaacg

SEQ ID NO: 308215 - DNA, 75 bp, Artificial Sequence
  Synthetic
gatgtaacacatgttacaagaaattcaaattcaatgaattttgatgacattacgtcagcagtgatgatatcaact

SEQ ID NO: 308216 - DNA, 75 bp, Artificial Sequence
  Synthetic
aagatcggctgatgacttcataccaaacagatcttataggatgatagaaaatggtgtagtacatgaggcgacaca

SEQ ID NO: 308217 - DNA, 75 bp, Artificial Sequence
  Synthetic
aacagatcttataggatgatagaaaatggtgtagtacatgaggcgacacagaatggagttttttcatatgatcta

SEQ ID NO: 308218 - DNA, 75 bp, Artificial Sequence
  Synthetic
agaatggactttccaactgccacagttaggtacgactttgcttaatttagatgataattatgtccaagcaactag

SEQ ID NO: 308219 - DNA, 75 bp, Artificial Sequence
  Synthetic
ttaggtacgactttgcttaatttagatgataattatgtccaagcaactagaagtgtaatcgattatttagcttca

SEQ ID NO: 308220 - DNA, 75 bp, Artificial Sequence
  Synthetic
ttctaaatcaccagtgatatctgccatagttgattttgctacgttaaaagcaatgagagatacatatggaattgg

SEQ ID NO: 308221 - DNA, 75 bp, Artificial Sequence
  Synthetic
tggaatgcagcctcaatctccgactctcatagcattatcttcttcaaaatttaggactatcaatttcaataacag

SEQ ID NO: 308222 - DNA, 75 bp, Artificial Sequence
  Synthetic
ctcatagcattatcttcttcaaaatttaggactatcaatttcaataacagttctcagtctattaagaattggagt

SEQ ID NO: 308223 - DNA, 75 bp, Artificial Sequence
  Synthetic
catttattaataataataatccattaataagaaatagaatagcagaattattgagacaatgcaggatttaacaag

SEQ ID NO: 308224 - DNA, 75 bp, Artificial Sequence
  Synthetic
tgacaaactggtcttctttttaaatggtttgtacaacattgtacactgtttgcgcagttctctgcatcttgttaa

SEQ ID NO: 308225 - DNA, 75 bp, Artificial Sequence
  Synthetic
atttgaatacagaaattcatacattttgcagcgtgctaatccacaattcggaaatgtcatgggactgagatatta

SEQ ID NO: 308226 - DNA, 75 bp, Artificial Sequence
  Synthetic
ttgcagcgtgctaatccacaattcggaaatgtcatgggactgagatattatacttcaagcaatacatgtcaaatt

SEQ ID NO: 308227 - DNA, 75 bp, Artificial Sequence
  Synthetic
tttcatttataatggaagacttaaaagaccaatttctaatgtcctaatgaaaattgaagctggtgctccaaacat

SEQ ID NO: 308228 - DNA, 75 bp, Artificial Sequence
  Synthetic
ccaacaaaccagacaacatggttgtttaatccaatacaagtaatgaatggaacttttactattgaattttacaac

SEQ ID NO: 308229 - DNA, 75 bp, Artificial Sequence
  Synthetic
atagctgaatggatattgaatgtttggcaatgtgatgatatgaatttagagatttatacttatgaacaggtgaat

SEQ ID NO: 308230 - DNA, 75 bp, Artificial Sequence
  Synthetic
attgatatgattagaccagcagctatgactcaatatgttcagagaatgtttccacaaggtggtccttatgcttat

SEQ ID NO: 308231 - DNA, 75 bp, Artificial Sequence
  Synthetic
agttttatgtgattcacattctgtcgattattcaatcgttgcaaatgttagaagagactcagctatgccagcggg

SEQ ID NO: 308232 - DNA, 75 bp, Artificial Sequence
  Synthetic
caatgacgcctagacatcgggctgtatatcctgaaggttggatgctgagatacgcgtaaacaagatcatgtggct

SEQ ID NO: 308233 - DNA, 75 bp, Artificial Sequence
  Synthetic
aacagttttccaaccaggatttccatgggaacagactctgtccaactacacagttgcacaagaagacaatctaga

SEQ ID NO: 308234 - DNA, 75 bp, Artificial Sequence
  Synthetic
aggatcaatggcgtcctcactttatcagcaattaatttcacagaactattattcaactggtaatgaaatcttatt

SEQ ID NO: 308235 - DNA, 75 bp, Artificial Sequence
  Synthetic
attcaactggtaatgaaatcttattggataaacagactaataaaaccactagaaattacgtagaggctggaaatt

SEQ ID NO: 308236 - DNA, 75 bp, Artificial Sequence
  Synthetic
ggataaacagactaataaaaccactagaaattacgtagaggctggaaattatacatatgctcaattaccaccatc

SEQ ID NO: 308237 - DNA, 75 bp, Artificial Sequence
  Synthetic
taactggtccgcacaataacacagtcatagaatggagtaatttaataaattctgacatttgggtactgtatcaaa

SEQ ID NO: 308238 - DNA, 75 bp, Artificial Sequence
  Synthetic
catagaatggagtaatttaataaattctgacatttgggtactgtatcaaaaaccattaaatgtaattgcaccagt

SEQ ID NO: 308239 - DNA, 75 bp, Artificial Sequence
  Synthetic
aattgtggtacggtagagctggtcataccgtgacatcaatatattattcagcaatatctaatcctaataataccg

SEQ ID NO: 308240 - DNA, 75 bp, Artificial Sequence
  Synthetic
taccgtgacatcaatatattattcagcaatatctaatcctaataataccgttgtgctgacatcagactcgttagt

SEQ ID NO: 308241 - DNA, 75 bp, Artificial Sequence
  Synthetic
agaacaatcgaataatattaatttacaaaagaatgatttggttaaagaagtcatgaatatacagaatcaaacatt

SEQ ID NO: 308242 - DNA, 75 bp, Artificial Sequence
  Synthetic
ttaattggaatatgggtggtatattagttagaccatcacgaggcacacgcgtggacatttgtatgtctgatatgg

SEQ ID NO: 308243 - DNA, 75 bp, Artificial Sequence
  Synthetic
ccgcgtagtagtagtaataccaatgtcagtatgtatgttgaatattatttagcaagtagtgatccataccatgaa

SEQ ID NO: 308244 - DNA, 75 bp, Artificial Sequence
  Synthetic
tcagtatgtatgttgaatattatttagcaagtagtgatccataccatgaacttaaagagttacaaagaccagctg

SEQ ID NO: 308245 - DNA, 75 bp, Artificial Sequence
  Synthetic
attcattatggcaagaaatgagatacgtaagggatataactttagaatgtaaaatactatcagaagtgatcaaag

SEQ ID NO: 308246 - DNA, 75 bp, Artificial Sequence
  Synthetic
catacatatacatatgaaagagcaggtgaaacggtcactgctcacgttacggtaagtttcaataatatgaaagaa

SEQ ID NO: 308247 - DNA, 75 bp, Artificial Sequence
  Synthetic
gtgaaacggtcactgctcacgttacggtaagtttcaataatatgaaagaaaggtcttatggaggatcattaccaa

SEQ ID NO: 308248 - DNA, 75 bp, Artificial Sequence
  Synthetic
tatattgattattgggatgattcagatatgtttaaaaatatggtgtatgtgcgtgatttgagagcagatgttact

SEQ ID NO: 308249 - DNA, 75 bp, Artificial Sequence
  Synthetic
atacttaacacaggataggattggattacatgatggatttgaatcaatatgggattcaaaaactcatgctgatta

SEQ ID NO: 308250 - DNA, 75 bp, Artificial Sequence
  Synthetic
atatgtttaaaaatatggtgtatgtgcgtgatttgagagcagatgttactggattcttttattataaagagatgt

SEQ ID NO: 308251 - DNA, 75 bp, Artificial Sequence
  Synthetic
ggaataggatttacgtatgagaaatgtatgttatcccaacagtttactgatcaacttgcattgaactccatgaga

SEQ ID NO: 308252 - DNA, 75 bp, Artificial Sequence
  Synthetic
gtatgttatcccaacagtttactgatcaacttgcattgaactccatgagatttgtgtttaaagcaacatctgcaa

SEQ ID NO: 308253 - DNA, 75 bp, Artificial Sequence
  Synthetic
ggaacagggtttgcttattcagatgggcatatatccagaaccattggaacattatcatttatatctttaatccca

SEQ ID NO: 308254 - DNA, 75 bp, Artificial Sequence
  Synthetic
ggcatatatccagaaccattggaacattatcatttatatctttaatcccaagtaatccaaattatcaaacaccta

SEQ ID NO: 308255 - DNA, 75 bp, Artificial Sequence
  Synthetic
ctagttcggtagctctaggtgatattatgtccttagctatgtcaccattaacttttgcaaacttgctcgaatctg

SEQ ID NO: 308256 - DNA, 75 bp, Artificial Sequence
  Synthetic
aaatttagaaattcgaaaatgtttaagaaagctacaaaacctaagtataaagaatttataattggggatttactt

SEQ ID NO: 308257 - DNA, 75 bp, Artificial Sequence
  Synthetic
agaaagctacaaaacctaagtataaagaatttataattggggatttacttgaggatgtaacagacgtgccaagga

SEQ ID NO: 308258 - DNA, 75 bp, Artificial Sequence
  Synthetic
acaactaataaactacaattaacagacgtagatacactctcagagattgtcgtcaggtcagctgatgatttcata

SEQ ID NO: 308259 - DNA, 75 bp, Artificial Sequence
  Synthetic
acgtagatacactctcagagattgtcgtcaggtcagctgatgatttcatacccaatagatcgtacagaatgattg

SEQ ID NO: 308260 - DNA, 75 bp, Artificial Sequence
  Synthetic
ttagtaaatatgcaacagcgagattttgatatggataaattcgttcagttagcttcaaaatcaccagtaatatct

SEQ ID NO: 308261 - DNA, 75 bp, Artificial Sequence
  Synthetic
ttgatatggataaattcgttcagttagcttcaaaatcaccagtaatatctgcaattgtggattttgcaactctaa

SEQ ID NO: 308262 - DNA, 75 bp, Artificial Sequence
  Synthetic
gtggcttcagactctccaacaatactgtcatttataaataacaataacccattgataagaaatagaatagaagaa

SEQ ID NO: 308263 - DNA, 75 bp, Artificial Sequence
  Synthetic
tgtcatttataaataacaataacccattgataagaaatagaatagaagaattattgagacaatgtagaatataaa

SEQ ID NO: 308264 - DNA, 75 bp, Artificial Sequence
  Synthetic
attgtggcgataataatatctaattgtgtgggatggacacaaggtcaaatttttattgatgatatacattatgaa

SEQ ID NO: 308265 - DNA, 75 bp, Artificial Sequence
  Synthetic
acttcgggatactccaatcatattgaaaggtgcgattccatatgttactaactcatcagtaattgatgttttatc

SEQ ID NO: 308266 - DNA, 75 bp, Artificial Sequence
  Synthetic
actattcagctataacgaatgcattacttcgggatactccaatcatattgaaaggtgcgattccatatgttacta

SEQ ID NO: 308267 - DNA, 75 bp, Artificial Sequence
  Synthetic
ttttattgatgatatacattatgaaggaaacgttgagacaatcgtcaatgcaaccaatccttttaatgtggaatc

SEQ ID NO: 308268 - DNA, 75 bp, Artificial Sequence
  Synthetic
aaacaaatggttatttgaacgatggtaattatgctcagacaattgctactctatttgaaacaaagggatttccta

SEQ ID NO: 308269 - DNA, 75 bp, Artificial Sequence
  Synthetic
taattatgctcagacaattgctactctatttgaaacaaagggatttcctaagggatcagtagtacttaaaacata

SEQ ID NO: 308270 - DNA, 75 bp, Artificial Sequence
  Synthetic
acatagttataatacctgatgatccagacagatcggaagcaattgaacaaattgcagaatggattttaaacgttt

SEQ ID NO: 308271 - DNA, 75 bp, Artificial Sequence
  Synthetic
agacagatcggaagcaattgaacaaattgcagaatggattttaaacgtttggagatgcgatgatatggatttgaa

SEQ ID NO: 308272 - DNA, 75 bp, Artificial Sequence
  Synthetic
ttatcttttgggtcttattcttgcattaactaatggatcaagaatacttagattcattaactcattcataatcat

SEQ ID NO: 308273 - DNA, 75 bp, Artificial Sequence
  Synthetic
gtgatgattgtgacatatctgtttgtccattagacaccacgatgaatggaattggatgtctaccagcgagtacgg

SEQ ID NO: 308274 - DNA, 75 bp, Artificial Sequence
  Synthetic
tccattagacaccacgatgaatggaattggatgtctaccagcgagtacggaaacatatgaagtggtatctaacaa

SEQ ID NO: 308275 - DNA, 75 bp, Artificial Sequence
  Synthetic
aaattaataattcggaacataacacaaagaatgcgcatgaagaatatgaagaggtaatgaagcagataagagaaa

SEQ ID NO: 308276 - DNA, 75 bp, Artificial Sequence
  Synthetic
agatgaatactggtcactgtaagttgaagaattgtgtgaaaggtgaagcgcggttaaatacggcaatcataagaa

SEQ ID NO: 308277 - DNA, 75 bp, Artificial Sequence
  Synthetic
gaagaattgtgtgaaaggtgaagcgcggttaaatacggcaatcataagaatttcaaaatcatcaagttttgacaa

SEQ ID NO: 308278 - DNA, 75 bp, Artificial Sequence
  Synthetic
atgctaaaaaatggtggacgatattttacacaataattgattacattaatacaattgttcaaacaatgaccccga

SEQ ID NO: 308279 - DNA, 75 bp, Artificial Sequence
  Synthetic
acaattgttcaaacaatgaccccgagacatcgggcaatttatcctgaaggttggatgctgagatatgcgtaaaca

SEQ ID NO: 308280 - DNA, 75 bp, Artificial Sequence
  Synthetic
caatgaccccgagacatcgggcaatttatcctgaaggttggatgctgagatatgcgtaaacaagatcatgtggct

SEQ ID NO: 308281 - DNA, 75 bp, Artificial Sequence
  Synthetic
tggaagatattattcaacaaacaaatgaattaatcagaacgctgaatggcaataccttttatactggtggaattg

SEQ ID NO: 308282 - DNA, 75 bp, Artificial Sequence
  Synthetic
aatatgtcttaactgtctaaatgaatgtaaagtttgtccatgtgattattgtggaatacggcataaatgtgaaaa

SEQ ID NO: 308283 - DNA, 75 bp, Artificial Sequence
  Synthetic
actttgcttaatttagatgataattacgttcaagcagctagaagtgtaattgattatttagcttcatttatagag

SEQ ID NO: 308284 - DNA, 75 bp, Artificial Sequence
  Synthetic
gggaagcatctagaaatggaatgcaacctcagtctccaactcttatagcactatcttcttcgaaatttaaaacta

SEQ ID NO: 308285 - DNA, 75 bp, Artificial Sequence
  Synthetic
acctcagtctccaactcttatagcactatcttcttcgaaatttaaaactattaactttaataatagttctcagtc

SEQ ID NO: 308286 - DNA, 75 bp, Artificial Sequence
  Synthetic
atagaaacccaatggtatttgaatacagaaattcatatattttgcaacgtgctaatccacaattcggaaatgtta

SEQ ID NO: 308287 - DNA, 75 bp, Artificial Sequence
  Synthetic
gctaatccacaattcggaaatgttatgggattaagatattatacttctagcaatacatgtcaaattgcagctttt

SEQ ID NO: 308288 - DNA, 75 bp, Artificial Sequence
  Synthetic
gattcaacatttgctgagaacgcgcaaaataatacacagcgtttcatttataatggaagacttaaaagaccgatt

SEQ ID NO: 308289 - DNA, 75 bp, Artificial Sequence
  Synthetic
tgcaagtgatgaatgggacttttactattgaattttacaataatggtcaattagtagatatggtcaggagtatgg

SEQ ID NO: 308290 - DNA, 75 bp, Artificial Sequence
  Synthetic
tattgaattttacaataatggtcaattagtagatatggtcaggagtatgggagtggtgactgttagaacatttga

SEQ ID NO: 308291 - DNA, 75 bp, Artificial Sequence
  Synthetic
attagaccagcagccatgactcaatatgttcagagaatatttccacaaggtggtccatatgcttatcaagctgca

SEQ ID NO: 308292 - DNA, 75 bp, Artificial Sequence
  Synthetic
tgattcacattctgttgattattcgattgttgcgaacgttaggagagattcagctatgccagcaggaactgtttt

SEQ ID NO: 308293 - DNA, 75 bp, Artificial Sequence
  Synthetic
aagaagataatctagaaagacttctattagttgcatccgtgaagagaatggtgttgtagataaactagagatcta

SEQ ID NO: 308294 - DNA, 75 bp, Artificial Sequence
  Synthetic
attagttgcatccgtgaagagaatggtgttgtagataaactagagatctaaccaatctctatgtggactacgcac

SEQ ID NO: 308295 - DNA, 75 bp, Artificial Sequence
  Synthetic
ggctataaaatggcttcgctcatatacagacagctgctcactaattcttacacagtggatttgtctgatgagata

SEQ ID NO: 308296 - DNA, 75 bp, Artificial Sequence
  Synthetic
cacagtggatttgtctgatgagatacagtcagttgggtcagagaggaaccagcgtgttacagtgaatccaggacc

SEQ ID NO: 308297 - DNA, 75 bp, Artificial Sequence
  Synthetic
cagtcagttgggtcagagaggaaccagcgtgttacagtgaatccaggaccatttgcgcagacggggtatgcgcca

SEQ ID NO: 308298 - DNA, 75 bp, Artificial Sequence
  Synthetic
atactatactatatggtgttgcaccaccaccggagtttagaaatagatttaaaacaaatgaaagatatggcttag

SEQ ID NO: 308299 - DNA, 75 bp, Artificial Sequence
  Synthetic
attggatggaccgtatcaaccggcgtcgttcgacctaccagtaggaaactggatgttgctggcaccagcgggacc

SEQ ID NO: 308300 - DNA, 75 bp, Artificial Sequence
  Synthetic
tcgttcgacctaccagtaggaaactggatgttgctggcaccagcgggaccaggtgtagtagtggaagggatggac

SEQ ID NO: 308301 - DNA, 75 bp, Artificial Sequence
  Synthetic
agagacgagaacatatacgatgtttggatcaagtaaacaggtgttagtatcgaacgtatctgatacgaaatggaa

SEQ ID NO: 308302 - DNA, 75 bp, Artificial Sequence
  Synthetic
ggatcaagtaaacaggtgttagtatcgaacgtatctgatacgaaatggaagtttgttgaaatgatgaagacgaca

SEQ ID NO: 308303 - DNA, 75 bp, Artificial Sequence
  Synthetic
ctatggggtgatgaaatatggagaaagactattcttatacgaaagggaaacaccaaatgccacaaccaaaggata

SEQ ID NO: 308304 - DNA, 75 bp, Artificial Sequence
  Synthetic
agactattcttatacgaaagggaaacaccaaatgccacaaccaaaggatacattgtaacgaattatgcatcagta

SEQ ID NO: 308305 - DNA, 75 bp, Artificial Sequence
  Synthetic
agcgtgtactgagtatataaataacgggctgccacccatccaaaataccaggaatgtggtgcctgtagcaatatc

SEQ ID NO: 308306 - DNA, 75 bp, Artificial Sequence
  Synthetic
gggctgccacccatccaaaataccaggaatgtggtgcctgtagcaatatcgtcaagatcaattgaaccaagagaa

SEQ ID NO: 308307 - DNA, 75 bp, Artificial Sequence
  Synthetic
gatgcaatataactgggatatcataatcagatttaagtttgataactcaataataaagtccgggggcttgggcta

SEQ ID NO: 308308 - DNA, 75 bp, Artificial Sequence
  Synthetic
atcagatttaagtttgataactcaataataaagtccgggggcttgggctataagtgggccgaaatctcatttaaa

SEQ ID NO: 308309 - DNA, 75 bp, Artificial Sequence
  Synthetic
ttataacactatcaataaccaaaataagacgcatgatgctaattcagattgtttaattttattttggaacgaggg

SEQ ID NO: 308310 - DNA, 75 bp, Artificial Sequence
  Synthetic
gcatacgacgtgctcagttaatggtgttaatgattttagcttcaacggaggctcactaccaacggatttcgcaat

SEQ ID NO: 308311 - DNA, 75 bp, Artificial Sequence
  Synthetic
gttaatgattttagcttcaacggaggctcactaccaacggatttcgcaatatcgagatatgaagtgattaaagaa

SEQ ID NO: 308312 - DNA, 75 bp, Artificial Sequence
  Synthetic
catggtctacgtacgatcattggcagcaaatttgaatgacgtaatgtgttctggcggagattatagctttgcgct

SEQ ID NO: 308313 - DNA, 75 bp, Artificial Sequence
  Synthetic
gcaaatttgaatgacgtaatgtgttctggcggagattatagctttgcgctacctgccggacagtggccagtgatg

SEQ ID NO: 308314 - DNA, 75 bp, Artificial Sequence
  Synthetic
ctttagcgagttcagttgcattaagtgatatactttccctcgctatgtcaccattaacattttctaatctattag

SEQ ID NO: 308315 - DNA, 75 bp, Artificial Sequence
  Synthetic
attcaccgacttcgtatcactgaactcactaagatttaggtttagattgacggtcgaggagccctctttcacgat

SEQ ID NO: 308316 - DNA, 75 bp, Artificial Sequence
  Synthetic
tcactaagatttaggtttagattgacggtcgaggagccctctttcacgataactaggacacgcgtgtcaaagctg

SEQ ID NO: 308317 - DNA, 75 bp, Artificial Sequence
  Synthetic
ggcaggaaggttttcgttgatatcattagtgccatcaaatgacgactatcaaacgcctattatgaactcagtgac

SEQ ID NO: 308318 - DNA, 75 bp, Artificial Sequence
  Synthetic
cgtttattgcaattcagttcactggtgcaatgagggtattggggctttttgaacgtgggaataacttgaatttcg

SEQ ID NO: 308319 - DNA, 75 bp, Artificial Sequence
  Synthetic
ttagtgccatcaaatgacgactatcaaacgcctattatgaactcagtgacagtgaggcaagatttggaaaggcgt

SEQ ID NO: 308320 - DNA, 75 bp, Artificial Sequence
  Synthetic
tgcaatgagggtattggggctttttgaacgtgggaataacttgaatttcgcagatacctacgtatatacatggaa

SEQ ID NO: 308321 - DNA, 75 bp, Artificial Sequence
  Synthetic
gtcacagttaattgacctggctatgttgccactagatatgttttcgatgttctcgggaactgaaggtactgtgaa

SEQ ID NO: 308322 - DNA, 75 bp, Artificial Sequence
  Synthetic
ctacgacaatcatattatatctggatggtataaacataaatgaagtcaataaagcatttgaattattgaactcaa

SEQ ID NO: 308323 - DNA, 75 bp, Artificial Sequence
  Synthetic
ttgccactagatatgttttcgatgttctcgggaactgaaggtactgtgaatgcagcaaaatcaatggctaccaat

SEQ ID NO: 308324 - DNA, 75 bp, Artificial Sequence
  Synthetic
tggtataaacataaatgaagtcaataaagcatttgaattattgaactcaaatggtataccagcacttattataaa

SEQ ID NO: 308325 - DNA, 75 bp, Artificial Sequence
  Synthetic
aacggattctttatccgatgcagcttcatctatcgcaagaagtacatcaatacgatcagtaggatcaacggcatc

SEQ ID NO: 308326 - DNA, 75 bp, Artificial Sequence
  Synthetic
aatacaaaatagtatattttcatgagtatacatattacaaaaataatgaatttattgtgagtgatgaattctggt

SEQ ID NO: 308327 - DNA, 75 bp, Artificial Sequence
  Synthetic
tcatctatcgcaagaagtacatcaatacgatcagtaggatcaacggcatcagcttgggctaacatttcagagcag

SEQ ID NO: 308328 - DNA, 75 bp, Artificial Sequence
  Synthetic
gtatacatattacaaaaataatgaatttattgtgagtgatgaattctggttatatactaatataaatgaattatt

SEQ ID NO: 308329 - DNA, 75 bp, Artificial Sequence
  Synthetic
agtaagtgggaaattaagattaaaagaaattacgactcaaacagagggaatgaatttcgatgacatatcagcggc

SEQ ID NO: 308330 - DNA, 75 bp, Artificial Sequence
  Synthetic
gtagagaatatacattgtataatacagcaacagatgacgatattttatataaatatatctatgaaaaagattcga

SEQ ID NO: 308331 - DNA, 75 bp, Artificial Sequence
  Synthetic
gaaattacgactcaaacagagggaatgaatttcgatgacatatcagcggcagtgttaaaagccaagatagataga

SEQ ID NO: 308332 - DNA, 75 bp, Artificial Sequence
  Synthetic
agcaacagatgacgatattttatataaatatatctatgaaaaagattcgattatgaatggtactgactataaaaa

SEQ ID NO: 308333 - DNA, 75 bp, Artificial Sequence
  Synthetic
agagaaattcattcgcaatagggcatatagagtaatagacggggatgaagcatttgaagcgggcactgacggaag

SEQ ID NO: 308334 - DNA, 75 bp, Artificial Sequence
  Synthetic
tatagagtaatagacggggatgaagcatttgaagcgggcactgacggaagatttttcgcgtacaaggttagaaca

SEQ ID NO: 308335 - DNA, 75 bp, Artificial Sequence
  Synthetic
tgatcaattatcaaatagaattactagatctcgtgttttctctaaaagcagaattcatattggattacgtaatga

SEQ ID NO: 308336 - DNA, 75 bp, Artificial Sequence
  Synthetic
ctcaccagtgatatcagcgataatagactttaagacattaaaaaacctgaatgacaattatgggataactagaga

SEQ ID NO: 308337 - DNA, 75 bp, Artificial Sequence
  Synthetic
ctgcaaatggaatagtaatttcagaattaaaaggattagggagttactctgaaaaaaagataagtgaatttggta

SEQ ID NO: 308338 - DNA, 75 bp, Artificial Sequence
  Synthetic
attaaaaggattagggagttactctgaaaaaaagataagtgaatttggtattggacaatttaaaaattatatgaa

SEQ ID NO: 308339 - DNA, 75 bp, Artificial Sequence
  Synthetic
ttgatcagaacaatccgattataaaaaatagaatagaacaattggtaatgcaatgtagattgtgagcagtgtcta

SEQ ID NO: 308340 - DNA, 75 bp, Artificial Sequence
  Synthetic
gtacaataattggtgcagcgcctggttattggatttcatcaatgaaaaaatattttaccatagtaacatacgaca

SEQ ID NO: 308341 - DNA, 75 bp, Artificial Sequence
  Synthetic
ttattggatttcatcaatgaaaaaatattttaccatagtaacatacgacaacaaggaagtcgatagtacagaaca

SEQ ID NO: 308342 - DNA, 75 bp, Artificial Sequence
  Synthetic
gtgtttatattgatgtgagatctgaatttaaaacaaatgactggcgacaaagaagaaagttaatagaagaagaaa

SEQ ID NO: 308343 - DNA, 75 bp, Artificial Sequence
  Synthetic
gtttgtacaactttgtacactatttgcgcaattctttgcatcttgttaatataaacattatttctaagaaaaatg

SEQ ID NO: 308344 - DNA, 75 bp, Artificial Sequence
  Synthetic
gtttgtacaactttgtacactatttgcgcaattctttgcatcttgttaatataaacattatttctaagaaatatg

SEQ ID NO: 308345 - DNA, 75 bp, Artificial Sequence
  Synthetic
gtttgtacaactttgtacactatttgcgcaattctttgcatcttgttaatataaacattatttctaagaaacatg

SEQ ID NO: 308346 - DNA, 75 bp, Artificial Sequence
  Synthetic
gtttgtacaactttgtacactatttgcgcaattctttgcatcttgttaatataaacattatttctaagaaagatg

SEQ ID NO: 308347 - DNA, 75 bp, Artificial Sequence
  Synthetic
gtttgtacaactttgtacactatttgcgcaattctttgcatcttgttaatataaacattatttcttagaaaaatg

SEQ ID NO: 308348 - DNA, 75 bp, Artificial Sequence
  Synthetic
gtttgtacaactttgtacactatttgcgcaattctttgcatcttgttaatataaacattatttcttagaaatatg

SEQ ID NO: 308349 - DNA, 75 bp, Artificial Sequence
  Synthetic
gtttgtacaactttgtacactatttgcgcaattctttgcatcttgttaatataaacattatttcttagaaacatg

SEQ ID NO: 308350 - DNA, 75 bp, Artificial Sequence
  Synthetic
gtttgtacaactttgtacactatttgcgcaattctttgcatcttgttaatataaacattatttcttagaaagatg

SEQ ID NO: 308351 - DNA, 75 bp, Artificial Sequence
  Synthetic
gtttgtacaactttgtacactatttgcgcaattctttgcatcttgttaatataaacattatttctcagaaaaatg

SEQ ID NO: 308352 - DNA, 75 bp, Artificial Sequence
  Synthetic
gtttgtacaactttgtacactatttgcgcaattctttgcatcttgttaatataaacattatttctcagaaatatg

SEQ ID NO: 308353 - DNA, 75 bp, Artificial Sequence
  Synthetic
gtttgtacaactttgtacactatttgcgcaattctttgcatcttgttaatataaacattatttctcagaaacatg

SEQ ID NO: 308354 - DNA, 75 bp, Artificial Sequence
  Synthetic
gtttgtacaactttgtacactatttgcgcaattctttgcatcttgttaatataaacattatttctcagaaagatg

SEQ ID NO: 308355 - DNA, 75 bp, Artificial Sequence
  Synthetic
gtttgtacaactttgtacactatttgcgcaattctttgcatcttgttaatataaacattatttctgagaaaaatg

SEQ ID NO: 308356 - DNA, 75 bp, Artificial Sequence
  Synthetic
gtttgtacaactttgtacactatttgcgcaattctttgcatcttgttaatataaacattatttctgagaaatatg

SEQ ID NO: 308357 - DNA, 75 bp, Artificial Sequence
  Synthetic
gtttgtacaactttgtacactatttgcgcaattctttgcatcttgttaatataaacattatttctgagaaacatg

SEQ ID NO: 308358 - DNA, 75 bp, Artificial Sequence
  Synthetic
gtttgtacaactttgtacactatttgcgcaattctttgcatcttgttaatataaacattatttctgagaaagatg

SEQ ID NO: 308359 - DNA, 75 bp, Artificial Sequence
  Synthetic
gtttgtacaactttgtacactatttgcgcaattctttgcatcttgttaatatatacattatttctaagaaaaatg

SEQ ID NO: 308360 - DNA, 75 bp, Artificial Sequence
  Synthetic
gtttgtacaactttgtacactatttgcgcaattctttgcatcttgttaatatatacattatttctaagaaatatg

SEQ ID NO: 308361 - DNA, 75 bp, Artificial Sequence
  Synthetic
gtttgtacaactttgtacactatttgcgcaattctttgcatcttgttaatatatacattatttctaagaaacatg

SEQ ID NO: 308362 - DNA, 75 bp, Artificial Sequence
  Synthetic
gtttgtacaactttgtacactatttgcgcaattctttgcatcttgttaatatatacattatttctaagaaagatg

SEQ ID NO: 308363 - DNA, 75 bp, Artificial Sequence
  Synthetic
gtttgtacaactttgtacactatttgcgcaattctttgcatcttgttaatatatacattatttcttagaaaaatg

SEQ ID NO: 308364 - DNA, 75 bp, Artificial Sequence
  Synthetic
gtttgtacaactttgtacactatttgcgcaattctttgcatcttgttaatatatacattatttcttagaaatatg

SEQ ID NO: 308365 - DNA, 75 bp, Artificial Sequence
  Synthetic
gtttgtacaactttgtacactatttgcgcaattctttgcatcttgttaatatatacattatttcttagaaacatg

SEQ ID NO: 308366 - DNA, 75 bp, Artificial Sequence
  Synthetic
gtttgtacaactttgtacactatttgcgcaattctttgcatcttgttaatatatacattatttcttagaaagatg

SEQ ID NO: 308367 - DNA, 75 bp, Artificial Sequence
  Synthetic
gtttgtacaactttgtacactatttgcgcaattctttgcatcttgttaatatatacattatttctcagaaaaatg

SEQ ID NO: 308368 - DNA, 75 bp, Artificial Sequence
  Synthetic
gtttgtacaactttgtacactatttgcgcaattctttgcatcttgttaatatatacattatttctcagaaatatg

SEQ ID NO: 308369 - DNA, 75 bp, Artificial Sequence
  Synthetic
gtttgtacaactttgtacactatttgcgcaattctttgcatcttgttaatatatacattatttctcagaaacatg

SEQ ID NO: 308370 - DNA, 75 bp, Artificial Sequence
  Synthetic
gtttgtacaactttgtacactatttgcgcaattctttgcatcttgttaatatatacattatttctcagaaagatg

SEQ ID NO: 308371 - DNA, 75 bp, Artificial Sequence
  Synthetic
gtttgtacaactttgtacactatttgcgcaattctttgcatcttgttaatatatacattatttctgagaaaaatg

SEQ ID NO: 308372 - DNA, 75 bp, Artificial Sequence
  Synthetic
gtttgtacaactttgtacactatttgcgcaattctttgcatcttgttaatatatacattatttctgagaaatatg

SEQ ID NO: 308373 - DNA, 75 bp, Artificial Sequence
  Synthetic
gtttgtacaactttgtacactatttgcgcaattctttgcatcttgttaatatatacattatttctgagaaacatg

SEQ ID NO: 308374 - DNA, 75 bp, Artificial Sequence
  Synthetic
gtttgtacaactttgtacactatttgcgcaattctttgcatcttgttaatatatacattatttctgagaaagatg

SEQ ID NO: 308375 - DNA, 75 bp, Artificial Sequence
  Synthetic
gtttgtacaactttgtacactatttgcgcaattctttgcatcttgttaatatacacattatttctaagaaaaatg

SEQ ID NO: 308376 - DNA, 75 bp, Artificial Sequence
  Synthetic
gtttgtacaactttgtacactatttgcgcaattctttgcatcttgttaatatacacattatttctaagaaatatg

SEQ ID NO: 308377 - DNA, 75 bp, Artificial Sequence
  Synthetic
gtttgtacaactttgtacactatttgcgcaattctttgcatcttgttaatatacacattatttctaagaaacatg

SEQ ID NO: 308378 - DNA, 75 bp, Artificial Sequence
  Synthetic
gtttgtacaactttgtacactatttgcgcaattctttgcatcttgttaatatacacattatttctaagaaagatg

SEQ ID NO: 308379 - DNA, 75 bp, Artificial Sequence
  Synthetic
gtttgtacaactttgtacactatttgcgcaattctttgcatcttgttaatatacacattatttcttagaaaaatg

SEQ ID NO: 308380 - DNA, 75 bp, Artificial Sequence
  Synthetic
gtttgtacaactttgtacactatttgcgcaattctttgcatcttgttaatatacacattatttcttagaaatatg

SEQ ID NO: 308381 - DNA, 75 bp, Artificial Sequence
  Synthetic
gtttgtacaactttgtacactatttgcgcaattctttgcatcttgttaatatacacattatttcttagaaacatg

SEQ ID NO: 308382 - DNA, 75 bp, Artificial Sequence
  Synthetic
gtttgtacaactttgtacactatttgcgcaattctttgcatcttgttaatatacacattatttcttagaaagatg

SEQ ID NO: 308383 - DNA, 75 bp, Artificial Sequence
  Synthetic
gtttgtacaactttgtacactatttgcgcaattctttgcatcttgttaatatacacattatttctcagaaaaatg

SEQ ID NO: 308384 - DNA, 75 bp, Artificial Sequence
  Synthetic
gtttgtacaactttgtacactatttgcgcaattctttgcatcttgttaatatacacattatttctcagaaatatg

SEQ ID NO: 308385 - DNA, 75 bp, Artificial Sequence
  Synthetic
gtttgtacaactttgtacactatttgcgcaattctttgcatcttgttaatatacacattatttctcagaaacatg

SEQ ID NO: 308386 - DNA, 75 bp, Artificial Sequence
  Synthetic
gtttgtacaactttgtacactatttgcgcaattctttgcatcttgttaatatacacattatttctcagaaagatg

SEQ ID NO: 308387 - DNA, 75 bp, Artificial Sequence
  Synthetic
gtttgtacaactttgtacactatttgcgcaattctttgcatcttgttaatatacacattatttctgagaaaaatg

SEQ ID NO: 308388 - DNA, 75 bp, Artificial Sequence
  Synthetic
gtttgtacaactttgtacactatttgcgcaattctttgcatcttgttaatatacacattatttctgagaaatatg

SEQ ID NO: 308389 - DNA, 75 bp, Artificial Sequence
  Synthetic
gtttgtacaactttgtacactatttgcgcaattctttgcatcttgttaatatacacattatttctgagaaacatg

SEQ ID NO: 308390 - DNA, 75 bp, Artificial Sequence
  Synthetic
gtttgtacaactttgtacactatttgcgcaattctttgcatcttgttaatatacacattatttctgagaaagatg

SEQ ID NO: 308391 - DNA, 75 bp, Artificial Sequence
  Synthetic
gtttgtacaactttgtacactatttgcgcaattctttgcatcttgttaatatagacattatttctaagaaaaatg

SEQ ID NO: 308392 - DNA, 75 bp, Artificial Sequence
  Synthetic
gtttgtacaactttgtacactatttgcgcaattctttgcatcttgttaatatagacattatttctaagaaatatg

SEQ ID NO: 308393 - DNA, 75 bp, Artificial Sequence
  Synthetic
gtttgtacaactttgtacactatttgcgcaattctttgcatcttgttaatatagacattatttctaagaaacatg

SEQ ID NO: 308394 - DNA, 75 bp, Artificial Sequence
  Synthetic
gtttgtacaactttgtacactatttgcgcaattctttgcatcttgttaatatagacattatttctaagaaagatg

SEQ ID NO: 308395 - DNA, 75 bp, Artificial Sequence
  Synthetic
gtttgtacaactttgtacactatttgcgcaattctttgcatcttgttaatatagacattatttcttagaaaaatg

SEQ ID NO: 308396 - DNA, 75 bp, Artificial Sequence
  Synthetic
gtttgtacaactttgtacactatttgcgcaattctttgcatcttgttaatatagacattatttcttagaaatatg

SEQ ID NO: 308397 - DNA, 75 bp, Artificial Sequence
  Synthetic
gtttgtacaactttgtacactatttgcgcaattctttgcatcttgttaatatagacattatttcttagaaacatg

SEQ ID NO: 308398 - DNA, 75 bp, Artificial Sequence
  Synthetic
gtttgtacaactttgtacactatttgcgcaattctttgcatcttgttaatatagacattatttcttagaaagatg

SEQ ID NO: 308399 - DNA, 75 bp, Artificial Sequence
  Synthetic
gtttgtacaactttgtacactatttgcgcaattctttgcatcttgttaatatagacattatttctcagaaaaatg

SEQ ID NO: 308400 - DNA, 75 bp, Artificial Sequence
  Synthetic
gtttgtacaactttgtacactatttgcgcaattctttgcatcttgttaatatagacattatttctcagaaatatg

SEQ ID NO: 308401 - DNA, 75 bp, Artificial Sequence
  Synthetic
gtttgtacaactttgtacactatttgcgcaattctttgcatcttgttaatatagacattatttctcagaaacatg

SEQ ID NO: 308402 - DNA, 75 bp, Artificial Sequence
  Synthetic
gtttgtacaactttgtacactatttgcgcaattctttgcatcttgttaatatagacattatttctcagaaagatg

SEQ ID NO: 308403 - DNA, 75 bp, Artificial Sequence
  Synthetic
gtttgtacaactttgtacactatttgcgcaattctttgcatcttgttaatatagacattatttctgagaaaaatg

SEQ ID NO: 308404 - DNA, 75 bp, Artificial Sequence
  Synthetic
gtttgtacaactttgtacactatttgcgcaattctttgcatcttgttaatatagacattatttctgagaaatatg

SEQ ID NO: 308405 - DNA, 75 bp, Artificial Sequence
  Synthetic
gtttgtacaactttgtacactatttgcgcaattctttgcatcttgttaatatagacattatttctgagaaacatg

SEQ ID NO: 308406 - DNA, 75 bp, Artificial Sequence
  Synthetic
gtttgtacaactttgtacactatttgcgcaattctttgcatcttgttaatatagacattatttctgagaaagatg

SEQ ID NO: 308407 - DNA, 75 bp, Artificial Sequence
  Synthetic
atttaaaacaaatgactggcgacaaagaagaaagttaatagaagaagaaacgataaaatggttggaaatttctta

SEQ ID NO: 308408 - DNA, 75 bp, Artificial Sequence
  Synthetic
tgctggatacactaatggtcaattattaactgatgatatttcgtatgaaggaaatattgaaggtgtgataaatgc

SEQ ID NO: 308409 - DNA, 75 bp, Artificial Sequence
  Synthetic
tgctggatacactaatggtcaattatttactgatgatatttcgtatgaaggaaatattgaaggtgtgataaatgc

SEQ ID NO: 308410 - DNA, 75 bp, Artificial Sequence
  Synthetic
tgctggatacactaatggtcaattattcactgatgatatttcgtatgaaggaaatattgaaggtgtgataaatgc

SEQ ID NO: 308411 - DNA, 75 bp, Artificial Sequence
  Synthetic
tgctggatacactaatggtcaattattgactgatgatatttcgtatgaaggaaatattgaaggtgtgataaatgc

SEQ ID NO: 308412 - DNA, 75 bp, Artificial Sequence
  Synthetic
tgctggatacactaatggtcaatttttaactgatgatatttcgtatgaaggaaatattgaaggtgtgataaatgc

SEQ ID NO: 308413 - DNA, 75 bp, Artificial Sequence
  Synthetic
tgctggatacactaatggtcaattttttactgatgatatttcgtatgaaggaaatattgaaggtgtgataaatgc

SEQ ID NO: 308414 - DNA, 75 bp, Artificial Sequence
  Synthetic
tgctggatacactaatggtcaatttttcactgatgatatttcgtatgaaggaaatattgaaggtgtgataaatgc

SEQ ID NO: 308415 - DNA, 75 bp, Artificial Sequence
  Synthetic
tgctggatacactaatggtcaatttttgactgatgatatttcgtatgaaggaaatattgaaggtgtgataaatgc

SEQ ID NO: 308416 - DNA, 75 bp, Artificial Sequence
  Synthetic
tgctggatacactaatggtcaattcttaactgatgatatttcgtatgaaggaaatattgaaggtgtgataaatgc

SEQ ID NO: 308417 - DNA, 75 bp, Artificial Sequence
  Synthetic
tgctggatacactaatggtcaattctttactgatgatatttcgtatgaaggaaatattgaaggtgtgataaatgc

SEQ ID NO: 308418 - DNA, 75 bp, Artificial Sequence
  Synthetic
tgctggatacactaatggtcaattcttcactgatgatatttcgtatgaaggaaatattgaaggtgtgataaatgc

SEQ ID NO: 308419 - DNA, 75 bp, Artificial Sequence
  Synthetic
tgctggatacactaatggtcaattcttgactgatgatatttcgtatgaaggaaatattgaaggtgtgataaatgc

SEQ ID NO: 308420 - DNA, 75 bp, Artificial Sequence
  Synthetic
tgctggatacactaatggtcaattgttaactgatgatatttcgtatgaaggaaatattgaaggtgtgataaatgc

SEQ ID NO: 308421 - DNA, 75 bp, Artificial Sequence
  Synthetic
tgctggatacactaatggtcaattgtttactgatgatatttcgtatgaaggaaatattgaaggtgtgataaatgc

SEQ ID NO: 308422 - DNA, 75 bp, Artificial Sequence
  Synthetic
tgctggatacactaatggtcaattgttcactgatgatatttcgtatgaaggaaatattgaaggtgtgataaatgc

SEQ ID NO: 308423 - DNA, 75 bp, Artificial Sequence
  Synthetic
tgctggatacactaatggtcaattgttgactgatgatatttcgtatgaaggaaatattgaaggtgtgataaatgc

SEQ ID NO: 308424 - DNA, 75 bp, Artificial Sequence
  Synthetic
tgctggatactctaatggtcaattattaactgatgatatttcgtatgaaggaaatattgaaggtgtgataaatgc

SEQ ID NO: 308425 - DNA, 75 bp, Artificial Sequence
  Synthetic
tgctggatactctaatggtcaattatttactgatgatatttcgtatgaaggaaatattgaaggtgtgataaatgc

SEQ ID NO: 308426 - DNA, 75 bp, Artificial Sequence
  Synthetic
tgctggatactctaatggtcaattattcactgatgatatttcgtatgaaggaaatattgaaggtgtgataaatgc

SEQ ID NO: 308427 - DNA, 75 bp, Artificial Sequence
  Synthetic
tgctggatactctaatggtcaattattgactgatgatatttcgtatgaaggaaatattgaaggtgtgataaatgc

SEQ ID NO: 308428 - DNA, 75 bp, Artificial Sequence
  Synthetic
tgctggatactctaatggtcaatttttaactgatgatatttcgtatgaaggaaatattgaaggtgtgataaatgc

SEQ ID NO: 308429 - DNA, 75 bp, Artificial Sequence
  Synthetic
tgctggatactctaatggtcaattttttactgatgatatttcgtatgaaggaaatattgaaggtgtgataaatgc

SEQ ID NO: 308430 - DNA, 75 bp, Artificial Sequence
  Synthetic
tgctggatactctaatggtcaatttttcactgatgatatttcgtatgaaggaaatattgaaggtgtgataaatgc

SEQ ID NO: 308431 - DNA, 75 bp, Artificial Sequence
  Synthetic
tgctggatactctaatggtcaatttttgactgatgatatttcgtatgaaggaaatattgaaggtgtgataaatgc

SEQ ID NO: 308432 - DNA, 75 bp, Artificial Sequence
  Synthetic
tgctggatactctaatggtcaattcttaactgatgatatttcgtatgaaggaaatattgaaggtgtgataaatgc

SEQ ID NO: 308433 - DNA, 75 bp, Artificial Sequence
  Synthetic
tgctggatactctaatggtcaattctttactgatgatatttcgtatgaaggaaatattgaaggtgtgataaatgc

SEQ ID NO: 308434 - DNA, 75 bp, Artificial Sequence
  Synthetic
tgctggatactctaatggtcaattcttcactgatgatatttcgtatgaaggaaatattgaaggtgtgataaatgc

SEQ ID NO: 308435 - DNA, 75 bp, Artificial Sequence
  Synthetic
tgctggatactctaatggtcaattcttgactgatgatatttcgtatgaaggaaatattgaaggtgtgataaatgc

SEQ ID NO: 308436 - DNA, 75 bp, Artificial Sequence
  Synthetic
tgctggatactctaatggtcaattgttaactgatgatatttcgtatgaaggaaatattgaaggtgtgataaatgc

SEQ ID NO: 308437 - DNA, 75 bp, Artificial Sequence
  Synthetic
tgctggatactctaatggtcaattgtttactgatgatatttcgtatgaaggaaatattgaaggtgtgataaatgc

SEQ ID NO: 308438 - DNA, 75 bp, Artificial Sequence
  Synthetic
tgctggatactctaatggtcaattgttcactgatgatatttcgtatgaaggaaatattgaaggtgtgataaatgc

SEQ ID NO: 308439 - DNA, 75 bp, Artificial Sequence
  Synthetic
tgctggatactctaatggtcaattgttgactgatgatatttcgtatgaaggaaatattgaaggtgtgataaatgc

SEQ ID NO: 308440 - DNA, 75 bp, Artificial Sequence
  Synthetic
tgctggataccctaatggtcaattattaactgatgatatttcgtatgaaggaaatattgaaggtgtgataaatgc

SEQ ID NO: 308441 - DNA, 75 bp, Artificial Sequence
  Synthetic
tgctggataccctaatggtcaattatttactgatgatatttcgtatgaaggaaatattgaaggtgtgataaatgc

SEQ ID NO: 308442 - DNA, 75 bp, Artificial Sequence
  Synthetic
tgctggataccctaatggtcaattattcactgatgatatttcgtatgaaggaaatattgaaggtgtgataaatgc

SEQ ID NO: 308443 - DNA, 75 bp, Artificial Sequence
  Synthetic
tgctggataccctaatggtcaattattgactgatgatatttcgtatgaaggaaatattgaaggtgtgataaatgc

SEQ ID NO: 308444 - DNA, 75 bp, Artificial Sequence
  Synthetic
tgctggataccctaatggtcaatttttaactgatgatatttcgtatgaaggaaatattgaaggtgtgataaatgc

SEQ ID NO: 308445 - DNA, 75 bp, Artificial Sequence
  Synthetic
tgctggataccctaatggtcaattttttactgatgatatttcgtatgaaggaaatattgaaggtgtgataaatgc

SEQ ID NO: 308446 - DNA, 75 bp, Artificial Sequence
  Synthetic
tgctggataccctaatggtcaatttttcactgatgatatttcgtatgaaggaaatattgaaggtgtgataaatgc

SEQ ID NO: 308447 - DNA, 75 bp, Artificial Sequence
  Synthetic
tgctggataccctaatggtcaatttttgactgatgatatttcgtatgaaggaaatattgaaggtgtgataaatgc

SEQ ID NO: 308448 - DNA, 75 bp, Artificial Sequence
  Synthetic
tgctggataccctaatggtcaattcttaactgatgatatttcgtatgaaggaaatattgaaggtgtgataaatgc

SEQ ID NO: 308449 - DNA, 75 bp, Artificial Sequence
  Synthetic
tgctggataccctaatggtcaattctttactgatgatatttcgtatgaaggaaatattgaaggtgtgataaatgc

SEQ ID NO: 308450 - DNA, 75 bp, Artificial Sequence
  Synthetic
tgctggataccctaatggtcaattcttcactgatgatatttcgtatgaaggaaatattgaaggtgtgataaatgc

SEQ ID NO: 308451 - DNA, 75 bp, Artificial Sequence
  Synthetic
tgctggataccctaatggtcaattcttgactgatgatatttcgtatgaaggaaatattgaaggtgtgataaatgc

SEQ ID NO: 308452 - DNA, 75 bp, Artificial Sequence
  Synthetic
tgctggataccctaatggtcaattgttaactgatgatatttcgtatgaaggaaatattgaaggtgtgataaatgc

SEQ ID NO: 308453 - DNA, 75 bp, Artificial Sequence
  Synthetic
tgctggataccctaatggtcaattgtttactgatgatatttcgtatgaaggaaatattgaaggtgtgataaatgc

SEQ ID NO: 308454 - DNA, 75 bp, Artificial Sequence
  Synthetic
tgctggataccctaatggtcaattgttcactgatgatatttcgtatgaaggaaatattgaaggtgtgataaatgc

SEQ ID NO: 308455 - DNA, 75 bp, Artificial Sequence
  Synthetic
tgctggataccctaatggtcaattgttgactgatgatatttcgtatgaaggaaatattgaaggtgtgataaatgc

SEQ ID NO: 308456 - DNA, 75 bp, Artificial Sequence
  Synthetic
tgctggatacgctaatggtcaattattaactgatgatatttcgtatgaaggaaatattgaaggtgtgataaatgc

SEQ ID NO: 308457 - DNA, 75 bp, Artificial Sequence
  Synthetic
tgctggatacgctaatggtcaattatttactgatgatatttcgtatgaaggaaatattgaaggtgtgataaatgc

SEQ ID NO: 308458 - DNA, 75 bp, Artificial Sequence
  Synthetic
tgctggatacgctaatggtcaattattcactgatgatatttcgtatgaaggaaatattgaaggtgtgataaatgc

SEQ ID NO: 308459 - DNA, 75 bp, Artificial Sequence
  Synthetic
tgctggatacgctaatggtcaattattgactgatgatatttcgtatgaaggaaatattgaaggtgtgataaatgc

SEQ ID NO: 308460 - DNA, 75 bp, Artificial Sequence
  Synthetic
tgctggatacgctaatggtcaatttttaactgatgatatttcgtatgaaggaaatattgaaggtgtgataaatgc

SEQ ID NO: 308461 - DNA, 75 bp, Artificial Sequence
  Synthetic
tgctggatacgctaatggtcaattttttactgatgatatttcgtatgaaggaaatattgaaggtgtgataaatgc

SEQ ID NO: 308462 - DNA, 75 bp, Artificial Sequence
  Synthetic
tgctggatacgctaatggtcaatttttcactgatgatatttcgtatgaaggaaatattgaaggtgtgataaatgc

SEQ ID NO: 308463 - DNA, 75 bp, Artificial Sequence
  Synthetic
tgctggatacgctaatggtcaatttttgactgatgatatttcgtatgaaggaaatattgaaggtgtgataaatgc

SEQ ID NO: 308464 - DNA, 75 bp, Artificial Sequence
  Synthetic
tgctggatacgctaatggtcaattcttaactgatgatatttcgtatgaaggaaatattgaaggtgtgataaatgc

SEQ ID NO: 308465 - DNA, 75 bp, Artificial Sequence
  Synthetic
tgctggatacgctaatggtcaattctttactgatgatatttcgtatgaaggaaatattgaaggtgtgataaatgc

SEQ ID NO: 308466 - DNA, 75 bp, Artificial Sequence
  Synthetic
tgctggatacgctaatggtcaattcttcactgatgatatttcgtatgaaggaaatattgaaggtgtgataaatgc

SEQ ID NO: 308467 - DNA, 75 bp, Artificial Sequence
  Synthetic
tgctggatacgctaatggtcaattcttgactgatgatatttcgtatgaaggaaatattgaaggtgtgataaatgc

SEQ ID NO: 308468 - DNA, 75 bp, Artificial Sequence
  Synthetic
tgctggatacgctaatggtcaattgttaactgatgatatttcgtatgaaggaaatattgaaggtgtgataaatgc

SEQ ID NO: 308469 - DNA, 75 bp, Artificial Sequence
  Synthetic
tgctggatacgctaatggtcaattgtttactgatgatatttcgtatgaaggaaatattgaaggtgtgataaatgc

SEQ ID NO: 308470 - DNA, 75 bp, Artificial Sequence
  Synthetic
tgctggatacgctaatggtcaattgttcactgatgatatttcgtatgaaggaaatattgaaggtgtgataaatgc

SEQ ID NO: 308471 - DNA, 75 bp, Artificial Sequence
  Synthetic
tgctggatacgctaatggtcaattgttgactgatgatatttcgtatgaaggaaatattgaaggtgtgataaatgc

SEQ ID NO: 308472 - DNA, 75 bp, Artificial Sequence
  Synthetic
caatggatggagagatacctgatggatattgtgtacattctcctacaacataccgaaaaagtgaatactatttac

SEQ ID NO: 308473 - DNA, 75 bp, Artificial Sequence
  Synthetic
atattgtgtacattctcctacaacataccgaaaaagtgaatactatttactcattgataaacatatcattaaaag

SEQ ID NO: 308474 - DNA, 75 bp, Artificial Sequence
  Synthetic
caatcggttcaccaggtacaggtaaatctgatggattattgaatgataataattatgcacagacactggcaacat

SEQ ID NO: 308475 - DNA, 75 bp, Artificial Sequence
  Synthetic
caatcggttcaccaggtacaggtaaatctgatggatttttgaatgataataattatgcacagacactggcaacat

SEQ ID NO: 308476 - DNA, 75 bp, Artificial Sequence
  Synthetic
caatcggttcaccaggtacaggtaaatctgatggattcttgaatgataataattatgcacagacactggcaacat

SEQ ID NO: 308477 - DNA, 75 bp, Artificial Sequence
  Synthetic
caatcggttcaccaggtacaggtaaatctgatggattgttgaatgataataattatgcacagacactggcaacat

SEQ ID NO: 308478 - DNA, 75 bp, Artificial Sequence
  Synthetic
caatcggttcaccaggtacaggtaattctgatggattattgaatgataataattatgcacagacactggcaacat

SEQ ID NO: 308479 - DNA, 75 bp, Artificial Sequence
  Synthetic
caatcggttcaccaggtacaggtaattctgatggatttttgaatgataataattatgcacagacactggcaacat

SEQ ID NO: 308480 - DNA, 75 bp, Artificial Sequence
  Synthetic
caatcggttcaccaggtacaggtaattctgatggattcttgaatgataataattatgcacagacactggcaacat

SEQ ID NO: 308481 - DNA, 75 bp, Artificial Sequence
  Synthetic
caatcggttcaccaggtacaggtaattctgatggattgttgaatgataataattatgcacagacactggcaacat

SEQ ID NO: 308482 - DNA, 75 bp, Artificial Sequence
  Synthetic
caatcggttcaccaggtacaggtaactctgatggattattgaatgataataattatgcacagacactggcaacat

SEQ ID NO: 308483 - DNA, 75 bp, Artificial Sequence
  Synthetic
caatcggttcaccaggtacaggtaactctgatggatttttgaatgataataattatgcacagacactggcaacat

SEQ ID NO: 308484 - DNA, 75 bp, Artificial Sequence
  Synthetic
caatcggttcaccaggtacaggtaactctgatggattcttgaatgataataattatgcacagacactggcaacat

SEQ ID NO: 308485 - DNA, 75 bp, Artificial Sequence
  Synthetic
caatcggttcaccaggtacaggtaactctgatggattgttgaatgataataattatgcacagacactggcaacat

SEQ ID NO: 308486 - DNA, 75 bp, Artificial Sequence
  Synthetic
caatcggttcaccaggtacaggtaagtctgatggattattgaatgataataattatgcacagacactggcaacat

SEQ ID NO: 308487 - DNA, 75 bp, Artificial Sequence
  Synthetic
caatcggttcaccaggtacaggtaagtctgatggatttttgaatgataataattatgcacagacactggcaacat

SEQ ID NO: 308488 - DNA, 75 bp, Artificial Sequence
  Synthetic
caatcggttcaccaggtacaggtaagtctgatggattcttgaatgataataattatgcacagacactggcaacat

SEQ ID NO: 308489 - DNA, 75 bp, Artificial Sequence
  Synthetic
caatcggttcaccaggtacaggtaagtctgatggattgttgaatgataataattatgcacagacactggcaacat

SEQ ID NO: 308490 - DNA, 75 bp, Artificial Sequence
  Synthetic
caatcggttcaccaggttcaggtaaatctgatggattattgaatgataataattatgcacagacactggcaacat

SEQ ID NO: 308491 - DNA, 75 bp, Artificial Sequence
  Synthetic
caatcggttcaccaggttcaggtaaatctgatggatttttgaatgataataattatgcacagacactggcaacat

SEQ ID NO: 308492 - DNA, 75 bp, Artificial Sequence
  Synthetic
caatcggttcaccaggttcaggtaaatctgatggattcttgaatgataataattatgcacagacactggcaacat

SEQ ID NO: 308493 - DNA, 75 bp, Artificial Sequence
  Synthetic
caatcggttcaccaggttcaggtaaatctgatggattgttgaatgataataattatgcacagacactggcaacat

SEQ ID NO: 308494 - DNA, 75 bp, Artificial Sequence
  Synthetic
caatcggttcaccaggttcaggtaattctgatggattattgaatgataataattatgcacagacactggcaacat

SEQ ID NO: 308495 - DNA, 75 bp, Artificial Sequence
  Synthetic
caatcggttcaccaggttcaggtaattctgatggatttttgaatgataataattatgcacagacactggcaacat

SEQ ID NO: 308496 - DNA, 75 bp, Artificial Sequence
  Synthetic
caatcggttcaccaggttcaggtaattctgatggattcttgaatgataataattatgcacagacactggcaacat

SEQ ID NO: 308497 - DNA, 75 bp, Artificial Sequence
  Synthetic
caatcggttcaccaggttcaggtaattctgatggattgttgaatgataataattatgcacagacactggcaacat

SEQ ID NO: 308498 - DNA, 75 bp, Artificial Sequence
  Synthetic
caatcggttcaccaggttcaggtaactctgatggattattgaatgataataattatgcacagacactggcaacat

SEQ ID NO: 308499 - DNA, 75 bp, Artificial Sequence
  Synthetic
caatcggttcaccaggttcaggtaactctgatggatttttgaatgataataattatgcacagacactggcaacat

SEQ ID NO: 308500 - DNA, 75 bp, Artificial Sequence
  Synthetic
caatcggttcaccaggttcaggtaactctgatggattcttgaatgataataattatgcacagacactggcaacat

SEQ ID NO: 308501 - DNA, 75 bp, Artificial Sequence
  Synthetic
caatcggttcaccaggttcaggtaactctgatggattgttgaatgataataattatgcacagacactggcaacat

SEQ ID NO: 308502 - DNA, 75 bp, Artificial Sequence
  Synthetic
caatcggttcaccaggttcaggtaagtctgatggattattgaatgataataattatgcacagacactggcaacat

SEQ ID NO: 308503 - DNA, 75 bp, Artificial Sequence
  Synthetic
caatcggttcaccaggttcaggtaagtctgatggatttttgaatgataataattatgcacagacactggcaacat

SEQ ID NO: 308504 - DNA, 75 bp, Artificial Sequence
  Synthetic
caatcggttcaccaggttcaggtaagtctgatggattcttgaatgataataattatgcacagacactggcaacat

SEQ ID NO: 308505 - DNA, 75 bp, Artificial Sequence
  Synthetic
caatcggttcaccaggttcaggtaagtctgatggattgttgaatgataataattatgcacagacactggcaacat

SEQ ID NO: 308506 - DNA, 75 bp, Artificial Sequence
  Synthetic
caatcggttcaccaggtccaggtaaatctgatggattattgaatgataataattatgcacagacactggcaacat

SEQ ID NO: 308507 - DNA, 75 bp, Artificial Sequence
  Synthetic
caatcggttcaccaggtccaggtaaatctgatggatttttgaatgataataattatgcacagacactggcaacat

SEQ ID NO: 308508 - DNA, 75 bp, Artificial Sequence
  Synthetic
caatcggttcaccaggtccaggtaaatctgatggattcttgaatgataataattatgcacagacactggcaacat

SEQ ID NO: 308509 - DNA, 75 bp, Artificial Sequence
  Synthetic
caatcggttcaccaggtccaggtaaatctgatggattgttgaatgataataattatgcacagacactggcaacat

SEQ ID NO: 308510 - DNA, 75 bp, Artificial Sequence
  Synthetic
caatcggttcaccaggtccaggtaattctgatggattattgaatgataataattatgcacagacactggcaacat

SEQ ID NO: 308511 - DNA, 75 bp, Artificial Sequence
  Synthetic
caatcggttcaccaggtccaggtaattctgatggatttttgaatgataataattatgcacagacactggcaacat

SEQ ID NO: 308512 - DNA, 75 bp, Artificial Sequence
  Synthetic
caatcggttcaccaggtccaggtaattctgatggattcttgaatgataataattatgcacagacactggcaacat

SEQ ID NO: 308513 - DNA, 75 bp, Artificial Sequence
  Synthetic
caatcggttcaccaggtccaggtaattctgatggattgttgaatgataataattatgcacagacactggcaacat

SEQ ID NO: 308514 - DNA, 75 bp, Artificial Sequence
  Synthetic
caatcggttcaccaggtccaggtaactctgatggattattgaatgataataattatgcacagacactggcaacat

SEQ ID NO: 308515 - DNA, 75 bp, Artificial Sequence
  Synthetic
caatcggttcaccaggtccaggtaactctgatggatttttgaatgataataattatgcacagacactggcaacat

SEQ ID NO: 308516 - DNA, 75 bp, Artificial Sequence
  Synthetic
caatcggttcaccaggtccaggtaactctgatggattcttgaatgataataattatgcacagacactggcaacat

SEQ ID NO: 308517 - DNA, 75 bp, Artificial Sequence
  Synthetic
caatcggttcaccaggtccaggtaactctgatggattgttgaatgataataattatgcacagacactggcaacat

SEQ ID NO: 308518 - DNA, 75 bp, Artificial Sequence
  Synthetic
caatcggttcaccaggtccaggtaagtctgatggattattgaatgataataattatgcacagacactggcaacat

SEQ ID NO: 308519 - DNA, 75 bp, Artificial Sequence
  Synthetic
caatcggttcaccaggtccaggtaagtctgatggatttttgaatgataataattatgcacagacactggcaacat

SEQ ID NO: 308520 - DNA, 75 bp, Artificial Sequence
  Synthetic
caatcggttcaccaggtccaggtaagtctgatggattcttgaatgataataattatgcacagacactggcaacat

SEQ ID NO: 308521 - DNA, 75 bp, Artificial Sequence
  Synthetic
caatcggttcaccaggtccaggtaagtctgatggattgttgaatgataataattatgcacagacactggcaacat

SEQ ID NO: 308522 - DNA, 75 bp, Artificial Sequence
  Synthetic
caatcggttcaccaggtgcaggtaaatctgatggattattgaatgataataattatgcacagacactggcaacat

SEQ ID NO: 308523 - DNA, 75 bp, Artificial Sequence
  Synthetic
caatcggttcaccaggtgcaggtaaatctgatggatttttgaatgataataattatgcacagacactggcaacat

SEQ ID NO: 308524 - DNA, 75 bp, Artificial Sequence
  Synthetic
caatcggttcaccaggtgcaggtaaatctgatggattcttgaatgataataattatgcacagacactggcaacat

SEQ ID NO: 308525 - DNA, 75 bp, Artificial Sequence
  Synthetic
caatcggttcaccaggtgcaggtaaatctgatggattgttgaatgataataattatgcacagacactggcaacat

SEQ ID NO: 308526 - DNA, 75 bp, Artificial Sequence
  Synthetic
caatcggttcaccaggtgcaggtaattctgatggattattgaatgataataattatgcacagacactggcaacat

SEQ ID NO: 308527 - DNA, 75 bp, Artificial Sequence
  Synthetic
caatcggttcaccaggtgcaggtaattctgatggatttttgaatgataataattatgcacagacactggcaacat

SEQ ID NO: 308528 - DNA, 75 bp, Artificial Sequence
  Synthetic
caatcggttcaccaggtgcaggtaattctgatggattcttgaatgataataattatgcacagacactggcaacat

SEQ ID NO: 308529 - DNA, 75 bp, Artificial Sequence
  Synthetic
caatcggttcaccaggtgcaggtaattctgatggattgttgaatgataataattatgcacagacactggcaacat

SEQ ID NO: 308530 - DNA, 75 bp, Artificial Sequence
  Synthetic
caatcggttcaccaggtgcaggtaactctgatggattattgaatgataataattatgcacagacactggcaacat

SEQ ID NO: 308531 - DNA, 75 bp, Artificial Sequence
  Synthetic
caatcggttcaccaggtgcaggtaactctgatggatttttgaatgataataattatgcacagacactggcaacat

SEQ ID NO: 308532 - DNA, 75 bp, Artificial Sequence
  Synthetic
caatcggttcaccaggtgcaggtaactctgatggattcttgaatgataataattatgcacagacactggcaacat

SEQ ID NO: 308533 - DNA, 75 bp, Artificial Sequence
  Synthetic
caatcggttcaccaggtgcaggtaactctgatggattgttgaatgataataattatgcacagacactggcaacat

SEQ ID NO: 308534 - DNA, 75 bp, Artificial Sequence
  Synthetic
caatcggttcaccaggtgcaggtaagtctgatggattattgaatgataataattatgcacagacactggcaacat

SEQ ID NO: 308535 - DNA, 75 bp, Artificial Sequence
  Synthetic
caatcggttcaccaggtgcaggtaagtctgatggatttttgaatgataataattatgcacagacactggcaacat

SEQ ID NO: 308536 - DNA, 75 bp, Artificial Sequence
  Synthetic
caatcggttcaccaggtgcaggtaagtctgatggattcttgaatgataataattatgcacagacactggcaacat

SEQ ID NO: 308537 - DNA, 75 bp, Artificial Sequence
  Synthetic
caatcggttcaccaggtgcaggtaagtctgatggattgttgaatgataataattatgcacagacactggcaacat

SEQ ID NO: 308538 - DNA, 75 bp, Artificial Sequence
  Synthetic
tatactcagataatgtattcatttcaggtaaatattcattaaggggcaaaactgaaggagtattagctttatact

SEQ ID NO: 308539 - DNA, 75 bp, Artificial Sequence
  Synthetic
aggtaaatattcattaaggggcaaaactgaaggagtattagctttatactgtttatcgaatacaataaatcaaaa

SEQ ID NO: 308540 - DNA, 75 bp, Artificial Sequence
  Synthetic
atctgatggattattgaatgataataattatgcacagacactggcaacattgtttgagactaaaggatttccaag

SEQ ID NO: 308541 - DNA, 75 bp, Artificial Sequence
  Synthetic
atctgatggatttttgaatgataataattatgcacagacactggcaacattgtttgagactaaaggatttccaag

SEQ ID NO: 308542 - DNA, 75 bp, Artificial Sequence
  Synthetic
atctgatggattcttgaatgataataattatgcacagacactggcaacattgtttgagactaaaggatttccaag

SEQ ID NO: 308543 - DNA, 75 bp, Artificial Sequence
  Synthetic
atctgatggattgttgaatgataataattatgcacagacactggcaacattgtttgagactaaaggatttccaag

SEQ ID NO: 308544 - DNA, 75 bp, Artificial Sequence
  Synthetic
ttctgatggattattgaatgataataattatgcacagacactggcaacattgtttgagactaaaggatttccaag

SEQ ID NO: 308545 - DNA, 75 bp, Artificial Sequence
  Synthetic
ttctgatggatttttgaatgataataattatgcacagacactggcaacattgtttgagactaaaggatttccaag

SEQ ID NO: 308546 - DNA, 75 bp, Artificial Sequence
  Synthetic
ttctgatggattcttgaatgataataattatgcacagacactggcaacattgtttgagactaaaggatttccaag

SEQ ID NO: 308547 - DNA, 75 bp, Artificial Sequence
  Synthetic
ttctgatggattgttgaatgataataattatgcacagacactggcaacattgtttgagactaaaggatttccaag

SEQ ID NO: 308548 - DNA, 75 bp, Artificial Sequence
  Synthetic
ctctgatggattattgaatgataataattatgcacagacactggcaacattgtttgagactaaaggatttccaag

SEQ ID NO: 308549 - DNA, 75 bp, Artificial Sequence
  Synthetic
ctctgatggatttttgaatgataataattatgcacagacactggcaacattgtttgagactaaaggatttccaag

SEQ ID NO: 308550 - DNA, 75 bp, Artificial Sequence
  Synthetic
ctctgatggattcttgaatgataataattatgcacagacactggcaacattgtttgagactaaaggatttccaag

SEQ ID NO: 308551 - DNA, 75 bp, Artificial Sequence
  Synthetic
ctctgatggattgttgaatgataataattatgcacagacactggcaacattgtttgagactaaaggatttccaag

SEQ ID NO: 308552 - DNA, 75 bp, Artificial Sequence
  Synthetic
gtctgatggattattgaatgataataattatgcacagacactggcaacattgtttgagactaaaggatttccaag

SEQ ID NO: 308553 - DNA, 75 bp, Artificial Sequence
  Synthetic
gtctgatggatttttgaatgataataattatgcacagacactggcaacattgtttgagactaaaggatttccaag

SEQ ID NO: 308554 - DNA, 75 bp, Artificial Sequence
  Synthetic
gtctgatggattcttgaatgataataattatgcacagacactggcaacattgtttgagactaaaggatttccaag

SEQ ID NO: 308555 - DNA, 75 bp, Artificial Sequence
  Synthetic
gtctgatggattgttgaatgataataattatgcacagacactggcaacattgtttgagactaaaggatttccaag

SEQ ID NO: 308556 - DNA, 75 bp, Artificial Sequence
  Synthetic
cagtagaaatgacttgttcatataatttagtcatcattcctgatgaaccaaaaaattcagaagcaattgaacaaa

SEQ ID NO: 308557 - DNA, 75 bp, Artificial Sequence
  Synthetic
tttagtcatcattcctgatgaaccaaaaaattcagaagcaattgaacaaatagctgaatgggtattaaatgtttg

SEQ ID NO: 308558 - DNA, 75 bp, Artificial Sequence
  Synthetic
taagattaaataatacatatgaagttgacaaaataatagattttaaaacaaattcggatcatacttttctaccat

SEQ ID NO: 308559 - DNA, 75 bp, Artificial Sequence
  Synthetic
aaaaattcagaagcaattgaacaaatagctgaatgggtattaaatgtttggcagtgtgatgatatgaatttggat

SEQ ID NO: 308560 - DNA, 75 bp, Artificial Sequence
  Synthetic
gctggaatatttgggtatgcaataacaaaagatctgaagtccaatggaaacaatcatatatacatcattccaaat

SEQ ID NO: 308561 - DNA, 75 bp, Artificial Sequence
  Synthetic
tgaagattgtgatatatccgtttgcccattagatacgacaatgaatggaataggttgttcaccagctagtacaga

SEQ ID NO: 308562 - DNA, 75 bp, Artificial Sequence
  Synthetic
caaaagatctgaagtccaatggaaacaatcatatatacatcattccaaatgcaagagatgagaataatttcgata

SEQ ID NO: 308563 - DNA, 75 bp, Artificial Sequence
  Synthetic
aacatacgaggtggtgtctaatgatactcaattggcgctcattgacgtggttgataacgttaaatacagaattca

SEQ ID NO: 308564 - DNA, 75 bp, Artificial Sequence
  Synthetic
gatatatatttagagatatggttagtggaaaagagaatatgcaggatacggataaagataattatgcatccggcc

SEQ ID NO: 308565 - DNA, 75 bp, Artificial Sequence
  Synthetic
agggtgaaccacgactaaacactgcaattataagaatttccacatcatcaagtttcgataattcattatcacctc

SEQ ID NO: 308566 - DNA, 75 bp, Artificial Sequence
  Synthetic
gtaggatggcttagattgcataagactggtcaatttaaagtcaaatcagatatatacaaagaacatacagatagt

SEQ ID NO: 308567 - DNA, 75 bp, Artificial Sequence
  Synthetic
tggaaaatcttttataccataattgattacattaacacattggtgcagacaatggcgcctagacatcgggctata

SEQ ID NO: 308568 - DNA, 75 bp, Artificial Sequence
  Synthetic
attacattaacacattggtgcagacaatggcgcctagacatcgggctatatatcctgaaggttggatgctgagat

SEQ ID NO: 308569 - DNA, 75 bp, Artificial Sequence
  Synthetic
tgataaagttggtgagaaatattcaaagaaaatgatggagatttgggaagttcaagtgtgaggctaatcacctct

SEQ ID NO: 308570 - DNA, 75 bp, Artificial Sequence
  Synthetic
gagcgcgtgcggaaagatggataagcttgcagaccttaattatactttgagcgttatcactttaatgaatgatac

SEQ ID NO: 308571 - DNA, 75 bp, Artificial Sequence
  Synthetic
tctacataaggcatcaattcccacaatgaaaattgcgttaaaaacgtcaaagtgttcgtacaaagtaattaagta

SEQ ID NO: 308572 - DNA, 75 bp, Artificial Sequence
  Synthetic
ttttatgataattataaagattgcattgatgattctggtgtgtataatgcatgtataggtagagctaaaactata

SEQ ID NO: 308573 - DNA, 75 bp, Artificial Sequence
  Synthetic
aacaggttactactaaggacgaaattgaacaacagatggatagaattgtaaaagagatgagacgtcaactggaaa

SEQ ID NO: 308574 - DNA, 75 bp, Artificial Sequence
  Synthetic
cgtatacacgataaattggtagttagacctgtagacgttatagacatgtcgaaagaatttaaccagaaaaatatt

SEQ ID NO: 308575 - DNA, 75 bp, Artificial Sequence
  Synthetic
gacctgtagacgttatagacatgtcgaaagaatttaaccagaaaaatattagaacgctagacgaatgggaaagtg

SEQ ID NO: 308576 - DNA, 75 bp, Artificial Sequence
  Synthetic
ttgaaaaaggaaaagatatcaccattgatttagacgctatgaacggtgaagttaaattagatggaaattcatgtt

SEQ ID NO: 308577 - DNA, 75 bp, Artificial Sequence
  Synthetic
aaaccccagtcaatcatttcgcgtgtagcacatccctaatcccgaataaccaatccagcgaatgttggacgttaa

SEQ ID NO: 308578 - DNA, 75 bp, Artificial Sequence
  Synthetic
gcgcaattctttgcatctcattaatatacacattatttctgagaaaaatgttccatctattaactgatgcattag

SEQ ID NO: 308579 - DNA, 75 bp, Artificial Sequence
  Synthetic
gcgcaattctttgcatctcattaatatacacattatttctgagaaaaatgttccatctatttactgatgcattag

SEQ ID NO: 308580 - DNA, 75 bp, Artificial Sequence
  Synthetic
gcgcaattctttgcatctcattaatatacacattatttctgagaaaaatgttccatctattcactgatgcattag

SEQ ID NO: 308581 - DNA, 75 bp, Artificial Sequence
  Synthetic
gcgcaattctttgcatctcattaatatacacattatttctgagaaaaatgttccatctattgactgatgcattag

SEQ ID NO: 308582 - DNA, 75 bp, Artificial Sequence
  Synthetic
gcgcaattctttgcatctcattaatatacacattttttctgagaaaaatgttccatctattaactgatgcattag

SEQ ID NO: 308583 - DNA, 75 bp, Artificial Sequence
  Synthetic
gcgcaattctttgcatctcattaatatacacattttttctgagaaaaatgttccatctatttactgatgcattag

SEQ ID NO: 308584 - DNA, 75 bp, Artificial Sequence
  Synthetic
gcgcaattctttgcatctcattaatatacacattttttctgagaaaaatgttccatctattcactgatgcattag

SEQ ID NO: 308585 - DNA, 75 bp, Artificial Sequence
  Synthetic
gcgcaattctttgcatctcattaatatacacattttttctgagaaaaatgttccatctattgactgatgcattag

SEQ ID NO: 308586 - DNA, 75 bp, Artificial Sequence
  Synthetic
gcgcaattctttgcatctcattaatatacacattctttctgagaaaaatgttccatctattaactgatgcattag

SEQ ID NO: 308587 - DNA, 75 bp, Artificial Sequence
  Synthetic
gcgcaattctttgcatctcattaatatacacattctttctgagaaaaatgttccatctatttactgatgcattag

SEQ ID NO: 308588 - DNA, 75 bp, Artificial Sequence
  Synthetic
gcgcaattctttgcatctcattaatatacacattctttctgagaaaaatgttccatctattcactgatgcattag

SEQ ID NO: 308589 - DNA, 75 bp, Artificial Sequence
  Synthetic
gcgcaattctttgcatctcattaatatacacattctttctgagaaaaatgttccatctattgactgatgcattag

SEQ ID NO: 308590 - DNA, 75 bp, Artificial Sequence
  Synthetic
gcgcaattctttgcatctcattaatatacacattgtttctgagaaaaatgttccatctattaactgatgcattag

SEQ ID NO: 308591 - DNA, 75 bp, Artificial Sequence
  Synthetic
gcgcaattctttgcatctcattaatatacacattgtttctgagaaaaatgttccatctatttactgatgcattag

SEQ ID NO: 308592 - DNA, 75 bp, Artificial Sequence
  Synthetic
gcgcaattctttgcatctcattaatatacacattgtttctgagaaaaatgttccatctattcactgatgcattag

SEQ ID NO: 308593 - DNA, 75 bp, Artificial Sequence
  Synthetic
gcgcaattctttgcatctcattaatatacacattgtttctgagaaaaatgttccatctattgactgatgcattag

SEQ ID NO: 308594 - DNA, 75 bp, Artificial Sequence
  Synthetic
gaatccaaaaaacattatcgaaaaaatgattgaattagaaattccaatttttaaatcagattataggaataatga

SEQ ID NO: 308595 - DNA, 75 bp, Artificial Sequence
  Synthetic
ttccatctattaactgatgcattagctgtttacattatcatatctgtatgcgctggatattctaatggtcaattg

SEQ ID NO: 308596 - DNA, 75 bp, Artificial Sequence
  Synthetic
ttccatctattaactgatgcattagctgtttacattatcatatctgtatgcgctggatattctaatggtcatttg

SEQ ID NO: 308597 - DNA, 75 bp, Artificial Sequence
  Synthetic
ttccatctattaactgatgcattagctgtttacattatcatatctgtatgcgctggatattctaatggtcacttg

SEQ ID NO: 308598 - DNA, 75 bp, Artificial Sequence
  Synthetic
ttccatctattaactgatgcattagctgtttacattatcatatctgtatgcgctggatattctaatggtcagttg

SEQ ID NO: 308599 - DNA, 75 bp, Artificial Sequence
  Synthetic
ttccatctattaactgatgcattagctgttttcattatcatatctgtatgcgctggatattctaatggtcaattg

SEQ ID NO: 308600 - DNA, 75 bp, Artificial Sequence
  Synthetic
ttccatctattaactgatgcattagctgttttcattatcatatctgtatgcgctggatattctaatggtcatttg

SEQ ID NO: 308601 - DNA, 75 bp, Artificial Sequence
  Synthetic
ttccatctattaactgatgcattagctgttttcattatcatatctgtatgcgctggatattctaatggtcacttg

SEQ ID NO: 308602 - DNA, 75 bp, Artificial Sequence
  Synthetic
ttccatctattaactgatgcattagctgttttcattatcatatctgtatgcgctggatattctaatggtcagttg

SEQ ID NO: 308603 - DNA, 75 bp, Artificial Sequence
  Synthetic
ttccatctattaactgatgcattagctgtttccattatcatatctgtatgcgctggatattctaatggtcaattg

SEQ ID NO: 308604 - DNA, 75 bp, Artificial Sequence
  Synthetic
ttccatctattaactgatgcattagctgtttccattatcatatctgtatgcgctggatattctaatggtcatttg

SEQ ID NO: 308605 - DNA, 75 bp, Artificial Sequence
  Synthetic
ttccatctattaactgatgcattagctgtttccattatcatatctgtatgcgctggatattctaatggtcacttg

SEQ ID NO: 308606 - DNA, 75 bp, Artificial Sequence
  Synthetic
ttccatctattaactgatgcattagctgtttccattatcatatctgtatgcgctggatattctaatggtcagttg

SEQ ID NO: 308607 - DNA, 75 bp, Artificial Sequence
  Synthetic
ttccatctattaactgatgcattagctgtttgcattatcatatctgtatgcgctggatattctaatggtcaattg

SEQ ID NO: 308608 - DNA, 75 bp, Artificial Sequence
  Synthetic
ttccatctattaactgatgcattagctgtttgcattatcatatctgtatgcgctggatattctaatggtcatttg

SEQ ID NO: 308609 - DNA, 75 bp, Artificial Sequence
  Synthetic
ttccatctattaactgatgcattagctgtttgcattatcatatctgtatgcgctggatattctaatggtcacttg

SEQ ID NO: 308610 - DNA, 75 bp, Artificial Sequence
  Synthetic
ttccatctattaactgatgcattagctgtttgcattatcatatctgtatgcgctggatattctaatggtcagttg

SEQ ID NO: 308611 - DNA, 75 bp, Artificial Sequence
  Synthetic
ttccatctatttactgatgcattagctgtttacattatcatatctgtatgcgctggatattctaatggtcaattg

SEQ ID NO: 308612 - DNA, 75 bp, Artificial Sequence
  Synthetic
ttccatctatttactgatgcattagctgtttacattatcatatctgtatgcgctggatattctaatggtcatttg

SEQ ID NO: 308613 - DNA, 75 bp, Artificial Sequence
  Synthetic
ttccatctatttactgatgcattagctgtttacattatcatatctgtatgcgctggatattctaatggtcacttg

SEQ ID NO: 308614 - DNA, 75 bp, Artificial Sequence
  Synthetic
ttccatctatttactgatgcattagctgtttacattatcatatctgtatgcgctggatattctaatggtcagttg

SEQ ID NO: 308615 - DNA, 75 bp, Artificial Sequence
  Synthetic
ttccatctatttactgatgcattagctgttttcattatcatatctgtatgcgctggatattctaatggtcaattg

SEQ ID NO: 308616 - DNA, 75 bp, Artificial Sequence
  Synthetic
ttccatctatttactgatgcattagctgttttcattatcatatctgtatgcgctggatattctaatggtcatttg

SEQ ID NO: 308617 - DNA, 75 bp, Artificial Sequence
  Synthetic
ttccatctatttactgatgcattagctgttttcattatcatatctgtatgcgctggatattctaatggtcacttg

SEQ ID NO: 308618 - DNA, 75 bp, Artificial Sequence
  Synthetic
ttccatctatttactgatgcattagctgttttcattatcatatctgtatgcgctggatattctaatggtcagttg

SEQ ID NO: 308619 - DNA, 75 bp, Artificial Sequence
  Synthetic
ttccatctatttactgatgcattagctgtttccattatcatatctgtatgcgctggatattctaatggtcaattg

SEQ ID NO: 308620 - DNA, 75 bp, Artificial Sequence
  Synthetic
ttccatctatttactgatgcattagctgtttccattatcatatctgtatgcgctggatattctaatggtcatttg

SEQ ID NO: 308621 - DNA, 75 bp, Artificial Sequence
  Synthetic
ttccatctatttactgatgcattagctgtttccattatcatatctgtatgcgctggatattctaatggtcacttg

SEQ ID NO: 308622 - DNA, 75 bp, Artificial Sequence
  Synthetic
ttccatctatttactgatgcattagctgtttccattatcatatctgtatgcgctggatattctaatggtcagttg

SEQ ID NO: 308623 - DNA, 75 bp, Artificial Sequence
  Synthetic
ttccatctatttactgatgcattagctgtttgcattatcatatctgtatgcgctggatattctaatggtcaattg

SEQ ID NO: 308624 - DNA, 75 bp, Artificial Sequence
  Synthetic
ttccatctatttactgatgcattagctgtttgcattatcatatctgtatgcgctggatattctaatggtcatttg

SEQ ID NO: 308625 - DNA, 75 bp, Artificial Sequence
  Synthetic
ttccatctatttactgatgcattagctgtttgcattatcatatctgtatgcgctggatattctaatggtcacttg

SEQ ID NO: 308626 - DNA, 75 bp, Artificial Sequence
  Synthetic
ttccatctatttactgatgcattagctgtttgcattatcatatctgtatgcgctggatattctaatggtcagttg

SEQ ID NO: 308627 - DNA, 75 bp, Artificial Sequence
  Synthetic
ttccatctattcactgatgcattagctgtttacattatcatatctgtatgcgctggatattctaatggtcaattg

SEQ ID NO: 308628 - DNA, 75 bp, Artificial Sequence
  Synthetic
ttccatctattcactgatgcattagctgtttacattatcatatctgtatgcgctggatattctaatggtcatttg

SEQ ID NO: 308629 - DNA, 75 bp, Artificial Sequence
  Synthetic
ttccatctattcactgatgcattagctgtttacattatcatatctgtatgcgctggatattctaatggtcacttg

SEQ ID NO: 308630 - DNA, 75 bp, Artificial Sequence
  Synthetic
ttccatctattcactgatgcattagctgtttacattatcatatctgtatgcgctggatattctaatggtcagttg

SEQ ID NO: 308631 - DNA, 75 bp, Artificial Sequence
  Synthetic
ttccatctattcactgatgcattagctgttttcattatcatatctgtatgcgctggatattctaatggtcaattg

SEQ ID NO: 308632 - DNA, 75 bp, Artificial Sequence
  Synthetic
ttccatctattcactgatgcattagctgttttcattatcatatctgtatgcgctggatattctaatggtcatttg

SEQ ID NO: 308633 - DNA, 75 bp, Artificial Sequence
  Synthetic
ttccatctattcactgatgcattagctgttttcattatcatatctgtatgcgctggatattctaatggtcacttg

SEQ ID NO: 308634 - DNA, 75 bp, Artificial Sequence
  Synthetic
ttccatctattcactgatgcattagctgttttcattatcatatctgtatgcgctggatattctaatggtcagttg

SEQ ID NO: 308635 - DNA, 75 bp, Artificial Sequence
  Synthetic
ttccatctattcactgatgcattagctgtttccattatcatatctgtatgcgctggatattctaatggtcaattg

SEQ ID NO: 308636 - DNA, 75 bp, Artificial Sequence
  Synthetic
ttccatctattcactgatgcattagctgtttccattatcatatctgtatgcgctggatattctaatggtcatttg

SEQ ID NO: 308637 - DNA, 75 bp, Artificial Sequence
  Synthetic
ttccatctattcactgatgcattagctgtttccattatcatatctgtatgcgctggatattctaatggtcacttg

SEQ ID NO: 308638 - DNA, 75 bp, Artificial Sequence
  Synthetic
ttccatctattcactgatgcattagctgtttccattatcatatctgtatgcgctggatattctaatggtcagttg

SEQ ID NO: 308639 - DNA, 75 bp, Artificial Sequence
  Synthetic
ttccatctattcactgatgcattagctgtttgcattatcatatctgtatgcgctggatattctaatggtcaattg

SEQ ID NO: 308640 - DNA, 75 bp, Artificial Sequence
  Synthetic
ttccatctattcactgatgcattagctgtttgcattatcatatctgtatgcgctggatattctaatggtcatttg

SEQ ID NO: 308641 - DNA, 75 bp, Artificial Sequence
  Synthetic
ttccatctattcactgatgcattagctgtttgcattatcatatctgtatgcgctggatattctaatggtcacttg

SEQ ID NO: 308642 - DNA, 75 bp, Artificial Sequence
  Synthetic
ttccatctattcactgatgcattagctgtttgcattatcatatctgtatgcgctggatattctaatggtcagttg

SEQ ID NO: 308643 - DNA, 75 bp, Artificial Sequence
  Synthetic
ttccatctattgactgatgcattagctgtttacattatcatatctgtatgcgctggatattctaatggtcaattg

SEQ ID NO: 308644 - DNA, 75 bp, Artificial Sequence
  Synthetic
ttccatctattgactgatgcattagctgtttacattatcatatctgtatgcgctggatattctaatggtcatttg

SEQ ID NO: 308645 - DNA, 75 bp, Artificial Sequence
  Synthetic
ttccatctattgactgatgcattagctgtttacattatcatatctgtatgcgctggatattctaatggtcacttg

SEQ ID NO: 308646 - DNA, 75 bp, Artificial Sequence
  Synthetic
ttccatctattgactgatgcattagctgtttacattatcatatctgtatgcgctggatattctaatggtcagttg

SEQ ID NO: 308647 - DNA, 75 bp, Artificial Sequence
  Synthetic
ttccatctattgactgatgcattagctgttttcattatcatatctgtatgcgctggatattctaatggtcaattg

SEQ ID NO: 308648 - DNA, 75 bp, Artificial Sequence
  Synthetic
ttccatctattgactgatgcattagctgttttcattatcatatctgtatgcgctggatattctaatggtcatttg

SEQ ID NO: 308649 - DNA, 75 bp, Artificial Sequence
  Synthetic
ttccatctattgactgatgcattagctgttttcattatcatatctgtatgcgctggatattctaatggtcacttg

SEQ ID NO: 308650 - DNA, 75 bp, Artificial Sequence
  Synthetic
ttccatctattgactgatgcattagctgttttcattatcatatctgtatgcgctggatattctaatggtcagttg

SEQ ID NO: 308651 - DNA, 75 bp, Artificial Sequence
  Synthetic
ttccatctattgactgatgcattagctgtttccattatcatatctgtatgcgctggatattctaatggtcaattg

SEQ ID NO: 308652 - DNA, 75 bp, Artificial Sequence
  Synthetic
ttccatctattgactgatgcattagctgtttccattatcatatctgtatgcgctggatattctaatggtcatttg

SEQ ID NO: 308653 - DNA, 75 bp, Artificial Sequence
  Synthetic
ttccatctattgactgatgcattagctgtttccattatcatatctgtatgcgctggatattctaatggtcacttg

SEQ ID NO: 308654 - DNA, 75 bp, Artificial Sequence
  Synthetic
ttccatctattgactgatgcattagctgtttccattatcatatctgtatgcgctggatattctaatggtcagttg

SEQ ID NO: 308655 - DNA, 75 bp, Artificial Sequence
  Synthetic
ttccatctattgactgatgcattagctgtttgcattatcatatctgtatgcgctggatattctaatggtcaattg

SEQ ID NO: 308656 - DNA, 75 bp, Artificial Sequence
  Synthetic
ttccatctattgactgatgcattagctgtttgcattatcatatctgtatgcgctggatattctaatggtcatttg

SEQ ID NO: 308657 - DNA, 75 bp, Artificial Sequence
  Synthetic
ttccatctattgactgatgcattagctgtttgcattatcatatctgtatgcgctggatattctaatggtcacttg

SEQ ID NO: 308658 - DNA, 75 bp, Artificial Sequence
  Synthetic
ttccatctattgactgatgcattagctgtttgcattatcatatctgtatgcgctggatattctaatggtcagttg

SEQ ID NO: 308659 - DNA, 75 bp, Artificial Sequence
  Synthetic
ttatgaatttattttccaaatgatgcaattggttcaccaggtccaggtaaagctgatggattattgaatgataat

SEQ ID NO: 308660 - DNA, 75 bp, Artificial Sequence
  Synthetic
ttatgaatttattttccaaatgatgcaattggttcaccaggtccaggtaaagctgatggtttattgaatgataat

SEQ ID NO: 308661 - DNA, 75 bp, Artificial Sequence
  Synthetic
ttatgaatttattttccaaatgatgcaattggttcaccaggtccaggtaaagctgatggcttattgaatgataat

SEQ ID NO: 308662 - DNA, 75 bp, Artificial Sequence
  Synthetic
ttatgaatttattttccaaatgatgcaattggttcaccaggtccaggtaaagctgatgggttattgaatgataat

SEQ ID NO: 308663 - DNA, 75 bp, Artificial Sequence
  Synthetic
ttatgaatttattttccaaatgttgcaattggttcaccaggtccaggtaaagctgatggattattgaatgataat

SEQ ID NO: 308664 - DNA, 75 bp, Artificial Sequence
  Synthetic
ttatgaatttattttccaaatgttgcaattggttcaccaggtccaggtaaagctgatggtttattgaatgataat

SEQ ID NO: 308665 - DNA, 75 bp, Artificial Sequence
  Synthetic
ttatgaatttattttccaaatgttgcaattggttcaccaggtccaggtaaagctgatggcttattgaatgataat

SEQ ID NO: 308666 - DNA, 75 bp, Artificial Sequence
  Synthetic
ttatgaatttattttccaaatgttgcaattggttcaccaggtccaggtaaagctgatgggttattgaatgataat

SEQ ID NO: 308667 - DNA, 75 bp, Artificial Sequence
  Synthetic
ttatgaatttattttccaaatgctgcaattggttcaccaggtccaggtaaagctgatggattattgaatgataat

SEQ ID NO: 308668 - DNA, 75 bp, Artificial Sequence
  Synthetic
ttatgaatttattttccaaatgctgcaattggttcaccaggtccaggtaaagctgatggtttattgaatgataat

SEQ ID NO: 308669 - DNA, 75 bp, Artificial Sequence
  Synthetic
ttatgaatttattttccaaatgctgcaattggttcaccaggtccaggtaaagctgatggcttattgaatgataat

SEQ ID NO: 308670 - DNA, 75 bp, Artificial Sequence
  Synthetic
ttatgaatttattttccaaatgctgcaattggttcaccaggtccaggtaaagctgatgggttattgaatgataat

SEQ ID NO: 308671 - DNA, 75 bp, Artificial Sequence
  Synthetic
ttatgaatttattttccaaatggtgcaattggttcaccaggtccaggtaaagctgatggattattgaatgataat

SEQ ID NO: 308672 - DNA, 75 bp, Artificial Sequence
  Synthetic
ttatgaatttattttccaaatggtgcaattggttcaccaggtccaggtaaagctgatggtttattgaatgataat

SEQ ID NO: 308673 - DNA, 75 bp, Artificial Sequence
  Synthetic
ttatgaatttattttccaaatggtgcaattggttcaccaggtccaggtaaagctgatggcttattgaatgataat

SEQ ID NO: 308674 - DNA, 75 bp, Artificial Sequence
  Synthetic
ttatgaatttattttccaaatggtgcaattggttcaccaggtccaggtaaagctgatgggttattgaatgataat

SEQ ID NO: 308675 - DNA, 75 bp, Artificial Sequence
  Synthetic
ttatgtatttattttccaaatgatgcaattggttcaccaggtccaggtaaagctgatggattattgaatgataat

SEQ ID NO: 308676 - DNA, 75 bp, Artificial Sequence
  Synthetic
ttatgtatttattttccaaatgatgcaattggttcaccaggtccaggtaaagctgatggtttattgaatgataat

SEQ ID NO: 308677 - DNA, 75 bp, Artificial Sequence
  Synthetic
ttatgtatttattttccaaatgatgcaattggttcaccaggtccaggtaaagctgatggcttattgaatgataat

SEQ ID NO: 308678 - DNA, 75 bp, Artificial Sequence
  Synthetic
ttatgtatttattttccaaatgatgcaattggttcaccaggtccaggtaaagctgatgggttattgaatgataat

SEQ ID NO: 308679 - DNA, 75 bp, Artificial Sequence
  Synthetic
ttatgtatttattttccaaatgttgcaattggttcaccaggtccaggtaaagctgatggattattgaatgataat

SEQ ID NO: 308680 - DNA, 75 bp, Artificial Sequence
  Synthetic
ttatgtatttattttccaaatgttgcaattggttcaccaggtccaggtaaagctgatggtttattgaatgataat

SEQ ID NO: 308681 - DNA, 75 bp, Artificial Sequence
  Synthetic
ttatgtatttattttccaaatgttgcaattggttcaccaggtccaggtaaagctgatggcttattgaatgataat

SEQ ID NO: 308682 - DNA, 75 bp, Artificial Sequence
  Synthetic
ttatgtatttattttccaaatgttgcaattggttcaccaggtccaggtaaagctgatgggttattgaatgataat

SEQ ID NO: 308683 - DNA, 75 bp, Artificial Sequence
  Synthetic
ttatgtatttattttccaaatgctgcaattggttcaccaggtccaggtaaagctgatggattattgaatgataat

SEQ ID NO: 308684 - DNA, 75 bp, Artificial Sequence
  Synthetic
ttatgtatttattttccaaatgctgcaattggttcaccaggtccaggtaaagctgatggtttattgaatgataat

SEQ ID NO: 308685 - DNA, 75 bp, Artificial Sequence
  Synthetic
ttatgtatttattttccaaatgctgcaattggttcaccaggtccaggtaaagctgatggcttattgaatgataat

SEQ ID NO: 308686 - DNA, 75 bp, Artificial Sequence
  Synthetic
ttatgtatttattttccaaatgctgcaattggttcaccaggtccaggtaaagctgatgggttattgaatgataat

SEQ ID NO: 308687 - DNA, 75 bp, Artificial Sequence
  Synthetic
ttatgtatttattttccaaatggtgcaattggttcaccaggtccaggtaaagctgatggattattgaatgataat

SEQ ID NO: 308688 - DNA, 75 bp, Artificial Sequence
  Synthetic
ttatgtatttattttccaaatggtgcaattggttcaccaggtccaggtaaagctgatggtttattgaatgataat

SEQ ID NO: 308689 - DNA, 75 bp, Artificial Sequence
  Synthetic
ttatgtatttattttccaaatggtgcaattggttcaccaggtccaggtaaagctgatggcttattgaatgataat

SEQ ID NO: 308690 - DNA, 75 bp, Artificial Sequence
  Synthetic
ttatgtatttattttccaaatggtgcaattggttcaccaggtccaggtaaagctgatgggttattgaatgataat

SEQ ID NO: 308691 - DNA, 75 bp, Artificial Sequence
  Synthetic
ttatgcatttattttccaaatgatgcaattggttcaccaggtccaggtaaagctgatggattattgaatgataat

SEQ ID NO: 308692 - DNA, 75 bp, Artificial Sequence
  Synthetic
ttatgcatttattttccaaatgatgcaattggttcaccaggtccaggtaaagctgatggtttattgaatgataat

SEQ ID NO: 308693 - DNA, 75 bp, Artificial Sequence
  Synthetic
ttatgcatttattttccaaatgatgcaattggttcaccaggtccaggtaaagctgatggcttattgaatgataat

SEQ ID NO: 308694 - DNA, 75 bp, Artificial Sequence
  Synthetic
ttatgcatttattttccaaatgatgcaattggttcaccaggtccaggtaaagctgatgggttattgaatgataat

SEQ ID NO: 308695 - DNA, 75 bp, Artificial Sequence
  Synthetic
ttatgcatttattttccaaatgttgcaattggttcaccaggtccaggtaaagctgatggattattgaatgataat

SEQ ID NO: 308696 - DNA, 75 bp, Artificial Sequence
  Synthetic
ttatgcatttattttccaaatgttgcaattggttcaccaggtccaggtaaagctgatggtttattgaatgataat

SEQ ID NO: 308697 - DNA, 75 bp, Artificial Sequence
  Synthetic
ttatgcatttattttccaaatgttgcaattggttcaccaggtccaggtaaagctgatggcttattgaatgataat

SEQ ID NO: 308698 - DNA, 75 bp, Artificial Sequence
  Synthetic
ttatgcatttattttccaaatgttgcaattggttcaccaggtccaggtaaagctgatgggttattgaatgataat

SEQ ID NO: 308699 - DNA, 75 bp, Artificial Sequence
  Synthetic
ttatgcatttattttccaaatgctgcaattggttcaccaggtccaggtaaagctgatggattattgaatgataat

SEQ ID NO: 308700 - DNA, 75 bp, Artificial Sequence; identical to SEQ ID NO: 307982
  Synthetic

SEQ ID NO: 308701 - DNA, 75 bp, Artificial Sequence
  Synthetic
ttatgcatttattttccaaatgctgcaattggttcaccaggtccaggtaaagctgatggcttattgaatgataat

SEQ ID NO: 308702 - DNA, 75 bp, Artificial Sequence
  Synthetic
ttatgcatttattttccaaatgctgcaattggttcaccaggtccaggtaaagctgatgggttattgaatgataat

SEQ ID NO: 308703 - DNA, 75 bp, Artificial Sequence
  Synthetic
ttatgcatttattttccaaatggtgcaattggttcaccaggtccaggtaaagctgatggattattgaatgataat

SEQ ID NO: 308704 - DNA, 75 bp, Artificial Sequence
  Synthetic
ttatgcatttattttccaaatggtgcaattggttcaccaggtccaggtaaagctgatggtttattgaatgataat

SEQ ID NO: 308705 - DNA, 75 bp, Artificial Sequence
  Synthetic
ttatgcatttattttccaaatggtgcaattggttcaccaggtccaggtaaagctgatggcttattgaatgataat

SEQ ID NO: 308706 - DNA, 75 bp, Artificial Sequence
  Synthetic
ttatgcatttattttccaaatggtgcaattggttcaccaggtccaggtaaagctgatgggttattgaatgataat

SEQ ID NO: 308707 - DNA, 75 bp, Artificial Sequence
  Synthetic
ttatggatttattttccaaatgatgcaattggttcaccaggtccaggtaaagctgatggattattgaatgataat

SEQ ID NO: 308708 - DNA, 75 bp, Artificial Sequence
  Synthetic
ttatggatttattttccaaatgatgcaattggttcaccaggtccaggtaaagctgatggtttattgaatgataat

SEQ ID NO: 308709 - DNA, 75 bp, Artificial Sequence
  Synthetic
ttatggatttattttccaaatgatgcaattggttcaccaggtccaggtaaagctgatggcttattgaatgataat

SEQ ID NO: 308710 - DNA, 75 bp, Artificial Sequence
  Synthetic
ttatggatttattttccaaatgatgcaattggttcaccaggtccaggtaaagctgatgggttattgaatgataat

SEQ ID NO: 308711 - DNA, 75 bp, Artificial Sequence
  Synthetic
ttatggatttattttccaaatgttgcaattggttcaccaggtccaggtaaagctgatggattattgaatgataat

SEQ ID NO: 308712 - DNA, 75 bp, Artificial Sequence
  Synthetic
ttatggatttattttccaaatgttgcaattggttcaccaggtccaggtaaagctgatggtttattgaatgataat

SEQ ID NO: 308713 - DNA, 75 bp, Artificial Sequence
  Synthetic
ttatggatttattttccaaatgttgcaattggttcaccaggtccaggtaaagctgatggcttattgaatgataat

SEQ ID NO: 308714 - DNA, 75 bp, Artificial Sequence
  Synthetic
ttatggatttattttccaaatgttgcaattggttcaccaggtccaggtaaagctgatgggttattgaatgataat

SEQ ID NO: 308715 - DNA, 75 bp, Artificial Sequence
  Synthetic
ttatggatttattttccaaatgctgcaattggttcaccaggtccaggtaaagctgatggattattgaatgataat

SEQ ID NO: 308716 - DNA, 75 bp, Artificial Sequence
  Synthetic
ttatggatttattttccaaatgctgcaattggttcaccaggtccaggtaaagctgatggtttattgaatgataat

SEQ ID NO: 308717 - DNA, 75 bp, Artificial Sequence
  Synthetic
ttatggatttattttccaaatgctgcaattggttcaccaggtccaggtaaagctgatggcttattgaatgataat

SEQ ID NO: 308718 - DNA, 75 bp, Artificial Sequence
  Synthetic
ttatggatttattttccaaatgctgcaattggttcaccaggtccaggtaaagctgatgggttattgaatgataat

SEQ ID NO: 308719 - DNA, 75 bp, Artificial Sequence
  Synthetic
ttatggatttattttccaaatggtgcaattggttcaccaggtccaggtaaagctgatggattattgaatgataat

SEQ ID NO: 308720 - DNA, 75 bp, Artificial Sequence
  Synthetic
ttatggatttattttccaaatggtgcaattggttcaccaggtccaggtaaagctgatggtttattgaatgataat

SEQ ID NO: 308721 - DNA, 75 bp, Artificial Sequence
  Synthetic
ttatggatttattttccaaatggtgcaattggttcaccaggtccaggtaaagctgatggcttattgaatgataat

SEQ ID NO: 308722 - DNA, 75 bp, Artificial Sequence
  Synthetic
ttatggatttattttccaaatggtgcaattggttcaccaggtccaggtaaagctgatgggttattgaatgataat

SEQ ID NO: 308723 - DNA, 75 bp, Artificial Sequence
  Synthetic
aagataatctgtgggcagcattcggtgaagattgtgacatatctgtttgtccattagatgcaacaatgaatggga

SEQ ID NO: 308724 - DNA, 75 bp, Artificial Sequence
  Synthetic
gctgtctgacaaactggtcttctttttaaatggtttgcataacattgtgcactgtttgcgtagttcttagtatcc

SEQ ID NO: 308725 - DNA, 75 bp, Artificial Sequence
  Synthetic
actgtttgcgtagttcttagtatcctgttagtgtatattataatttttagaaaaatgttccatcttattgtcgat

SEQ ID NO: 308726 - DNA, 75 bp, Artificial Sequence
  Synthetic
tgttagtgtatattataatttttagaaaaatgttccatcttattgtcgatactgtaattattactctagttatat

SEQ ID NO: 308727 - DNA, 75 bp, Artificial Sequence
  Synthetic
cagtgtaaattgaaaaattgtgttaagggtgaatcacgattaaacactgcaattataagaatttctacatcatca

SEQ ID NO: 308728 - DNA, 75 bp, Artificial Sequence
  Synthetic
tataatggaaatattgagacggtagtcaatggtactaatccatttgatgttaattctttatgcatatattttccg

SEQ ID NO: 308729 - DNA, 75 bp, Artificial Sequence
  Synthetic
tcaatggtactaatccatttgatgttaattctttatgcatatattttccggcatcagccataggaagtccaggac

SEQ ID NO: 308730 - DNA, 75 bp, Artificial Sequence
  Synthetic
gcaactttatttgagacgaaagggtttccaaaaggttcagttaatcttattaaatacacaaaacctgtagatttt

SEQ ID NO: 308731 - DNA, 75 bp, Artificial Sequence
  Synthetic
ttccaaaaggttcagttaatcttattaaatacacaaaacctgtagattttattgattcaatagatatgacatgtg

SEQ ID NO: 308732 - DNA, 75 bp, Artificial Sequence
  Synthetic
ttgtttgaaacaaaaggattcccaaaaggttcaataatacttaaaacatatacacagacatcagactttataaat

SEQ ID NO: 308733 - DNA, 75 bp, Artificial Sequence
  Synthetic
gaacaagtggctgaatggatacttaatgtatggaagtgtgatgaaatgaatttagatgtgtatacatatgagcaa

SEQ ID NO: 308734 - DNA, 75 bp, Artificial Sequence
  Synthetic
atgtatggaagtgtgatgaaatgaatttagatgtgtatacatatgagcaaataggaaatgataacatatgggctg

SEQ ID NO: 308735 - DNA, 75 bp, Artificial Sequence
  Synthetic
cgactgaatactgcactaataaggatttcaacatcatcaagttttgataattcattgtcaccattaaataacggc

SEQ ID NO: 308736 - DNA, 75 bp, Artificial Sequence
  Synthetic
gatcaatggcgtcttcactttatcatcaactaatttctcaaaactattatgcaactggaaatgagatattaaaag

SEQ ID NO: 308737 - DNA, 75 bp, Artificial Sequence
  Synthetic
gcaactggaaatgagatattaaaagatcaacaaacgaataaaactatcactgactatgtagatgctgggaattat

SEQ ID NO: 308738 - DNA, 75 bp, Artificial Sequence
  Synthetic
aatggaatagggtgcattccagcaagtttagatacatatgaagtgatatctaataatacagaagtggcactatta

SEQ ID NO: 308739 - DNA, 75 bp, Artificial Sequence
  Synthetic
atcaacaaacgaataaaactatcactgactatgtagatgctgggaattatacatatgctcaactaccaccaacta

SEQ ID NO: 308740 - DNA, 75 bp, Artificial Sequence
  Synthetic
aatgtggttgataatgtaaggcatagaattcaaatgaatcagaatacgtgtagaattaagaattgtgtaaaaggc

SEQ ID NO: 308741 - DNA, 75 bp, Artificial Sequence
  Synthetic
acagggccgcatacaaacagagtaatagaatggagtaatttgcttaattctaaccaatggttgttgttttcaaaa

SEQ ID NO: 308742 - DNA, 75 bp, Artificial Sequence
  Synthetic
tagaatggagtaatttgcttaattctaaccaatggttgttgttttcaaaacctgcgggtacagttaaattattaa

SEQ ID NO: 308743 - DNA, 75 bp, Artificial Sequence
  Synthetic
tgataactcattatctccattaaacaatggacaaaacacaagatcttttaagattaatgcaatgaaatggtggaa

SEQ ID NO: 308744 - DNA, 75 bp, Artificial Sequence
  Synthetic
tatggaaaagctggtaccacagtaacatcggaacactattcatcattaagtgatcatgtagtagctgtgcataat

SEQ ID NO: 308745 - DNA, 75 bp, Artificial Sequence
  Synthetic
gtaaacattttcattcaatcaatggcgcctagacatagggctatatatccggatggatggatgctgagatacgcg

SEQ ID NO: 308746 - DNA, 75 bp, Artificial Sequence
  Synthetic
catcggaacactattcatcattaagtgatcatgtagtagctgtgcataatgattcattagttttgttttggaatg

SEQ ID NO: 308747 - DNA, 75 bp, Artificial Sequence
  Synthetic
atgtccaagcgatcacgctccttagattctgctgccttttattaccgagtctaaatatatctaagttaaaagttg

SEQ ID NO: 308748 - DNA, 75 bp, Artificial Sequence
  Synthetic
ggtggaatactaattaaaccatcatctcaaacacccagaatcgtcatatgtatggcagatatgaacaattatgat

SEQ ID NO: 308749 - DNA, 75 bp, Artificial Sequence
  Synthetic
ctcaaacacccagaatcgtcatatgtatggcagatatgaacaattatgatagtgaaacatttaattgggaagagt

SEQ ID NO: 308750 - DNA, 75 bp, Artificial Sequence
  Synthetic
aggatcaatggcgtcctcactatacaagcaactaatttcgcagaattactattcaactggaaatgatatcttatt

SEQ ID NO: 308751 - DNA, 75 bp, Artificial Sequence
  Synthetic
attgattactacctagctaacagtgatccgtataatcaactgaaaagtttacagcagccgacaatcactactctt

SEQ ID NO: 308752 - DNA, 75 bp, Artificial Sequence
  Synthetic
attcaactggaaatgatatcttattagatcaacaaacaaataaaaccactgttgactatgtagatgtagggaatt

SEQ ID NO: 308753 - DNA, 75 bp, Artificial Sequence
  Synthetic
atccgtataatcaactgaaaagtttacagcagccgacaatcactactcttgaaatgaaaatgatgcaagtgatta

SEQ ID NO: 308754 - DNA, 75 bp, Artificial Sequence
  Synthetic
agatcaacaaacaaataaaaccactgttgactatgtagatgtagggaattattcttatacgcaattaccgccaac

SEQ ID NO: 308755 - DNA, 75 bp, Artificial Sequence
  Synthetic
caagagatgagatatgcgagagatataacccttgaatgtaaaatagaatcagaagtaattaaaggaggtggatgg

SEQ ID NO: 308756 - DNA, 75 bp, Artificial Sequence
  Synthetic
ttacaggaccaaatacaggtgatgttgatttgaatagtttaacaaatgcaaatggatggatattgtataataaac

SEQ ID NO: 308757 - DNA, 75 bp, Artificial Sequence
  Synthetic
taacccttgaatgtaaaatagaatcagaagtaattaaaggaggtggatgggggtacgactacacaagcataaggt

SEQ ID NO: 308758 - DNA, 75 bp, Artificial Sequence
  Synthetic
tgatttgaatagtttaacaaatgcaaatggatggatattgtataataaaccagctaatacaaaacgattgttaaa

SEQ ID NO: 308759 - DNA, 75 bp, Artificial Sequence
  Synthetic
agtgctcatgtgactgttagttttaataacatgaaagaaaggtcttatggaggatcactaccaaccgactttaaa

SEQ ID NO: 308760 - DNA, 75 bp, Artificial Sequence
  Synthetic
atggcaaagcgaatactacggttacctcaatatattatgcatcggcgcaaaactctgaaaatactgcaacagtac

SEQ ID NO: 308761 - DNA, 75 bp, Artificial Sequence
  Synthetic
ataacatgaaagaaaggtcttatggaggatcactaccaaccgactttaaaataggtaaatttgacataatagatg

SEQ ID NO: 308762 - DNA, 75 bp, Artificial Sequence
  Synthetic
ctcaatatattatgcatcggcgcaaaactctgaaaatactgcaacagtacactatgactcattagtattattctt

SEQ ID NO: 308763 - DNA, 75 bp, Artificial Sequence
  Synthetic
aatatggtatatgtacgtgatttgaccgcagatataggagattttttccattattcacaaatgtcatattacttc

SEQ ID NO: 308764 - DNA, 75 bp, Artificial Sequence
  Synthetic
atatgggaggcatattaattaggccaactgctgatggtagggtagatatctgtatggctgatatgaatgatttta

SEQ ID NO: 308765 - DNA, 75 bp, Artificial Sequence
  Synthetic
ccgcagatataggagattttttccattattcacaaatgtcatattacttcaaaataccagctggagtacatccag

SEQ ID NO: 308766 - DNA, 75 bp, Artificial Sequence
  Synthetic
aactgctgatggtagggtagatatctgtatggctgatatgaatgattttaatagtgatagttttaattgggaagc

SEQ ID NO: 308767 - DNA, 75 bp, Artificial Sequence
  Synthetic
caacagtttactgatcaagtggcattaaattcgatgaggtttgtctttaaagtgacagaaacgaacggttggttc

SEQ ID NO: 308768 - DNA, 75 bp, Artificial Sequence
  Synthetic
atatcgcaaatgttgatccatataaccaactaaaagcattaaatcagcttactgtaaaaaatgtagaactcagga

SEQ ID NO: 308769 - DNA, 75 bp, Artificial Sequence
  Synthetic
taaattcgatgaggtttgtctttaaagtgacagaaacgaacggttggttcatgacatcaggcaaaataggtacaa

SEQ ID NO: 308770 - DNA, 75 bp, Artificial Sequence
  Synthetic
ccaactaaaagcattaaatcagcttactgtaaaaaatgtagaactcaggatgatgaaatcaattagacagcaagg

SEQ ID NO: 308771 - DNA, 75 bp, Artificial Sequence
  Synthetic
cgaactgttggaaacatttcgttcatatctctaataccgagtaatccaaattatcaaactccaatagcatcatca

SEQ ID NO: 308772 - DNA, 75 bp, Artificial Sequence
  Synthetic
tgagatatgctagagacataacattaaaatgtaaaatagaatcagagatcattaaaggtggtggttggggatatg

SEQ ID NO: 308773 - DNA, 75 bp, Artificial Sequence
  Synthetic
tatctctaataccgagtaatccaaattatcaaactccaatagcatcatcaagcacagttagaatggatttagaaa

SEQ ID NO: 308774 - DNA, 75 bp, Artificial Sequence
  Synthetic
gcattaagtgacattctatcattagcaacatcccctttaacatttgctaatttactagagtcggtaccagctatg

SEQ ID NO: 308775 - DNA, 75 bp, Artificial Sequence
  Synthetic
agatcaggtgaagaagtaaatgcgcatgtcacaataagtttcaataatatgaaagagagatcgtatggtgggtca

SEQ ID NO: 308776 - DNA, 75 bp, Artificial Sequence
  Synthetic
caacatcccctttaacatttgctaatttactagagtcggtaccagctatggcttcatcagttaaagatgtggctg

SEQ ID NO: 308777 - DNA, 75 bp, Artificial Sequence
  Synthetic
gattcagatatatttaaaaatatggtatatgtacgtgatttgagggctaatatgggtgattttttctattactca

SEQ ID NO: 308778 - DNA, 75 bp, Artificial Sequence
  Synthetic
aagccgaaatataaagaatttattattggagatttattagaagatgtgactaatgtgacaaggaattcaaattca

SEQ ID NO: 308779 - DNA, 75 bp, Artificial Sequence
  Synthetic
tatgggtgattttttctattactcagaaatgtggcatcggtttcagattccagtcggcacatatccaggattaca

SEQ ID NO: 308780 - DNA, 75 bp, Artificial Sequence
  Synthetic
ttggagatttattagaagatgtgactaatgtgacaaggaattcaaattcaatgaattttgatgacataacatcag

SEQ ID NO: 308781 - DNA, 75 bp, Artificial Sequence
  Synthetic
gaaatgtggcatcggtttcagattccagtcggcacatatccaggattacattcgtctggagtacagtttacatat

SEQ ID NO: 308782 - DNA, 75 bp, Artificial Sequence
  Synthetic
ctctcggaaattgtagcgagatcagctgacaacttcatatcaaatagatcatatagagtaatagataatggtata

SEQ ID NO: 308783 - DNA, 75 bp, Artificial Sequence
  Synthetic
ctgacaacttcatatcaaatagatcatatagagtaatagataatggtatagcacatgagataacacgtggtggaa

SEQ ID NO: 308784 - DNA, 75 bp, Artificial Sequence
  Synthetic
gatgagattcatatttaaagtaacatcatcgaatggttggtacataacgtctggaggaccgaatactagaagagt

SEQ ID NO: 308785 - DNA, 75 bp, Artificial Sequence
  Synthetic
aaatttttgcagttagcgtcaaaatcaccagtaatatcagctatagttgattttgctacattgaaggcaatgaga

SEQ ID NO: 308786 - DNA, 75 bp, Artificial Sequence
  Synthetic
ttggaaatatttcatttatatcactgattccaagtaatccaaactaccagactccaattgcgtcatcaagtacag

SEQ ID NO: 308787 - DNA, 75 bp, Artificial Sequence
  Synthetic
tgctccgacaattctatcatttattaataataacaatccattaataaaaggaagaatcgaagaactattaagaca

SEQ ID NO: 308788 - DNA, 75 bp, Artificial Sequence
  Synthetic
aataataacaatccattaataaaaggaagaatcgaagaactattaagacaatgtagaatctaataagtgaggaga

SEQ ID NO: 308789 - DNA, 75 bp, Artificial Sequence
  Synthetic
tatgaaaaaattcaggaacacaaaaatgtttaaaagagcaaccaaaacaaagtataaagaatacataattggaga

SEQ ID NO: 308790 - DNA, 75 bp, Artificial Sequence
  Synthetic
acacgagatgcaaataaaatgaattttgatgacattacttcagccatgatggtttcaactacaaataaattacaa

SEQ ID NO: 308791 - DNA, 75 bp, Artificial Sequence
  Synthetic
atgatagagaatggaatagtgcatgaagcaacgccaactagagtgttctcctatgacttaaaaacattacaacaa

SEQ ID NO: 308792 - DNA, 75 bp, Artificial Sequence
  Synthetic
catatctgccataattgatttcgctacactaaaagcaatgagagatacatatggagttagtacagatataatgta

SEQ ID NO: 308793 - DNA, 75 bp, Artificial Sequence
  Synthetic
acaatccattgatacgaaacagaatagagggattactaaggcaatgcagaatataaatagtgaggagatcgactt

SEQ ID NO: 308794 - DNA, 75 bp, Artificial Sequence
  Synthetic
gtaatacttgtcaaattgcagcatttgattccaccctggctgaaaatgcaccaaacaatacacaacgtttcgtat

SEQ ID NO: 308795 - DNA, 75 bp, Artificial Sequence
  Synthetic
gtgggattgggacacagcctcaaaaagaatggaatttccaacttcctcaactaggaacaactctactaaatttag

SEQ ID NO: 308796 - DNA, 75 bp, Artificial Sequence
  Synthetic
atgataattatgttcaagcagctagaggtgtgattgattacttagcatcatttatagaagctgtgtgtgatgatg

SEQ ID NO: 308797 - DNA, 75 bp, Artificial Sequence
  Synthetic
gtgattctcactcagttgaatattcaatagtggcaaacgttagaagagattcagcgatgccagctggaactgttt

SEQ ID NO: 308798 - DNA, 75 bp, Artificial Sequence
  Synthetic
ttaagaccatcaattttaataatagttctcaatctattaaaaattggagtgctcagtctagacgtgaaaatcctg

SEQ ID NO: 308799 - DNA, 75 bp, Artificial Sequence
  Synthetic
cttcaacgagctgatccacaatatggaaatgtcatgggagtaaggtattatacagctggtaacacatgtcaactt

SEQ ID NO: 308800 - DNA, 75 bp, Artificial Sequence
  Synthetic
tcacaaaattactattctctaggaaatgaaattttatctgatcaacaaactaataaagtgatatcagactatgtg

SEQ ID NO: 308801 - DNA, 75 bp, Artificial Sequence
  Synthetic
atgaaattttatctgatcaacaaactaataaagtgatatcagactatgtggatgcaggaaactacacttatgctc

SEQ ID NO: 308802 - DNA, 75 bp, Artificial Sequence
  Synthetic
aaaatgcacaaaataatacgcaacgtttcatttataatgggagacttaagagaccaatttctaatgttctgatga

SEQ ID NO: 308803 - DNA, 75 bp, Artificial Sequence
  Synthetic
tgggtcaatacttaaatcagcattctctacacctgaaataactggaccacatacgaatacagtaattgaatggag

SEQ ID NO: 308804 - DNA, 75 bp, Artificial Sequence
  Synthetic
cagttagattattaaagcatggtccagacacttataacagcaatctagcagcatttgaactatggtatggaaaat

SEQ ID NO: 308805 - DNA, 75 bp, Artificial Sequence
  Synthetic
acaatccagtgcagataatgaatggagcatttacaattgaattttataataatggtcaactagttgatatgatca

SEQ ID NO: 308806 - DNA, 75 bp, Artificial Sequence
  Synthetic
gcatttgaactatggtatggaaaatctggaactactatagcatccgtatattataacactatcactaatcagaat

SEQ ID NO: 308807 - DNA, 75 bp, Artificial Sequence
  Synthetic
gtagatataataagaccagcagctatgacacaatatgtccaaagactttttccacaaggcggaccatacccttat

SEQ ID NO: 308808 - DNA, 75 bp, Artificial Sequence
  Synthetic
ggaatggaaaattttaataatgattcatttaattgggagaattggaatcacgagtttccaagaagtaatcctggt

SEQ ID NO: 308809 - DNA, 75 bp, Artificial Sequence
  Synthetic
gactactcaattgttgctaatgttagaagagattcagcaatgccagctggaacagtatttcagccaggttttcca

SEQ ID NO: 308810 - DNA, 75 bp, Artificial Sequence
  Synthetic
aggatcaatggcgtcctcactatataagcaactaatctcacagaattactattcaactggaaatgatattttact

SEQ ID NO: 308811 - DNA, 75 bp, Artificial Sequence
  Synthetic
attcaactggaaatgatattttactggatcagcaaacaaataaaacaactgttgattatgtagatgtaggaaatt

SEQ ID NO: 308812 - DNA, 75 bp, Artificial Sequence
  Synthetic
ggatcagcaaacaaataaaacaactgttgattatgtagatgtaggaaattatgcatacacgcaattaccaccaac

SEQ ID NO: 308813 - DNA, 75 bp, Artificial Sequence
  Synthetic
ttacaggaccgaatacaggtgatatagatttaaacaatttgacaaatgcaaatggctggatattatatgataaac

SEQ ID NO: 308814 - DNA, 75 bp, Artificial Sequence
  Synthetic
aatggctggatattatatgataaaccaactaatacgaaacggttgttaaaattgggacctgacagctatgatagt

SEQ ID NO: 308815 - DNA, 75 bp, Artificial Sequence
  Synthetic
aactctgaaaatactgtaacagtacaatatgattcactagtattgttctttaatgttggttatactggtttaact

SEQ ID NO: 308816 - DNA, 75 bp, Artificial Sequence
  Synthetic
aactgctgatggtagagtggatatttgtatggctgacatgaatgattttaatagcaatagttttaattgggaaat

SEQ ID NO: 308817 - DNA, 75 bp, Artificial Sequence
  Synthetic
tgtatggctgacatgaatgattttaatagcaatagttttaattgggaaatctggaagcgtagttttccacgtagt

SEQ ID NO: 308818 - DNA, 75 bp, Artificial Sequence
  Synthetic
tcaactaaaggcgctaagtcagctcactgtaaaaaacatagaacttagaatgatgagattaattaaacaacaagg

SEQ ID NO: 308819 - DNA, 75 bp, Artificial Sequence
  Synthetic
tagtgacattacttcggccatgatggtttcaactactaacagattacaaattactgatgtagatactttctcaga

SEQ ID NO: 308820 - DNA, 75 bp, Artificial Sequence
  Synthetic
agatcaggtgaagaagtaaccgcacatgtcacgataagttttaacaatatgaaagagagatcgtacggcgggtca

SEQ ID NO: 308821 - DNA, 75 bp, Artificial Sequence
  Synthetic
taaactagcttctcaatctcccgttatatctgcaatagttgattttgctactataaaagcaatacgtgatactta

SEQ ID NO: 308822 - DNA, 75 bp, Artificial Sequence
  Synthetic
tatatgtacgtgatctgagggctaatatgggtgattttttctactactcagaaatgtggcatcgatttcagattc

SEQ ID NO: 308823 - DNA, 75 bp, Artificial Sequence
  Synthetic
gaaaagtgtttgttgtctcaacaatttaccgatatggttgcactaaattcaatgagatttatattcaaagtaaca

SEQ ID NO: 308824 - DNA, 75 bp, Artificial Sequence
  Synthetic
ttaccgatatggttgcactaaattcaatgagatttatattcaaagtaacatcatcaaatggttggtatataacgt

SEQ ID NO: 308825 - DNA, 75 bp, Artificial Sequence
  Synthetic
tctaatggtcatgtttctgaaactgttggaaatatttcattcatatcattaattccaagtaatccaaattatcaa

SEQ ID NO: 308826 - DNA, 75 bp, Artificial Sequence
  Synthetic
ttggaaatatttcattcatatcattaattccaagtaatccaaattatcaaactccaatcgcatcatcgagcacag

SEQ ID NO: 308827 - DNA, 75 bp, Artificial Sequence
  Synthetic
caattagctagttcagttgcactaggagatataatgtcattggccatgtcacctctaacgtttgctaatttgctt

SEQ ID NO: 308828 - DNA, 75 bp, Artificial Sequence
  Synthetic
gagatataatgtcattggccatgtcacctctaacgtttgctaatttgcttgagtcggtgccagctattacatcat

SEQ ID NO: 308829 - DNA, 75 bp, Artificial Sequence
  Synthetic
atgtttaaaagggcaactaaaacaaagtacaaagaatacattattggagatttgttagaagacgtaacgaatgta

SEQ ID NO: 308830 - DNA, 75 bp, Artificial Sequence
  Synthetic
agtacaaagaatacattattggagatttgttagaagacgtaacgaatgtaacacgagacatgaataaaatgaact

SEQ ID NO: 308831 - DNA, 75 bp, Artificial Sequence
  Synthetic
ctaacagatattgataccctttcagagatagttgttaggtctgcagatgattttatacctaacagatcgtatagg

SEQ ID NO: 308832 - DNA, 75 bp, Artificial Sequence
  Synthetic
tttcaacatcatcaagttttgataattcgttatcaccattaaataacggccaaactacaagatcgtttaaaataa

SEQ ID NO: 308833 - DNA, 75 bp, Artificial Sequence
  Synthetic
agatagttgttaggtctgcagatgattttatacctaacagatcgtataggatcgtagaaaatggaatagtacatg

SEQ ID NO: 308834 - DNA, 75 bp, Artificial Sequence
  Synthetic
acagattttgatatggataaattcatgcagttagcttcagaatcaccagttatatcagccataattgactttgct

SEQ ID NO: 308835 - DNA, 75 bp, Artificial Sequence
  Synthetic
tatatcagccataattgactttgctacgctaaaagcaatgaaagacacatatggagttagtacagatataatgta

SEQ ID NO: 308836 - DNA, 75 bp, Artificial Sequence
  Synthetic
actgtttgcgtagttctctgcattctttttgtttatatgatgtttttcagaaagatgttccaccttatagcagac

SEQ ID NO: 308837 - DNA, 75 bp, Artificial Sequence
  Synthetic
tttttgtttatatgatgtttttcagaaagatgttccaccttatagcagacacactaatcgtgacaatcgtcatat

SEQ ID NO: 308838 - DNA, 75 bp, Artificial Sequence
  Synthetic
gataagaaatagaatagagggattactaaggcaatgtaggatataaatagtgaggagatcgacttattatgtggc

SEQ ID NO: 308839 - DNA, 75 bp, Artificial Sequence
  Synthetic
tataatggaaatgttgaaacggtagtaaacgctacagatccttttgacgttaaatctttatgtatagattttcca

SEQ ID NO: 308840 - DNA, 75 bp, Artificial Sequence
  Synthetic
taaacgctacagatccttttgacgttaaatctttatgtatagattttccaaatgcggttgtgggctctcagggtc

SEQ ID NO: 308841 - DNA, 75 bp, Artificial Sequence
  Synthetic
ggtttgtacaacattgtacactgtttacgtagttctctgcatcttgttaatatacacactgtttttaagaaagat

SEQ ID NO: 308842 - DNA, 75 bp, Artificial Sequence
  Synthetic
gcagcattgtttgaaacaaaaggctttccaagaggatcaattgtgttgatgacatatacaaaagtttcagatttt

SEQ ID NO: 308843 - DNA, 75 bp, Artificial Sequence
  Synthetic
gcgctgggtggactaacggtcagttgtttactaatgacatttcatacgacggaaacattgaaggtgtgattaaca

SEQ ID NO: 308844 - DNA, 75 bp, Artificial Sequence
  Synthetic
gacatatacaaaagtttcagattttatagattcagtggagatgacatgtgcatataatatagtcataatacctga

SEQ ID NO: 308845 - DNA, 75 bp, Artificial Sequence
  Synthetic
gtttactaatgacatttcatacgacggaaacattgaaggtgtgattaacatgacaaatccatttgatgttgaatc

SEQ ID NO: 308846 - DNA, 75 bp, Artificial Sequence
  Synthetic
aagatgatggtttactaaatgataacagttatgcacaaacgttagcgacattatttgaaacaaagggatttccaa

SEQ ID NO: 308847 - DNA, 75 bp, Artificial Sequence
  Synthetic
atgtttggaggtgtgatgatatgaatttagatatctatacttatgaacagactggaatagataatctatgggctg

SEQ ID NO: 308848 - DNA, 75 bp, Artificial Sequence
  Synthetic
tttagatatctatacttatgaacagactggaatagataatctatgggctgcttttggtagtgattgtgacatatc

SEQ ID NO: 308849 - DNA, 75 bp, Artificial Sequence
  Synthetic
cagttatgcacaaacgttagcgacattatttgaaacaaagggatttccaaaaggatcagtaattttaaaaactta

SEQ ID NO: 308850 - DNA, 75 bp, Artificial Sequence
  Synthetic
atttagttattattccagatgaacctaataattctgaatcaattgagcagatagctgaatggattatgaatgttt

SEQ ID NO: 308851 - DNA, 75 bp, Artificial Sequence
  Synthetic
gcacagaaacatatgaagtattgtcaaataatactcaattagcattgctcaatgtagtagataatataaaacatc

SEQ ID NO: 308852 - DNA, 75 bp, Artificial Sequence
  Synthetic
taataattctgaatcaattgagcagatagctgaatggattatgaatgtttggcaatgtgatgatatgaatttaga

SEQ ID NO: 308853 - DNA, 75 bp, Artificial Sequence
  Synthetic
aatgtagtagataatataaaacatcgtattcagatgaatacagctagttgtaagttgaagaattgcattaaaggt

SEQ ID NO: 308854 - DNA, 75 bp, Artificial Sequence
  Synthetic
gtgaagattgtgatatatctgtttgtccattggatacaacaatgaatggaattggttgctcaccagccagcacag

SEQ ID NO: 308855 - DNA, 75 bp, Artificial Sequence
  Synthetic
tccattggatacaacaatgaatggaattggttgctcaccagccagcacagagacatatgaggtagtgtcaaataa

SEQ ID NO: 308856 - DNA, 75 bp, Artificial Sequence
  Synthetic
tgataattcattgtcaccattaaatgatggacaaacaacacgaacatttaaaataaatgcaaagaaatggtggac

SEQ ID NO: 308857 - DNA, 75 bp, Artificial Sequence
  Synthetic
aaatgtcttcaaccttgaatcatcttcagtgtaaattaaaaaactgcattaaaggtgaatcacgattgaatactg

SEQ ID NO: 308858 - DNA, 75 bp, Artificial Sequence
  Synthetic
atcaatacaattgtacaaactatggctccaaggcatcgggccatttatcctgaagggtggatgttgagatacgcg

SEQ ID NO: 308859 - DNA, 75 bp, Artificial Sequence
  Synthetic
tagttttgataattcattatcacctttaaatcatggacaaacgacacgatcgtttagaattaatgcaaaaaaatg

SEQ ID NO: 308860 - DNA, 75 bp, Artificial Sequence
  Synthetic
agttgcggatctgttggctgaagtattgaatatggtatctatgcccaccgagaaattctcttttgatttggtgaa

SEQ ID NO: 308861 - DNA, 75 bp, Artificial Sequence
  Synthetic
ttcgcccttgcatttaaaatctcattcacaatggatgtgctttttttcattgctaagactgtgtcagatctcata

SEQ ID NO: 308862 - DNA, 75 bp, Artificial Sequence
  Synthetic
tgctaagactgtgtcagatctcataaagaaagttgtagttggtacaatttatactaatgtggaggatattattca

SEQ ID NO: 308863 - DNA, 75 bp, Artificial Sequence
  Synthetic
aagaaagttgtagttggtacaatttatactaatgtggaggatattattcaacagacaaatgaactaattagaaca

SEQ ID NO: 308864 - DNA, 75 bp, Artificial Sequence
  Synthetic
atactgatgacattttgaatgggaatgttaaaatgaaagtaaaagctgttatgattgcgtgtaatttggtaaatg

SEQ ID NO: 308865 - DNA, 75 bp, Artificial Sequence
  Synthetic
agaatggacttttcagttaccacagttaggcacaactttgcttaatttggatgataattatgttcaagcaactag

SEQ ID NO: 308866 - DNA, 75 bp, Artificial Sequence
  Synthetic
ttaggcacaactttgcttaatttggatgataattatgttcaagcaactagaagtataattgattatctagcttca

SEQ ID NO: 308867 - DNA, 75 bp, Artificial Sequence
  Synthetic
tggaatgcagcctcaatctccgacacttattgcactatcctcttcgaaatttaaaactatcaactttaataacag

SEQ ID NO: 308868 - DNA, 75 bp, Artificial Sequence
  Synthetic
cttattgcactatcctcttcgaaatttaaaactatcaactttaataacagttctcagtccattaaaaattggagt

SEQ ID NO: 308869 - DNA, 75 bp, Artificial Sequence
  Synthetic
gaaatgttatgggactaagatattatacttctagcaatacatgccagattgcagcttttgattcaacgttcgctg

SEQ ID NO: 308870 - DNA, 75 bp, Artificial Sequence
  Synthetic
aagtgatttgatctctatggtgggaaattgagaatgtaatgagtgaaggttacaagcaacaggaatagcagctgt

SEQ ID NO: 308871 - DNA, 75 bp, Artificial Sequence
  Synthetic
cagttgaggacaaatcgttcaagatgataagcagaaatagacgtaaaaatgctcaacaaaagatagtagaaagag

SEQ ID NO: 308872 - DNA, 75 bp, Artificial Sequence
  Synthetic
agattgaagctggtgctccaaatattagtaatacaactgttttacctgatccaacaaatcaaacaacatggttat

SEQ ID NO: 308873 - DNA, 75 bp, Artificial Sequence
  Synthetic
aagagaaagtagaagatgttaataaaaatgagacgaaagaattaaataatgacgaaaaacaagtcattacagagg

SEQ ID NO: 308874 - DNA, 75 bp, Artificial Sequence
  Synthetic
aatggccaattagtggatatggttaggaatatgggagtggtaaccgttagaacatttgattcatatagaatcaca

SEQ ID NO: 308875 - DNA, 75 bp, Artificial Sequence
  Synthetic
ggaatatgggagtggtaaccgttagaacatttgattcatatagaatcacagttgatatgatcagaccagcagcta

SEQ ID NO: 308876 - DNA, 75 bp, Artificial Sequence
  Synthetic
caagctgcatatatgttatcattaagtatattggatgttacaacagagtccgttttatgtgattcacattccatc

SEQ ID NO: 308877 - DNA, 75 bp, Artificial Sequence
  Synthetic
gattattcaattgttgcaaatgttagaagggattcagctatgccagcgggaactgttttccaaccagggtttcca

SEQ ID NO: 308878 - DNA, 75 bp, Artificial Sequence
  Synthetic
gattattcagttagacaattctttctatcactatacctaaacgtgttagaggagatgcctgactatgttatgctt

SEQ ID NO: 308879 - DNA, 75 bp, Artificial Sequence
  Synthetic
aaatctgcattcagtgcagaggaaattacaggaccaaatacaggtgatatagatttaaataatttaacaaatgca

SEQ ID NO: 308880 - DNA, 75 bp, Artificial Sequence
  Synthetic
actaggacctaacagttatgatagcatatatgcagcattcgaattatggtatggcaaagcaaatactgtaattga

SEQ ID NO: 308881 - DNA, 75 bp, Artificial Sequence
  Synthetic
atatatgcagcattcgaattatggtatggcaaagcaaatactgtaattgaatcggtatattatgcatcagcacaa

SEQ ID NO: 308882 - DNA, 75 bp, Artificial Sequence
  Synthetic
taatgttggttataccggtttaactaagcaaatagttaaatttaactggaatatgggaggtatattggtcagacc

SEQ ID NO: 308883 - DNA, 75 bp, Artificial Sequence
  Synthetic
aagcaaatagttaaatttaactggaatatgggaggtatattggtcagaccaactgctgatggtagagtagatatc

SEQ ID NO: 308884 - DNA, 75 bp, Artificial Sequence
  Synthetic
ctggaaacgtagttttccacgtagcaatatcaatatgtacactgaatattatttagcaaatgttgacccgtatag

SEQ ID NO: 308885 - DNA, 75 bp, Artificial Sequence
  Synthetic
tgatgagactgattaagcaacaagggtcaattaatgttgatgaggttgtaagtaaagactcattgtggcaggaaa

SEQ ID NO: 308886 - DNA, 75 bp, Artificial Sequence
  Synthetic
attaagggtggtggttggggatacgattatactagtattacttttaagactgttaattatgtttataaatatact

SEQ ID NO: 308887 - DNA, 75 bp, Artificial Sequence
  Synthetic
aagaataataaacttgttttctacaatgcttgtagctctgtcttcacaaccgtttgctacttatccgcttgacta

SEQ ID NO: 308888 - DNA, 75 bp, Artificial Sequence
  Synthetic
caactactttcaaatagaaccgcacagatagcagatttaactaggttgattgcttataattacaccacattgtca

SEQ ID NO: 308889 - DNA, 75 bp, Artificial Sequence
  Synthetic
tatatgtacgtgacttgagagctaatatgggtgattttttctattactcagagatgtggcatcggtttcagattc

SEQ ID NO: 308890 - DNA, 75 bp, Artificial Sequence
  Synthetic
gaaaagtgtttgttatctcaacaatatactgatatggttgcgctgaattcaatgagattcatattcaaagtaaca

SEQ ID NO: 308891 - DNA, 75 bp, Artificial Sequence
  Synthetic
aatttcttaacaaattataatgaacagattgataatgtagtggcagaaataatggcagcttatagactcgatctg

SEQ ID NO: 308892 - DNA, 75 bp, Artificial Sequence
  Synthetic
atactgatatggttgcgctgaattcaatgagattcatattcaaagtaacatcatcaaatggttggtacataacgt

SEQ ID NO: 308893 - DNA, 75 bp, Artificial Sequence
  Synthetic
tctaatggttatgtttctgaaaccgttggaaatatttcattcgtatcactgattccaagtaatccaaattatcaa

SEQ ID NO: 308894 - DNA, 75 bp, Artificial Sequence
  Synthetic
ttggaaatatttcattcgtatcactgattccaagtaatccaaattatcaaactccaattgcatcatcaagtacag

SEQ ID NO: 308895 - DNA, 75 bp, Artificial Sequence
  Synthetic
tcaaggtgtactactatcttatacaccaatgccgctgacatacgtagaagacgtaggccttacaaatgtagttaa

SEQ ID NO: 308896 - DNA, 75 bp, Artificial Sequence
  Synthetic
acacgagatgtaaataaaatgaactttgatgacattacctcagctatgatggtttcaactacaaataaattgcaa

SEQ ID NO: 308897 - DNA, 75 bp, Artificial Sequence
  Synthetic
ttttatacctaatagatcatatagaatgatagagaatggaatagtgcatgaagcaacgccaactagagtgttctc

SEQ ID NO: 308898 - DNA, 75 bp, Artificial Sequence
  Synthetic
atgatagagaatggaatagtgcatgaagcaacgccaactagagtgttctcatatgacctaaaaacattacagcaa

SEQ ID NO: 308899 - DNA, 75 bp, Artificial Sequence
  Synthetic
tatatcagccataattgattttgctacgctaaaagcaatgagagacacatatggagttagtacagacataatgta

SEQ ID NO: 308900 - DNA, 75 bp, Artificial Sequence
  Synthetic
ataatccgttgataaaaaatagaatagagggattgttaaggcaatgtagaatataaatagtgaggagatcgactt

SEQ ID NO: 308901 - DNA, 75 bp, Artificial Sequence
  Synthetic
ggtttgtacaactttgtacactgtttgcgcaattctttgcatcttgttaatatatacattatttctcagaaagat

SEQ ID NO: 308902 - DNA, 75 bp, Artificial Sequence
  Synthetic
tatatacattatttctcagaaagatgttccatctgttaactgatgcactagttgttattctaatcatatctacat

SEQ ID NO: 308903 - DNA, 75 bp, Artificial Sequence
  Synthetic
atgatgataacacaaaatggagaatgagcgagtcaattcgtcgagaaaagaagaatgagatgaaagcacatgcag

SEQ ID NO: 308904 - DNA, 75 bp, Artificial Sequence
  Synthetic
gattcatcttttgattgacatgtcacttattgctttcgtgatatcaagttgcatcggactgtctaatgctcagtt

SEQ ID NO: 308905 - DNA, 75 bp, Artificial Sequence
  Synthetic
tcagtagaaatgacatgttcatataatttagtcatcattcctgatgaaccaaaaaattcagaagcaatcgaacag

SEQ ID NO: 308906 - DNA, 75 bp, Artificial Sequence
  Synthetic
catttatacctatgaacaaataaataaagataatctgtgggcagcattcggtgaagattgtgatgtatctgtttg

SEQ ID NO: 308907 - DNA, 75 bp, Artificial Sequence
  Synthetic
agacatacgaagtagtatctaacgatactcaattggcacttattgacgtggttaacgacgtaaaacatagaattc

SEQ ID NO: 308908 - DNA, 75 bp, Artificial Sequence
  Synthetic
cgactaaacactgcaattataagaatttctacatcatcaagtttcgataattcattatcacctctaaataatgga

SEQ ID NO: 308909 - DNA, 75 bp, Artificial Sequence
  Synthetic
gtgaagattgtgatgttgcggtatgtccactggacaccacaatgaatggtatcggatgtacaccagcaagtactg

SEQ ID NO: 308910 - DNA, 75 bp, Artificial Sequence
  Synthetic
gtagataatgtgaaacataggatacaactgaatcaagttacgtgcaaattgagaaattgtgtgaaaggtgaagcg

SEQ ID NO: 308911 - DNA, 75 bp, Artificial Sequence
  Synthetic
ggtttgtacgacattgtacactgtttgcgtaattctctgcattctttttatttacatgctattttttagaaagat

SEQ ID NO: 308912 - DNA, 75 bp, Artificial Sequence
  Synthetic
gagaaattgtgtgaaaggtgaagcgagacttaacacagcgattgtgagaatctcaaactcgtctagttttgataa

SEQ ID NO: 308913 - DNA, 75 bp, Artificial Sequence
  Synthetic
gtgttggatggtcacaaggtcaaatgttcactgatgatatatattataatggaaatgttgaaacgatagtaaatg

SEQ ID NO: 308914 - DNA, 75 bp, Artificial Sequence
  Synthetic
ctatgacacctaggcacagagccatttatcctgagggatggatgctgagatatgcgtaaacgagattatgtggct

SEQ ID NO: 308915 - DNA, 75 bp, Artificial Sequence
  Synthetic
gttgtaggatctcaaggtccaggtaagacagatggatatctaaatgatggtaattacgctcaaactatcgcagca

SEQ ID NO: 308916 - DNA, 75 bp, Artificial Sequence
  Synthetic
cacaaaagtctcagattttatagattcagtagagatgacatgttcatataatatagttataatacctgatagcgc

SEQ ID NO: 308917 - DNA, 75 bp, Artificial Sequence
  Synthetic
tatttatacttatgaacagactgggatagataatctatgggctgcttttggtaacgattgtgacatatccgtctg

SEQ ID NO: 308918 - DNA, 75 bp, Artificial Sequence
  Synthetic
aaacatacgaagtattatcaaatgatactcaactggcattgcttaatgttgtagataatgtaaaacatcgcattc

SEQ ID NO: 308919 - DNA, 75 bp, Artificial Sequence
  Synthetic
gaagaattgtatcaaaggtgaagctagattgaatactgcactcatcagaatctctacgtcatcaagcttcgataa

SEQ ID NO: 308920 - DNA, 75 bp, Artificial Sequence
  Synthetic
atgcaaagaaatggtggactatattttacactataattgattacattaatacaattatacaaactatggctccga

SEQ ID NO: 308921 - DNA, 75 bp, Artificial Sequence
  Synthetic
acaattatacaaactatggctccgaggcatcgagccatctatccagaagggtggatgttgagatacgcgtaaaca

SEQ ID NO: 308922 - DNA, 75 bp, Artificial Sequence
  Synthetic
atttaagaaagagattgaagaatatatcgaaaatggtaagagaataacactaaattcaattctaccggaagagca

SEQ ID NO: 308923 - DNA, 75 bp, Artificial Sequence
  Synthetic
ggacacagcctcagaaagaatggacttttcaactgccacaactaggtacaactttgcttaatttagatgataatt

SEQ ID NO: 308924 - DNA, 75 bp, Artificial Sequence
  Synthetic
ttttcaactgccacaactaggtacaactttgcttaatttagatgataattatgttcaagcaaccaggagtataat

SEQ ID NO: 308925 - DNA, 75 bp, Artificial Sequence
  Synthetic
ttgatatggcactgcttaaaatcagatctcaaagtatgggcgtgctgtgatcctctatgtcctgtgtctgatcgc

SEQ ID NO: 308926 - DNA, 75 bp, Artificial Sequence
  Synthetic
ctatcttcttcgaaatttaaaactatcaacttcaataacagctctcagtctatcaagaattggagtgctcaatca

SEQ ID NO: 308927 - DNA, 75 bp, Artificial Sequence
  Synthetic
atgaaatggatgatggatagtcatgatggaataagtgtaaatggaggtctgaatttttcaaaatcaaaaaataaa

SEQ ID NO: 308928 - DNA, 75 bp, Artificial Sequence
  Synthetic
cgtttcagcaggaatcaattcacaattggggatgttcaacccaattcagcacaaagtaaagaaagaggctatacc

SEQ ID NO: 308929 - DNA, 75 bp, Artificial Sequence
  Synthetic
agagatgtttgaagatgaagatgtagatgaatgtacttgtagaagttgtccatataaagaaaaatatctaaaact

SEQ ID NO: 308930 - DNA, 75 bp, Artificial Sequence
  Synthetic
tgtagtcgagtacttgcccgtactgcatcaggtgactggaatcggcattgaggggatccccaacccgatctgtgg

SEQ ID NO: 308931 - DNA, 75 bp, Artificial Sequence
  Synthetic
atgttcaaagaatgttcccacaaggtggtccttatgcttatcaagctgcatatatgttaacattaagtatactag

SEQ ID NO: 308932 - DNA, 75 bp, Artificial Sequence
  Synthetic
tggtccttatgcttatcaagctgcatatatgttaacattaagtatactagatgctacaacagaatccgttttatg

SEQ ID NO: 308933 - DNA, 75 bp, Artificial Sequence
  Synthetic
agtacgttccatactggtggtattggcacgcagcctcaaaaagactgggttgttcaacttcctcaactaggcacg

SEQ ID NO: 308934 - DNA, 75 bp, Artificial Sequence
  Synthetic
tgattatctggcctcatttattgaagctgtatgtgatgatgaaatggttagagaagcatcaagaaatggaatgca

SEQ ID NO: 308935 - DNA, 75 bp, Artificial Sequence
  Synthetic
taaatttcaataatagttctcagtctatcaaaaattggagcgctcaatctagacgtgaaaatccagtttatgaat

SEQ ID NO: 308936 - DNA, 75 bp, Artificial Sequence
  Synthetic
tccgaatacaagacgtatagcatcaggaacggggtttgcttattcagatggacatacgtcaagaactgttggaac

SEQ ID NO: 308937 - DNA, 75 bp, Artificial Sequence
  Synthetic
attctaatactatgaattttgacgacattacgtcagcagtcatgatttcaactactaataaattacaattaacgg

SEQ ID NO: 308938 - DNA, 75 bp, Artificial Sequence
  Synthetic
atgccacgacagaatctgttttgtgcgattctcattcagtcgattattcgatagttgccaatacgagaagggatt

SEQ ID NO: 308939 - DNA, 75 bp, Artificial Sequence
  Synthetic
aagaggataatttggaaagattgttgctagttgcatccgtgaagagaatggtgatgtagataagctagagatcta

SEQ ID NO: 308940 - DNA, 75 bp, Artificial Sequence
  Synthetic
attcatgatggagaaaaaatatcacagagtaaaattgattcagcggaaaaaatattgttgtctaaagtgccagat

SEQ ID NO: 308941 - DNA, 75 bp, Artificial Sequence
  Synthetic
agagtaaaattgattcagcggaaaaaatattgttgtctaaagtgccagataaagatcgatgcttaatttcaaaat

SEQ ID NO: 308942 - DNA, 75 bp, Artificial Sequence
  Synthetic
atatatgttaacgttaagtatattagatgctaccacagagtccgttctatgtgattctcattcagtagaatattc

SEQ ID NO: 308943 - DNA, 75 bp, Artificial Sequence
  Synthetic
atctacacagttagaaaaacaagtcgtaacattcaactggaatgtgggtggtatactaattaaaccaataaattc

SEQ ID NO: 308944 - DNA, 75 bp, Artificial Sequence
  Synthetic
tagatcacctgacccgttggtgtttccgaatatagctttaatatactcattcagttttcatgtaggatataggaa

SEQ ID NO: 308945 - DNA, 75 bp, Artificial Sequence
  Synthetic
ataaatgtttattatctcaacaatttactgattatgcagctttgaattcgttaagattcatattcagagtagttt

SEQ ID NO: 308946 - DNA, 75 bp, Artificial Sequence
  Synthetic
aggacagaaagtgaggtctaccaaaaagaatatgcatgtgattgatgacatgtataatgggaggtatacaacaga

SEQ ID NO: 308947 - DNA, 75 bp, Artificial Sequence
  Synthetic
atagctcaacattcatttgcagagataatgctacagcatgcaaaacatgagagagaatactctgaattttattcg

SEQ ID NO: 308948 - DNA, 75 bp, Artificial Sequence
  Synthetic
gagatgttactcgctatcttgactctaatagtatattatgctttactgatgtatcacaatgggatgcttctcaac

SEQ ID NO: 308949 - DNA, 75 bp, Artificial Sequence
  Synthetic
taatagtatattatgctttactgatgtatcacaatgggatgcttctcaacataacacgagagttctacgcaaatc

SEQ ID NO: 308950 - DNA, 75 bp, Artificial Sequence
  Synthetic
ataacacgagagttctacgcaaatctatagtacgtgctatggacagacttaagcaattgactcataatgaaaata

SEQ ID NO: 308951 - DNA, 75 bp, Artificial Sequence
  Synthetic
gctgtctgacaaactggtcttctttttaaatggtttgtacgacattgtacactgtttgcgcaattctctgcatct

SEQ ID NO: 308952 - DNA, 75 bp, Artificial Sequence
  Synthetic
actgtttgcgcaattctctgcatcttattgatatacacattgtttcttagaaagatgttccacctattaactgat

SEQ ID NO: 308953 - DNA, 75 bp, Artificial Sequence
  Synthetic
tattgatatacacattgtttcttagaaagatgttccacctattaactgatacattagttgttattctcattatat

SEQ ID NO: 308954 - DNA, 75 bp, Artificial Sequence
  Synthetic
tatgatgggaatattgaaggtgtaataaatgtgactaatccttttaatgttgaatcactatgcatttattttccg

SEQ ID NO: 308955 - DNA, 75 bp, Artificial Sequence
  Synthetic
taaatgtgactaatccttttaatgttgaatcactatgcatttattttccgaatgctgcaataggttcgccaggtc

SEQ ID NO: 308956 - DNA, 75 bp, Artificial Sequence
  Synthetic
gccacattatttgaaacaaaagggtttccaaaaggatcagtgatttttaaaacgtatactaaaacttcagatttt

SEQ ID NO: 308957 - DNA, 75 bp, Artificial Sequence
  Synthetic
ttccaaaaggatcagtgatttttaaaacgtatactaaaacttcagattttataagttcagtagaaatgacttgtt

SEQ ID NO: 308958 - DNA, 75 bp, Artificial Sequence
  Synthetic
aatgggattggctgttcaccagctagtactgaaacatatgaggtggtatctaacaatacccaactagcgcttatt

SEQ ID NO: 308959 - DNA, 75 bp, Artificial Sequence
  Synthetic
gtactgaaacatatgaggtggtatctaacaatacccaactagcgcttattgacgtagttgataatgtcaaatata

SEQ ID NO: 308960 - DNA, 75 bp, Artificial Sequence
  Synthetic
tcaggatcaatggcgtcctcactttaccgtcagctgatatcccagaactattattcaactggaaatgaaatacta

SEQ ID NO: 308961 - DNA, 75 bp, Artificial Sequence
  Synthetic
tgtattaaaggtgagtcgagattgaataccgcaatcataagaatttcaacatcatcaagttttgataattcacta

SEQ ID NO: 308962 - DNA, 75 bp, Artificial Sequence
  Synthetic
ttattcaactggaaatgaaatactactggatcagcaaacaaacaaaacaactgttgattatgtagatgctggaaa

SEQ ID NO: 308963 - DNA, 75 bp, Artificial Sequence
  Synthetic
ataccgcaatcataagaatttcaacatcatcaagttttgataattcactatcacctctaaataatggacagatga

SEQ ID NO: 308964 - DNA, 75 bp, Artificial Sequence
  Synthetic
atgaatctgcattcagcgcgccagagataactggaccatatacaaatgcagtcataaaattgagtgatctatcag

SEQ ID NO: 308965 - DNA, 75 bp, Artificial Sequence
  Synthetic
atagtcgattatattaacacgatcatacaaacaatgacgcctagacatcgggccatatatcctgaaggttggatg

SEQ ID NO: 308966 - DNA, 75 bp, Artificial Sequence
  Synthetic
gataactggaccatatacaaatgcagtcataaaattgagtgatctatcagattcaaacgtatggatattatatca

SEQ ID NO: 308967 - DNA, 75 bp, Artificial Sequence
  Synthetic
gttggaaccttgcagcgtttgagctatggtatggaaaggcaaatacaacggtgacatcagattactatgcaggga

SEQ ID NO: 308968 - DNA, 75 bp, Artificial Sequence
  Synthetic
acaaacgaatgagttaattagaacgctgaatggtaatacttttcatactggtggaattggaacacagccccagaa

SEQ ID NO: 308969 - DNA, 75 bp, Artificial Sequence
  Synthetic
tgacaaattctgaaaaaagtgttgaggtagatcatgattcactagtactattttggaatgaaggctcaacagcat

SEQ ID NO: 308970 - DNA, 75 bp, Artificial Sequence
  Synthetic
ctgaatggtaatacttttcatactggtggaattggaacacagccccagaaagaatggacttttcaactaccacag

SEQ ID NO: 308971 - DNA, 75 bp, Artificial Sequence
  Synthetic
ttcatagaagcagtgtgtgatgatgaaatagttagggaagcatctagaaatggaatgcaaccacagtctccagct

SEQ ID NO: 308972 - DNA, 75 bp, Artificial Sequence
  Synthetic
ccatacagtcaaataagagcatcacagcaaccaataataacaactgttgaaatgaagatggtgaaagttaagaga

SEQ ID NO: 308973 - DNA, 75 bp, Artificial Sequence
  Synthetic
gttcaatcaaggcgcgaaaatccagtctatgaatacagaaatccaatggtatttgaatacagaaattcatatatt

SEQ ID NO: 308974 - DNA, 75 bp, Artificial Sequence
  Synthetic
agcaaccaataataacaactgttgaaatgaagatggtgaaagttaagagagaaggatcaattaatgtagatgaag

SEQ ID NO: 308975 - DNA, 75 bp, Artificial Sequence
  Synthetic
acacttcaatgtaaaattgagtctgaagttgttaaaggtggtggatggggttatgactatactagcgtagccttt

SEQ ID NO: 308976 - DNA, 75 bp, Artificial Sequence
  Synthetic
tacttctggtaatacatgtcaaatcgcagcttttgattcaacgtttgctgagaacgcaccgaataatactcagcg

SEQ ID NO: 308977 - DNA, 75 bp, Artificial Sequence
  Synthetic
gcagcttttgattcaacgtttgctgagaacgcaccgaataatactcagcgtttcatctacaatggaagacttaaa

SEQ ID NO: 308978 - DNA, 75 bp, Artificial Sequence
  Synthetic
tgcgcacgttacaattagttttaacaatttgaaggaacgatcatatggagggtcattaccaactgatttcaaaat

SEQ ID NO: 308979 - DNA, 75 bp, Artificial Sequence
  Synthetic
taataacccaactgttttacctgatccaacaaatcagataacgtggttatttaatccagtacaagtgatgaatgg

SEQ ID NO: 308980 - DNA, 75 bp, Artificial Sequence
  Synthetic
ccaacaaatcagataacgtggttatttaatccagtacaagtgatgaatggaacttttagcattgaattctacaat

SEQ ID NO: 308981 - DNA, 75 bp, Artificial Sequence
  Synthetic
gacatttgattcatacagaattacagttgatgtgatcagaccagtagctatgactcaatatgttcagagattatt

SEQ ID NO: 308982 - DNA, 75 bp, Artificial Sequence
  Synthetic
tccacaaggtggtccttatacacatcaagctgcatatatgttatcattgagcatactggatgttacaacagagtc

SEQ ID NO: 308983 - DNA, 75 bp, Artificial Sequence
  Synthetic
gacagcaggaaatataaatgcaagacgtatagcgtctggaacaggatttgcatattcggatggttatgttactga

SEQ ID NO: 308984 - DNA, 75 bp, Artificial Sequence
  Synthetic
cgtatagcgtctggaacaggatttgcatattcggatggttatgttactgaaactgttgggacggtttcatttata

SEQ ID NO: 308985 - DNA, 75 bp, Artificial Sequence
  Synthetic
tgggaacaaactctatccaactacacagttgcacaggaagataatttagaaagactattgctagttgcatccgtg

SEQ ID NO: 308986 - DNA, 75 bp, Artificial Sequence
  Synthetic
tacagtgagaatggatttagaacggaaaattaatgatctacgtaatgattttaatgaattggctagctctgttgc

SEQ ID NO: 308987 - DNA, 75 bp, Artificial Sequence
  Synthetic
aggatcaatggcgtcctcactttatcagcaactaatctcacaaaattattattcaactggaaatgatatactact

SEQ ID NO: 308988 - DNA, 75 bp, Artificial Sequence
  Synthetic
atcatctgtgaaagatgttgcggcaaacgttatgaaaaaatttaaaacaacgaaaatgtttaaaaaagctgcaaa

SEQ ID NO: 308989 - DNA, 75 bp, Artificial Sequence
  Synthetic
attcaactggaaatgatatactactggatcaacagacaaataagacaatcactgactacgtagatgtgggaaatt

SEQ ID NO: 308990 - DNA, 75 bp, Artificial Sequence
  Synthetic
ggatcaacagacaaataagacaatcactgactacgtagatgtgggaaattattcatacacacagttaccaccaac

SEQ ID NO: 308991 - DNA, 75 bp, Artificial Sequence
  Synthetic
gccaaggtataaggaatacattatcggagacttgctggaagatgtgacaaatcttccaagaagcactaccgcaat

SEQ ID NO: 308992 - DNA, 75 bp, Artificial Sequence
  Synthetic
atcttccaagaagcactaccgcaatggattttgatgatattacatcagcagtaatggtttcaacaacaaacaggt

SEQ ID NO: 308993 - DNA, 75 bp, Artificial Sequence
  Synthetic
ttacagggcctaacacaggtgatatagatttgaacaatctaactgccacgaacgggtggatattatatgagaaac

SEQ ID NO: 308994 - DNA, 75 bp, Artificial Sequence
  Synthetic
agatttgaacaatctaactgccacgaacgggtggatattatatgagaaaccaaataccactaaacgattattgaa

SEQ ID NO: 308995 - DNA, 75 bp, Artificial Sequence
  Synthetic
gatgatttcatacccaatagagcgtatagaatgatagaggatggtatggtgcacgaagcaacacctaatggagtt

SEQ ID NO: 308996 - DNA, 75 bp, Artificial Sequence
  Synthetic
atagaatgatagaggatggtatggtgcacgaagcaacacctaatggagttttttcttatgatttggctactctac

SEQ ID NO: 308997 - DNA, 75 bp, Artificial Sequence
  Synthetic
acggtaaagcgaatacagtggttacatcaatatattatgcttcagcgcagaactctgagaatactgcaacagtac

SEQ ID NO: 308998 - DNA, 75 bp, Artificial Sequence
  Synthetic
atcaatatattatgcttcagcgcagaactctgagaatactgcaacagtacagcacgattcattggtactattctt

SEQ ID NO: 308999 - DNA, 75 bp, Artificial Sequence
  Synthetic
atatgggaggaatattaattaggccaactgctgatggcagagtagacatctgtatggcagatatggatgatttta

SEQ ID NO: 309000 - DNA, 75 bp, Artificial Sequence
  Synthetic
aactgctgatggcagagtagacatctgtatggcagatatggatgattttaatagtgacgactttaattgggaaaa

SEQ ID NO: 309001 - DNA, 75 bp, Artificial Sequence
  Synthetic
atctagcaactgctgatccgtatagtcagctaaaagcattgagccagttttctataaaaaatatagaaattagaa

SEQ ID NO: 309002 - DNA, 75 bp, Artificial Sequence
  Synthetic
tcagctaaaagcattgagccagttttctataaaaaatatagaaattagaatgatgaaagcaatcaaacaacaggg

SEQ ID NO: 309003 - DNA, 75 bp, Artificial Sequence
  Synthetic
caaagaaattgtaaaccaggtgaatgaagcattcgatcttttgaattcaaatggaatacctgcgttagtaattaa

SEQ ID NO: 309004 - DNA, 75 bp, Artificial Sequence
  Synthetic
tgagatacgctagagatataacactgaagtgtaaaatagagtcggagatcatcaaaggtggagggtggggatacg

SEQ ID NO: 309005 - DNA, 75 bp, Artificial Sequence
  Synthetic
actatactggtattactttcaagactgttaattacgtttataagtacactagatcaggtgaagaagtgaatgcac

SEQ ID NO: 309006 - DNA, 75 bp, Artificial Sequence
  Synthetic
atgtcacagtaagctttaataatatgaaagaaagatcatatggcggatcactaccgactgattttaaaattaaaa

SEQ ID NO: 309007 - DNA, 75 bp, Artificial Sequence
  Synthetic
ctaccgactgattttaaaattaaaagattcgatgtgattgataacgatacttatatgtatattgattactgggat

SEQ ID NO: 309008 - DNA, 75 bp, Artificial Sequence
  Synthetic
gaaatgtggtatcggtttcagattccagtcggcacatatccaggattacattcatctggggtacaatttacatat

SEQ ID NO: 309009 - DNA, 75 bp, Artificial Sequence
  Synthetic
aatgagatttatattcaaagtaacagcatcaaatggttggtacataacgtctggaggaccgaataccagaaagat

SEQ ID NO: 309010 - DNA, 75 bp, Artificial Sequence
  Synthetic
gcatcaaatggttggtacataacgtctggaggaccgaataccagaaagatcgcatctggaactggattcgcatat

SEQ ID NO: 309011 - DNA, 75 bp, Artificial Sequence
  Synthetic
aattccgagtaatccaaactatcaaactccaattgcatcatcgaacacagttagaatggatctggataggaaaat

SEQ ID NO: 309012 - DNA, 75 bp, Artificial Sequence
  Synthetic
aagtgatttacgaagtgattttaaccaactagccagttcggttgcattaggagatatattatcattagcaacatc

SEQ ID NO: 309013 - DNA, 75 bp, Artificial Sequence
  Synthetic
accgttaacatttgctaatttacttgagtcagtgccagctattacatcgtctgttaaagatgttgctgcaaatgt

SEQ ID NO: 309014 - DNA, 75 bp, Artificial Sequence
  Synthetic
ctgttaaagatgttgctgcaaatgttatgaaaaaatttagaaatacgaaaatgtttaagagagctactaaaacga

SEQ ID NO: 309015 - DNA, 75 bp, Artificial Sequence
  Synthetic
acacgcgacgttaacaaaatgaactttgatgacattacttcagctatgatgatttcaactacaaataaattacaa

SEQ ID NO: 309016 - DNA, 75 bp, Artificial Sequence
  Synthetic
atgatagagaatggaatagtgcatgaagcaacaccgactagagtgttctcttatgatttgaaaacactacaacaa

SEQ ID NO: 309017 - DNA, 75 bp, Artificial Sequence
  Synthetic
tatatctgctataattgactttgctacattaaaagcaatgagggatacatatggagtcagtaccgatgtaatgta

SEQ ID NO: 309018 - DNA, 75 bp, Artificial Sequence
  Synthetic
actatattatcattcattaacaataataacccattaataagaaacagaatagaaggattactaagacagtgtagg

SEQ ID NO: 309019 - DNA, 75 bp, Artificial Sequence
  Synthetic
ataacccattaataagaaacagaatagaaggattactaagacagtgtaggatatagacagtgaggagatcgactt

SEQ ID NO: 309020 - DNA, 75 bp, Artificial Sequence
  Synthetic
gaaatacgaaatgctattgaggctgcttacgtatactatttgctggatggtgatgaagttggtaaagagtatgca

SEQ ID NO: 309021 - DNA, 75 bp, Artificial Sequence
  Synthetic
ggtttgtacaacattgtacactatttgcgcagttctttgcatcttgttaatatatacattgtttcttagaaagat

SEQ ID NO: 309022 - DNA, 75 bp, Artificial Sequence
  Synthetic
atgctgggtggactaatggtcaattatttactaacgatatctcatacgacggaaatatcgaaggtgtgataaatg

SEQ ID NO: 309023 - DNA, 75 bp, Artificial Sequence
  Synthetic
ttctatgacaattacaaagatagtattgatgattctggtatatataatgcttgtatgggaagagctaggactgta

SEQ ID NO: 309024 - DNA, 75 bp, Artificial Sequence
  Synthetic
atttactaacgatatctcatacgacggaaatatcgaaggtgtgataaatgtgacaaacccttttaatgttgaatc

SEQ ID NO: 309025 - DNA, 75 bp, Artificial Sequence
  Synthetic
aagctgatggtttactaaatgataataattatgcacaaacattagcaacattattcgaaacaaaagggtttccaa

SEQ ID NO: 309026 - DNA, 75 bp, Artificial Sequence
  Synthetic
taattatgcacaaacattagcaacattattcgaaacaaaagggtttccaaaaggatcagtgctctttaaaacgta

SEQ ID NO: 309027 - DNA, 75 bp, Artificial Sequence
  Synthetic
atctagttatcattcctgatgaaccaaataattctgaagcgattgaacaaatagctgaatggatactgaacgttt

SEQ ID NO: 309028 - DNA, 75 bp, Artificial Sequence
  Synthetic
aaataattctgaagcgattgaacaaatagctgaatggatactgaacgtttggcaatgtgatgatatgaatttgga

SEQ ID NO: 309029 - DNA, 75 bp, Artificial Sequence
  Synthetic
gtgaagattgcgatatatctgtttgtcccttagatacaacaatgaatggaattggttgctcaccagctagtacag

SEQ ID NO: 309030 - DNA, 75 bp, Artificial Sequence
  Synthetic
tcccttagatacaacaatgaatggaattggttgctcaccagctagtacagaaacgtatgaagtagtgtctaataa

SEQ ID NO: 309031 - DNA, 75 bp, Artificial Sequence
  Synthetic
agatgtcatcaactgtaaatcacctacaatgtaaattgaaaaattgtattaaaggcgaaccacggttgaatactg

SEQ ID NO: 309032 - DNA, 75 bp, Artificial Sequence
  Synthetic
acaatgtaaattgaaaaattgtattaaaggcgaaccacggttgaatactgcaatcataagaatttccacatcatc

SEQ ID NO: 309033 - DNA, 75 bp, Artificial Sequence
  Synthetic
catttaaaattaatgcgaaaaaatggtggaagattttctatactattgttgattatataaacacactcatacaaa

SEQ ID NO: 309034 - DNA, 75 bp, Artificial Sequence
  Synthetic
gattatataaacacactcatacaaacaatgacgcctagacatcgggcaatatatcctgaaggttggatgctgaga

SEQ ID NO: 309035 - DNA, 75 bp, Artificial Sequence
  Synthetic
attaattgttgcaaattcaaagttccagattgacagaattctagtttccggagatgttgagctgaatccaggtcc

SEQ ID NO: 309036 - DNA, 75 bp, Artificial Sequence
  Synthetic
cagattgacagaattctagtttccggagatgttgagctgaatccaggtcctaacgctcttatcaaattgaatgac

SEQ ID NO: 309037 - DNA, 75 bp, Artificial Sequence
  Synthetic
atgtactgttttccattgcaaaaactgtttctgatcttaaagagaaggttgtagttggtacaatttatacaaatg

SEQ ID NO: 309038 - DNA, 75 bp, Artificial Sequence
  Synthetic
tcacaatggatgtgctattttccattgcaaagactgtatcagatctcaaaaagaaagttgtagttggtacaattt

SEQ ID NO: 309039 - DNA, 75 bp, Artificial Sequence
  Synthetic
tcagtctgtgatgatgaaatcgttcgagaagcatcaagaaatggaatgcaacctcaatctcccacgctcatagca

SEQ ID NO: 309040 - DNA, 75 bp, Artificial Sequence
  Synthetic
acactaatgtagaagatatcattcaacagacaaatgaattaattagaactctaaatggcaacacctttcatactg

SEQ ID NO: 309041 - DNA, 75 bp, Artificial Sequence
  Synthetic
ttaggtacaactttacttaatttagatgataattatgttcaagcaactagaagtgtgattgattatctagcatca

SEQ ID NO: 309042 - DNA, 75 bp, Artificial Sequence
  Synthetic
atgataattatgttcaagcaactagaagtgtgattgattatctagcatcatttatagaggcagtatgtgatgacg

SEQ ID NO: 309043 - DNA, 75 bp, Artificial Sequence
  Synthetic
taatatatgtcagatcgcagcatttgactccactctagctgaaaatgcacctaatggtactcaacggtttattta

SEQ ID NO: 309044 - DNA, 75 bp, Artificial Sequence
  Synthetic
gactccactctagctgaaaatgcacctaatggtactcaacggtttatttataatggcagacttaggagaccaatt

SEQ ID NO: 309045 - DNA, 75 bp, Artificial Sequence
  Synthetic
ctcatagcactatcttcttcaaagtttaagactatcaatttcaataatagttctcagtctattaagaattggagt

SEQ ID NO: 309046 - DNA, 75 bp, Artificial Sequence
  Synthetic
ttaagactatcaatttcaataatagttctcagtctattaagaattggagtgctcaatcgaggcgtgaaaacccag

SEQ ID NO: 309047 - DNA, 75 bp, Artificial Sequence
  Synthetic
aaccatcttgcctgatcctgccaatcaaacgacatggttatatagtcctgtacagataatgaatgggaattttac

SEQ ID NO: 309048 - DNA, 75 bp, Artificial Sequence
  Synthetic
ttgcaacgcgctaatccacaattcggaaatgttatgggactaagatattttacttctagtaatatatgtcaaatt

SEQ ID NO: 309049 - DNA, 75 bp, Artificial Sequence
  Synthetic
gaaatgttatgggactaagatattttacttctagtaatatatgtcaaattgcagcttttgattcaacatttgctg

SEQ ID NO: 309050 - DNA, 75 bp, Artificial Sequence
  Synthetic
gagtagcaactgttagaacatttgacacgtatagaataataattgacatgattagaccggcagccatgactcaat

SEQ ID NO: 309051 - DNA, 75 bp, Artificial Sequence
  Synthetic
cacgtatagaataataattgacatgattagaccggcagccatgactcaatatatacaacagatatttccaagagg

SEQ ID NO: 309052 - DNA, 75 bp, Artificial Sequence
  Synthetic
agaccaatttctaatgtattaatgaagattgaggctggcgctcaaaatattagtaattcaactgttctgcctgat

SEQ ID NO: 309053 - DNA, 75 bp, Artificial Sequence
  Synthetic
agattgaggctggcgctcaaaatattagtaattcaactgttctgcctgatccaacgaaccagacgacatggttgt

SEQ ID NO: 309054 - DNA, 75 bp, Artificial Sequence
  Synthetic
atgcaacaacagaatctgttctttgtgactcacattcagttgaatattcaattattgcaaacgttagaagagatt

SEQ ID NO: 309055 - DNA, 75 bp, Artificial Sequence
  Synthetic
aatggtcaattggtagatatggtcaggaatatgggagtagtgactgttagaacatttgattcatatagaatgaca

SEQ ID NO: 309056 - DNA, 75 bp, Artificial Sequence
  Synthetic
ttaaatggtttgtacgacattgtacactgtttgcgtaattctctgcattctttttatctacatactgttattcag

SEQ ID NO: 309057 - DNA, 75 bp, Artificial Sequence
  Synthetic
tccacaaggtggtccatatgcttatcaagctgcgtatatgttatcattaagtatactggatgctacaacagagtc

SEQ ID NO: 309058 - DNA, 75 bp, Artificial Sequence
  Synthetic
ctaattgtattggatggtcacagggtcagatgtttactgatgatatatattataacggaaatgttgaaacgatag

SEQ ID NO: 309059 - DNA, 75 bp, Artificial Sequence
  Synthetic
tcagatgtttactgatgatatatattataacggaaatgttgaaacgatagtaaatgctactaacccttttgatgt

SEQ ID NO: 309060 - DNA, 75 bp, Artificial Sequence
  Synthetic
ctggtaagacagatggatatctaaatgatggtaattacgctcaaactatagcaacgttgttcgaaacaaaaggct

SEQ ID NO: 309061 - DNA, 75 bp, Artificial Sequence
  Synthetic
aacatatacaaaagtctcagactttatagattctgtagaaatgacgtgttcatataatatagttataatacctga

SEQ ID NO: 309062 - DNA, 75 bp, Artificial Sequence
  Synthetic
cagcaactaatctcacaaaattattattcaactggtaatgaaattttattggataaacagactaataaaactact

SEQ ID NO: 309063 - DNA, 75 bp, Artificial Sequence
  Synthetic
agaatggggagcggggtcaaccttcgaatctacattcaaatcatcaaatataactggtccacataataacacagt

SEQ ID NO: 309064 - DNA, 75 bp, Artificial Sequence
  Synthetic
gaatctacattcaaatcatcaaatataactggtccacataataacacagtcatagagtggagtaatttaataaat

SEQ ID NO: 309065 - DNA, 75 bp, Artificial Sequence
  Synthetic
tttagatatatatacttatgaacagactggaatagataatctatgggctgcttttggtagtgattgcgatatatc

SEQ ID NO: 309066 - DNA, 75 bp, Artificial Sequence
  Synthetic
tagattattaaaacatggaccagaaaattatggtaatgtagcagcttttgaattatggtatggtaaagctggtca

SEQ ID NO: 309067 - DNA, 75 bp, Artificial Sequence
  Synthetic
gtacggaaacatatgaagtactgtcaaataatactcagctagcattactcaatgtagtagataacgtaaaacatc

SEQ ID NO: 309068 - DNA, 75 bp, Artificial Sequence
  Synthetic
gaagccaggctaaatactgcacttatcagaatctctacatcatcaagttttgataattcattgtcaccgttgaat

SEQ ID NO: 309069 - DNA, 75 bp, Artificial Sequence
  Synthetic
tcagaatctctacatcatcaagttttgataattcattgtcaccgttgaatgatggacaaacaacacgtacattta

SEQ ID NO: 309070 - DNA, 75 bp, Artificial Sequence
  Synthetic
gtggatatttgtatgtctgatatggacaatacagatggtactagttttaattggattcaatggaagcatgagttc

SEQ ID NO: 309071 - DNA, 75 bp, Artificial Sequence
  Synthetic
attaacacaattgtacaaactatggctccgagacatcgggctatttatccagaaggttggatgctgagatacgcg

SEQ ID NO: 309072 - DNA, 75 bp, Artificial Sequence
  Synthetic
acaatacagatggtactagttttaattggattcaatggaagcatgagttcccacgtagtagtagtaatgctgata

SEQ ID NO: 309073 - DNA, 75 bp, Artificial Sequence
  Synthetic
cttaaagagttacaaagaccaacagtaacaactataaatatgcgaatgatgaggactgtaaatggagatctaatc

SEQ ID NO: 309074 - DNA, 75 bp, Artificial Sequence
  Synthetic
attcattatggcaagaaatgagatacgtaagagatataactctagaatgtaaaatagagtcagaagtaattaaag

SEQ ID NO: 309075 - DNA, 75 bp, Artificial Sequence
  Synthetic
catacatattcatatgatagagcaggtgaaagtgtcactgctcacgtaacagtgagtttcaataatatgaaagaa

SEQ ID NO: 309076 - DNA, 75 bp, Artificial Sequence
  Synthetic
cgtgatggatatcgacacatatatgtatattgattattgggatgattcagatatgtttaaaaatatggtatacgt

SEQ ID NO: 309077 - DNA, 75 bp, Artificial Sequence
  Synthetic
cttattcctttcgtattcctgttggagtgcatcctagaataaattcatctgggatagaatttgcatatgagaaat

SEQ ID NO: 309078 - DNA, 75 bp, Artificial Sequence
  Synthetic
tttgtatttaaagtgacgtctgcaaacggttggtttatgacctcaggcggtccaaataccagacgtatagcatca

SEQ ID NO: 309079 - DNA, 75 bp, Artificial Sequence
  Synthetic
gacatacgtccagaaccgttggaacgttatcatttatatctttgatcccaagtaatccaaattatcaaacaccta

SEQ ID NO: 309080 - DNA, 75 bp, Artificial Sequence
  Synthetic
agacgtagctgctaatgtaatgaaaaaatttagaaatacaaagatgtttaagaaagctacaaaaaccaagtataa

SEQ ID NO: 309081 - DNA, 75 bp, Artificial Sequence
  Synthetic
actctaatactatgaattttgatgatattacgtcagcagtcatgatttcaactactaataaattacaattgaccg

SEQ ID NO: 309082 - DNA, 75 bp, Artificial Sequence
  Synthetic
aaaataatacagtatatgaagcaactcccagcagagtattttcatatgatttagtaactatgcaacagcgagatt

SEQ ID NO: 309083 - DNA, 75 bp, Artificial Sequence
  Synthetic
tgcaaagactgtgtcagatctcaaaaagaaagttgtagttggtacaatttacactaatgtagaagatattattca

SEQ ID NO: 309084 - DNA, 75 bp, Artificial Sequence
  Synthetic
gcaattgtagattttgcaactctgaaggcgatgagagagacgtatgggacaagtgctgacgttatttataaatta

SEQ ID NO: 309085 - DNA, 75 bp, Artificial Sequence
  Synthetic
tatcattcataaatagcaataatccgttgataagaaatagaatagaagagttgttaagacagtgtagaatataag

SEQ ID NO: 309086 - DNA, 75 bp, Artificial Sequence
  Synthetic
tgacaaactggtcttctttttagatggtttgtacaacattgtacactgtttgcgttattctctgcattcttttca

SEQ ID NO: 309087 - DNA, 75 bp, Artificial Sequence
  Synthetic
ggtttgtacaacattgtacactgtttgcgttattctctgcattcttttcatttacatgttattgtttagaaaaat

SEQ ID NO: 309088 - DNA, 75 bp, Artificial Sequence
  Synthetic
aaatagttagagaagcgtccagaaatggaatgcaacctcaatctccaacccttatagctctatcttcttcgaaat

SEQ ID NO: 309089 - DNA, 75 bp, Artificial Sequence
  Synthetic
gcgtagggtggacacaaggtcaaatgttcattgatgatatgcattatgaaggaaacgttgagacaattgtcaatg

SEQ ID NO: 309090 - DNA, 75 bp, Artificial Sequence
  Synthetic
gttcattgatgatatgcattatgaaggaaacgttgagacaattgtcaatgcgaccaatccatttaatgtagaatc

SEQ ID NO: 309091 - DNA, 75 bp, Artificial Sequence
  Synthetic
tacttctagtaatacatgtcaaattgcagcatttgattcaacatttgctgagaacgcacccaatggtacgcaacg

SEQ ID NO: 309092 - DNA, 75 bp, Artificial Sequence
  Synthetic
gcagcatttgattcaacatttgctgagaacgcacccaatggtacgcaacgcttcatttacaatggaagacttaaa

SEQ ID NO: 309093 - DNA, 75 bp, Artificial Sequence
  Synthetic
atatagttataatacctgatgatccaaataagttagaaacaattgaacaaatcgcagagtggattttaaacgttt

SEQ ID NO: 309094 - DNA, 75 bp, Artificial Sequence
  Synthetic
ccaacaaaccaaacaacatggttgtttaatccagtacaagtgatgaatggcacttttacaattgaattttataat

SEQ ID NO: 309095 - DNA, 75 bp, Artificial Sequence
  Synthetic
gtgatgattgtgatatatctgtttgtccattagataccacaatgaatggaatcggatgtctgccagcgagtacag

SEQ ID NO: 309096 - DNA, 75 bp, Artificial Sequence
  Synthetic
aacatttgattcatatagaattactgttgatatgattaggccagcagctatgactcaatatgttcagagagtatt

SEQ ID NO: 309097 - DNA, 75 bp, Artificial Sequence
  Synthetic
gttgatatgattaggccagcagctatgactcaatatgttcagagagtatttccacaaggtggtccatatgctcat

SEQ ID NO: 309098 - DNA, 75 bp, Artificial Sequence
  Synthetic
gtggataatgttaaacatagaattcagatgaacactggtcattgtaagctgaaaaattgtgtgaagggtgaagcg

SEQ ID NO: 309099 - DNA, 75 bp, Artificial Sequence
  Synthetic
ctcattatcacctatgaacaatggccaaaccacacgcacatttaaaataaacgctaagaagtggtggacaatatt

SEQ ID NO: 309100 - DNA, 75 bp, Artificial Sequence
  Synthetic
aacagaatcaagaactggttctcaattatcaaatcggagttcacgaagaatggattttattgatgatgaagagtt

SEQ ID NO: 309101 - DNA, 75 bp, Artificial Sequence
  Synthetic
atacgtatgctcaattaccaccaacgaattggggagctggagctacttttgaatcagcttttagtgcagcagaaa

SEQ ID NO: 309102 - DNA, 75 bp, Artificial Sequence
  Synthetic
cgaatgatttagtaatgaaacattctattataacagaggcagtagtatgcgatgaatctgcgcatgtgtcggcag

SEQ ID NO: 309103 - DNA, 75 bp, Artificial Sequence
  Synthetic
ttgaaagaaacagaaaatgagattactgaaatgaaatcaaagacaaatttattagttaacgcttcagtaggtatt

SEQ ID NO: 309104 - DNA, 75 bp, Artificial Sequence
  Synthetic
ctgaaatgaaatcaaagacaaatttattagttaacgcttcagtaggtattaattcaaacttaggagcagttaatc

SEQ ID NO: 309105 - DNA, 75 bp, Artificial Sequence
  Synthetic
tatatatgtatggctaacatgaataatttcaatactgagaattttaattgggaagagtggaaatttttgtcacct

SEQ ID NO: 309106 - DNA, 75 bp, Artificial Sequence
  Synthetic
gaagatattgagggatgcgtctgtaaaaattgtccatatagagaaaagtaccgaaaactccgaagtaaaatgaaa

SEQ ID NO: 309107 - DNA, 75 bp, Artificial Sequence
  Synthetic
taacagcgatccatatagacaattgaaagagttgcagcaaccaacaattactacgtttgagatgcgaatgatgca

SEQ ID NO: 309108 - DNA, 75 bp, Artificial Sequence
  Synthetic
aaagagttgcagcaaccaacaattactacgtttgagatgcgaatgatgcaagtgactaaaaatggacagattaat

SEQ ID NO: 309109 - DNA, 75 bp, Artificial Sequence
  Synthetic
ggctttaaaaaagagctggacttggaggtgtgtcaacatggcaaattcatttagagaaatgctatattggtatag

SEQ ID NO: 309110 - DNA, 75 bp, Artificial Sequence
  Synthetic
aggtgtgtcaacatggcaaattcatttagagaaatgctatattggtatagaaaaattattgatagaaaattacca

SEQ ID NO: 309111 - DNA, 75 bp, Artificial Sequence
  Synthetic
ttagagaaatgctatattggtatagaaaaattattgatagaaaattaccatgtgtgaatgtaaacatgtggagaa

SEQ ID NO: 309112 - DNA, 75 bp, Artificial Sequence
  Synthetic
gagagatataacacttcaatgtaaaatagagtctgaagttgttaagggcggtggatgggggtatgattatacaag

SEQ ID NO: 309113 - DNA, 75 bp, Artificial Sequence
  Synthetic
tataagatttaaaactattaatcacacgtattcatatgatagagcaggcgagaatgtaaatgcccatgttactat

SEQ ID NO: 309114 - DNA, 75 bp, Artificial Sequence
  Synthetic
atagatggattatttttgatgaagaaccaagtcagatggtattatttgagtattggattatgtataaagactatt

SEQ ID NO: 309115 - DNA, 75 bp, Artificial Sequence
  Synthetic
ttctaagcaaattcaattataattataaagcacaattgaaaattcttaatatgaacaaaaatcggagatttcata

SEQ ID NO: 309116 - DNA, 75 bp, Artificial Sequence
  Synthetic
atgaacaaaaatcggagatttcatattaatgagagtaaaaagaaagcattatcagtaccaatcacttctcagtat

SEQ ID NO: 309117 - DNA, 75 bp, Artificial Sequence
  Synthetic
ctaaaatttaagtttaataataagatttacattatgtttgggacttttctgacttcaaagattcaaccatggata

SEQ ID NO: 309118 - DNA, 75 bp, Artificial Sequence
  Synthetic
tttacattatgtttgggacttttctgacttcaaagattcaaccatggatacagctgaaaagtttaaaggtaggat

SEQ ID NO: 309119 - DNA, 75 bp, Artificial Sequence
  Synthetic
atgtgcaaagttgatagctactaaaggaatgtttgcaacaaattcatttaaatcattatgtattactgaaattaa

SEQ ID NO: 309120 - DNA, 75 bp, Artificial Sequence
  Synthetic
ggaatgtttgcaacaaattcatttaaatcattatgtattactgaaattaatgcacgtagaccaatttctgagtgt

SEQ ID NO: 309121 - DNA, 75 bp, Artificial Sequence
  Synthetic
agaaatgattttaaccaattagcaagttctgtggcattgggtgatatcctatcactagcaacatctcccttaact

SEQ ID NO: 309122 - DNA, 75 bp, Artificial Sequence
  Synthetic
ttcagctgtaatgggaaaagacaaaatacctgtaactaaaagtttagctatgaaatatttttgtaaaaacattaa

SEQ ID NO: 309123 - DNA, 75 bp, Artificial Sequence
  Synthetic
atacctgtaactaaaagtttagctatgaaatatttttgtaaaaacattaatactgaattattttattatggtcat

SEQ ID NO: 309124 - DNA, 75 bp, Artificial Sequence
  Synthetic
tgaaatatttttgtaaaaacattaatactgaattattttattatggtcattcaaagtgtcatgtcgtttcagagt

SEQ ID NO: 309125 - DNA, 75 bp, Artificial Sequence
  Synthetic
atagtatttagacggcaatttatgaatgaagttgttgaatggtttgaaaattttactcaattaacgggaatgcat

SEQ ID NO: 309126 - DNA, 75 bp, Artificial Sequence
  Synthetic
gatgtaacacgtgttacaagaaattcaaattcaatgaattttgatgacattacgtcagcgatgatgatatcagct

SEQ ID NO: 309127 - DNA, 75 bp, Artificial Sequence
  Synthetic
tagaaaagaaattgaggattatataaattctggtaaaaaaatatctttatcttctgtcataccagatggacacgc

SEQ ID NO: 309128 - DNA, 75 bp, Artificial Sequence
  Synthetic
aaggtcggctgatgacttcataccaaacagatcttatagaatgatagaaaatggtgtagtacatgaggcgataca

SEQ ID NO: 309129 - DNA, 75 bp, Artificial Sequence
  Synthetic
aacagatcttatagaatgatagaaaatggtgtagtacatgaggcgatacagaacggagttttttcatacgatcta

SEQ ID NO: 309130 - DNA, 75 bp, Artificial Sequence
  Synthetic
ttctaaatcaccagtgatatctgctatagttgattttgctacgttaaaagcaatgcgagatacatatggagttgg

SEQ ID NO: 309131 - DNA, 75 bp, Artificial Sequence
  Synthetic
catttattaataataataatccattaataagaaataggatagaagaattattgagacaatgcagaatttaacaag

SEQ ID NO: 309132 - DNA, 75 bp, Artificial Sequence
  Synthetic
ggtttgtacaacgttgtacactgtttgcgcaattctctgcattctttttatttacatgttgttattcagaaaaat

SEQ ID NO: 309133 - DNA, 75 bp, Artificial Sequence
  Synthetic
gtattggatggtcacaaggtcagatgtttgctgacgatatatattataatggaaacgttgaaacaatagtaaatg

SEQ ID NO: 309134 - DNA, 75 bp, Artificial Sequence
  Synthetic
gtttgctgacgatatatattataatggaaacgttgaaacaatagtaaatgctacagatccatttgacgtaagatc

SEQ ID NO: 309135 - DNA, 75 bp, Artificial Sequence
  Synthetic
agacggatgggtatctaaatgatggtaattatgctcaaaccatcgcagcattatttgaaacgaaaggctttccaa

SEQ ID NO: 309136 - DNA, 75 bp, Artificial Sequence
  Synthetic
taattatgctcaaaccatcgcagcattatttgaaacgaaaggctttccaaaaggatcaataatactcaaaacata

SEQ ID NO: 309137 - DNA, 75 bp, Artificial Sequence
  Synthetic
atatagtcatagtacccgatagttcagctaattcggaagatatagaacgaatagcagaatggatattgaatgttt

SEQ ID NO: 309138 - DNA, 75 bp, Artificial Sequence
  Synthetic
agctaattcggaagatatagaacgaatagcagaatggatattgaatgtttggagatgtgatgatatgaatttgga

SEQ ID NO: 309139 - DNA, 75 bp, Artificial Sequence
  Synthetic
gtgattcccattcagtagaatattcaatagtagcaaacgtcagaagagattcagcgatgccagctggaaccgttt

SEQ ID NO: 309140 - DNA, 75 bp, Artificial Sequence
  Synthetic
gcaatgattgcgatatatctgtctgtccattagacacaacaatgaatgggattggctgctcaccagctagtacag

SEQ ID NO: 309141 - DNA, 75 bp, Artificial Sequence
  Synthetic
tccattagacacaacaatgaatgggattggctgctcaccagctagtacagaaacatatgaagtgttatcaaacga

SEQ ID NO: 309142 - DNA, 75 bp, Artificial Sequence
  Synthetic
ggctttaaaattttcagatcactttgctctacgaagtaatggatttcatcaatcaaactttgttctcaaagtata

SEQ ID NO: 309143 - DNA, 75 bp, Artificial Sequence
  Synthetic
aatcaaactttgttctcaaagtatactgaaagtaatatagatacaattccttatcttttgggtcttattcttgca

SEQ ID NO: 309144 - DNA, 75 bp, Artificial Sequence
  Synthetic
aaatgaatacggctagttgtaaattaaaaaattgcattaaaggtgaagctagactaaatactgcacttatcagaa

SEQ ID NO: 309145 - DNA, 75 bp, Artificial Sequence
  Synthetic
aaaaaattgcattaaaggtgaagctagactaaatactgcacttatcagaatatctacctcgtcaagttttgacaa

SEQ ID NO: 309146 - DNA, 75 bp, Artificial Sequence
  Synthetic
atgtaagcatatagtaattacgtctaaatcagccattgataaaatgagaaaaattaataattcggaacataacac

SEQ ID NO: 309147 - DNA, 75 bp, Artificial Sequence
  Synthetic
atgctaaaaagtggtggacaatattctacactatagttgactacattaacacaattatacaaactatggctccga

SEQ ID NO: 309148 - DNA, 75 bp, Artificial Sequence
  Synthetic
acaattatacaaactatggctccgaggcatcgagcaatttatccggaaggttggatgttgagatacgcgtaaaca

SEQ ID NO: 309149 - DNA, 75 bp, Artificial Sequence
  Synthetic
gatgagtgataatagaaatgaattcaaacattcatatgatgatacaaatatatgtgaaaaatctggattagagac

SEQ ID NO: 309150 - DNA, 75 bp, Artificial Sequence
  Synthetic
tatgtgaaaaatctggattagagacggaagtttgtctatgaaattcctgcgcttcctgctggtgaacggacgcca

SEQ ID NO: 309151 - DNA, 75 bp, Artificial Sequence
  Synthetic
tcccgttcatttctagcgagtagagaaaaacattgtacccgaaacgctgagttgaggatcaatgtagatatgaaa

SEQ ID NO: 309152 - DNA, 75 bp, Artificial Sequence
  Synthetic
atactatactatatggtgttgcaccaccaccagaatttagaaatagatttaaaacaaatgaaagatatggtttag

SEQ ID NO: 309153 - DNA, 75 bp, Artificial Sequence
  Synthetic
atttatacttatgaacaaataaataaggataatttgtgggcagcattcggtgaagattgtgatatatctgtttgt

SEQ ID NO: 309154 - DNA, 75 bp, Artificial Sequence
  Synthetic
tcatattttacgattacaaaattagattattccaatcataaattacttccattaatggctgatgaatataaaatt

SEQ ID NO: 309155 - DNA, 75 bp, Artificial Sequence
  Synthetic
attattccaatcataaattacttccattaatggctgatgaatataaaattacaattaacacaaaagctgatattc

SEQ ID NO: 309156 - DNA, 75 bp, Artificial Sequence
  Synthetic
tatactataattgattacattaatacattagtacagacaatgacgcccagacatcgggccatatatcctgaaggt

SEQ ID NO: 309157 - DNA, 75 bp, Artificial Sequence
  Synthetic
ataaaaaacatggtagacaattctcttatgatgatggagatatggctttcgtacatccaggatggaaaacgtgta

SEQ ID NO: 309158 - DNA, 75 bp, Artificial Sequence
  Synthetic
gtacatccaggatggaaaacgtgtattggtcaattatgtggtggtactacatttgaagttgctaaaacatcacta

SEQ ID NO: 309159 - DNA, 75 bp, Artificial Sequence
  Synthetic
ttggtcaattatgtggtggtactacatttgaagttgctaaaacatcactatacagcataaaaccatcgaaaactg

SEQ ID NO: 309160 - DNA, 75 bp, Artificial Sequence
  Synthetic
ttctatggttggaaattaagaatgtagtgagtgaaggttacaagcaataggaattgcagctgtgcatatgtggct

SEQ ID NO: 309161 - DNA, 75 bp, Artificial Sequence
  Synthetic
gatcgatggcgtcctcactttatcagcagttaatttcacaaaattatcattctattggaaatgaaatattgacgg

SEQ ID NO: 309162 - DNA, 75 bp, Artificial Sequence
  Synthetic
tctattggaaatgaaatattgacggatcaacagacaacaaaagctgtagttgactatgtagatgctggcaattac

SEQ ID NO: 309163 - DNA, 75 bp, Artificial Sequence
  Synthetic
atcaacagacaacaaaagctgtagttgactatgtagatgctggcaattacacatacgcgcagttaccacctacta

SEQ ID NO: 309164 - DNA, 75 bp, Artificial Sequence
  Synthetic
actggacctcatacgaatacaataatagaatggagtaacttattaaattctaacggatgggttatttatcaaaaa

SEQ ID NO: 309165 - DNA, 75 bp, Artificial Sequence
  Synthetic
tagaatggagtaacttattaaattctaacggatgggttatttatcaaaaaccgaccaatactgcaaaattgttta

SEQ ID NO: 309166 - DNA, 75 bp, Artificial Sequence
  Synthetic
tatggtaagtctggtgcaacaattacatcagactatttttcttcattacaaaataatgaaaaaactgtgacggtg

SEQ ID NO: 309167 - DNA, 75 bp, Artificial Sequence
  Synthetic
catcagactatttttcttcattacaaaataatgaaaaaactgtgacggtgacttcagattcattaatactttttt

SEQ ID NO: 309168 - DNA, 75 bp, Artificial Sequence
  Synthetic
gatatgggtggtatattaataaaacctacaagaggcaatagagtagacatatgcatggcaaatatgaataatttt

SEQ ID NO: 309169 - DNA, 75 bp, Artificial Sequence
  Synthetic
ctacaagaggcaatagagtagacatatgcatggcaaatatgaataattttaatagtagcacatttaattgggagg

SEQ ID NO: 309170 - DNA, 75 bp, Artificial Sequence
  Synthetic
tatacagattattatctcgctagtgaagatccatatactgagcttaaaacgttgcaacagccaaatattacaact

SEQ ID NO: 309171 - DNA, 75 bp, Artificial Sequence
  Synthetic
aagatccatatactgagcttaaaacgttgcaacagccaaatattacaacttttgatatgagaatgatgaaagttg

SEQ ID NO: 309172 - DNA, 75 bp, Artificial Sequence
  Synthetic
tggcaagaggtaagatatgctagagatataacgttagagtgtaagatacagtcagaagtagtaaaaggtggtgga

SEQ ID NO: 309173 - DNA, 75 bp, Artificial Sequence
  Synthetic
atataacgttagagtgtaagatacagtcagaagtagtaaaaggtggtggatggggctatgactacacaggtgtgg

SEQ ID NO: 309174 - DNA, 75 bp, Artificial Sequence
  Synthetic
gtaaatgcacatgtcactattagttttaataatatgaaagaacgatcatacggaggttcattacctactgatttt

SEQ ID NO: 309175 - DNA, 75 bp, Artificial Sequence
  Synthetic
ttaataatatgaaagaacgatcatacggaggttcattacctactgattttaaaataggaagatttgatgtaattg

SEQ ID NO: 309176 - DNA, 75 bp, Artificial Sequence
  Synthetic
aaaaatatggtgtatgtgcgtgatttgagtgccaatattggtggtttcttttactatgctgaaatgtcatactat

SEQ ID NO: 309177 - DNA, 75 bp, Artificial Sequence
  Synthetic
tgagtgccaatattggtggtttcttttactatgctgaaatgtcatactattttcaaattcctgtaggtgtgcatc

SEQ ID NO: 309178 - DNA, 75 bp, Artificial Sequence
  Synthetic
tctcaacaatttactgacatggttgcgctaaattcgatgagatttatatttaaggtaacagcatcaaatggttgg

SEQ ID NO: 309179 - DNA, 75 bp, Artificial Sequence
  Synthetic
atttgcatactcggacggtcatatttctgaaactgtcggaaatatttcattcatatcattaattccaagtaatcc

SEQ ID NO: 309180 - DNA, 75 bp, Artificial Sequence
  Synthetic
tcgaacacggtcaggatggatttagataggaaaataaatgatttgcgaaatgattttaataatttagctagttca

SEQ ID NO: 309181 - DNA, 75 bp, Artificial Sequence
  Synthetic
tgattttaataatttagctagttcagttgcattaggagatataatgtcattagctatgtcacctttaacatttgc

SEQ ID NO: 309182 - DNA, 75 bp, Artificial Sequence
  Synthetic
attacatcatccgttaaagatgttgctgcaaatgttatgaaaaaattcaggaatacaaaaatgtttaaaagagca

SEQ ID NO: 309183 - DNA, 75 bp, Artificial Sequence
  Synthetic
ctgcaaatgttatgaaaaaattcaggaatacaaaaatgtttaaaagagcaactaaagcaaaatataaagaatata

SEQ ID NO: 309184 - DNA, 75 bp, Artificial Sequence
  Synthetic
aaaataaattttgacgatattacttcagctatgatggtttcaactacaaataaattacagttgacagatgttgat

SEQ ID NO: 309185 - DNA, 75 bp, Artificial Sequence
  Synthetic
gtcgtataggatgatagagaatgggatagtacatgaagcaacgccaactagagtattctcttatgatttaaaaac

SEQ ID NO: 309186 - DNA, 75 bp, Artificial Sequence
  Synthetic
atagtacatgaagcaacgccaactagagtattctcttatgatttaaaaacgttacaacaaacagatttcgatatg

SEQ ID NO: 309187 - DNA, 75 bp, Artificial Sequence
  Synthetic
tgactttgctacgctaaaagcaatgagagatacatatggagttagtacagatgtaatgtacaagttaatagcatc

SEQ ID NO: 309188 - DNA, 75 bp, Artificial Sequence
  Synthetic
attaataacaataatccattgataagaaatagaatagagggattattaaggcaatgcagaatataaatagtgagg

SEQ ID NO: 309189 - DNA, 75 bp, Artificial Sequence
  Synthetic
ttaaatggtttgtacaactttgtacactgtttgcgcaattctttgcatcttattaatatatacattatttcttag

SEQ ID NO: 309190 - DNA, 75 bp, Artificial Sequence
  Synthetic
tgagtcattatgtatttattttccaaacgctgcaattggttcaccaggtccaggtaaggctgatggcttattgaa

SEQ ID NO: 309191 - DNA, 75 bp, Artificial Sequence
  Synthetic
gcaacattgtttgaaacaaaaggatttccgaaaggatctgtaatctttaaaacatatacaaaaacatcagatttt

SEQ ID NO: 309192 - DNA, 75 bp, Artificial Sequence
  Synthetic
ttccgaaaggatctgtaatctttaaaacatatacaaaaacatcagattttataaattcagtagaaatgacttgtt

SEQ ID NO: 309193 - DNA, 75 bp, Artificial Sequence
  Synthetic
aacatatacaaaaacatcagattttataaattcagtagaaatgacttgttcatataatttagttatcattcctga

SEQ ID NO: 309194 - DNA, 75 bp, Artificial Sequence
  Synthetic
ataaattcagtagaaatgacttgttcatataatttagttatcattcctgatgaaccaaaaaattcagaagcaatt

SEQ ID NO: 309195 - DNA, 75 bp, Artificial Sequence
  Synthetic
tgtttgtccattagatacaacaatgaatgggataggttgttcaccagctagtacagaaacatacgaggtggtgtc

SEQ ID NO: 309196 - DNA, 75 bp, Artificial Sequence
  Synthetic
aagacgcatgaagctaattcagattgtttaattttattttggaacgagggatctacacagttagaaaagcaagtc

SEQ ID NO: 309197 - DNA, 75 bp, Artificial Sequence
  Synthetic
cacgaacattcaaaattaatgcaaaaaaatggtggaagattttttatactataattgattacattaatacactag

SEQ ID NO: 309198 - DNA, 75 bp, Artificial Sequence
  Synthetic
tacaaccaatgacgcctagacatcgggctgtatatcctgaaggttggatgctgagatatgcgtaaacaagatcat

SEQ ID NO: 309199 - DNA, 75 bp, Artificial Sequence
  Synthetic
cgcaaatccacaatttggaagcgttatgggtttaagatattatacaacaagtaatacttgtcaaattgcagcatt

SEQ ID NO: 309200 - DNA, 75 bp, Artificial Sequence
  Synthetic
acacattgagtgtaatcactttaatgaatgatacattacattctattattcaagatccaggaatggcgtattttc

SEQ ID NO: 309201 - DNA, 75 bp, Artificial Sequence
  Synthetic
gaatgatacattacattctattattcaagatccaggaatggcgtattttccatacattgcatctgttctgactgt

SEQ ID NO: 309202 - DNA, 75 bp, Artificial Sequence
  Synthetic
agacatcgaagtgttcgtacaaagtaattaaatattgcatggttacagttattaatactcttctaaagttggctg

SEQ ID NO: 309203 - DNA, 75 bp, Artificial Sequence
  Synthetic
aattaaatattgcatggttacagttattaatactcttctaaagttggctggttataaagagcaggttactactaa

SEQ ID NO: 309204 - DNA, 75 bp, Artificial Sequence
  Synthetic
aactggagatgattgataaattgacaactcgcgagattgaacaagttgaattacttaaacgtatacatgacaagc

SEQ ID NO: 309205 - DNA, 75 bp, Artificial Sequence
  Synthetic
aactcgcgagattgaacaagttgaattacttaaacgtatacatgacaagctaattatcagaccagttgatgctat

SEQ ID NO: 309206 - DNA, 75 bp, Artificial Sequence
  Synthetic
tgagaggttgagttgccgtcgtctgtcttcggaagcggcggaactcttcaccgcaagccccattggacctgatgg

SEQ ID NO: 309207 - DNA, 75 bp, Artificial Sequence
  Synthetic
ttctaacttttttgatatcgcttgtatttgttaattatatactaaaatcagttactagaacaatggacttcatca

SEQ ID NO: 309208 - DNA, 75 bp, Artificial Sequence
  Synthetic
cagaattatggaattaatttaccaataactggatctatggatacgccttacatgaactctacaacgagcgaaaca

SEQ ID NO: 309209 - DNA, 75 bp, Artificial Sequence
  Synthetic
taactggatctatggatacgccttacatgaactctacaacgagcgaaacatttttgacatcgacgttatgtctat

SEQ ID NO: 309210 - DNA, 75 bp, Artificial Sequence
  Synthetic
acgttgtcgcaattgtttttaacaaaaggatggccgacggggtcggtttactttaaaggatatgcagatattgcg

SEQ ID NO: 309211 - DNA, 75 bp, Artificial Sequence
  Synthetic
aaggatggccgacggggtcggtttactttaaaggatatgcagatattgcgtcattttctgtagaaccacagttat

SEQ ID NO: 309212 - DNA, 75 bp, Artificial Sequence
  Synthetic
aacagatgttgtagatggagtgaattataaaataaatgtgacaagaactacatgtactattagaaaatggaaaaa

SEQ ID NO: 309213 - DNA, 75 bp, Artificial Sequence
  Synthetic
gatatgtcagagttggctgatttaatattaaacgaatggctatgtaatccaatggatataacattatattattac

SEQ ID NO: 309214 - DNA, 75 bp, Artificial Sequence
  Synthetic
tattaaacgaatggctatgtaatccaatggatataacattatattattaccagcaaacagatgaagctaataagt

SEQ ID NO: 309215 - DNA, 75 bp, Artificial Sequence
  Synthetic
tattggatattacggcagatccaacaacagcaccacaaacagaaagaatgatgagaataaattggaagaaatggt

SEQ ID NO: 309216 - DNA, 75 bp, Artificial Sequence
  Synthetic
cagactcttggaatagggtgttcgactacagacaaaaattcatttgagacagtagctaacgcagaaaaattagct

SEQ ID NO: 309217 - DNA, 75 bp, Artificial Sequence
  Synthetic
atgtccaaaagatcgcggtcattggattcagcatcgttttattatagaatttgaatattattgaagttatagttg

SEQ ID NO: 309218 - DNA, 75 bp, Artificial Sequence
  Synthetic
ctacagacaaaaattcatttgagacagtagctaacgcagaaaaattagctataactgatgttgttgatggagtca

SEQ ID NO: 309219 - DNA, 75 bp, Artificial Sequence
  Synthetic
gcacgcaatgcgttcattacaactcagttcactggtgtaatgagggtattggggctttttgaacgcgggaacaac

SEQ ID NO: 309220 - DNA, 75 bp, Artificial Sequence
  Synthetic
ggggctttttgaacgcgggaacaacttgaatttcgcagacacctatatatacacatggaacaaacaatattcata

SEQ ID NO: 309221 - DNA, 75 bp, Artificial Sequence
  Synthetic
aaacttggaccgagagaaaatgttgctgtgattcaggtagggggtccaaatatacttgacataacagctgatcca

SEQ ID NO: 309222 - DNA, 75 bp, Artificial Sequence
  Synthetic
ttgaatttcgcagacacctatatatacacatggaacaaacaatattcatatcatgaaaacgcattcttaatttca

SEQ ID NO: 309223 - DNA, 75 bp, Artificial Sequence
  Synthetic
tgaagtggataaagcatttactttattaaattctaacggtataccagcattagttattagaaaagatcacatcgg

SEQ ID NO: 309224 - DNA, 75 bp, Artificial Sequence
  Synthetic
gtggcaagtcttttatacaatagttgattacgtgaatcaaattgtacaagtcatgtccaagcgatcacgttcctt

SEQ ID NO: 309225 - DNA, 75 bp, Artificial Sequence
  Synthetic
ttaaattctaacggtataccagcattagttattagaaaagatcacatcggaatatttacgtcatcaaattttacc

SEQ ID NO: 309226 - DNA, 75 bp, Artificial Sequence
  Synthetic
gattacgtgaatcaaattgtacaagtcatgtccaagcgatcacgttccttagattctgctgctttttattaccga

SEQ ID NO: 309227 - DNA, 75 bp, Artificial Sequence
  Synthetic
aaacaatgaatttattgttagtgatgaattttggttacacactaatatacatgagctactgccgtacaaattact

SEQ ID NO: 309228 - DNA, 75 bp, Artificial Sequence
  Synthetic
gcattaaaaatctcattcacaatggacgtgttgttttcaatcgcgaagactgtttcagaacttaaaaagaaagtt

SEQ ID NO: 309229 - DNA, 75 bp, Artificial Sequence
  Synthetic
tgtttcagaacttaaaaagaaagttgtggttggtactatttacactaatgtagaggatataattcaacaaactaa

SEQ ID NO: 309230 - DNA, 75 bp, Artificial Sequence
  Synthetic
gtggttggtactatttacactaatgtagaggatataattcaacaaactaatgaattaattagaactctaaatggc

SEQ ID NO: 309231 - DNA, 75 bp, Artificial Sequence
  Synthetic
gaattttggttacacactaatatacatgagctactgccgtacaaattactttattatgaacgaggaatgagaaaa

SEQ ID NO: 309232 - DNA, 75 bp, Artificial Sequence
  Synthetic
tattctatataagtacatttatgaaaaagatgcaattatgagcggcgatgactattctgagttatatgatgataa

SEQ ID NO: 309233 - DNA, 75 bp, Artificial Sequence
  Synthetic
aaagatgcaattatgagcggcgatgactattctgagttatatgatgataaaaattttagaaacttcgttcatttt

SEQ ID NO: 309234 - DNA, 75 bp, Artificial Sequence
  Synthetic
ctttcaattaccacagctaggtactacacttttaaatttagatgataattatgtccaggctactagaagtattat

SEQ ID NO: 309235 - DNA, 75 bp, Artificial Sequence
  Synthetic
acacttttaaatttagatgataattatgtccaggctactagaagtattattgattatttagcttcatttatagag

SEQ ID NO: 309236 - DNA, 75 bp, Artificial Sequence
  Synthetic
tagagtaactcgatctcgcgcattttttaagagtaaaatacatattggtttgcgtaatgaatctataccacaagc

SEQ ID NO: 309237 - DNA, 75 bp, Artificial Sequence
  Synthetic
tttaagagtaaaatacatattggtttgcgtaatgaatctataccacaagcattagataacataaactcacagtgg

SEQ ID NO: 309238 - DNA, 75 bp, Artificial Sequence
  Synthetic
gcctcaatcacctacacttattgcactatcttcatcaaagtttaaaactattaatttcaataacagctcacaatc

SEQ ID NO: 309239 - DNA, 75 bp, Artificial Sequence
  Synthetic
ctatcttcatcaaagtttaaaactattaatttcaataacagctcacaatctattaaaaattggagtgctcaatca

SEQ ID NO: 309240 - DNA, 75 bp, Artificial Sequence
  Synthetic
aagttattcagaaaagagaataagtgaatttgacattggacagtttaaaaactacatgaactttctcacattaat

SEQ ID NO: 309241 - DNA, 75 bp, Artificial Sequence
  Synthetic
gaatttgacattggacagtttaaaaactacatgaactttctcacattaatgttctacattaaaaacatgaaaaaa

SEQ ID NO: 309242 - DNA, 75 bp, Artificial Sequence
  Synthetic
caggaattcatacattcttcaacgcgccaatgcgcagttcggaaacgtaatgggattgaggtattatacaactag

SEQ ID NO: 309243 - DNA, 75 bp, Artificial Sequence
  Synthetic
gccaatgcgcagttcggaaacgtaatgggattgaggtattatacaactagtaacatttgtcaaattgcagctttt

SEQ ID NO: 309244 - DNA, 75 bp, Artificial Sequence
  Synthetic
aatgaaaagatattttactataataacatatgatgacaagatagttgatagcacagaacatcataatagatactt

SEQ ID NO: 309245 - DNA, 75 bp, Artificial Sequence
  Synthetic
acatatgatgacaagatagttgatagcacagaacatcataatagatacttttcagaagaagacattactaaagta

SEQ ID NO: 309246 - DNA, 75 bp, Artificial Sequence
  Synthetic
taatggtagacttaaaagaccaatctctaatgtattaatgaaaattgaggctggagctcagaacatcagtagtcc

SEQ ID NO: 309247 - DNA, 75 bp, Artificial Sequence
  Synthetic
tctaatgtattaatgaaaattgaggctggagctcagaacatcagtagtccaacagttctacctgatccaacaaat

SEQ ID NO: 309248 - DNA, 75 bp, Artificial Sequence
  Synthetic
ctggaagaagagaagacaattagtggaagaagagacaaagcgatggctagaaatatcatatagactgttggaggg

SEQ ID NO: 309249 - DNA, 75 bp, Artificial Sequence
  Synthetic
gaagaagagacaaagcgatggctagaaatatcatatagactgttggagggcaaatatgtggaagcagtattgttg

SEQ ID NO: 309250 - DNA, 75 bp, Artificial Sequence
  Synthetic
tattgagttctacaataatggacaattagttgatatgattagaaatatgggagtagttactgttagaacatttga

SEQ ID NO: 309251 - DNA, 75 bp, Artificial Sequence
  Synthetic
tccaacgacgtatcggaagagtgagtactacctgcttattgacaagcagattattaaaaaacaaaaagtgaaagt

SEQ ID NO: 309252 - DNA, 75 bp, Artificial Sequence
  Synthetic
atgttcagagaacattcccacaagggggtccttatccataccaagctgcatatatgctaacacttagtgtattag

SEQ ID NO: 309253 - DNA, 75 bp, Artificial Sequence
  Synthetic
tactacctgcttattgacaagcagattattaaaaaacaaaaagtgaaagtcaccaaatcactgatgtataatgct

SEQ ID NO: 309254 - DNA, 75 bp, Artificial Sequence
  Synthetic
atgcgacaacagaatctgtcctatgtgattcacactctgtagactattcaatcgttgcaaacgttagaagagact

SEQ ID NO: 309255 - DNA, 75 bp, Artificial Sequence
  Synthetic
aagaggtaaaactgaaggagtcgtggcgctgtactgtttatcaaacacaataaatcaaaaagataaagtgataca

SEQ ID NO: 309256 - DNA, 75 bp, Artificial Sequence
  Synthetic
cagcaatgccagctggaacagtatttcagccaggatttccatgggaacaaacattatccaactacactgttgctc

SEQ ID NO: 309257 - DNA, 75 bp, Artificial Sequence
  Synthetic
gcgctgtactgtttatcaaacacaataaatcaaaaagataaagtgatacagtatgctaattcattctcagggaca

SEQ ID NO: 309258 - DNA, 75 bp, Artificial Sequence
  Synthetic
acattatccaactacactgttgctcaggaagataatctagaaagacttttgctagttgcgtccgtgaagagaatg

SEQ ID NO: 309259 - DNA, 75 bp, Artificial Sequence
  Synthetic
tttaaacaatgcagattatacatttctaccatcagattttgtttgtccagtaaatactgtactaacatcatatag

SEQ ID NO: 309260 - DNA, 75 bp, Artificial Sequence
  Synthetic
ctaccatcagattttgtttgtccagtaaatactgtactaacatcatatagagggtatgctggagtatttggttat

SEQ ID NO: 309261 - DNA, 75 bp, Artificial Sequence
  Synthetic
tccgaatgcaagggatgaaaacaacttcgatacattcgcatcacatctaggattgtcaagatactctcattcaaa

SEQ ID NO: 309262 - DNA, 75 bp, Artificial Sequence
  Synthetic
ttcgatacattcgcatcacatctaggattgtcaagatactctcattcaaaaagattctcagaatcagcgacaact

SEQ ID NO: 309263 - DNA, 75 bp, Artificial Sequence
  Synthetic
agacacagataaagcgaattacgcatctggtcatgtttttaatgccatagcacattatagatttgattatacata

SEQ ID NO: 309264 - DNA, 75 bp, Artificial Sequence
  Synthetic
tctggtcatgtttttaatgccatagcacattatagatttgattatacatatgacattgtgggctggctaagattg

SEQ ID NO: 309265 - DNA, 75 bp, Artificial Sequence
  Synthetic
tagtgatgaagtacggaatgcaatagaagcagcgtatacgtattacttactggatggtgatagagttggtaaaga

SEQ ID NO: 309266 - DNA, 75 bp, Artificial Sequence
  Synthetic
aaagaatacgcaaagaaaattatggagatctgggaggctcaagtgtgaggctaactacctctacctcatgatgta

SEQ ID NO: 309267 - DNA, 75 bp, Artificial Sequence
  Synthetic
tgaatgatacgttacactctattattcaagatccaggaatggcgtattttccatatatcgcatctgttctaactg

SEQ ID NO: 309268 - DNA, 75 bp, Artificial Sequence
  Synthetic
ggatcaacgcaatgaaatggtggaagattttttacactatagttgattatataaacgtatttattcaatcaatgg

SEQ ID NO: 309269 - DNA, 75 bp, Artificial Sequence
  Synthetic
agaacgtcaaaatgttcatacaaagtaattaaatattgtatggttacgatcattaatactcttctaaagttggct

SEQ ID NO: 309270 - DNA, 75 bp, Artificial Sequence
  Synthetic
taattaaatattgtatggttacgatcattaatactcttctaaagttggctggttataaagaacaggttactacca

SEQ ID NO: 309271 - DNA, 75 bp, Artificial Sequence
  Synthetic
ggctttaaatttttcagatcactttgctctacgaagcaatggagttcatcaaccaaactttcttctctgactata

SEQ ID NO: 309272 - DNA, 75 bp, Artificial Sequence
  Synthetic
caactggagatgattgacaaattgacaactcgtgaaattgaacaggtcgaattacttaagcgtatacatgataaa

SEQ ID NO: 309273 - DNA, 75 bp, Artificial Sequence
  Synthetic
aaccaaactttcttctctgactatagtgaagggaaaatagacactattccatatgctctaggaatcgttctcgcg

SEQ ID NO: 309274 - DNA, 75 bp, Artificial Sequence
  Synthetic
caactcgtgaaattgaacaggtcgaattacttaagcgtatacatgataaattagttactagaccagttgatgcta

SEQ ID NO: 309275 - DNA, 75 bp, Artificial Sequence
  Synthetic
tgggaaagcggaaaaaatccatatgaaccatcagaagtgactgcatctatgtgagaggttgagttgccgtcgtct

SEQ ID NO: 309276 - DNA, 75 bp, Artificial Sequence
  Synthetic
actcagaaaatttatcatcacctcaaaaactgtgattggtaaattcaagattgaaaacaacactagtcatcagaa

SEQ ID NO: 309277 - DNA, 75 bp, Artificial Sequence
  Synthetic
aaaactgtgattggtaaattcaagattgaaaacaacactagtcatcagaatgacgatattcataaagaatatgaa

SEQ ID NO: 309278 - DNA, 75 bp, Artificial Sequence
  Synthetic
tgctggaaggattaacggtcaattattcactaatgatatttcatatgatggaaacattgaaggtgtgataaatgt

SEQ ID NO: 309279 - DNA, 75 bp, Artificial Sequence
  Synthetic
gaaacattgaaggtgtgataaatgtaacaaatccatttgatgttgaatcattatgcatttattttccaaacgctg

SEQ ID NO: 309280 - DNA, 75 bp, Artificial Sequence
  Synthetic
gaagctggtgctccaaatataagtaacccaactattttacctgatcctaataatcaaacaacttggctttttaat

SEQ ID NO: 309281 - DNA, 75 bp, Artificial Sequence
  Synthetic
tttagttataatccctgacgagccaaataactctgaggcaattgaacaaatagctgaatggatattaaacgtctg

SEQ ID NO: 309282 - DNA, 75 bp, Artificial Sequence
  Synthetic
atggcgtcttcactgtacgcacaattaatctcacaaaattactattctctaggaaatgaaattttatctgatcaa

SEQ ID NO: 309283 - DNA, 75 bp, Artificial Sequence
  Synthetic
ttgataatgttaaatatagaattcaaatgtcatcaactttgaatcaattacaatgtaaattgaaaaattgtgtaa

SEQ ID NO: 309284 - DNA, 75 bp, Artificial Sequence
  Synthetic
aattataagagtttctacatcatcgagttttgataattcattatcacctctaaataatggacaaacagcgcgatc

SEQ ID NO: 309285 - DNA, 75 bp, Artificial Sequence
  Synthetic
ccatatacatatcttaaaaatttacaacagccaacagttaaaactatagacatgaaaatgatgaaaaagatgaat

SEQ ID NO: 309286 - DNA, 75 bp, Artificial Sequence
  Synthetic
attcgttaagattcatattcagagtagtttcgactagtggatggtttattacaacaggagacataaatactagaa

SEQ ID NO: 309287 - DNA, 75 bp, Artificial Sequence
  Synthetic
acaattttatttcaaatagatcttatagaatgatagaaaataatactgttcatgaaataacgcccacaagaagct

SEQ ID NO: 309288 - DNA, 75 bp, Artificial Sequence
  Synthetic
tcccactattttgtcatttattaatcaggataatccactcatacggaatagaattactaatctaataaatcaatg

SEQ ID NO: 309289 - DNA, 75 bp, Artificial Sequence
  Synthetic
tacataactaaatatcaattaaaacttgaatgcacttttgacatttttctagaggatgatgggtcaattacatat

SEQ ID NO: 309290 - DNA, 75 bp, Artificial Sequence
  Synthetic
ttcgcccttgcatttaaaatctcattcacaatggatgtacttttttctatcgcgaagactgtgtcagatcttaaa

SEQ ID NO: 309291 - DNA, 75 bp, Artificial Sequence
  Synthetic
ctaaatggcaatgtttttcatactggtggaattggaacgcaacctcaaaaagaatggacttttcaactaccacag

SEQ ID NO: 309292 - DNA, 75 bp, Artificial Sequence
  Synthetic
gcatttaaaatctcattcacaatggacgtgctgttttccattgcgaagactgtctcagatcttaagaaaaaagtt

SEQ ID NO: 309293 - DNA, 75 bp, Artificial Sequence
  Synthetic
tgtctcagatcttaagaaaaaagttgtagttggtactatttatacgaatgtagaagatataatccagcagactaa

SEQ ID NO: 309294 - DNA, 75 bp, Artificial Sequence
  Synthetic
tgaattgattagaactctgaatggtaacacattccatactggtggaattggaacacaacctcagaaagaatggaa

SEQ ID NO: 309295 - DNA, 75 bp, Artificial Sequence
  Synthetic
gctcaatcaaggcgtgaaaatccagtttatgaatacaaaaatccaatggtatttgaatacagaaattcatacatt

SEQ ID NO: 309296 - DNA, 75 bp, Artificial Sequence
  Synthetic
tttatgaatacaaaaatccaatggtatttgaatacagaaattcatacattttacaacgtgctaatgcgcaatttg

SEQ ID NO: 309297 - DNA, 75 bp, Artificial Sequence
  Synthetic
tgattatttggcctcattcatagaagctgtgtgtgatgacgaaattgttagagaagcatcaaggaacggaatgca

SEQ ID NO: 309298 - DNA, 75 bp, Artificial Sequence
  Synthetic
gcagctttcgattcaacatttgctgagaacgcaccaaataatactcagcgtttcatttacaatgggagacttaaa

SEQ ID NO: 309299 - DNA, 75 bp, Artificial Sequence
  Synthetic
ttaattttaacaatagctcacaatccataaaaaattggagtgctcagtcaagacgtgaaaatccagtttatgaat

SEQ ID NO: 309300 - DNA, 75 bp, Artificial Sequence
  Synthetic
agaacgcaccaaataatactcagcgtttcatttacaatgggagacttaaaaggccaatttctaacgtcttaatga

SEQ ID NO: 309301 - DNA, 75 bp, Artificial Sequence
  Synthetic
cataaaaaattggagtgctcagtcaagacgtgaaaatccagtttatgaatatagaaacccaatggtgtttgaata

SEQ ID NO: 309302 - DNA, 75 bp, Artificial Sequence
  Synthetic
ccaacaaaccagacaacgtggttatttaatccagtgcaagtgatgaatggaacttttactattgaattttacaat

SEQ ID NO: 309303 - DNA, 75 bp, Artificial Sequence
  Synthetic
tgggattgagatattacacagccagtaatgcctgtcagattgcggcttttgattcaactctcgctgaaaatgctc

SEQ ID NO: 309304 - DNA, 75 bp, Artificial Sequence
  Synthetic
ttaatccagtgcaagtgatgaatggaacttttactattgaattttacaataatggtcaactagtagacatgatta

SEQ ID NO: 309305 - DNA, 75 bp, Artificial Sequence
  Synthetic
gattcaactctcgctgaaaatgctcctaatggcactcaacggtttatctataatggaagacttaaaagaccaatc

SEQ ID NO: 309306 - DNA, 75 bp, Artificial Sequence
  Synthetic
gttgatgtgattagaccagcagccatgactcaatacgttcagagattttttccgcagggtggtccatacactcat

SEQ ID NO: 309307 - DNA, 75 bp, Artificial Sequence
  Synthetic
tccgcagggtggtccatacactcatcaagctgcatatatgctatcattgagtatactggatgttacaactgagtc

SEQ ID NO: 309308 - DNA, 75 bp, Artificial Sequence
  Synthetic
tattgaattttataataatggacagttggttgatttgattagaaatatgggagtggttactgttagaacatttga

SEQ ID NO: 309309 - DNA, 75 bp, Artificial Sequence
  Synthetic
atcagaccagcagctatgacacagtatgtacaaagactgtttccacaaggtgggccatatcaatatcaagctgcg

SEQ ID NO: 309310 - DNA, 75 bp, Artificial Sequence
  Synthetic
cagcaactaatctcacaaaattattattcaactggaaatgaaattttgttagataaacagactgataaaactact

SEQ ID NO: 309311 - DNA, 75 bp, Artificial Sequence
  Synthetic
acattatccaactacactgttgctcaggaagacaatttagaaagacttttactggttgcgtctgtgaagagaatg

SEQ ID NO: 309312 - DNA, 75 bp, Artificial Sequence
  Synthetic
agagtggggagcagggtcaaccttcgaatctacgttcagatcatcaaatataactggtccacacaataatacagt

SEQ ID NO: 309313 - DNA, 75 bp, Artificial Sequence
  Synthetic
gaatctacgttcagatcatcaaatataactggtccacacaataatacagtcatagaatggggtaatttaataaat

SEQ ID NO: 309314 - DNA, 75 bp, Artificial Sequence
  Synthetic
aattatggtaatgtagcagcttttgaactatggtatggtaaagctggtcataccgtaacatcaatatattattca

SEQ ID NO: 309315 - DNA, 75 bp, Artificial Sequence
  Synthetic
ttacgttaacatcagattcattagttctattttggaacgaaggtcaaacgacactggataaaaagatagtcaatt

SEQ ID NO: 309316 - DNA, 75 bp, Artificial Sequence
  Synthetic
aatgagaatgttaaaatgaaagtaaaagctgttatgattgcgtgtaatttagtgaatgaaattgaaataacacct

SEQ ID NO: 309317 - DNA, 75 bp, Artificial Sequence
  Synthetic
acaatacggatggtactagttttaattggattcaatggaagcatgagtttccccgtagcagtagtaatgctaatg

SEQ ID NO: 309318 - DNA, 75 bp, Artificial Sequence
  Synthetic
cttaaagagttgcaaagaccatcagtaacaactataaacatgcaaatgatgaagactacaaatggagatctaatt

SEQ ID NO: 309319 - DNA, 75 bp, Artificial Sequence
  Synthetic
attcattatggcaagaaatgagatacgtaagagatataactctggaatgtaagatagagtcagaagtaatcaaag

SEQ ID NO: 309320 - DNA, 75 bp, Artificial Sequence
  Synthetic
cgtcactatatagcgtcaaaacgtcaaaagtggtacgcacagcagcaaataaaattgaaagtgatttgatttcta

SEQ ID NO: 309321 - DNA, 75 bp, Artificial Sequence
  Synthetic
tatattgattattgggatgattcagatatgttcaaaaatatggtgtacgtacgcgatctaagagcggatgtcact

SEQ ID NO: 309322 - DNA, 75 bp, Artificial Sequence
  Synthetic
atgataagcagaaatagacgtaaaaatgctcaacaaaagatagtggaaagagaagagaaagtagaagatgttaat

SEQ ID NO: 309323 - DNA, 75 bp, Artificial Sequence
  Synthetic
agtacatcccagaataaattcatctggaatagaattcacatatgagaaatgtatgttatctcaacagttcactga

SEQ ID NO: 309324 - DNA, 75 bp, Artificial Sequence
  Synthetic
atttacagaaaaatgatttagttaaagaagtagtgaacatgcaggctcaaacattgaatacaattgtggctgata

SEQ ID NO: 309325 - DNA, 75 bp, Artificial Sequence
  Synthetic
tttatatttaaagtaacgtctgcaaatggttggtttatgacctcaggcggtccgaatacaagacgtatagcatca

SEQ ID NO: 309326 - DNA, 75 bp, Artificial Sequence
  Synthetic
gctatcatttatatctttgatcccaagtaatccaaattaccaaacacctattgcatcatcaagcacagtaagaat

SEQ ID NO: 309327 - DNA, 75 bp, Artificial Sequence
  Synthetic
ctagttcagtagctctaggtgatattatgtccttagctatgtcgcccttaactttttctaacttacttgaatctg

SEQ ID NO: 309328 - DNA, 75 bp, Artificial Sequence
  Synthetic
aaatttagaaatacaaagatgtttaagaaggctacaaaacccaagtataaagaatttataattggtgatttactt

SEQ ID NO: 309329 - DNA, 75 bp, Artificial Sequence
  Synthetic
tgacaaactggtcttctttttaaatggtttgtacgacattgtacactgtttgcgttatactttgcatccttttta

SEQ ID NO: 309330 - DNA, 75 bp, Artificial Sequence
  Synthetic
attataactctaataatatccaactgtattggatggacgcatggtcaaatgtttactgatgatatacgctatgat

SEQ ID NO: 309331 - DNA, 75 bp, Artificial Sequence
  Synthetic
gtattggatggacgcatggtcaaatgtttactgatgatatacgctatgatggaaacgttgaaacagttattaatg

SEQ ID NO: 309332 - DNA, 75 bp, Artificial Sequence
  Synthetic
gttgtaggatctcaaggacctggtcaaacaaatggttatttaaatgacggtaattatgctcaaacgattgctact

SEQ ID NO: 309333 - DNA, 75 bp, Artificial Sequence
  Synthetic
aaggttcagtgatacttaaaacatatactaaaacttcagatttcattaattcggtggagatgacttgttcgtata

SEQ ID NO: 309334 - DNA, 75 bp, Artificial Sequence
  Synthetic
atagcggaatggattctgaatgtttggagatgtgatgatatggatttaaacatatatacttatgaacaaacagga

SEQ ID NO: 309335 - DNA, 75 bp, Artificial Sequence
  Synthetic
ggagatgtgatgatatggatttaaacatatatacttatgaacaaacaggaataaataatttatgggctgcttttg

SEQ ID NO: 309336 - DNA, 75 bp, Artificial Sequence
  Synthetic
attggatgttcacctgcgagcacgcagacgtatgaagtattatcaaatgacacacaattagcattgattaatgtt

SEQ ID NO: 309337 - DNA, 75 bp, Artificial Sequence
  Synthetic
agacgtatgaagtattatcaaatgacacacaattagcattgattaatgttgtggacaatgtaaaacatagaattc

SEQ ID NO: 309338 - DNA, 75 bp, Artificial Sequence
  Synthetic
agattaaataccgcaatagtgagaatttcaacatcatcaagttttgataactcgttgtcaccgttaaacaacgga

SEQ ID NO: 309339 - DNA, 75 bp, Artificial Sequence
  Synthetic
ttacacgataattgactacattaatatgattgtgcaaacaatgactcccagacatagggctatttatccggaagg

SEQ ID NO: 309340 - DNA, 75 bp, Artificial Sequence
  Synthetic
atgattgtgcaaacaatgactcccagacatagggctatttatccggaaggctggatgctgagatatgcgtaaaca

SEQ ID NO: 309341 - DNA, 75 bp, Artificial Sequence
  Synthetic
gaataattatgaataatagagagttgattgaaaagacatctgaaagaatatgtcaaggtgtgctactatcttata

SEQ ID NO: 309342 - DNA, 75 bp, Artificial Sequence
  Synthetic
gctttcattgtggcaattgtcatatcaaattgcgtcggatggtcacaaggtcaattatttactgatgacatatat

SEQ ID NO: 309343 - DNA, 75 bp, Artificial Sequence
  Synthetic
aacatataccaaggtttcagattttatagactcagtagaaatgacatgctcatataacatagttataatacctga

SEQ ID NO: 309344 - DNA, 75 bp, Artificial Sequence
  Synthetic
ggtaatgttgaaggtgtaattaatacgacaaatatttttaatgttgaatctctttgtatttactttccaaattct

SEQ ID NO: 309345 - DNA, 75 bp, Artificial Sequence
  Synthetic
tttcgctaatgacatgctttatgatggtaatgttgaaggtgtaattaatacgacaaatatttttaatgttgaatc

SEQ ID NO: 309346 - DNA, 75 bp, Artificial Sequence
  Synthetic
acgtttggagatgtgatgatatgaatttagatatttacacttatgaacaaactggaatagataatttgtgggctg

SEQ ID NO: 309347 - DNA, 75 bp, Artificial Sequence
  Synthetic
gtacggaaacatatgaagtgttatcaaatgatacacaacttgcattgattaatgttgtagataacataaaacata

SEQ ID NO: 309348 - DNA, 75 bp, Artificial Sequence
  Synthetic
gaagccaggttaaatactgcattaataagaatttccacatcatcaagcttcgacaattcattaccaccattaaat

SEQ ID NO: 309349 - DNA, 75 bp, Artificial Sequence
  Synthetic
taagaatttccacatcatcaagcttcgacaattcattaccaccattaaatgatggtcaaacaactcgatcattta

SEQ ID NO: 309350 - DNA, 75 bp, Artificial Sequence
  Synthetic
acaatgactcctagacatagggccatttatccagaagggtggatgctgagatatgcgtaaacaagatcatgtggc

SEQ ID NO: 309351 - DNA, 75 bp, Artificial Sequence
  Synthetic
gtcattacagaagatggaaatgataacgtgaaagatatgaaggaacaatcgaacaatgcaaatttacagaaaaat

SEQ ID NO: 309352 - DNA, 75 bp, Artificial Sequence
  Synthetic
cttggatgagtgtaagttgtctgtttgtgatgattgtggaattaaacatgtgtgtgaaagttgcgtgtcgtcaga

SEQ ID NO: 309353 - DNA, 75 bp, Artificial Sequence
  Synthetic
catcatacaccacagatgaactagtaattaaaaaactgactgagattcaggaatcaagtgctaaaacatataaca

SEQ ID NO: 309354 - DNA, 75 bp, Artificial Sequence
  Synthetic
aaatttcaactaaatgaagggaagaaacaagcgctgtctgttccaatcactgcacaatattttaaattctcactt

SEQ ID NO: 309355 - DNA, 75 bp, Artificial Sequence
  Synthetic
ggagaaagaaaactgtcaactagatggtattggaagttattgaaagatgatttaccagctggtgattattcagtt

SEQ ID NO: 309356 - DNA, 75 bp, Artificial Sequence
  Synthetic
accttggttgcaactatctgaattgaatattggctacttacaatcattgaatgttgatagatgtgctgaattact

SEQ ID NO: 309357 - DNA, 75 bp, Artificial Sequence
  Synthetic
tcagaagatatatggcagatttgcgacataaaatatcaggtgaagcaaacaccgcaaaatacccagcaattttac

SEQ ID NO: 309358 - DNA, 75 bp, Artificial Sequence
  Synthetic
cagaattaattccaacccaattgtaccacgatccaaattacgtctttaatattgatgctgctttcttaacaaatt

SEQ ID NO: 309359 - DNA, 75 bp, Artificial Sequence
  Synthetic
agaaggcagtttatgaatgagatagtggaatggtttgaattgctctcacagtacacaggtgtgcattatgatttt

SEQ ID NO: 309360 - DNA, 75 bp, Artificial Sequence
  Synthetic
acatatcttaaatttgagaaaatcattgatgctcgccattgatatggcattgcttagaattggatctcaaagtat

SEQ ID NO: 309361 - DNA, 75 bp, Artificial Sequence
  Synthetic
ggcttcatcactgtaacactctacagtttggaagacaagtgactgaaggagtcattcatctaagattcactaatg

SEQ ID NO: 309362 - DNA, 75 bp, Artificial Sequence
  Synthetic
tttcaaagttgtatatatttgatgctccaaaaattccaccagatcaaatgtatagactaagaaacaggttaagaa

SEQ ID NO: 309363 - DNA, 75 bp, Artificial Sequence
  Synthetic
tgatgtgttcagaataattatgaataatagagaattgattgaaaagacatctgaaagaatatgtcaaggtgtact

SEQ ID NO: 309364 - DNA, 75 bp, Artificial Sequence
  Synthetic
tttatgactttgatgacgtcacgtatcagaacaactatttcgtcacagatgaatttaagacagatttagacacgt

SEQ ID NO: 309365 - DNA, 75 bp, Artificial Sequence
  Synthetic
ttagcggaaaaaatattattgtctaaagtgccagataaagatcgatgtttaatttcaaaattagtatttgcatat

SEQ ID NO: 309366 - DNA, 75 bp, Artificial Sequence
  Synthetic
aatttcaaaattagtatttgcatatggtaagcatggaaacgtggaaaataagttactaaaatatggcactaaaga

SEQ ID NO: 309367 - DNA, 75 bp, Artificial Sequence
  Synthetic
gtgttgccaataaatgccgtttcatttgacggtgcaagaattatgcaggaaacgtaaaatgattaatcatattat

SEQ ID NO: 309368 - DNA, 75 bp, Artificial Sequence
  Synthetic
tgcgtgattctctgcattctgctaatgtatataatactgttcagaaaaatgattcattttctaatcgacttgtca

SEQ ID NO: 309369 - DNA, 75 bp, Artificial Sequence
  Synthetic
agagtgatggtttgattaatgacaacaactacgctcaaacactagcagttctttttgaaacaaaaggatttccta

SEQ ID NO: 309370 - DNA, 75 bp, Artificial Sequence
  Synthetic
tcaattgaaatgacatgttcttataacatagttataattcctgaaactctagctaattctgaaacgattgaacaa

SEQ ID NO: 309371 - DNA, 75 bp, Artificial Sequence
  Synthetic
gaaatgtataaagaatattcagaacgtattgagaatgaaattttttcaattttaaaagataaagtgattcatgaa

SEQ ID NO: 309372 - DNA, 75 bp, Artificial Sequence
  Synthetic
tgcttcaaacggtgtattgaaagagatagattttggaggacagaaagtgaggtctaccaaaaagaatatgcatgt

SEQ ID NO: 309373 - DNA, 75 bp, Artificial Sequence
  Synthetic
gtggataatgtgaaacatagaatacaactgaatcaagtaacgtgtaaattgagaaattgtgtgaaaggtgaagca

SEQ ID NO: 309374 - DNA, 75 bp, Artificial Sequence
  Synthetic
ttccaattaataagaaagctataaaaactatgctgtgtgcaagagtggaaaaggaacagagaagtaattactatg

SEQ ID NO: 309375 - DNA, 75 bp, Artificial Sequence
  Synthetic
taatgaaaatatccataaagcaattgacacatataccaagtcacagaagaatttagaaaattcgtatgtattgat

SEQ ID NO: 309376 - DNA, 75 bp, Artificial Sequence
  Synthetic
tcatattttacaattactaagctagattacatgaatcataaaattctacctttgatggctgatgaatataagatt

SEQ ID NO: 309377 - DNA, 75 bp, Artificial Sequence
  Synthetic
aacgtcattggagattggtcttgcactcacagttgatgtctcatgctgagagattggataggaaaattaaatctg

SEQ ID NO: 309378 - DNA, 75 bp, Artificial Sequence
  Synthetic
cattacgaggtctgacgatgtctcgcattttcattctaacaaaaatttgtcaaatgacatcaattaaaatcactg

SEQ ID NO: 309379 - DNA, 75 bp, Artificial Sequence
  Synthetic
ttctatggtaggaaattaagaatgtaatgagtgaaggttacaagcaacaggaatagcagctgtgcatatgtggct

SEQ ID NO: 309380 - DNA, 75 bp, Artificial Sequence
  Synthetic
ttgccttaattgtttggatgagtgtagattgtctgtttgtaatgattgtggaattaagcatgtgtgtgaaaattg

SEQ ID NO: 309381 - DNA, 75 bp, Artificial Sequence
  Synthetic
ctgcttgcattacaaagatagcatgtaagagaccaatcagtgaaggtgattacgtggttgaagcttatttagaaa

SEQ ID NO: 309382 - DNA, 75 bp, Artificial Sequence
  Synthetic
gtttgctgctgtgattgggaggaagaaaatacctgtgccacaaagtttagctatgaaatattttcttaaatcaat

SEQ ID NO: 309383 - DNA, 75 bp, Artificial Sequence
  Synthetic
ctatgaaatattttcttaaatcaattgatacagaattgttttactatgcacattcaagatgccatccactatcag

SEQ ID NO: 309384 - DNA, 75 bp, Artificial Sequence
  Synthetic
gagaatctttagtgtgtctacaatagatatagtctttagaaggcagtttatgaatgagatagtggaatggtttga

SEQ ID NO: 309385 - DNA, 75 bp, Artificial Sequence
  Synthetic
gatatagtctttagaaggcagtttatgaatgagatagtggaatggtttgaattgctttcacagtatataggtgcg

SEQ ID NO: 309386 - DNA, 75 bp, Artificial Sequence
  Synthetic
atttaaaaaagaaattgaagaatatattgagaatggtaagaaaataacactgagctcaattctaccagaagagca

SEQ ID NO: 309387 - DNA, 75 bp, Artificial Sequence
  Synthetic
ttgagaaaatcactgatgctcgccattgatatggcattgcttagaattagatctcaaagtatgggcgtgctgtga

SEQ ID NO: 309388 - DNA, 75 bp, Artificial Sequence
  Synthetic
cttgctagtgactatcttaggtttgtttatgactttgacgacgtcacgtatcagaacaactatttcgtcacagat

SEQ ID NO: 309389 - DNA, 75 bp, Artificial Sequence
  Synthetic
ttatcacttctgaaatatttaaagatgaatcagaatatactgatacatatatggatccagctataaacacatcat

SEQ ID NO: 309390 - DNA, 75 bp, Artificial Sequence
  Synthetic
tgctacaataaataaatatggcatgccaagacataatgtgaggtaccgttatgagtggcagactatgcgagataa

SEQ ID NO: 309391 - DNA, 75 bp, Artificial Sequence
  Synthetic
gatagcaaaagaattgatagtaaaatctttcacgaatagaacatctctagcgaaattagtgtcatcacctatgac

SEQ ID NO: 309392 - DNA, 75 bp, Artificial Sequence
  Synthetic
gagtaagatttacatatgagagaagtctattatctcagcaatttactgatcaggtagcacttaattcaatgagat

SEQ ID NO: 309393 - DNA, 75 bp, Artificial Sequence
  Synthetic
atgccgtgtatgaccagattacagttacgtataatgataatgtgaacatggaaatgtataaagagtattcagaac

SEQ ID NO: 309394 - DNA, 75 bp, Artificial Sequence
  Synthetic
gataagagactggaggagtatgagctgtctgctttactatcaatgtcatctgcttcaaacggtgtattgaaggag

SEQ ID NO: 309395 - DNA, 75 bp, Artificial Sequence
  Synthetic
gatctactaaaaagaatatgcatgtgattgatgatatgtataatgggaagtatacaacagatataccgccagtgg

SEQ ID NO: 309396 - DNA, 75 bp, Artificial Sequence
  Synthetic
tatcttgactctaatagtatattatgctttactgatgtatcacaatgggatgcttctcaacataacactagagtc

SEQ ID NO: 309397 - DNA, 75 bp, Artificial Sequence
  Synthetic
caacgaaaatattcacaaagcaattgacacgtacactaagtctcagaagaatttggaaaattcttatgtattgat

SEQ ID NO: 309398 - DNA, 75 bp, Artificial Sequence
  Synthetic
gcgtcaaaatcaccagtaatatcagcaatagtagactttgcaacattaaaggctatgagagatacatatggcgtt

SEQ ID NO: 309399 - DNA, 75 bp, Artificial Sequence
  Synthetic
ctaaaattatgaattcaatagctaataaggctctcatacagacagtgctagggaagttaatgatggattacgctt

SEQ ID NO: 309400 - DNA, 75 bp, Artificial Sequence
  Synthetic
atcattcattaataataacaatccgctgattagaaatagaatagaaggattgttgagacaatgtagaatataaaa

SEQ ID NO: 309401 - DNA, 75 bp, Artificial Sequence
  Synthetic
atgagggtattggggctttttgaacgcgggaacaatctgaacttcgcagacacatatgtttatacatggaataga

SEQ ID NO: 309402 - DNA, 75 bp, Artificial Sequence
  Synthetic
caccatagttatatatctagacaaaggaattgtgaaccaagtgaatgaagcatttaatcttttaaattcaaacgg

SEQ ID NO: 309403 - DNA, 75 bp, Artificial Sequence
  Synthetic
ggaattgtgaaccaagtgaatgaagcatttaatcttttaaattcaaacggaatacctgcgttaataattagatct

SEQ ID NO: 309404 - DNA, 75 bp, Artificial Sequence
  Synthetic
acgtattatagaaataatgaatttattgtaagtgatgagttctggttaagtactggcatacaagatttattgcca

SEQ ID NO: 309405 - DNA, 75 bp, Artificial Sequence
  Synthetic
agagtatatattgtacaatactgcaactgacgatgacattatatacaaatacatttatgaaaaagatgtgataat

SEQ ID NO: 309406 - DNA, 75 bp, Artificial Sequence
  Synthetic
actgacgatgacattatatacaaatacatttatgaaaaagatgtgataatgtccggtgatgattattctaaacta

SEQ ID NO: 309407 - DNA, 75 bp, Artificial Sequence
  Synthetic
aatgcgatttgccgtaccattcgatcagttgtcaaatagagtcacacgatccagagcttttgctagaagtaaaat

SEQ ID NO: 309408 - DNA, 75 bp, Artificial Sequence
  Synthetic
cagttgtcaaatagagtcacacgatccagagcttttgctagaagtaaaatacatattgggctgagaaatgaatca

SEQ ID NO: 309409 - DNA, 75 bp, Artificial Sequence
  Synthetic
cttacactaatgttttacattaagaatatgaaaaagaaaccgtcatgtacgataattggagctgctccaggatac

SEQ ID NO: 309410 - DNA, 75 bp, Artificial Sequence
  Synthetic
gataattggagctgctccaggatactggataccttcgatgaagaaatattttaatataatcacttacgatgataa

SEQ ID NO: 309411 - DNA, 75 bp, Artificial Sequence
  Synthetic
tttgtgcactttccgaccacgtacagaagaagtgagtattatctgttagttgataagcaaactgtaaaaagagcg

SEQ ID NO: 309412 - DNA, 75 bp, Artificial Sequence
  Synthetic
gattatctgaaactgtggcgaatgctgtggaaagttaagacaatgaattcaccttattcaaaaaattctatattt

SEQ ID NO: 309413 - DNA, 75 bp, Artificial Sequence
  Synthetic
aaggagtgctagcattatattgtttgtcaaatacaataaatccaaaagagaaagtggtgcaatatgcaaattcat

SEQ ID NO: 309414 - DNA, 75 bp, Artificial Sequence
  Synthetic
ccaccactataattatatatctagataaagaaattgtaaaccaagtgaatgaagcatttaatcttttgaattcaa

SEQ ID NO: 309415 - DNA, 75 bp, Artificial Sequence
  Synthetic
ctgattatacattcttgccatcagatttccaatgttcaatcaaaaccatattgacatcatatagaggctatgctg

SEQ ID NO: 309416 - DNA, 75 bp, Artificial Sequence
  Synthetic
catatttacatcattccaaattcaagagatgatgaaaattttgacactttcgcgtcacatttaggactatccaga

SEQ ID NO: 309417 - DNA, 75 bp, Artificial Sequence
  Synthetic
cgtggattgagaaagttatatgaaggtgaagagtatatattatataatactgcaactgacgatgacattatatat

SEQ ID NO: 309418 - DNA, 75 bp, Artificial Sequence
  Synthetic
tattcgcattctaagaggttttcagagtctgcaactactatgtcagggtatttatttagagatatggttggtggg

SEQ ID NO: 309419 - DNA, 75 bp, Artificial Sequence
  Synthetic
attatatgacactaaaagttttaaaaatttcgtacattttatgagactacttagaatgcggtttgctgtaccatt

SEQ ID NO: 309420 - DNA, 75 bp, Artificial Sequence
  Synthetic
cgatcagttgtcaaatagagtcacacgatctcgagcttttgctaaaagtaaaatacacattggactgagaaatga

SEQ ID NO: 309421 - DNA, 75 bp, Artificial Sequence
  Synthetic
ctggatggtgatgaagttggtaaagagtatgcaaaaaggatgatggagatctgggatgttcagatgtggggctaa

SEQ ID NO: 309422 - DNA, 75 bp, Artificial Sequence
  Synthetic
cagcaaacggaatgagggtatcagaattgaaaggatcaggaagttactctgaaaaaaagattagtgaatttgaca

SEQ ID NO: 309423 - DNA, 75 bp, Artificial Sequence
  Synthetic
aagcagaaacaggcgcagaaataaccaacaaaaagatataggaaaagagaaacaattagagactataattgacaa

SEQ ID NO: 309424 - DNA, 75 bp, Artificial Sequence
  Synthetic
caacaaaaagatataggaaaagagaaacaattagagactataattgacaaagaagtaaaggaaaacaaagattct

SEQ ID NO: 309425 - DNA, 75 bp, Artificial Sequence
  Synthetic
agctgttaaagaacaatcgaataatattaatttacaaaagaatgatttggttaaagaagtcatgaatatacagaa

SEQ ID NO: 309426 - DNA, 75 bp, Artificial Sequence
  Synthetic
gaagccgttttactgaaaatgacggccatggatattgagataccagatggatattttgtgcactttccaactacg

SEQ ID NO: 309427 - DNA, 75 bp, Artificial Sequence
  Synthetic
gctggcgtttttggctatgcgataaccaaagatttgaagtcggatgggaataatcacatctacatcattccaaat

SEQ ID NO: 309428 - DNA, 75 bp, Artificial Sequence
  Synthetic
tagatgctgaaaagcaaataaaagaaatggctgcacatttacaactagaggctattacagtacaggttgaatcac

SEQ ID NO: 309429 - DNA, 75 bp, Artificial Sequence
  Synthetic
gacaaactggtcttctttttaaatggtttgtacaacattgtacactgtttgcgttattctctgcattcttctaat

SEQ ID NO: 309430 - DNA, 75 bp, Artificial Sequence
  Synthetic
gcgttattctctgcattcttctaatttacatgttattatttagaaaaatgctccacctaataacagatacggtga

SEQ ID NO: 309431 - DNA, 75 bp, Artificial Sequence
  Synthetic
ttgtgacgataataatttctaattgtgtggggtggacacaaggtcaaatgttcattgatgatatgcattatgaag

SEQ ID NO: 309432 - DNA, 75 bp, Artificial Sequence
  Synthetic
ttgtaggatcacaggggcctggtcaaacaaatggttatttgaatgacggtaattatgctcatacaattgctactc

SEQ ID NO: 309433 - DNA, 75 bp, Artificial Sequence
  Synthetic
gctaaaacatcagattttatcagttctgtagagatgacatgttcatataacatagttataatacctgacgatcca

SEQ ID NO: 309434 - DNA, 75 bp, Artificial Sequence
  Synthetic
ctgtagagatgacatgttcatataacatagttataatacctgacgatccagataaatcagaagcaatcgaacaaa

SEQ ID NO: 309435 - DNA, 75 bp, Artificial Sequence
  Synthetic
atttacacttatgaacagattgggatagagaatctttgggctgcttttggtgatgattgtgatatatctgtttgt

SEQ ID NO: 309436 - DNA, 75 bp, Artificial Sequence
  Synthetic
tagagaatctttgggctgcttttggtgatgattgtgatatatctgtttgtccattagatactacaatgaatggaa

SEQ ID NO: 309437 - DNA, 75 bp, Artificial Sequence
  Synthetic
tgatgattgtgatatatctgtttgtccattagatactacaatgaatggaatcggatgtctacctgcgagtacaga

SEQ ID NO: 309438 - DNA, 75 bp, Artificial Sequence
  Synthetic
tggataatgtgaaacatagaattcagatgaatactggtcattgtaagttgaagaattgtgtgaagggtgaagcgc

SEQ ID NO: 309439 - DNA, 75 bp, Artificial Sequence
  Synthetic
gactaaatacggcaattataagaatttcaaaatcatcaagttttgataactcactgtcacctatgaataacggtc

SEQ ID NO: 309440 - DNA, 75 bp, Artificial Sequence
  Synthetic
tatacaataattgattatattaatacaattgttcaaacaatgaccccgagacatcgggcaatttatccagaaggc

SEQ ID NO: 309441 - DNA, 75 bp, Artificial Sequence
  Synthetic
aggtgtgattgactatttagcttcattcatagaagcagtgtgtgatgatgaaatagttagagaagcatctagaaa

SEQ ID NO: 309442 - DNA, 75 bp, Artificial Sequence
  Synthetic
ttctcagtctattaaaaattggagtgctcaatcaaggcgcgaaaatccagtctatgaatacagaaatccaatggt

SEQ ID NO: 309443 - DNA, 75 bp, Artificial Sequence
  Synthetic
caatgctttagcgagttcagttgcattaagtgatatactttccctagctatgtcgccattaacattttctaatct

SEQ ID NO: 309444 - DNA, 75 bp, Artificial Sequence
  Synthetic
ggctataaaatggcttcactcatttacaggcagttgcttacaaattcgtacacgactgatctatctgaagaaatc

SEQ ID NO: 309445 - DNA, 75 bp, Artificial Sequence
  Synthetic
cacgactgatctatctgaagaaatcaaagaaattggatcatcaaaatcacaagatgttacaataaatccaggacc

SEQ ID NO: 309446 - DNA, 75 bp, Artificial Sequence
  Synthetic
aaagaaattggatcatcaaaatcacaagatgttacaataaatccaggaccatttgctcacactggatatgctcca

SEQ ID NO: 309447 - DNA, 75 bp, Artificial Sequence
  Synthetic
actggatggaccataccaaccaacaactttcaatccaccagtagaatattggacattattcgctccaagtgataa

SEQ ID NO: 309448 - DNA, 75 bp, Artificial Sequence
  Synthetic
actttcaatccaccagtagaatattggacattattcgctccaagtgataagggtgtagttgctgaattgacaaat

SEQ ID NO: 309449 - DNA, 75 bp, Artificial Sequence
  Synthetic
agaattaaaaacatacactatattcggtcaacaagttaacctagtgattgaaaatacgtcacaaacaaaatggaa

SEQ ID NO: 309450 - DNA, 75 bp, Artificial Sequence
  Synthetic
ggtcaacaagttaacctagtgattgaaaatacgtcacaaacaaaatggaaatttgctgattttagaaaaagaagt

SEQ ID NO: 309451 - DNA, 75 bp, Artificial Sequence
  Synthetic
gcaggctgcaatgaaatacggagcaagactatttacattcactgggaacacaccgaacgcagcgccacaagaata

SEQ ID NO: 309452 - DNA, 75 bp, Artificial Sequence
  Synthetic
atttttacatcataccacgtatgccaagagaagtgtgtagaaactatattaaccatggtcttccaccaatgcaga

SEQ ID NO: 309453 - DNA, 75 bp, Artificial Sequence
  Synthetic
ataacccattaataagaaacagaatagaaggactactaagacaatgtaggatatagacagcgaggagatcgactt

SEQ ID NO: 309454 - DNA, 75 bp, Artificial Sequence
  Synthetic
caccgagcgagtgttaatgaagatattgttatatccaaaacttccttatggaaagaaatgcaatacaacagagat

SEQ ID NO: 309455 - DNA, 75 bp, Artificial Sequence
  Synthetic
ttgttatatccaaaacttccttatggaaagaaatgcaatacaacagagatattgtaatcagattcaaattcgcca

SEQ ID NO: 309456 - DNA, 75 bp, Artificial Sequence
  Synthetic
ttttacacaattattgactatattaacacaagtgtacagacaatgacgcctagacatagggccatttatccagga

SEQ ID NO: 309457 - DNA, 75 bp, Artificial Sequence
  Synthetic
tttaggccagcgaattatcaatatacgtatactagagatggagaagaagtcacagcgcacactacatgttcagtt

SEQ ID NO: 309458 - DNA, 75 bp, Artificial Sequence
  Synthetic
cgtatactagagatggagaagaagtcacagcgcacactacatgttcagttaatggagtgaacaattttagttata

SEQ ID NO: 309459 - DNA, 75 bp, Artificial Sequence
  Synthetic
ttaaatggtttgtacaactttgtacacagtttgcgcaattctttgcatcctattactgtatacattgtttcttag

SEQ ID NO: 309460 - DNA, 75 bp, Artificial Sequence
  Synthetic
aaagagaattcatttgtgtatatagactactgggatgattcgcaagcatttagaaatatggtatatgtaagatca

SEQ ID NO: 309461 - DNA, 75 bp, Artificial Sequence
  Synthetic
tagaaatatggtatatgtaagatcactggcggccgatttaaattcgataatttgtagcggtggtagctatagttt

SEQ ID NO: 309462 - DNA, 75 bp, Artificial Sequence
  Synthetic
gttatgtcaggaggcgccgtatcgttgcatccttctggagtaacactatcaacccagtttacggattatgtatct

SEQ ID NO: 309463 - DNA, 75 bp, Artificial Sequence
  Synthetic
tgaatcactatgtatttattttccaaatgctgcgatcggttcaccaggtccaggcaaggcagatggtttattgaa

SEQ ID NO: 309464 - DNA, 75 bp, Artificial Sequence
  Synthetic
tgcatccttctggagtaacactatcaacccagtttacggattatgtatctctcaattcattaagattcaggttca

SEQ ID NO: 309465 - DNA, 75 bp, Artificial Sequence
  Synthetic
agattgtatgggttaccagctgtaaatccaaataatactagagatttttatgaaatgacaggaaggttttctttg

SEQ ID NO: 309466 - DNA, 75 bp, Artificial Sequence
  Synthetic
atccaaataatactagagatttttatgaaatgacaggaaggttttctttgatatcgctagtaccatcaaacgatg

SEQ ID NO: 309467 - DNA, 75 bp, Artificial Sequence
  Synthetic
cattcggtgaagattgtgatatatctgtttgtccattagatacaacaatgaatgggattggttgttcaccagcta

SEQ ID NO: 309468 - DNA, 75 bp, Artificial Sequence
  Synthetic
cgatgttttcaggaattaaaggtacaatagatatagcaaaatccatggctacaaacgtaatgaaaaaattcagaa

SEQ ID NO: 309469 - DNA, 75 bp, Artificial Sequence
  Synthetic
acaaacgtaatgaaaaaattcagaaaatcaaaattagctaattcagtttcaacattaactgaatctttatcggac

SEQ ID NO: 309470 - DNA, 75 bp, Artificial Sequence
  Synthetic
aatcaaaattagctaattcagtttcaacattaactgaatctttatcggacgcagcatcgtcaatatctagagggt

SEQ ID NO: 309471 - DNA, 75 bp, Artificial Sequence
  Synthetic
acaatggcgcctagacatcgggctatatatcctgaaggttggatgctaagatacgcgtaaacaagatcatgtggc

SEQ ID NO: 309472 - DNA, 75 bp, Artificial Sequence
  Synthetic
actacgattgtagatacaactagcgcaactaattcaatagcgacacagaccgctacaattagtaaacgattaaga

SEQ ID NO: 309473 - DNA, 75 bp, Artificial Sequence
  Synthetic
gtcaacatggctaactcatacagagagatgctctattggtttggcaaaactatagatagaaacttgccgtatgtg

SEQ ID NO: 309474 - DNA, 75 bp, Artificial Sequence
  Synthetic
tatagatagaaacttgccgtatgtgaatactaatggatggaggaagcagaaaggcagaaaagatggaatttgtct

SEQ ID NO: 309475 - DNA, 75 bp, Artificial Sequence
  Synthetic
ttaaaagaaatagctacacagactgatggtatgaattttgacgacatttctgctgcagtactaaaaactaaaata

SEQ ID NO: 309476 - DNA, 75 bp, Artificial Sequence
  Synthetic
aatactaatggatggaggaagcagaaaggcagaaaagatggaatttgtcttaattgtctggatgaatgtaaatta

SEQ ID NO: 309477 - DNA, 75 bp, Artificial Sequence
  Synthetic
tgctgcagtactaaaaactaaaatagataaatcgacacaaatttcaccaaatacattaccagatattgtcacaga

SEQ ID NO: 309478 - DNA, 75 bp, Artificial Sequence
  Synthetic
gtctgaatgttttctagatgttaagaatgaattcaataagtatagatggcttgtttttgatgaagaacctgatca

SEQ ID NO: 309479 - DNA, 75 bp, Artificial Sequence
  Synthetic
aatgaattcaataagtatagatggcttgtttttgatgaagaacctgatcaagctgttttgttgcaacactggatc

SEQ ID NO: 309480 - DNA, 75 bp, Artificial Sequence
  Synthetic
atgaagtgtttgaagctggaacagatggaaaatttttcgcatatcgagttgaaacattcgaagaaatacctttcg

SEQ ID NO: 309481 - DNA, 75 bp, Artificial Sequence
  Synthetic
tggaaaatttttcgcatatcgagttgaaacattcgaagaaatacctttcgatgtgcaaaaattcgcagacttagt

SEQ ID NO: 309482 - DNA, 75 bp, Artificial Sequence
  Synthetic
agctaagatcttgaacatgaacaaaaatcaaaaattccaattaaatgaaggaaggaaaagagcattgtcagttcc

SEQ ID NO: 309483 - DNA, 75 bp, Artificial Sequence
  Synthetic
aatcaaaaattccaattaaatgaaggaaggaaaagagcattgtcagttccaataacatcacaatttttaaagttc

SEQ ID NO: 309484 - DNA, 75 bp, Artificial Sequence
  Synthetic
atttaaatgataactatggaataactaaacagcaagcatataacctgttacgatccgatccgcgagtattacgtg

SEQ ID NO: 309485 - DNA, 75 bp, Artificial Sequence
  Synthetic
agttcatcaatcaagaaaatccaataatacgtaatagaattgaaaatctaatcgcgcaatgtaggctgtaagcag

SEQ ID NO: 309486 - DNA, 75 bp, Artificial Sequence
  Synthetic
aattcagccttggttagaattatcaacattaaaaattggctatttacaattattaaatgttgagagatgttctga

SEQ ID NO: 309487 - DNA, 75 bp, Artificial Sequence
  Synthetic
acattaaaaattggctatttacaattattaaatgttgagagatgttctgagctgatggcaaccagaggacaattt

SEQ ID NO: 309488 - DNA, 75 bp, Artificial Sequence
  Synthetic
gccaatatatgataatgactgtatcattgaagcatatctcgacaaaaatgatcgtggatggaaattcgctgcaat

SEQ ID NO: 309489 - DNA, 75 bp, Artificial Sequence
  Synthetic
attgaagcatatctcgacaaaaatgatcgtggatggaaattcgctgcaattctaggaagacgaaaaattccagtt

SEQ ID NO: 309490 - DNA, 75 bp, Artificial Sequence
  Synthetic
gttttactatgcacactcaagatgtcatacattatcaaattgtcccaggtggaatgaaggattaagattgcttaa

SEQ ID NO: 309491 - DNA, 75 bp, Artificial Sequence
  Synthetic
catacattatcaaattgtcccaggtggaatgaaggattaagattgcttaattcatcaacattaaatatagttttc

SEQ ID NO: 309492 - DNA, 75 bp, Artificial Sequence
  Synthetic
gtatactggttcgcattatgaattcattactgaatgtgttcacgataaaagtgccattactgctttcaaacaaga

SEQ ID NO: 309493 - DNA, 75 bp, Artificial Sequence
  Synthetic
attactgaatgtgttcacgataaaagtgccattactgctttcaaacaagaaattgaagattatataaaagagggc

SEQ ID NO: 309494 - DNA, 75 bp, Artificial Sequence
  Synthetic
acatattcttagattaagagaatcattaatgcttgccattgatgcagctttatcaagaatcagatctcaaagtat

SEQ ID NO: 309495 - DNA, 75 bp, Artificial Sequence
  Synthetic
gctgtctgacaaactggtcttctttttaaatggtttgtacaacattgtacaccatttgcgcaatcttatgcatcc

SEQ ID NO: 309496 - DNA, 75 bp, Artificial Sequence
  Synthetic
accatttgcgcaatcttatgcatcctttttatatacatgttattgtttagaaaaatgttccacctaataactgat

SEQ ID NO: 309497 - DNA, 75 bp, Artificial Sequence
  Synthetic
tatcaagaatcagatctcaaagtatgggcgtgctgtgatcctccttgtcccgtgtctgatcgcaacagactaaac

SEQ ID NO: 309498 - DNA, 75 bp, Artificial Sequence
  Synthetic
tttttatatacatgttattgtttagaaaaatgttccacctaataactgatactttcattgtggtagttattatat

SEQ ID NO: 309499 - DNA, 75 bp, Artificial Sequence
  Synthetic
tatattggaaatgttgaaactgtagtcaatgcaacaaatccatttgaagtcaaatctctatgcatttattttcca

SEQ ID NO: 309500 - DNA, 75 bp, Artificial Sequence
  Synthetic
caggcaaaacagatggatacttaaacgatggcaattatgcccagacgattgcaactttgtttgaaacaaagggat

SEQ ID NO: 309501 - DNA, 75 bp, Artificial Sequence
  Synthetic
atgtttggagatgtgatgacatgaacttagatatttatacttatgaacagactggaatagataatctatgggctg

SEQ ID NO: 309502 - DNA, 75 bp, Artificial Sequence
  Synthetic
aatgttgtagataatgtaaaacataggattcagatgaacactgctaaatgtaagatcaagaattgtgtaaaaggt

SEQ ID NO: 309503 - DNA, 75 bp, Artificial Sequence
  Synthetic
gctgtctgacaaactggtcttctttctaaatggtttgtacaacattgtacactgtttgcgtagttcttggcatca

SEQ ID NO: 309504 - DNA, 75 bp, Artificial Sequence
  Synthetic
ggtttgtacaacattgtacactgtttgcgtaattctctgcattctttttatttatatgctgttattcagaaaaat

SEQ ID NO: 309505 - DNA, 75 bp, Artificial Sequence
  Synthetic
actgtttgcgtagttcttggcatcacgttgatgtacgtcctagttttcagagagatgtttcaccttattattgat

SEQ ID NO: 309506 - DNA, 75 bp, Artificial Sequence
  Synthetic
cgttgatgtacgtcctagttttcagagagatgtttcaccttattattgatacagtaattataactatagttatgt

SEQ ID NO: 309507 - DNA, 75 bp, Artificial Sequence
  Synthetic
gtattggatggtcacaaggtcagatgtttattgatgacatacattataatggaaatgttgaaacgatagtaaatg

SEQ ID NO: 309508 - DNA, 75 bp, Artificial Sequence
  Synthetic
tatgatggtaacattgagacagtagttaacggtactaatccatttgacgttgattctttatgtatgtattttcca

SEQ ID NO: 309509 - DNA, 75 bp, Artificial Sequence
  Synthetic
ttaacggtactaatccatttgacgttgattctttatgtatgtattttccagcatcagctgttggaagtccaggac

SEQ ID NO: 309510 - DNA, 75 bp, Artificial Sequence
  Synthetic
gttgtaggatctcaggggcccggtaagacagatggatatctaaatgatggcaattacgctcaaactattgcagca

SEQ ID NO: 309511 - DNA, 75 bp, Artificial Sequence
  Synthetic
gcgactctgtttggaacaaaaggatttccgaagggctcagttaatttcataacatatgcaagacttgtagacttc

SEQ ID NO: 309512 - DNA, 75 bp, Artificial Sequence
  Synthetic
ttccgaagggctcagttaatttcataacatatgcaagacttgtagacttcgttaattcaatagatatgacatgtt

SEQ ID NO: 309513 - DNA, 75 bp, Artificial Sequence
  Synthetic
gaacaggtggctgaatggatacttaatgtatggaagtgtgatgagatgaatttggatatatacacgtatgaacaa

SEQ ID NO: 309514 - DNA, 75 bp, Artificial Sequence
  Synthetic
atgtatggaagtgtgatgagatgaatttggatatatacacgtatgaacaaataggaaataataatatatgggctg

SEQ ID NO: 309515 - DNA, 75 bp, Artificial Sequence
  Synthetic
aatggaataggatgcattcccgcgagtttagagacgtatgaagtaatatctaacaacacacagatagcactgtta

SEQ ID NO: 309516 - DNA, 75 bp, Artificial Sequence
  Synthetic
aatgtagttgataatgttagacacagaattcagatgaatcaagctacatgtaggatcaagaattgtgtaaaaggt

SEQ ID NO: 309517 - DNA, 75 bp, Artificial Sequence
  Synthetic
ctcttttaaaagcacttgctggaaatggcgactcaggcttccgttgaatggattttcaacattgccggatcagct

SEQ ID NO: 309518 - DNA, 75 bp, Artificial Sequence
  Synthetic
gattttcaacattgccggatcagctgcttcggcttcaattgcaaaggctatcaaggatgctggaggaagtgaaga

SEQ ID NO: 309519 - DNA, 75 bp, Artificial Sequence
  Synthetic
gcttcggcttcaattgcaaaggctatcaaggatgctggaggaagtgaagattttgcaaaatatgttattgccagg

SEQ ID NO: 309520 - DNA, 75 bp, Artificial Sequence
  Synthetic
atgtattggaagggctagaactgtggataaggctttggatgactcaaggaaagcagaaagaaatgaagattggca

SEQ ID NO: 309521 - DNA, 75 bp, Artificial Sequence
  Synthetic
gataaggctttggatgactcaaggaaagcagaaagaaatgaagattggcatactaatctagaaacgataagcagg

SEQ ID NO: 309522 - DNA, 75 bp, Artificial Sequence
  Synthetic
taagagagaggatagagtactaaattcaatgttttctgtggttagagaagaaggtaaatcatcaaatactgtcat

SEQ ID NO: 309523 - DNA, 75 bp, Artificial Sequence
  Synthetic
tcaatgttttctgtggttagagaagaaggtaaatcatcaaatactgtcatgttaaagcaaaatgcagtaagaatg

SEQ ID NO: 309524 - DNA, 75 bp, Artificial Sequence
  Synthetic
tgcatcacttaaaaataagatagaagaactagaatgtatgattgatgcttttgaaaaagggaaagagatcattat

SEQ ID NO: 309525 - DNA, 75 bp, Artificial Sequence
  Synthetic
gaactagaatgtatgattgatgcttttgaaaaagggaaagagatcattattagtttagatgctatgaatggtgag

SEQ ID NO: 309526 - DNA, 75 bp, Artificial Sequence
  Synthetic
gcgcgattctttgcatcttattaatatatacactatttcttaggaaaatgttccatctattaactgatgcgttag

SEQ ID NO: 309527 - DNA, 75 bp, Artificial Sequence
  Synthetic
ctgttgctttaatcgtatctacatgtgctgggtacactaatggtcaattattcactgatgatatttcttatgaag

SEQ ID NO: 309528 - DNA, 75 bp, Artificial Sequence
  Synthetic
ctctacaatcgtaggtaatccaattaaaatgtatgatgagtcaggcaaaccattgtttgatgtaggtgactactt

SEQ ID NO: 309529 - DNA, 75 bp, Artificial Sequence
  Synthetic
aaaatgtatgatgagtcaggcaaaccattgtttgatgtaggtgactacttaaatcctaaacatatcattgataaa

SEQ ID NO: 309530 - DNA, 75 bp, Artificial Sequence
  Synthetic
atcaccagattttgatgtatggaatgaaaggagtaatcttaagattgttagtataaatgactgtcatgcaatttg

SEQ ID NO: 309531 - DNA, 75 bp, Artificial Sequence
  Synthetic
gaaaggagtaatcttaagattgttagtataaatgactgtcatgcaatttgtgtgtttaaatttgagaatgcttgg

SEQ ID NO: 309532 - DNA, 75 bp, Artificial Sequence
  Synthetic
attgattgttgcaaatgctaaattccaaattgacaaaattttaatttctggagatgttgaattgaatcctggacc

SEQ ID NO: 309533 - DNA, 75 bp, Artificial Sequence
  Synthetic
caaattgacaaaattttaatttctggagatgttgaattgaatcctggacctgatccacttatcagattgaatgat

SEQ ID NO: 309534 - DNA, 75 bp, Artificial Sequence
  Synthetic
aagaattcagaagcaattgaacaaatagctgaatgggtattaaatgtttggcaatgtgatgacatgaatttagat

SEQ ID NO: 309535 - DNA, 75 bp, Artificial Sequence
  Synthetic
aagataatctatgggcagcgtttggtgaggattgtgacatatctgtttgtccattagatacaacaatgaatggga

SEQ ID NO: 309536 - DNA, 75 bp, Artificial Sequence
  Synthetic
agacaatgatggttcaatcattcatatgtgttatatgagaactggatctgcagaggcagttgctaaaggaaggtc

SEQ ID NO: 309537 - DNA, 75 bp, Artificial Sequence
  Synthetic
atgtgttatatgagaactggatctgcagaggcagttgctaaaggaaggtcaaagaaagaagcaaagagaatagct

SEQ ID NO: 309538 - DNA, 75 bp, Artificial Sequence
  Synthetic
aacgtatgaggtggtgtccaacaatactcaattagcacttattgatgtagttgataacgttaaacataggattca

SEQ ID NO: 309539 - DNA, 75 bp, Artificial Sequence
  Synthetic
tgaccgctaatagtccagaatatgcggagcactgagttaccgacttaattgtctgacagcaagtaaaaggtcaat

SEQ ID NO: 309540 - DNA, 75 bp, Artificial Sequence
  Synthetic
agggtgagccacgactaaacactgcaattataagagtttctacatcatcaagtttcgataattcgttatcacctc

SEQ ID NO: 309541 - DNA, 75 bp, Artificial Sequence
  Synthetic
gatgctgaaaaggaaaagcagacagaaaatgtggaggagaaagagataaaggaagctaaagaacaagttaaagat

SEQ ID NO: 309542 - DNA, 75 bp, Artificial Sequence
  Synthetic
aaaatgtggaggagaaagagataaaggaagctaaagaacaagttaaagatgaaaagcaagtgattacagaagaaa

SEQ ID NO: 309543 - DNA, 75 bp, Artificial Sequence
  Synthetic
caaaaaaatgacttagttaaagaagttataaatatccaaaatcaaacattgaatacaatagttgctgagaataaa

SEQ ID NO: 309544 - DNA, 75 bp, Artificial Sequence
  Synthetic
agtatattccatcatactcaactgacaagctaatagttaaaaaattaactgaaattcaagaatcaagtgctaaaa

SEQ ID NO: 309545 - DNA, 75 bp, Artificial Sequence
  Synthetic
gatgtaaatggagagaaaaaactatccactagatggtattggaaactacttaaagatgatctacctgctggtgat

SEQ ID NO: 309546 - DNA, 75 bp, Artificial Sequence
  Synthetic
ccactagatggtattggaaactacttaaagatgatctacctgctggtgattactcagttagacaattctttctat

SEQ ID NO: 309547 - DNA, 75 bp, Artificial Sequence
  Synthetic
gatatggctgtggataatccatattcagcagaggcaggaaaaatagtagatgaaaaatcaaaagaaatcctagta

SEQ ID NO: 309548 - DNA, 75 bp, Artificial Sequence
  Synthetic
cagcagaggcaggaaaaatagtagatgaaaaatcaaaagaaatcctagtagaaatatatcaagatcaaatgactg

SEQ ID NO: 309549 - DNA, 75 bp, Artificial Sequence
  Synthetic
gaaacgaatactgctaaatatccagctattttacatcctgtagatgaagaactaaataaatactttcttgagcac

SEQ ID NO: 309550 - DNA, 75 bp, Artificial Sequence
  Synthetic
ctattttacatcctgtagatgaagaactaaataaatactttcttgagcaccaactgattcaaccattgactacaa

SEQ ID NO: 309551 - DNA, 75 bp, Artificial Sequence
  Synthetic
gtgtttaacattgatgctgcatttttaacaaactcaagatttgttccaccgtatctaacacaagatagaattgga

SEQ ID NO: 309552 - DNA, 75 bp, Artificial Sequence
  Synthetic
gacaaatccttttaatgttgagtcattatgtatttattttccaaatgctgcaattggttcaccaggtccaggtaa

SEQ ID NO: 309553 - DNA, 75 bp, Artificial Sequence
  Synthetic
gatttaactgagttagttgatgctgaaaaacagatgaaagaaatggcagcacatttacagcttgaagctattaca

SEQ ID NO: 309554 - DNA, 75 bp, Artificial Sequence
  Synthetic
tgaagcatttaagtttataattggtactgtgctgtcaactagaacaatagcagtagaattcatcacatcaaatta

SEQ ID NO: 309555 - DNA, 75 bp, Artificial Sequence
  Synthetic
actgtgctgtcaactagaacaatagcagtagaattcatcacatcaaattatatgtcattagcgtcatgtatgtat

SEQ ID NO: 309556 - DNA, 75 bp, Artificial Sequence
  Synthetic
aatgcagttagcagtaataaatactcttacctatccagctttaggattagcacaaatgcattatcaggcaggtga

SEQ ID NO: 309557 - DNA, 75 bp, Artificial Sequence
  Synthetic
gaaatgcaagtagcaaataggcccattaggcaatggttgcatcattgtaatacacttcaatttggcagacaagta

SEQ ID NO: 309558 - DNA, 75 bp, Artificial Sequence
  Synthetic
tacacttcaatttggcagacaagtaactgaaggagtaacacatctacggtttacaaatgacatcatgacaggtag

SEQ ID NO: 309559 - DNA, 75 bp, Artificial Sequence
  Synthetic
actgaaggagtaacacatctacggtttacaaatgacatcatgacaggtagaatagttaatctcttttcaactatg

SEQ ID NO: 309560 - DNA, 75 bp, Artificial Sequence
  Synthetic
aagatctgtccagagagcattacagcttctttcaaacaggactgctcaaatagctgatttgactagattaatagt

SEQ ID NO: 309561 - DNA, 75 bp, Artificial Sequence
  Synthetic
cttctttcaaacaggactgctcaaatagctgatttgactagattaatagtgtacaactatacaacattgtcagca

SEQ ID NO: 309562 - DNA, 75 bp, Artificial Sequence
  Synthetic
acaagctacagctttaacttcactgataatgttgatatccaataaaacggttattccagaaccatcatccctctt

SEQ ID NO: 309563 - DNA, 75 bp, Artificial Sequence
  Synthetic
ataatgttgatatccaataaaacggttattccagaaccatcatccctcttttcatacttttctagtaatattaat

SEQ ID NO: 309564 - DNA, 75 bp, Artificial Sequence
  Synthetic
ttcgcccttgcatttaaaatctcattcacaatggatgtacttttttccattgcgaagactgtgtcagatctcaaa

SEQ ID NO: 309565 - DNA, 75 bp, Artificial Sequence
  Synthetic
ggcagcatacagactagatctatatcaacagaaaatgctaatgcttgttactcgatttgtttcacgactgtacat

SEQ ID NO: 309566 - DNA, 75 bp, Artificial Sequence
  Synthetic
tgcgaagactgtgtcagatctcaaaaagaaagttgtagttggtacaatctacactaatgtagaagatattattca

SEQ ID NO: 309567 - DNA, 75 bp, Artificial Sequence
  Synthetic
caacagaaaatgctaatgcttgttactcgatttgtttcacgactgtacatatttgatgctcctaagataccacca

SEQ ID NO: 309568 - DNA, 75 bp, Artificial Sequence
  Synthetic
acactaatgtagaagatattattcaacagacaaatgaattaattagaacgctgaacggcaatacttttcatactg

SEQ ID NO: 309569 - DNA, 75 bp, Artificial Sequence
  Synthetic
ctgaacggcaatacttttcatactggtggaattggaacacaacctcagaaagaatggaattttcaactcccacag

SEQ ID NO: 309570 - DNA, 75 bp, Artificial Sequence
  Synthetic
aagaagagcagatgtgttcagaatcattatgaataacagagatcttatagagaaaacatcagaacgcatttgtca

SEQ ID NO: 309571 - DNA, 75 bp, Artificial Sequence
  Synthetic
attatgaataacagagatcttatagagaaaacatcagaacgcatttgtcaaggagtgttactatcatattcacca

SEQ ID NO: 309572 - DNA, 75 bp, Artificial Sequence
  Synthetic
gagtgtaattgattatctagcttcttttattgaggcagtgtgtgatgatgaaatagttagggaagcatctagaaa

SEQ ID NO: 309573 - DNA, 75 bp, Artificial Sequence
  Synthetic
tttattgaggcagtgtgtgatgatgaaatagttagggaagcatctagaaatggaatgcaacctcaatctccgact

SEQ ID NO: 309574 - DNA, 75 bp, Artificial Sequence
  Synthetic
cactaatggttttcagataataaacattgaagaaatcgagaagacaggtgattattcagcaattacaaacgcatt

SEQ ID NO: 309575 - DNA, 75 bp, Artificial Sequence
  Synthetic
attgaagaaatcgagaagacaggtgattattcagcaattacaaacgcattactccgtgatactccaatcatactg

SEQ ID NO: 309576 - DNA, 75 bp, Artificial Sequence
  Synthetic
tctatgaatacagaaatccaatggtatttgaatataggaattcatacattttacaacgtgccaatccacaattcg

SEQ ID NO: 309577 - DNA, 75 bp, Artificial Sequence
  Synthetic
taaaatagatacaacagtgtttgcgagtatcgttaaagacagagatatttcaaaattaaaaccgataaaattcac

SEQ ID NO: 309578 - DNA, 75 bp, Artificial Sequence
  Synthetic
agtatcgttaaagacagagatatttcaaaattaaaaccgataaaattcacaattaattcagactcatcagaatac

SEQ ID NO: 309579 - DNA, 75 bp, Artificial Sequence
  Synthetic
agaacgcgccaaataatactcagcgtttcatttataatggaagacttaaaagaccgatttctaacgttttaatga

SEQ ID NO: 309580 - DNA, 75 bp, Artificial Sequence
  Synthetic
caaagccagatctcagcaatttaatatacaacattcagtgtcaatgttagagtcaaacttgttctttgttgtata

SEQ ID NO: 309581 - DNA, 75 bp, Artificial Sequence
  Synthetic
ccaacgaaccagacaacatggttatttaatccagtgcaagtgatgaatggaacttttaccattgaattttataat

SEQ ID NO: 309582 - DNA, 75 bp, Artificial Sequence
  Synthetic
ttcgcccttgcatttaaaatctcattcacaatggatgtgcttttttccattgcgaagactgtatcagatcttaag

SEQ ID NO: 309583 - DNA, 75 bp, Artificial Sequence
  Synthetic
aacatttgattcatatagaattacaattgatatgattagacaagcagctatgactcaatatgtccagagaacatt

SEQ ID NO: 309584 - DNA, 75 bp, Artificial Sequence
  Synthetic
attgatatgattagacaagcagctatgactcaatatgtccagagaacatttccgcaaggtggtccttacgctcat

SEQ ID NO: 309585 - DNA, 75 bp, Artificial Sequence
  Synthetic
acagacaaatgaattaattagaacgctgaatggcaatacttttcatactggtggaattggaacacaacctcagaa

SEQ ID NO: 309586 - DNA, 75 bp, Artificial Sequence
  Synthetic
ctgaatggcaatacttttcatactggtggaattggaacacaacctcagaaagaatggactttccaactgcctcaa

SEQ ID NO: 309587 - DNA, 75 bp, Artificial Sequence
  Synthetic
tgttttatgtgattcacattctgttgattactcaattgttgcaaatgtcagaagggattcagctatgccggcagg

SEQ ID NO: 309588 - DNA, 75 bp, Artificial Sequence
  Synthetic
gattactcaattgttgcaaatgtcagaagggattcagctatgccggcaggaactgttttccaaccagggtttcca

SEQ ID NO: 309589 - DNA, 75 bp, Artificial Sequence
  Synthetic
aagtgtaattgattatttagcttcatttatagaggcagtatgtgatgatgaaatggttagagaagcgtctagaaa

SEQ ID NO: 309590 - DNA, 75 bp, Artificial Sequence
  Synthetic
aggatcaatggcgtcctcactttatcagcaattgatctcacaaaactattattcaaatggtaatgaaattttatt

SEQ ID NO: 309591 - DNA, 75 bp, Artificial Sequence
  Synthetic
ttaaaactataaacttcaataacagttctcagtctattaagaattggggtgctcaatcaagacgtgaaaatccaa

SEQ ID NO: 309592 - DNA, 75 bp, Artificial Sequence
  Synthetic
attcaaatggtaatgaaattttattggataaacaaacgacaagaaccactgaagattatgtagaagcagggaatt

SEQ ID NO: 309593 - DNA, 75 bp, Artificial Sequence
  Synthetic
ggataaacaaacgacaagaaccactgaagattatgtagaagcagggaattatacgtatgcccaattgccaccaac

SEQ ID NO: 309594 - DNA, 75 bp, Artificial Sequence
  Synthetic
ttctcagtctattaagaattggggtgctcaatcaagacgtgaaaatccaatatatgaatacagaaatccaatggt

SEQ ID NO: 309595 - DNA, 75 bp, Artificial Sequence
  Synthetic
gaaatgttatgggactaagatattacacttctagtaatacatgtcaaattgcagcttttgattcaacatttgctg

SEQ ID NO: 309596 - DNA, 75 bp, Artificial Sequence
  Synthetic
taactggtccacacagtaatacagtcattgaatggagtagtttaataaattctgaagtttgggtattatatcaaa

SEQ ID NO: 309597 - DNA, 75 bp, Artificial Sequence
  Synthetic
cattgaatggagtagtttaataaattctgaagtttgggtattatatcaaaaaccgttggatgcagctacaccaat

SEQ ID NO: 309598 - DNA, 75 bp, Artificial Sequence
  Synthetic
cacttctagtaatacatgtcaaattgcagcttttgattcaacatttgctgagaacgcacctaataatactcagcg

SEQ ID NO: 309599 - DNA, 75 bp, Artificial Sequence
  Synthetic
agattgaagctggtgctccaaatattagtaatttgactgttctgcctgatccagcaaaccagacgacatggttat

SEQ ID NO: 309600 - DNA, 75 bp, Artificial Sequence
  Synthetic
aattatggtatggtaaagctggtcataccataacatccatatattattcagcagtatctaatcctaataatactg

SEQ ID NO: 309601 - DNA, 75 bp, Artificial Sequence
  Synthetic
taccataacatccatatattattcagcagtatctaatcctaataatactgtcacattgacatcagattcattagt

SEQ ID NO: 309602 - DNA, 75 bp, Artificial Sequence
  Synthetic
tagtaatttgactgttctgcctgatccagcaaaccagacgacatggttatttaatccagtgcaagtgatgaatgg

SEQ ID NO: 309603 - DNA, 75 bp, Artificial Sequence
  Synthetic
gaaatatgggagtagtaaccgttagaacatttgatacatatagaatcacagttgatattattagaccagcggcta

SEQ ID NO: 309604 - DNA, 75 bp, Artificial Sequence
  Synthetic
ttaactggaatatgggaggtatattagtcagaccgtcaagaggtacgcgagtggacatctgtatggctgatatgg

SEQ ID NO: 309605 - DNA, 75 bp, Artificial Sequence
  Synthetic
agtcagaccgtcaagaggtacgcgagtggacatctgtatggctgatatggataatacagacggtgccagctttaa

SEQ ID NO: 309606 - DNA, 75 bp, Artificial Sequence
  Synthetic
aacatttgatacatatagaatcacagttgatattattagaccagcggctatgacacaatatgttcaaagaatatt

SEQ ID NO: 309607 - DNA, 75 bp, Artificial Sequence
  Synthetic
gtatactggatgctacaacagaatctgttttatgtgattcacattctgtcgattactcaaccgttgcaaatgtta

SEQ ID NO: 309608 - DNA, 75 bp, Artificial Sequence
  Synthetic
tcaatatgtatattgagtattatttagcaagtagtgatccatacaatgaaattaaagagttacagagaccagcta

SEQ ID NO: 309609 - DNA, 75 bp, Artificial Sequence
  Synthetic
agcaagtagtgatccatacaatgaaattaaagagttacagagaccagctataacaactctaaatatgcagatggt

SEQ ID NO: 309610 - DNA, 75 bp, Artificial Sequence
  Synthetic
tgggaacagactctgtccaactacacagttgcacaagaggataatttagaaagacttttattagttgcatccgtg

SEQ ID NO: 309611 - DNA, 75 bp, Artificial Sequence
  Synthetic
actcattatggcaagaaatgagatatgttagggatataactctagagtgcaaaatacaatcagaagtaattaaag

SEQ ID NO: 309612 - DNA, 75 bp, Artificial Sequence
  Synthetic
tgttagggatataactctagagtgcaaaatacaatcagaagtaattaaaggcggaggatgggggtatgattacac

SEQ ID NO: 309613 - DNA, 75 bp, Artificial Sequence
  Synthetic
aggatcaatggcgtcctcactttatcatcaattgatttctcaaaattattattcaactgggaatgagattttaaa

SEQ ID NO: 309614 - DNA, 75 bp, Artificial Sequence
  Synthetic
gtgaagttgtcactgctcacgtcacagtaagtttcaataacatgaaagaaagatcttatggaggagcattaccaa

SEQ ID NO: 309615 - DNA, 75 bp, Artificial Sequence
  Synthetic
agtaagtttcaataacatgaaagaaagatcttatggaggagcattaccaactgatttcaaaataaatagatttga

SEQ ID NO: 309616 - DNA, 75 bp, Artificial Sequence
  Synthetic
atacatatgctcagttgccaccaacaaaatggggagctggagctaccttcgaatcatcatttagtactgcagaaa

SEQ ID NO: 309617 - DNA, 75 bp, Artificial Sequence
  Synthetic
acatgtttaaaaatatggtgtacgtacgtgatttgagagcggatgttaatggatttttttactataaagaaatgt

SEQ ID NO: 309618 - DNA, 75 bp, Artificial Sequence
  Synthetic
tctgatcagtggttactgtttccaaaacctattaatacagttaaactactgaaacatggaccacaaacgtatgat

SEQ ID NO: 309619 - DNA, 75 bp, Artificial Sequence
  Synthetic
acgtgatttgagagcggatgttaatggatttttttactataaagaaatgtcttattcctttcgtattcctgttgg

SEQ ID NO: 309620 - DNA, 75 bp, Artificial Sequence
  Synthetic
aacctattaatacagttaaactactgaaacatggaccacaaacgtatgataatactttagcagcatgtgaattat

SEQ ID NO: 309621 - DNA, 75 bp, Artificial Sequence
  Synthetic
gcatgttatcccaacagttcacagatcaacttgcattaaattctatgagattcgtgtttaaagtaacgtctgcaa

SEQ ID NO: 309622 - DNA, 75 bp, Artificial Sequence
  Synthetic
agtgataatcaggtgcatgttagcagtgactcattagtactattttggaatgcaggtggaacagtgtttgacaaa

SEQ ID NO: 309623 - DNA, 75 bp, Artificial Sequence
  Synthetic
tcaacttgcattaaattctatgagattcgtgtttaaagtaacgtctgcaaatggttggtttatcacatctggtgg

SEQ ID NO: 309624 - DNA, 75 bp, Artificial Sequence
  Synthetic
gtgactcattagtactattttggaatgcaggtggaacagtgtttgacaaaaaggtatttaattttatttggagta

SEQ ID NO: 309625 - DNA, 75 bp, Artificial Sequence
  Synthetic
gacacacatctaaaactgtcggaacgttatcatttatatctttgattccaagtaatccgaattatcaaacaccca

SEQ ID NO: 309626 - DNA, 75 bp, Artificial Sequence
  Synthetic
tacatggctaatatgactaacttcaatagtgataattttaattgggaagagtggcgtttaacattaccccgtagc

SEQ ID NO: 309627 - DNA, 75 bp, Artificial Sequence
  Synthetic
gttatcatttatatctttgattccaagtaatccgaattatcaaacacccattgcatcatctaacacagtaagaat

SEQ ID NO: 309628 - DNA, 75 bp, Artificial Sequence
  Synthetic
aatgagataattaatatgtatgttgattattatctagctagtagtgatccatacaatcaactaaaagaattacaa

SEQ ID NO: 309629 - DNA, 75 bp, Artificial Sequence
  Synthetic
ctagttcagtagctctaggtgatatcatgtctttagctatgtcgccattaactttttctaaccttcttgaatccg

SEQ ID NO: 309630 - DNA, 75 bp, Artificial Sequence
  Synthetic
catgtctttagctatgtcgccattaactttttctaaccttcttgaatccgttcctgcaattacgtcatctgtgaa

SEQ ID NO: 309631 - DNA, 75 bp, Artificial Sequence
  Synthetic
agaaagctactaaatctaaatataaagaatttataattggtgatttgcttgaagatgtgacaaatgtgacaagaa

SEQ ID NO: 309632 - DNA, 75 bp, Artificial Sequence
  Synthetic
agaatttataattggtgatttgcttgaagatgtgacaaatgtgacaagaaactctaatactatgaatttcgatga

SEQ ID NO: 309633 - DNA, 75 bp, Artificial Sequence
  Synthetic
atgtagacacactttcagaaattgttgttagatctgcagatgactttatacctactagatcatacagaatgattg

SEQ ID NO: 309634 - DNA, 75 bp, Artificial Sequence
  Synthetic
tttgaaggaaaggtcatatggagggtcactaccaactgattttaaaataggtaaatttgatataatcgacgtaga

SEQ ID NO: 309635 - DNA, 75 bp, Artificial Sequence
  Synthetic
tgttagatctgcagatgactttatacctactagatcatacagaatgattgaaaatgatattgtatatgaagcaac

SEQ ID NO: 309636 - DNA, 75 bp, Artificial Sequence
  Synthetic
ttgatatggacaaattcattcaactagcgtcaagatcaccagtgatatctgcgattgtggattttgcaaccttaa

SEQ ID NO: 309637 - DNA, 75 bp, Artificial Sequence
  Synthetic
agcgtcaagatcaccagtgatatctgcgattgtggattttgcaaccttaaaagcaatgagagagacgtacggtac

SEQ ID NO: 309638 - DNA, 75 bp, Artificial Sequence
  Synthetic
acattcatctggagtacgatttatgtatgaacgctgtttattgtcacagcaatttacagatcaagtagcattaaa

SEQ ID NO: 309639 - DNA, 75 bp, Artificial Sequence
  Synthetic
catcgggtaacataaacacaagacgcatagcttcaggaacaggatttgcatatgcggatgggtatgtttctcaga

SEQ ID NO: 309640 - DNA, 75 bp, Artificial Sequence
  Synthetic
tatatacattatttcttagaaagatgttccatctactaactgatacattagttattattctgattatgtcaacat

SEQ ID NO: 309641 - DNA, 75 bp, Artificial Sequence
  Synthetic
cagtaaggatggatctagaaaggaaaataaatgatttacggaatgattttaatcaattagcaagctctgtggcac

SEQ ID NO: 309642 - DNA, 75 bp, Artificial Sequence
  Synthetic
ggaaatgttgaaggtgtgataaatgcgacaaatccttttaatgttgaatcattatgtatttactttccaaacgct

SEQ ID NO: 309643 - DNA, 75 bp, Artificial Sequence
  Synthetic
catcagttaaagatgtcgctgcgaatgtcatgaaaagatttagaaatacaaaaatgtttaaaaaagctgctaaac

SEQ ID NO: 309644 - DNA, 75 bp, Artificial Sequence
  Synthetic
caattacgcacagacattagcgacattatttgaaacaaaagggtttccaaaaggatcagtaatctttaaaacata

SEQ ID NO: 309645 - DNA, 75 bp, Artificial Sequence
  Synthetic
aaggatcagtaatctttaaaacatatactaaaacttcagacttcataaactcaatagaaatgacttgttcatata

SEQ ID NO: 309646 - DNA, 75 bp, Artificial Sequence
  Synthetic
attttgatgatcttacatcagcagtgatgatatcaactacaaataaactgcaacttactgatgtagatacattat

SEQ ID NO: 309647 - DNA, 75 bp, Artificial Sequence
  Synthetic
gatgatatcaactacaaataaactgcaacttactgatgtagatacattatcagaaattgttgcaagatcagctga

SEQ ID NO: 309648 - DNA, 75 bp, Artificial Sequence
  Synthetic
ggcaatgtgatgatatgaatttagagatttatacttatgaacaggtgaataaagataatttgtgggcggcatttg

SEQ ID NO: 309649 - DNA, 75 bp, Artificial Sequence
  Synthetic
ctcatatgatcttgttacacttcaacagcgaagttttgatatggataaatttctacaactagcatctaaatcacc

SEQ ID NO: 309650 - DNA, 75 bp, Artificial Sequence
  Synthetic
attggttgttcaccagctagtacggaaacatatgaagtggtgtctaatgatactcaactagcacttattgatgta

SEQ ID NO: 309651 - DNA, 75 bp, Artificial Sequence
  Synthetic
catatggaattgcaactgacgtgttataccaattagtggcatcagatactccgacacttctatcatttataaata

SEQ ID NO: 309652 - DNA, 75 bp, Artificial Sequence
  Synthetic
gtcaataacgttaaacatagaattcagatgtcatcaactgtaaatcaactccaatgtaaattgaaaaattgtatt

SEQ ID NO: 309653 - DNA, 75 bp, Artificial Sequence
  Synthetic
ataataacccgttaataaggaatagaattgaggaactattacgacagtgtaggatataataagtgaggagatcga

SEQ ID NO: 309654 - DNA, 75 bp, Artificial Sequence
  Synthetic
aaaggtgaatcacgattaaatactgcaattataaggatttccacatcatcaagctttgataattcactgtcaccc

SEQ ID NO: 309655 - DNA, 75 bp, Artificial Sequence
  Synthetic
aagctttgataattcactgtcacccctaaataatggacagatgacacgatcattcaaaatcaatgcgaaaaaatg

SEQ ID NO: 309656 - DNA, 75 bp, Artificial Sequence
  Synthetic
ggtttgtacgactttgtacactgcttgcgtagttctctgcattctttttatttacatgttgtttttcagaaaaat

SEQ ID NO: 309657 - DNA, 75 bp, Artificial Sequence
  Synthetic
tgcgtagttctctgcattctttttatttacatgttgtttttcagaaaaatgttccaccttatagcagatacacta

SEQ ID NO: 309658 - DNA, 75 bp, Artificial Sequence
  Synthetic
gttcattgatgatatacattatgatggaaacgttgaaacaatagtaaatgctacagatccttttaatgttagatc

SEQ ID NO: 309659 - DNA, 75 bp, Artificial Sequence
  Synthetic
ggaaacgttgaaacaatagtaaatgctacagatccttttaatgttagatctttgtgtatatattttccaaacgca

SEQ ID NO: 309660 - DNA, 75 bp, Artificial Sequence
  Synthetic
taattacgctcaaactatcgcagcgttgtttgaaacaaagggttttccaagaggatcaataatactcaaaacata

SEQ ID NO: 309661 - DNA, 75 bp, Artificial Sequence
  Synthetic
ttgtttgaaacaaagggttttccaagaggatcaataatactcaaaacatatacaaaagtctcagattttatagat

SEQ ID NO: 309662 - DNA, 75 bp, Artificial Sequence
  Synthetic
ggctttaaaaattgcgacaatgtctgattttggaattaatcttgatgccatttgcgacaatgtaaaaaaaggcca

SEQ ID NO: 309663 - DNA, 75 bp, Artificial Sequence
  Synthetic
aactaattcggagactatagaacgaatagcagaatggatattgaatgtttggagatgtgatgatatgaatctaga

SEQ ID NO: 309664 - DNA, 75 bp, Artificial Sequence
  Synthetic
atagcagaatggatattgaatgtttggagatgtgatgatatgaatctagacatctacacttacgaacagactggg

SEQ ID NO: 309665 - DNA, 75 bp, Artificial Sequence
  Synthetic
tccattagacacgacgatgaatggaattggttgttcaccagctagtacagaaacatacgaagtgttatcaaatga

SEQ ID NO: 309666 - DNA, 75 bp, Artificial Sequence
  Synthetic
attggttgttcaccagctagtacagaaacatacgaagtgttatcaaatgatactcaactagcgttgcttaatgta

SEQ ID NO: 309667 - DNA, 75 bp, Artificial Sequence
  Synthetic
agcagtatcggatatgttcgaagatgaagatattgagggatgcatctgtaaaaattgtccatatagagaaaagta

SEQ ID NO: 309668 - DNA, 75 bp, Artificial Sequence
  Synthetic
gaagaattgtattaaaggtgaagctagactaaatactgcacttattagaatttctacatcatctagttttgataa

SEQ ID NO: 309669 - DNA, 75 bp, Artificial Sequence
  Synthetic
agactaaatactgcacttattagaatttctacatcatctagttttgataattcattatcgccattaaatgatggg

SEQ ID NO: 309670 - DNA, 75 bp, Artificial Sequence
  Synthetic
ttacactataatcgattatattaatacaatcatacaaactatgactccgagacatcgagccatttatccagaagg

SEQ ID NO: 309671 - DNA, 75 bp, Artificial Sequence
  Synthetic
acaatcatacaaactatgactccgagacatcgagccatttatccagaaggttggatgttgagatacgcgtaaaca

SEQ ID NO: 309672 - DNA, 75 bp, Artificial Sequence
  Synthetic
aaacttatgaagttgtatcaaatgacactcaattggcattaattaatgttgtagataatgttaaacatagaatac

SEQ ID NO: 309673 - DNA, 75 bp, Artificial Sequence
  Synthetic
aatacatttcacactggtggaattggaacacagcctcagaaagaatggatttttcaactaccacaattaggtaca

SEQ ID NO: 309674 - DNA, 75 bp, Artificial Sequence
  Synthetic
tgattatttagcttcatttatagaggcagtgtgtgatgatgagatagttagagaagcgtctagaaatggaatgca

SEQ ID NO: 309675 - DNA, 75 bp, Artificial Sequence
  Synthetic
gtatggtattgaatataccacaactttaacttttttgatattgcttgtattattgaattatatattaaaatcgat

SEQ ID NO: 309676 - DNA, 75 bp, Artificial Sequence
  Synthetic
cagaaattcatatattttgcaacgtgctaatccacaatttggaaatgttatgggactaagatattatacttctag

SEQ ID NO: 309677 - DNA, 75 bp, Artificial Sequence
  Synthetic
ttgtcacaccatttgtaaattcacaaaattatggcattaatttgcccataactgggtcaatggatacaaactatc

SEQ ID NO: 309678 - DNA, 75 bp, Artificial Sequence
  Synthetic
actgggtcaatggatacaaactatcaaaacgtgtctaatccagaaccatttcttacatcaacactatgtttgtat

SEQ ID NO: 309679 - DNA, 75 bp, Artificial Sequence
  Synthetic
tctaatgtcttaatgaagattgaagctggtgctccaaatattagtaattcaactgttttacctgatccaacaaat

SEQ ID NO: 309680 - DNA, 75 bp, Artificial Sequence
  Synthetic
ctcatatagaatgacaattgatatgattagaccagcagccatgactcaatatgttcagagaatgtttccacaagg

SEQ ID NO: 309681 - DNA, 75 bp, Artificial Sequence
  Synthetic
tggtccatatgcttatcaagctgcatatatgttaacattgagtatactagatgctacaacggaatccgttttatg

SEQ ID NO: 309682 - DNA, 75 bp, Artificial Sequence
  Synthetic
ggaggttctgtattcattatcaaaaactttgaaagatgctagggataaaattgttgaaggtacattatattcgaa

SEQ ID NO: 309683 - DNA, 75 bp, Artificial Sequence
  Synthetic
cagctatgccagcaggaactgtttttcaaccagggtttccatgggaacaaactctatccaactacacagttgcac

SEQ ID NO: 309684 - DNA, 75 bp, Artificial Sequence
  Synthetic
gaaatgattttcagacaggaggaataggaaatttgccaattagaaattggaattttgactttggattacttggta

SEQ ID NO: 309685 - DNA, 75 bp, Artificial Sequence
  Synthetic
aggaaatttgccaattagaaattggaattttgactttggattacttggtactactttacttaatttggatgcaaa

SEQ ID NO: 309686 - DNA, 75 bp, Artificial Sequence
  Synthetic
ataatgtgtgtatggatgaaatagctagagagtcacaaagaaatggaatagctccacaatctgaggcactaagaa

SEQ ID NO: 309687 - DNA, 75 bp, Artificial Sequence
  Synthetic
atcgtggctataataatatctaattgtgtagggtggacacaaggtcaaatgtttattgatgatatgcattatgaa

SEQ ID NO: 309688 - DNA, 75 bp, Artificial Sequence
  Synthetic
gtgtagggtggacacaaggtcaaatgtttattgatgatatgcattatgaaggaaatgttgagacaatcattaatg

SEQ ID NO: 309689 - DNA, 75 bp, Artificial Sequence
  Synthetic
tagagagtcacaaagaaatggaatagctccacaatctgaggcactaagaaagctgtcgggtattaaatttaaaag

SEQ ID NO: 309690 - DNA, 75 bp, Artificial Sequence
  Synthetic
atagacgacagcgtactggattcgtattccataaaccaaatatacttccatactcagcatcattcactttgaata

SEQ ID NO: 309691 - DNA, 75 bp, Artificial Sequence
  Synthetic
gtcgtaggatcacagggacctggtcaaataaatggttatttgaacgatggtaattatgctcagacaatcgccact

SEQ ID NO: 309692 - DNA, 75 bp, Artificial Sequence
  Synthetic
aaataaatggttatttgaacgatggtaattatgctcagacaatcgccactctatttgaaacaaaaggatttccta

SEQ ID NO: 309693 - DNA, 75 bp, Artificial Sequence
  Synthetic
attccataaaccaaatatacttccatactcagcatcattcactttgaatagatcacaaccggcgcatgacaactt

SEQ ID NO: 309694 - DNA, 75 bp, Artificial Sequence
  Synthetic
ttgattattcgtgtgcttttaatgcgccggcaaatattcagcagtttgagcatgttgtgccattgagacgtgcac

SEQ ID NO: 309695 - DNA, 75 bp, Artificial Sequence
  Synthetic
tctgtggagatgacatgttcatacaacatagtcataatacctgatgatcctgacaggtcagaagcaatcgaacaa

SEQ ID NO: 309696 - DNA, 75 bp, Artificial Sequence
  Synthetic
gccggcaaatattcagcagtttgagcatgttgtgccattgagacgtgcacttacgacagctacaattactttatt

SEQ ID NO: 309697 - DNA, 75 bp, Artificial Sequence
  Synthetic
gcactaccacatggtatttcaatccagttattctaagaccaagtaatgtagaagttgagtttctgttgaatggac

SEQ ID NO: 309698 - DNA, 75 bp, Artificial Sequence
  Synthetic
agttattctaagaccaagtaatgtagaagttgagtttctgttgaatggacaaataattaatacatatcaagcaag

SEQ ID NO: 309699 - DNA, 75 bp, Artificial Sequence
  Synthetic
gtgatgattgtgatatatctgtttgtccattggataccacaatgaatggaatcggatgtctacctgcaagtacag

SEQ ID NO: 309700 - DNA, 75 bp, Artificial Sequence
  Synthetic
aattagtacgaccaccaaatatgacaccagcagttgcaaacctatttccgcaagcaccaccatttatattccatg

SEQ ID NO: 309701 - DNA, 75 bp, Artificial Sequence
  Synthetic
accagcagttgcaaacctatttccgcaagcaccaccatttatattccatgctacagttgggctaacgctacgaat

SEQ ID NO: 309702 - DNA, 75 bp, Artificial Sequence
  Synthetic
cgactaaatacggcaattgtaagaatttcaaaatcatcaagttttgataattcattgtcacctatgaataacggc

SEQ ID NO: 309703 - DNA, 75 bp, Artificial Sequence
  Synthetic
tggcaaatgtaactgcagttcgtcaagagtatgctataccagtaggaccagtatttccaccaggtatgaactgga

SEQ ID NO: 309704 - DNA, 75 bp, Artificial Sequence
  Synthetic
agagtatgctataccagtaggaccagtatttccaccaggtatgaactggacagaactgattaccaattactcacc

SEQ ID NO: 309705 - DNA, 75 bp, Artificial Sequence
  Synthetic
acaattgttcaaacgatgaccccgagacatcgggcaatttatccagaaggctggatgctgagatacgcgtaaaca

SEQ ID NO: 309706 - DNA, 75 bp, Artificial Sequence
  Synthetic
ttcgcccttgcatttaaaatctcattcacaatggatgtgcttttttccattgcaaaaactgttttagagctgaag

SEQ ID NO: 309707 - DNA, 75 bp, Artificial Sequence
  Synthetic
tgcaaaaactgttttagagctgaagaagaaagttgtagttggcacaatttataccaatgtagaagatattataca

SEQ ID NO: 309708 - DNA, 75 bp, Artificial Sequence
  Synthetic
aagaaagttgtagttggcacaatttataccaatgtagaagatattatacaacagacaaatgaattgattaggact

SEQ ID NO: 309709 - DNA, 75 bp, Artificial Sequence
  Synthetic
ggcttttaaaagttctgttccgagagagcgcgtgcggaaagatggataagcttgccgacctccacaacacattga

SEQ ID NO: 309710 - DNA, 75 bp, Artificial Sequence
  Synthetic
cttgccgacctccacaacacattgagcatgatcaccttagtaaacgatacattacattctataattccaaattca

SEQ ID NO: 309711 - DNA, 75 bp, Artificial Sequence
  Synthetic
agagtggaattttcaacttccacaactaggaacaactttattaaacttggatgataattatgttcaagctgccag

SEQ ID NO: 309712 - DNA, 75 bp, Artificial Sequence
  Synthetic
gcatgatcaccttagtaaacgatacattacattctataattccaaattcaggaatggcgtattttccatatatag

SEQ ID NO: 309713 - DNA, 75 bp, Artificial Sequence
  Synthetic
atgataattatgttcaagctgccagaggcgtaattgattatttagcatcatttatagaagccgtatgtgatgatg

SEQ ID NO: 309714 - DNA, 75 bp, Artificial Sequence
  Synthetic
atgaaaatagcacttaaaacatcaaaatgctcatataaagtgatcaaatattgcgtagtcactatcattaatgct

SEQ ID NO: 309715 - DNA, 75 bp, Artificial Sequence
  Synthetic
aatgctcatataaagtgatcaaatattgcgtagtcactatcattaatgctttgttgaaactagctggttttaaag

SEQ ID NO: 309716 - DNA, 75 bp, Artificial Sequence
  Synthetic
cttataacacttgcatcaccaaaatttaagaccattaattttaataatagttctcaatctattaaaaattggagt

SEQ ID NO: 309717 - DNA, 75 bp, Artificial Sequence
  Synthetic
ttaagaccattaattttaataatagttctcaatctattaaaaattggagtgctcagtctagacgtgagaatccag

SEQ ID NO: 309718 - DNA, 75 bp, Artificial Sequence
  Synthetic
aaagaaatgcagcgtcagcttgaaatgattgacaagctaactacccgtgagattgaacaggttgaactacttaaa

SEQ ID NO: 309719 - DNA, 75 bp, Artificial Sequence
  Synthetic
cttcaacgagctgatccgcaattcgggaatgtcatgggagtgagatattacacagctggtaatacatgtcaactc

SEQ ID NO: 309720 - DNA, 75 bp, Artificial Sequence
  Synthetic
ggaatgtcatgggagtgagatattacacagctggtaatacatgtcaactcgcggctttcgattcaacactcgctg

SEQ ID NO: 309721 - DNA, 75 bp, Artificial Sequence
  Synthetic
agaatgttgacgctattgacatgtcaaaagaatttaatcagaagaatgttagaacgctagacgaatgggaaaacg

SEQ ID NO: 309722 - DNA, 75 bp, Artificial Sequence
  Synthetic
agaccaatttccaacgttctgatgaaaattgaagctggtgctccaaacatcaacaacttgacagttctacctgat

SEQ ID NO: 309723 - DNA, 75 bp, Artificial Sequence
  Synthetic
ccattggacctgatggttgactgagaagccacagtcaatcatatcgcgtgtggctcagccttaatcccgtttaac

SEQ ID NO: 309724 - DNA, 75 bp, Artificial Sequence
  Synthetic
ccaacgaatcgaacgacatggttatataatccagtacagataatgaatggagcatttacaattgaattttataat

SEQ ID NO: 309725 - DNA, 75 bp, Artificial Sequence
  Synthetic
aagccacagtcaatcatatcgcgtgtggctcagccttaatcccgtttaaccaatccggcgagtgctggacgttaa

SEQ ID NO: 309726 - DNA, 75 bp, Artificial Sequence
  Synthetic
atggcttcgctcatttatagacaattacttacgaattcatatactgtagatttatcggacgaaattgaaataatt

SEQ ID NO: 309727 - DNA, 75 bp, Artificial Sequence
  Synthetic
aacatttgattcctacagaatcaccgttgatataataagaccagcagccatgacacaatacgttcagagactttt

SEQ ID NO: 309728 - DNA, 75 bp, Artificial Sequence
  Synthetic
tttatcggacgaaattgaaataattggctcagaaaagtcgaccaatgttacagttaatccaggtccatttgctca

SEQ ID NO: 309729 - DNA, 75 bp, Artificial Sequence
  Synthetic
tgacacaatacgttcagagacttttcccacaaggcgggccgtacccttatcaagctgcatacatgctgactttaa

SEQ ID NO: 309730 - DNA, 75 bp, Artificial Sequence
  Synthetic
ggctcagaaaagtcgaccaatgttacagttaatccaggtccatttgctcaaacagactatgcaccagttgattgg

SEQ ID NO: 309731 - DNA, 75 bp, Artificial Sequence
  Synthetic
accttatcaaccaacaacttttaaacctgacgttggctattggctactattagaaccgaagaaccaagatgtcat

SEQ ID NO: 309732 - DNA, 75 bp, Artificial Sequence
  Synthetic
cctgacgttggctattggctactattagaaccgaagaaccaagatgtcattttcgaaacaactaatggtattgac

SEQ ID NO: 309733 - DNA, 75 bp, Artificial Sequence
  Synthetic
gaagagactcagcaatgccagctggaacagtatttcagccaggttttccgtgggaacagacactgtccaactaca

SEQ ID NO: 309734 - DNA, 75 bp, Artificial Sequence
  Synthetic
gaattatacgttatttgggaagcaagaacagatagaagtgtcaaatccttcatctaagtggaaatttgttgagct

SEQ ID NO: 309735 - DNA, 75 bp, Artificial Sequence
  Synthetic
gaacagatagaagtgtcaaatccttcatctaagtggaaatttgttgagctaatgaaacaaacagcagatggtaat

SEQ ID NO: 309736 - DNA, 75 bp, Artificial Sequence
  Synthetic
aggatcaatggcgtcctcactatacaagcagctaatctcgcagaattactattcaactggaaatgacattttatt

SEQ ID NO: 309737 - DNA, 75 bp, Artificial Sequence
  Synthetic
attcaactggaaatgacattttattggatcagcaaacaaacaaaacaactgttgattatgtggatgtgggaaatt

SEQ ID NO: 309738 - DNA, 75 bp, Artificial Sequence
  Synthetic
gaagtatggtcaaaaggtatttacatatgagggcgaaacaccaaacgctagaactgactattatatcgtgtctaa

SEQ ID NO: 309739 - DNA, 75 bp, Artificial Sequence
  Synthetic
ggatcagcaaacaaacaaaacaactgttgattatgtggatgtgggaaattattcatacacgcaattaccaccaac

SEQ ID NO: 309740 - DNA, 75 bp, Artificial Sequence
  Synthetic
tatgagggcgaaacaccaaacgctagaactgactattatatcgtgtctaattacaatgaattaattataacggta

SEQ ID NO: 309741 - DNA, 75 bp, Artificial Sequence
  Synthetic
ttacggggccaaatacaggtgatataaatttagataatataacaaatgcaaatggttggatattgtatgataaac

SEQ ID NO: 309742 - DNA, 75 bp, Artificial Sequence
  Synthetic
cttcattaataatggattgccaccaatacagaacactagaaacatcgtaccagtgtccattaaagcaaggtcaat

SEQ ID NO: 309743 - DNA, 75 bp, Artificial Sequence
  Synthetic
aaatttagataatataacaaatgcaaatggttggatattgtatgataaaccaattagcacgaaacgattattaaa

SEQ ID NO: 309744 - DNA, 75 bp, Artificial Sequence
  Synthetic
atacagaacactagaaacatcgtaccagtgtccattaaagcaaggtcaataacatatcaacgagctcaggcaaat

SEQ ID NO: 309745 - DNA, 75 bp, Artificial Sequence
  Synthetic
atggtaaagcaaatactgtagttgaatcagtatattatgcatcagcacaaaattctgaaaaaactgtaacagtgc

SEQ ID NO: 309746 - DNA, 75 bp, Artificial Sequence
  Synthetic
cagagacattaaaatcaaatttaaatttaacaataatataattaaatctagtggcttaggatataaatggtcaga

SEQ ID NO: 309747 - DNA, 75 bp, Artificial Sequence
  Synthetic
atcagtatattatgcatcagcacaaaattctgaaaaaactgtaacagtgcaatatgattcactaattttgttttt

SEQ ID NO: 309748 - DNA, 75 bp, Artificial Sequence
  Synthetic
tttaacaataatataattaaatctagtggcttaggatataaatggtcagaaatatcatttaaaccagaaaattat

SEQ ID NO: 309749 - DNA, 75 bp, Artificial Sequence
  Synthetic
atatgggaggtatattagttagaccgactgctgatggtagagtcgacatctgtatggctgacatgaatgatttca

SEQ ID NO: 309750 - DNA, 75 bp, Artificial Sequence
  Synthetic
ctcagttaatggtgtatatgattttagctttaatagtggaccattgccaacagattttgtaatacataagtatga

SEQ ID NO: 309751 - DNA, 75 bp, Artificial Sequence
  Synthetic
agctttaatagtggaccattgccaacagattttgtaatacataagtatgaagttattaaagaaggttcttacgta

SEQ ID NO: 309752 - DNA, 75 bp, Artificial Sequence
  Synthetic
aatatcaatatgtacactgaatattatttagcaagtgttgatccgtatagtcaactaaaagcgttaaatcaactc

SEQ ID NO: 309753 - DNA, 75 bp, Artificial Sequence
  Synthetic
cagatcgctagctgctgacttaaactctgtaacgtgtaatggcggtgattatacttttagattacctgcaggtaa

SEQ ID NO: 309754 - DNA, 75 bp, Artificial Sequence
  Synthetic
tctgtaacgtgtaatggcggtgattatacttttagattacctgcaggtaaacatcctgtaatgactggcggttct

SEQ ID NO: 309755 - DNA, 75 bp, Artificial Sequence
  Synthetic
atcgatcaatgttgatgaagttgtaagtaaagattcactgtggcaggaaatgaggtatgctagagatataacact

SEQ ID NO: 309756 - DNA, 75 bp, Artificial Sequence
  Synthetic
agtaaagattcactgtggcaggaaatgaggtatgctagagatataacactgaaatgtaaaatagaatcagagatc

SEQ ID NO: 309757 - DNA, 75 bp, Artificial Sequence
  Synthetic
cgtatcactcaattcattacgattcaggtttagtttagaggtgttggatccgcctttttcaattttgaagactag

SEQ ID NO: 309758 - DNA, 75 bp, Artificial Sequence
  Synthetic
aggtttagtttagaggtgttggatccgcctttttcaattttgaagactagagtatctagattatacggattgcct

SEQ ID NO: 309759 - DNA, 75 bp, Artificial Sequence
  Synthetic
atgtcacaataagttttaataatatgaaagagagatcgtacggtgggtcattaccaactgattttaaaattaaaa

SEQ ID NO: 309760 - DNA, 75 bp, Artificial Sequence
  Synthetic
ttcattaatatcactcgttccatcaaatgacgactatcaaacgcctataatgaattccgtaacagtaagacaaga

SEQ ID NO: 309761 - DNA, 75 bp, Artificial Sequence
  Synthetic
aatgacgactatcaaacgcctataatgaattccgtaacagtaagacaagacttagaacaacagctggacagtcta

SEQ ID NO: 309762 - DNA, 75 bp, Artificial Sequence
  Synthetic
ttatatgtatattgattattgggatgattcagatatatttaaaaatatggtatatgtacgtgatctgagggctaa

SEQ ID NO: 309763 - DNA, 75 bp, Artificial Sequence
  Synthetic
tgatttagcactattaccacctgatatgttttcaatgttcgcaggtattaaaagtacagtgaatgctgcaaaatc

SEQ ID NO: 309764 - DNA, 75 bp, Artificial Sequence
  Synthetic
tatatgtacgtgatctgagggctaatatgggtgattttttctattactcagaaatgtggcataggtttcagattc

SEQ ID NO: 309765 - DNA, 75 bp, Artificial Sequence
  Synthetic
atgttttcaatgttcgcaggtattaaaagtacagtgaatgctgcaaaatcaatggctaccagcgtaatgaagaag

SEQ ID NO: 309766 - DNA, 75 bp, Artificial Sequence
  Synthetic
gaaaagtgcttgttgtctcaacaatatactgatatggttgcactgaattcaatgagatttatattcagagtaaca

SEQ ID NO: 309767 - DNA, 75 bp, Artificial Sequence
  Synthetic
atctgatgcagcatcgtctatatcacgtaacgcttccatcagatcggttgggtcatctgcctcggtgtggactga

SEQ ID NO: 309768 - DNA, 75 bp, Artificial Sequence
  Synthetic
atactgatatggttgcactgaattcaatgagatttatattcagagtaacatcatctaatggctggtacataacat

SEQ ID NO: 309769 - DNA, 75 bp, Artificial Sequence
  Synthetic
cgtaacgcttccatcagatcggttgggtcatctgcctcggtgtggactgatgtcccttcgcagataatagacaca

SEQ ID NO: 309770 - DNA, 75 bp, Artificial Sequence
  Synthetic
tctaatgggtatgtttctgaaactgttggaaatatttcattcatatcattagttccaagtaatccaaattatcaa

SEQ ID NO: 309771 - DNA, 75 bp, Artificial Sequence
  Synthetic
aaaagagatagctactcaaacagaaggagtcaactttgacgatttatcagctgccgtattaaaaactaaaataga

SEQ ID NO: 309772 - DNA, 75 bp, Artificial Sequence
  Synthetic
ttggaaatatttcattcatatcattagttccaagtaatccaaattatcaaactccaattgcatcatcaagtacag

SEQ ID NO: 309773 - DNA, 75 bp, Artificial Sequence
  Synthetic
ggagtcaactttgacgatttatcagctgccgtattaaaaactaaaatagataaatccgcacaagtgtcagtaaac

SEQ ID NO: 309774 - DNA, 75 bp, Artificial Sequence
  Synthetic
caactagctagttcagttgcgctaggagatataatgtcattggccatgtcacctttgacgtttgctaatctactt

SEQ ID NO: 309775 - DNA, 75 bp, Artificial Sequence
  Synthetic
atcgtatagagtaattaaaaatgatgaagtactagaagcgagtactgatggtaaatttttcgcatacagagtaga

SEQ ID NO: 309776 - DNA, 75 bp, Artificial Sequence
  Synthetic
gagatataatgtcattggccatgtcacctttgacgtttgctaatctacttgagtcagtaccagcaattacatcat

SEQ ID NO: 309777 - DNA, 75 bp, Artificial Sequence
  Synthetic
gaagtactagaagcgagtactgatggtaaatttttcgcatacagagtagacacgtttgaggaggtgccattcgac

SEQ ID NO: 309778 - DNA, 75 bp, Artificial Sequence
  Synthetic
atgtttaaaagggcgacaaaagcaaagtataaagaatacattattggagatttattagaagatgtaacaaatgta

SEQ ID NO: 309779 - DNA, 75 bp, Artificial Sequence
  Synthetic
aatagatttcaaaactcttaaaaacttaaatgataactacggtatcacgcgtgagcaagctttcaacttactaaa

SEQ ID NO: 309780 - DNA, 75 bp, Artificial Sequence
  Synthetic
acccgagatgtaaataaaatgaattttgatgacattacctcagctatgatggtttcaactacaaacaaattgcaa

SEQ ID NO: 309781 - DNA, 75 bp, Artificial Sequence
  Synthetic
ttcattaatcaaaacaacccaataattaagaatagaatagaacagcttatattgcaatgtagattataagcaacg

SEQ ID NO: 309782 - DNA, 75 bp, Artificial Sequence
  Synthetic
atgatagagaatggaatagtgcatgaagcaacgccaactagagtattttcatatgacttaaaaacactgcaacaa

SEQ ID NO: 309783 - DNA, 75 bp, Artificial Sequence
  Synthetic
tatagatttttattgcttattgctttgatatcaccacttgttaaatcgcaaaactatggcatgtacttaccaatc

SEQ ID NO: 309784 - DNA, 75 bp, Artificial Sequence
  Synthetic
tatatctgctataattgattttgctacgctaaaagcaatgagggacacttatggagtcagtacagatataatgta

SEQ ID NO: 309785 - DNA, 75 bp, Artificial Sequence
  Synthetic
tgatatcaccacttgttaaatcgcaaaactatggcatgtacttaccaatcacgggatcaatggatgccgcttacg

SEQ ID NO: 309786 - DNA, 75 bp, Artificial Sequence
  Synthetic
tatccaacagaagctaaaaacgaaatctcagataccgagtgggaaagtactctatcacagctattactaactaaa

SEQ ID NO: 309787 - DNA, 75 bp, Artificial Sequence
  Synthetic
tctcagataccgagtgggaaagtactctatcacagctattactaactaaaggttggcccaccggatcagtttatt

SEQ ID NO: 309788 - DNA, 75 bp, Artificial Sequence
  Synthetic
tgtgactacaacgtagtgttgatgagatatgatactacatccgagttagatgcatctgaacttgcagatttaatt

SEQ ID NO: 309789 - DNA, 75 bp, Artificial Sequence
  Synthetic
gttccatctattaactgatgcgttcgccgttttcataattatatcaacatgtactggatacactaattgtcaact

SEQ ID NO: 309790 - DNA, 75 bp, Artificial Sequence
  Synthetic
gatatgatactacatccgagttagatgcatctgaacttgcagatttaattctaaatgaatggttatgtaacccta

SEQ ID NO: 309791 - DNA, 75 bp, Artificial Sequence
  Synthetic
cgacgaatccttttaatgttgagtcattatgtatttatttcccgaatgctgcaattggttcaccaggtccaggta

SEQ ID NO: 309792 - DNA, 75 bp, Artificial Sequence
  Synthetic
atatcaatgggaaatgattgtaccgtaaaagtatgtccacttaatacgcagacgttaggaataggatgcaaaact

SEQ ID NO: 309793 - DNA, 75 bp, Artificial Sequence
  Synthetic
attatgtatttatttcccgaatgctgcaattggttcaccaggtccaggtaaagctgatggtctattgaatgataa

SEQ ID NO: 309794 - DNA, 75 bp, Artificial Sequence
  Synthetic
taaaagtatgtccacttaatacgcagacgttaggaataggatgcaaaactacagaggtgaatacgtttgaaacgg

SEQ ID NO: 309795 - DNA, 75 bp, Artificial Sequence
  Synthetic
aaggatctgtaatcttcaaaacatatacaaaaacatcggattttataagttcagtagaaatgacttgttcatata

SEQ ID NO: 309796 - DNA, 75 bp, Artificial Sequence
  Synthetic
cataaaattagtgtctcaacaagtacatgcacaatacgtaattgtaataaattaggaccacgagagaatgttgct

SEQ ID NO: 309797 - DNA, 75 bp, Artificial Sequence
  Synthetic
tacaaaaacatcggattttataagttcagtagaaatgacttgttcatataacttgattattattccagatgaacc

SEQ ID NO: 309798 - DNA, 75 bp, Artificial Sequence
  Synthetic
catgcacaatacgtaattgtaataaattaggaccacgagagaatgttgctatcattcaagttggcggaccaaatg

SEQ ID NO: 309799 - DNA, 75 bp, Artificial Sequence
  Synthetic
ggcagtgtgatgacatgaatctggatatctatacttatgagcaaataaataaagataacctgtgggccgcatttg

SEQ ID NO: 309800 - DNA, 75 bp, Artificial Sequence
  Synthetic
atgcgaataaattggaaaaagtggtggcaagttttttatacagtggtcgattatattgatcaaattattaaagtt

SEQ ID NO: 309801 - DNA, 75 bp, Artificial Sequence
  Synthetic
tatctatacttatgagcaaataaataaagataacctgtgggccgcatttggtgaagattgtgatatatcggtttg

SEQ ID NO: 309802 - DNA, 75 bp, Artificial Sequence
  Synthetic
atgtccaagcgatcaagatcactagattcggctgctttctactatagaatttagatatagcttagattagaattg

SEQ ID NO: 309803 - DNA, 75 bp, Artificial Sequence
  Synthetic
agacatatgaggtggtggttaatgatactcaattagcacttattaatgtggttgataacgttaagcatagagtcc

SEQ ID NO: 309804 - DNA, 75 bp, Artificial Sequence
  Synthetic
tactcaattagcacttattaatgtggttgataacgttaagcatagagtccaaatgtcgtcaaccttgaatcaatt

SEQ ID NO: 309805 - DNA, 75 bp, Artificial Sequence
  Synthetic
caattataagggtgtctacatcatcaaatttcgataattcactatcacctctgaataatggacagacgacacgaa

SEQ ID NO: 309806 - DNA, 75 bp, Artificial Sequence
  Synthetic
ggcttataaaagtcaatcagtcgcaatggaggccatctattctattgcaagaactatagccgatgcggaggagaa

SEQ ID NO: 309807 - DNA, 75 bp, Artificial Sequence
  Synthetic
taccctacaggaatcagtatattttaagattattcgttgagcaaatggtttatgaacatagattgaaattaaatt

SEQ ID NO: 309808 - DNA, 75 bp, Artificial Sequence
  Synthetic
aattgtagttggtacactgttttcgaatgtgcaacaaatagtaatgcaaatgaatgaagtaattaaggtaatgaa

SEQ ID NO: 309809 - DNA, 75 bp, Artificial Sequence
  Synthetic
tggttaggtacctaccacggtacgcattggaatttaagagacaatttggtttacttaatgaatatctttctactt

SEQ ID NO: 309810 - DNA, 75 bp, Artificial Sequence
  Synthetic
cggatcacaatttttgacaggtggagtcggaaatatgggagtaacacaatggacgttcaaccatggacaacttgg

SEQ ID NO: 309811 - DNA, 75 bp, Artificial Sequence
  Synthetic
tacaaatagcagaaccaatttccgttgcagaagctctaattcattattgtacacacagacattttagcatccaag

SEQ ID NO: 309812 - DNA, 75 bp, Artificial Sequence
  Synthetic
agttgcaccgctttatgtagatgaaaattacagagaagaattgatgcagactataaattattacaaacgttttgt

SEQ ID NO: 309813 - DNA, 75 bp, Artificial Sequence
  Synthetic
attgtatatcatgtatagcatcaaatgaagtagtgtctcaatttcgtgattggaaaatacgcaggtgtaatcaac

SEQ ID NO: 309814 - DNA, 75 bp, Artificial Sequence
  Synthetic
ccatgctgtatgtgaaactgaaatgtgtcttgaatcacagagaggtggggctacgatgcaatcagctgctatgca

SEQ ID NO: 309815 - DNA, 75 bp, Artificial Sequence
  Synthetic
ttaaccacatccaatgggtgcaaaatagaaaatgttcatgtgaagaagcatgtaactgtatgtttcagcaattag

SEQ ID NO: 309816 - DNA, 75 bp, Artificial Sequence
  Synthetic
agcgctacagacagtcaaatttaaaaatttatcttatgactatagtgaaaactatataaaacagtgggcattaca

SEQ ID NO: 309817 - DNA, 75 bp, Artificial Sequence
  Synthetic
tatcaaatgaatacacagaatatgtatcgcatgatcactcagtttgtgaagaccaagacatacttagacaatgca

SEQ ID NO: 309818 - DNA, 75 bp, Artificial Sequence
  Synthetic
aaaggttagagttagaacagcttactcgtcgaggaatccttatgttgtacctgagttgaatactattacatatag

SEQ ID NO: 309819 - DNA, 75 bp, Artificial Sequence
  Synthetic
gtagattgagctatgcttttactgatcatgagtcaattactaatcagtcacctcttatagatctgacagcagctg

SEQ ID NO: 309820 - DNA, 75 bp, Artificial Sequence
  Synthetic
acgttctcaagcagctatggataacgtagcaggtactagagtaatggcaattggagacacaattaagtttgctgt

SEQ ID NO: 309821 - DNA, 75 bp, Artificial Sequence
  Synthetic
aaagaatatcaaattctttggaaacaaatgactttgtagcttatagactaccaatacccagtgaatttcaatcgc

SEQ ID NO: 309822 - DNA, 75 bp, Artificial Sequence
  Synthetic
ttttgatcaggactttgcacgtacggaaccaggccagatgtgggaatcaaattttgaatataacatgccggtacc

SEQ ID NO: 309823 - DNA, 75 bp, Artificial Sequence
  Synthetic
ctgaagagtatatggaatacgtagtattgaaatttccgcaactaccagttagtgtactgaacttaattgcgtgtg

SEQ ID NO: 309824 - DNA, 75 bp, Artificial Sequence
  Synthetic
gatatctgatgctacaatacaagtcggtacagatgcatctggtctactcaatgatcaagtactaattacaaatac

SEQ ID NO: 309825 - DNA, 75 bp, Artificial Sequence
  Synthetic
aatgcgaaaggatccacaactgtgtaatatcactaactgaaggtgcaattaaagtaattgatgatgatggagttt

SEQ ID NO: 309826 - DNA, 75 bp, Artificial Sequence
  Synthetic
ttataatactacctggctatatgttccttttcaggtgccgctaacacgttttacaattgaattttacaataccgg

SEQ ID NO: 309827 - DNA, 75 bp, Artificial Sequence
  Synthetic
ctgtaataccgatgttttaacacgtttccaatcaatttaatacaatcaatatgattagtataaaaattaagtaat

SEQ ID NO: 309828 - DNA, 75 bp, Artificial Sequence
  Synthetic
caatctagtatatcagatagttgcaccaggtatgcattgtgttccaacttttaactctatcatctttaggctacg

SEQ ID NO: 309829 - DNA, 75 bp, Artificial Sequence
  Synthetic
ttaagtaattaattaaccgtgtgcgatgctgaatcggtgattgtgtagtagcagcgcaatcaacacggtttgacc

SEQ ID NO: 309830 - DNA, 75 bp, Artificial Sequence
  Synthetic
aatagttagaccagcggtgctatcacaacaactacagcaatacttccctgctcaaaacccaggtaatgtacacgc

SEQ ID NO: 309831 - DNA, 75 bp, Artificial Sequence
  Synthetic
ggcttatttttgtttacgaacagcctccatcagctcgtgtaaacataagtaagtagcctgtaattcaggatgttc

SEQ ID NO: 309832 - DNA, 75 bp, Artificial Sequence
  Synthetic
tactgtagtgatttcgctgcaaattaaatcttgtgtgactgatgttgttttagcagatccagattccactcatta

SEQ ID NO: 309833 - DNA, 75 bp, Artificial Sequence
  Synthetic
gcaatgcttaatgatttagttatattgattagaaatatagtaatattaattgctatattgagattttttggttat

SEQ ID NO: 309834 - DNA, 75 bp, Artificial Sequence
  Synthetic
cgccagaataacgaatgtaagaacattgtatggcattccagttgggccagtgtttcctccaaatatggcgtggga

SEQ ID NO: 309835 - DNA, 75 bp, Artificial Sequence
  Synthetic
gctgagataactgagaatgtagatgttgaattgtctgatactgctattgctgatagaagaggaacggtatgttta

SEQ ID NO: 309836 - DNA, 75 bp, Artificial Sequence
  Synthetic
tacaatcgttagagattattcagcatctagacaagataatatgcaaaggttaatgaccatcgctgcgatagattg

SEQ ID NO: 309837 - DNA, 75 bp, Artificial Sequence
  Synthetic
tatgtaccaaacaaagctgctactgaactagctaaaaataatgcaaagccaacatggcaagaaattcttaatcaa

SEQ ID NO: 309838 - DNA, 75 bp, Artificial Sequence
  Synthetic
catgctatccgaataattccatattggttattataccatatggtttattccgatagtatcactgttacgtttggc

SEQ ID NO: 309839 - DNA, 75 bp, Artificial Sequence
  Synthetic
ttattcataacgcagggcattccaataggtgacgttaaatatatattatacacagaagtaaatgagttatttcaa

SEQ ID NO: 309840 - DNA, 75 bp, Artificial Sequence
  Synthetic
atggtttattccgatagtatcactgttacgtttggccgggcaactgtgtagcggcgtaacaggaactttatgacc

SEQ ID NO: 309841 - DNA, 75 bp, Artificial Sequence
  Synthetic
ggcttttaattgctaccatgagcatggatcttgatatagacttagccaactgtgttattgattcaagttcaataa

SEQ ID NO: 309842 - DNA, 75 bp, Artificial Sequence
  Synthetic
tcaaaatcgaggtgtaactataatttgtatgttgttcatggaccagatgacttatcgtatactgcacaactacta

SEQ ID NO: 309843 - DNA, 75 bp, Artificial Sequence
  Synthetic
taggaggatctaatactggatctagattaccttttacgcaagcagcatcttacactaccacatctcttgctggtt

SEQ ID NO: 309844 - DNA, 75 bp, Artificial Sequence
  Synthetic
cttaataagtgggaatgtactgactataattttaatgtttattattatgaacaacaagaaagacattacttaaag

SEQ ID NO: 309845 - DNA, 75 bp, Artificial Sequence
  Synthetic
tggaggaagcggagaatgaacgaagaaaggcaatagagtattcaaaatatatgctagaaaaacaagatttaggtc

SEQ ID NO: 309846 - DNA, 75 bp, Artificial Sequence
  Synthetic
ttcaaaagttcaggtactaattgtgttgcggttgcttgtcctatagattcaacgactttaggaattggatgtgtc

SEQ ID NO: 309847 - DNA, 75 bp, Artificial Sequence
  Synthetic
caaatgattccgcttcgaacgacggaatgaatgaatggtcagtatcatcaagatctttttctacaaatgagtcaa

SEQ ID NO: 309848 - DNA, 75 bp, Artificial Sequence
  Synthetic
tcgactgatgtgaaaacatatgaatcagtaacccaacacgatgcgtttatagatctgattgatcaacagaaatat

SEQ ID NO: 309849 - DNA, 75 bp, Artificial Sequence
  Synthetic
atatggaatctgttaataattttgaaattaacctaccgtctgaccattcttgtgtttcagttaagtcatctaatt

SEQ ID NO: 309850 - DNA, 75 bp, Artificial Sequence
  Synthetic
agaatgaatataacgggtacacaagccataaactgttattatcaagattgtaaattagttggaccagattattcc

SEQ ID NO: 309851 - DNA, 75 bp, Artificial Sequence
  Synthetic
cgatgaattcacaaaattcacaaaatttcaagtccgcagtgcaaagcattactcagcatcaatcacgaattaggg

SEQ ID NO: 309852 - DNA, 75 bp, Artificial Sequence
  Synthetic
tcatatctaattgttgcttcaacagaaagttattttagaaatgttgatggtgacttagatccattgactcaggct

SEQ ID NO: 309853 - DNA, 75 bp, Artificial Sequence
  Synthetic
agaatcctaaaccacaaaagcagtatcaacaaaagaagaggaaacataaagaaaaggctgtgattgatgccattt

SEQ ID NO: 309854 - DNA, 75 bp, Artificial Sequence
  Synthetic
ggagcaagaatgtcacgtataaattttaagcagtggtggcaggtattttatcaaattgtacaaatgattaataat

SEQ ID NO: 309855 - DNA, 75 bp, Artificial Sequence
  Synthetic
ctgatgatgaatggggaaatagagtagagtcatttgatgaatcatcggattcagacacctgtaataatagttgta

SEQ ID NO: 309856 - DNA, 75 bp, Artificial Sequence
  Synthetic
ataataaatcagatgaccaaaactggtacttactatgcgtataatttgtatagataaataatcattaacgttgcg

SEQ ID NO: 309857 - DNA, 75 bp, Artificial Sequence
  Synthetic
ggcaattaattgcgtacgatggggacgtatgatgctttactcgaggaatatatacattttttgtattctgatgat

SEQ ID NO: 309858 - DNA, 75 bp, Artificial Sequence
  Synthetic
agtgttgcaagcgctacaagaaactaaagaaaagtgtgaagcatacagtggctaagcttatatccgatctataat

SEQ ID NO: 309859 - DNA, 75 bp, Artificial Sequence
  Synthetic
accaaaactggtacttactatgcgtataatttgtatagataaataatcattaacgttgcgaacaacattatgacc

SEQ ID NO: 309860 - DNA, 75 bp, Artificial Sequence
  Synthetic
tctttatcagttataccaatctattatacttcaaacgtagatatacatcaagaactatctaagtatcacactgaa

SEQ ID NO: 309861 - DNA, 75 bp, Artificial Sequence
  Synthetic
ggctattaaagatggcttctcgcttttgggtcggaattataaatgactggcaaaatgttcaagcaaggcagcaaa

SEQ ID NO: 309862 - DNA, 75 bp, Artificial Sequence
  Synthetic
aagtgtgaagcatacagtggctaagcttatatccgatctataatcatgcggtgatccccacactgacctgtgacc

SEQ ID NO: 309863 - DNA, 75 bp, Artificial Sequence
  Synthetic
ctgattgagtataataaaatcaaagctagaactaaaaaacatgatttcaataaattagagtctatacatgctaaa

SEQ ID NO: 309864 - DNA, 75 bp, Artificial Sequence
  Synthetic
caattgcgcaaacttcgaacaagaaatttgaaacttatatagatacatctaatgtaggtacagcacaattaccac

SEQ ID NO: 309865 - DNA, 75 bp, Artificial Sequence
  Synthetic
tacaatgaatcaattagtaagtcaagaagattatctatagttgtttatgcatatggtaaacatgatgctgtagaa

SEQ ID NO: 309866 - DNA, 75 bp, Artificial Sequence
  Synthetic
cttctaattttagtaatgataacatgtctcaaccatcggaagatgtatctagtagtctttggtatggaccaaaca

SEQ ID NO: 309867 - DNA, 75 bp, Artificial Sequence
  Synthetic
agaaaaatagttaagtatgctactaagaaaccgttaattgctgatttaactgcgaatgaattagattatgaaaat

SEQ ID NO: 309868 - DNA, 75 bp, Artificial Sequence
  Synthetic
aaccgcagattttgacaaatgctgaataccaacaagtgaaaccagctaaattgttctttaagtttgaaactccaa

SEQ ID NO: 309869 - DNA, 75 bp, Artificial Sequence
  Synthetic
aataaattgacaaaagacctttacgacgaaaaaagctatacagattacttaatggatcctgcaatatctacatct

SEQ ID NO: 309870 - DNA, 75 bp, Artificial Sequence
  Synthetic
aacaatatttaatgtggcaagttgataattacgctgcaggattttataaaaaaggcgataattttggaacagaag

SEQ ID NO: 309871 - DNA, 75 bp, Artificial Sequence
  Synthetic
ttaacgtcaaatttaaatgcgtgtatgttcaccatagaaacagaaactaacgagaaacagcgaaagaggtactat

SEQ ID NO: 309872 - DNA, 75 bp, Artificial Sequence
  Synthetic
taataaaagatgattcaataataattgtgtatgataaaaccagtaatcagaaattgtttactagtacaattatta

SEQ ID NO: 309873 - DNA, 75 bp, Artificial Sequence
  Synthetic
gaattatttacaatagtggcttcaactttacatcattatgggataccacgtcatgactcaaaatatagatatact

SEQ ID NO: 309874 - DNA, 75 bp, Artificial Sequence
  Synthetic
attctatagtgtttagtatttcagagatgacaagtaatcagctcgagctgacagcatatcaaggaaatatgtcta

SEQ ID NO: 309875 - DNA, 75 bp, Artificial Sequence
  Synthetic
tatgaacaaatgcgagacaagccatattatattgttccgtgggctaactcagctatagaaatgttaatgtcagta

SEQ ID NO: 309876 - DNA, 75 bp, Artificial Sequence
  Synthetic
gatcgattgctaatattaccgatcaaaattttaatttggatattagacaagattactattcatgtgcttcaacac

SEQ ID NO: 309877 - DNA, 75 bp, Artificial Sequence
  Synthetic
aataatcatgatgattttgtaatagcacgagaattaattacttactctttctcaaatagatcaacattagcgaaa

SEQ ID NO: 309878 - DNA, 75 bp, Artificial Sequence
  Synthetic
tatttccaactctatataaaaatgaaatgcattatgtaatagaaagaaatgctaaggtattatcaaaagctttaa

SEQ ID NO: 309879 - DNA, 75 bp, Artificial Sequence
  Synthetic
atagtgtcatcaccaatgtcaattatgactgcattactagacataaatggtacttttatcactgatgagtcacta

SEQ ID NO: 309880 - DNA, 75 bp, Artificial Sequence
  Synthetic
ctgaagaaactgtcgtgtcacaagctggattatggaaggaagtgaggtatgcagctgatataacactacgtttct

SEQ ID NO: 309881 - DNA, 75 bp, Artificial Sequence
  Synthetic
cagttacaatattcatcaaaaatgattaaagcgcttgttacagatgaagcaaaaaaagaactcgaagaaatgtta

SEQ ID NO: 309882 - DNA, 75 bp, Artificial Sequence
  Synthetic
attttcaatcagaagctataaggaagggtggatttggttatcaattttcaacgtctaactttaaaccctggacgt

SEQ ID NO: 309883 - DNA, 75 bp, Artificial Sequence
  Synthetic
caaaaaatgattgacttaggattagttgatattcctaatatattgttatcatggattgagaatccgaggcttgat

SEQ ID NO: 309884 - DNA, 75 bp, Artificial Sequence
  Synthetic
ctgtatattcatatacacgtgacaatgagaatgttaccgcacatgttacagttactttgaatggactatcagtat

SEQ ID NO: 309885 - DNA, 75 bp, Artificial Sequence
  Synthetic
acattccacagagttgcaaatgtatattcatggtcgtttcatgtaggatataggaagcagttaatgcaggatgct

SEQ ID NO: 309886 - DNA, 75 bp, Artificial Sequence
  Synthetic
attcacaaagaggagcagtaccaactgattttgcaattgatagaatggaatgtattacaaatgatacatatatgt

SEQ ID NO: 309887 - DNA, 75 bp, Artificial Sequence
  Synthetic
gtgcaagatcagttgtcagttgaatactcagagaatgttgataaaactatgtatgatgagtactataattacata

SEQ ID NO: 309888 - DNA, 75 bp, Artificial Sequence
  Synthetic
atattgactattgggatacttcaaatttattcagaaacatggtatatgttagagatcttaaagtagagcaatcat

SEQ ID NO: 309889 - DNA, 75 bp, Artificial Sequence
  Synthetic
aaggaagattacatccgtatgcttaaagatgacgttattaaatcaacgacgattcttaagcagcatgaactagct

SEQ ID NO: 309890 - DNA, 75 bp, Artificial Sequence
  Synthetic
caattagaatagggttctggccatatatgagatcactgacattaccagtaggaagtataactccatattatcctt

SEQ ID NO: 309891 - DNA, 75 bp, Artificial Sequence
  Synthetic
ggccttttatctatgtcgtcagcttcgaatggaaagaaaatggaaataaaatttggaagtaaaaaattgtttact

SEQ ID NO: 309892 - DNA, 75 bp, Artificial Sequence
  Synthetic
tcggtataacaccaaatggtgtgattaatgcagatttaatatgtgaagggataacgttatcaactcaatttacag

SEQ ID NO: 309893 - DNA, 75 bp, Artificial Sequence
  Synthetic
acaaggaaaaatatgcatgttatgtctgacgtatcttctggaaattataattcatcaatagttccgccagttgat

SEQ ID NO: 309894 - DNA, 75 bp, Artificial Sequence
  Synthetic
atgcagcgtcaatgaattcattacgctttatattcaaatttaaaaattttgacccaccaaatggtaatataacaa

SEQ ID NO: 309895 - DNA, 75 bp, Artificial Sequence
  Synthetic
gcaactagcccaataccgttaggtagaagagatgtaccaggtagaagaacacgcgtaatttttatacttccgtat

SEQ ID NO: 309896 - DNA, 75 bp, Artificial Sequence
  Synthetic
gaatgaaagtgaccggagtcccagcagcatatatgcaatatgcacaagtaggaggaaatccaggaaatccaggag

SEQ ID NO: 309897 - DNA, 75 bp, Artificial Sequence
  Synthetic
gaatattttttagcacaacatgccatagtagagttgttactaaagcaagcaaaacatactagagaattttccgaa

SEQ ID NO: 309898 - DNA, 75 bp, Artificial Sequence
  Synthetic
atccatttaattataatgtaagattttcgatgatatcattaataccagcaaatgatgaatataaaacgccaattg

SEQ ID NO: 309899 - DNA, 75 bp, Artificial Sequence
  Synthetic
ttttattcgtcagcaaatcaattactgtcctacggtgatacaatgagagaattaaatccttcaactattattatt

SEQ ID NO: 309900 - DNA, 75 bp, Artificial Sequence
  Synthetic
cagcttcagtcaccgtacgtcaagatttggatattaagttaagccaattacgacaggaattcaatcaagtggcag

SEQ ID NO: 309901 - DNA, 75 bp, Artificial Sequence
  Synthetic
tacactgatgtgtcacaatgggacggctcgcagcacaatactcaaccattcaggaaagcgattatggcagctatg

SEQ ID NO: 309902 - DNA, 75 bp, Artificial Sequence
  Synthetic
aaaatttagccgtttctcaagcgataggtttggcaactatgccatttgatatgctatcaatgttttcaggtactt

SEQ ID NO: 309903 - DNA, 75 bp, Artificial Sequence
  Synthetic
caagatttacaagcatatactactgatcaaaatgttgaacgagcgttaaataaatattatgaaacgcagagacag

SEQ ID NO: 309904 - DNA, 75 bp, Artificial Sequence
  Synthetic
ttgacgtagtacaaaacattggtgattttacgtcaacgcttttttcaaaattttcaaaaacaactactggagttc

SEQ ID NO: 309905 - DNA, 75 bp, Artificial Sequence
  Synthetic
ttgatgaattcatatgtcacaattgatgataaaattattcaatatggcgctgtagcgtcaggtgaaaagcagact

SEQ ID NO: 309906 - DNA, 75 bp, Artificial Sequence
  Synthetic
aattacttaaatatacaaaatatacagatgaattggtagatgttgctacatcgacagatgatgttttggaagtgg

SEQ ID NO: 309907 - DNA, 75 bp, Artificial Sequence
  Synthetic
aaaatagctaattctattgcaaatttagctctaataaagactgtactaaataaattatctgcaaaatacacattt

SEQ ID NO: 309908 - DNA, 75 bp, Artificial Sequence
  Synthetic
caacaattgcaaataaagcgaagataatgaaatcagtagagactatgactgattcactagattttgaggacattt

SEQ ID NO: 309909 - DNA, 75 bp, Artificial Sequence
  Synthetic
aatattaagttaataagagttgatggtgatgacaattatactgtaattgaatcacgctctcaagtaacccaagag

SEQ ID NO: 309910 - DNA, 75 bp, Artificial Sequence
  Synthetic
caacagctgttttgaataaagcaatgcgtgaaattggtacacaaacagattataattctatagctcagatagcag

SEQ ID NO: 309911 - DNA, 75 bp, Artificial Sequence
  Synthetic
ttattatcaaatttgtcaaaggacattaaggacacttatgcacttatgaacgttaaagttaaagctttagtatca

SEQ ID NO: 309912 - DNA, 75 bp, Artificial Sequence
  Synthetic
ctgagtcaattgatatgataccgactaaagcttaccgagtaattgataatgcatcagacacggtttatgaagtaa

SEQ ID NO: 309913 - DNA, 75 bp, Artificial Sequence
  Synthetic
actaccggacttgaaatggcaaaaaggtacatcgcgggaggacgtatttattttagagctggtattaacatttta

SEQ ID NO: 309914 - DNA, 75 bp, Artificial Sequence
  Synthetic
gtaaggatgctaatatagcatataagttaactgatctaagtcaaattcaattcgatattgataagtttaaaaagc

SEQ ID NO: 309915 - DNA, 75 bp, Artificial Sequence
  Synthetic
aataatgagaagagaaatcaacaaactgcttgggatcaggcagccattttatacgcatcatatacagttaataaa

SEQ ID NO: 309916 - DNA, 75 bp, Artificial Sequence
  Synthetic
tttcatctgagtccccagtattatctgcaattattgattttaagacaattaaaatgatgaatcaagcaaatggta

SEQ ID NO: 309917 - DNA, 75 bp, Artificial Sequence
  Synthetic
ttaagaggatttataaccaatagaacattcatactcacaaaaataatgcagatgacatcagttaagatatcagga

SEQ ID NO: 309918 - DNA, 75 bp, Artificial Sequence
  Synthetic
aattggacagaattacgttagacaatttacttgcatctaatccacaaatactcaaaactatgattgcgcaaaata

SEQ ID NO: 309919 - DNA, 75 bp, Artificial Sequence
  Synthetic
gtattgcgaatctttccagctagtgatgttttaacattaaactcaacttacaaagtatttgatgaagttgactac

SEQ ID NO: 309920 - DNA, 75 bp, Artificial Sequence
  Synthetic
aataatccgataattgtgcgtagagttcaagagctaattgatcaatgtagactttgagcgagaaacagtatgacc

SEQ ID NO: 309921 - DNA, 75 bp, Artificial Sequence
  Synthetic
ggcatttttaaagctgttaacgagaaggttgcggcctaattgttagtggttttaaaagacctgttattcgaaatg

SEQ ID NO: 309922 - DNA, 75 bp, Artificial Sequence
  Synthetic
gctgttaattataaagttgatgctgattcattaatgctgcagaagctattaatcaaagtctctcagtcaagatca

SEQ ID NO: 309923 - DNA, 75 bp, Artificial Sequence
  Synthetic
gcaactgaggcttcgatgagacatgccttgaaagttcttgagacaacatgtgaagaagtggtaaagcagattatc

SEQ ID NO: 309924 - DNA, 75 bp, Artificial Sequence
  Synthetic
aaggttgctgatgagatttccaaatcgcatattttttcaaattacgtaaaatatatttcaactatgttattaaaa

SEQ ID NO: 309925 - DNA, 75 bp, Artificial Sequence
  Synthetic
actgagaaagggctagtttacgccagaggagaagcacgcagaagattggaatatgtgttagatgatacaggaatt

SEQ ID NO: 309926 - DNA, 75 bp, Artificial Sequence
  Synthetic
ataccaaataaaacaattgaacaaggtttagctaagactgagaaggcgaaattaaattcatatccaccgatatca

SEQ ID NO: 309927 - DNA, 75 bp, Artificial Sequence
  Synthetic
aaaggagcactgatttgtagagcaaaaactattgatcatgcgcttagaggaaaaatggaatcagcagagaaaaac

SEQ ID NO: 309928 - DNA, 75 bp, Artificial Sequence
  Synthetic
ttagagaagagaaaaacacaactcgatacactaattaaaacactgcaatatccgattatttatgtaggcgggaaa

SEQ ID NO: 309929 - DNA, 75 bp, Artificial Sequence
  Synthetic
catgagtatatgacgagaatagagactgtggaaaaacttgagtctgacctgctacaaatgcgcacacaactatca

SEQ ID NO: 309930 - DNA, 75 bp, Artificial Sequence
  Synthetic
acaacactaaacgatgttgtctcagtcgttgaccaatatgtagaatataagagtattgatccagagaagaagtat

SEQ ID NO: 309931 - DNA, 75 bp, Artificial Sequence
  Synthetic
ttacgtgggatagatcgtaaagctagagtgctagcttcattgtttgatgttacaccctggaaggggtcgaaggtg

SEQ ID NO: 309932 - DNA, 75 bp, Artificial Sequence
  Synthetic
agaaattactctccaatgttgccaactgatataagtgaagttattacagtaattggttcacgactatcatcttat

SEQ ID NO: 309933 - DNA, 75 bp, Artificial Sequence
  Synthetic
actagtactgttgtgatgtcagatgtagctaaagaaaagtttaagaatggttcgttacgtgttgcagatgattgt

SEQ ID NO: 309934 - DNA, 75 bp, Artificial Sequence
  Synthetic
gaagaccatgctggtaaatccgctatagcaaaattaatttctacttattcagtctacaggccatcaattgaagaa

SEQ ID NO: 309935 - DNA, 75 bp, Artificial Sequence
  Synthetic
gaattgtggacaaatgttagatctactgaaatggcggttgaactcgaagaagcgaagagactgctggcaacacgt

SEQ ID NO: 309936 - DNA, 75 bp, Artificial Sequence
  Synthetic
ctatatgctataattacgaaaagagagaatgaaattaagctctacatgttatcactttctgtgccattacaggat

SEQ ID NO: 309937 - DNA, 75 bp, Artificial Sequence
  Synthetic
caagaagatttaattcagacaagaaaggcatatcaagatgttttggcatatgctgagaaactaaacgctagcatt

SEQ ID NO: 309938 - DNA, 75 bp, Artificial Sequence
  Synthetic
gttgatgcttatatagcatctcaaacgtataaaagagataaatatcttattttgcagtcatatgtttatgattta

SEQ ID NO: 309939 - DNA, 75 bp, Artificial Sequence
  Synthetic
gatctattgaagaaacagaacagtgagttatctgagaaatgtcagttgtgggaaaagatgtcaaaacaaaaacag

SEQ ID NO: 309940 - DNA, 75 bp, Artificial Sequence
  Synthetic
ttatcaataaattatggtgcttatcaattatttgattttgaatcagaattttttagtaaatatataacatatgta

SEQ ID NO: 309941 - DNA, 75 bp, Artificial Sequence
  Synthetic
ctaacaacggaagagagaattattgatactcagcgtaaggaggatagcagacttgaaaaaatggagagacaattg

SEQ ID NO: 309942 - DNA, 75 bp, Artificial Sequence
  Synthetic
gctatgtcgaaagttccgagtgcagaatttctagtagggacgtacgtaaaattgaaaattattaatagatacctc

SEQ ID NO: 309943 - DNA, 75 bp, Artificial Sequence
  Synthetic
agtacatacactaagctgcttgaggaacaagacaaaatgctgagagaagagagatctgagcgagcttatattgaa

SEQ ID NO: 309944 - DNA, 75 bp, Artificial Sequence
  Synthetic
acagagcgaaagtggtacagtgctaatattacaatacctaaacacgaatatatgaaaataaataaattaacgtgg

SEQ ID NO: 309945 - DNA, 75 bp, Artificial Sequence
  Synthetic
gcgaaatacaataccctattaacacaatttgcaagcgcatctgaagaggaagctccttttgatcaagttgacgga

SEQ ID NO: 309946 - DNA, 75 bp, Artificial Sequence
  Synthetic
gtgggagatttcttcagttcgatcaccatacacatctgcgaatttcttccaagagtaagctgcaataatgtgacc

SEQ ID NO: 309947 - DNA, 75 bp, Artificial Sequence
  Synthetic
aagtttaaaataacaattgaatgtgaaatgagtttgacaagcaaaattctatcaatggcaactggttacggggag

SEQ ID NO: 309948 - DNA, 75 bp, Artificial Sequence
  Synthetic
attaagcggagatataaacatgcaaaaaagctaatcaaatctatggcaaacatggcaaaattaatggtagaagtt

SEQ ID NO: 309949 - DNA, 75 bp, Artificial Sequence
  Synthetic
ccagatgataacatggagaaagaagtagacgagactaatgaaatcagtgatgtagattaaaaagtgagaattatt

SEQ ID NO: 309950 - DNA, 75 bp, Artificial Sequence
  Synthetic
taatcagaaatcaatatttaattgggcactctaaaagcctcagtgtcattgccaatacaccaattggacgaataa

SEQ ID NO: 309951 - DNA, 75 bp, Artificial Sequence
  Synthetic
aagcctcagtgtcattgccaatacaccaattggacgaataacaataaaccagcatgacactggggtcatatgacc

SEQ ID NO: 309952 - DNA, 75 bp, Artificial Sequence
  Synthetic
ggctattattggcaggatgtccagtaataaggcaaaacaacgtttagaggaattaaagaataaaagagaagcgtc

SEQ ID NO: 309953 - DNA, 75 bp, Artificial Sequence
  Synthetic
tcttaaaaaagcaataaatgaaggtgctgaagcagtgaaaaagttagtagatcaacagaatgacgagaattcagt

SEQ ID NO: 309954 - DNA, 75 bp, Artificial Sequence
  Synthetic
ccaatctgaacaaacattaagtcagtcagacactaaaacaaaagaagataaaaaagagaaagagaatagtcagat

SEQ ID NO: 309955 - DNA, 75 bp, Artificial Sequence
  Synthetic
acagcaatcagacgaagtaaaatcattagaagatgtggaaaaagcagcgaaagagaaaagagatgggactagaca

SEQ ID NO: 309956 - DNA, 75 bp, Artificial Sequence
  Synthetic
tcttatagaagtccttaaaactaaagaagatagtgaaaaagaaatacagaaagaaatattacagaaggcaatacc

SEQ ID NO: 309957 - DNA, 75 bp, Artificial Sequence
  Synthetic
aacttatacaccaaatgatgaggcagttaaaaaattgtctgagattaaaattgaagagaatgcggaaattaaaca

SEQ ID NO: 309958 - DNA, 75 bp, Artificial Sequence
  Synthetic
attatttagactatttgagccagaagttgttccaatttatgcaaacgatggtagaaagactttaattactgcatg

SEQ ID NO: 309959 - DNA, 75 bp, Artificial Sequence
  Synthetic
gtattggaagcttaaaaaagatgatataccaactggagattacacagttagagaatactttctatctctatatac

SEQ ID NO: 309960 - DNA, 75 bp, Artificial Sequence
  Synthetic
tcacgtcattgatacaatgccaccatatataatgctgagaagtatggctgtagacaataagcattcacgtgaagc

SEQ ID NO: 309961 - DNA, 75 bp, Artificial Sequence
  Synthetic
aggtaaagtagtagatgcggaaactgcctcaattcttgaaaaattatttgcagatgaacaaacagatgcaatgac

SEQ ID NO: 309962 - DNA, 75 bp, Artificial Sequence
  Synthetic
aagaagatatattgcagaaatgagacatagagttaacgctgaagctaatatagttagatatcaagcagtgctgca

SEQ ID NO: 309963 - DNA, 75 bp, Artificial Sequence
  Synthetic
tccagttgactatgaatttaatcaatatttcttggagcatcagatattaagaccactaacaacacgtgagatatt

SEQ ID NO: 309964 - DNA, 75 bp, Artificial Sequence
  Synthetic
tcagatgataccaacacgtatgagaaatgatgttaattatatatttactatcgataattcctttcttgaaacagc

SEQ ID NO: 309965 - DNA, 75 bp, Artificial Sequence
  Synthetic
aagatatgttccttataatctgttgcaagatagattaaatctacatgaaggtctacagtctatatgggaaacatt

SEQ ID NO: 309966 - DNA, 75 bp, Artificial Sequence
  Synthetic
aacgttaactaattatgtgcatgccagaactgcagtgcctgatctagtagatcttgtagacacagaaacacaaat

SEQ ID NO: 309967 - DNA, 75 bp, Artificial Sequence
  Synthetic
taaagaaatgtcgcaaatgttgcaattagaagcgatgacaatacagtccgaatcacaatttataacaggtattaa

SEQ ID NO: 309968 - DNA, 75 bp, Artificial Sequence
  Synthetic
ttctgacgccgcaaatgaattctttaaaactgttatagctgcttgtttgtcacagcgcactttaagaatggaatt

SEQ ID NO: 309969 - DNA, 75 bp, Artificial Sequence
  Synthetic
tactcaagcgaattatatgtcattattgtctggaatgtttgtattagctctcgttccgaatgaacttattcttcg

SEQ ID NO: 309970 - DNA, 75 bp, Artificial Sequence
  Synthetic
tgaatcactgaattctctgcaagtagcgataataaatacaattttatgtccagcttttgacattccagctatgca

SEQ ID NO: 309971 - DNA, 75 bp, Artificial Sequence
  Synthetic
gtataattatttagaaatacagactccatttgagctcattttaccacgcatagtttcacgacaagtcagagatta

SEQ ID NO: 309972 - DNA, 75 bp, Artificial Sequence
  Synthetic
tttacaccatgtcaacaataaccacttcctatataatgtagtagatggagtaagaaatgcctctttacaaaatat

SEQ ID NO: 309973 - DNA, 75 bp, Artificial Sequence
  Synthetic
tattagatcaggagcgatagtacaaaatgtagccgctgctttgttaaatatagcaggccaaccatttcgcgcgta

SEQ ID NO: 309974 - DNA, 75 bp, Artificial Sequence
  Synthetic
taatcaggagtataaaagatcaatacaaagagcaattactatattaacgagacgtgcgccacagattgaagattc

SEQ ID NO: 309975 - DNA, 75 bp, Artificial Sequence
  Synthetic
atttaggatgttgatttacaattatgaagtgattcaaagattcatagtaatgaatcagcaatatgcacaaactat

SEQ ID NO: 309976 - DNA, 75 bp, Artificial Sequence
  Synthetic
aaacaccgaattagtgaatatgacagcagctacgtcgtatttcatgttaatgtcaaatagagctgtatatccaga

SEQ ID NO: 309977 - DNA, 75 bp, Artificial Sequence
  Synthetic
tgcatctgttctactacagtattataaagtgaacatcagatttttgcataattataacgaggcaattgatgatac

SEQ ID NO: 309978 - DNA, 75 bp, Artificial Sequence
  Synthetic
cgtagctaccctactcgtatctcataggttaaatctctatcagaagaaaatactgtcactggtaactgaatttat

SEQ ID NO: 309979 - DNA, 75 bp, Artificial Sequence
  Synthetic
gcgtaaattaaaaatatttgatgctccaaagattccaccagatcagatgtatttactaaggaataggatgaggca

SEQ ID NO: 309980 - DNA, 75 bp, Artificial Sequence
  Synthetic
attaccagttgaacagagaagggctgatgtatacaatataatggagacacatagaacacagattgaacgcgcttc

SEQ ID NO: 309981 - DNA, 75 bp, Artificial Sequence
  Synthetic
aaaacgaattgcacagggagttgtattaatgcaacaagaagcaccattacaacatgacccaattgtcggttatac

SEQ ID NO: 309982 - DNA, 75 bp, Artificial Sequence
  Synthetic
taatgtaacaagaaatttagatggttatagaaccatctcacttgaagatttgcagatgcgtggagattttcaacc

SEQ ID NO: 309983 - DNA, 75 bp, Artificial Sequence
  Synthetic
attaacggacgttttgttagctaaccaaccaattgctttacaaggtgcaataacgtacaaaactgaaactgatcc

SEQ ID NO: 309984 - DNA, 75 bp, Artificial Sequence
  Synthetic
atttgctgtattagctaaatctgacgttgcagtatttgcgccaataataaaagagcggaatctaaatgctttaaa

SEQ ID NO: 309985 - DNA, 75 bp, Artificial Sequence
  Synthetic
tccaatttcatatgaaataaattcagactcaaaaggcttctatatagttcataataattcatgggttccgacatc

SEQ ID NO: 309986 - DNA, 75 bp, Artificial Sequence
  Synthetic
aaatactaaattattcaaacaaccgccacgcaaatttgttctatctgattcaacattctttttagagtctggact

SEQ ID NO: 309987 - DNA, 75 bp, Artificial Sequence
  Synthetic
gttttacactatatttaccgatccattgtcatttatatcacacacttcagttgaaccggttaatgctgtagcttt

SEQ ID NO: 309988 - DNA, 75 bp, Artificial Sequence
  Synthetic
agcttttgatggtcatagaatcgtcagaacgctctaaacggccttagctggaggagtattatctccattgtgacc

SEQ ID NO: 309989 - DNA, 75 bp, Artificial Sequence
  Synthetic
ggcttttaaacctcatcttagttatacgtaccctcagtggttttgacaagctgtattgaaatggatgctagtagc

SEQ ID NO: 309990 - DNA, 75 bp, Artificial Sequence
  Synthetic
atcatgatgaatataatgaatataacaggaaatgacactgctgcaaatggtagcgtggaaacacttactaatatg

SEQ ID NO: 309991 - DNA, 75 bp, Artificial Sequence
  Synthetic
attaataattacattactaacaatccaggcacgtttctatacacaataatcaccacgctatcaacaatgtttgct

SEQ ID NO: 309992 - DNA, 75 bp, Artificial Sequence
  Synthetic
atatctaaaattggagtaattaaggtaataagtaaaccactagtttcgatttcgaagaagattaaagaactggtt

SEQ ID NO: 309993 - DNA, 75 bp, Artificial Sequence
  Synthetic
atggtatgtgtagatagaatgcttaataaggtaggtgttgatgtagctataactgatcaaatgagattgaatatg

SEQ ID NO: 309994 - DNA, 75 bp, Artificial Sequence
  Synthetic
gatcttgactacattaaaaatgaactaaatgaactgaagatgctagtggtaaaaaatacgctatgcagaactgta

SEQ ID NO: 309995 - DNA, 75 bp, Artificial Sequence
  Synthetic
tttgtagatcgtgcgcagcaaacagataagcagcaagatacatcaaaggtaaagtctaaattggatagtactgcg

SEQ ID NO: 309996 - DNA, 75 bp, Artificial Sequence
  Synthetic
aatgctacccacgtagatacagtgatgaccgaaaccgtaaactgagtgctcctgttggtttagccatctcccaac

SEQ ID NO: 309997 - DNA, 75 bp, Artificial Sequence
  Synthetic
agggcagcgtataacatactgtaccaagcctcgtgcccagccagagtgcagcgatcagctaacggatgagttatg

SEQ ID NO: 309998 - DNA, 75 bp, Artificial Sequence
  Synthetic
gcagcgtataacatactgtaccaagcctcgtgcccagccagagtgcagcgatcagctaacggatgagttatgacc

SEQ ID NO: 309999 - DNA, 75 bp, Artificial Sequence
  Synthetic
ggctattaattgaagcctatcagcgtttcaagcgttggtatgcggatgttaatttgcaataaacagcagttgaga

SEQ ID NO: 310000 - DNA, 75 bp, Artificial Sequence
  Synthetic
cgacaagctgcgaattcatctatatatacatataacactgaattatcacaatatgaaaacgcatttttatgttca

SEQ ID NO: 310001 - DNA, 75 bp, Artificial Sequence
  Synthetic
aatgttacaactgatattgtatttgtcgatacaaatcatgatcaatctatgtcgaattttgttaatatcttaaga

SEQ ID NO: 310002 - DNA, 75 bp, Artificial Sequence
  Synthetic
acaaatggtattgcacgtgttgatgtacgtaaatctgatgaattgtttgatatactagtttcatcgtcatttata

SEQ ID NO: 310003 - DNA, 75 bp, Artificial Sequence
  Synthetic
tttgactataaatctagtacaatttatcttatggattactcatattataaagaatttgatttagcgacggaccag

SEQ ID NO: 310004 - DNA, 75 bp, Artificial Sequence
  Synthetic
ttttgggcatatgaagaattaaaaaatgcaggctacaaaatagaatatacaggatacatgggtagagagagaatg

SEQ ID NO: 310005 - DNA, 75 bp, Artificial Sequence
  Synthetic
aagtttatcggtaactattttttgacaaatatagctacagacgatgatataatatcggcatacatatatgatgca

SEQ ID NO: 310006 - DNA, 75 bp, Artificial Sequence
  Synthetic
tgtatcattgatttcaaacagtttctattccagaaaaaattagaacgcctatcccatgcactagactttaatagg

SEQ ID NO: 310007 - DNA, 75 bp, Artificial Sequence
  Synthetic
cttgaatcacgagtattgagacacgtaatttactcaagatcaatctataatcacatagttggtccgagaaatgaa

SEQ ID NO: 310008 - DNA, 75 bp, Artificial Sequence
  Synthetic
tcagctatcgccttattatggtcaaatatgaaatttagacattacgcaaataatctaccagtagcgattaatatt

SEQ ID NO: 310009 - DNA, 75 bp, Artificial Sequence
  Synthetic
atgcgacagggaacgtcaaaattcgcggaaagaattaactcacaatttgacataggacaatataaaaatatgatg

SEQ ID NO: 310010 - DNA, 75 bp, Artificial Sequence
  Synthetic
aatttcttaactgtatggttcagatatattacggtatacggaaaatcaccagattgtgcttatattataggttcg

SEQ ID NO: 310011 - DNA, 75 bp, Artificial Sequence
  Synthetic
tcaccagcacgttggttaaaagacattccacaacatatactagaaaagatttttacatatgatccgaaggagaca

SEQ ID NO: 310012 - DNA, 75 bp, Artificial Sequence
  Synthetic
gaattctcattacaccattttaagcaactattcgaaataagtgatgttaaaagtttgtccaataattcggtagtt

SEQ ID NO: 310013 - DNA, 75 bp, Artificial Sequence
  Synthetic
tatattgatatcagaacagatggtgatagatcatactctaattgggaaaaacgacgtaatcaagtagaaactgag

SEQ ID NO: 310014 - DNA, 75 bp, Artificial Sequence
  Synthetic
tcaatgaaaaatatggaacttgcccaaatgatcctgaaactaaaaagaaactgcattgtaatgtataaattaact

SEQ ID NO: 310015 - DNA, 75 bp, Artificial Sequence
  Synthetic
gctatggatttcaatattccagtaaatgcatattttattcattttccaacaactaatactcgttctgagttctat

SEQ ID NO: 310016 - DNA, 75 bp, Artificial Sequence
  Synthetic
ttgctccaggatgagctgtctgcaactgaatatgttacaaaaggtaactgttattatgctattaataacttcact

SEQ ID NO: 310017 - DNA, 75 bp, Artificial Sequence
  Synthetic
tccgacaacgtgtttatatcaccaaaatttcatttaacaaagagaaataagggtcgagaagtgtgtgcactatat

SEQ ID NO: 310018 - DNA, 75 bp, Artificial Sequence
  Synthetic
gcgttatcaaatgtgattaatataaagactgacgtgttacagtacataaatcaaacaaataaaggggtctacaca

SEQ ID NO: 310019 - DNA, 75 bp, Artificial Sequence
  Synthetic
cttagattggcaaatgattttgatttaagttgtaccattaaatttaaagatggggcagatttcctcacattacca

SEQ ID NO: 310020 - DNA, 75 bp, Artificial Sequence
  Synthetic
actgagttacgatcagacgataatacacttataacgtcacacagaggggcattaggatattacaatttgtgcact

SEQ ID NO: 310021 - DNA, 75 bp, Artificial Sequence
  Synthetic
acacacgatgataaaccaacgggtaataatcatatttatataatcaagaacgtgataaagccaattgatgacaca

SEQ ID NO: 310022 - DNA, 75 bp, Artificial Sequence
  Synthetic
tatgctggacattattcaatatcaagaagatcgcatacagtaaggttttcagaaacagcaactaagttagcaggt

SEQ ID NO: 310023 - DNA, 75 bp, Artificial Sequence
  Synthetic
tatatgtttcgtgacttagtagcaaatggaccagactacaaactctcaaatacggatataaataatagtgcatca

SEQ ID NO: 310024 - DNA, 75 bp, Artificial Sequence
  Synthetic
ggacatgtatgtaatgctataatttattatagacataattacacttttgatttgatgaattggttacgtaaacat

SEQ ID NO: 310025 - DNA, 75 bp, Artificial Sequence
  Synthetic
gcaattggtacatataaaatagttggcggcagatatgaaaaacatgctgttaaagaaattttaaatgcaattgaa

SEQ ID NO: 310026 - DNA, 75 bp, Artificial Sequence
  Synthetic
tctgctataatgttcacgaggttaaataatgatttaacaggacaaaattatgctcagcaatgtaaagatgtattc

SEQ ID NO: 310027 - DNA, 75 bp, Artificial Sequence
  Synthetic
caacgcattcgtcgaagtggactaataatccacctgttgtgcgggagtcgtgcccagccaggctccaatcagacc

SEQ ID NO: 310028 - DNA, 75 bp, Artificial Sequence
  Synthetic
ggcttttatttttgatatagagcagtcggtccggcaaaatcctgcctgccgtgtcatggccgagctgggttgttt

SEQ ID NO: 310029 - DNA, 75 bp, Artificial Sequence
  Synthetic
cgtttgggttgaggaattggatggctcagaagatacttgtgtctttagggcgtttagtcgtaaagcagttgatgt

SEQ ID NO: 310030 - DNA, 75 bp, Artificial Sequence
  Synthetic
gcttacaaaatacgattttaaggatgatgatactgaagttgtgcaaacaatttatggaccaacaccacctagaaa

SEQ ID NO: 310031 - DNA, 75 bp, Artificial Sequence
  Synthetic
gcatcttcgtaggtttaagactagaacgaacaaatcaggatttcactgggataatgatgtttatgacggatgctg

SEQ ID NO: 310032 - DNA, 75 bp, Artificial Sequence
  Synthetic
taagatgttggctactgttttaaatactgcacatcttaaaggagaacaagctaagaaattgttgaatagtgttat

SEQ ID NO: 310033 - DNA, 75 bp, Artificial Sequence
  Synthetic
gtcagtaaggcatcttgagggaatatataaaagaatgaatgatgcagaagataggctactggatgatgatggtaa

SEQ ID NO: 310034 - DNA, 75 bp, Artificial Sequence
  Synthetic
gactcatctcttgtctgtactaattatgcttggggcaacgaagaaaattgagactactgtaacatcagaaggtgg

SEQ ID NO: 310035 - DNA, 75 bp, Artificial Sequence
  Synthetic
tactattgaatatatgaataagtacttcacgatattcaaattagactattcaaattataaaatggcgccactgca

SEQ ID NO: 310036 - DNA, 75 bp, Artificial Sequence
  Synthetic
aacaattgagtataaaattacattcaatagtgattcagacaacataccagatgatgcgtttaaaaaactaggtgg

SEQ ID NO: 310037 - DNA, 75 bp, Artificial Sequence
  Synthetic
atatattaaatttaattacaacaagtacatgccaataacacatggtaaaggacactggagactagttcactactc

SEQ ID NO: 310038 - DNA, 75 bp, Artificial Sequence
  Synthetic
agagactgcgcaacacgctgagagaatagctgcgactcttaaagctattaaagcaataagaccagactataaaac

SEQ ID NO: 310039 - DNA, 75 bp, Artificial Sequence
  Synthetic
aatgcagctttctgaatatgttactgctaggaattggatggaatttatgctagcaatagagtctggtatggatgt

SEQ ID NO: 310040 - DNA, 75 bp, Artificial Sequence
  Synthetic
acaaaaagcaaaagatcaatgcttgtttaagcgtgttcaatttactaaagaagtcaaagcacatgctagagaact

SEQ ID NO: 310041 - DNA, 75 bp, Artificial Sequence
  Synthetic
cgctatatcatctatgtctgttataaacggaaattgagtactacccaataacttgatcctgaaacttccaaaaat

SEQ ID NO: 310042 - DNA, 75 bp, Artificial Sequence
  Synthetic
tgttataaacggaaattgagtactacccaataacttgatcctgaaacttccaaaaatctatatcatactacgacc

SEQ ID NO: 310043 - DNA, 75 bp, Artificial Sequence
  Synthetic
ggcttttaaagtgtgccgattcagagatggcttcgctactggttaagttgtactatattctgcgtttacttggag

SEQ ID NO: 310044 - DNA, 75 bp, Artificial Sequence
  Synthetic
ttacgtactcgcatcaagtggttggaaacaaatttttgaaacgacatctgaaaacaacgctaggaattgtaccaa

SEQ ID NO: 310045 - DNA, 75 bp, Artificial Sequence
  Synthetic
cagatgaatggagagaaacaccatgcacgcaacaatcactggtcactggctgttgtctttcatgcggtagagtga

SEQ ID NO: 310046 - DNA, 75 bp, Artificial Sequence
  Synthetic
gatcattgttctcctgcattctttgtcatgtaccacacatatgtcataattgcctatcactgaatttactgatct

SEQ ID NO: 310047 - DNA, 75 bp, Artificial Sequence
  Synthetic
gtccatttgttccaatgaaaaatagatttgaaataacagcaatttataaaaagaaggagaatgaaactactttca

SEQ ID NO: 310048 - DNA, 75 bp, Artificial Sequence
  Synthetic
caatcactgatttaaagttaatgatcggaaaatggtttgatttgttgtcaataggtgaaaaaaggctggaaaaaa

SEQ ID NO: 310049 - DNA, 75 bp, Artificial Sequence
  Synthetic
ttcaaagactaaggaaacagagattgcattatggacttggaaatacaattgatctaaattcattcttgattccat

SEQ ID NO: 310050 - DNA, 75 bp, Artificial Sequence
  Synthetic
atactgtaatgaaaattgagaccagaaattacgttatttacgatttggcttattatgatactgtgaaatcacaaa

SEQ ID NO: 310051 - DNA, 75 bp, Artificial Sequence
  Synthetic
atacgagttacagtttgattaatttagataaattagttggcgcaagacaattaatttctcaaaataactttgaac

SEQ ID NO: 310052 - DNA, 75 bp, Artificial Sequence
  Synthetic
taatacaacaaaggaaatttatgggtatgagtgtagttccagcaacgtttactttgaacctagtagtcgagcgag

SEQ ID NO: 310053 - DNA, 75 bp, Artificial Sequence
  Synthetic
aaacatggccggtagagaatgattatccggtatactcacaatcttatcattattcgaaaagagtgatcgttcctt

SEQ ID NO: 310054 - DNA, 75 bp, Artificial Sequence
  Synthetic
tactagcttcaggcaaatgtgcatttgttaaacggcaaattgatgctggtatgagaggcctattcgaaccggttt

SEQ ID NO: 310055 - DNA, 75 bp, Artificial Sequence
  Synthetic
ggaatttttttttgttgttgtgcattcggttgggaagccagcgtatgggcaactcaaatacaaatatacaagtaa

SEQ ID NO: 310056 - DNA, 75 bp, Artificial Sequence
  Synthetic
gccagcagaatactcatattcaagcatcggattcaaaactagagttacacgatcaaaaaacagcgacgctgcaat

SEQ ID NO: 310057 - DNA, 75 bp, Artificial Sequence
  Synthetic
caacacaactgttgatctctattggtgctataattatagtagcgctaattctgttactgctattttcgctaattc

SEQ ID NO: 310058 - DNA, 75 bp, Artificial Sequence
  Synthetic
tgctataattatagtagcgctaattctgttactgctattttcgctaattctgaactgttatttgtgtaacagact

SEQ ID NO: 310059 - DNA, 75 bp, Artificial Sequence
  Synthetic
caaaaagaagaatggttatctcaaacgagaaagaaaaatttccaatctcagggacaaaggactggataaattcat

SEQ ID NO: 310060 - DNA, 75 bp, Artificial Sequence
  Synthetic
acttgataaacccaatgatatcaccagtggttgtgtatgaatggaaagatgacattgctgatctgggaatgataa

SEQ ID NO: 310061 - DNA, 75 bp, Artificial Sequence
  Synthetic
caccatttaatgagtgttcagtagtaccaggcgaaaaactattgattcataaagtgtgcgcaataaaacatgaac

SEQ ID NO: 310062 - DNA, 75 bp, Artificial Sequence
  Synthetic
attggtgtggacatctgcatgtcccagatcaggagagaagtttttggaaacatgaatccagactatgcatggcca

SEQ ID NO: 310063 - DNA, 75 bp, Artificial Sequence
  Synthetic
catgtgataagatcttttggccttgtggagctaaaaaaattagaattgatggaaaaacaatggaaggtgatgatt

SEQ ID NO: 310064 - DNA, 75 bp, Artificial Sequence
  Synthetic
ttgttagatgtaagtgcggacagttttatcctacaaaaataataaagaacggtgatttcacagtactaactttct

SEQ ID NO: 310065 - DNA, 75 bp, Artificial Sequence
  Synthetic
gcgccaatgattatgcagcaattgaaattggaatgtcgtacggagaacaatgcagaaattgcaaaaaaacgtaca

SEQ ID NO: 310066 - DNA, 75 bp, Artificial Sequence
  Synthetic
ggtattatagagctgcaaatggatttgaaggagacacaagatcttggtggagaactgataaattatgtgtacaat

SEQ ID NO: 310067 - DNA, 75 bp, Artificial Sequence
  Synthetic
gtactccatacaaagaattatgcagaataatgatggcaggtaagcagatcagattcattgaaaataactataagg

SEQ ID NO: 310068 - DNA, 75 bp, Artificial Sequence
  Synthetic
aaatgaaagctaactttgggagacggatcagacgagagaacagatcaaatctagcaattaaagaagtaaattcac

SEQ ID NO: 310069 - DNA, 75 bp, Artificial Sequence
  Synthetic
catctattgtctacaaacttgaggttgtagagaaatcaagcgaatggcacaattcaacatctgaaatgttgacag

SEQ ID NO: 310070 - DNA, 75 bp, Artificial Sequence
  Synthetic
caattaatctcatttataggggagaattcaagactgatgcactagatagggacatagtcgtattaagctcacttt

SEQ ID NO: 310071 - DNA, 75 bp, Artificial Sequence
  Synthetic
atggaagaaggattttcaaatccgatagcacttcagaaatgttcaatctaatacgtacatacctaaaaaaaatga

SEQ ID NO: 310072 - DNA, 75 bp, Artificial Sequence
  Synthetic
aatgagtatgctctaagctgaatgacggttccagacgtctaaccaaccaaccacacaacaaaacaataaaaaccc

SEQ ID NO: 310073 - DNA, 75 bp, Artificial Sequence
  Synthetic
ggcatatattgaggatggaccagttcttggaatggctatctaggagcatggttcgtgatctctcttatacatcac

SEQ ID NO: 310074 - DNA, 75 bp, Artificial Sequence
  Synthetic
tagtatatacaaatccaagagttagcagaataatattggagaaagatggcaaggaaaatatatggcaaactagag

SEQ ID NO: 310075 - DNA, 75 bp, Artificial Sequence
  Synthetic
aaactttaactgaaactccaaaacaagcaattcaatacattcagacgataataggttcaaatgatacagtagaaa

SEQ ID NO: 310076 - DNA, 75 bp, Artificial Sequence
  Synthetic
agaaagtcgaaaaactactacgtatacgctatcatgcggtgtatgtagaagataaatcagataaacgtgatctag

SEQ ID NO: 310077 - DNA, 75 bp, Artificial Sequence
  Synthetic
tcaataaattactatcaataacaattaaacagttgggaaatgaagatttagatgaaacaaatataaatttaatag

SEQ ID NO: 310078 - DNA, 75 bp, Artificial Sequence
  Synthetic
taaacgatgcaaaaaaatggagagtaaagaacgcttcaaagttaagaccatatcattttaacataccaatcaaag

SEQ ID NO: 310079 - DNA, 75 bp, Artificial Sequence
  Synthetic
aatttattagagataatgaatttgagatagttgacacaggagatagacgttggaaatcggatacactgcaggggt

SEQ ID NO: 310080 - DNA, 75 bp, Artificial Sequence
  Synthetic
tgataccacattactatcatagaacacatacattagtatcatcggtgttatacgcaatacagtcaagaatagaca

SEQ ID NO: 310081 - DNA, 75 bp, Artificial Sequence
  Synthetic
catatgatgatgataggaagaaagctttaaaatggatgttgaaaaaaatacaatcgaaaatgattgaaggatatt

SEQ ID NO: 310082 - DNA, 75 bp, Artificial Sequence
  Synthetic
tagaattagaaagaaatagaaaatggtcaatgacgattaaagaactaaaagaggctaattttagaatgtataatg

SEQ ID NO: 310083 - DNA, 75 bp, Artificial Sequence
  Synthetic
ctaaaataatacatgctgcatgcgcaatgatatcaatattacactcaaaaagaataattccagaatttctatgtc

SEQ ID NO: 310084 - DNA, 75 bp, Artificial Sequence
  Synthetic
aaatattagctgcatttgaagagataccagcgaatgctgcaaaagttttatcgtcgccaatgacattatatattg

SEQ ID NO: 310085 - DNA, 75 bp, Artificial Sequence
  Synthetic
gaatatgtcagttaaatactaaaaaagttgtatctacaggaaatgcaaatgagtctgcacagacagatcagccaa

SEQ ID NO: 310086 - DNA, 75 bp, Artificial Sequence
  Synthetic
atatacaaagagtcgatgattctcaacttgaagagtggaagaaatcaattgaagaagatccactaccaaattcat

SEQ ID NO: 310087 - DNA, 75 bp, Artificial Sequence
  Synthetic
taatgttaaggctgatgtcaagaaatttaaaaacagacgtggacacgttcaaaacgatatttaactgtttttcag

SEQ ID NO: 310088 - DNA, 75 bp, Artificial Sequence
  Synthetic
ccacatttcatgtgggtcacagaatagataattcacaggacgcaattcaagatcaagtaacagtagaatatacaa

SEQ ID NO: 310089 - DNA, 75 bp, Artificial Sequence
  Synthetic
caaaggtgaatagagaaatgtatgacatgtactattatacactaaaaaatatgttaaaagatgaaataaagaatt

SEQ ID NO: 310090 - DNA, 75 bp, Artificial Sequence
  Synthetic
atatgttggaaatgaaaaagcaaatgaattctgacgttacagtaccgtcattagcgagtctagcaaatacatcaa

SEQ ID NO: 310091 - DNA, 75 bp, Artificial Sequence
  Synthetic
acggaaaaacgattgaagtcgagtttgttggaagaaagattaaaacaacgaagaaaatgcttcatcttgataacg

SEQ ID NO: 310092 - DNA, 75 bp, Artificial Sequence
  Synthetic
acttatttactcagtctaattacactgaaatagaaaaaataataagacaaggaataccaatgggaactagaaatg

SEQ ID NO: 310093 - DNA, 75 bp, Artificial Sequence
  Synthetic
ttccagcaagacagacaagaggtatatttatattaccgtggcaagttgctgcagttcaacatactttagcagaaa

SEQ ID NO: 310094 - DNA, 75 bp, Artificial Sequence
  Synthetic
ctatgtataaaagagcgaagaaaggtgcatatagaggagcgtttgcggaagcgtataccgctaaagccgcatctt

SEQ ID NO: 310095 - DNA, 75 bp, Artificial Sequence
  Synthetic
taacatacggtgtattagctcaagacacatcaacagcagaaaagattatattatacacggacgtttcacagtggg

SEQ ID NO: 310096 - DNA, 75 bp, Artificial Sequence
  Synthetic
atgcgtcgcaacataatacagaaccatacagatccgcatggataaacgcaattgatgaagcgagagaagaattgg

SEQ ID NO: 310097 - DNA, 75 bp, Artificial Sequence
  Synthetic
ccatgccgaggtcactggaaccaaaagtgctggagatgaatgtattagataaaatgaaagaaatccaaaaggcgt

SEQ ID NO: 310098 - DNA, 75 bp, Artificial Sequence
  Synthetic
tactgaattcagatttaataattgaatcaccaggatcgcaacgcgagccattaaaaattagatatcatggagtcg

SEQ ID NO: 310099 - DNA, 75 bp, Artificial Sequence
  Synthetic
catcaggtgaaaagacaactaagataggcaattctttcgcaaacgtggcattgattaatacggtattaaataaag

SEQ ID NO: 310100 - DNA, 75 bp, Artificial Sequence
  Synthetic
ttgcagaaagaatcccagacatcagagtaacacatatgcgggttgatggagatgataatgtagtaacaatgtaca

SEQ ID NO: 310101 - DNA, 75 bp, Artificial Sequence
  Synthetic
catcatgtaaaatagaggaacttcagaaagaaatcaaggatgcgtacacacaaatgaatgcacgcgtaaaggctc

SEQ ID NO: 310102 - DNA, 75 bp, Artificial Sequence
  Synthetic
tagcatcatggacggggttagaaatggctaaaagattcataatatgtggaaaaatctttgagagaggagcaatat

SEQ ID NO: 310103 - DNA, 75 bp, Artificial Sequence
  Synthetic
caatatttactgctgagaggccatacggcacagatgtttcaatacagcaaatgacaggtgcgtcattatattcag

SEQ ID NO: 310104 - DNA, 75 bp, Artificial Sequence
  Synthetic
cagcggtgaatgcttatagaggatttggtgagacatataggaaatttatggaggatgtcctaataccaccttcag

SEQ ID NO: 310105 - DNA, 75 bp, Artificial Sequence
  Synthetic
cctcaactaaaataacagcaagattaagagtacttttatcaccgataacgttacattcgataggaccattgggat

SEQ ID NO: 310106 - DNA, 75 bp, Artificial Sequence
  Synthetic
atgagataacaccaggaggactaggaggccgtatgaggatgcattttgctgataagatcaatatgcaattattta

SEQ ID NO: 310107 - DNA, 75 bp, Artificial Sequence
  Synthetic
aacaactgacgaactcagtgtcaatatccattacacccgacgaaataaaagaatacaagggaacgccacaattta

SEQ ID NO: 310108 - DNA, 75 bp, Artificial Sequence
  Synthetic
agaagagaacagagataatgatcgacgcacttagaaataatgtaatgaaacaagctaaaattcttgaagatattc

SEQ ID NO: 310109 - DNA, 75 bp, Artificial Sequence
  Synthetic
tggtggacaaagaaagtcaaaagacgcttggtgtgcctaatgttcaaacgtcaaagaatcgccaacagcttgagg

SEQ ID NO: 310110 - DNA, 75 bp, Artificial Sequence
  Synthetic
aagcagtaagaatactatcgaaacctgaaaataagttggaaaatgtagaccaattctatcctgaagaagtcttca

SEQ ID NO: 310111 - DNA, 75 bp, Artificial Sequence
  Synthetic
atttagtcacagcgtcttcaaatagagctcaaccaagttatgtgtcaattgatagattatatgaacatgagtcag

SEQ ID NO: 310112 - DNA, 75 bp, Artificial Sequence
  Synthetic
agccagtgaggaaattacagatgcagttaggggtgcgaatagctgatacgaaaccattaacgaaaccggttaatc

SEQ ID NO: 310113 - DNA, 75 bp, Artificial Sequence
  Synthetic
aattgtacgagatagtatcaaaaatcgctccaatgaatatttcaccaacagacattttgacgaatgcaaggaaat

SEQ ID NO: 310114 - DNA, 75 bp, Artificial Sequence
  Synthetic
atgacctaaaaacattaaacggaaagagggcttttttatcagatctaggactacaaggcgctcaattaaaacagt

SEQ ID NO: 310115 - DNA, 75 bp, Artificial Sequence
  Synthetic
atttaggatcaaaactattatttagagatttactactagccaaatatgacaaattatacgaagctccaggtttcg

SEQ ID NO: 310116 - DNA, 75 bp, Artificial Sequence
  Synthetic
gggccactcaattaactacaattccattgaatttagaatctgcggaaagaatattcaacgtcgcttttagactac

SEQ ID NO: 310117 - DNA, 75 bp, Artificial Sequence
  Synthetic
catctaactattatgaaattttaatgttaatgttgttatatgagtacgtaaattacatatttgacggaggacaac

SEQ ID NO: 310118 - DNA, 75 bp, Artificial Sequence
  Synthetic
catgtgtgtggaagttaaaagatatggaagcaaatgaaaatgtgaaactctcagcacaaataatgaagatgatag

SEQ ID NO: 310119 - DNA, 75 bp, Artificial Sequence
  Synthetic
acaatattaaacttgatgaagtactgttttcagattacatatactagtgtgagatcgtcaaactaaataaagacc

SEQ ID NO: 310120 - DNA, 75 bp, Artificial Sequence
  Synthetic
caatattaaacttgatgaagtactgttttcagattacatatactagtgtgagatcgtcaaactaaataaagaccc

SEQ ID NO: 310121 - DNA, 75 bp, Artificial Sequence
  Synthetic
ggcatttaatggctaagttaattgaattttccgaactcggggcgagggttcaaaatacagaagacgtatttagaa

SEQ ID NO: 310122 - DNA, 75 bp, Artificial Sequence
  Synthetic
caaaatacagaagacgtatttagaatttcaaatagtactgaaaaatttataattatcaatccatctagaaacgct

SEQ ID NO: 310123 - DNA, 75 bp, Artificial Sequence
  Synthetic
gaaaattacataaaagagaggactcattatgttacaattgataagagaaatgttgaccagtcaattaaagaatac

SEQ ID NO: 310124 - DNA, 75 bp, Artificial Sequence
  Synthetic
gaagaattattccctacatcagtttcaacgcataattcagaaatcattaagcttggtgcttgtggacacgtcgtt

SEQ ID NO: 310125 - DNA, 75 bp, Artificial Sequence
  Synthetic
actaattgcttacacgtcgatcacccttattttacaagtaatattgctagtttgggggattatgcacccactggt

SEQ ID NO: 310126 - DNA, 75 bp, Artificial Sequence
  Synthetic
tggagatatgaagcaatgggtaaaagagatgatcaattgggcgacttcatttttaatcatatatttgatcagtgt

SEQ ID NO: 310127 - DNA, 75 bp, Artificial Sequence
  Synthetic
aatggctggcaaaatggcgagtacattaataaatttaattatggtataataccaaataaaaaaacttcacaaaag

SEQ ID NO: 310128 - DNA, 75 bp, Artificial Sequence
  Synthetic
gaagtagacagttatttctctgaactaatgaaagagattgtaaaagtacaagatgatgtagatgaagatagttat

SEQ ID NO: 310129 - DNA, 75 bp, Artificial Sequence
  Synthetic
tattataatatacagcggagacaaattggaacagcggttagagaaaccgtttttgaattaatagaaaagaaaaat

SEQ ID NO: 310130 - DNA, 75 bp, Artificial Sequence
  Synthetic
tggaacgtgaatttaataggtccagaatttgaatcatttgctttgatttataaattattgatgtcaagttacaca

SEQ ID NO: 310131 - DNA, 75 bp, Artificial Sequence
  Synthetic
ggagatttcaaaatgtttacgattaatgaaacacaagaacataactataagaaagagttgactatgtggaagaaa

SEQ ID NO: 310132 - DNA, 75 bp, Artificial Sequence
  Synthetic
aaaaccttatcattgagaacggttctagctaataaatggaaatacgagaatgcgttttgtaaattattgatgtca

SEQ ID NO: 310133 - DNA, 75 bp, Artificial Sequence
  Synthetic
catctctgcaaaagaaaaaaatatagctacatctatataaatagtagatataacgttgataactgggttattaat

SEQ ID NO: 310134 - DNA, 75 bp, Artificial Sequence
  Synthetic
tatccatatataatgaatgtgatattaacgaatgatttaattacacacgctgaaaattcaataatttttggtttc

SEQ ID NO: 310135 - DNA, 75 bp, Artificial Sequence
  Synthetic
gaagtaacagataatacttcttcttatgcagtaaataaaatatcagacaaagtcgtttacacatcaactccatat

SEQ ID NO: 310136 - DNA, 75 bp, Artificial Sequence
  Synthetic
gcggacgaaaataatgcttggactatgtcaataaaaggtgaaagaataggagatagatttaacaaagatgattca

SEQ ID NO: 310137 - DNA, 75 bp, Artificial Sequence
  Synthetic
tggtatgccaagaaaaataactactcaaattttgtatatggaggagatatatttacaactaaagacttaaaatta

SEQ ID NO: 310138 - DNA, 75 bp, Artificial Sequence
  Synthetic
aattacgtaaatattgcattatattctctatccaattcgaaaaattcaattgaattaattagatcagtattatca

SEQ ID NO: 310139 - DNA, 75 bp, Artificial Sequence
  Synthetic
tatgaacatattgtaacatttccgctaccagttagaacggactggcgacaaatggaagactatgaagaaaagccg

SEQ ID NO: 310140 - DNA, 75 bp, Artificial Sequence
  Synthetic
tttttgggactggtaaaacaaaataagttcgaagatcatgtgatacatccaaaaatactagcacttgagcatgac

SEQ ID NO: 310141 - DNA, 75 bp, Artificial Sequence
  Synthetic
tgtgaaattgttactgagatggtttttttacaattaggaaataggagatgtattatatcagatatgtatcagcac

SEQ ID NO: 310142 - DNA, 75 bp, Artificial Sequence
  Synthetic
gctgttgtaatgagaataaaaacagatagtttttattcagacaagtacttttctcacatagggattaggcaagtt

SEQ ID NO: 310143 - DNA, 75 bp, Artificial Sequence
  Synthetic
tcagtgtacaatcgtgataattttttaacctctagattaaatgcttatatagatagacaattgtcaagatcaata

SEQ ID NO: 310144 - DNA, 75 bp, Artificial Sequence
  Synthetic
gactttacacaaatagtaaaaaataaatttggaggattttctggccatttagtagcagttgaaaggtattttaat

SEQ ID NO: 310145 - DNA, 75 bp, Artificial Sequence
  Synthetic
cagctaatatacacaatgtcaccaatgagatgggcgaaaagagcattttctgaagctaaatacaaaaaaagagat

SEQ ID NO: 310146 - DNA, 75 bp, Artificial Sequence
  Synthetic
cagtataagaatgctgatggtgaaaaacatgaaatgactgatttcataaacacatatcattatttaaatctatac

SEQ ID NO: 310147 - DNA, 75 bp, Artificial Sequence
  Synthetic
tacacaacattcgaagatttaattgagtgttctgacagagctgaccatccacaatactatatagcagttaaatca

SEQ ID NO: 310148 - DNA, 75 bp, Artificial Sequence
  Synthetic
ggtataagtcatataacactacaattaacagaagtggatccaactattttgctagatgatattatatctaaaata

SEQ ID NO: 310149 - DNA, 75 bp, Artificial Sequence
  Synthetic
aaaggcgttagattaaaacgagttggagaaactgagtttgaaaatttgaatgttgtactgtaccaaactaaagaa

SEQ ID NO: 310150 - DNA, 75 bp, Artificial Sequence
  Synthetic
tgttgtactgtaccaaactaaagaagtcttacagtaccatatcgttaaaattttgcgacgaaataaaattgcgtg

SEQ ID NO: 310151 - DNA, 75 bp, Artificial Sequence
  Synthetic
tcaacaatcaagaccatatataatgcatatgaatgtaaaagaggatggagatgacaaagatgaaatagtaataaa

SEQ ID NO: 310152 - DNA, 75 bp, Artificial Sequence
  Synthetic
tgaaaagaatgtttatgtgaagaaaatcgtccggacttagccattcggggaggatctcctggagataataaagac

SEQ ID NO: 310153 - DNA, 75 bp, Artificial Sequence
  Synthetic
aaaagaatgtttatgtgaagaaaatcgtccggacttagccattcggggaggatctcctggagataataaagaccc

SEQ ID NO: 310154 - DNA, 75 bp, Artificial Sequence
  Synthetic
ggaatattaaagtgtcgcttggtggctggaaacactgagtggcagcctcttgccctagcatggctgaagtctctg

SEQ ID NO: 310155 - DNA, 75 bp, Artificial Sequence
  Synthetic
aatttgatttcaaaataaagaaagataagaagaaacaagaaaaaacgaaatcgaagaaaatggttgtcaaagata

SEQ ID NO: 310156 - DNA, 75 bp, Artificial Sequence
  Synthetic
atgaaacagtagtaacacatgaagaaaagtctgaacgtggttcagtctattctgaagaatcatcaagtcattcat

SEQ ID NO: 310157 - DNA, 75 bp, Artificial Sequence
  Synthetic
caagtaattacgctgaagcatatgaaaggctacagcgtgaacttaatgctagcgaatcaaatgacaacaagtgta

SEQ ID NO: 310158 - DNA, 75 bp, Artificial Sequence
  Synthetic
agcgaacaattagaaactgggcagatgaagttgaaaaacaagaaagtgaatctgagaacgaatatgatgtaccag

SEQ ID NO: 310159 - DNA, 75 bp, Artificial Sequence
  Synthetic
atacagaattcattccaaagaaaacaaacataatagatatggggtctgaagcaaaagagcagataatgaatgaaa

SEQ ID NO: 310160 - DNA, 75 bp, Artificial Sequence
  Synthetic
tatcaaaaattagaatggaaatggatgtaattaaagaagcaatgaaaccacaaggcgttgatgctgcatttaacc

SEQ ID NO: 310161 - DNA, 75 bp, Artificial Sequence
  Synthetic
tcattctcaagaatgtagacaacctatctacaaaacaaaaacacgctcttgtaaacgcaatagttatgtcaatga

SEQ ID NO: 310162 - DNA, 75 bp, Artificial Sequence
  Synthetic
aataatcaaataacagagtgcggtgaaaatcgcctgacatgactaggggttagcccctgaggtgactaataaaga

SEQ ID NO: 310163 - DNA, 75 bp, Artificial Sequence
  Synthetic
aatcaaataacagagtgcggtgaaaatcgcctgacatgactaggggttagcccctgaggtgactaataaagaccc

SEQ ID NO: 310164 - DNA, 75 bp, Artificial Sequence
  Synthetic
ggaatttttttgttgttgtgcattcggttgggaaaccagcgtatgggcaactcaaatacgaacatacaagtaagt

SEQ ID NO: 310165 - DNA, 75 bp, Artificial Sequence
  Synthetic
cagcagaatactcatattcaagcatcggattcaaaactagagttacatgatcaaaaaacagcaacactgcaatca

SEQ ID NO: 310166 - DNA, 75 bp, Artificial Sequence
  Synthetic
acacaactattgatctctattggcgcaataattatagtagcgctaattctgctactgatattttcactaattctg

SEQ ID NO: 310167 - DNA, 75 bp, Artificial Sequence
  Synthetic
caataattatagtagcgctaattctgctactgatattttcactaattctgaattgctatttgtgcaacagactca

SEQ ID NO: 310168 - DNA, 75 bp, Artificial Sequence
  Synthetic
aaaagaagaatggttatctcaaacgagaaagaaaaatttccaatctcagggacaaaggattggataaattcatac

SEQ ID NO: 310169 - DNA, 75 bp, Artificial Sequence
  Synthetic
ttgataaatccaatgatatcgccagtagttgtgtatgaatggaaagatgacattgctgatttggggatgataaca

SEQ ID NO: 310170 - DNA, 75 bp, Artificial Sequence
  Synthetic
ccatttaacgaatgtccaatagtaccaggtgaaaaactactgattcataaagtgtgtgcaacaaaacatgagcat

SEQ ID NO: 310171 - DNA, 75 bp, Artificial Sequence
  Synthetic
tggtgtggtcatttacacgttccagatcaggagaggaattcttggaaacacgagtctagattgtgtatggctacg

SEQ ID NO: 310172 - DNA, 75 bp, Artificial Sequence
  Synthetic
tgtgacaaaattttctggccttgtggagctaaaagaattagaattgatggaaaaataatggaaggtgacgatttt

SEQ ID NO: 310173 - DNA, 75 bp, Artificial Sequence
  Synthetic
gtcagatgcaagtgtggacagttttacccgacaaaaataacaaaaaacggtgattttacagtactgaccttctgt

SEQ ID NO: 310174 - DNA, 75 bp, Artificial Sequence
  Synthetic
gcaaatgactatgcggcaatcgaggttgggatgtcatacggagagcaatgcagaaattgcaaaaaaatgtataga

SEQ ID NO: 310175 - DNA, 75 bp, Artificial Sequence
  Synthetic
tattatagagctgcaaatggatttgaaggagacacaagatcttggtggaaaactgataaattatgtgtacaatgc

SEQ ID NO: 310176 - DNA, 75 bp, Artificial Sequence
  Synthetic
actccatacaaagaattatgcagagtaatgatggcgggcaaacaaatcagattcattgacaataactataaggag

SEQ ID NO: 310177 - DNA, 75 bp, Artificial Sequence
  Synthetic
atgaaagctaattttgggagacggattagacgagagaacagatcaagtctggcaatcaaggaagtaaactcacca

SEQ ID NO: 310178 - DNA, 75 bp, Artificial Sequence
  Synthetic
tctattgtctataaacttgaggttatagagaaatcaagcgaatggcacaattcaatatctgaaatgctgacagcg

SEQ ID NO: 310179 - DNA, 75 bp, Artificial Sequence
  Synthetic
attaatctcatttacagaggagaattcagaactgatgcactagatagagacatagtcatattaagctcactttat

SEQ ID NO: 310180 - DNA, 75 bp, Artificial Sequence
  Synthetic
ggaaggagaatttttagatccgatagcgcttcagacatgttcagtctaatacgtacacacctgaaaaaaatgagt

SEQ ID NO: 310181 - DNA, 75 bp, Artificial Sequence
  Synthetic
ggcatattttcagcgttatggatcccgaaggtttaatttcagatgcgattaaagcaatcgatgaagcaaagaatg

SEQ ID NO: 310182 - DNA, 75 bp, Artificial Sequence
  Synthetic
ataaaaagaagataatagtaatagctaagcagttagtcaacgatattaaagatacagttgaagacttggatattg

SEQ ID NO: 310183 - DNA, 75 bp, Artificial Sequence
  Synthetic
atttactaaaaaaattgaaagtacaatttagcgcaaaacgaattgcaacaaaagaaattgatgtactgataaaaa

SEQ ID NO: 310184 - DNA, 75 bp, Artificial Sequence
  Synthetic
atattgaagataaaaagaaagaaagtaagaatgtgagcgataaaaaggaggaaagcggtaaaaacgatgataatc

SEQ ID NO: 310185 - DNA, 75 bp, Artificial Sequence
  Synthetic
aaaatcaggaaaaaggaaaggataatgaatctggaaagaaagagaaaatcaataacagtaaaggggacgaaggcg

SEQ ID NO: 310186 - DNA, 75 bp, Artificial Sequence
  Synthetic
gactaagagataatgtacttggtaattcagatccagatagtaaattaacaaaagatatattgacaataagacaaa

SEQ ID NO: 310187 - DNA, 75 bp, Artificial Sequence
  Synthetic
aaagatatattgacaataagacaaataaattccaaaatattatttgttgatactgagaatgatacttactcagtg

SEQ ID NO: 310188 - DNA, 75 bp, Artificial Sequence
  Synthetic
tatatacctgaacaaactacgacactcaaaccaatagaaatagaatttaaaccaatacaagactataagccaata

SEQ ID NO: 310189 - DNA, 75 bp, Artificial Sequence
  Synthetic
gcagacttaaggatggagaagatgatatttttgtcgaatagggatcaagtgtctgatcaagaaggaccagaagag

SEQ ID NO: 310190 - DNA, 75 bp, Artificial Sequence
  Synthetic
gtactttatacatcagatttctttaaggatataaagaatgaagatattaaatactttagaaattactttttggag

SEQ ID NO: 310191 - DNA, 75 bp, Artificial Sequence
  Synthetic
aaggctatggtgttaaggaaacaaatgccaaacgttaattacatgtcaggattgaataaagagactaatccattg

SEQ ID NO: 310192 - DNA, 75 bp, Artificial Sequence
  Synthetic
aatatacaaaatacaatatgcacatcattcgatcaaatgaaatattataatattgtagtagatagaactaataga

SEQ ID NO: 310193 - DNA, 75 bp, Artificial Sequence
  Synthetic
gcatttgacaatagaagaagagatgtcgagtttgacaatgtcaccatagatggggtgaatagaagagcaacggta

SEQ ID NO: 310194 - DNA, 75 bp, Artificial Sequence
  Synthetic
tctttgagactacatccagtggatgaccaaattctagcagcagttgatatgaacacatatgaaacacaaaactta

SEQ ID NO: 310195 - DNA, 75 bp, Artificial Sequence
  Synthetic
gctgatgtgatgactagatatcaaatgattgcagcggatggatatgcagttgcgccaaaaattcgagttgataga

SEQ ID NO: 310196 - DNA, 75 bp, Artificial Sequence
  Synthetic
gatcatacagtgattgcagacgtacggtcacgtgtcttagcaagaatatgcgtattgtcaccttatgtttataga

SEQ ID NO: 310197 - DNA, 75 bp, Artificial Sequence
  Synthetic
tcaagaatactaaactcagtatcgatggtcaatagattatggagaacaaatgtcttttctgaatcaattgaaaat

SEQ ID NO: 310198 - DNA, 75 bp, Artificial Sequence
  Synthetic
gcaaaagacgccatttatagatcagcggaaatccagtttacggtggcagatgcaactacatctgcactatctact

SEQ ID NO: 310199 - DNA, 75 bp, Artificial Sequence
  Synthetic
attaacgtagcctcagcacagcaaacgctatcggcaatactaaatatgacaatattcagaatggatattgaacta

SEQ ID NO: 310200 - DNA, 75 bp, Artificial Sequence
  Synthetic
cgctatcggcaatactaaatatgacaatattcagaatggatattgaactaaccgggaatcaatcatcttttggag

SEQ ID NO: 310201 - DNA, 75 bp, Artificial Sequence
  Synthetic
cagctatatcagctgcaattgcgttaattatactaccaactgatgatggaatgatgtcaggaatggtgtttgatg

SEQ ID NO: 310202 - DNA, 75 bp, Artificial Sequence
  Synthetic
atctttgcaatttagtttttaatgaattgatagcttgggcaactgaaaggccaactttcgttaaaaggacaggag

SEQ ID NO: 310203 - DNA, 75 bp, Artificial Sequence
  Synthetic
ctactaatgcatttgaagctcacgtcaatttaggaggtggtaatttgaatagagacataataaattatatgagat

SEQ ID NO: 310204 - DNA, 75 bp, Artificial Sequence
  Synthetic
acgtattactcagaagaccatgggccatattccaaaggacacaaacggtggattatcaaaccgacatcatgttac

SEQ ID NO: 310205 - DNA, 75 bp, Artificial Sequence
  Synthetic
caaatatagaccctgtaaatgtaaatgatcaggcatatatggcaatgaatagcctgttaagtggtatctcagccg

SEQ ID NO: 310206 - DNA, 75 bp, Artificial Sequence
  Synthetic
cagcacaaagaaatccaaatcctggtagacagatagcggcaaattctttcagaaagctgattaaatcgatgaaag

SEQ ID NO: 310207 - DNA, 75 bp, Artificial Sequence
  Synthetic
acatgtgttcaaataatattatgccactaattagactgatacagtttaatgtagaaagagtagctcgaattatgg

SEQ ID NO: 310208 - DNA, 75 bp, Artificial Sequence
  Synthetic
aatttctgccatattcggcggatattggacaactgaaccaaaatatgagagatgaaagattacgtgttaaaatac

SEQ ID NO: 310209 - DNA, 75 bp, Artificial Sequence
  Synthetic
cagtttcaggtttcctgtcaataattatgggaataaataaagcgccagacaatttcgattggggagccatgttag

SEQ ID NO: 310210 - DNA, 75 bp, Artificial Sequence
  Synthetic
cattcgctgatgaggtgagaagagtgaattatgcagagagagaggcaattgaaaatgtaacgacatatgtagtcc

SEQ ID NO: 310211 - DNA, 75 bp, Artificial Sequence
  Synthetic
tgaaaaatgatggaaatagatcggtatcaaaaaaagatacgtttctggaaaaagttgaaacacctactgagacga

SEQ ID NO: 310212 - DNA, 75 bp, Artificial Sequence
  Synthetic
ttaaagctatcacgaaaataccttcagcatcactaactacaatcctatcagatagattactcgtaaatgagataa

SEQ ID NO: 310213 - DNA, 75 bp, Artificial Sequence
  Synthetic
ggaatacgagaacatatgcactcgtaaatagattaattgacatattgagaactgcattcgataatgtgccgactt

SEQ ID NO: 310214 - DNA, 75 bp, Artificial Sequence
  Synthetic
cacatcatggaattggtaaaggagcattgttactcccgtatccaagaagatttggcaggtcatcagtatatgtaa

SEQ ID NO: 310215 - DNA, 75 bp, Artificial Sequence
  Synthetic
gaaaagataatataatattcaatagaccgcaaggggttaacagatacaacgtagacgatttactacatggaagat

SEQ ID NO: 310216 - DNA, 75 bp, Artificial Sequence
  Synthetic
tctaccaaggtttaatggggcaagttcagaatatgcaaccagtttttattgatggtccaatgaaactgagaacat

SEQ ID NO: 310217 - DNA, 75 bp, Artificial Sequence
  Synthetic
gatggtccaatgaaactgagaacatcagatccgacagcaattgaatcaataacatcagcatatttgacgatgtca

SEQ ID NO: 310218 - DNA, 75 bp, Artificial Sequence
  Synthetic
gcaccttatgatgcttatatacatccaatggatctaaagcataataaagttattgaaccaagagaagttgatttc

SEQ ID NO: 310219 - DNA, 75 bp, Artificial Sequence
  Synthetic
tttgttgatgataaaccaacaaaaccgcatgaacaatttgaagagatgatgtctaaaacatcagtttttattcta

SEQ ID NO: 310220 - DNA, 75 bp, Artificial Sequence
  Synthetic
gatgcacaacgactgattgttcagagcggagcgacaaattataactttgattatcacgatatgttgataactgat

SEQ ID NO: 310221 - DNA, 75 bp, Artificial Sequence
  Synthetic
aaagtcgttgacaagctacagttctcaactgtgctaccaccagatgtaaccttattcaacggtgtactcgtatat

SEQ ID NO: 310222 - DNA, 75 bp, Artificial Sequence
  Synthetic
ccagatgtaaccttattcaacggtgtactcgtatatgaagctaaaccttcgtgagctgaatacaattaaagaccc

SEQ ID NO: 310223 - DNA, 75 bp, Artificial Sequence
  Synthetic
gaaaattatataaaagagagaactcattatgttacaattgataagagaaatgttgaccaatcaattaaagaatac

SEQ ID NO: 310224 - DNA, 75 bp, Artificial Sequence
  Synthetic
gaagagttattccctacatcagtttcaacgaataattcagaaatcgttaagcttggtgcttgtggacacatcgtt

SEQ ID NO: 310225 - DNA, 75 bp, Artificial Sequence
  Synthetic
actaattgcttacacgttgatcacccttattttacaagtaatattactagtctgggagattatgcacccactggt

SEQ ID NO: 310226 - DNA, 75 bp, Artificial Sequence
  Synthetic
tggaggtacgaagcaatgggtaaaagagatgatcaattgggcgatttcatttttaatcatatatttgatcagtgc

SEQ ID NO: 310227 - DNA, 75 bp, Artificial Sequence
  Synthetic
aatggctggcaaaatggcgagtacattaatagatttaattatggtgtaataccaaataaaaaaacttcacaaaag

SEQ ID NO: 310228 - DNA, 75 bp, Artificial Sequence
  Synthetic
gaagtagacagctatttttctgaactaatgaaagagattgttaaagtacaagatgatgtagatgcagatagctat

SEQ ID NO: 310229 - DNA, 75 bp, Artificial Sequence
  Synthetic
tggaatgtaaatttaataggtccagaatttgaatcatttgctttaatttataaattactaatgtcaaattacaca

SEQ ID NO: 310230 - DNA, 75 bp, Artificial Sequence
  Synthetic
ggagattttaaaatgtttacaattaatgaaacgcaagaacataactataaaaaagaattgactgtatggaagaaa

SEQ ID NO: 310231 - DNA, 75 bp, Artificial Sequence
  Synthetic
aaaaccttatcgttgagaacagttttagctaacaagtggaaatacgagaatgcgttctgtaaattattaatgtca

SEQ ID NO: 310232 - DNA, 75 bp, Artificial Sequence
  Synthetic
catctatgtaaaaggaggaaatatagctacatctatataaataatagatataatgttgataactgggttataaat

SEQ ID NO: 310233 - DNA, 75 bp, Artificial Sequence
  Synthetic
tatccatatataatgaatgtgatattaacagatgatttaattacacacgctgagaattcaataatttttggtttt

SEQ ID NO: 310234 - DNA, 75 bp, Artificial Sequence
  Synthetic
gaagtgacagataatacctcatcttacgcagtaaataaaatatcagataaagttgtatatacatcaacgccatat

SEQ ID NO: 310235 - DNA, 75 bp, Artificial Sequence
  Synthetic
gcggacgaaaataatgcttggactatgttaataaaaggtgaaagaataggagataaatttaacaaagatgattca

SEQ ID NO: 310236 - DNA, 75 bp, Artificial Sequence
  Synthetic
tggtatgctaagaaaaataactactcaaattttgtatacgggggagatatatttacaactaaagacttaaattta

SEQ ID NO: 310237 - DNA, 75 bp, Artificial Sequence
  Synthetic
aattacgtaaatattgcattatattctctatcaaattcgaaaaattcaattgagttaatcaaatcagtattatca

SEQ ID NO: 310238 - DNA, 75 bp, Artificial Sequence
  Synthetic
tatgaacatattgtgacatttccactgccagttagaatggactggcggcaaatggaagactatgaagaaaagccg

SEQ ID NO: 310239 - DNA, 75 bp, Artificial Sequence
  Synthetic
tttttgggactggtgagacaaaataagttcgaagatcatgtgatacatccgaagatactagctcttgagcatgat

SEQ ID NO: 310240 - DNA, 75 bp, Artificial Sequence
  Synthetic
tgtgaaattgttactgagatggtatttttgcagttaggaagtagaagatgtattatatcagatatgtatcaacat

SEQ ID NO: 310241 - DNA, 75 bp, Artificial Sequence
  Synthetic
gctgttgtaatgagaataaaaacagacagtttctattcagataaatatttttctcacataggaattagacaagta

SEQ ID NO: 310242 - DNA, 75 bp, Artificial Sequence
  Synthetic
tcagtatataatcgtgataattttttaacctcaagattaaatgcttatgtagatagacaattgtcgaggtcaata

SEQ ID NO: 310243 - DNA, 75 bp, Artificial Sequence
  Synthetic
gattttacacaaataataaaaaataaatttggaggattttctggtcacttagtggcagttgaaagatattttaat

SEQ ID NO: 310244 - DNA, 75 bp, Artificial Sequence
  Synthetic
cagttaatatacacaatgtcaccaataagatgggcgaaaagagcattttctgaagctaaatataaaaaaagagat

SEQ ID NO: 310245 - DNA, 75 bp, Artificial Sequence
  Synthetic
caatacaaaaatgctgatggtgaaaaacatgaaatgactgattttataaatacatatcattatttaaatctatac

SEQ ID NO: 310246 - DNA, 75 bp, Artificial Sequence
  Synthetic
tacacaacattcgaagatttaattgaatgctctggcatagccgattatccacaatactatatagcggttaaatca

SEQ ID NO: 310247 - DNA, 75 bp, Artificial Sequence
  Synthetic
ggtatgagtcatataacactacaattgacagaagtagatccaactatcttactagacgacattgtttttaaaata

SEQ ID NO: 310248 - DNA, 75 bp, Artificial Sequence
  Synthetic
aaaggtgtcagactaaaacgggttggagaaactaagtttaaagatttaaatgttgtgctgtatcaaactaaagaa

SEQ ID NO: 310249 - DNA, 75 bp, Artificial Sequence
  Synthetic
tgttgtgctgtatcaaactaaagaagtattacagtaccatattgttaaaattttgcgacaaaacaaaattgcgtg

SEQ ID NO: 310250 - DNA, 75 bp, Artificial Sequence
  Synthetic
tgagagaaatgtttatgtaaagaaaatcgtccggacttagccattcggggaggatctcctggagataataaagac

SEQ ID NO: 310251 - DNA, 75 bp, Artificial Sequence
  Synthetic
agagaaatgtttatgtaaagaaaatcgtccggacttagccattcggggaggatctcctggagataataaagaccc

SEQ ID NO: 310252 - DNA, 75 bp, Artificial Sequence
  Synthetic
ggaatttttttgttgtttggacggaccttggtcctgagaacgcaaagaaatggctgaacttcttaaagtgtgttt

SEQ ID NO: 310253 - DNA, 75 bp, Artificial Sequence
  Synthetic
cgatgatatgatgaaaggtggaaactgcagttttgaacattttatggaaaagatgaacgatgtgggaattgacat

SEQ ID NO: 310254 - DNA, 75 bp, Artificial Sequence
  Synthetic
agacgcatggaaacaagcctttgataacgccagactgccaagaagaatgacaaaatcaactcttgccatacaaaa

SEQ ID NO: 310255 - DNA, 75 bp, Artificial Sequence
  Synthetic
cgcaaatttggaaaaggaaattgcaaaactgagagcaaaagaacatagaaatggttacgacagaaataagcgtac

SEQ ID NO: 310256 - DNA, 75 bp, Artificial Sequence
  Synthetic
actggccagttttgacgttgacaagaaaaatggaaatacagttctagttccaaaaacgagactggctgagattgt

SEQ ID NO: 310257 - DNA, 75 bp, Artificial Sequence
  Synthetic
tctactaaattcgacacaagacttgaaacttagcgcaccaccatcagattacattgaagagcttgagagaaaaat

SEQ ID NO: 310258 - DNA, 75 bp, Artificial Sequence
  Synthetic
cagtctattggaagaagagagagctaatctactaaaatgcaacaatgacatctactatcaatatctgacactaca

SEQ ID NO: 310259 - DNA, 75 bp, Artificial Sequence
  Synthetic
cacgacaagttactgtctccaagaaaccaacaaatggcaggaaaaagttatatcaagaatgcaagaaaacgaaat

SEQ ID NO: 310260 - DNA, 75 bp, Artificial Sequence
  Synthetic
ggtgatgtcaagtgaaatcaacgaactgaaatctgtggtgagaactttgactagagaactaaactacgatgtcac

SEQ ID NO: 310261 - DNA, 75 bp, Artificial Sequence
  Synthetic
tttcgaagatgaacctgacgtagggtacatctctgaagagagtgaccagagcagtgaagaaaatgaatcagatca

SEQ ID NO: 310262 - DNA, 75 bp, Artificial Sequence
  Synthetic
agaatccgacgatggtaatgaagtcaatgaaaattcagataatgagcaactgttcgacaatctagatgacctact

SEQ ID NO: 310263 - DNA, 75 bp, Artificial Sequence
  Synthetic
tgaacaatatgaacaaaggcaacgtcaaatggaaagagatagagtgataaatgagttaagggcaccagaatatag

SEQ ID NO: 310264 - DNA, 75 bp, Artificial Sequence
  Synthetic
cgatgatgacgagtcggaccacgaatactacatcgaaagagaacacaaacactgaaatgtatactaatacaaaaa

SEQ ID NO: 310265 - DNA, 75 bp, Artificial Sequence
  Synthetic
aaatcaacatccgaaaaacactttattgattgttcagcttaatcgctgactgaccatcagcatcaataaagaccc

SEQ ID NO: 310266 - DNA, 75 bp, Artificial Sequence
  Synthetic
ggaaagaaatctccaacctagctttcagcatggatctcatcgaaacagtgaatgcagttgttgatctgcagaaac

SEQ ID NO: 310267 - DNA, 75 bp, Artificial Sequence
  Synthetic
gtatatatgaattatcatcaaatacaaatctttcaagtaagggtcaacaagtagtaaatgactacaatgcattgg

SEQ ID NO: 310268 - DNA, 75 bp, Artificial Sequence
  Synthetic
catctagagtaaatggcaagacatatgcgctacatgatcagacagctgttttgacaccatatattataaatatga

SEQ ID NO: 310269 - DNA, 75 bp, Artificial Sequence
  Synthetic
acttgatctccatttcaacacggatatcaactgatgattatgaagcgatgaaagaaggaatgaatggactactgg

SEQ ID NO: 310270 - DNA, 75 bp, Artificial Sequence
  Synthetic
atgtaatagccgctgcgataagaactgaatgttcgcgtagagtaagagcaatagaacaaagagtgttagaacctg

SEQ ID NO: 310271 - DNA, 75 bp, Artificial Sequence
  Synthetic
tagttaaaatgctgattgaagatattagacttagagctcaagtatcaaagattgcaatcgccaatatgtctgcat

SEQ ID NO: 310272 - DNA, 75 bp, Artificial Sequence
  Synthetic
attgcaatcgccaatatgtctgcatatgatacagctaagctcgaacctcaaattgtaaatatagaaaacccacta

SEQ ID NO: 310273 - DNA, 75 bp, Artificial Sequence
  Synthetic
agaccgggaattgttgatgatgtgcttcaaagaccaaattttactcaaagaggaggcggaattagatatactact

SEQ ID NO: 310274 - DNA, 75 bp, Artificial Sequence
  Synthetic
ggaagatggtctggtaacaaaggtatagtcacatgcgtatcaggaactgatggagtacacactatagaaattcaa

SEQ ID NO: 310275 - DNA, 75 bp, Artificial Sequence
  Synthetic
ctacgcactacactaacaggaatactgaatctgctctatgttccagcaccaggaaaaatagttcagtcaagaggg

SEQ ID NO: 310276 - DNA, 75 bp, Artificial Sequence
  Synthetic
agagcacaaggagtcccagtcacactaagatgttcagatgtatcaccagatatggcgaggggtgatatagtaata

SEQ ID NO: 310277 - DNA, 75 bp, Artificial Sequence
  Synthetic
gaatttttgagaaatggagcggtcgtggatgccgaaggtggatccggaacattccagttcacacaatgtgataca

SEQ ID NO: 310278 - DNA, 75 bp, Artificial Sequence
  Synthetic
ataagaataagagttgaaccatggagtatcgttaagaatctaaatccaacacctgattttgcaaattggaatcaa

SEQ ID NO: 310279 - DNA, 75 bp, Artificial Sequence
  Synthetic
aatcaagcaaacagtcagccaacagtgttaataatgtttgaaataaggcaagcatacacacagcttgaaaatgat

SEQ ID NO: 310280 - DNA, 75 bp, Artificial Sequence
  Synthetic
gaaatgagcgcagatgcaccaaaagttcagtattatttggacacaatttttactcaagattcgttcgtgagacat

SEQ ID NO: 310281 - DNA, 75 bp, Artificial Sequence
  Synthetic
ccaaacgtgctttggaggactcaagacctggcaaacgctcaaaataatacagcatgggcaagaaaagttgtaaca

SEQ ID NO: 310282 - DNA, 75 bp, Artificial Sequence
  Synthetic
acctggcaaacgctcaaaataatacagcatgggcaagaaaagttgtaacatctgtggctgctttcgctgctaaga

SEQ ID NO: 310283 - DNA, 75 bp, Artificial Sequence
  Synthetic
tgctaagatttgatctagctagggaccgggatctggtcggctgtggaggagagtttactgataaaataaagaccc

SEQ ID NO: 310284 - DNA, 75 bp, Artificial Sequence
  Synthetic
ggaaatagtaatccagcaatatgctgaggcttctcttccttgcgactacggccattggccagctagtaatgaaac

SEQ ID NO: 310285 - DNA, 75 bp, Artificial Sequence
  Synthetic
cagtaaacaacaataatatttgtgtaatgtatccaaaatcgcgcgcttcagaagtaaatgaaacagtttatgaac

SEQ ID NO: 310286 - DNA, 75 bp, Artificial Sequence
  Synthetic
cttttaaatcatattcacaagtatacataaaattcagtgagtacgatgatacaacagatggcaaaaatgtactaa

SEQ ID NO: 310287 - DNA, 75 bp, Artificial Sequence
  Synthetic
agatacttaaccaaatcgatatatctaattgcccaatgttagcagtatatatagttgactcaggaatggatttca

SEQ ID NO: 310288 - DNA, 75 bp, Artificial Sequence
  Synthetic
ttagctttttgtcatcacaaaatgaatgtcaggagtttgaagcacggaaaaaacactatataaagctagatgttg

SEQ ID NO: 310289 - DNA, 75 bp, Artificial Sequence
  Synthetic
agaaagagtattttacatatgccagagacctaaaatattgtccactgtctaacgatttaattggcatttactgtg

SEQ ID NO: 310290 - DNA, 75 bp, Artificial Sequence
  Synthetic
attcgcaattggatggtacttatcatgaaatacaaccaacgggccaatcgtactatgatattactgatatacctg

SEQ ID NO: 310291 - DNA, 75 bp, Artificial Sequence
  Synthetic
aatttacagaaatgggctacgttttttattcaacacaatcattttatatatgtgaaagagtatcgagtaatgaat

SEQ ID NO: 310292 - DNA, 75 bp, Artificial Sequence
  Synthetic
ttatgccagtgtattatttctataataatcaagcaccggatggaacaataacaagagcggtaaattggggaaatg

SEQ ID NO: 310293 - DNA, 75 bp, Artificial Sequence
  Synthetic
catggtcaaacttcaaaaaagtggcgcagatgatatacaaaatactagacatattttttggaagaaagaatctgg

SEQ ID NO: 310294 - DNA, 75 bp, Artificial Sequence
  Synthetic
aaccgagggcttagactaaagaggaataggggaaacggagggatccaaaggagtacccgaagcgaataaagaccc

SEQ ID NO: 310295 - DNA, 75 bp, Artificial Sequence
  Synthetic
gtatatatgatttgtcatcaaatacaaatctctcgagtaagggtcaacaagtagtgaatgactacaacgcactag

SEQ ID NO: 310296 - DNA, 75 bp, Artificial Sequence
  Synthetic
cttctagagtaaatggtaaaacatacgcactacacgatcaaacagctgtcttgacaccatatattataaatatga

SEQ ID NO: 310297 - DNA, 75 bp, Artificial Sequence
  Synthetic
atttaatttccatttcaacacggatatcgactgatgattatgaagcaatgaaagaaggaatgaacggactactgg

SEQ ID NO: 310298 - DNA, 75 bp, Artificial Sequence
  Synthetic
atgtgatagccgctgcgataagaactgaatgttcccgtagagtgagagcaatagaacaaagagtgttagaacctg

SEQ ID NO: 310299 - DNA, 75 bp, Artificial Sequence
  Synthetic
tagttaaaatgctgattgaagatattaaacttaaagctcaggtatcgaagattgcgattgctaatatgtctgcgt

SEQ ID NO: 310300 - DNA, 75 bp, Artificial Sequence
  Synthetic
attgcgattgctaatatgtctgcgtatgatacggctaagttagaacctcaaatcgtgaatatagaaaatccacta

SEQ ID NO: 310301 - DNA, 75 bp, Artificial Sequence
  Synthetic
ggaagatggtcaggtaataaaggcatagtcacgtgcgtatcaggaaccgatggagtgcacactatcgagattcag

SEQ ID NO: 310302 - DNA, 75 bp, Artificial Sequence
  Synthetic
ctacgtactacattaacaggaatactgaatctactttatgttccagcaccaggtaaaatagttcaatcaagaggg

SEQ ID NO: 310303 - DNA, 75 bp, Artificial Sequence
  Synthetic
agagcacagggagttccagttacactaaaatgttcagatgtatcgccagatatggcgagaggtgatatagtgata

SEQ ID NO: 310304 - DNA, 75 bp, Artificial Sequence
  Synthetic
gaatttctaagaaatggagcagtcgtggacgctgaaggtggatctggaacatttcagttcacgcaatgtgacaca

SEQ ID NO: 310305 - DNA, 75 bp, Artificial Sequence
  Synthetic
ataagaataagagttgaaccgtggagtgttgtgaaaaatcttaatccaacacctgattttgcgaattggaatcaa

SEQ ID NO: 310306 - DNA, 75 bp, Artificial Sequence
  Synthetic
aatcaagcaaacagtcagccaactgtgtcaataatgttcgaaataagacaagcatatacacaacttgaaaatgat

SEQ ID NO: 310307 - DNA, 75 bp, Artificial Sequence
  Synthetic
gaaatgagcgcagacgcaccaaaagttcagtattatctggacacaatttttactcaagattcattcgtaagacat

SEQ ID NO: 310308 - DNA, 75 bp, Artificial Sequence
  Synthetic
ccaaatgtactttggaggacccaagatctagcaaacgctcagaatgatacggcatgggcaagaaaagttgtaaca

SEQ ID NO: 310309 - DNA, 75 bp, Artificial Sequence
  Synthetic
atctagcaaacgctcagaatgatacggcatgggcaagaaaagttgtaacatctgtagctgcatttgccgctaaga

SEQ ID NO: 310310 - DNA, 75 bp, Artificial Sequence
  Synthetic
ggcaaatataagctcactatgttatcctatctgaggaaagagtatgcgacatttggaggaacgtcggatacctct

SEQ ID NO: 310311 - DNA, 75 bp, Artificial Sequence
  Synthetic
aaatcagatcaatctgaagcaacgtcaagatctattaatgagaaagaaattaaagagagagaaaaaccagtaaaa

SEQ ID NO: 310312 - DNA, 75 bp, Artificial Sequence
  Synthetic
tcaggtgattacttctgctacagacaacaacagaatagaacaatatggaattcagacgcgttcggatttgtactt

SEQ ID NO: 310313 - DNA, 75 bp, Artificial Sequence
  Synthetic
ggagaaaatattgaaccaaaagaagacagtggaaatataatatatagatcgactcttcaaggtgatttaaaattc

SEQ ID NO: 310314 - DNA, 75 bp, Artificial Sequence
  Synthetic
atatataatgaagtgtgtgatccgaaactaaaaataaaaatttatatggaatcgggtggacaattgagcgtaaca

SEQ ID NO: 310315 - DNA, 75 bp, Artificial Sequence
  Synthetic
atagatggaatacaaaaacaaattgatactatggatgttgatgtcatttttaatgatgatggaacgattacagca

SEQ ID NO: 310316 - DNA, 75 bp, Artificial Sequence
  Synthetic
acgcaagatgatgtaaaagacataaatgaagatcaaaaatttattataataaaattgttagatattaatagtcat

SEQ ID NO: 310317 - DNA, 75 bp, Artificial Sequence
  Synthetic
tcatatacatcaaatgcaatattagaaatgacatatattcagaacgttcgtacaacaagaccattaaaaataaca

SEQ ID NO: 310318 - DNA, 75 bp, Artificial Sequence
  Synthetic
acagatcatttacaaataactaaatgttcacaggacaatggtccaccaccaatagtactgcgaggattaaatcat

SEQ ID NO: 310319 - DNA, 75 bp, Artificial Sequence
  Synthetic
gaagaaacattcgatgtcaagttcaatggtattgaaaatagcaggacgataatatcagaagaaatggatggctat

SEQ ID NO: 310320 - DNA, 75 bp, Artificial Sequence
  Synthetic
tggaaaataacacaggaaactgtagcgattaaattaaagtttggaatagaagcaaaaggtgtaatgggaggtgca

SEQ ID NO: 310321 - DNA, 75 bp, Artificial Sequence
  Synthetic
tttaaaaattggttagtcgattcttattttgtgaaaaaacaattagattatacttacacgcgtgatggtgccacg

SEQ ID NO: 310322 - DNA, 75 bp, Artificial Sequence
  Synthetic
gtatcagcaaaaacggtaacatacgtcagcccgacaggaaagggcggcatagctcaaccatcaagaccagcaacg

SEQ ID NO: 310323 - DNA, 75 bp, Artificial Sequence
  Synthetic
gattataatggacagtttactgttctacaacctggcgatattatagaagtgtggtatgcagaagatcagtggcag

SEQ ID NO: 310324 - DNA, 75 bp, Artificial Sequence
  Synthetic
ataaataatgctatctacgcaaaaaatttccaaagcgatacgatggcgtcgggatggataggacctgttgactca

SEQ ID NO: 310325 - DNA, 75 bp, Artificial Sequence
  Synthetic
agtaaactaatatacagaatgaattatataccatcattagcgaaaataacaaactactcaggaaaagtacagtat

SEQ ID NO: 310326 - DNA, 75 bp, Artificial Sequence
  Synthetic
aaatatgaatcaggtggatttgcacaaatggatgctgtaggatatacgggtttagctgtaatttttagatttaga

SEQ ID NO: 310327 - DNA, 75 bp, Artificial Sequence
  Synthetic
tgtgtaggtgataaatggtataatgaatcatggcaatcatggtatgatagagataattctaggattgcatatata

SEQ ID NO: 310328 - DNA, 75 bp, Artificial Sequence
  Synthetic
ggtgaacgttatacagattcaactggatggatatataggcctggagcaacttatggatttggagcaggttatcca

SEQ ID NO: 310329 - DNA, 75 bp, Artificial Sequence
  Synthetic
ttacaggaatacactcatgatataacactttcctatactgtgttaaaaccatctgatccagagtttgttacaggg

SEQ ID NO: 310330 - DNA, 75 bp, Artificial Sequence
  Synthetic
ggtgataactatcaagaatcaataacgtcagatttgtatgagaaagtaagagatttacaagatcaaataaatact

SEQ ID NO: 310331 - DNA, 75 bp, Artificial Sequence
  Synthetic
ataaaagcagaattaaacgtttcaggagtgacatctggcattttcgaagcgctaacaaatatagggaacttgccg

SEQ ID NO: 310332 - DNA, 75 bp, Artificial Sequence
  Synthetic
cagatgttcagtaactttgtagaggtattctcaaaagtaaaagtagctatactaggaatgagaaagaagaacgtc

SEQ ID NO: 310333 - DNA, 75 bp, Artificial Sequence
  Synthetic
aaaccaaagccaattgaggcaatacaaatagtgagtaaagtcgatgtacaaaaaccactcatacagtcaatagcc

SEQ ID NO: 310334 - DNA, 75 bp, Artificial Sequence
  Synthetic
aaacaaatgccagaagaaattgaattgggaattatatataattctattagaaacaaaaggctaagagaaagacaa

SEQ ID NO: 310335 - DNA, 75 bp, Artificial Sequence
  Synthetic
atacatgagatagataaatttgcaatagcaacagaaatggaattaccaatgattcaacgaactgaaacactaaaa

SEQ ID NO: 310336 - DNA, 75 bp, Artificial Sequence
  Synthetic
ccaaaatttaaaaaatatttaagagaaaggggtatgctgccggaaaacgcacatgcaatagaatttgatgctgct

SEQ ID NO: 310337 - DNA, 75 bp, Artificial Sequence
  Synthetic
aataataagtttagtgttttgcttaaagagaaagctgatatattgtcatacaagatagataaagaattagcccat

SEQ ID NO: 310338 - DNA, 75 bp, Artificial Sequence
  Synthetic
gaagtgttgtcggaaatgtcaacttcagcttctcgttctatattctcactgaacgttagaaagcagataaatcta

SEQ ID NO: 310339 - DNA, 75 bp, Artificial Sequence
  Synthetic
gacaataatttctctagtcctacatacgcagatttggtaaataagattctagacgatggtgaactactggatgta

SEQ ID NO: 310340 - DNA, 75 bp, Artificial Sequence
  Synthetic
ctgggtagaattgataaacacagattagagaattacgtcgaagaattcgttactagaatagaagatatgttgcaa

SEQ ID NO: 310341 - DNA, 75 bp, Artificial Sequence
  Synthetic
gaagaattcgttactagaatagaagatatgttgcaaaagattgcataacatcgtgaagcgaaaataaaaaaaccc

SEQ ID NO: 310342 - DNA, 75 bp, Artificial Sequence
  Synthetic
ggaattttagtgtctcagtgagtgcgtcgtgagaagggagccataacccttggtcaccatgacgcagtcggtttc

SEQ ID NO: 310343 - DNA, 75 bp, Artificial Sequence
  Synthetic
attagctgatttcattgtcaaaactgatgatggttatatgccaagtgacagagaatgtaaagtgcttgatagatt

SEQ ID NO: 310344 - DNA, 75 bp, Artificial Sequence
  Synthetic
tctgtccagagaacaaaaagcaattcgtgaagaatataaatccagaacgggagtgaaatgtgatttaagaaagaa

SEQ ID NO: 310345 - DNA, 75 bp, Artificial Sequence
  Synthetic
aatgtttatgctagctgcaccatcaaggagatttactcaggaaggtgtagttcctatgaaggaattgagaagtaa

SEQ ID NO: 310346 - DNA, 75 bp, Artificial Sequence
  Synthetic
gactgacattccaagtgcagtgaaaagattgatcactgattggctgctgaaaacactagaagacgacgatgtctg

SEQ ID NO: 310347 - DNA, 75 bp, Artificial Sequence
  Synthetic
tgaagtttttgaagatgtatttgaaaataagtttccagatattttcgcatcatcggataaaatttcaagatttgc

SEQ ID NO: 310348 - DNA, 75 bp, Artificial Sequence
  Synthetic
aatgcgactagaaaatgaaaacgatttgattcataaaaatgtatcaaaggcaatgaatgcgtttgcagcttgttt

SEQ ID NO: 310349 - DNA, 75 bp, Artificial Sequence
  Synthetic
tcacgatattaagccttcatttgccacagagggaaaatgtactgttgcaagagcatgtgaagattcgatcattct

SEQ ID NO: 310350 - DNA, 75 bp, Artificial Sequence
  Synthetic
ggaatttcctgtaataccagaacatctgagaattggacaagttagaggagtattctataaattgtatccactatc

SEQ ID NO: 310351 - DNA, 75 bp, Artificial Sequence
  Synthetic
tgatgatctaccaacgcaaggttttcttgctttaaaacatgtgtcaaacaatcaattccaaatgtaccatggaca

SEQ ID NO: 310352 - DNA, 75 bp, Artificial Sequence
  Synthetic
cggacatgttagaacagtaccgttttctgaagtgccagaagcagtacgatcattcgcaaaaaaacagaaagatga

SEQ ID NO: 310353 - DNA, 75 bp, Artificial Sequence
  Synthetic
actggaaaagatagctaaagatcaacttgccgtgcagtgcggacagaaattcattaaaatgattgatgatctacg

SEQ ID NO: 310354 - DNA, 75 bp, Artificial Sequence
  Synthetic
tgctggtaggaagattgaagaagtgatttctgacgtgatgaaattcgacaagaaacagtgaaaaaactgactgtg

SEQ ID NO: 310355 - DNA, 75 bp, Artificial Sequence
  Synthetic
atgaaattcgacaagaaacagtgaaaaaactgactgtgacaaatccattcattgagcgctgggtaataaagaccc

SEQ ID NO: 310356 - DNA, 75 bp, Artificial Sequence
  Synthetic
ggcatattttcagcgttatggatcccgaaggtttaatttcagatgcgatcaaagcaattgatgaagcgaagaatg

SEQ ID NO: 310357 - DNA, 75 bp, Artificial Sequence
  Synthetic
ataaaaagaaaataatagaaatagctaagcagttagtcaacgatattaaagatacagttgaagacttagatattg

SEQ ID NO: 310358 - DNA, 75 bp, Artificial Sequence
  Synthetic
atctactaaaaaaattgaaagtacaatttaacgcaaaacggattgcaacaaaagaaattgatgcattaataaaga

SEQ ID NO: 310359 - DNA, 75 bp, Artificial Sequence
  Synthetic
atattgaagataaaaagaaagaaagtaaggatataagtgataagaaagaagaaagcagtaaaaacgatgacgatc

SEQ ID NO: 310360 - DNA, 75 bp, Artificial Sequence
  Synthetic
aaaataagaaaaacgtaaagaataatgaatctggaaaaaaagagaaagtcagtaatgataaagaagacgaaggcg

SEQ ID NO: 310361 - DNA, 75 bp, Artificial Sequence
  Synthetic
gactacgagatagcatacttggtaattcagatccagacagtaaattaacgaaagatatattgacaataaggcaaa

SEQ ID NO: 310362 - DNA, 75 bp, Artificial Sequence
  Synthetic
aaagatatattgacaataaggcaaataaattctaaaatattatttgtcgatacagagaacgacacctactcagtg

SEQ ID NO: 310363 - DNA, 75 bp, Artificial Sequence
  Synthetic
gcagacttaagaatggagaagatgatatttctgtcgaatagggatcaagtgtctgaccaagaaggaccagaagag

SEQ ID NO: 310364 - DNA, 75 bp, Artificial Sequence
  Synthetic
gtactttacacatcggatttctttaaggatataaagaatgaagatattaaatactttaggaattactttttggag

SEQ ID NO: 310365 - DNA, 75 bp, Artificial Sequence
  Synthetic
aaggctatgatgttaagaaaacaaatgccaaatgttaattacatgtcaggattgaataaagaaactaatccattg

SEQ ID NO: 310366 - DNA, 75 bp, Artificial Sequence
  Synthetic
aatatacaaaatacaatatgcacatcatttgatcaaatgaaatattataatattgtagtagatagaaccaataga

SEQ ID NO: 310367 - DNA, 75 bp, Artificial Sequence
  Synthetic
gcatttgacaatagaagaagagatgtcgagtttgacaacgttactatagacggagtgaatagaagggcaacggta

SEQ ID NO: 310368 - DNA, 75 bp, Artificial Sequence
  Synthetic
tctttgagactacatccagtggacgaccaaatcctagcagcagttgatatgaacacatacgaaacacagaactta

SEQ ID NO: 310369 - DNA, 75 bp, Artificial Sequence
  Synthetic
gctgatgtgatgtccagatatcaaatgattgcagcagatggatatgcagttacaccaaaaattcgagttgataga

SEQ ID NO: 310370 - DNA, 75 bp, Artificial Sequence
  Synthetic
tcaagaatattaaactcagtgtcaatggttaatagattatggagaacaaacgttttttctgagtcaattgaaaat

SEQ ID NO: 310371 - DNA, 75 bp, Artificial Sequence
  Synthetic
gcaaaagacgccatttatagatcagcggaaattcagtttacggtggcagatgcaactacatccgcactatccact

SEQ ID NO: 310372 - DNA, 75 bp, Artificial Sequence
  Synthetic
attaacgtagcttcagcacagcaaacactatcagcaatactaaatatgacaatattcagaatggatattgaactg

SEQ ID NO: 310373 - DNA, 75 bp, Artificial Sequence
  Synthetic
cactatcagcaatactaaatatgacaatattcagaatggatattgaactgactgggaatcaatcatcttttggag

SEQ ID NO: 310374 - DNA, 75 bp, Artificial Sequence
  Synthetic
ctactaatgcatttgaagctcatgttaatttaggaggtggtaatttaaatagagacataataaattatatgagat

SEQ ID NO: 310375 - DNA, 75 bp, Artificial Sequence
  Synthetic
atgtattactcagaagaccatgggctatattccaaagaacacaaacagtagattaccaaactgacattatgttac

SEQ ID NO: 310376 - DNA, 75 bp, Artificial Sequence
  Synthetic
caaatatagaccctgtaaacataaatgatcaggcatatatggcgatgaatagcctgttaagtggtatttcagccg

SEQ ID NO: 310377 - DNA, 75 bp, Artificial Sequence
  Synthetic
cagcacaaagaaatccgaatcccggtagacagatagcggcaaattctttcagaaaattgattaaatcgatgaaag

SEQ ID NO: 310378 - DNA, 75 bp, Artificial Sequence
  Synthetic
aatttctgccgtattcggctgatatcggacagctaaatcagaacatgagagatgaaagattgcgtgttaaaatac

SEQ ID NO: 310379 - DNA, 75 bp, Artificial Sequence
  Synthetic
cagtttcaggctttctgtcaataatcatgggaataaataaagcaccagacaacttcgattggggagccatgttag

SEQ ID NO: 310380 - DNA, 75 bp, Artificial Sequence
  Synthetic
cattcgctgatgaagtgagaagagtgaattatgcggagagagaggcaattgagaatgtaacaacatatgtagttc

SEQ ID NO: 310381 - DNA, 75 bp, Artificial Sequence
  Synthetic
tgaaaaatgatggaaacagatcagtatcgaaaaaagatacgtttctggaaagagttgaaacacccactgagacaa

SEQ ID NO: 310382 - DNA, 75 bp, Artificial Sequence
  Synthetic
ttaaagctatcacgaaaataccttcagcgtcactaactacgattctatcagatagactactcgtgaatgaaataa

SEQ ID NO: 310383 - DNA, 75 bp, Artificial Sequence
  Synthetic
ggaatacgagaacatatgcacttataaatagattaattgacatactgaaaactgcattcgataatgtaccgacgt

SEQ ID NO: 310384 - DNA, 75 bp, Artificial Sequence
  Synthetic
cacatcatggagttggtaaaggagcattgttatttccatatccaagaagatttggcagatcatcagtatacgtga

SEQ ID NO: 310385 - DNA, 75 bp, Artificial Sequence
  Synthetic
gaaaagataatattatatttaatagaccacaaggagttaatagatataacgtagatgatttactacatggaagat

SEQ ID NO: 310386 - DNA, 75 bp, Artificial Sequence
  Synthetic
tctatcaaggcttgatgggacaagtccagaatatgcaaccagtttttattgatggtccaatgaaattgagaacat

SEQ ID NO: 310387 - DNA, 75 bp, Artificial Sequence
  Synthetic
gatggtccaatgaaattgagaacatcagatccgacagcgattgaatcaataacgtcagcatatttgacaatgtcc

SEQ ID NO: 310388 - DNA, 75 bp, Artificial Sequence
  Synthetic
tttgttgacgacaaaccaacaaaaccgcatgaacaatttgaagagatgatgtctaaaacatcagtttttattcta

SEQ ID NO: 310389 - DNA, 75 bp, Artificial Sequence
  Synthetic
gatgcacaacgactaattgttcaaagtggagcgacaaattataatttcaattatcatgacatgttgataactgat

SEQ ID NO: 310390 - DNA, 75 bp, Artificial Sequence
  Synthetic
aaagtcgttgataagctacagttctcgactgtgctaccaccagatgtaactctatttaatggtgtactcgtatat

SEQ ID NO: 310391 - DNA, 75 bp, Artificial Sequence
  Synthetic
cagatgtaactctatttaatggtgtactcgtatatgaagcttaaaccttcgtgagctgaatacaattaaagaccc

SEQ ID NO: 310392 - DNA, 75 bp, Artificial Sequence
  Synthetic
tagtatatacaaatccaagagttagtagaataatattagagaaagatggtaaagaaagtatatggcaaactagag

SEQ ID NO: 310393 - DNA, 75 bp, Artificial Sequence
  Synthetic
aaacattaactgaaactccaaaacaagcaattcaatatattcaagctatattagattcaaatgatgcagtagaaa

SEQ ID NO: 310394 - DNA, 75 bp, Artificial Sequence
  Synthetic
agaaagtcgagaaactactacgtgtacgttatcatgcagtgtatgtagaagataaatcagataaacgcgagttag

SEQ ID NO: 310395 - DNA, 75 bp, Artificial Sequence
  Synthetic
tcagtaaattattatcaataacaattaaacaattagggagtgaagacttggatgaaacgaatataaatttgatag

SEQ ID NO: 310396 - DNA, 75 bp, Artificial Sequence
  Synthetic
taaatgatgcaaaaaaatggagagtcaagaacgcgtcgaaactaagaccatatcactttaacatacctatcaaag

SEQ ID NO: 310397 - DNA, 75 bp, Artificial Sequence
  Synthetic
aatttattagggataacgaattcgagatagttgatacaggagatagacgatggagatcagatacgttacaaggat

SEQ ID NO: 310398 - DNA, 75 bp, Artificial Sequence
  Synthetic
taataccacattactatcatagaacacacacattagtatcatcagtgttatacgcaatacagtcaagaataggca

SEQ ID NO: 310399 - DNA, 75 bp, Artificial Sequence
  Synthetic
catatgatgatgacaggaggaaagctttaaaatggatgttgaaaaaaatacaatcaaaaatgattgaaggatatc

SEQ ID NO: 310400 - DNA, 75 bp, Artificial Sequence
  Synthetic
tagaattagaaagaaatagaaaatggtcaatgacaatcaaagaactgaaagaagctaattttagaatgtataatg

SEQ ID NO: 310401 - DNA, 75 bp, Artificial Sequence
  Synthetic
ctaaaataatacatgctgcatgtgcgatgatatcaatattacactcaaagaggattattccagaatttttatgtc

SEQ ID NO: 310402 - DNA, 75 bp, Artificial Sequence
  Synthetic
aaatattagctgcatttgaagaaataccggcaaatgctgcgaaagttctatcgtcacccatgacattatatattg

SEQ ID NO: 310403 - DNA, 75 bp, Artificial Sequence
  Synthetic
gaatatgccagctaaatactaaaaaagttgtatctactggaaatgcgaatgagtctgcgcaaatagatcagccaa

SEQ ID NO: 310404 - DNA, 75 bp, Artificial Sequence
  Synthetic
atatacaaagagttgataattctcaacttgaagagtggaaaaaaacaattgaagaagatccactaccaaattcat

SEQ ID NO: 310405 - DNA, 75 bp, Artificial Sequence
  Synthetic
taatgctaaagctaatgtcaaagaatttaaaaacagatgtggatacattcaagacgatatttaattgtttttcag

SEQ ID NO: 310406 - DNA, 75 bp, Artificial Sequence
  Synthetic
ctacattccatgtgggtcacagaatagataactcacaggacgcaattcaagatcaagtaacagttgagtatacaa

SEQ ID NO: 310407 - DNA, 75 bp, Artificial Sequence
  Synthetic
caaaagtgaatagagaaatgtatgacatgtactattatacattaaagaatatgttaaaagatgaaattaagaatt

SEQ ID NO: 310408 - DNA, 75 bp, Artificial Sequence
  Synthetic
atatgctagagatgaaaaagcaaatgaactctgacgttacagtaccatcactagcgagtctagcaaatacatcaa

SEQ ID NO: 310409 - DNA, 75 bp, Artificial Sequence
  Synthetic
acgggaaaacgattgaagtcgaatttgttgggaggaaaattaaaacaacgaagaaaatgcttcatcttgacaatg

SEQ ID NO: 310410 - DNA, 75 bp, Artificial Sequence
  Synthetic
atttgttaactaattctaattatactgaaatagaaaaaataataggacaaggaataccgatgggaacgaggaatg

SEQ ID NO: 310411 - DNA, 75 bp, Artificial Sequence
  Synthetic
ttccagcaaggcagacaagaggtatatttatattgccatggcaagttgctgcagtccagcatactttagcagaaa

SEQ ID NO: 310412 - DNA, 75 bp, Artificial Sequence
  Synthetic
cgatgtacaaaagagcgaagaaaggtgcatataaaggagcatttgcggaagcatataccgctaaagctgcatctt

SEQ ID NO: 310413 - DNA, 75 bp, Artificial Sequence
  Synthetic
taacatacggtgtgctagcgcaggacacatcaacagcagaaaagattatattatatacggacgtttcgcagtggg

SEQ ID NO: 310414 - DNA, 75 bp, Artificial Sequence
  Synthetic
atgcatcgcaacataatacggaaccatacagatcagcatggataaatgcgattgatgaagcgagagaagagttgg

SEQ ID NO: 310415 - DNA, 75 bp, Artificial Sequence
  Synthetic
ctatgccaaagtcactagaacctaaagtattaaatatgaatgtactagataaaatgaaagaaatccagaaagcgc

SEQ ID NO: 310416 - DNA, 75 bp, Artificial Sequence
  Synthetic
tgttgaattcagatttaataattgaatcaccaggatcacaacgcgaaccattaaaaattagatatcatggagtcg

SEQ ID NO: 310417 - DNA, 75 bp, Artificial Sequence
  Synthetic
cgtcaggtgaaaagacgaccaagataggtaattcttttgcaaatgtggcattgattaatacggtattaaataagg

SEQ ID NO: 310418 - DNA, 75 bp, Artificial Sequence
  Synthetic
tctcagaaaagatttcagatatcagagtgacacatatgcgagttgatggagatgataatgtggtgacaatgtaca

SEQ ID NO: 310419 - DNA, 75 bp, Artificial Sequence
  Synthetic
cgtcatgcaaaatagaagaacttcagaaagaaattaaggatgcatatacacaaatgaatgcgcgtgtaaaagctt

SEQ ID NO: 310420 - DNA, 75 bp, Artificial Sequence
  Synthetic
tagcatcatggacaggattggaaatggctaagagattcataatatgcggaaagatctttgagagaggagcaatat

SEQ ID NO: 310421 - DNA, 75 bp, Artificial Sequence
  Synthetic
caatatttaccgctgagagaccatatggcacagacgtttcagtacagcagatgacaggcgcgtcactatattcgg

SEQ ID NO: 310422 - DNA, 75 bp, Artificial Sequence
  Synthetic
cagcagtgaatgcttatagaggatttggtgagacatatagaaaatttatggaagatgttctaataccaccttcag

SEQ ID NO: 310423 - DNA, 75 bp, Artificial Sequence
  Synthetic
cttcaacaaaaataacagcaagattgagagtgcttttgtcaccaataacattacactcgacaggaccgttgggat

SEQ ID NO: 310424 - DNA, 75 bp, Artificial Sequence
  Synthetic
atgagataacaccaggaggattaggaggtcgtataaggatgcatttcgctgataagattaacatgcaattattta

SEQ ID NO: 310425 - DNA, 75 bp, Artificial Sequence
  Synthetic
aacaattgacaaactcagtgtcaatatctattacgccagacgaaataagagaatacaagaaaacgccgcaattta

SEQ ID NO: 310426 - DNA, 75 bp, Artificial Sequence
  Synthetic
aaagaagaacagaattgatgattgacgcacttagaaataatgtgatgaaacaagctaaaattcttgaagatattc

SEQ ID NO: 310427 - DNA, 75 bp, Artificial Sequence
  Synthetic
tggtggacaaagaaagtcaaaaaacgcttggtgtacccaatgttcagacgtcaaaaaatcgtcaacagcttgaag

SEQ ID NO: 310428 - DNA, 75 bp, Artificial Sequence
  Synthetic
aagcagttaaaatgttatcaaaacctgaaaataagttagaaaatgtagatcaattctatccagaagaagttttta

SEQ ID NO: 310429 - DNA, 75 bp, Artificial Sequence
  Synthetic
atttagtcacagcgtcttcgaatagagctcagccaagctatatttcaactgataggttatatgaacatgagtcag

SEQ ID NO: 310430 - DNA, 75 bp, Artificial Sequence
  Synthetic
agccagtgagaaaattacagatgcaattaggggtgcggatagctgatacgagaccattaacgaaaccagttaatc

SEQ ID NO: 310431 - DNA, 75 bp, Artificial Sequence
  Synthetic
aactgtatgagatagtgtcaaaaatcgctccaatgaatatctcaccaacagacattctagcaaatgcaagaaaat

SEQ ID NO: 310432 - DNA, 75 bp, Artificial Sequence
  Synthetic
atgaccttaaaacattaaatggaaaaaaagctttcctatctgacttaggattgcaaggcgctcaattaaagcaat

SEQ ID NO: 310433 - DNA, 75 bp, Artificial Sequence
  Synthetic
atttaggatcaaagttactatttagagatttattactagctaaatacgataaattgtacgaagcaccaggtttcg

SEQ ID NO: 310434 - DNA, 75 bp, Artificial Sequence
  Synthetic
gagctactcagttaactacaattcccttgaatttagagtctgcagaaagaatattcaatgtcgcctttaggctac

SEQ ID NO: 310435 - DNA, 75 bp, Artificial Sequence
  Synthetic
catccaattattatgagattttaatgttaatgttgctgtatgaatacgtgaattacatatttgatggaggacaac

SEQ ID NO: 310436 - DNA, 75 bp, Artificial Sequence
  Synthetic
catgcgtttggaagctgaaagatatggaaacaaatgaaaatgtaaaactctcagcacaaataatgaagatgatag

SEQ ID NO: 310437 - DNA, 75 bp, Artificial Sequence
  Synthetic
ataacattaaacttgatgaagtattgttttcagattatatatactagtgtgagatcgtcaaattgaataaagacc

SEQ ID NO: 310438 - DNA, 75 bp, Artificial Sequence
  Synthetic
taacattaaacttgatgaagtattgttttcagattatatatactagtgtgagatcgtcaaattgaataaagaccc

SEQ ID NO: 310439 - DNA, 75 bp, Artificial Sequence
  Synthetic
ggaatttttttgttgtttggacgagcttcggctctgagaacgcaaagaaatggctgaacttcttaaagtgtgttt

SEQ ID NO: 310440 - DNA, 75 bp, Artificial Sequence
  Synthetic
tgatgagatgatgaaaagtggaaattgtagttttgaacatctaatggagaagatgaatgacgctggaattgattt

SEQ ID NO: 310441 - DNA, 75 bp, Artificial Sequence
  Synthetic
ggataaatggaagcaagcttttgatggtgctagactaccacaaagaatgactaaatcgacccttgcaatacaaaa

SEQ ID NO: 310442 - DNA, 75 bp, Artificial Sequence
  Synthetic
cacaaatctggagaaagagattgtcatgctgagagcgaaggaacaccgacacggttacgacaaaaacaaaagaac

SEQ ID NO: 310443 - DNA, 75 bp, Artificial Sequence
  Synthetic
acttgcaaattttgacgttgagaggaaaaatgggaatacaattctaactccaaaaaccagactggctgaaattat

SEQ ID NO: 310444 - DNA, 75 bp, Artificial Sequence
  Synthetic
tctgctgaattcaacacgggatctgaaactaagcgcaccaccatccgactatattgaggagctagaggataaagt

SEQ ID NO: 310445 - DNA, 75 bp, Artificial Sequence
  Synthetic
ggcacaactggaagaagagagactgaatctaatgcgctgcaacaatgatatctactatcaatacctcacattaca

SEQ ID NO: 310446 - DNA, 75 bp, Artificial Sequence
  Synthetic
cacaactagttactgtcttcaagaaaccaacaaatggcaagaaaaaatgatctcaagactacaagaaaacgaaat

SEQ ID NO: 310447 - DNA, 75 bp, Artificial Sequence
  Synthetic
ggtgatgtcaagtgaaataaatgatctgaaatcaatggtaagaacactgacgagggagctaaattatgaaatttc

SEQ ID NO: 310448 - DNA, 75 bp, Artificial Sequence
  Synthetic
atttgaagatgaaccagacacaggatacatttcggatgagaacagtcaagtcagtgaagatgatctgtctgaaca

SEQ ID NO: 310449 - DNA, 75 bp, Artificial Sequence
  Synthetic
agagttagacaatgaccaacaagatgaaaatgagtcaagtgatgaagaaatatttgaggatcttgacgatctaat

SEQ ID NO: 310450 - DNA, 75 bp, Artificial Sequence
  Synthetic
caaccaatatgaacaaagacagagactaatggagagagaacgaattctcaatgaactacaagcaccagactatga

SEQ ID NO: 310451 - DNA, 75 bp, Artificial Sequence
  Synthetic
caccgagactgatgatgagaatgaatatgcatacaacattgagagagagcatagacattgaagatacaagctaat

SEQ ID NO: 310452 - DNA, 75 bp, Artificial Sequence
  Synthetic
gttaataactattcaaaattcactttattgatcgttcagcttaatagctgactgaccatcagcatcaataaagac

SEQ ID NO: 310453 - DNA, 75 bp, Artificial Sequence
  Synthetic
taataactattcaaaattcactttattgatcgttcagcttaatagctgactgaccatcagcatcaataaagaccc

SEQ ID NO: 310454 - DNA, 75 bp, Artificial Sequence
  Synthetic
aatttgatttcaaaataaaaaaggataagaagaaacaagaaaagacgaaaccaaagaaaatggttgtcaaagaca

SEQ ID NO: 310455 - DNA, 75 bp, Artificial Sequence
  Synthetic
atgaaacagtagtaacacatgaagaaaaatctgaacgtggttcagtctattctgaggaatcgtcaaatcattcat

SEQ ID NO: 310456 - DNA, 75 bp, Artificial Sequence
  Synthetic
cgagtaattacgctgaagcatatgaaaggctacagcgtgaacttaatactaacgaatcaaatgacaacaaatgca

SEQ ID NO: 310457 - DNA, 75 bp, Artificial Sequence
  Synthetic
aacgaacgatcagaaactgggcggatgaagttgaaagacaagaaagtgaatctgagagcgaatatgatataccag

SEQ ID NO: 310458 - DNA, 75 bp, Artificial Sequence
  Synthetic
acacagaatccattccgaagaagacgaatataatagatatggggtctgagacaaaagagcaaataatgaatgaaa

SEQ ID NO: 310459 - DNA, 75 bp, Artificial Sequence
  Synthetic
tcattctcaagaatgtagacaatctatccacaaaacaaaaacacgctcttgtaaacgcaatagttatgtcaatga

SEQ ID NO: 310460 - DNA, 75 bp, Artificial Sequence
  Synthetic
aataatcaaatgacggagtgcggtgaaaaccgcctgacatgactaggggttagcccctgaggtgactaataaaga

SEQ ID NO: 310461 - DNA, 75 bp, Artificial Sequence
  Synthetic
aatcaaatgacggagtgcggtgaaaaccgcctgacatgactaggggttagcccctgaggtgactaataaagaccc

SEQ ID NO: 310462 - DNA, 75 bp, Artificial Sequence
  Synthetic
ggaaatttagtgtctcagtgagtgcgtcgtgagaagggagccataacccttggtcaccatgacgcagtcagtttc

SEQ ID NO: 310463 - DNA, 75 bp, Artificial Sequence
  Synthetic
aatagctgatttcattgtcaaaaccgaagatggctatatgccaagtgacagagagtgtaaagtacttgatagatt

SEQ ID NO: 310464 - DNA, 75 bp, Artificial Sequence
  Synthetic
tctgtccagagaacaaaaagcgatccgtgaagaatataaatctagaacaggaatgaaatgtgatctaaggaagaa

SEQ ID NO: 310465 - DNA, 75 bp, Artificial Sequence
  Synthetic
aatgtttatgctaactgcaccatcaagaaggtttactcaggaaggtgtagttccgatgaaagaactgaaaagtaa

SEQ ID NO: 310466 - DNA, 75 bp, Artificial Sequence
  Synthetic
gactgacattccaagtgcagtgaaaaggctgattactgattggttgcttaaaacgctagaagacgatgatgtttg

SEQ ID NO: 310467 - DNA, 75 bp, Artificial Sequence
  Synthetic
tgaagtttttgaggatgtatttgaaaacaagtttccagatgtttttgcatcatcagataaaatttcaagatttgc

SEQ ID NO: 310468 - DNA, 75 bp, Artificial Sequence
  Synthetic
catgaggttagagaatgagaatgacttgattcataaaaatgtatcaaaagcgatgaatgcgtttgcagcttgttt

SEQ ID NO: 310469 - DNA, 75 bp, Artificial Sequence
  Synthetic
ccatgccattaagccttcattcgccacagagggaaagtgtactgttgcaagagcatgtgaagactcaatcattct

SEQ ID NO: 310470 - DNA, 75 bp, Artificial Sequence
  Synthetic
agaatttcctgtgataccagaacatctgagaattggacaagttagaggagtgttctacaaactatatccactatc

SEQ ID NO: 310471 - DNA, 75 bp, Artificial Sequence
  Synthetic
agatgatttaccaacgcaaggttttcttgctctgaaacacgtatcaaataatcaattccaaatgtatcatgggca

SEQ ID NO: 310472 - DNA, 75 bp, Artificial Sequence
  Synthetic
cggacatgttagaacagtaccattttctgaagtgccagaagcggtacgatcgtttgcaaaaaaacagaaaggtga

SEQ ID NO: 310473 - DNA, 75 bp, Artificial Sequence
  Synthetic
gctggaaaaaatagctaaagaccaacttgccgtacagtgtgggcagaaattcattaaaatgattgacgatatacg

SEQ ID NO: 310474 - DNA, 75 bp, Artificial Sequence
  Synthetic
tgctggcagaaagattgaagaagtgatttctgacataatgagattcgacaagaaacagtgaaagaactggctgtg

SEQ ID NO: 310475 - DNA, 75 bp, Artificial Sequence
  Synthetic
atgagattcgacaagaaacagtgaaagaactggctgtgataaatccattcattgagcgctgggtaataaagaccc

SEQ ID NO: 310476 - DNA, 75 bp, Artificial Sequence
  Synthetic
ggaatattgagaccttgattataacagaactgaatttcaaattatagaaaacgtattcctagttatattatcatt

SEQ ID NO: 310477 - DNA, 75 bp, Artificial Sequence
  Synthetic
tgttaatacagctacattgatgcatataattctttcattattatataagggtgcaatttagaagaaaacagaaga

SEQ ID NO: 310478 - DNA, 75 bp, Artificial Sequence
  Synthetic
aaatggaagaagaaacgatacagaatatgactaaaatgctaatggcgacactaactgatcacatagattttaata

SEQ ID NO: 310479 - DNA, 75 bp, Artificial Sequence
  Synthetic
aaatacttcaaacaacagttacggctatagtagcttttttctttaataaaaagatggcaactcctattatcaaga

SEQ ID NO: 310480 - DNA, 75 bp, Artificial Sequence
  Synthetic
aagtcctatcaaaagtaaaagaaaaaatcaatgaaaaaatagatagcgtaattgatcagtcaatgctaagactag

SEQ ID NO: 310481 - DNA, 75 bp, Artificial Sequence
  Synthetic
gaacgactcaaaattcgaaagaaatggtgacaaattgtatagcacaagaaatgcgtaagtttgacacaataatga

SEQ ID NO: 310482 - DNA, 75 bp, Artificial Sequence
  Synthetic
aaaatcttgaagatacaacgcttgattttgatgttatggctaggtttgatgagaaaacagttgacattgacaaga

SEQ ID NO: 310483 - DNA, 75 bp, Artificial Sequence
  Synthetic
aaatacgtggaattgaagaatcaatggaaagaagaatgaaagattttgagattaaaatgaatgcattgatgaaat

SEQ ID NO: 310484 - DNA, 75 bp, Artificial Sequence
  Synthetic
cagtaacacagtgcactaaaaagaaagaaacaccaatagttcatattgcacaacaagataaagtacagctgtaca

SEQ ID NO: 310485 - DNA, 75 bp, Artificial Sequence
  Synthetic
caggaccaaaaaaagagtatgatcctcgtgacaagttgtaattaacgtctcgcgaagtcggattggtgcagagcc

SEQ ID NO: 310486 - DNA, 75 bp, Artificial Sequence
  Synthetic
gcgaagtcggattggtgcagagccgatgggtttcgtaggccagtcctcctccaggcttcagttcaataaagaccc

SEQ ID NO: 310487 - DNA, 75 bp, Artificial Sequence
  Synthetic
atggatctcatcgaaacgattaatgcagtcgttgaactgcaagaaagagttcgaaatttatcaccaaatacaaat

SEQ ID NO: 310488 - DNA, 75 bp, Artificial Sequence
  Synthetic
atttatcaagatggacaaacaactattaatgattacaatgctgttgcttctagaacgaatggtaaattatataat

SEQ ID NO: 310489 - DNA, 75 bp, Artificial Sequence
  Synthetic
ttaatgattacaatgctgttgcttctagaacgaatggtaaattatataatctacgtgatccaattgctcaacttt

SEQ ID NO: 310490 - DNA, 75 bp, Artificial Sequence
  Synthetic
tagaacgaatggtaaattatataatctacgtgatccaattgctcaactttcaccttttcaggtgcatatgccaat

SEQ ID NO: 310491 - DNA, 75 bp, Artificial Sequence
  Synthetic
actgatgaccatgaatccatggttgcaggaattgaatctctatttgatgctttagctgccgctgtgcgtacagaa

SEQ ID NO: 310492 - DNA, 75 bp, Artificial Sequence
  Synthetic
ttacgaaatcagttgaaccagaagtactaaggttagtgcttgacattggaatcaaatcacaggtatcaaaaaatc

SEQ ID NO: 310493 - DNA, 75 bp, Artificial Sequence
  Synthetic
tacagcaaaaatggagcagcagatcgaaccagccgatgatccatttgcaaatttgagagtaaatctacttgcacc

SEQ ID NO: 310494 - DNA, 75 bp, Artificial Sequence
  Synthetic
gaaccagccgatgatccatttgcaaatttgagagtaaatctacttgcaccaggtggagcgacgaataacactggt

SEQ ID NO: 310495 - DNA, 75 bp, Artificial Sequence
  Synthetic
gagctactggaaagatggctgtcgtaactgcagttcaaggaagacccggaggaatcaatttcgcacttgatatga

SEQ ID NO: 310496 - DNA, 75 bp, Artificial Sequence
  Synthetic
gagttgcaattgtctctagggaatcagcctccgaataatatacctgtccacgctcaatgtgttgatgtatcaaca

SEQ ID NO: 310497 - DNA, 75 bp, Artificial Sequence
  Synthetic
cgctcaatgtgttgatgtatcaacagttatgactgaaggagacatacgatttcagttcacattaggtgggagaat

SEQ ID NO: 310498 - DNA, 75 bp, Artificial Sequence
  Synthetic
acattcaacttcccgctatgtgacagagttaatataatgattgagccatggaacgctaataaacaggcaaataac

SEQ ID NO: 310499 - DNA, 75 bp, Artificial Sequence
  Synthetic
ataccaattcgccataccttgcaaagccaacttatctaatgggcacagtgtttaattcagcttcattcgttaata

SEQ ID NO: 310500 - DNA, 75 bp, Artificial Sequence
  Synthetic
caccaccaaacgttctttggactatgaattcactactatcaaaagcgccgccacaactagttcattggtccagga

SEQ ID NO: 310501 - DNA, 75 bp, Artificial Sequence
  Synthetic
aaattgcatgtttaattgcagcctattcatgcaaaatctaagatgggatctggtcacgcactgggatccagtgtt

SEQ ID NO: 310502 - DNA, 75 bp, Artificial Sequence
  Synthetic
atggatctcatcgaaacgattaatgcagttgttgaactgcaagaaagagttcgaaatctatcaccaaatacaaat

SEQ ID NO: 310503 - DNA, 75 bp, Artificial Sequence
  Synthetic
cagttgttgaactgcaagaaagagttcgaaatctatcaccaaatacaaatatttatcaggatggacaaacaacta

SEQ ID NO: 310504 - DNA, 75 bp, Artificial Sequence
  Synthetic
cagaacgaatggtaaattatataatctacgtgatccaattgctcaactttcaccttttcaggtgcatatgccaat

SEQ ID NO: 310505 - DNA, 75 bp, Artificial Sequence
  Synthetic
ctacgtgatccaattgctcaactttcaccttttcaggtgcatatgccaattgttccattagcaactgtgctatct

SEQ ID NO: 310506 - DNA, 75 bp, Artificial Sequence
  Synthetic
acagacgaccatgagtccatggttgcaggaattgaatctctgtttgatgctttagcggctgctgtgcgtacagaa

SEQ ID NO: 310507 - DNA, 75 bp, Artificial Sequence
  Synthetic
ggctcaagacagaacagagctgttgtcacgaagtcagttgaaccagaagtactgaggttagtgcttgacattgga

SEQ ID NO: 310508 - DNA, 75 bp, Artificial Sequence
  Synthetic
attaagtcacaggtatcaaaaaatccgttggcaaacatgcttcaagttgatacagcgaaaatggagcagcaaata

SEQ ID NO: 310509 - DNA, 75 bp, Artificial Sequence
  Synthetic
attaagtcacaggtatcaaaaaatccgttggcaaacatgcttcaagttgatacagcgaaaatggagcagcaaatt

SEQ ID NO: 310510 - DNA, 75 bp, Artificial Sequence
  Synthetic
attaagtcacaggtatcaaaaaatccgttggcaaacatgcttcaagttgatacagcgaaaatggagcagcaaatc

SEQ ID NO: 310511 - DNA, 75 bp, Artificial Sequence
  Synthetic
attaagtcacaggtatcaaaaaatccgttggcaaacatgcttcaagttgatacagcgaaaatggagcagcaaatg

SEQ ID NO: 310512 - DNA, 75 bp, Artificial Sequence
  Synthetic
attaagtcacaggtatcaaaaaatccgttggcaaacatgcttcaagttgatactgcgaaaatggagcagcaaata

SEQ ID NO: 310513 - DNA, 75 bp, Artificial Sequence
  Synthetic
attaagtcacaggtatcaaaaaatccgttggcaaacatgcttcaagttgatactgcgaaaatggagcagcaaatt

SEQ ID NO: 310514 - DNA, 75 bp, Artificial Sequence
  Synthetic
attaagtcacaggtatcaaaaaatccgttggcaaacatgcttcaagttgatactgcgaaaatggagcagcaaatc

SEQ ID NO: 310515 - DNA, 75 bp, Artificial Sequence
  Synthetic
attaagtcacaggtatcaaaaaatccgttggcaaacatgcttcaagttgatactgcgaaaatggagcagcaaatg

SEQ ID NO: 310516 - DNA, 75 bp, Artificial Sequence
  Synthetic
attaagtcacaggtatcaaaaaatccgttggcaaacatgcttcaagttgataccgcgaaaatggagcagcaaata

SEQ ID NO: 310517 - DNA, 75 bp, Artificial Sequence
  Synthetic
attaagtcacaggtatcaaaaaatccgttggcaaacatgcttcaagttgataccgcgaaaatggagcagcaaatt

SEQ ID NO: 310518 - DNA, 75 bp, Artificial Sequence
  Synthetic
attaagtcacaggtatcaaaaaatccgttggcaaacatgcttcaagttgataccgcgaaaatggagcagcaaatc

SEQ ID NO: 310519 - DNA, 75 bp, Artificial Sequence
  Synthetic
attaagtcacaggtatcaaaaaatccgttggcaaacatgcttcaagttgataccgcgaaaatggagcagcaaatg

SEQ ID NO: 310520 - DNA, 75 bp, Artificial Sequence
  Synthetic
attaagtcacaggtatcaaaaaatccgttggcaaacatgcttcaagttgatacggcgaaaatggagcagcaaata

SEQ ID NO: 310521 - DNA, 75 bp, Artificial Sequence
  Synthetic
attaagtcacaggtatcaaaaaatccgttggcaaacatgcttcaagttgatacggcgaaaatggagcagcaaatt

SEQ ID NO: 310522 - DNA, 75 bp, Artificial Sequence
  Synthetic
attaagtcacaggtatcaaaaaatccgttggcaaacatgcttcaagttgatacggcgaaaatggagcagcaaatc

SEQ ID NO: 310523 - DNA, 75 bp, Artificial Sequence
  Synthetic
attaagtcacaggtatcaaaaaatccgttggcaaacatgcttcaagttgatacggcgaaaatggagcagcaaatg

SEQ ID NO: 310524 - DNA, 75 bp, Artificial Sequence
  Synthetic
gagccagctgatgatccatttgcaaatttgagagtcaatctgcttgcaccaggtggagcaacaaataacactggt

SEQ ID NO: 310525 - DNA, 75 bp, Artificial Sequence
  Synthetic
ggagggtatcatgcactcgttggaagagctactggaaaaatggctgtcgtaactgcagttcaaggtagacccggg

SEQ ID NO: 310526 - DNA, 75 bp, Artificial Sequence
  Synthetic
ggagggtatcatgctctcgttggaagagctactggaaaaatggctgtcgtaactgcagttcaaggtagacccggg

SEQ ID NO: 310527 - DNA, 75 bp, Artificial Sequence
  Synthetic
ggagggtatcatgccctcgttggaagagctactggaaaaatggctgtcgtaactgcagttcaaggtagacccggg

SEQ ID NO: 310528 - DNA, 75 bp, Artificial Sequence
  Synthetic
ggagggtatcatgcgctcgttggaagagctactggaaaaatggctgtcgtaactgcagttcaaggtagacccggg

SEQ ID NO: 310529 - DNA, 75 bp, Artificial Sequence
  Synthetic
ggaatcaattttgcacttgacatgaaagtgccatgttcaggagtaatgacagcaatatatttgcccgcaccaggt

SEQ ID NO: 310530 - DNA, 75 bp, Artificial Sequence
  Synthetic
ggaatcaattttgcacttgacatgaaagtgccatgttcaggagtaatgacagctatatatttgcccgcaccaggt

SEQ ID NO: 310531 - DNA, 75 bp, Artificial Sequence
  Synthetic
ggaatcaattttgcacttgacatgaaagtgccatgttcaggagtaatgacagccatatatttgcccgcaccaggt

SEQ ID NO: 310532 - DNA, 75 bp, Artificial Sequence
  Synthetic
ggaatcaattttgcacttgacatgaaagtgccatgttcaggagtaatgacagcgatatatttgcccgcaccaggt

SEQ ID NO: 310533 - DNA, 75 bp, Artificial Sequence
  Synthetic
aagtgccatgttcaggagtaatgacagcaatatatttgcccgcaccaggtgagctacaattgtctctagggaatc

SEQ ID NO: 310534 - DNA, 75 bp, Artificial Sequence
  Synthetic
aagtgccatgttcaggagtaatgacagctatatatttgcccgcaccaggtgagctacaattgtctctagggaatc

SEQ ID NO: 310535 - DNA, 75 bp, Artificial Sequence
  Synthetic
aagtgccatgttcaggagtaatgacagccatatatttgcccgcaccaggtgagctacaattgtctctagggaatc

SEQ ID NO: 310536 - DNA, 75 bp, Artificial Sequence
  Synthetic
aagtgccatgttcaggagtaatgacagcgatatatttgcccgcaccaggtgagctacaattgtctctagggaatc

SEQ ID NO: 310537 - DNA, 75 bp, Artificial Sequence
  Synthetic
gttatgactgaaggagacatccgattccagttcacattaggtgggagaattgttgccacagtagatcgtactggg

SEQ ID NO: 310538 - DNA, 75 bp, Artificial Sequence
  Synthetic
gaatgctaataaacaagcaaataacaatgccaattttaataaatggcctgctggtactgcacagagacaaccaac

SEQ ID NO: 310539 - DNA, 75 bp, Artificial Sequence
  Synthetic
gaatgctaataaacaagcaaataacaatgccaattttaataattggcctgctggtactgcacagagacaaccaac

SEQ ID NO: 310540 - DNA, 75 bp, Artificial Sequence
  Synthetic
gaatgctaataaacaagcaaataacaatgccaattttaataactggcctgctggtactgcacagagacaaccaac

SEQ ID NO: 310541 - DNA, 75 bp, Artificial Sequence
  Synthetic
gaatgctaataaacaagcaaataacaatgccaattttaataagtggcctgctggtactgcacagagacaaccaac

SEQ ID NO: 310542 - DNA, 75 bp, Artificial Sequence
  Synthetic
tgtttcacttatgattaccataccatcagctgtttctcttactgattatgataccaattcgccatacctcgctaa

SEQ ID NO: 310543 - DNA, 75 bp, Artificial Sequence
  Synthetic
gccaacttatctaatgggtacagtgtttagctcagcttcatttgttaatacaccaccaaacgttctttggactat

SEQ ID NO: 310544 - DNA, 75 bp, Artificial Sequence
  Synthetic
caccaccaaacgttctttggactatgaattcattactatcaaaggcgccaccacaattagttcattggtccagaa

SEQ ID NO: 310545 - DNA, 75 bp, Artificial Sequence
  Synthetic
tcgaaatttatcaccaaatacaaatatttatcaggatggacaaacaactattaatgattacaatgctgttgcttc

SEQ ID NO: 310546 - DNA, 75 bp, Artificial Sequence
  Synthetic
ctacgtgatccaattgctcaactttcacctttccaggtgcatatgccgattgttccattggcaactgtgttatct

SEQ ID NO: 310547 - DNA, 75 bp, Artificial Sequence
  Synthetic
tttagctgctgctgtgcgcacagaaggctcaagacagaacagagctgttgtcacgaaatcagttgaaccagaagt

SEQ ID NO: 310548 - DNA, 75 bp, Artificial Sequence
  Synthetic
atcaaatcacaggtatcaaaaaatccattagcaaatatgctccaagttgatacagcaaaaatggaacaacagatt

SEQ ID NO: 310549 - DNA, 75 bp, Artificial Sequence
  Synthetic
aggtggagcaacgaataacactggtggaggatatcacgcacttgttggaagagctactggaaagatggctgtcgt

SEQ ID NO: 310550 - DNA, 75 bp, Artificial Sequence
  Synthetic
aaccgcagtgcaaggaagaccaggaggaatcaattttgcacttgacatgaaagtaccatgttcaggggtaatgac

SEQ ID NO: 310551 - DNA, 75 bp, Artificial Sequence
  Synthetic
aagtaccatgttcaggggtaatgacagccatatatttacctgcaccgggtgagttacaattgtctctagggaacc

SEQ ID NO: 310552 - DNA, 75 bp, Artificial Sequence
  Synthetic
gttatgactgaaggagacatccgatttcagttcacattaggtgggagaattgttgccacagtagatcgtactggg

SEQ ID NO: 310553 - DNA, 75 bp, Artificial Sequence
  Synthetic
accttcaatttcccgctatgtgacagagttaatataatgattgaaccatggaacgctaataaacaagcaaataac

SEQ ID NO: 310554 - DNA, 75 bp, Artificial Sequence
  Synthetic
aatgccaattttaataattggcctgctggtactgcacagagacaaccaactgtttcactcatgattactatacca

SEQ ID NO: 310555 - DNA, 75 bp, Artificial Sequence
  Synthetic
ctggtactgcacagagacaaccaactgtttcactcatgattactataccatccgccgtttctcttactgattatg

SEQ ID NO: 310556 - DNA, 75 bp, Artificial Sequence
  Synthetic
tgtttcactcatgattactataccatccgccgtttctcttactgattatgataccaattcaccataccttgcaaa

SEQ ID NO: 310557 - DNA, 75 bp, Artificial Sequence
  Synthetic
ataccaattcaccataccttgcaaagccaacttatctaatgggcacagtgtttaattcagcttcatttgttaaca

SEQ ID NO: 310558 - DNA, 75 bp, Artificial Sequence
  Synthetic
gccaacttatctaatgggcacagtgtttaattcagcttcatttgttaacacaccaccaaacgttctttggactat

SEQ ID NO: 310559 - DNA, 75 bp, Artificial Sequence
  Synthetic
atggatctcatcgaaacgattaatgcagttgttgaactgcaagaaagagttcgaaatttatcaccaaatacaaac

SEQ ID NO: 310560 - DNA, 75 bp, Artificial Sequence
  Synthetic
atttatcaggatggacaaacaactattaatgattacaatgctgttgcttctagaacgaatggtaaattatataat

SEQ ID NO: 310561 - DNA, 75 bp, Artificial Sequence
  Synthetic
tagaacgaatggtaaattatataatctacgtgatccaattgctcaactttcaccttttcaagtacatatgccaat

SEQ ID NO: 310562 - DNA, 75 bp, Artificial Sequence
  Synthetic
tagaacgaatggtaaattatataatctacgtgatccaattgctcaactttcaccttttcaagttcatatgccaat

SEQ ID NO: 310563 - DNA, 75 bp, Artificial Sequence
  Synthetic
tagaacgaatggtaaattatataatctacgtgatccaattgctcaactttcaccttttcaagtccatatgccaat

SEQ ID NO: 310564 - DNA, 75 bp, Artificial Sequence
  Synthetic
tagaacgaatggtaaattatataatctacgtgatccaattgctcaactttcaccttttcaagtgcatatgccaat

SEQ ID NO: 310565 - DNA, 75 bp, Artificial Sequence
  Synthetic
actgatgatcatgagtccatggttgcagggattgaatctctatttgatgctttagctgctgctgtgcgtacagaa

SEQ ID NO: 310566 - DNA, 75 bp, Artificial Sequence
  Synthetic
cagggattgaatctctatttgatgctttagctgctgctgtgcgtacagaaggctcaagacagaacagagccgttg

SEQ ID NO: 310567 - DNA, 75 bp, Artificial Sequence
  Synthetic
actaagattagtgcttgacattggaatcaaatcacaggtatcaaaaaatccattagcaaatatgctccaagttga

SEQ ID NO: 310568 - DNA, 75 bp, Artificial Sequence
  Synthetic
atttgagagtaaatctacttgcaccaggtggagcaacgaataacactggtggaggatatcacgcacttgttggaa

SEQ ID NO: 310569 - DNA, 75 bp, Artificial Sequence
  Synthetic
ggaggatatcacgcacttgttggaagagctactggaaagatggctgtcgtaactgcagttcaaggaagacccgga

SEQ ID NO: 310570 - DNA, 75 bp, Artificial Sequence
  Synthetic
gagctactggaaagatggctgtcgtaactgcagttcaaggaagacccggaggaatcaattttgcacttgacatga

SEQ ID NO: 310571 - DNA, 75 bp, Artificial Sequence
  Synthetic
ggaatcaattttgcacttgacatgaaagtaccatgttcaggagtaatgacagccatatatttacctgcaccaggt

SEQ ID NO: 310572 - DNA, 75 bp, Artificial Sequence
  Synthetic
agcctccaaataatatacctgtccacgctcaatgtgttgatgtatcaacagttatgactgaaggagacatccgat

SEQ ID NO: 310573 - DNA, 75 bp, Artificial Sequence
  Synthetic
cgctcaatgtgttgatgtatcaacagttatgactgaaggagacatccgatttcagttcacattaggtgggagaat

SEQ ID NO: 310574 - DNA, 75 bp, Artificial Sequence
  Synthetic
tgttgccacagtagatcgtactgggactttcaatttcccgctatgtgacagagttaatataatgattgagccatg

SEQ ID NO: 310575 - DNA, 75 bp, Artificial Sequence
  Synthetic
actttcaatttcccgctatgtgacagagttaatataatgattgagccatggaacgctaataaacaggcaaataac

SEQ ID NO: 310576 - DNA, 75 bp, Artificial Sequence
  Synthetic
tctgccgtttctcttactgattatgataccaattcaccataccttgcaaagccaacttatctaatgggcacagtg

SEQ ID NO: 310577 - DNA, 75 bp, Artificial Sequence
  Synthetic
gaattcactattatcaaaagcgccaccacaattagttcattggtccagaaaaattgcatgtttaattgcagccta

SEQ ID NO: 310578 - DNA, 75 bp, Artificial Sequence
  Synthetic
tgttccattagcaactgtattatctactgatgatcatgagtccatggttgcaggaattgaatctctatttgatgc

SEQ ID NO: 310579 - DNA, 75 bp, Artificial Sequence
  Synthetic
tttagctgctgctgtgcgtacagaaggctcaagacagaacagagctgttgttacgaaatcagttgaaccagaagt

SEQ ID NO: 310580 - DNA, 75 bp, Artificial Sequence
  Synthetic
actaagattagtgcttgacattgggatcaaatcacaggtatcaaaaaatccattagcaaatatgctccaagttga

SEQ ID NO: 310581 - DNA, 75 bp, Artificial Sequence
  Synthetic
atcaaatcacaggtatcaaaaaatccattagcaaatatgctccaagttgatacagcaaaaatggaacagcaaatc

SEQ ID NO: 310582 - DNA, 75 bp, Artificial Sequence
  Synthetic
cattagcaaatatgctccaagttgatacagcaaaaatggaacagcaaatcgagccagctgatgacccatttgcaa

SEQ ID NO: 310583 - DNA, 75 bp, Artificial Sequence
  Synthetic
gttatgactgaaggagacatccgatttcaatttacattaggtgggagaattgttgccacagtagatcgtactggg

SEQ ID NO: 310584 - DNA, 75 bp, Artificial Sequence
  Synthetic
gagttaacataatgattgagccatggaacgctaataaacaggcaaataacaatgccaattttaataattggcccg

SEQ ID NO: 310585 - DNA, 75 bp, Artificial Sequence
  Synthetic
tccgccgtttctcttactgattatgataccaattcaccataccttgcaaagcctacttatctaatgggcacagtg

SEQ ID NO: 310586 - DNA, 75 bp, Artificial Sequence
  Synthetic
ataccaattcaccataccttgcaaagcctacttatctaatgggcacagtgtttaattcagcttcatttgttaaca

SEQ ID NO: 310587 - DNA, 75 bp, Artificial Sequence
  Synthetic
tttaattcagcttcatttgttaacacaccaccaaacgttctttggactatgaattcactactatcaaaagcgcca

SEQ ID NO: 310588 - DNA, 75 bp, Artificial Sequence
  Synthetic
caccaccaaacgttctttggactatgaattcactactatcaaaagcgccaccacaattagttcattggtccagga

SEQ ID NO: 310589 - DNA, 75 bp, Artificial Sequence
  Synthetic
aaattgcatgtttaattgcagcatattcatgcaaaatctaagatgagatctggtcacgcactgggatccagtgtt

SEQ ID NO: 310590 - DNA, 75 bp, Artificial Sequence
  Synthetic
aaattgcatgtttaattgcagcttattcatgcaaaatctaagatgagatctggtcacgcactgggatccagtgtt

SEQ ID NO: 310591 - DNA, 75 bp, Artificial Sequence
  Synthetic
aaattgcatgtttaattgcagcctattcatgcaaaatctaagatgagatctggtcacgcactgggatccagtgtt

SEQ ID NO: 310592 - DNA, 75 bp, Artificial Sequence
  Synthetic
aaattgcatgtttaattgcagcgtattcatgcaaaatctaagatgagatctggtcacgcactgggatccagtgtt

SEQ ID NO: 310593 - DNA, 75 bp, Artificial Sequence
  Synthetic
ctacgtgatccgattgctcaactttcacctttccaggtgcatatgccaatcgttccattagcaactgtattatct

SEQ ID NO: 310594 - DNA, 75 bp, Artificial Sequence
  Synthetic
gagccagctgatgacccatttgcaaatttgagagtaaatctacttgcaccaggtggagcaacgaataacactggt

SEQ ID NO: 310595 - DNA, 75 bp, Artificial Sequence
  Synthetic
ggaggatatcatgcactcgttggaagagctactgggaagatggctgtcgtaactgcagttcaaggaagacccgga

SEQ ID NO: 310596 - DNA, 75 bp, Artificial Sequence
  Synthetic
agcctccaaataacatacctgttcacgcccaatgtgttgatgtatcaacagtaatgactgaaggagacatccgat

SEQ ID NO: 310597 - DNA, 75 bp, Artificial Sequence
  Synthetic
ttcagtttactttaggtgggagaattgtcgctacagtagatcgaactgggactttcaatttcccgctatgtgaca

SEQ ID NO: 310598 - DNA, 75 bp, Artificial Sequence
  Synthetic
actttcaatttcccgctatgtgacagagttaatataatgattgagccatggaacgccaataaacaggcaaacaac

SEQ ID NO: 310599 - DNA, 75 bp, Artificial Sequence
  Synthetic
aaattgcatgtttaattgcagcctattcgtgcaaaatctaagatgggatctggtcacgcactgggatccagtgtt

SEQ ID NO: 310600 - DNA, 75 bp, Artificial Sequence
  Synthetic
tcgaaatctatcaccaaatacaaatatctatcaggatggacaaacaactatcaatgattacaacgctgttgcttc

SEQ ID NO: 310601 - DNA, 75 bp, Artificial Sequence
  Synthetic
tgttccattggcaactgtattatctacagatgaccatgagtccatggttgcaggaattgaatctctatttgacgc

SEQ ID NO: 310602 - DNA, 75 bp, Artificial Sequence
  Synthetic
actaagattagtgcttgacattggaattaagtcacaagtttcaaaaaatccattagcaaatatgcttcaagttga

SEQ ID NO: 310603 - DNA, 75 bp, Artificial Sequence
  Synthetic
tacagcaaaaatggaacagcagattgagccagctgatgacccattcgcaaatttgagagtaaatctacttgcacc

SEQ ID NO: 310604 - DNA, 75 bp, Artificial Sequence
  Synthetic
aggtggagcaacaaataacactggtggaggatatcacgcacttgttgggagagctactggaaaaatggctgtcgt

SEQ ID NO: 310605 - DNA, 75 bp, Artificial Sequence
  Synthetic
aactgcagttcaaggtagaccaggaggaatcaattttgcacttgacatgaaagtaccatgctcaggagtaatgac

SEQ ID NO: 310606 - DNA, 75 bp, Artificial Sequence
  Synthetic
aagtaccatgctcaggagtaatgacagctatatatttacctgcaccaggcgagctacaattgtctttagggaatc

SEQ ID NO: 310607 - DNA, 75 bp, Artificial Sequence
  Synthetic
agcctccaaataatatacctgtccatgctcaatgtgttgatgtatcaacagttatgactgaaggagacatccgat

SEQ ID NO: 310608 - DNA, 75 bp, Artificial Sequence
  Synthetic
gttatgactgaaggagacatccgatttcagtttacattaggtggaagaattgtagctacagtagatcgtactggg

SEQ ID NO: 310609 - DNA, 75 bp, Artificial Sequence
  Synthetic
aatgctaattttaataattggcctgcaggtactgcacagagacaaccaactgtttctctcatgattactatacca

SEQ ID NO: 310610 - DNA, 75 bp, Artificial Sequence
  Synthetic
ttaacgattacaatgctgttgcttccagaacgaatggtaaattatatcatctacgtgatccaatcgctcaacttt

SEQ ID NO: 310611 - DNA, 75 bp, Artificial Sequence
  Synthetic
cacccttccaggtgcatatgccaattgttccattagcaactgtgctatccacagatgaacatgaatccatggttg

SEQ ID NO: 310612 - DNA, 75 bp, Artificial Sequence
  Synthetic
cacccttccaggtgcatatgccaattgttccattagcaactgtgctatccacagatgaacatgattccatggttg

SEQ ID NO: 310613 - DNA, 75 bp, Artificial Sequence
  Synthetic
cacccttccaggtgcatatgccaattgttccattagcaactgtgctatccacagatgaacatgactccatggttg

SEQ ID NO: 310614 - DNA, 75 bp, Artificial Sequence
  Synthetic
cacccttccaggtgcatatgccaattgttccattagcaactgtgctatccacagatgaacatgagtccatggttg

SEQ ID NO: 310615 - DNA, 75 bp, Artificial Sequence
  Synthetic
cacccttccaggtgcatatgccaattgttccattagcaactgtgctatccacagatgatcatgaatccatggttg

SEQ ID NO: 310616 - DNA, 75 bp, Artificial Sequence
  Synthetic
cacccttccaggtgcatatgccaattgttccattagcaactgtgctatccacagatgatcatgattccatggttg

SEQ ID NO: 310617 - DNA, 75 bp, Artificial Sequence
  Synthetic
cacccttccaggtgcatatgccaattgttccattagcaactgtgctatccacagatgatcatgactccatggttg

SEQ ID NO: 310618 - DNA, 75 bp, Artificial Sequence
  Synthetic
cacccttccaggtgcatatgccaattgttccattagcaactgtgctatccacagatgatcatgagtccatggttg

SEQ ID NO: 310619 - DNA, 75 bp, Artificial Sequence
  Synthetic
cacccttccaggtgcatatgccaattgttccattagcaactgtgctatccacagatgaccatgaatccatggttg

SEQ ID NO: 310620 - DNA, 75 bp, Artificial Sequence
  Synthetic
cacccttccaggtgcatatgccaattgttccattagcaactgtgctatccacagatgaccatgattccatggttg

SEQ ID NO: 310621 - DNA, 75 bp, Artificial Sequence
  Synthetic
cacccttccaggtgcatatgccaattgttccattagcaactgtgctatccacagatgaccatgactccatggttg

SEQ ID NO: 310622 - DNA, 75 bp, Artificial Sequence
  Synthetic
cacccttccaggtgcatatgccaattgttccattagcaactgtgctatccacagatgaccatgagtccatggttg

SEQ ID NO: 310623 - DNA, 75 bp, Artificial Sequence
  Synthetic
cacccttccaggtgcatatgccaattgttccattagcaactgtgctatccacagatgagcatgaatccatggttg

SEQ ID NO: 310624 - DNA, 75 bp, Artificial Sequence
  Synthetic
cacccttccaggtgcatatgccaattgttccattagcaactgtgctatccacagatgagcatgattccatggttg

SEQ ID NO: 310625 - DNA, 75 bp, Artificial Sequence
  Synthetic
cacccttccaggtgcatatgccaattgttccattagcaactgtgctatccacagatgagcatgactccatggttg

SEQ ID NO: 310626 - DNA, 75 bp, Artificial Sequence
  Synthetic
cacccttccaggtgcatatgccaattgttccattagcaactgtgctatccacagatgagcatgagtccatggttg

SEQ ID NO: 310627 - DNA, 75 bp, Artificial Sequence
  Synthetic
ctcccttccaggtgcatatgccaattgttccattagcaactgtgctatccacagatgaacatgaatccatggttg

SEQ ID NO: 310628 - DNA, 75 bp, Artificial Sequence
  Synthetic
ctcccttccaggtgcatatgccaattgttccattagcaactgtgctatccacagatgaacatgattccatggttg

SEQ ID NO: 310629 - DNA, 75 bp, Artificial Sequence
  Synthetic
ctcccttccaggtgcatatgccaattgttccattagcaactgtgctatccacagatgaacatgactccatggttg

SEQ ID NO: 310630 - DNA, 75 bp, Artificial Sequence
  Synthetic
ctcccttccaggtgcatatgccaattgttccattagcaactgtgctatccacagatgaacatgagtccatggttg

SEQ ID NO: 310631 - DNA, 75 bp, Artificial Sequence
  Synthetic
ctcccttccaggtgcatatgccaattgttccattagcaactgtgctatccacagatgatcatgaatccatggttg

SEQ ID NO: 310632 - DNA, 75 bp, Artificial Sequence
  Synthetic
ctcccttccaggtgcatatgccaattgttccattagcaactgtgctatccacagatgatcatgattccatggttg

SEQ ID NO: 310633 - DNA, 75 bp, Artificial Sequence
  Synthetic
ctcccttccaggtgcatatgccaattgttccattagcaactgtgctatccacagatgatcatgactccatggttg

SEQ ID NO: 310634 - DNA, 75 bp, Artificial Sequence
  Synthetic
ctcccttccaggtgcatatgccaattgttccattagcaactgtgctatccacagatgatcatgagtccatggttg

SEQ ID NO: 310635 - DNA, 75 bp, Artificial Sequence
  Synthetic
ctcccttccaggtgcatatgccaattgttccattagcaactgtgctatccacagatgaccatgaatccatggttg

SEQ ID NO: 310636 - DNA, 75 bp, Artificial Sequence
  Synthetic
ctcccttccaggtgcatatgccaattgttccattagcaactgtgctatccacagatgaccatgattccatggttg

SEQ ID NO: 310637 - DNA, 75 bp, Artificial Sequence
  Synthetic
ctcccttccaggtgcatatgccaattgttccattagcaactgtgctatccacagatgaccatgactccatggttg

SEQ ID NO: 310638 - DNA, 75 bp, Artificial Sequence
  Synthetic
ctcccttccaggtgcatatgccaattgttccattagcaactgtgctatccacagatgaccatgagtccatggttg

SEQ ID NO: 310639 - DNA, 75 bp, Artificial Sequence
  Synthetic
ctcccttccaggtgcatatgccaattgttccattagcaactgtgctatccacagatgagcatgaatccatggttg

SEQ ID NO: 310640 - DNA, 75 bp, Artificial Sequence
  Synthetic
ctcccttccaggtgcatatgccaattgttccattagcaactgtgctatccacagatgagcatgattccatggttg

SEQ ID NO: 310641 - DNA, 75 bp, Artificial Sequence
  Synthetic
ctcccttccaggtgcatatgccaattgttccattagcaactgtgctatccacagatgagcatgactccatggttg

SEQ ID NO: 310642 - DNA, 75 bp, Artificial Sequence
  Synthetic
ctcccttccaggtgcatatgccaattgttccattagcaactgtgctatccacagatgagcatgagtccatggttg

SEQ ID NO: 310643 - DNA, 75 bp, Artificial Sequence
  Synthetic
cccccttccaggtgcatatgccaattgttccattagcaactgtgctatccacagatgaacatgaatccatggttg

SEQ ID NO: 310644 - DNA, 75 bp, Artificial Sequence
  Synthetic
cccccttccaggtgcatatgccaattgttccattagcaactgtgctatccacagatgaacatgattccatggttg

SEQ ID NO: 310645 - DNA, 75 bp, Artificial Sequence
  Synthetic
cccccttccaggtgcatatgccaattgttccattagcaactgtgctatccacagatgaacatgactccatggttg

SEQ ID NO: 310646 - DNA, 75 bp, Artificial Sequence
  Synthetic
cccccttccaggtgcatatgccaattgttccattagcaactgtgctatccacagatgaacatgagtccatggttg

SEQ ID NO: 310647 - DNA, 75 bp, Artificial Sequence
  Synthetic
cccccttccaggtgcatatgccaattgttccattagcaactgtgctatccacagatgatcatgaatccatggttg

SEQ ID NO: 310648 - DNA, 75 bp, Artificial Sequence
  Synthetic
cccccttccaggtgcatatgccaattgttccattagcaactgtgctatccacagatgatcatgattccatggttg

SEQ ID NO: 310649 - DNA, 75 bp, Artificial Sequence
  Synthetic
cccccttccaggtgcatatgccaattgttccattagcaactgtgctatccacagatgatcatgactccatggttg

SEQ ID NO: 310650 - DNA, 75 bp, Artificial Sequence
  Synthetic
cccccttccaggtgcatatgccaattgttccattagcaactgtgctatccacagatgatcatgagtccatggttg

SEQ ID NO: 310651 - DNA, 75 bp, Artificial Sequence
  Synthetic
cccccttccaggtgcatatgccaattgttccattagcaactgtgctatccacagatgaccatgaatccatggttg

SEQ ID NO: 310652 - DNA, 75 bp, Artificial Sequence
  Synthetic
cccccttccaggtgcatatgccaattgttccattagcaactgtgctatccacagatgaccatgattccatggttg

SEQ ID NO: 310653 - DNA, 75 bp, Artificial Sequence
  Synthetic
cccccttccaggtgcatatgccaattgttccattagcaactgtgctatccacagatgaccatgactccatggttg

SEQ ID NO: 310654 - DNA, 75 bp, Artificial Sequence
  Synthetic
cccccttccaggtgcatatgccaattgttccattagcaactgtgctatccacagatgaccatgagtccatggttg

SEQ ID NO: 310655 - DNA, 75 bp, Artificial Sequence
  Synthetic
cccccttccaggtgcatatgccaattgttccattagcaactgtgctatccacagatgagcatgaatccatggttg

SEQ ID NO: 310656 - DNA, 75 bp, Artificial Sequence
  Synthetic
cccccttccaggtgcatatgccaattgttccattagcaactgtgctatccacagatgagcatgattccatggttg

SEQ ID NO: 310657 - DNA, 75 bp, Artificial Sequence
  Synthetic
cccccttccaggtgcatatgccaattgttccattagcaactgtgctatccacagatgagcatgactccatggttg

SEQ ID NO: 310658 - DNA, 75 bp, Artificial Sequence
  Synthetic
cccccttccaggtgcatatgccaattgttccattagcaactgtgctatccacagatgagcatgagtccatggttg

SEQ ID NO: 310659 - DNA, 75 bp, Artificial Sequence
  Synthetic
cgcccttccaggtgcatatgccaattgttccattagcaactgtgctatccacagatgaacatgaatccatggttg

SEQ ID NO: 310660 - DNA, 75 bp, Artificial Sequence
  Synthetic
cgcccttccaggtgcatatgccaattgttccattagcaactgtgctatccacagatgaacatgattccatggttg

SEQ ID NO: 310661 - DNA, 75 bp, Artificial Sequence
  Synthetic
cgcccttccaggtgcatatgccaattgttccattagcaactgtgctatccacagatgaacatgactccatggttg

SEQ ID NO: 310662 - DNA, 75 bp, Artificial Sequence
  Synthetic
cgcccttccaggtgcatatgccaattgttccattagcaactgtgctatccacagatgaacatgagtccatggttg

SEQ ID NO: 310663 - DNA, 75 bp, Artificial Sequence
  Synthetic
cgcccttccaggtgcatatgccaattgttccattagcaactgtgctatccacagatgatcatgaatccatggttg

SEQ ID NO: 310664 - DNA, 75 bp, Artificial Sequence
  Synthetic
cgcccttccaggtgcatatgccaattgttccattagcaactgtgctatccacagatgatcatgattccatggttg

SEQ ID NO: 310665 - DNA, 75 bp, Artificial Sequence
  Synthetic
cgcccttccaggtgcatatgccaattgttccattagcaactgtgctatccacagatgatcatgactccatggttg

SEQ ID NO: 310666 - DNA, 75 bp, Artificial Sequence
  Synthetic
cgcccttccaggtgcatatgccaattgttccattagcaactgtgctatccacagatgatcatgagtccatggttg

SEQ ID NO: 310667 - DNA, 75 bp, Artificial Sequence
  Synthetic
cgcccttccaggtgcatatgccaattgttccattagcaactgtgctatccacagatgaccatgaatccatggttg

SEQ ID NO: 310668 - DNA, 75 bp, Artificial Sequence
  Synthetic
cgcccttccaggtgcatatgccaattgttccattagcaactgtgctatccacagatgaccatgattccatggttg

SEQ ID NO: 310669 - DNA, 75 bp, Artificial Sequence
  Synthetic
cgcccttccaggtgcatatgccaattgttccattagcaactgtgctatccacagatgaccatgactccatggttg

SEQ ID NO: 310670 - DNA, 75 bp, Artificial Sequence
  Synthetic
cgcccttccaggtgcatatgccaattgttccattagcaactgtgctatccacagatgaccatgagtccatggttg

SEQ ID NO: 310671 - DNA, 75 bp, Artificial Sequence
  Synthetic
cgcccttccaggtgcatatgccaattgttccattagcaactgtgctatccacagatgagcatgaatccatggttg

SEQ ID NO: 310672 - DNA, 75 bp, Artificial Sequence
  Synthetic
cgcccttccaggtgcatatgccaattgttccattagcaactgtgctatccacagatgagcatgattccatggttg

SEQ ID NO: 310673 - DNA, 75 bp, Artificial Sequence
  Synthetic
cgcccttccaggtgcatatgccaattgttccattagcaactgtgctatccacagatgagcatgactccatggttg

SEQ ID NO: 310674 - DNA, 75 bp, Artificial Sequence
  Synthetic
cgcccttccaggtgcatatgccaattgttccattagcaactgtgctatccacagatgagcatgagtccatggttg

SEQ ID NO: 310675 - DNA, 75 bp, Artificial Sequence
  Synthetic
caggaattgaatctctatttgatgctttagcagcagctgtgcgtacagaaggatcaaggcagaacagagctgtcg

SEQ ID NO: 310676 - DNA, 75 bp, Artificial Sequence
  Synthetic
caggaattgaatctctatttgatgctttagcagcagctgtgcgtacagaaggttcaaggcagaacagagctgtcg

SEQ ID NO: 310677 - DNA, 75 bp, Artificial Sequence
  Synthetic
caggaattgaatctctatttgatgctttagcagcagctgtgcgtacagaaggctcaaggcagaacagagctgtcg

SEQ ID NO: 310678 - DNA, 75 bp, Artificial Sequence
  Synthetic
caggaattgaatctctatttgatgctttagcagcagctgtgcgtacagaagggtcaaggcagaacagagctgtcg

SEQ ID NO: 310679 - DNA, 75 bp, Artificial Sequence
  Synthetic
caggaattgaatctctatttgatgctttagcagctgctgtgcgtacagaaggatcaaggcagaacagagctgtcg

SEQ ID NO: 310680 - DNA, 75 bp, Artificial Sequence
  Synthetic
caggaattgaatctctatttgatgctttagcagctgctgtgcgtacagaaggttcaaggcagaacagagctgtcg

SEQ ID NO: 310681 - DNA, 75 bp, Artificial Sequence
  Synthetic
caggaattgaatctctatttgatgctttagcagctgctgtgcgtacagaaggctcaaggcagaacagagctgtcg

SEQ ID NO: 310682 - DNA, 75 bp, Artificial Sequence
  Synthetic
caggaattgaatctctatttgatgctttagcagctgctgtgcgtacagaagggtcaaggcagaacagagctgtcg

SEQ ID NO: 310683 - DNA, 75 bp, Artificial Sequence
  Synthetic
caggaattgaatctctatttgatgctttagcagccgctgtgcgtacagaaggatcaaggcagaacagagctgtcg

SEQ ID NO: 310684 - DNA, 75 bp, Artificial Sequence
  Synthetic
caggaattgaatctctatttgatgctttagcagccgctgtgcgtacagaaggttcaaggcagaacagagctgtcg

SEQ ID NO: 310685 - DNA, 75 bp, Artificial Sequence
  Synthetic
caggaattgaatctctatttgatgctttagcagccgctgtgcgtacagaaggctcaaggcagaacagagctgtcg

SEQ ID NO: 310686 - DNA, 75 bp, Artificial Sequence
  Synthetic
caggaattgaatctctatttgatgctttagcagccgctgtgcgtacagaagggtcaaggcagaacagagctgtcg

SEQ ID NO: 310687 - DNA, 75 bp, Artificial Sequence
  Synthetic
caggaattgaatctctatttgatgctttagcagcggctgtgcgtacagaaggatcaaggcagaacagagctgtcg

SEQ ID NO: 310688 - DNA, 75 bp, Artificial Sequence
  Synthetic
caggaattgaatctctatttgatgctttagcagcggctgtgcgtacagaaggttcaaggcagaacagagctgtcg

SEQ ID NO: 310689 - DNA, 75 bp, Artificial Sequence
  Synthetic
caggaattgaatctctatttgatgctttagcagcggctgtgcgtacagaaggctcaaggcagaacagagctgtcg

SEQ ID NO: 310690 - DNA, 75 bp, Artificial Sequence
  Synthetic
caggaattgaatctctatttgatgctttagcagcggctgtgcgtacagaagggtcaaggcagaacagagctgtcg

SEQ ID NO: 310691 - DNA, 75 bp, Artificial Sequence
  Synthetic
ttacaaagtcagttgagccagaagtaatgaggttagtgcttgacattggaattaaatctcaggtgtcaaaaaaac

SEQ ID NO: 310692 - DNA, 75 bp, Artificial Sequence
  Synthetic
ttacaaagtcagttgagccagaagtaatgaggttagtgcttgacattggaattaaatctcaggtgtcaaaaaatc

SEQ ID NO: 310693 - DNA, 75 bp, Artificial Sequence
  Synthetic
ttacaaagtcagttgagccagaagtaatgaggttagtgcttgacattggaattaaatctcaggtgtcaaaaaacc

SEQ ID NO: 310694 - DNA, 75 bp, Artificial Sequence
  Synthetic
ttacaaagtcagttgagccagaagtaatgaggttagtgcttgacattggaattaaatctcaggtgtcaaaaaagc

SEQ ID NO: 310695 - DNA, 75 bp, Artificial Sequence
  Synthetic
ttacaaagtcagttgagccagaagtattgaggttagtgcttgacattggaattaaatctcaggtgtcaaaaaaac

SEQ ID NO: 310696 - DNA, 75 bp, Artificial Sequence
  Synthetic
ttacaaagtcagttgagccagaagtattgaggttagtgcttgacattggaattaaatctcaggtgtcaaaaaatc

SEQ ID NO: 310697 - DNA, 75 bp, Artificial Sequence
  Synthetic
ttacaaagtcagttgagccagaagtattgaggttagtgcttgacattggaattaaatctcaggtgtcaaaaaacc

SEQ ID NO: 310698 - DNA, 75 bp, Artificial Sequence
  Synthetic
ttacaaagtcagttgagccagaagtattgaggttagtgcttgacattggaattaaatctcaggtgtcaaaaaagc

SEQ ID NO: 310699 - DNA, 75 bp, Artificial Sequence
  Synthetic
ttacaaagtcagttgagccagaagtactgaggttagtgcttgacattggaattaaatctcaggtgtcaaaaaaac

SEQ ID NO: 310700 - DNA, 75 bp, Artificial Sequence
  Synthetic
ttacaaagtcagttgagccagaagtactgaggttagtgcttgacattggaattaaatctcaggtgtcaaaaaatc

SEQ ID NO: 310701 - DNA, 75 bp, Artificial Sequence
  Synthetic
ttacaaagtcagttgagccagaagtactgaggttagtgcttgacattggaattaaatctcaggtgtcaaaaaacc

SEQ ID NO: 310702 - DNA, 75 bp, Artificial Sequence
  Synthetic
ttacaaagtcagttgagccagaagtactgaggttagtgcttgacattggaattaaatctcaggtgtcaaaaaagc

SEQ ID NO: 310703 - DNA, 75 bp, Artificial Sequence
  Synthetic
ttacaaagtcagttgagccagaagtagtgaggttagtgcttgacattggaattaaatctcaggtgtcaaaaaaac

SEQ ID NO: 310704 - DNA, 75 bp, Artificial Sequence
  Synthetic
ttacaaagtcagttgagccagaagtagtgaggttagtgcttgacattggaattaaatctcaggtgtcaaaaaatc

SEQ ID NO: 310705 - DNA, 75 bp, Artificial Sequence
  Synthetic
ttacaaagtcagttgagccagaagtagtgaggttagtgcttgacattggaattaaatctcaggtgtcaaaaaacc

SEQ ID NO: 310706 - DNA, 75 bp, Artificial Sequence
  Synthetic
ttacaaagtcagttgagccagaagtagtgaggttagtgcttgacattggaattaaatctcaggtgtcaaaaaagc

SEQ ID NO: 310707 - DNA, 75 bp, Artificial Sequence
  Synthetic
cgttagcaaatatgcttcaagttgatacagcaaaaatggaacagcaagtcgagcctgctgatgatccatttgcaa

SEQ ID NO: 310708 - DNA, 75 bp, Artificial Sequence
  Synthetic
atttgagagttaatctactcgcaccaggtggagcaacaaataatactggaggaggatatcaagcactcgttggaa

SEQ ID NO: 310709 - DNA, 75 bp, Artificial Sequence
  Synthetic
atttgagagttaatctactcgcaccaggtggagcaacaaataatactggaggaggatatcatgcactcgttggaa

SEQ ID NO: 310710 - DNA, 75 bp, Artificial Sequence
  Synthetic
atttgagagttaatctactcgcaccaggtggagcaacaaataatactggaggaggatatcacgcactcgttggaa

SEQ ID NO: 310711 - DNA, 75 bp, Artificial Sequence
  Synthetic
atttgagagttaatctactcgcaccaggtggagcaacaaataatactggaggaggatatcaggcactcgttggaa

SEQ ID NO: 310712 - DNA, 75 bp, Artificial Sequence
  Synthetic
gagccactggaaaaatggctgtcgtgactgcagttcaaggtagacccggaagaatcaattttgcacttgacatga

SEQ ID NO: 310713 - DNA, 75 bp, Artificial Sequence
  Synthetic
gagccactggtaaaatggctgtcgtgactgcagttcaaggtagacccggaagaatcaattttgcacttgacatga

SEQ ID NO: 310714 - DNA, 75 bp, Artificial Sequence
  Synthetic
gagccactggcaaaatggctgtcgtgactgcagttcaaggtagacccggaagaatcaattttgcacttgacatga

SEQ ID NO: 310715 - DNA, 75 bp, Artificial Sequence
  Synthetic
gagccactgggaaaatggctgtcgtgactgcagttcaaggtagacccggaagaatcaattttgcacttgacatga

SEQ ID NO: 310716 - DNA, 75 bp, Artificial Sequence
  Synthetic
aagtaccatgttcaggagtaatgacagctatatatttacctgcaccaggtgagctacaattgtctctagggaatc

SEQ ID NO: 310717 - DNA, 75 bp, Artificial Sequence
  Synthetic
agccaccaaacaatatacctgtccacgctcaatgtgttgatgtatcaactgttatgactgaaggagacatccaat

SEQ ID NO: 310718 - DNA, 75 bp, Artificial Sequence
  Synthetic
agccaccaaacaatatacctgtccacgctcaatgtgttgatgtatcaactgttatgactgaaggagacatccatt

SEQ ID NO: 310719 - DNA, 75 bp, Artificial Sequence
  Synthetic
agccaccaaacaatatacctgtccacgctcaatgtgttgatgtatcaactgttatgactgaaggagacatccact

SEQ ID NO: 310720 - DNA, 75 bp, Artificial Sequence
  Synthetic
agccaccaaacaatatacctgtccacgctcaatgtgttgatgtatcaactgttatgactgaaggagacatccagt

SEQ ID NO: 310721 - DNA, 75 bp, Artificial Sequence
  Synthetic
agcctccaaacaatatacctgtccacgctcaatgtgttgatgtatcaactgttatgactgaaggagacatccaat

SEQ ID NO: 310722 - DNA, 75 bp, Artificial Sequence
  Synthetic
agcctccaaacaatatacctgtccacgctcaatgtgttgatgtatcaactgttatgactgaaggagacatccatt

SEQ ID NO: 310723 - DNA, 75 bp, Artificial Sequence
  Synthetic
agcctccaaacaatatacctgtccacgctcaatgtgttgatgtatcaactgttatgactgaaggagacatccact

SEQ ID NO: 310724 - DNA, 75 bp, Artificial Sequence
  Synthetic
agcctccaaacaatatacctgtccacgctcaatgtgttgatgtatcaactgttatgactgaaggagacatccagt

SEQ ID NO: 310725 - DNA, 75 bp, Artificial Sequence
  Synthetic
agcccccaaacaatatacctgtccacgctcaatgtgttgatgtatcaactgttatgactgaaggagacatccaat

SEQ ID NO: 310726 - DNA, 75 bp, Artificial Sequence
  Synthetic
agcccccaaacaatatacctgtccacgctcaatgtgttgatgtatcaactgttatgactgaaggagacatccatt

SEQ ID NO: 310727 - DNA, 75 bp, Artificial Sequence
  Synthetic
agcccccaaacaatatacctgtccacgctcaatgtgttgatgtatcaactgttatgactgaaggagacatccact

SEQ ID NO: 310728 - DNA, 75 bp, Artificial Sequence
  Synthetic
agcccccaaacaatatacctgtccacgctcaatgtgttgatgtatcaactgttatgactgaaggagacatccagt

SEQ ID NO: 310729 - DNA, 75 bp, Artificial Sequence
  Synthetic
agccgccaaacaatatacctgtccacgctcaatgtgttgatgtatcaactgttatgactgaaggagacatccaat

SEQ ID NO: 310730 - DNA, 75 bp, Artificial Sequence
  Synthetic
agccgccaaacaatatacctgtccacgctcaatgtgttgatgtatcaactgttatgactgaaggagacatccatt

SEQ ID NO: 310731 - DNA, 75 bp, Artificial Sequence
  Synthetic
agccgccaaacaatatacctgtccacgctcaatgtgttgatgtatcaactgttatgactgaaggagacatccact

SEQ ID NO: 310732 - DNA, 75 bp, Artificial Sequence
  Synthetic
agccgccaaacaatatacctgtccacgctcaatgtgttgatgtatcaactgttatgactgaaggagacatccagt

SEQ ID NO: 310733 - DNA, 75 bp, Artificial Sequence
  Synthetic
ttcagttcacattaggtggaagaattgttgctacagtagatcgtactggaacttttaatttcccgatatgtgaca

SEQ ID NO: 310734 - DNA, 75 bp, Artificial Sequence
  Synthetic
ttcagttcacattaggtggaagaattgttgctacagtagatcgtactggaacttttaatttcccgttatgtgaca

SEQ ID NO: 310735 - DNA, 75 bp, Artificial Sequence
  Synthetic
ttcagttcacattaggtggaagaattgttgctacagtagatcgtactggaacttttaatttcccgctatgtgaca

SEQ ID NO: 310736 - DNA, 75 bp, Artificial Sequence
  Synthetic
ttcagttcacattaggtggaagaattgttgctacagtagatcgtactggaacttttaatttcccggtatgtgaca

SEQ ID NO: 310737 - DNA, 75 bp, Artificial Sequence
  Synthetic
gagttaatataatgattgaaccatggaatgccaataaacaagcaaataacaatgccaattttaatgcttggcctg

SEQ ID NO: 310738 - DNA, 75 bp, Artificial Sequence
  Synthetic
ctggtactgcacagagacaaccaactgtttcacttatgattactataccatcagccgtttctcttactgattatg

SEQ ID NO: 310739 - DNA, 75 bp, Artificial Sequence
  Synthetic
atactaattcaccataccttgcaaagccaacttatctaatgggcacagtgtttagctcagcttcatttgtaaata

SEQ ID NO: 310740 - DNA, 75 bp, Artificial Sequence
  Synthetic
caccaccaaacgttctttggactatgaattcactactatcaaaggcgccaccacaatttgtccattggtcaagga

SEQ ID NO: 310741 - DNA, 75 bp, Artificial Sequence
  Synthetic
atggatctcatcgaaacgattaatgcagttgttgacctgcaagaaagagttcgaaatttatcaccaaacacaaac

SEQ ID NO: 310742 - DNA, 75 bp, Artificial Sequence
  Synthetic
atttatcaggatggacaaacaactattaatgattacaatgccgttgcttctagaacgaatggtaaattatataat

SEQ ID NO: 310743 - DNA, 75 bp, Artificial Sequence
  Synthetic
ctacgcgatccaattgctcagctttcacccttccaagtgcatatgccaatcgttccattagcaaccgtattatct

SEQ ID NO: 310744 - DNA, 75 bp, Artificial Sequence
  Synthetic
acagatgaccatgagtctatggttgcagggattgaatccctatttgatgctttagctgctgctgtgcgtacagaa

SEQ ID NO: 310745 - DNA, 75 bp, Artificial Sequence
  Synthetic
ggctcaagacagaatagagccgttgttacgaaatcagttgagccagaagtattaaggttagtgcttgacattgga

SEQ ID NO: 310746 - DNA, 75 bp, Artificial Sequence
  Synthetic
atcaaatcgcaggtatcaaaaaatccattagcaaatatgcttcaagttgacacagcaaaaatggaacagcagatc

SEQ ID NO: 310747 - DNA, 75 bp, Artificial Sequence
  Synthetic
ggaggatatcacgcgctcgttggaagagccactggaaagatggctgtcgtaactgcagttcaaggaagacccggt

SEQ ID NO: 310748 - DNA, 75 bp, Artificial Sequence
  Synthetic
agccatatatttacctgcaccaggtgagctgcagttgtctctgggaaatcagcctccaaataatatacctgtcca

SEQ ID NO: 310749 - DNA, 75 bp, Artificial Sequence
  Synthetic
cgctcaatgtgttgatgtatcaactgttatgactgaaggagatattcgatttcagttcacattaggcgggagaat

SEQ ID NO: 310750 - DNA, 75 bp, Artificial Sequence
  Synthetic
gttatgactgaaggagatattcgatttcagttcacattaggcgggagaatcgttgcaacagtagatcgtaccggg

SEQ ID NO: 310751 - DNA, 75 bp, Artificial Sequence
  Synthetic
gttatgactgaaggagatattcgatttcagttcacattaggcgggagaatcgttgctacagtagatcgtaccggg

SEQ ID NO: 310752 - DNA, 75 bp, Artificial Sequence
  Synthetic
gttatgactgaaggagatattcgatttcagttcacattaggcgggagaatcgttgccacagtagatcgtaccggg

SEQ ID NO: 310753 - DNA, 75 bp, Artificial Sequence
  Synthetic
gttatgactgaaggagatattcgatttcagttcacattaggcgggagaatcgttgcgacagtagatcgtaccggg

SEQ ID NO: 310754 - DNA, 75 bp, Artificial Sequence
  Synthetic
ataccaattcgccataccttgcaaagccaacttatctgatgggcacagtgtttagttcagcttcatttgttaaca

SEQ ID NO: 310755 - DNA, 75 bp, Artificial Sequence
  Synthetic
caccaccaaacgttctttggactatgaattcactactatcaaaagcgccaccacagttcgttcattggtccagaa

SEQ ID NO: 310756 - DNA, 75 bp, Artificial Sequence
  Synthetic
aaattgcatgtttaattgcagcctattcatgcaaaatctgagatgggatctggtcacgcactgggatccagtgtt

SEQ ID NO: 310757 - DNA, 75 bp, Artificial Sequence
  Synthetic
atggatctcatcgaaacgattaatgcagttgttgaactgcaagaaagagttcgaaatttatcaccaaatacaaat

SEQ ID NO: 310758 - DNA, 75 bp, Artificial Sequence
  Synthetic
caccttttcaggtgcatatgccaattgttccattagctactgtgttatctactgatgaccatgagtcaatggttg

SEQ ID NO: 310759 - DNA, 75 bp, Artificial Sequence
  Synthetic
ggctcaagacagaacagagctgttgttacgaaatcagttgaaccagaagtactaaggttagtgcttgacattgga

SEQ ID NO: 310760 - DNA, 75 bp, Artificial Sequence
  Synthetic
atcaaatcacaggtatcaaaaaatccattggcaaatatgctccaagttgatacagcaaaaatggagcaacaaatc

SEQ ID NO: 310761 - DNA, 75 bp, Artificial Sequence
  Synthetic
gaaccagctgatgacccatttgcaaatttgagagtaaatctacttgcaccaggtggagcaacgaataacactggt

SEQ ID NO: 310762 - DNA, 75 bp, Artificial Sequence
  Synthetic
agccatatatttacctgcaccaggtgaattacaattgtctctagggaatcagcctccgaataatatacctgtaca

SEQ ID NO: 310763 - DNA, 75 bp, Artificial Sequence
  Synthetic
actttcaattttccgctatgtgacagagttaatataatgattgagccatggaatgctaataaacaggcaaataac

SEQ ID NO: 310764 - DNA, 75 bp, Artificial Sequence
  Synthetic
atggatctcattgaaacgattaacgcagttgttgaactgcaagaaagagttcgaaatttatcaccaaatacaaat

SEQ ID NO: 310765 - DNA, 75 bp, Artificial Sequence
  Synthetic
ttaatgactacaatgctgttgcttctagaacaaatggtaaattatataatctacgtgatccaattgctcaactct

SEQ ID NO: 310766 - DNA, 75 bp, Artificial Sequence
  Synthetic
tgttccattagcgactgtattatctactgatgaccatgagtccatggttgcagggattgaatctctattcgatgc

SEQ ID NO: 310767 - DNA, 75 bp, Artificial Sequence
  Synthetic
ttacgaaatcagttgaaccagaagtactaaggttggtgcttgacattggaatcaaatcacaagtatcaaaaaatc

SEQ ID NO: 310768 - DNA, 75 bp, Artificial Sequence
  Synthetic
tacagcaaaaatggaacagcaaatcgagccagctgatgacccatttgcaaatttgagagtaaatctacttgcacc

SEQ ID NO: 310769 - DNA, 75 bp, Artificial Sequence
  Synthetic
gagttgcaattgtctctagggaatcagcctccaaataatatacctgttcacgctcaatgcgttgatgtatcaacg

SEQ ID NO: 310770 - DNA, 75 bp, Artificial Sequence
  Synthetic
actttcaatttcccgctatgtgacagagttaatataatgattgagccatggaacgctaataaacaggcaaataat

SEQ ID NO: 310771 - DNA, 75 bp, Artificial Sequence
  Synthetic
ctacgtgatccaattgctcaactttcaccttttcaggtgcatatgccaattgttccattagcaactgtattatct

SEQ ID NO: 310772 - DNA, 75 bp, Artificial Sequence
  Synthetic
aagtaccatgttcaggagtaatgacagccatatatttacctgcaccaggtgagttgcaattgtctctagggaatc

SEQ ID NO: 310773 - DNA, 75 bp, Artificial Sequence
  Synthetic
gagttgcaattgtctctagggaatcagcctccaaataatatacctgtccacgctcaatgtgttgatgtatcaaca

SEQ ID NO: 310774 - DNA, 75 bp, Artificial Sequence
  Synthetic
gagttaatataatgattgagccatggaacgctaataaacaggcaaataacaatgccaattttaataattggcctg

SEQ ID NO: 310775 - DNA, 75 bp, Artificial Sequence
  Synthetic
cagggattgaatctctatttgatgctttagctgctgctgtgcgtacagaaggctcaagacagaacagagctgttg

SEQ ID NO: 310776 - DNA, 75 bp, Artificial Sequence
  Synthetic
ggctcaagacagaacagagctgttgttacgaaatcagttgaaccagaagtactaagattagtgcttgacattgga

SEQ ID NO: 310777 - DNA, 75 bp, Artificial Sequence
  Synthetic
attaaatcacaagtatcaaaaaatccattagcaaatatgctccaagttgacacagcaaaaatggaacagcaaatc

SEQ ID NO: 310778 - DNA, 75 bp, Artificial Sequence
  Synthetic
cacagcaaaaatggaacagcaaatcgaaccggctgatgatccatttgcaaatttgagagtaaatttacttgcacc

SEQ ID NO: 310779 - DNA, 75 bp, Artificial Sequence
  Synthetic
ggaatcaattttgcacttgacatgaaagtaccgtgttcaggagtaatgacagccatatatttacctgcaccaggt

SEQ ID NO: 310780 - DNA, 75 bp, Artificial Sequence
  Synthetic
atttatcaggatggacaaacaactattaatgattataatgctgttgcttctagaacgaatggtaaattatataat

SEQ ID NO: 310781 - DNA, 75 bp, Artificial Sequence
  Synthetic
cattagcaaatatgctccaagttgatacagcaaaaatggaacagcagatcgagccggcagatgacccatttgcaa

SEQ ID NO: 310782 - DNA, 75 bp, Artificial Sequence
  Synthetic
ggaggatatcacgcacttgtcggaagagctactggaaagatggctgttgtaactgcagttcagggaagaccagga

SEQ ID NO: 310783 - DNA, 75 bp, Artificial Sequence
  Synthetic
gagttgcaattgtctctagggaatcagcctccaaataatatacctgtccatgctcaatgtgttgatgtatcaacg

SEQ ID NO: 310784 - DNA, 75 bp, Artificial Sequence
  Synthetic
actttcaatttcccgctatgtgacagagttaatataatgattgagccatggaacgctaacaaacaggcaaacaac

SEQ ID NO: 310785 - DNA, 75 bp, Artificial Sequence
  Synthetic
tccgccgtttctcttactgattatgataccaattcaccataccttgcaaagccaacttatctaatgggcacaata

SEQ ID NO: 310786 - DNA, 75 bp, Artificial Sequence
  Synthetic
aaattgcatgtttgattgcagcctattcatgcaaaatctaaggtgggatctggtcacgcactgggatccagtgtt

SEQ ID NO: 310787 - DNA, 75 bp, Artificial Sequence
  Synthetic
tgtttcactcatgattactataccatctgccgtttcccttactgattatgatactaattcaccataccttgcaaa

SEQ ID NO: 310788 - DNA, 75 bp, Artificial Sequence
  Synthetic
caccttttcaggtgcatatgccaattgttccattagcaactgtattatctactgatgaccatgagtccatggttg

SEQ ID NO: 310789 - DNA, 75 bp, Artificial Sequence
  Synthetic
actgatgaccatgagtccatggttgcagggattgaatctctatttgatgctttagctgctgctgtgcgtacagaa

SEQ ID NO: 310790 - DNA, 75 bp, Artificial Sequence
  Synthetic
ggctcaagacagaacagagccgttgttacaaaatcagttgagccagaagtactaaggttagtacttgacattgga

SEQ ID NO: 310791 - DNA, 75 bp, Artificial Sequence
  Synthetic
agccatatatttacctgcaccaggtgaattgcagttgtctctagggaatcagcccccaaataacatacctgtcca

SEQ ID NO: 310792 - DNA, 75 bp, Artificial Sequence
  Synthetic
gagttaatataatgattgagccatggaacgctaataaacaggcaaataacaatgcaaactttaataattggcctg

SEQ ID NO: 310793 - DNA, 75 bp, Artificial Sequence
  Synthetic
tttaattcagcttcatttgttaacacaccaccaaacgttctttggactatgaattcactactatcaaaagcacca

SEQ ID NO: 310794 - DNA, 75 bp, Artificial Sequence
  Synthetic
gttaagattagtgcttgacattggaatcaaatcacaggtgtcaaaaaacccattagcaaatatgcttcaagttga

SEQ ID NO: 310795 - DNA, 75 bp, Artificial Sequence
  Synthetic
tacagcaaaaatggaacagcaaatcgagccagctgatgacccatttgcaaatttaagagtaaatctgcttgcacc

SEQ ID NO: 310796 - DNA, 75 bp, Artificial Sequence
  Synthetic
atggatctcatcgaaacgattaatgcagttgttgaactgcaagaaagagttagaaatttgtcaccaaatacaaat

SEQ ID NO: 310797 - DNA, 75 bp, Artificial Sequence
  Synthetic
atttaccaggatggacaaacaactattaatgattacaatgccgttgcttctagaacgaatggtaaattgtacaac

SEQ ID NO: 310798 - DNA, 75 bp, Artificial Sequence
  Synthetic
ctacgtgatccaattgctcaactttcaccttttcaggtgcacatgccaattattccattagcaactgtattatct

SEQ ID NO: 310799 - DNA, 75 bp, Artificial Sequence
  Synthetic
acagatgatcatgagtcaatggttgcggggattgaatctctatttgacgctttagctgctgctgtgcgtacagaa

SEQ ID NO: 310800 - DNA, 75 bp, Artificial Sequence
  Synthetic
tttagctgctgctgtgcgtacagaaggctcgagacaaaacagagctgttgttacaaaatcagttgaaccagaagt

SEQ ID NO: 310801 - DNA, 75 bp, Artificial Sequence
  Synthetic
cattagcaaatatgctccaagttgatacagcaaaaatggaacaacaaatcgaaccagctgatgatccatttgcaa

SEQ ID NO: 310802 - DNA, 75 bp, Artificial Sequence
  Synthetic
gagctactggaaagatggctgtcataactgcagttcaaggaagaccaggagggatcaattttgcacttgacatga

SEQ ID NO: 310803 - DNA, 75 bp, Artificial Sequence
  Synthetic
aagtaccatgttcaggagtgatgacagccatatttttacctgcaccaggcgaattgcaattgtctctagggaatc

SEQ ID NO: 310804 - DNA, 75 bp, Artificial Sequence
  Synthetic
aatgccaatttcaacaattggcctgctggtactgcacagaggcaaccaactatttcactcatgattactatacca

SEQ ID NO: 310805 - DNA, 75 bp, Artificial Sequence
  Synthetic
tccgcagtttctctcactgattatgataccaattcaccataccttgcaaagccaacttatctgatgggcacagta

SEQ ID NO: 310806 - DNA, 75 bp, Artificial Sequence
  Synthetic
atggatctcatcgaaacgattaatgcagttgttgacctgcaagaaagagttcgaaatttatcaccaaatacgaac

SEQ ID NO: 310807 - DNA, 75 bp, Artificial Sequence
  Synthetic
tagaacgaatggtaagttatataatctacgtgatccaattgctcaactttcgccttttcaggtgcatatgccaat

SEQ ID NO: 310808 - DNA, 75 bp, Artificial Sequence
  Synthetic
tgctcaatgtgttgatgtatcaacagttatgactgaaggagacatccgatttcagtttacattaggtgggaggat

SEQ ID NO: 310809 - DNA, 75 bp, Artificial Sequence
  Synthetic
aatgctaattttaataattggcctgctggtactgcacaaagacaaccaactatttcactaatgattactatacca

SEQ ID NO: 310810 - DNA, 75 bp, Artificial Sequence
  Synthetic
actgatgaccatgaatccatggttgcaggaattgaatctctgtttgatgctttagctgccgctgtgcgtacggaa

SEQ ID NO: 310811 - DNA, 75 bp, Artificial Sequence
  Synthetic
cattagcaaatatgctccaagtcgacacagcaaaaatggagcagcagatcgaaccagccgatgacccattcgcaa

SEQ ID NO: 310812 - DNA, 75 bp, Artificial Sequence
  Synthetic
gagctactggaaagatggctgtcgtaactgcagttcaaggaagacccggagggatcaattttgcacttgatatga

SEQ ID NO: 310813 - DNA, 75 bp, Artificial Sequence
  Synthetic
aacgctaactttaataattggcctgctggtactgcacagagacaaccaactgtttcactcatgattactatacca

SEQ ID NO: 310814 - DNA, 75 bp, Artificial Sequence
  Synthetic
atttatcaggatggacaaacaactattaatgattacaatgctgttgcttccagaacgaatggtaaattgtacaat

SEQ ID NO: 310815 - DNA, 75 bp, Artificial Sequence
  Synthetic
acagatgaccatgagtccatggttgcagggattgaatctctctttgatgccttagcggctgctgtgcgtacggaa

SEQ ID NO: 310816 - DNA, 75 bp, Artificial Sequence
  Synthetic
ggttcaagacagaacagggctgttgttacgaagtcagttgaaccagaagtactaaggttagtgcttgacattgga

SEQ ID NO: 310817 - DNA, 75 bp, Artificial Sequence
  Synthetic
attaaatcacaggtatcaaaaaacccactagcgaatatgcttcaagttgatacagcaaaaatggaacagcaaatt

SEQ ID NO: 310818 - DNA, 75 bp, Artificial Sequence
  Synthetic
gagccagccgatgacccatttgcgaatttgagagttaatctacttgcaccaggtggggcaacaaataatactggt

SEQ ID NO: 310819 - DNA, 75 bp, Artificial Sequence
  Synthetic
ggaggataccatgcacttgttggaagagccactggaaaaatggctgtcgtaactgcggttcaaggtagaccagga

SEQ ID NO: 310820 - DNA, 75 bp, Artificial Sequence
  Synthetic
gagctgcaactgtctctagggaatcagcctccaaataacatacccgtccacgctcaatgtgttgatgtatcaact

SEQ ID NO: 310821 - DNA, 75 bp, Artificial Sequence
  Synthetic
gttatggctgaaggagacatccgatttcagttcacattaggtgggagaattgttgccacagtggatcgtactggg

SEQ ID NO: 310822 - DNA, 75 bp, Artificial Sequence
  Synthetic
actttcaatttcccgctatgtgatagagtcaacataatgattgagccatggaacgctaataaacaggcaaacaac

SEQ ID NO: 310823 - DNA, 75 bp, Artificial Sequence
  Synthetic
aatgccaattttaataattggcccgccggtactgcacagagacaaccaactgtttcactcatgattactatacca

SEQ ID NO: 310824 - DNA, 75 bp, Artificial Sequence
  Synthetic
tccgccgtttccctcaccgattatgataccaattcaccatatcttgctaagccaacttatctaatgggcacagtg

SEQ ID NO: 310825 - DNA, 75 bp, Artificial Sequence
  Synthetic
tttagctcagcttcgtttgttaacacaccaccaaacgttctttggactatgaattcactactgtcaaaagcgcca

SEQ ID NO: 310826 - DNA, 75 bp, Artificial Sequence
  Synthetic
caccaccaaacgttctttggactatgaattcactactgtcaaaagcgccaccacaattagtccattggtccagaa

SEQ ID NO: 310827 - DNA, 75 bp, Artificial Sequence
  Synthetic
aactgcagttcaaggaagacccggagggattaattttgcacttgaaatgaaagtaccatgttcaggagtaatgac

SEQ ID NO: 310828 - DNA, 75 bp, Artificial Sequence
  Synthetic
aactgcagttcaaggaagacccggagggattaattttgcacttgatatgaaagtaccatgttcaggagtaatgac

SEQ ID NO: 310829 - DNA, 75 bp, Artificial Sequence
  Synthetic
aactgcagttcaaggaagacccggagggattaattttgcacttgacatgaaagtaccatgttcaggagtaatgac

SEQ ID NO: 310830 - DNA, 75 bp, Artificial Sequence
  Synthetic
aactgcagttcaaggaagacccggagggattaattttgcacttgagatgaaagtaccatgttcaggagtaatgac

SEQ ID NO: 310831 - DNA, 75 bp, Artificial Sequence
  Synthetic
caccaccaaacgttctttggactatgaattcactactgtcaaaagcgccaccacagttcgttcattggtccagga

SEQ ID NO: 310832 - DNA, 75 bp, Artificial Sequence
  Synthetic
ggcacttaagcgctgcaagatggaagtgattgaaaagctcgagacaattagagaaacgttaaatgacacaaaaga

SEQ ID NO: 310833 - DNA, 75 bp, Artificial Sequence
  Synthetic
taaaaaagatttccaaaaaattcatgatgaactagttcaatatcttgacggtatagatccactgactatcgatga

SEQ ID NO: 310834 - DNA, 75 bp, Artificial Sequence
  Synthetic
tgataaatggaatgaaatccttaaactttttaaaattatcatagtaaagttaaaaaactcaacaatcaaaacgac

SEQ ID NO: 310835 - DNA, 75 bp, Artificial Sequence
  Synthetic
ttctcttgaaaatgagttaacccaacatgagaaaaaaagaacggttaaagaagtggaaaaagttgaagaagacat

SEQ ID NO: 310836 - DNA, 75 bp, Artificial Sequence
  Synthetic
gaaggtggatgtggcgaatgataatagcaaaccaactcttatggataaagtattacaggtgtcaagtcagccaaa

SEQ ID NO: 310837 - DNA, 75 bp, Artificial Sequence
  Synthetic
taatccatattctgctgatgtattacaaataagaacaattttatcaaaaactttgtttgttgatacggattctga

SEQ ID NO: 310838 - DNA, 75 bp, Artificial Sequence
  Synthetic
ggcatattcactatatgttccagaatctcagaaacttgatgtttcaccaattactattgaattaactacgattga

SEQ ID NO: 310839 - DNA, 75 bp, Artificial Sequence
  Synthetic
aaagtatcaaccaaaggttaatattctcaaacaagcagttatagtcccatcacaaaatccattgctagcagatac

SEQ ID NO: 310840 - DNA, 75 bp, Artificial Sequence
  Synthetic
ctatggtgcacctgagatacttttttctactgatttctttgatgatatcacttcaaattcttcagaaggattaca

SEQ ID NO: 310841 - DNA, 75 bp, Artificial Sequence
  Synthetic
attatatttctttgataaggcatacaaattaaaaaaagaattaccaaatctaccatttctttcatcattagataa

SEQ ID NO: 310842 - DNA, 75 bp, Artificial Sequence
  Synthetic
ggatgttaacccgcttaatccacttaattcagtatgtaaatcatttggacaagaaaagtattatgatatggtaat

SEQ ID NO: 310843 - DNA, 75 bp, Artificial Sequence
  Synthetic
ggatcgcaccgatagaggattagatgctagaagagcagcaatgcaatttgataatgttatcgttgatgcacaaaa

SEQ ID NO: 310844 - DNA, 75 bp, Artificial Sequence
  Synthetic
cagaaccgttcaatttaatgttagaatgcatccatttgatttacaattgctacgtatatctcaacagttcgctga

SEQ ID NO: 310845 - DNA, 75 bp, Artificial Sequence
  Synthetic
gccaatgcaagatttggctccagttgtaagagagtatatgatgctaggagccgacggatatgtgttaacacagaa

SEQ ID NO: 310846 - DNA, 75 bp, Artificial Sequence
  Synthetic
gacaagattggatagagatcagcaattaatagctaacagaagatctgtggtatttgatagaatgtgtgaattgtc

SEQ ID NO: 310847 - DNA, 75 bp, Artificial Sequence
  Synthetic
agggcctttatatagatcacgtattgttcattcaatgagaatgatgtcaaaattatggagaacgaatgtctttag

SEQ ID NO: 310848 - DNA, 75 bp, Artificial Sequence
  Synthetic
aacttctcttgaagatgaaataaccaaaatttacgccgctgctgaggtatctatggtttctattgatgcgactac

SEQ ID NO: 310849 - DNA, 75 bp, Artificial Sequence
  Synthetic
gtctgcactttccaccattaatattgcatcagctgaacaaacgctgaatgcgttattaaacatgtctttttttag

SEQ ID NO: 310850 - DNA, 75 bp, Artificial Sequence
  Synthetic
atgtgagttagatttaattggtagtcagtcttcttttggagctgcaatgtctgcaatgattgcactaatgatact

SEQ ID NO: 310851 - DNA, 75 bp, Artificial Sequence
  Synthetic
cccaacagatcaagaaaatatggatgacgaagtgtttgatgttctatgcaatcttgtttacaatgaattaatagc

SEQ ID NO: 310852 - DNA, 75 bp, Artificial Sequence
  Synthetic
atgggctgctgatagacctgttttcgttaggagagctggagcaacaaacgcatttaggcaatttgttaatgctgg

SEQ ID NO: 310853 - DNA, 75 bp, Artificial Sequence
  Synthetic
attgaatcgtgacatcactaattatatgagatttgtattgttaagaagaccttggcttccactttacaactctag

SEQ ID NO: 310854 - DNA, 75 bp, Artificial Sequence
  Synthetic
agatgtgcggagaaatgctcacgttctggttcctaatgttgatttagctaatattaatgatcaagtgtacgttgc

SEQ ID NO: 310855 - DNA, 75 bp, Artificial Sequence
  Synthetic
aattaatagtttcctgaatggaattattgaagcatcaagaaggaacccaaatcctaataaaacgatttctgccaa

SEQ ID NO: 310856 - DNA, 75 bp, Artificial Sequence
  Synthetic
ttcatttcgaaaattaatgaaaaacatgagagatatttgtgttaatagattgatgccagttataagattaattag

SEQ ID NO: 310857 - DNA, 75 bp, Artificial Sequence
  Synthetic
atacaacgttgaaagaataggtatgattttgcacatgttaccatattcagcagacatttttgatatcaacagaaa

SEQ ID NO: 310858 - DNA, 75 bp, Artificial Sequence
  Synthetic
tttgagagatgaacggcttagaattaaaattccgatgtctggctttctgtccttagttatgggcataacgaaagc

SEQ ID NO: 310859 - DNA, 75 bp, Artificial Sequence
  Synthetic
tcctgatgcttttgattggtcacaggttctaaattttgctgatgatgtaaggaaaatggattatgctgaagcaat

SEQ ID NO: 310860 - DNA, 75 bp, Artificial Sequence
  Synthetic
ttcaattgaagattcagcatcagtggctataatgcggaatgatgctaatagagcaacttcgaagaaagaaatttt

SEQ ID NO: 310861 - DNA, 75 bp, Artificial Sequence
  Synthetic
catttcagaagttaaaccaccaactccaactgtagcttcaatacaaaaaattccctcagcaactttgactgcaat

SEQ ID NO: 310862 - DNA, 75 bp, Artificial Sequence
  Synthetic
gttttcagacagacagttaattaatttaattagagacactcattcattcagagtaattcgtgaaatagctgtagc

SEQ ID NO: 310863 - DNA, 75 bp, Artificial Sequence
  Synthetic
tctccaagcggcatttgataattcccctacatctcaacatggagttggtaaaggtgcagtgcttcatccagttcc

SEQ ID NO: 310864 - DNA, 75 bp, Artificial Sequence
  Synthetic
acaaaattttggcagatcttctcaattcgtgagaagagataacatattactgcaacgtccagctggaattcaaca

SEQ ID NO: 310865 - DNA, 75 bp, Artificial Sequence
  Synthetic
atttacaatagaagacttaaaacaaggaagatattttcaaggtcttatggcacaaattagagccagacaaccgat

SEQ ID NO: 310866 - DNA, 75 bp, Artificial Sequence
  Synthetic
tatagttaatggccctattcctttaagaatttctgatgccgctgaaattgaacaagttacattagcatttctaac

SEQ ID NO: 310867 - DNA, 75 bp, Artificial Sequence
  Synthetic
tatgaattcaccatatgatgcatacattgatccaagagatttgaaacaacaaaaacttttgactgatagagaagt

SEQ ID NO: 310868 - DNA, 75 bp, Artificial Sequence
  Synthetic
ggatttatttatcgatcaaaatccagctagaccaaatgatgaatttgataatgtaatggctagaacatcagtttt

SEQ ID NO: 310869 - DNA, 75 bp, Artificial Sequence
  Synthetic
cataattgacgcccctagagctatcgttccaattaatcctcaaagactaaattttccatatcatgatattatggt

SEQ ID NO: 310870 - DNA, 75 bp, Artificial Sequence
  Synthetic
aactgattctgtgactaagttcatcgaatttacagttgcactgactccagatctacaattatttaacggtttact

SEQ ID NO: 310871 - DNA, 75 bp, Artificial Sequence
  Synthetic
ctccagatctacaattatttaacggtttactagtatttgagcaataaatcacgatctagcttattcaatataccc

SEQ ID NO: 310872 - DNA, 75 bp, Artificial Sequence
  Synthetic
ggcaatttcttgctacaagtgactgtgaaggatggatctgattgagacgattaatgcagttgttgaactgcaaca

SEQ ID NO: 310873 - DNA, 75 bp, Artificial Sequence
  Synthetic
tagagttagaaatttatcaccaaatactaatatatatcaagatgggcagacaacaattaatgattataatgctat

SEQ ID NO: 310874 - DNA, 75 bp, Artificial Sequence
  Synthetic
tgcatctagatgtaatggaaaagtgtacaatctaagagaccaaattgctcagttgtctccatttcaagttcatat

SEQ ID NO: 310875 - DNA, 75 bp, Artificial Sequence
  Synthetic
gccagtgattccaatatcaactattttatcaacagatgatcatgaaacaatgtcggcgggaattgaatcgctgtt

SEQ ID NO: 310876 - DNA, 75 bp, Artificial Sequence
  Synthetic
tgacgttctagccgcagctattagaactgagggatctagacagaatagagctgttgtcactaagtctattgagcc

SEQ ID NO: 310877 - DNA, 75 bp, Artificial Sequence
  Synthetic
tgaggttctaaaagcagttttagatattggaattagatcccagttttcagagaatccttatgcgaatatgttaca

SEQ ID NO: 310878 - DNA, 75 bp, Artificial Sequence
  Synthetic
agttgacacggcaaaaatggagcagcaactagaacccattgatgatccacttgcaagtcagagaattaatatgtt

SEQ ID NO: 310879 - DNA, 75 bp, Artificial Sequence
  Synthetic
agcagctggaggtgctacaaataatactggtggaggatatcacgcattagttggaagagcaacaggaaaaacagg

SEQ ID NO: 310880 - DNA, 75 bp, Artificial Sequence
  Synthetic
tataattacgattatccagggtagaccaggagccgtaacattcaatttaaatatgaaagtgccatgttctggagt

SEQ ID NO: 310881 - DNA, 75 bp, Artificial Sequence
  Synthetic
actatcactaactttacttccagctccaggtgtgattcaattatcgctaggaaatcagccacctaataacatccc

SEQ ID NO: 310882 - DNA, 75 bp, Artificial Sequence
  Synthetic
cgtacatgcggaatgtgttgacgtatcaacggtttttactgaaggagatatcgttataaggtttgaattggcagg

SEQ ID NO: 310883 - DNA, 75 bp, Artificial Sequence
  Synthetic
aagagttgttggaaacgccaacaaacttggaacactcaactttcctctatgtgatcgtattagcattacaattga

SEQ ID NO: 310884 - DNA, 75 bp, Artificial Sequence
  Synthetic
accttggaatgccaataaacaaaataatgctaatgctaattttaataattggccggctggaacagcacaaagaca

SEQ ID NO: 310885 - DNA, 75 bp, Artificial Sequence
  Synthetic
accaactatatcattatttgttaacattattaatgcatcatctttaattgattatgaaactcattccaaatattt

SEQ ID NO: 310886 - DNA, 75 bp, Artificial Sequence
  Synthetic
agctggtgcaacatatctgatgggtacaactttttcagaagattcatttattgcgtctccacctaatgttgtatg

SEQ ID NO: 310887 - DNA, 75 bp, Artificial Sequence
  Synthetic
gacaatgagctcattgctttcaggtgcgccaccacagtatattcattggacaagaaaaattgcatgtatgattgc

SEQ ID NO: 310888 - DNA, 75 bp, Artificial Sequence
  Synthetic
agctttctcctgcaaaatctgattggtcaggtttggtcacgcgctgcgaagcggcgttccgtagtagtatagaaa

SEQ ID NO: 310889 - DNA, 75 bp, Artificial Sequence
  Synthetic
caaaatctgattggtcaggtttggtcacgcgctgcgaagcggcgttccgtagtagtatagaaataaaatataccc

SEQ ID NO: 310890 - DNA, 75 bp, Artificial Sequence
  Synthetic
ggaattttagtggtttctctgattacattgtctggcttctaggacagttagaaagatgatgtctattcaaagagc

SEQ ID NO: 310891 - DNA, 75 bp, Artificial Sequence
  Synthetic
tgctcaaattaaccgacaatttgactacatgtcaattaaagaactgtggatggcgaaatttccattgcataaacc

SEQ ID NO: 310892 - DNA, 75 bp, Artificial Sequence
  Synthetic
cggtgattgtttggatatgtttaaaaatggtgattacactggaccaacaatgggatgtatccaaaaaacaaaagc

SEQ ID NO: 310893 - DNA, 75 bp, Artificial Sequence
  Synthetic
ttcaaagaaaaatacaattttccacatcaagtctgactttaattccactgaatatgacgaacctccaattagcgg

SEQ ID NO: 310894 - DNA, 75 bp, Artificial Sequence
  Synthetic
atttaaaatgtttactcaacattgctgccaacgtatagatgaacatttctgtggagcccttcaccctgtgattag

SEQ ID NO: 310895 - DNA, 75 bp, Artificial Sequence
  Synthetic
taatattgaatttgagcataatcaattaaaaactagaccacaagtggcatcagagcttaatctgttcattccatg

SEQ ID NO: 310896 - DNA, 75 bp, Artificial Sequence
  Synthetic
tggaattaaaaatttaaaaatagaaagtggagaaaaatcaacatggattgttggaacaaaatttcgaaagtgtat

SEQ ID NO: 310897 - DNA, 75 bp, Artificial Sequence
  Synthetic
gtgtttgaaaccagtgatagtggcagcaacaataattggaacaccaataaataaaaatttgatcacattttgttc

SEQ ID NO: 310898 - DNA, 75 bp, Artificial Sequence
  Synthetic
atctgactatattcaagttatagttaatagaaatagagaaggatcatgtggtatatgtatgggaaatgtttcaac

SEQ ID NO: 310899 - DNA, 75 bp, Artificial Sequence
  Synthetic
atatgaagcttgtggaaattggactaacgaaacatggggagaggaatttagcttagacttaaaattatgttataa

SEQ ID NO: 310900 - DNA, 75 bp, Artificial Sequence
  Synthetic
gtgcacgcccgttgcatttatattttcattaatgatgagtaccggacataaaccatacgtcagtaagaaacaatt

SEQ ID NO: 310901 - DNA, 75 bp, Artificial Sequence
  Synthetic
tgaagaaaatagaagaaagtgggaaagagtcttaaattacaaaatctgtaaagaaaatcttgactcacatttagc

SEQ ID NO: 310902 - DNA, 75 bp, Artificial Sequence
  Synthetic
ttgtgctaaccacgaaaatgtttataaatcaataaaaaaatatgagttcttcgattcggtttgggtgtaccactt

SEQ ID NO: 310903 - DNA, 75 bp, Artificial Sequence
  Synthetic
ggcaaacagctcttgggttcgagatttaactagagaatgcattgaatctaaccctggaccaaactatatacagct

SEQ ID NO: 310904 - DNA, 75 bp, Artificial Sequence
  Synthetic
cctcaatgagcattctcaaagatatggatttgtacagcctacatatgagataatagctgtggttagtgacggaca

SEQ ID NO: 310905 - DNA, 75 bp, Artificial Sequence
  Synthetic
tcattcttaccaatgcacatgttactataaagatatgaaaacacaatcaactggaccgtcaaagaaaaacgctaa

SEQ ID NO: 310906 - DNA, 75 bp, Artificial Sequence
  Synthetic
acatcaagctgcagaacaaatgttcagacatcaatgtttctaatttccttgttgcagcaaggatgactagtgcat

SEQ ID NO: 310907 - DNA, 75 bp, Artificial Sequence
  Synthetic
aatgtttctaatttccttgttgcagcaaggatgactagtgcattcaatgtatgattagcgacctatcatataccc

SEQ ID NO: 310908 - DNA, 75 bp, Artificial Sequence
  Synthetic
ggcacttaatggctaagttaattataatcaacagtgagaaaggcgagaaagtagaaacacatgaagacattttta

SEQ ID NO: 310909 - DNA, 75 bp, Artificial Sequence
  Synthetic
aattatcaaatttacaacaacgtgaaatatacgcaattacaaatgagaggactaaatcgattctgctgaatcaga

SEQ ID NO: 310910 - DNA, 75 bp, Artificial Sequence
  Synthetic
cattttatactatcttagatattgaaaatgagccaaaagataaagttgcttttgatagctataatagtctattcc

SEQ ID NO: 310911 - DNA, 75 bp, Artificial Sequence
  Synthetic
ctacatcaattttttcatatagcaggcaagaccgcctattcggtacttgtaatcatgttttggataataacattc

SEQ ID NO: 310912 - DNA, 75 bp, Artificial Sequence
  Synthetic
attattcttttgctctctttgattctatggttgataatctttcaacctaccttccaaatgattggaatattatta

SEQ ID NO: 310913 - DNA, 75 bp, Artificial Sequence
  Synthetic
agatatctgattcaattgattaccccataggcaatgatttgttattctacgtatttgataatttagtacatatga

SEQ ID NO: 310914 - DNA, 75 bp, Artificial Sequence
  Synthetic
ctatagaccaatttgtcaattctgaggagaaacaaatgaatactgtaccaaaatgcaaagaatcacaggataaga

SEQ ID NO: 310915 - DNA, 75 bp, Artificial Sequence
  Synthetic
ttaaagaggtattcacagatataatgtcccatttatatatgcctgctattgattatgatccacagtcgtataatt

SEQ ID NO: 310916 - DNA, 75 bp, Artificial Sequence
  Synthetic
acagagtgtcaagaagagaaattggaaacttagtacgtgatcaagttttttcattagtaaagggacacatacatt

SEQ ID NO: 310917 - DNA, 75 bp, Artificial Sequence
  Synthetic
taataggacctgaaatggaatcattgagaaacataatcatgtttttacacgcaggaaactcaataacatttcaca

SEQ ID NO: 310918 - DNA, 75 bp, Artificial Sequence
  Synthetic
cgattgatacatcaacgaaatctagttatatcaaagaattagaatttaataaaaaaacaaaattaaccatggcta

SEQ ID NO: 310919 - DNA, 75 bp, Artificial Sequence
  Synthetic
gtgtgctagtaaatcaaaggaaaaatatgaataatttttttaaaggtcttatcagacattatataacgtatggaa

SEQ ID NO: 310920 - DNA, 75 bp, Artificial Sequence
  Synthetic
ttccaagaaaagtttattacattggcgcctatccatcttactggttagaattgattacatgggttccttttaata

SEQ ID NO: 310921 - DNA, 75 bp, Artificial Sequence
  Synthetic
tagtagcgtatgatccaaaatatcgccgtgtagataatgacaaaatcatttggtatgataggttatttgatagaa

SEQ ID NO: 310922 - DNA, 75 bp, Artificial Sequence
  Synthetic
atgacattgaaacaattgaatctaaatcatatatttacattgatataagaactgacgtacggaatttagacacga

SEQ ID NO: 310923 - DNA, 75 bp, Artificial Sequence
  Synthetic
caaaaaaacagcgtatatttaaagaagaagatgatatgatagttgatatggctattaaactagcttctaaacaat

SEQ ID NO: 310924 - DNA, 75 bp, Artificial Sequence
  Synthetic
gtacagttatgtttaaaagaaaaatttttccaggaaataatatgtcattcggtgatccacttttccatccgaaat

SEQ ID NO: 310925 - DNA, 75 bp, Artificial Sequence
  Synthetic
taacacaattgggtcgtgaatactataattgcataacaactattgttagtccatctgtttacaaagagtcagagc

SEQ ID NO: 310926 - DNA, 75 bp, Artificial Sequence
  Synthetic
tgtattcattattattatctgcaagatcaaacaatgtatcaaattatgtgtacggtggaagtaaatttgatcaat

SEQ ID NO: 310927 - DNA, 75 bp, Artificial Sequence
  Synthetic
tttcaattgtgaactgtaacagtaccgtggttgccttatattcactttctaacactgttaacagtttaaaaacta

SEQ ID NO: 310928 - DNA, 75 bp, Artificial Sequence
  Synthetic
ttgaacacgccattaaatataatcatataatcacttttccacatcgtaccgatagaggtgattggaggaatatag

SEQ ID NO: 310929 - DNA, 75 bp, Artificial Sequence
  Synthetic
aagaattggataactcaagtccatttcaaaatagaaaaagacagttagagtttgaagattggtctatagatccaa

SEQ ID NO: 310930 - DNA, 75 bp, Artificial Sequence
  Synthetic
aaaattatgtaatgaagtttagatgtgaaatggtttctgaatcagtttttttgcaactaggacattcaagagctt

SEQ ID NO: 310931 - DNA, 75 bp, Artificial Sequence
  Synthetic
taattcctgatttgtataatcatatgatttcacttagaatggagatgccactattttattctgatcgtttttttt

SEQ ID NO: 310932 - DNA, 75 bp, Artificial Sequence
  Synthetic
cacatattggcattagacaaccgtcaattttcaaaagagatagttatatgacatcacgactgtcagcgtatattt

SEQ ID NO: 310933 - DNA, 75 bp, Artificial Sequence
  Synthetic
caagacagttgacacattcgattaacttatcagtgttaaagaggaatcattttgaaggatattcaggacatttga

SEQ ID NO: 310934 - DNA, 75 bp, Artificial Sequence
  Synthetic
tagctattgaaacatcatttagttcattagtatttacaatgtcaccgtatagatggctgattagagctaaaaaat

SEQ ID NO: 310935 - DNA, 75 bp, Artificial Sequence
  Synthetic
tgttaactaaaaataaaatgagggataaatttaaaataggtgatggtcaacctcacacgcgtgaagagtttgaaa

SEQ ID NO: 310936 - DNA, 75 bp, Artificial Sequence
  Synthetic
atacttatgattatctcaaaatcaatagattagtaaacagtacatttcgttctttactgttggactaggtcataa

SEQ ID NO: 310937 - DNA, 75 bp, Artificial Sequence
  Synthetic
ttagtaaacagtacatttcgttctttactgttggactaggtcataagtaacttaatgagttgctgtaatataccc

SEQ ID NO: 310938 - DNA, 75 bp, Artificial Sequence
  Synthetic
ggtaaaaagctcttatcttagtcacatcatccagggttgcagctgggagagaatggtgtcgatcaaagtgtcttt

SEQ ID NO: 310939 - DNA, 75 bp, Artificial Sequence
  Synthetic
agctgatttcattgttaagactgaggaaggttggattccatctgataactgtcctgctttagatagatttaaaac

SEQ ID NO: 310940 - DNA, 75 bp, Artificial Sequence
  Synthetic
taaaactgaaaaggagctgttggattcaataaaaaaagaaggagcagatagagcatcaattcgaaaacaattgtt

SEQ ID NO: 310941 - DNA, 75 bp, Artificial Sequence
  Synthetic
tttaacatctatatcaaataaaagacttactcaacttggaggtgtgcctgtgcgagatattcgcacatccacgac

SEQ ID NO: 310942 - DNA, 75 bp, Artificial Sequence
  Synthetic
tattccatcttcaactagaaatttaatcactgattggttgttaaatatatttaatgatgaagagtcaggtgaaga

SEQ ID NO: 310943 - DNA, 75 bp, Artificial Sequence
  Synthetic
ggttgaaagtgctattgcaagcaagtatcctgatatattttgttctgctgataaaattagtcgagttgcacagag

SEQ ID NO: 310944 - DNA, 75 bp, Artificial Sequence
  Synthetic
acttgaaaatagaagagatagagtacatgaagatgggtttagaattttatcagcaacaatgctagctatagattc

SEQ ID NO: 310945 - DNA, 75 bp, Artificial Sequence
  Synthetic
tgatattgctactgagggtaaatgtgaaatagtaagagcgactgaagatgctattattgctaaatttgaaccagt

SEQ ID NO: 310946 - DNA, 75 bp, Artificial Sequence
  Synthetic
ttcagaacatctatgtataggaaatccaagaggtgttttctataaagcttttccaataaaaaaagaacagccaat

SEQ ID NO: 310947 - DNA, 75 bp, Artificial Sequence
  Synthetic
ggtctatggagttaaggctttgttaggtatatctaatagagactttatcatgaaccatggtcatggtcatttaag

SEQ ID NO: 310948 - DNA, 75 bp, Artificial Sequence
  Synthetic
aactgttccatattctgaaattaataacgcagttagatcttttgcaaaaaagaatgaagctgagatcaaaagaat

SEQ ID NO: 310949 - DNA, 75 bp, Artificial Sequence
  Synthetic
tcgttccgattcattgtcacccaatgcaggtgaaaaatttattaacatgtgcgatatgttgttacaaaaagagaa

SEQ ID NO: 310950 - DNA, 75 bp, Artificial Sequence
  Synthetic
aattgagactgtcatagctaaaataatgaaaagcgataaaaattagatgttatcagtaacattttgatcgaaaaa

SEQ ID NO: 310951 - DNA, 75 bp, Artificial Sequence
  Synthetic
aaagcgataaaaattagatgttatcagtaacattttgatcgaaaaaaactaagataatctttgattgatataccc

SEQ ID NO: 310952 - DNA, 75 bp, Artificial Sequence
  Synthetic
ggcacttaagatgtctctcagaagtttgttgattacaactgaggcggttggagagaccactcaaacgagtgatca

SEQ ID NO: 310953 - DNA, 75 bp, Artificial Sequence
  Synthetic
tcaaacatcatttagcacaagaacgtataacgaaatcaatgatagaccttcactgagaatagaaaaggatggaga

SEQ ID NO: 310954 - DNA, 75 bp, Artificial Sequence
  Synthetic
aaaagcatactgttttaaaaatctagatccagtaagatatgatacacgaatgggagagtacccgtttgattacgg

SEQ ID NO: 310955 - DNA, 75 bp, Artificial Sequence
  Synthetic
tggacaatcaacagaaaataatcaattacaatttgatcttttcacaaaggatctcaaagcagacactgatattga

SEQ ID NO: 310956 - DNA, 75 bp, Artificial Sequence
  Synthetic
tttatctgatgatgtgaaagatgatttgaaacggcaaattatggaatactatcaacaaggataccgcgcaatttt

SEQ ID NO: 310957 - DNA, 75 bp, Artificial Sequence
  Synthetic
tttagttagacctcaaaatcaagaacaacattatatagccagttatagttcaactaatttaaacttcacatcaca

SEQ ID NO: 310958 - DNA, 75 bp, Artificial Sequence
  Synthetic
gccaagtatcggtgttaacctatctattttaaataaaattcaagagaataaattatacatttattccacgcagcc

SEQ ID NO: 310959 - DNA, 75 bp, Artificial Sequence
  Synthetic
acacattccttctgtaggatgtgagatgatagcaaaaatatttagaaccgatatagataatgaaaattcattgat

SEQ ID NO: 310960 - DNA, 75 bp, Artificial Sequence
  Synthetic
taactattcagcacctgtaacggtaacgatctcagtcacaaaagctacatttggagacacatttgtgtgcaatca

SEQ ID NO: 310961 - DNA, 75 bp, Artificial Sequence
  Synthetic
tccgaacatgaattaccaagatttaatacctactatgactaaaaatagcatttaccatgatgttaaaagaataac

SEQ ID NO: 310962 - DNA, 75 bp, Artificial Sequence
  Synthetic
taaaatccatgaatacattaatagtaaaaaaaagaagaaaaatagcactagtaaaataggaggaattcaaatagc

SEQ ID NO: 310963 - DNA, 75 bp, Artificial Sequence
  Synthetic
tgaatcaaaagacggattttggaaaatattaacgaaaaattatcaaatcaaactcaaatttggtgtcgaaggata

SEQ ID NO: 310964 - DNA, 75 bp, Artificial Sequence
  Synthetic
tggagttatgggtggcacatttggaaattggctaattgatagtggatttaaaaccgttgagacaaattatgagta

SEQ ID NO: 310965 - DNA, 75 bp, Artificial Sequence
  Synthetic
ccagagaaacgggaagacaattaatgcaacaacggttgcttcagttaaaccatcaagaaaatgtggaactagaag

SEQ ID NO: 310966 - DNA, 75 bp, Artificial Sequence
  Synthetic
tcctgtatttggacagttacagttttcaggagaaatgatggtgttatcacataatgatattctaactgtgttcta

SEQ ID NO: 310967 - DNA, 75 bp, Artificial Sequence
  Synthetic
tactgaaagggaatgggctttgtctaatgctatatatgcaaaaaactttgcaacggattttaaaagacaatttga

SEQ ID NO: 310968 - DNA, 75 bp, Artificial Sequence
  Synthetic
aataactgcacagtcagatgaattattagttcgtactaatgtagttccacatactataaaaaatacaccaggaaa

SEQ ID NO: 310969 - DNA, 75 bp, Artificial Sequence
  Synthetic
agctttaatggaatattcacatggaggttttggccaaattgatacttccgactatactggcatggcacttacatt

SEQ ID NO: 310970 - DNA, 75 bp, Artificial Sequence
  Synthetic
tagatttagatgcattagcgaagatttacccgaaggttattatgacagagataaagctttagctttcgctaatgt

SEQ ID NO: 310971 - DNA, 75 bp, Artificial Sequence
  Synthetic
cggtctaacatcatttcaagatagacaagaagctaatggaacttattgggtatacaacacatctactgttggatt

SEQ ID NO: 310972 - DNA, 75 bp, Artificial Sequence
  Synthetic
cggttcatgttatccgaaaaaagaatttgaatatgatatcaatgtgacatatactacactgttgccatctgatcc

SEQ ID NO: 310973 - DNA, 75 bp, Artificial Sequence
  Synthetic
agaatttacaacggggggaactaactatgctcaatcagttactgcagttctggaagaatcatttattaatttaca

SEQ ID NO: 310974 - DNA, 75 bp, Artificial Sequence
  Synthetic
aaatcaagttaatgagatgttaacaagaatgaacatttctgatcttacttcgggagttatgtctgttttttctgt

SEQ ID NO: 310975 - DNA, 75 bp, Artificial Sequence
  Synthetic
cgcaacatcttttccacaaattcttgatggtataagtgatctgttaaaagcagcttcatcagcttttaaaaaagt

SEQ ID NO: 310976 - DNA, 75 bp, Artificial Sequence
  Synthetic
gaaaggaaaggtaggaagtgttgctaaaagactgagagggaagagatatgttagactttttgatgaaaatgtatc

SEQ ID NO: 310977 - DNA, 75 bp, Artificial Sequence
  Synthetic
aatcgaggagactcccagatttcttgattcaattagatcaagtagacgaccgtcaatcttgtccaacatgttcaa

SEQ ID NO: 310978 - DNA, 75 bp, Artificial Sequence
  Synthetic
tgacgacgaaacttttactgctttgcatactttagcaagtagaacgaattccgttgcaagtgatgtgacatattt

SEQ ID NO: 310979 - DNA, 75 bp, Artificial Sequence
  Synthetic
acagcctataataacaacaagaatagcaaactcgacacctccagttattgcaccagcatcttccgtaacatatgc

SEQ ID NO: 310980 - DNA, 75 bp, Artificial Sequence
  Synthetic
aaaactaaaagatatttcaaaaattatcaacgcggaaattgatccaaaatcaattatggagtttaaccaaatatc

SEQ ID NO: 310981 - DNA, 75 bp, Artificial Sequence
  Synthetic
taatactatcagcatattagattcaacaaagaaattagcacaatatgctgttgatccagacattatagatggtat

SEQ ID NO: 310982 - DNA, 75 bp, Artificial Sequence
  Synthetic
attgaataaaatggtaggtggacacgctagatcgttattttcacttaaagttaggaaacatttgttagatgccgt

SEQ ID NO: 310983 - DNA, 75 bp, Artificial Sequence
  Synthetic
ggaaaaggacgcattcgtgaaatataattatcacgatttgatgggtaaactattaaatgatagagaactgttaga

SEQ ID NO: 310984 - DNA, 75 bp, Artificial Sequence
  Synthetic
tataacaaataatctatcctcgcaaaaacaattcgaattagcaaaagaatttcgcgatctgttaattaacgctct

SEQ ID NO: 310985 - DNA, 75 bp, Artificial Sequence
  Synthetic
ttagcaaaagaatttcgcgatctgttaattaacgctcttgcctagatgatatgaaagagatctttaaatataccc

SEQ ID NO: 310986 - DNA, 75 bp, Artificial Sequence
  Synthetic
ggcaatttgaagccatgttgctctttattattctatctgttggcgttgacgccataagttacattcaaaatgata

SEQ ID NO: 310987 - DNA, 75 bp, Artificial Sequence
  Synthetic
gaagtaatgacttgtgtatcgtttatgaaatgactagttttggaacaagttttaacaacgcaaatgactcattag

SEQ ID NO: 310988 - DNA, 75 bp, Artificial Sequence
  Synthetic
ttaagctacataagcatatgggattgaaatatgaagtttgtaaaatagaatcgaacgctaatgcattaactcaaa

SEQ ID NO: 310989 - DNA, 75 bp, Artificial Sequence
  Synthetic
tgcaaaagtgtaattgtatatatgatgatacaccacaaatagttgtcttcaccaattttaaaaaatctagtttaa

SEQ ID NO: 310990 - DNA, 75 bp, Artificial Sequence
  Synthetic
aaacgttaattggaactgaaaataaatgtgaattactaccacagacaacaatctacactccaaccgttgatattg

SEQ ID NO: 310991 - DNA, 75 bp, Artificial Sequence
  Synthetic
aatcggaatatttcatatatggaaacgatgtcaaaatatgttatttagacaaaaatttactgggaattggatgtg

SEQ ID NO: 310992 - DNA, 75 bp, Artificial Sequence
  Synthetic
atgccactgatacaacttcttggcttgatttagacgccggattacctaccaatcacgcacttgatattcctgaga

SEQ ID NO: 310993 - DNA, 75 bp, Artificial Sequence
  Synthetic
ttacaagcgatggatttaaactattcgcaaaatacagtgattctttcttatgtcaacgactaatggatgagccaa

SEQ ID NO: 310994 - DNA, 75 bp, Artificial Sequence
  Synthetic
aaaaacaaattcaattctacgcagaggtagacaatgtcccatctaatgatgtaatagaaagttcaagatcttggg

SEQ ID NO: 310995 - DNA, 75 bp, Artificial Sequence
  Synthetic
cttctgtttggaaagttgttaaaacagtcttacattttacttaccatatacttgatttgttctatggtaacagac

SEQ ID NO: 310996 - DNA, 75 bp, Artificial Sequence
  Synthetic
cagacgtgctacagctagaatgattgagcattcaccactaggttgagaaatcccgaatggtgagcaaatataccc

SEQ ID NO: 310997 - DNA, 75 bp, Artificial Sequence
  Synthetic
ggaacttaaaacatcaatcgttgctgcaacagcggttggttacctcttgccttagaatgagcgaagtgcctcgat

SEQ ID NO: 310998 - DNA, 75 bp, Artificial Sequence
  Synthetic
ttgaattaagaagcaaacgaaagattggaaagaaacaaaaagttgatatatttggagataaagatgatgaatcta

SEQ ID NO: 310999 - DNA, 75 bp, Artificial Sequence
  Synthetic
tgttacagatcgactgtgagacagattctcttatttcagaatcggttagttcaactcatagttacgaagattatt

SEQ ID NO: 311000 - DNA, 75 bp, Artificial Sequence
  Synthetic
ctaaagcgtataaagagttaactttagagactccagccgatgtaaatgactcagcttctacaatcgttgacagtg

SEQ ID NO: 311001 - DNA, 75 bp, Artificial Sequence
  Synthetic
tttgtgaagagtcttggtatgataaaacgattaaagatgaacaaactaaagaggataaaaaaacagataaaaaac

SEQ ID NO: 311002 - DNA, 75 bp, Artificial Sequence
  Synthetic
ttaaaagaatagaaaaagttaaagagaataatcaaaatgattcaatgagtttgcaaatagctcaattatcattac

SEQ ID NO: 311003 - DNA, 75 bp, Artificial Sequence
  Synthetic
gaatacaaagaatagaatcagaaacaaagttgaaaacacttgattcagcttacaatactataattacacaagccg

SEQ ID NO: 311004 - DNA, 75 bp, Artificial Sequence
  Synthetic
acaatttgactactccacaaaaaaaatcattaataagtgctatattagcaactatgagataatcgagagccggat

SEQ ID NO: 311005 - DNA, 75 bp, Artificial Sequence
  Synthetic
aactatgagataatcgagagccggatacattcccctcattactaagggtcagcccctgaggtcaatagtataccc

SEQ ID NO: 311006 - DNA, 75 bp, Artificial Sequence
  Synthetic
ggcactatggaacctgagaactatctagcttggctagctagagatatagttcgaaatttatcatatacttctctc

SEQ ID NO: 311007 - DNA, 75 bp, Artificial Sequence
  Synthetic
gtttataataatccaaaagtcgcaattgtagagttactggataataaagaagcgttctttgcttatgaaaaagag

SEQ ID NO: 311008 - DNA, 75 bp, Artificial Sequence
  Synthetic
caaaaaacacctgaagcactaattaattatattgactctatagttaaatcctctatatcagtagaagataaaatt

SEQ ID NO: 311009 - DNA, 75 bp, Artificial Sequence
  Synthetic
gaagcattgttgaaaattcgatatatttcggtatacgttgatgataaatctgacaaaagagatatagtattgcag

SEQ ID NO: 311010 - DNA, 75 bp, Artificial Sequence
  Synthetic
cttttgaatcgtactattaaaaaaatagaattaaaaactaaaatatctgatgaattgaatgatgcaattaatgct

SEQ ID NO: 311011 - DNA, 75 bp, Artificial Sequence
  Synthetic
ataacgattgaatcgaaaaattggaagattcaaaattcaaagtcatttaaaccatatcattataaccagttagtg

SEQ ID NO: 311012 - DNA, 75 bp, Artificial Sequence
  Synthetic
tcagactttataaagtataacgagtttgaggtacttgaaggtacggatcctttaaaatggaaaagtgatacttta

SEQ ID NO: 311013 - DNA, 75 bp, Artificial Sequence
  Synthetic
caaggattgagtccaaactacaatcataggacacatactttgatttcatcaattatatatgcgacaagcgttagg

SEQ ID NO: 311014 - DNA, 75 bp, Artificial Sequence
  Synthetic
tttgataattataatgatgaacaattacaagtattattatatttatttagtgtaattagaactaattatgtgaat

SEQ ID NO: 311015 - DNA, 75 bp, Artificial Sequence
  Synthetic
ggttatcttgaaattctaccaaataggaaatggtcacattcattagctgatctacgagaaaataaatcaataatg

SEQ ID NO: 311016 - DNA, 75 bp, Artificial Sequence
  Synthetic
atgtattctgctaaaattatacatgcttcttgtgcgatgatttcaatattgcatgctgttccaatcgactacttt

SEQ ID NO: 311017 - DNA, 75 bp, Artificial Sequence
  Synthetic
ttccttgcacaaatcatcgcgtcattttccgaaatacccgcccatgctgctaaacatctttcttctccgatgact

SEQ ID NO: 311018 - DNA, 75 bp, Artificial Sequence
  Synthetic
ttatacattggaattgcacagcttcgttctaatattgttgtatcaactaaaatcgcggctgaaagtgttgcaaca

SEQ ID NO: 311019 - DNA, 75 bp, Artificial Sequence
  Synthetic
gaaagcccgaatatttctagattagaagaaagccaaatacgtgaatgggagcaagagatgagtgaatatccattt

SEQ ID NO: 311020 - DNA, 75 bp, Artificial Sequence
  Synthetic
caatcttctaggatggtaagaatgatgaaaaaaaatatatttgacgtttctgttgatatgttttatgcaattttt

SEQ ID NO: 311021 - DNA, 75 bp, Artificial Sequence
  Synthetic
aattgcttttcagccacattccacgttggccatagaatagacaatccacaagatgctattgaagcccaagttaaa

SEQ ID NO: 311022 - DNA, 75 bp, Artificial Sequence
  Synthetic
gttgaatatacatctgatgtagataaagaaatgtatgatcaatattattttctcttaaaacgaatgttaactgac

SEQ ID NO: 311023 - DNA, 75 bp, Artificial Sequence
  Synthetic
caacttgccgaatatgctgaagaaatgtatttcaaatataactctgacgttacagctgaatctttagcggcaatg

SEQ ID NO: 311024 - DNA, 75 bp, Artificial Sequence
  Synthetic
gcaaattcatcaaatggttattcaagatctgtcactttccttgacagagaaattaaaactacaaagaagatgttg

SEQ ID NO: 311025 - DNA, 75 bp, Artificial Sequence
  Synthetic
catttggatgacgatttatcaaagaatcttaatttcacaaatattggtgaccagataaaaaagggtattccaatg

SEQ ID NO: 311026 - DNA, 75 bp, Artificial Sequence
  Synthetic
ggaacaagaaatgtaccagcgagacaaactagaggtatatttatactaagctggcaagtcgctgcaatacaacac

SEQ ID NO: 311027 - DNA, 75 bp, Artificial Sequence
  Synthetic
accattgccgagtttttatacaaaaaagctaaaaaaggtggttttggtgctacttttgcggaagcctacgtagcc

SEQ ID NO: 311028 - DNA, 75 bp, Artificial Sequence
  Synthetic
aaagctgctacattgacttatggaattctagctgaggcaacgtcaaaagcagatcaattaattttatatactgat

SEQ ID NO: 311029 - DNA, 75 bp, Artificial Sequence
  Synthetic
gtatcccaatgggacgcctcgcaacataacactgagccttatcgttcagcttggattaatgcaattaaagaagct

SEQ ID NO: 311030 - DNA, 75 bp, Artificial Sequence
  Synthetic
agaactaaatataaaataaattacaatcaagaacctgtcgttcttggaatgaatgtgttggataaaatgattgaa

SEQ ID NO: 311031 - DNA, 75 bp, Artificial Sequence
  Synthetic
atccaagaagcacttttaaattcaaatttaatagttgagtcacaaggatcaaaaagacagccattgcgcatcaaa

SEQ ID NO: 311032 - DNA, 75 bp, Artificial Sequence
  Synthetic
tatcatggtgtggcctcaggtgagaaaacaacaaagataggaaattcatttgccaatgtagctttaataactacg

SEQ ID NO: 311033 - DNA, 75 bp, Artificial Sequence
  Synthetic
gtattcaataatctaacgaatactatgccttctataagagttaatcatatgagagttgacggtgacgataatgtt

SEQ ID NO: 311034 - DNA, 75 bp, Artificial Sequence
  Synthetic
gtaactatgtacacagctaatagaatagatgaagtccaagaaaatataaaagaaaaatacaaacgcatgaatgcg

SEQ ID NO: 311035 - DNA, 75 bp, Artificial Sequence
  Synthetic
aaagttaaggctttagcatcatatacaggattagaaatggctaaaagatttattatatgtggtaaaatatttgaa

SEQ ID NO: 311036 - DNA, 75 bp, Artificial Sequence
  Synthetic
agaggtgctatatcaatattcactgcagaacgtccatatgggactgatttatcagttcaatctaccacgggttca

SEQ ID NO: 311037 - DNA, 75 bp, Artificial Sequence
  Synthetic
ttaatttattcagcagcagtaaacgcatatcgaggatttggtgataactatttgaattttatgactgatgtacta

SEQ ID NO: 311038 - DNA, 75 bp, Artificial Sequence
  Synthetic
gtgccaccatcagcttcagtaaaaataacaggcagactgaggtccctgttgtcaccagttacactatactccacc

SEQ ID NO: 311039 - DNA, 75 bp, Artificial Sequence
  Synthetic
ggaccattatcctttgaaataacaccatatggattaggaggtaggatgagactgttttcgttatctaaagagaat

SEQ ID NO: 311040 - DNA, 75 bp, Artificial Sequence
  Synthetic
atggagttatataagattttaacatcctccctcgcaatatcagttcaacctgatgaaataaaaaaatattcatct

SEQ ID NO: 311041 - DNA, 75 bp, Artificial Sequence
  Synthetic
actccacagtttaaagcaagagttgatagaatgatatcatcagtgcaaatagcaatgaaatcagaagcaaaaatt

SEQ ID NO: 311042 - DNA, 75 bp, Artificial Sequence
  Synthetic
ataacgtctatattgagagataaagaagagcagaaaaccttaggtgttccgaatgttgcaacaacaaagaacaga

SEQ ID NO: 311043 - DNA, 75 bp, Artificial Sequence
  Synthetic
caacaaattgaaaaagctagaaaaactctgtctttaccaaaagaaacattaccgaaagtaacaaaatattatcca

SEQ ID NO: 311044 - DNA, 75 bp, Artificial Sequence
  Synthetic
gaagaaatatttcatctgatattacgtaactcaacctttaccattcccaagttaaatactatgacaaaagtttac

SEQ ID NO: 311045 - DNA, 75 bp, Artificial Sequence
  Synthetic
atgaataattctgcaaatataacaaaattgcaacaacagctcggagtcagagtatcttcaggaatacaggtgcac

SEQ ID NO: 311046 - DNA, 75 bp, Artificial Sequence
  Synthetic
aggccagttaataccttactaaaattagttgagaagcattcaccaatcaaaatatcaccatctgatctagtattg

SEQ ID NO: 311047 - DNA, 75 bp, Artificial Sequence
  Synthetic
tattcaaagaaatacgatctaacaaacttaaatggaaaaaaacaatttctaatagacttaggtatatcaggcaat

SEQ ID NO: 311048 - DNA, 75 bp, Artificial Sequence
  Synthetic
gaactacgattttatttaaactcaaaactactctttcatgacttgttactctcaaaatatgataaattgtatgaa

SEQ ID NO: 311049 - DNA, 75 bp, Artificial Sequence
  Synthetic
tctcccggttttggtgcaacacaattaaatgcgctaccattagatttaacggcagcagaaaaagttttctctatt

SEQ ID NO: 311050 - DNA, 75 bp, Artificial Sequence
  Synthetic
aaactaaatttaccaaatacatactatgaactcttaatgttaatattgttatatgagtacgtcaattttgtcatg

SEQ ID NO: 311051 - DNA, 75 bp, Artificial Sequence
  Synthetic
ttcactggcgatactttcagagcggtgtgcattccagaatcacaaactataaacgcaaaattagtcaaaacggtc

SEQ ID NO: 311052 - DNA, 75 bp, Artificial Sequence
  Synthetic
atgaccatgattgataacattcagttagacacagttatgttttctgataacatatattaaacgtgagagtacatc

SEQ ID NO: 311053 - DNA, 75 bp, Artificial Sequence
  Synthetic
ataacattcagttagacacagttatgttttctgataacatatattaaacgtgagagtacatccattaatataccc

SEQ ID NO: 311054 - DNA, 75 bp, Artificial Sequence
  Synthetic
ggcattttgttcatcacaaatcacgatggaaggaactagtgaaagtccagtgttagatgaattcgaagtcaacaa

SEQ ID NO: 311055 - DNA, 75 bp, Artificial Sequence
  Synthetic
caatgactatgataatgattttatttctagattttcacaaaatccgttaaatgctttttctttatttacagatgg

SEQ ID NO: 311056 - DNA, 75 bp, Artificial Sequence
  Synthetic
gaacttacaggaatattttatgaacaattcgttagagaagatagtcatacacgttgtgttaatagttatttcatt

SEQ ID NO: 311057 - DNA, 75 bp, Artificial Sequence
  Synthetic
atgtgggataaaagcccaaacatcaaagataatctatgttgtcagattactgttttggaaaatatataatgtgat

SEQ ID NO: 311058 - DNA, 75 bp, Artificial Sequence
  Synthetic
taacaatctagtaaataaagtgataaatagagagaagattattaatcatcaagtagttgataatagatttagaga

SEQ ID NO: 311059 - DNA, 75 bp, Artificial Sequence
  Synthetic
gtttgaagaacgttttagacttttattacttcagcatgataaaaacattgctaaacaggatgatatagtacagta

SEQ ID NO: 311060 - DNA, 75 bp, Artificial Sequence
  Synthetic
taataagttggataatttcgctgaatccataaagagtgaattcaacttaaaagtcgcagagatggagagaagatt

SEQ ID NO: 311061 - DNA, 75 bp, Artificial Sequence
  Synthetic
tcaagaattaaagtggagatgtgatatgatagctaacaaagcaatgaacacaatagttctagcgaatacagttga

SEQ ID NO: 311062 - DNA, 75 bp, Artificial Sequence
  Synthetic
ttcaaataacaaagatgaaaaaatagtttttgatgagggatcagtagtgcaatataatcgtgagtgatgtgtagc

SEQ ID NO: 311063 - DNA, 75 bp, Artificial Sequence
  Synthetic
tgatgtgtagcatgctctaccatggatggaaacatagcttggtagaggctctcccatgctcaatgcaatataccc

SEQ ID NO: 311064 - DNA, 75 bp, Artificial Sequence
  Synthetic
ggaattttcgattcttaagacgagcttgctccgatagagtcggaaatggcggaacttgtttgtgatgcactggct

SEQ ID NO: 311065 - DNA, 75 bp, Artificial Sequence
  Synthetic
accttaacccgcaacacatatggtgacaacgatgaatcagctaaattttgcagaatgtttcgaactatgataaga

SEQ ID NO: 311066 - DNA, 75 bp, Artificial Sequence
  Synthetic
gattctggtctatacggcaatattgaaaactggagagccgcattctacagagagcgattgccaaaaagaatgtca

SEQ ID NO: 311067 - DNA, 75 bp, Artificial Sequence
  Synthetic
cactcaactgtatcaattcaattagataatttagaacgcgaggtgctaaaaattagagctgaaggattttgtcag

SEQ ID NO: 311068 - DNA, 75 bp, Artificial Sequence
  Synthetic
ggatatactagaaaggagagaactttgaatgcatttgatttgagtgatgatggcaaaggaaatacaataattaaa

SEQ ID NO: 311069 - DNA, 75 bp, Artificial Sequence
  Synthetic
ccaacaacacatctttctagcattattctgcaaaattcatataattcggcttttaagcttccaaaaattccagat

SEQ ID NO: 311070 - DNA, 75 bp, Artificial Sequence
  Synthetic
ggactacttgaaaaaactagatatgaattggaggaagaaaagaaaaataatgatattttgaagcaaaagatcaaa

SEQ ID NO: 311071 - DNA, 75 bp, Artificial Sequence
  Synthetic
gaactagaaaacacaatttctcaattagaaaactatgaaaatgaagctaaagcttctcaatttgttttagaacat

SEQ ID NO: 311072 - DNA, 75 bp, Artificial Sequence
  Synthetic
cttaaattcacaaatgaatccctaaaaattcaaagagatgaagctcaaatttgcttaattggtctctgtaataaa

SEQ ID NO: 311073 - DNA, 75 bp, Artificial Sequence
  Synthetic
ttcggtttacagtgtgaaatcgataattccattcatgttactgaatcagataagaaaggaaaacggaagggcagg

SEQ ID NO: 311074 - DNA, 75 bp, Artificial Sequence
  Synthetic
aaaaatagaagaattgaagtttcatttggtgctccaggacatgacttgaccgaacaaattagtactttaagtgat

SEQ ID NO: 311075 - DNA, 75 bp, Artificial Sequence
  Synthetic
gttgaatgaatgtaaatgaaatacaatcaattaagtacaattgaatatacttaaatcacaaataatccgttaatt

SEQ ID NO: 311076 - DNA, 75 bp, Artificial Sequence
  Synthetic
aagtacaattgaatatacttaaatcacaaataatccgttaattacccaagatctctccttgggctaaatacaccc

SEQ ID NO: 311077 - DNA, 75 bp, Artificial Sequence
  Synthetic
atcaaatcacaggtatcaaaaaatccattagcgaatatgctccaagttgatacagcaaaaatggaacaacaaatc

SEQ ID NO: 311078 - DNA, 75 bp, Artificial Sequence
  Synthetic
cattagcaaatatgctccaagttgatacagcaaaaatggaacagcaaatcgagccagctgatgatccgttcgcaa

SEQ ID NO: 311079 - DNA, 75 bp, Artificial Sequence
  Synthetic
aaagcaccaccacaattagttcattggtccaggaaaattgcatgtttaattgcagcctattcatgcaaaatctaa

SEQ ID NO: 311080 - DNA, 75 bp, Artificial Sequence
  Synthetic
atttatcaggatggacaaacaactattaatgactacaatgctgttgcttctagaacaaatggtaaattatataac

SEQ ID NO: 311081 - DNA, 75 bp, Artificial Sequence
  Synthetic
agccatatatttacctgcaccaggtgagttgcaattgtctttagggaatcagcctccaaataatatacccgtcca

SEQ ID NO: 311082 - DNA, 75 bp, Artificial Sequence
  Synthetic
atggatctcatcgaaacgattaatgcagtcgttgatctgcaagaaagagttcgaaacttatcaccaaatacaaat

SEQ ID NO: 311083 - DNA, 75 bp, Artificial Sequence
  Synthetic
ctacgtgatccaattgctcaactctcaccttttcaggtgcacatgccgatcgttccattagcaactgtattatct

SEQ ID NO: 311084 - DNA, 75 bp, Artificial Sequence
  Synthetic
ggttcaagacagaacagagctgtcgtcacgaaatcagttgaaccagaagtactaaggttagtgcttgatattgga

SEQ ID NO: 311085 - DNA, 75 bp, Artificial Sequence
  Synthetic
attaagtcacaagtatcaaaaaacccattagcaaatatgctccaagtcgatacagcgaaaatggaacaacagatt

SEQ ID NO: 311086 - DNA, 75 bp, Artificial Sequence
  Synthetic
gagccggctgatgacccattcgcaaatttaagagtaaatctacttgcaccaggtggagcaacgaataatactggt

SEQ ID NO: 311087 - DNA, 75 bp, Artificial Sequence
  Synthetic
ggagggtatcatgcacttgttggaagagctactggaaagatggctgtcgtaactgcagttcaagggagaccagga

SEQ ID NO: 311088 - DNA, 75 bp, Artificial Sequence
  Synthetic
ggaatcaatttcgcactcgatatgaaagtaccatgttcaggagtaatgacagccatatatttacctgcaccaggt

SEQ ID NO: 311089 - DNA, 75 bp, Artificial Sequence
  Synthetic
gaattgcaattgtctttgggaaatcagcctccaaataatatacctgtccacgctcaatgcgttgatgtatcaaca

SEQ ID NO: 311090 - DNA, 75 bp, Artificial Sequence
  Synthetic
acattcaatttcccgctatgtgacagagtgaatataatgattgagccatggaacgctaataagcaagcaaataac

SEQ ID NO: 311091 - DNA, 75 bp, Artificial Sequence
  Synthetic
aatgctaattttaataattggcctgccggtactgcacagaggcaaccaactgtttcgctcatgattactatccca

SEQ ID NO: 311092 - DNA, 75 bp, Artificial Sequence
  Synthetic
tccgccgtttctcttactgattatgataccaattcaccatacctcgcaaagccaacttatctaatgggcacagta

SEQ ID NO: 311093 - DNA, 75 bp, Artificial Sequence
  Synthetic
caccaccaaacgttctttggactatgaattcactactatcaaaagcgccaccacaactagttcattggtccagaa

SEQ ID NO: 311094 - DNA, 75 bp, Artificial Sequence
  Synthetic
agccatatatttacctgcaccaggtgagttgcaattgtctctagggaatcagcctccaaataatatacctgttca

SEQ ID NO: 311095 - DNA, 75 bp, Artificial Sequence
  Synthetic
atgggtaatacttacaacgttcacaacaatcaacaagtatcctctaacacagttcacggatcgggacagatacat

SEQ ID NO: 311096 - DNA, 75 bp, Artificial Sequence
  Synthetic
agtgaagatcagaaaacaagttcacaaatcacaacaatcgtccagttttcaaatttatcactactttttctaatt

SEQ ID NO: 311097 - DNA, 75 bp, Artificial Sequence
  Synthetic
gctcttttcttgtttataagtttattgtttaagtgtgataaaaatcgaaagaaacaaaaatggaatacccgggaa

SEQ ID NO: 311098 - DNA, 75 bp, Artificial Sequence
  Synthetic
attatcgaactatgagagatctatctccaaatcatagattattagttactgatgaatgtagaattttgaacaatt

SEQ ID NO: 311099 - DNA, 75 bp, Artificial Sequence
  Synthetic
taaatttggatccaaaaattgcaagtgatttgaatatattaataccatgtggagtgcatttgcaaaagagtggaa

SEQ ID NO: 311100 - DNA, 75 bp, Artificial Sequence
  Synthetic
tgatttgaatatattaataccatgtggagtgcatttgcaaaagagtggaaatgtcatgattgaagtcgttgaaac

SEQ ID NO: 311101 - DNA, 75 bp, Artificial Sequence
  Synthetic
tgaggagtgtatttgcggaaatagaataccaactaaggtcataaccaattcgatagaacaccaaattattacatt

SEQ ID NO: 311102 - DNA, 75 bp, Artificial Sequence
  Synthetic
atgcactaatgaaatatacaccataatttacaatgaaaatagtggtaaatgtgagtgtggtaaacaattgtttga

SEQ ID NO: 311103 - DNA, 75 bp, Artificial Sequence
  Synthetic
cgttgaaccagctgaaggatatggtgggaatggatggtgcatttcctcaaaaaaatgtttaaaatgtacttcagt

SEQ ID NO: 311104 - DNA, 75 bp, Artificial Sequence
  Synthetic
ggatgaaatcattggtattcttttcgaaaatggatttcagagagatgaaatatatttcagaccaacaaatcaaat

SEQ ID NO: 311105 - DNA, 75 bp, Artificial Sequence
  Synthetic
tatatttcagaccaacaaatcaaatcaaattaaatagtttcaacatgattccaacactaaagcttgaggatgagt

SEQ ID NO: 311106 - DNA, 75 bp, Artificial Sequence
  Synthetic
ggcaacgagatttaacggcagaaaatgttgaatccaatccagggccaataatgctgacaggtgatagaagttatt

SEQ ID NO: 311107 - DNA, 75 bp, Artificial Sequence
  Synthetic
ttaatgcagcaaatacttttatctggctttcatttaaacaagacataccgttctatccctggtatgatgatttga

SEQ ID NO: 311108 - DNA, 75 bp, Artificial Sequence
  Synthetic
aatcaccaatagctgtgttgaatgattacataccaacgggaaaaagaaattatataacatggaagcagaaaggct

SEQ ID NO: 311109 - DNA, 75 bp, Artificial Sequence
  Synthetic
tttgttatagcaccaaattcaatattgcaattggacaaacgaaagataagtacgtttgcattcgtaaatcaaatt

SEQ ID NO: 311110 - DNA, 75 bp, Artificial Sequence
  Synthetic
ctggtcagtggttcacttatatggaagataagatcattataggcaaaccaacagattttgttccaagtgtaaagg

SEQ ID NO: 311111 - DNA, 75 bp, Artificial Sequence
  Synthetic
gttggattagagatcttacagctgaaggcattgaatcaaatccaggaccaaattacatatcattgttgaatgaac

SEQ ID NO: 311112 - DNA, 75 bp, Artificial Sequence
  Synthetic
acgctcaaaaaaataagaatcaatttccaaattattcatttgagatgataataatagataatgaaatactattca

SEQ ID NO: 311113 - DNA, 75 bp, Artificial Sequence
  Synthetic
catgcacgtgtaaatacatgcatatcatcgaaacctcaaatccacacaggacaaagaaagaatcaaaaaatgaag

SEQ ID NO: 311114 - DNA, 75 bp, Artificial Sequence
  Synthetic
acctcaaatccacacaggacaaagaaagaatcaaaaaatgaagcggctgaactagttgttcgtattattgagtaa

SEQ ID NO: 311115 - DNA, 75 bp, Artificial Sequence
  Synthetic
atggcgaaattgctaacagtatctgaaaaaggtaagctactgttggacaacgaagatattttcaaattatctaac

SEQ ID NO: 311116 - DNA, 75 bp, Artificial Sequence
  Synthetic
cgaagatattttcaaattatctaacagtttagaagaatatattgaaataaatccatcagaagaagcaaggaaatt

SEQ ID NO: 311117 - DNA, 75 bp, Artificial Sequence
  Synthetic
attggataacactttttatacagttatagataaaaatgaaaatcagcaactttttaaagttattagcgatcttta

SEQ ID NO: 311118 - DNA, 75 bp, Artificial Sequence
  Synthetic
tccttcttcagtttataaagacattgacaaaagctggaaagtcggtttttgcaatcatcttacaagtaatgttgt

SEQ ID NO: 311119 - DNA, 75 bp, Artificial Sequence
  Synthetic
gacaaaagctggaaagtcggtttttgcaatcatcttacaagtaatgttgtgcattgtagcaatagttatattttt

SEQ ID NO: 311120 - DNA, 75 bp, Artificial Sequence
  Synthetic
gcaatcatcttacaagtaatgttgtgcattgtagcaatagttatatttttcactatgaagatgatcttaaaactt

SEQ ID NO: 311121 - DNA, 75 bp, Artificial Sequence
  Synthetic
atttacctagtggatggagttttttacacaaggatgacatcgatgtttcaattggagaccatatactcactatgt

SEQ ID NO: 311122 - DNA, 75 bp, Artificial Sequence
  Synthetic
tatttgacaggctcaacgatcatactattcagtcttttaacgagtttaggaaaagtaatcctgactcattaccaa

SEQ ID NO: 311123 - DNA, 75 bp, Artificial Sequence
  Synthetic
aaaagtaatcctgactcattaccaaaatgcttaaaatccgagaacgaaaagaatgattgtatgatatctgtgtta

SEQ ID NO: 311124 - DNA, 75 bp, Artificial Sequence
  Synthetic
aaggatatttgcaagcaacctgatgacaacaatttcactgagacatttatatatggattagatagaaagttggct

SEQ ID NO: 311125 - DNA, 75 bp, Artificial Sequence
  Synthetic
ggtaatatattacgaaacacatcgttcaaaatattcaataggaacgtgtcagttattgggccagaactagaaagt

SEQ ID NO: 311126 - DNA, 75 bp, Artificial Sequence
  Synthetic
ttaaaaaatatagttaatcattattataatggatatgatgtagaattgttcaccatgtcaacagaaaaaaagaga

SEQ ID NO: 311127 - DNA, 75 bp, Artificial Sequence
  Synthetic
acatacaggcaaaatattgactggatgaaacagactaaactgacattcaaattagcaatgtcttcacaaaataag

SEQ ID NO: 311128 - DNA, 75 bp, Artificial Sequence
  Synthetic
aatgagcataactttttgaaaggactaattgcacattgtaagaaatttggatttccaagtagaatattatactta

SEQ ID NO: 311129 - DNA, 75 bp, Artificial Sequence
  Synthetic
ggaagctatccatctttctggttagagaacattccatggttccccgcaatgatacattgctatgatccaaagtat

SEQ ID NO: 311130 - DNA, 75 bp, Artificial Sequence
  Synthetic
aggcagacaaatttgaagtatgtaaaatggcatacaactgaattcacagtaaaagattgttcagccattattagt

SEQ ID NO: 311131 - DNA, 75 bp, Artificial Sequence
  Synthetic
aaaagattgttcagccattattagtaacacatatgtatacatagacattcgtactgatataagaggtatgtctga

SEQ ID NO: 311132 - DNA, 75 bp, Artificial Sequence
  Synthetic
agatgctttcatcagagaagacaatatgataacggatattgcaatggaaatatcgagtaaaccttcatgctcagt

SEQ ID NO: 311133 - DNA, 75 bp, Artificial Sequence
  Synthetic
atgataacggatattgcaatggaaatatcgagtaaaccttcatgctcagtctttttcaaacgtaaggttctttca

SEQ ID NO: 311134 - DNA, 75 bp, Artificial Sequence
  Synthetic
gataatttcactttcaatgatccaatatacccaccagattcgattcattttggaaaagaatattacaattacatg

SEQ ID NO: 311135 - DNA, 75 bp, Artificial Sequence
  Synthetic
tctggagtaacaaacaaaagaaaaatatcaaaggaagacctttttagtggtataaacagtgccataactgagaat

SEQ ID NO: 311136 - DNA, 75 bp, Artificial Sequence
  Synthetic
attccacattatatatataatggaacagtttatattgggaattcaaaatatccaataataggattgtattcacta

SEQ ID NO: 311137 - DNA, 75 bp, Artificial Sequence
  Synthetic
cagtttatattgggaattcaaaatatccaataataggattgtattcactatcaaataaatttaacaatatatcca

SEQ ID NO: 311138 - DNA, 75 bp, Artificial Sequence
  Synthetic
ttatagaagagacattaaggaataaagatgaatttataattacttttccagtgcagaaatttcagaattggagag

SEQ ID NO: 311139 - DNA, 75 bp, Artificial Sequence
  Synthetic
agatgaatttataattacttttccagtgcagaaatttcagaattggagagacataaaactgcacgatgagccgtt

SEQ ID NO: 311140 - DNA, 75 bp, Artificial Sequence
  Synthetic
taatggctatgtacatcaaggaaaatatattgatcacactattagtccaaaagcaatctccagcaaatttaagat

SEQ ID NO: 311141 - DNA, 75 bp, Artificial Sequence
  Synthetic
tgaagtagtttcagaagaagtatttgtctcaattttagatggtagaataaacatgcctacaaatttcctacatat

SEQ ID NO: 311142 - DNA, 75 bp, Artificial Sequence
  Synthetic
ggtaacgttcaaattcaagtggagagacttcttttcagatagatattttcaacatataggtatacgacaaccatc

SEQ ID NO: 311143 - DNA, 75 bp, Artificial Sequence
  Synthetic
tatatatgctagagataggttcagagtatcgagaattacagcatatataaataggcaattaactcattcaagcga

SEQ ID NO: 311144 - DNA, 75 bp, Artificial Sequence
  Synthetic
catgtcaaaacttgaaaagaataattttgaaggatattcaggacatttaatagctgttgaacagtttttcaattc

SEQ ID NO: 311145 - DNA, 75 bp, Artificial Sequence
  Synthetic
tagctgttgaacagtttttcaattcattggtatatactatgtcaccatacagatggatgatacgttcaatacatc

SEQ ID NO: 311146 - DNA, 75 bp, Artificial Sequence
  Synthetic
attggtatatactatgtcaccatacagatggatgatacgttcaatacatcaaatcaggaaaaaagaaacatccaa

SEQ ID NO: 311147 - DNA, 75 bp, Artificial Sequence
  Synthetic
atatcgcattggaagattccaacaacattctgaacaagaatacattaacacgtacgagtatttagaaaagctagg

SEQ ID NO: 311148 - DNA, 75 bp, Artificial Sequence
  Synthetic
gaacaagaatacattaacacgtacgagtatttagaaaagctaggcattgatccactgcacaaaaaattacagtga

SEQ ID NO: 311149 - DNA, 75 bp, Artificial Sequence
  Synthetic
atgtggtttctactactgctgcctatcgtatcatccacagttgtaatacaggaatataaaccagtagacgtttgt

SEQ ID NO: 311150 - DNA, 75 bp, Artificial Sequence
  Synthetic
atatttgtatacgcatcatctggagataatagttcagcttattatgcttttcatacttggatgcaacgtttacag

SEQ ID NO: 311151 - DNA, 75 bp, Artificial Sequence
  Synthetic
ccagtactggcaacgacgtatcatgtatgtggtgttcaagcagtggactcagtggatgtaattaaagcagtggca

SEQ ID NO: 311152 - DNA, 75 bp, Artificial Sequence
  Synthetic
gaatgtagctgtttaaatgataaattaaccgatgtaaatattgtgtattcagatgaaccacaatctactttagct

SEQ ID NO: 311153 - DNA, 75 bp, Artificial Sequence
  Synthetic
acatttattggcaaccagaacacatgtactaaattgcaagttcgaaaagcagcgtatatacatttaaataaatct

SEQ ID NO: 311154 - DNA, 75 bp, Artificial Sequence
  Synthetic
gaagaattttttatctatggaaaaagggatttaaaactttgttttttaagtagtagttatcttggattggattgt

SEQ ID NO: 311155 - DNA, 75 bp, Artificial Sequence
  Synthetic
gactccgccaatccaaccacctggccgaccatagattacaatattcagtcaataatccatgaaaaaccaataata

SEQ ID NO: 311156 - DNA, 75 bp, Artificial Sequence
  Synthetic
tatgatattcctgaaattacctatgctgtaggtatatatcctgaagcagatccaacctacatttgtaagagagta

SEQ ID NO: 311157 - DNA, 75 bp, Artificial Sequence
  Synthetic
gatgacaatggtataaatccaacatatttctttgctggggataactctattcaatggggagatcaaatggcacgt

SEQ ID NO: 311158 - DNA, 75 bp, Artificial Sequence
  Synthetic
gaaattaactggggaaacgtatggaataaagtagtaagcgtatcacaagccttgtacaagattctagatctattt

SEQ ID NO: 311159 - DNA, 75 bp, Artificial Sequence
  Synthetic
gccttgtacaagattctagatctattttttaacgagaaagaaagaattgaacaacaaccaaggtacgaactgtga

SEQ ID NO: 311160 - DNA, 75 bp, Artificial Sequence
  Synthetic
atggctcaacttgttatttcagctctttccggtattctctcaaatgaacaattagctagagttcaagatgttatg

SEQ ID NO: 311161 - DNA, 75 bp, Artificial Sequence
  Synthetic
aatgacactggagtaactgagaccctaaataaatatgaagaagcatataatggtaagtggtttccagttggaaca

SEQ ID NO: 311162 - DNA, 75 bp, Artificial Sequence
  Synthetic
catttttcaactaaatgtaagattaagaacttggaatgcgacatggtaaagcttagaagcatgcttttcgataga

SEQ ID NO: 311163 - DNA, 75 bp, Artificial Sequence
  Synthetic
ggcatcaacagagagcaacgtgcgctaagagacttctctattgagaaaaacaaacttggacacactatactagtt

SEQ ID NO: 311164 - DNA, 75 bp, Artificial Sequence
  Synthetic
ccaaagactaaattggctgagttaatgattgcaaacacaaaagatcctgggtataaactgaacgctgttccatgc

SEQ ID NO: 311165 - DNA, 75 bp, Artificial Sequence
  Synthetic
gaacaatttgaagagacgttgaagaagttgaatgaggctgaggaaactatttcaaatttgaaagttcaacttaat

SEQ ID NO: 311166 - DNA, 75 bp, Artificial Sequence
  Synthetic
caatgtaaaatggatttggttacattgtctgaaaaaaacatgatgttaaaaatggctaacaattctttgaaagag

SEQ ID NO: 311167 - DNA, 75 bp, Artificial Sequence
  Synthetic
gacgtggaggaaaatgatcaatatactgactatctggaaaatttagttcgcagattggccgaatctcaaaatctt

SEQ ID NO: 311168 - DNA, 75 bp, Artificial Sequence
  Synthetic
gaagcttattatgaagaggaccacacaggctttttaaattttggagccgacgatatactagaaggatttagacct

SEQ ID NO: 311169 - DNA, 75 bp, Artificial Sequence
  Synthetic
gaaattcaaattgattgtggtgatccagacgaagtttttttctctgatgatgatgatttcacgtttggatcagta

SEQ ID NO: 311170 - DNA, 75 bp, Artificial Sequence
  Synthetic
tttggatcagtagacaaacatcttatagaaaatttggagggtaaaaatgtatctaatcaagaagttgtgatttag

SEQ ID NO: 311171 - DNA, 75 bp, Artificial Sequence
  Synthetic
atggcgctgaaactgagtttatctgactttgtgacaagaaatgacgatggtaacttcattccaagtgacttgagt

SEQ ID NO: 311172 - DNA, 75 bp, Artificial Sequence
  Synthetic
ggagaacctctgagtagatacatgactaaagatgaaaaatcagttagagatgatttgaaagcagaaaaaggacca

SEQ ID NO: 311173 - DNA, 75 bp, Artificial Sequence
  Synthetic
agagggaaaatcagagttaaacttttccttatgcaatcttgcaaactaagaaggacacagaaaggtattgttcct

SEQ ID NO: 311174 - DNA, 75 bp, Artificial Sequence
  Synthetic
cttaatgaactaaaatctggaaacaatccaacatctactttgaaagctctttttacaccatggttgcttaatcta

SEQ ID NO: 311175 - DNA, 75 bp, Artificial Sequence
  Synthetic
cttaatgatgaagaaactcaagaacaagtgattgcttacatggaagataaatttgaggatatttttgtttcttct

SEQ ID NO: 311176 - DNA, 75 bp, Artificial Sequence
  Synthetic
gacaaattggccagagtttgtcttagacttgaggataaagacgatattattcacacagatccagagttggcagtt

SEQ ID NO: 311177 - DNA, 75 bp, Artificial Sequence
  Synthetic
aaaacatttttttgcatgtgtaatgcaatgaattcaacaatcgcaacagaagggaaatgtgaaatcatcagagca

SEQ ID NO: 311178 - DNA, 75 bp, Artificial Sequence
  Synthetic
actgaagatggaataattgttaaatttgatcctctacctgaaaattttacggtcggtaaatcgaaaggcactttt

SEQ ID NO: 311179 - DNA, 75 bp, Artificial Sequence
  Synthetic
tttaagatgtttccagttaataaagacactattccagttcaagcattcaaagcactatcttatgttagtgggaga

SEQ ID NO: 311180 - DNA, 75 bp, Artificial Sequence
  Synthetic
gatattgtcatgtatcatgggcgaggacatgtaagaacagttccttttaatgaaattcttggatgtatttacgga

SEQ ID NO: 311181 - DNA, 75 bp, Artificial Sequence
  Synthetic
ctatcaaataaatcaaaagatgatttaatgaaaattaagtctgatcctctttgttcagcttctggtgaaaagatg

SEQ ID NO: 311182 - DNA, 75 bp, Artificial Sequence
  Synthetic
gttgcaatagcggatatgctgatttcaggtgaaaaaccacaggaagtacttcgacgagtgactgtaagagcgcaa

SEQ ID NO: 311183 - DNA, 75 bp, Artificial Sequence
  Synthetic
atagcggatatgctgatttcaggtgaaaaaccacaggaagtacttcgacgagtgactgtaagagcgcaaaaatag

SEQ ID NO: 311184 - DNA, 75 bp, Artificial Sequence
  Synthetic
atggatctagttgagtgcattaacggcattattacattgaaagaaagagtaagaaaactagcaccaaacgcacca

SEQ ID NO: 311185 - DNA, 75 bp, Artificial Sequence
  Synthetic
ctaacacaggaaggtctagccacattgaatgactataacgctgtagcttcaagctcaaatggtaccacggtcatt

SEQ ID NO: 311186 - DNA, 75 bp, Artificial Sequence
  Synthetic
gtacgcgatgtattagggcaactctctccatttactataaatgctccattgaccccaataaccaacgtactctca

SEQ ID NO: 311187 - DNA, 75 bp, Artificial Sequence
  Synthetic
acagatgtatttgacgacatcaaaagtgggctggagtcaatgcttgaagcattggctggagcagctagatcagaa

SEQ ID NO: 311188 - DNA, 75 bp, Artificial Sequence
  Synthetic
ggatcaagaagaactaaagctataattaccaaagcacaagatccagaagtgaagaaattgatcggtattcttagt

SEQ ID NO: 311189 - DNA, 75 bp, Artificial Sequence
  Synthetic
attaaatctcaactatcaaacaatgtatacgcaaatacaatggaatttgacacagcaagggcagaaaacccgatt

SEQ ID NO: 311190 - DNA, 75 bp, Artificial Sequence
  Synthetic
gttgaaatagataatcctttctttaacgaaaacatacaacattcaaatgttcaaggtgttccaaatgcacatggt

SEQ ID NO: 311191 - DNA, 75 bp, Artificial Sequence
  Synthetic
ggaggatacatttcagtaataggtagagcctcgggaaatcaaatgaccgccacatgtgtagccggaagagatgac

SEQ ID NO: 311192 - DNA, 75 bp, Artificial Sequence
  Synthetic
gcagttgaatgggacattggactacgagttccgacatcaggttctatggcgattaatttccttccaacaccaggt

SEQ ID NO: 311193 - DNA, 75 bp, Artificial Sequence
  Synthetic
agaattttgttgccaagggggaacaggggaccaaatgatattcctaccatagcagactgtgttgatgtgagtgct

SEQ ID NO: 311194 - DNA, 75 bp, Artificial Sequence
  Synthetic
gatgctgatggtgacgatattaccgttcagttcatgctgaataaccagattgtatttacaagagaagcaccaggt

SEQ ID NO: 311195 - DNA, 75 bp, Artificial Sequence
  Synthetic
cagttcagttttccaatgtgcgatagtatccatttcattattagaccatggactgccaacaaaaacaacaatcca

SEQ ID NO: 311196 - DNA, 75 bp, Artificial Sequence
  Synthetic
aatgctctatttgtcaattgggatcagggtggagctcaagcgcaacctacactgtcactactagtaacaatcaca

SEQ ID NO: 311197 - DNA, 75 bp, Artificial Sequence
  Synthetic
aatgcttcagcagtactcgatgcaatggtatcaaatacagatgcagccaaaccaaattatttaatgaacactatc

SEQ ID NO: 311198 - DNA, 75 bp, Artificial Sequence
  Synthetic
tttactcaagattcttttgtgaacacaccaaacatcaactggacgttcctgtctttactgaatgatcaagatcca

SEQ ID NO: 311199 - DNA, 75 bp, Artificial Sequence
  Synthetic
gatcaagatccacagaccgcgccatggtcacgaaaaatagcatcattgatagctgccttcgctgcacaaaactag

SEQ ID NO: 311200 - DNA, 75 bp, Artificial Sequence
  Synthetic
atgtcactaatagggacacttgagaagtacctctcagcacttgaagagataaggacaaaaggaggattacaaaag

SEQ ID NO: 311201 - DNA, 75 bp, Artificial Sequence
  Synthetic
atacacgatgatttgttgcatgaattggatatgtttattgacgatatagatgtcaaagaagaaagagaaaccaaa

SEQ ID NO: 311202 - DNA, 75 bp, Artificial Sequence
  Synthetic
actttatttgaaaaaataaacagaatactaagaaagaaaggcattaaaacaacgccaattgaaaatgaattcaat

SEQ ID NO: 311203 - DNA, 75 bp, Artificial Sequence
  Synthetic
tcaaagaaatttgtagagaagaataacgctgtagaaacagacaatacgaatggaaaaacagatgagactacaatc

SEQ ID NO: 311204 - DNA, 75 bp, Artificial Sequence
  Synthetic
ggaaaggaaaaaggaaatgcggacaccacacaacgtaacgtgaagaatgatgatgaaaaacaacatgacgatagt

SEQ ID NO: 311205 - DNA, 75 bp, Artificial Sequence
  Synthetic
tctagtattaattcatatgttcaaaatgttataaacataagagacattctatcaaagactctattcgttgacact

SEQ ID NO: 311206 - DNA, 75 bp, Artificial Sequence
  Synthetic
gatgcggatgactatgcaatatatcttccatcagaagttccagagtcaataaaaccaattcaaattgatgttata

SEQ ID NO: 311207 - DNA, 75 bp, Artificial Sequence
  Synthetic
cctatcaacatgtttgaaacatttgctaacatgagaaaaatcaacacaataaacatttcccacaatgacttgata

SEQ ID NO: 311208 - DNA, 75 bp, Artificial Sequence
  Synthetic
tctgacacatatggtccagcagagatactgtacgacagtatatttttctcggatatggaccttgaaaaatatggc

SEQ ID NO: 311209 - DNA, 75 bp, Artificial Sequence
  Synthetic
aacattgaaaaatactttttatataaggcttcaaatgtatcacggaaattaccaaatgttgactatatgactgaa

SEQ ID NO: 311210 - DNA, 75 bp, Artificial Sequence
  Synthetic
tgcacaaaaattccgaatccatataacagtgacaatacgattacaacgatgtttggacaaggaacatattatgat

SEQ ID NO: 311211 - DNA, 75 bp, Artificial Sequence
  Synthetic
atgctgatggatcgcacagacaagagtttagtcggaagaagaactgatgctcaatatgatgatatttctgttgat

SEQ ID NO: 311212 - DNA, 75 bp, Artificial Sequence
  Synthetic
gctataaataggcagatatctatatcattacggatacatccagtagatgatcaattacttaatatagctatgaac

SEQ ID NO: 311213 - DNA, 75 bp, Artificial Sequence
  Synthetic
aattgtattcaaacacaaccattacaaccagttttgaatgaatatattatgatagcagctgatggatatgttgca

SEQ ID NO: 311214 - DNA, 75 bp, Artificial Sequence
  Synthetic
tctccaaaaaaacgttatgacagaaatacattaactatatcaaatgttttctcaccagtttttaatagattatgt

SEQ ID NO: 311215 - DNA, 75 bp, Artificial Sequence
  Synthetic
gtattatcaggtacaacatatagagccagaactttgcaatccatgacttttatgtcgaggctatggaagaccaac

SEQ ID NO: 311216 - DNA, 75 bp, Artificial Sequence
  Synthetic
gtttttaaaacatcgctggaagatgatatagctaaaatgtacgctggagctgaaatctcaatgactacaattgat

SEQ ID NO: 311217 - DNA, 75 bp, Artificial Sequence
  Synthetic
ggaacgacagctagtcttgccacaataaatatttctgcagctgaacaagctttaataggtatactaaatgcttca

SEQ ID NO: 311218 - DNA, 75 bp, Artificial Sequence
  Synthetic
ttttttagatttgattttaatttaacaggacctcaaaattctctaggagctgcggtatcagcactaatagcatta

SEQ ID NO: 311219 - DNA, 75 bp, Artificial Sequence
  Synthetic
atagtgttaccaattgatcaagatacaatggacaatgacacatatgatatgttgtgtaacactgtttttaatgaa

SEQ ID NO: 311220 - DNA, 75 bp, Artificial Sequence
  Synthetic
atgatggccaatgcaatgaatttgccagcgtttgtgcgaagagcgggagatgaaaacgcatttagacggtatgtt

SEQ ID NO: 311221 - DNA, 75 bp, Artificial Sequence
  Synthetic
aatggaccaattccaagagaagcttctgcatttatcagattcattttgttgcggcgaggatggttgctcttccag

SEQ ID NO: 311222 - DNA, 75 bp, Artificial Sequence
  Synthetic
agatcagatgacagaacaattcactgcgatatcttggtaccaaactgtgatactcaaaatgtgaatgatcagcca

SEQ ID NO: 311223 - DNA, 75 bp, Artificial Sequence
  Synthetic
tatgttttactttcagacttttttgctgcaatattggagtcttctagacgtaatccaaatccaggaaaaaataca

SEQ ID NO: 311224 - DNA, 75 bp, Artificial Sequence
  Synthetic
tctgctaattcatttagaagactcattcggggactaagagatattgtctgtaataaaataatgccaaccatgagg

SEQ ID NO: 311225 - DNA, 75 bp, Artificial Sequence
  Synthetic
ttaatcaggtataatatagaaagaatagctagaattcaaaatatgttaccatattctgctgatcttgcattagtc

SEQ ID NO: 311226 - DNA, 75 bp, Artificial Sequence
  Synthetic
aacccctctttaagagacgaaagattgagggcaaacattccattatcaggttttttatcattgttaatgggaata

SEQ ID NO: 311227 - DNA, 75 bp, Artificial Sequence
  Synthetic
tcaaaagcaccagatgcatttgattggacaacggttttaacattttgtgattcaatgcgaaaattaaactatgct

SEQ ID NO: 311228 - DNA, 75 bp, Artificial Sequence
  Synthetic
gagacgatatcagtagaggaggctttgactgttgctatctcgtcacatgatattgacaaatcagtatcaaaaaaa

SEQ ID NO: 311229 - DNA, 75 bp, Artificial Sequence
  Synthetic
gatattataaaagatgtattgcacgcaccaacctctgccgtagctgcgattacaaaagttccatcagcatcactt

SEQ ID NO: 311230 - DNA, 75 bp, Artificial Sequence
  Synthetic
tctgcattgctgtcagatacagttttgattaacttggtaaaaaattcaagaccatttaggaagattatagacata

SEQ ID NO: 311231 - DNA, 75 bp, Artificial Sequence
  Synthetic
gtaaaagttttgaaagcagcctttcagcattcaccaacagcaagctatggagtagttaaaggcgctttattaatg

SEQ ID NO: 311232 - DNA, 75 bp, Artificial Sequence
  Synthetic
tcatcacctcaaaactttagaagatcatctcagtatgttaaaagagataatgtaatacatagtgttgtggatggc

SEQ ID NO: 311233 - DNA, 75 bp, Artificial Sequence
  Synthetic
attcagaagtttaaggcggaagatttggttaaaggcaaccactttcctggtctaattaattcaataaaaaatggc

SEQ ID NO: 311234 - DNA, 75 bp, Artificial Sequence
  Synthetic
gatgatatatatatagaaggacctttaccagtgagaacatcacattcatcggaggttgctaccgcttctttcgct

SEQ ID NO: 311235 - DNA, 75 bp, Artificial Sequence
  Synthetic
ttcttaacaatgaactcaccgtatgatgccttcattgacccaactgacctacaacatcaaagactaataaaagtc

SEQ ID NO: 311236 - DNA, 75 bp, Artificial Sequence
  Synthetic
agagcagtagaccatttttcagattcgtcaattgacatgataccatcgaaatttgacaatttgttggctaaaacg

SEQ ID NO: 311237 - DNA, 75 bp, Artificial Sequence
  Synthetic
tcagtgttcgtgcatgatgcacaaaatttaatggtacagtcaaaatcaacagtgagacgatttaactatcatgaa

SEQ ID NO: 311238 - DNA, 75 bp, Artificial Sequence
  Synthetic
tcactattacatattgatgtagcaaatctaattgatttttcagttgctctgccaactgaattacaactgttcgat

SEQ ID NO: 311239 - DNA, 75 bp, Artificial Sequence
  Synthetic
aatctaattgatttttcagttgctctgccaactgaattacaactgttcgatggaacattagtttatgatgtataa

SEQ ID NO: 311240 - DNA, 75 bp, Artificial Sequence
  Synthetic
atggcagacgattccagcttcaccttgacgagaaagaaaactaataaaaaagagaaagaaaaaaacgtcacaaga

SEQ ID NO: 311241 - DNA, 75 bp, Artificial Sequence
  Synthetic
ggtcaaagaatgaactttgaagaagaagacgtttcagtggctggtgagacagatactaagagcattgccacagaa

SEQ ID NO: 311242 - DNA, 75 bp, Artificial Sequence
  Synthetic
tcagagtcatctacacattcatatgaagactatgaaagagcatatagagaactaacaaaagattcaagctcagag

SEQ ID NO: 311243 - DNA, 75 bp, Artificial Sequence
  Synthetic
caaattagccttaccagtactactgctgaacagaaaaacctttctcgatctgatgaacggaaaaatgtttgcgat

SEQ ID NO: 311244 - DNA, 75 bp, Artificial Sequence
  Synthetic
ccaacgttgaatctattgatctcacaaatgaaagctgaaattgatcaattgaaagtcaaagtaagtgatcaaagt

SEQ ID NO: 311245 - DNA, 75 bp, Artificial Sequence
  Synthetic
aaatgaaagctgaaattgatcaattgaaagtcaaagtaagtgatcaaagtctagataatgcttacaataaagttc

SEQ ID NO: 311246 - DNA, 75 bp, Artificial Sequence
  Synthetic
cttgcaaacgtagaaattttgacctcatcacaaaagaaggctctgctaatggcgctagcatcctcaatgaaataa

SEQ ID NO: 311247 - DNA, 75 bp, Artificial Sequence
  Synthetic
atgtcggaaaaggaatatctagactggctgtctagctcaatattccgaaaccttttatacacttctttagtttac

SEQ ID NO: 311248 - DNA, 75 bp, Artificial Sequence
  Synthetic
acgaatgctagaattggaattgttgaattaaatagagatcaaaaagatttcagatctagggaaacaacagtatta

SEQ ID NO: 311249 - DNA, 75 bp, Artificial Sequence
  Synthetic
tctccaattgatgcaattcaaaatattaaagatagaataacagatgatattacattaagtttaaagaatttatta

SEQ ID NO: 311250 - DNA, 75 bp, Artificial Sequence
  Synthetic
aggatacgttatcttaccgtctatgtagaagataaatcagataaaagagttctagttgctaaacagattgacact

SEQ ID NO: 311251 - DNA, 75 bp, Artificial Sequence
  Synthetic
gttttgtcccagttgaaacagagaggcgcatcaactgatacaataaatattcatgtagatcaaatatcgttggag

SEQ ID NO: 311252 - DNA, 75 bp, Artificial Sequence
  Synthetic
gcgcatcaactgatacaataaatattcatgtagatcaaatatcgttggaggctaagaagttaagagtgaaagagt

SEQ ID NO: 311253 - DNA, 75 bp, Artificial Sequence
  Synthetic
ctcaaaaaatgcgtccatatcatactgatcagacggtttcaaatttcttcactatgaaccaatttgaatttgttg

SEQ ID NO: 311254 - DNA, 75 bp, Artificial Sequence
  Synthetic
aaggagcagatccatataaatggaggtcagacacccttgaaggaatgataccgcatttcaatcatagaacacata

SEQ ID NO: 311255 - DNA, 75 bp, Artificial Sequence
  Synthetic
ctctaatatcgtcggtaatatttgctgttatgtcacgtcttgaaaagtatcacagagaacaactcgatgttatat

SEQ ID NO: 311256 - DNA, 75 bp, Artificial Sequence
  Synthetic
actggttgatgttaaaagtaaaacagaaatttgatgatgggtatttagagctatctagaaatagaaaatggaata

SEQ ID NO: 311257 - DNA, 75 bp, Artificial Sequence
  Synthetic
tatcgtatggtgatttatcgacatcaaagattaaaatatattcagccaaaatcatgcacgcagcattggcgatga

SEQ ID NO: 311258 - DNA, 75 bp, Artificial Sequence
  Synthetic
tatcaattgccaattcaactgacgtcatacattattttttaccacagattattgctgtttttgaaatcataccat

SEQ ID NO: 311259 - DNA, 75 bp, Artificial Sequence
  Synthetic
ctatagcagctaaacaattgtcatcaccgatgaccatgttcataggtatatgtcaattaaaatcaaatatagttg

SEQ ID NO: 311260 - DNA, 75 bp, Artificial Sequence
  Synthetic
tagctactacaagaccgcatgagtgtgtagctacaccgagagaaaatgtatcacgattatcaaatgatcaaagga

SEQ ID NO: 311261 - DNA, 75 bp, Artificial Sequence
  Synthetic
aacaatggaaagatgaaagggaggattacccatttacatcaagtttaatgttttcagagatgataaaaaatgtag

SEQ ID NO: 311262 - DNA, 75 bp, Artificial Sequence
  Synthetic
ataacgttcaaatagatacatttaggcgtatatttaactcattttcagctacttttcacgtaggccacagaatag

SEQ ID NO: 311263 - DNA, 75 bp, Artificial Sequence
  Synthetic
ataacgctcaagacgctatagaggatcaagtgtcggtgaaatatacatcagaagttgatagagagatgtacgatc

SEQ ID NO: 311264 - DNA, 75 bp, Artificial Sequence
  Synthetic
aatactatcatcagttgaagaacatgttcaaaattgaaatatcaagatatctagaatacatgaagaaatacaata

SEQ ID NO: 311265 - DNA, 75 bp, Artificial Sequence
  Synthetic
acgacgcaacagctcaatcaatgtctgctttagctaattcgtctaatggattctcaaaagaagtaactttcatcg

SEQ ID NO: 311266 - DNA, 75 bp, Artificial Sequence
  Synthetic
acaggaaaataaatacaacaaagaaaatgttacatatggatgacgatttgttgaaacaagatttttcaaacgtta

SEQ ID NO: 311267 - DNA, 75 bp, Artificial Sequence
  Synthetic
gagaaattatagaaagaggcattccaatgggaaccagaaacgtcccagccagacaaactagaggtatatttattt

SEQ ID NO: 311268 - DNA, 75 bp, Artificial Sequence
  Synthetic
taccatggcaggtagctgtgatacagcatacaatagctgaatcaatgtattcacatgcaaagaaaggtgattatg

SEQ ID NO: 311269 - DNA, 75 bp, Artificial Sequence
  Synthetic
gcgctacgtttgctgaagcatatactgcaaaagcatctaccttaacatatggagtgttagcacaagcaacatcga

SEQ ID NO: 311270 - DNA, 75 bp, Artificial Sequence
  Synthetic
atgctgagcaatttatattatatacggacgtgtctcagtgggatgcctcacaacataatacagaaccatatagat

SEQ ID NO: 311271 - DNA, 75 bp, Artificial Sequence
  Synthetic
cagcgtggattaacgcgatagatgaagtcagacaagagaaaaatatagatagaaaggcagaaccgattgtactgg

SEQ ID NO: 311272 - DNA, 75 bp, Artificial Sequence
  Synthetic
gtatgaatgtactagataagatgatggacattcagaaagcactattgaactcaaatctaatcttgacttcacgtg

SEQ ID NO: 311273 - DNA, 75 bp, Artificial Sequence
  Synthetic
gttcgcaaagagaggacaaaaaaattagataccatggagtcgcttcaggagaaaaaacaactaaaattggaaact

SEQ ID NO: 311274 - DNA, 75 bp, Artificial Sequence
  Synthetic
cttttgctaatgtatcactcattacaactgttttaaagaaaacaatacagaaatatccgcagatacgagttacac

SEQ ID NO: 311275 - DNA, 75 bp, Artificial Sequence
  Synthetic
atactagagttgatggagatgataacgtagtaactatgtactataatgattcaatgcaactgttacaagaagaaa

SEQ ID NO: 311276 - DNA, 75 bp, Artificial Sequence
  Synthetic
taaagaaaaattatgggttgatgaatgcgcgtgttaaggcattggcatcatatactgggttagagatggcaaaaa

SEQ ID NO: 311277 - DNA, 75 bp, Artificial Sequence
  Synthetic
gattcatcatatgtggaaaaatattcgaaagaggtgctatatcaatatttacagctgagagaccgtatggtacag

SEQ ID NO: 311278 - DNA, 75 bp, Artificial Sequence
  Synthetic
acagatcagatcaagctattacagggtcattattatactcagcgtcagttaatgcttaccgtggatttggagacg

SEQ ID NO: 311279 - DNA, 75 bp, Artificial Sequence
  Synthetic
aatatttacatttcatgcaagatgtattaattccaccatcagcctccataagaatatccggtagactgcgactgt

SEQ ID NO: 311280 - DNA, 75 bp, Artificial Sequence
  Synthetic
tattatcgccagtgactttattttcaacgggtccactatctttcgaagtgacaccagctgggcttggtggaagaa

SEQ ID NO: 311281 - DNA, 75 bp, Artificial Sequence
  Synthetic
tgagactatttacaaattcagaggaaataatgacgttgtataaaagtttgtccgaagcaacgatggtgtcagtag

SEQ ID NO: 311282 - DNA, 75 bp, Artificial Sequence
  Synthetic
aacctgaagaaataaatttatattcaaaaacagatatgtttaacaatagaatgacgataatgacagaggctgtaa

SEQ ID NO: 311283 - DNA, 75 bp, Artificial Sequence
  Synthetic
aaaataatatgaaatctgaaccacaatcagtgttgaagatcatcagagaaaaggaacgtcaaaaaacattaggaa

SEQ ID NO: 311284 - DNA, 75 bp, Artificial Sequence
  Synthetic
ttccaaatgttcagacaacaaaaaacagaatgcagaatgaaaagacaaagaaaaacttggcaattatagaaagca

SEQ ID NO: 311285 - DNA, 75 bp, Artificial Sequence
  Synthetic
aattaccgatagtaagaaaatttttcccggaagaattatttatgctgattaaatcaatgtgtgatataaatcaac

SEQ ID NO: 311286 - DNA, 75 bp, Artificial Sequence
  Synthetic
cacattgtgttgaacatataccaatatatatgtattcatcatcattaatcaagaaactgcactgtcagctagggg

SEQ ID NO: 311287 - DNA, 75 bp, Artificial Sequence
  Synthetic
ttagaatgcatgaatctccgcctttgcacaagccagtaaacattctagttaaaatggttaatgcacactcaccaa

SEQ ID NO: 311288 - DNA, 75 bp, Artificial Sequence
  Synthetic
tagcaatatcaccaagtgatatattcgctgagagtaagaattttgatttaagtacgttttcaggaaagaagaaat

SEQ ID NO: 311289 - DNA, 75 bp, Artificial Sequence
  Synthetic
ttctgatatcattgggtatcgttggtaatgaactaaggtattacttgaattctaaattgttaatgcatgatcttg

SEQ ID NO: 311290 - DNA, 75 bp, Artificial Sequence
  Synthetic
cattagctaaatacgacaaattgtatgaaacgccaggctttggtgcaactcagctgacaactgtaccattcgact

SEQ ID NO: 311291 - DNA, 75 bp, Artificial Sequence
  Synthetic
tacaatctgctgaaagaatatttagactcactctaccaatgcctgcacaatattacgagatactcatgcttctct

SEQ ID NO: 311292 - DNA, 75 bp, Artificial Sequence
  Synthetic
tgacacacgagtacattcattacattgcgaatggcggacagcgatcaacttttattatgcgcacatatcaacaag

SEQ ID NO: 311293 - DNA, 75 bp, Artificial Sequence
  Synthetic
aagagttagcttcaaagatatctttaattatgcgaatgattgataacttgcaattggacaaagtgaattttaaag

SEQ ID NO: 311294 - DNA, 75 bp, Artificial Sequence
  Synthetic
aagatatctttaattatgcgaatgattgataacttgcaattggacaaagtgaattttaaagatgatgtatattag

SEQ ID NO: 311295 - DNA, 75 bp, Artificial Sequence
  Synthetic
atgattgacggacatccagcaatcgaacagccaaagcaaattgaagataattatcaagagtggtttcacaataat

SEQ ID NO: 311296 - DNA, 75 bp, Artificial Sequence
  Synthetic
ttatcaagagtggtttcacaataatttgaacaacgtattaaatggttcttatcaaactatagttgattacacaaa

SEQ ID NO: 311297 - DNA, 75 bp, Artificial Sequence
  Synthetic
ttgaacaacgtattaaatggttcttatcaaactatagttgattacacaaatacgcatagcattgaagaaatttta

SEQ ID NO: 311298 - DNA, 75 bp, Artificial Sequence
  Synthetic
gttaaactaatactgctatttactacacttggagcaacaagaagagcggctagaagtattaaatcattcacgata

SEQ ID NO: 311299 - DNA, 75 bp, Artificial Sequence
  Synthetic
caacacattccgaaactaatatacttgatacgactagtatcggataaattacgcaatactttaagaagagagact

SEQ ID NO: 311300 - DNA, 75 bp, Artificial Sequence
  Synthetic
gatattaaaattgctgaaaacattgatcctctaaaagatagaattgaatgtcttgagaaagaactgaccactagg

SEQ ID NO: 311301 - DNA, 75 bp, Artificial Sequence
  Synthetic
atacttaaaactttggagaaaaatggatatacaactttcacaccttatattcaatcaacagatcgcatgataagc

SEQ ID NO: 311302 - DNA, 75 bp, Artificial Sequence
  Synthetic
gatttaagacaagaacagaggaatttagagagcaaacttaataatttcttagatttcacaaaatttcgcatggat

SEQ ID NO: 311303 - DNA, 75 bp, Artificial Sequence
  Synthetic
gcttttattggtggcagattacatgatataaatatacaacaaataaaccaacaagcggaaaatgtacacaaagcc

SEQ ID NO: 311304 - DNA, 75 bp, Artificial Sequence
  Synthetic
aatgtacacaaagccacttcagtcatagcagcaaacgtcagaagcgaaaacataagaaataagttccgcaattga

SEQ ID NO: 311305 - DNA, 75 bp, Artificial Sequence
  Synthetic
atgttacgttctttgttgacagaaagtgctgaaatgcagttatcagcacaggaagttgcaaacgacataacgaat

SEQ ID NO: 311306 - DNA, 75 bp, Artificial Sequence
  Synthetic
attagaggatacacatataagttatatgacaatgataacacagttgaaaaacaggagatatgttatacaaactat

SEQ ID NO: 311307 - DNA, 75 bp, Artificial Sequence
  Synthetic
atgccggtagatatagaatacagaagagggatggaccatataggaatttcatctggagcagacacacaagctgta

SEQ ID NO: 311308 - DNA, 75 bp, Artificial Sequence
  Synthetic
tatgataactacttttggaaacatgaaggtcaaattgacagagatttaataacttctcaaagaaatcaattaata

SEQ ID NO: 311309 - DNA, 75 bp, Artificial Sequence
  Synthetic
aaatattgtgacgataataatatgtatattattataaagatacaatttttggaaaatgaaacaatactagcagtg

SEQ ID NO: 311310 - DNA, 75 bp, Artificial Sequence
  Synthetic
aatgttagcggtaacgttacatctttgacaggagcaacgtattatagtggagatagtggcacaataaagattatt

SEQ ID NO: 311311 - DNA, 75 bp, Artificial Sequence
  Synthetic
agaaccagtaacaatatactagtgtataatcagcttgagaaaatgcctctaaaaaataaagatccatgtttgttt

SEQ ID NO: 311312 - DNA, 75 bp, Artificial Sequence
  Synthetic
ctagccgcagcattatttgcaaaagacgatacatacgttcatacatcaaaaaaagttatattgcagttaggctat

SEQ ID NO: 311313 - DNA, 75 bp, Artificial Sequence
  Synthetic
tcaagagaaaagaatccagaagaaatgaccgatgtacttccaacgacactaataacatatgatgtagaaaataga

SEQ ID NO: 311314 - DNA, 75 bp, Artificial Sequence
  Synthetic
atgcgaacgagaactgtatctacgagagattttaatccatcattaccatcacatcagattttacagcaaaaagtc

SEQ ID NO: 311315 - DNA, 75 bp, Artificial Sequence
  Synthetic
gaaggattttggaaaattgtatcagaagtatttaatataaagttaaaaataactatagattccagaggaattatg

SEQ ID NO: 311316 - DNA, 75 bp, Artificial Sequence
  Synthetic
ggtgggccatttggagactggctggtcgataattcattcgttactgtggaaaacaaatatacataccagagagat

SEQ ID NO: 311317 - DNA, 75 bp, Artificial Sequence
  Synthetic
aacgagacgataaacgccataactataactacttgctatcctagcgctcaaactggtacagaaaagccatgggca

SEQ ID NO: 311318 - DNA, 75 bp, Artificial Sequence
  Synthetic
tgggcatcagattttaaaggacacgcagtggcattagttccaggtgacatcatagaagtgagatacactgaagac

SEQ ID NO: 311319 - DNA, 75 bp, Artificial Sequence
  Synthetic
aaatggacattggctaattcgttatacgcaaaagatttcgatacagactctcaagcttccttcactgttccaagt

SEQ ID NO: 311320 - DNA, 75 bp, Artificial Sequence
  Synthetic
acaagagaggaagcaaagaatgatccaagtgatattaaattctatatgaattacattccagctttcgcttacata

SEQ ID NO: 311321 - DNA, 75 bp, Artificial Sequence
  Synthetic
aagaactcaactgggatgtcacatttcaaatttcattcaggaggatttacacaaattgatgcgaaaggatatacc

SEQ ID NO: 311322 - DNA, 75 bp, Artificial Sequence
  Synthetic
ggacttgcaatggtgtttagatttaaagctcaagaattcgataaatggaatagtaatattataaatcctgagtac

SEQ ID NO: 311323 - DNA, 75 bp, Artificial Sequence
  Synthetic
ggccatatgttttcaaacataggggatcatggtttaaatacacgacacaatccagcacctggtgctcaaccaggt

SEQ ID NO: 311324 - DNA, 75 bp, Artificial Sequence
  Synthetic
tttcaagcttgttatgctgcaagaaattatgaaattgacatgcgtgttgcgtacacagccttaactccatcggat

SEQ ID NO: 311325 - DNA, 75 bp, Artificial Sequence
  Synthetic
cctgaattcacaaatggatcaacgaattttataagtacggtgacattagatatagaaaagactattgattcttta

SEQ ID NO: 311326 - DNA, 75 bp, Artificial Sequence
  Synthetic
cagcaacatataaataagttacaagcagaagttaacatcggacaggttacgacaggaatatttgaactactaaca

SEQ ID NO: 311327 - DNA, 75 bp, Artificial Sequence
  Synthetic
aatctttacaatttgcctcaaacgcttcaaggatttatgagtacttttagagacattagatcagcgattaaaaaa

SEQ ID NO: 311328 - DNA, 75 bp, Artificial Sequence
  Synthetic
ttctcaaacaaaagaaaagaaatgttgaagggaagaaatagagaagctataaattcaaaatactcattagaaaat

SEQ ID NO: 311329 - DNA, 75 bp, Artificial Sequence
  Synthetic
ttactgtctacaacggatacagcatcattggatgacgatcagctcttgtcactaatgtccaagacttctaatatc

SEQ ID NO: 311330 - DNA, 75 bp, Artificial Sequence
  Synthetic
gctatgaaagctgacaatgtcaatgtattgcagccagtggtggctgcgacaatactagaatcaacaccattactt

SEQ ID NO: 311331 - DNA, 75 bp, Artificial Sequence
  Synthetic
caaacaacggttacttcgcgagtcagaaataagtttgttaagatgcaatccagggtcattccagaagaaggatca

SEQ ID NO: 311332 - DNA, 75 bp, Artificial Sequence
  Synthetic
cagggtcattccagaagaaggatcattgttagagattgatttcaaccggcagcgattaacatttgcttcgcatag

SEQ ID NO: 311333 - DNA, 75 bp, Artificial Sequence
  Synthetic
tggtatctcaacaattcctatagattatgaaactattgacgaaattttaggatcaatgtctcatggttttacgag

SEQ ID NO: 311334 - DNA, 75 bp, Artificial Sequence
  Synthetic
atcattgttttcattacaaatgcgtaagaatgtctttaacggaagtggaataggtaagcacactctagatgatat

SEQ ID NO: 311335 - DNA, 75 bp, Artificial Sequence
  Synthetic
aattaatgacaagaagctattagatgtaactgggcatttaactcctgatttacaacgccaattttttatagattt

SEQ ID NO: 311336 - DNA, 75 bp, Artificial Sequence
  Synthetic
catttaactcctgatttacaacgccaattttttatagatttcataaaccaatatgcagctgcaatgaaactctaa

SEQ ID NO: 311337 - DNA, 75 bp, Artificial Sequence
  Synthetic
atgtggtacttgttactactcccagtgtctttgtgttcagtacactttacaacaaataaaagagtagatatatgt

SEQ ID NO: 311338 - DNA, 75 bp, Artificial Sequence
  Synthetic
ttttttatacaatcgcagccaggttcagttaatcaaggaattgacaatgcttttaacaaaacattaaacgcacta

SEQ ID NO: 311339 - DNA, 75 bp, Artificial Sequence
  Synthetic
tcatctttatcgtatacaacataccaggtgtgtggtacgaattaccagaaccaagcaaaagatatagtagaagat

SEQ ID NO: 311340 - DNA, 75 bp, Artificial Sequence
  Synthetic
attgcagcctgcagttgtctatcagatccggaagttgatcaggtgattgtatatgcagaattggcgtcagaagtg

SEQ ID NO: 311341 - DNA, 75 bp, Artificial Sequence
  Synthetic
ttaagcacgttaattggatcacaaaatgagtgtatgaaactaccttttaggaaaatattttatcataaaataaac

SEQ ID NO: 311342 - DNA, 75 bp, Artificial Sequence
  Synthetic
gcttcggaagaaatatttataatctcgacgcaatgtaagttgtgttatcttggattttcaggccttggagcaggt

SEQ ID NO: 311343 - DNA, 75 bp, Artificial Sequence
  Synthetic
tgcgactcagctaatacagcaaattggttaacaattggagaaggaaattctcagtcagattatcaagtttataat

SEQ ID NO: 311344 - DNA, 75 bp, Artificial Sequence
  Synthetic
gttccggaacttggaatgggtgtagctatatatccagctgatgatgcgacaacccaaaaagacgtttatttttgc

SEQ ID NO: 311345 - DNA, 75 bp, Artificial Sequence
  Synthetic
aaacgaataaatgactctccagtcaatccagttatcttttttacttcatcagcacagccaccacagtcagaccaa

SEQ ID NO: 311346 - DNA, 75 bp, Artificial Sequence
  Synthetic
gttatgcgtagtgtaaattgggacagagtatggaaaaacgtaaaaaacgctgctcaagtggtgtatcaggtatta

SEQ ID NO: 311347 - DNA, 75 bp, Artificial Sequence
  Synthetic
tatcaggtattagatttattctttaaaccaagagaaggtgaacctagaccggaagaagtggcaaggtcgatttaa

SEQ ID NO: 311348 - DNA, 75 bp, Artificial Sequence
  Synthetic
atggctcaacttgttatttcagctctctctggtattctctcaaatgaacaattagctagagttcaagatgttatg

SEQ ID NO: 311349 - DNA, 75 bp, Artificial Sequence
  Synthetic
gatgacactggagttactgagaccctaaacaaatatgaagaggcatacaatggtaagtggtttccagttggaaca

SEQ ID NO: 311350 - DNA, 75 bp, Artificial Sequence
  Synthetic
catttttcaaccaaatgtaagattaggaatttggagtgtgacatggtaaagcttagaggcatgctgttcaataga

SEQ ID NO: 311351 - DNA, 75 bp, Artificial Sequence
  Synthetic
ggcgtcaacagagaacaacgtgcactaagagacttctctattgaaaagaacaaacttggacacacgatactagtt

SEQ ID NO: 311352 - DNA, 75 bp, Artificial Sequence
  Synthetic
ccaaagacaaaattggctgaattgatgattgcaaacacaaaagatcctggatacaaactgaacgctgttccatgc

SEQ ID NO: 311353 - DNA, 75 bp, Artificial Sequence
  Synthetic
gaacaattcgaagagacgttgaagaaattgaatgacgctgaggaaactatttcgaacttaagagttcaacttgat

SEQ ID NO: 311354 - DNA, 75 bp, Artificial Sequence
  Synthetic
aaatgtaaaatggatttggttactttgtctgaaaaaaacatgatgttgaaaatggctaacaattctttgaaagaa

SEQ ID NO: 311355 - DNA, 75 bp, Artificial Sequence
  Synthetic
gacgtggaggagaatgatcaatatactgactatctggaaaaattggttcgtagattggccgaatctcaaaatctt

SEQ ID NO: 311356 - DNA, 75 bp, Artificial Sequence
  Synthetic
gaagcttattatgaagaggatcatataggctttttaaattttggagctgacgatatactggaaggatttagacct

SEQ ID NO: 311357 - DNA, 75 bp, Artificial Sequence
  Synthetic
gaaattcaaattgattgtagtgatccggacgaggtttttttctctgatgatgataatttcatatttggatcagtg

SEQ ID NO: 311358 - DNA, 75 bp, Artificial Sequence
  Synthetic
gtggataaacatcttatagaaaatctaaaaggtaaaaatgtgtctaatcaagatgctgtagatgttgtgagttag

SEQ ID NO: 311359 - DNA, 75 bp, Artificial Sequence
  Synthetic
atggcgctgaaactgagtctgtctgactttgtgacaagaaatgatgatggaaattttattcctagtgacttaagt

SEQ ID NO: 311360 - DNA, 75 bp, Artificial Sequence
  Synthetic
ggggaacctctgagtagatatatgactaaagatgaaaaatcggttagagatgatttgaaagcagagaaaggacca

SEQ ID NO: 311361 - DNA, 75 bp, Artificial Sequence
  Synthetic
agagggaaaatcagagttaaacttttcctaatgcaatcttgcaagctaagaaggacacaaaaaggcattgtccct

SEQ ID NO: 311362 - DNA, 75 bp, Artificial Sequence
  Synthetic
cttaatgatgaagaaactcaagaacaagtaatcgcttacatggaagataaatttgaagacatttttgtttcttct

SEQ ID NO: 311363 - DNA, 75 bp, Artificial Sequence
  Synthetic
gacaaattggctagagtttgtctcagacttgaagataaggatgatgtcattcatacagatccagagttggcagtt

SEQ ID NO: 311364 - DNA, 75 bp, Artificial Sequence
  Synthetic
aaaacgtttttctgtatgtgcaatgcgatgaattcaacaattgcaacggaagggaaatgcgagattatacgagca

SEQ ID NO: 311365 - DNA, 75 bp, Artificial Sequence
  Synthetic
actgaagatggaataatcgtcaaatttgatcctctacctgaaaattttacagtcggtaaatcgaaaggtactttc

SEQ ID NO: 311366 - DNA, 75 bp, Artificial Sequence
  Synthetic
tacaaaatgtttccagtcaacaaagatactatccctgttcaagcatttaaagcgctatcttatgttagtggaaga

SEQ ID NO: 311367 - DNA, 75 bp, Artificial Sequence
  Synthetic
gacataattatgtatcatggacgaggacatgtaaggacggttccttttaacgaaatcctcggatgtgtttacgga

SEQ ID NO: 311368 - DNA, 75 bp, Artificial Sequence
  Synthetic
ctatcaaataagtcaaaagatgatctaataaaaattaagtctgatcctctttgctcagcttctggtgaaaaaatg

SEQ ID NO: 311369 - DNA, 75 bp, Artificial Sequence
  Synthetic
gttgctattgcggacatgttaatctcaggtgaaaaaccacaagaaatacttcgacgagtgactgttagaacacaa

SEQ ID NO: 311370 - DNA, 75 bp, Artificial Sequence
  Synthetic
attgcggacatgttaatctcaggtgaaaaaccacaagaaatacttcgacgagtgactgttagaacacaaaaataa

SEQ ID NO: 311371 - DNA, 75 bp, Artificial Sequence
  Synthetic
atggatctagttgaatgcatcaacggcattatcacattgaaggaaagagtgaggaaactagcaccaaatgcacca

SEQ ID NO: 311372 - DNA, 75 bp, Artificial Sequence
  Synthetic
ctgacacaggaaggtctagctacattaaatgactacaacgctgtggcttcaagctcaaatggcaccacagtcatt

SEQ ID NO: 311373 - DNA, 75 bp, Artificial Sequence
  Synthetic
gtgcgtgatgtgttaggacaactatctccatttactataaatgctccattgactccgataactaacgttctctca

SEQ ID NO: 311374 - DNA, 75 bp, Artificial Sequence
  Synthetic
acagacgtatttgatgatatcaagagtggactggaatcgatgcttgaggcattggctggagcagctagatcagaa

SEQ ID NO: 311375 - DNA, 75 bp, Artificial Sequence
  Synthetic
ggatcgagaagaactaaagctataattactaaagcacaggatccagaagtgaagaaattgatcggtattcttagt

SEQ ID NO: 311376 - DNA, 75 bp, Artificial Sequence
  Synthetic
attaaatctcaactatcaaataatgtatatgcaaacacaatggaattcgacacagcaagagctgaaaatccaatt

SEQ ID NO: 311377 - DNA, 75 bp, Artificial Sequence
  Synthetic
gttgaaatagataatcccttcttcaatgaaaacatacaacattcaaatgttcaaggggttccaaatgcacatggt

SEQ ID NO: 311378 - DNA, 75 bp, Artificial Sequence
  Synthetic
ggaggatacatttcagtagtaggcagagcttcaggaaatcaaatgactgctacatgtatagctggaagagatgat

SEQ ID NO: 311379 - DNA, 75 bp, Artificial Sequence
  Synthetic
gcagttgaatgggatattggactacgagtgccaacgtcgggttctatggcaattaattttcttccaacaccaggt

SEQ ID NO: 311380 - DNA, 75 bp, Artificial Sequence
  Synthetic
agaattttgttgccgagaggaaacagaggaccaaatgatattcctaccatcgcagactgtgttgatgtaagtgct

SEQ ID NO: 311381 - DNA, 75 bp, Artificial Sequence
  Synthetic
gatgctgatggtgatgacattaccgtgcagttcatgttaaataatcagatcgtgtttactagagaagcaccaggc

SEQ ID NO: 311382 - DNA, 75 bp, Artificial Sequence
  Synthetic
cagtttagttttccaatgtgtgatagtattcatttcattattaggccatggactgttaacaaaaacaataatcca

SEQ ID NO: 311383 - DNA, 75 bp, Artificial Sequence
  Synthetic
aatgccctattcgtcaattgggatcagggtggagctcaagcgcaacctacgttgtcactactagtatcaatcaca

SEQ ID NO: 311384 - DNA, 75 bp, Artificial Sequence
  Synthetic
aatgcttcagcagtacttgatgcaatggtatcaaacacagatgcagctaaaccaaactatttaatgaatactatt

SEQ ID NO: 311385 - DNA, 75 bp, Artificial Sequence
  Synthetic
tttactcaagattcttttgtgaacacgccaaacatcaattggacattcctgtcattactgaatgaccaggatcca

SEQ ID NO: 311386 - DNA, 75 bp, Artificial Sequence
  Synthetic
gaccaggatccacagaccgcgccatggtcacgaaaaatagcatcattgatagccgcttttgctgcacaaaactag

SEQ ID NO: 311387 - DNA, 75 bp, Artificial Sequence
  Synthetic
atgtcactaatagggacgctcgagaagtacctctcagcacttgaagaaataaaaacaaaaggaggactacaaaaa

SEQ ID NO: 311388 - DNA, 75 bp, Artificial Sequence
  Synthetic
atacatgatgatttgctacatgaattagacatgtttattgatgatatagacattaaagaagagaaagaaaccaaa

SEQ ID NO: 311389 - DNA, 75 bp, Artificial Sequence
  Synthetic
attttgttcgaaaaaataagcagactattaaaaaagaagggcataaagacaacgccaatagaaaatgaatttaat

SEQ ID NO: 311390 - DNA, 75 bp, Artificial Sequence
  Synthetic
tcaaaaaaattcacagaaaagaatggcactgcagaaacagacaatatgagcaaaagaacagaagaaactatgact

SEQ ID NO: 311391 - DNA, 75 bp, Artificial Sequence
  Synthetic
gaaaaagaaaatggaaatgctaacaccacacaacataacgtgaagagtgatggtgaaaagcgacatgacgacaat

SEQ ID NO: 311392 - DNA, 75 bp, Artificial Sequence
  Synthetic
tctaatatcaattcatatattcaaaatgtcataaacattagagatattttatccaaaacattattcgtcgatact

SEQ ID NO: 311393 - DNA, 75 bp, Artificial Sequence
  Synthetic
gacgcagatgactatgcaatataccttccatcagaagttccggaatcaataaaaccaatccagatcgacgttata

SEQ ID NO: 311394 - DNA, 75 bp, Artificial Sequence
  Synthetic
cctatcaatatgtttgagacatttgctaacatgagaaaaatcaatacaataaacatttcaaacaatgacttggta

SEQ ID NO: 311395 - DNA, 75 bp, Artificial Sequence
  Synthetic
tctgacacatacggtccagcagaagtattgtatgacagcatatttttctcagatatggaccttgaaaagtacggt

SEQ ID NO: 311396 - DNA, 75 bp, Artificial Sequence
  Synthetic
aacattgaaaaatacttcttatacaaagcttcaaacgtatcacggaaattgccaaatgttaattatatgaccgaa

SEQ ID NO: 311397 - DNA, 75 bp, Artificial Sequence
  Synthetic
tgcacaaaaattccaaacccatataacaacgataacacaattacgacgatgtttggacaagggacgtattatgac

SEQ ID NO: 311398 - DNA, 75 bp, Artificial Sequence
  Synthetic
atgctaatggatcgtacagataagagtttgactggaagaagaactgatgctcagtatgatgatatttctgttgat

SEQ ID NO: 311399 - DNA, 75 bp, Artificial Sequence
  Synthetic
gcaataaacagacaaatatccatatcactacggatacatccagtagatgatcagctactcaacatagccataaac

SEQ ID NO: 311400 - DNA, 75 bp, Artificial Sequence
  Synthetic
aattgcatccagacacagccattacaaccggtcttaaatgaatacattatgatagcggctgatggatatgttgca

SEQ ID NO: 311401 - DNA, 75 bp, Artificial Sequence
  Synthetic
tcccctaaaaaacgttatgataggaacacattgactatatcaaatgttttttcaccagttttcaatagactgtgt

SEQ ID NO: 311402 - DNA, 75 bp, Artificial Sequence
  Synthetic
gtgttatcaggcacaacatacagagctagaactttacaatctatgacttttatgtcgagactgtggaaaaccaat

SEQ ID NO: 311403 - DNA, 75 bp, Artificial Sequence
  Synthetic
gttttcaaaacatcactagaggatgatatagctaaaatgtatgctggagccgaaatttcaatgactacgatcgat

SEQ ID NO: 311404 - DNA, 75 bp, Artificial Sequence
  Synthetic
ggaacaacagccagtcttgctacaataaacatttctgcggccgaacaagctttaataggtatactaaatgcgtca

SEQ ID NO: 311405 - DNA, 75 bp, Artificial Sequence
  Synthetic
ttttttagattcgactttaacttaactggacctcaaaactcgttaggagctgcgatatcggcgttaatagcgttg

SEQ ID NO: 311406 - DNA, 75 bp, Artificial Sequence
  Synthetic
atagtactaccaattgaccaagatacaatggataatgatacatatgatatgttgtgtaacactgtttttaatgaa

SEQ ID NO: 311407 - DNA, 75 bp, Artificial Sequence
  Synthetic
atgatggcaaatgcaatgaacctaccagcgtttgtgcgaagagctggagatgaaaatgcgtttagaagatatgtg

SEQ ID NO: 311408 - DNA, 75 bp, Artificial Sequence
  Synthetic
aatggaccaattccgagagaagcttctgcttttattagattcattttgttacgaagaggatggttgctttttcag

SEQ ID NO: 311409 - DNA, 75 bp, Artificial Sequence
  Synthetic
agatctgatgatagaacgattcattgtgacatcttagtaccaaattgtgacacgcagaatgtaaatgatcaacca

SEQ ID NO: 311410 - DNA, 75 bp, Artificial Sequence
  Synthetic
tatgttttactctcagacttcttcgctgcgatattggaatcttccagacgtaatccaaatccaggaaaaaataca

SEQ ID NO: 311411 - DNA, 75 bp, Artificial Sequence
  Synthetic
tccgctaattcgtttagacgactaattcgaggacttagggacattgtctgtaacaaaatcatgccagctatgagg

SEQ ID NO: 311412 - DNA, 75 bp, Artificial Sequence
  Synthetic
ttaattaggtacaatgtagaaagaatagctagaattcaaagtatgttaccatattctgctgatcttgcattagtt

SEQ ID NO: 311413 - DNA, 75 bp, Artificial Sequence
  Synthetic
aacccctctttgagagatgaaagattgagagcaaacatcccattatcaggatttttatcattgttaatgggaata

SEQ ID NO: 311414 - DNA, 75 bp, Artificial Sequence
  Synthetic
tcaaaggcaccagatgcatttgattggacaacagtattaacattttgtgattcaatgcgaaaattaaactatgct

SEQ ID NO: 311415 - DNA, 75 bp, Artificial Sequence
  Synthetic
gaaacaatatcggtcgaagaagctctaaccgttgctatttcatcacatgatatagataaatcagtatcaaaaaaa

SEQ ID NO: 311416 - DNA, 75 bp, Artificial Sequence
  Synthetic
gacattataaaagacgtattgcacccaccaacttcagccgtagctgcgattacaaaggttccatcagcgtcactt

SEQ ID NO: 311417 - DNA, 75 bp, Artificial Sequence
  Synthetic
tctgcattgctatcagatacggttttaattaacctggtaaaaaactcaaaaccatttaggaaaattacagacata

SEQ ID NO: 311418 - DNA, 75 bp, Artificial Sequence
  Synthetic
gtgaaagttttgaaagcagcttttcaacattcaccgactgcgagttatggagtagtcaaaggcgctctattgatg

SEQ ID NO: 311419 - DNA, 75 bp, Artificial Sequence
  Synthetic
tcatcaccccaaaattttaggagatcatctcaatatgttaaaagagataatgtaatacacaatgtcgtagatggc

SEQ ID NO: 311420 - DNA, 75 bp, Artificial Sequence
  Synthetic
attcaaaaattcaaagcagaagatctagttaaaggcaatcactttcctggtctaattaattcaataaagaacggt

SEQ ID NO: 311421 - DNA, 75 bp, Artificial Sequence
  Synthetic
gatgatatatatatagaaggacctttaccagtaagaacatcgcattcatcggaggtcgctaccgcttctttcgcc

SEQ ID NO: 311422 - DNA, 75 bp, Artificial Sequence
  Synthetic
tttctaacaatgaattcaccatatgacgccttcattgatccaactgatttacaacatcaaagattaataaaaatt

SEQ ID NO: 311423 - DNA, 75 bp, Artificial Sequence
  Synthetic
agagcagttgaccatttttcagactcgtcaattgacatgataccatcgaaatttgacaatttgctagctaagaca

SEQ ID NO: 311424 - DNA, 75 bp, Artificial Sequence
  Synthetic
tcagtattcgtacatgatgctcaaagcttaatggtacagtcaaaatcaacagtgagacggttcaactaccacgaa

SEQ ID NO: 311425 - DNA, 75 bp, Artificial Sequence
  Synthetic
tcactattacatattgacatagcaaatctgattaacttctcagttgctttgccaactgaactacagctattcgat

SEQ ID NO: 311426 - DNA, 75 bp, Artificial Sequence
  Synthetic
aatctgattaacttctcagttgctttgccaactgaactacagctattcgatggaacattagtgtatgatgtgtag

SEQ ID NO: 311427 - DNA, 75 bp, Artificial Sequence
  Synthetic
atggcagacgattccagcttcaccttgacaagaaagaaaactaataaaaaagagaaggaaaaaaacgtcacaaga

SEQ ID NO: 311428 - DNA, 75 bp, Artificial Sequence
  Synthetic
ggtcaaaggatgaattttgaagaagaagatgtttcagtagctggtgaaaccgacactaagagcattgccacagaa

SEQ ID NO: 311429 - DNA, 75 bp, Artificial Sequence
  Synthetic
tcggagtcatcaacacattcatatgaagactacgaaagagcgtatagagaactaacaaaagattctagctcagaa

SEQ ID NO: 311430 - DNA, 75 bp, Artificial Sequence
  Synthetic
caagttaacttaactaatactgctattgaacagaagaatctttctcgatttgatgaacggaagaatgtttgtgat

SEQ ID NO: 311431 - DNA, 75 bp, Artificial Sequence
  Synthetic
ccaacgttaaatctgttgatctcacaaatgaaagctgaaattgatcaattgaaagttaaagtaagtgatcaaagc

SEQ ID NO: 311432 - DNA, 75 bp, Artificial Sequence
  Synthetic
aaatgaaagctgaaattgatcaattgaaagttaaagtaagtgatcaaagcctagataacgcttacaacaaaattc

SEQ ID NO: 311433 - DNA, 75 bp, Artificial Sequence
  Synthetic
ttgaacaacgtattaaatggttcttatcaaactatagttgattacacaaatacgcataacattgaagaaatctta

SEQ ID NO: 311434 - DNA, 75 bp, Artificial Sequence
  Synthetic
atggcaaaattactaacagtatctgaaaaaggtaggctactgttggacagcgaagatattttcaaattatctaac

SEQ ID NO: 311435 - DNA, 75 bp, Artificial Sequence
  Synthetic
gcaatcatcttacaagtaatgttgtgcattgtagcaatagttatatttttcaccatgaaaatgatcttaaaactt

SEQ ID NO: 311436 - DNA, 75 bp, Artificial Sequence
  Synthetic
aaggatatttgtaaacaacctgatgacaacaatttcactgagacattcatatatgggttagatagaaagttggct

SEQ ID NO: 311437 - DNA, 75 bp, Artificial Sequence
  Synthetic
ggtaatatattacgaaacacatcattcaacatattcaataggaacgtgtcggtcattggaccagaactagaaagt

SEQ ID NO: 311438 - DNA, 75 bp, Artificial Sequence
  Synthetic
ttaaagaatatagttaatcattattataatggatatgatgtggaattattcacaatgtcaacagaaaaagagaga

SEQ ID NO: 311439 - DNA, 75 bp, Artificial Sequence
  Synthetic
acgtataagcaaaatattgactggatgaaacagaccaaactgacgttcaaattagcaatgtcttcacaaaataag

SEQ ID NO: 311440 - DNA, 75 bp, Artificial Sequence
  Synthetic
aatgaacataactttctgaaaggactaattgcacactgtaagaaatttggatttccaagcaaaatattatacttg

SEQ ID NO: 311441 - DNA, 75 bp, Artificial Sequence
  Synthetic
ggaagctatccatctttctggttagagaacatttcatggtttcccgcaatgatacattgctatgatccaaagtat

SEQ ID NO: 311442 - DNA, 75 bp, Artificial Sequence
  Synthetic
agacagacaaatttgaagtatgtaaaatggcatacaactgaatttacaataaaagattgttcagccattattagc

SEQ ID NO: 311443 - DNA, 75 bp, Artificial Sequence
  Synthetic
aaaagattgttcagccattattagcaacacatatgtatatatagacatccgtactgatatacgaggtatgtcgga

SEQ ID NO: 311444 - DNA, 75 bp, Artificial Sequence
  Synthetic
atgataacggatattgcaatggaaatatcgagtaaaccttcatgctcagtctttttcaaacgcaagattctttca

SEQ ID NO: 311445 - DNA, 75 bp, Artificial Sequence
  Synthetic
tctggagtaacggacaaaagaaaaatatcaaaggaagacctttttaggggtataaacaatgcaataactgagaat

SEQ ID NO: 311446 - DNA, 75 bp, Artificial Sequence
  Synthetic
atcccacattatatatatgatggaacagtttatattgggaattcaaagtatccaataataggattgtattcacta

SEQ ID NO: 311447 - DNA, 75 bp, Artificial Sequence
  Synthetic
cagtttatattgggaattcaaagtatccaataataggattgtattcactatcaaataaatttaacaggatatcta

SEQ ID NO: 311448 - DNA, 75 bp, Artificial Sequence
  Synthetic
agatgaatttataattacttttccagtgcagaaatttcagaattggagagatataaaactgtacgatgagccgtt

SEQ ID NO: 311449 - DNA, 75 bp, Artificial Sequence
  Synthetic
tgaagtagtttcagaagaggtattcgtctcaattttagatggtaggataaatatgcctacaaattttctacatat

SEQ ID NO: 311450 - DNA, 75 bp, Artificial Sequence
  Synthetic
ggtaacattcaaattcaagtggagagacttcttttcagatagatattttcaacatataggcatacgacagccatc

SEQ ID NO: 311451 - DNA, 75 bp, Artificial Sequence
  Synthetic
tatatatgctagagataggttcagagtatcgagaattacagcatatataaatcgacaattgactcattcaagcga

SEQ ID NO: 311452 - DNA, 75 bp, Artificial Sequence
  Synthetic
attggtatatactatgtcaccatacagatggatgatacgttcaatacatcaaatcaggaagaaagaaacctccaa

SEQ ID NO: 311453 - DNA, 75 bp, Artificial Sequence
  Synthetic
attatcgaattataagagatctatctccaaatcatagattactagttactgatgagtgcagaatattaaacaatt

SEQ ID NO: 311454 - DNA, 75 bp, Artificial Sequence
  Synthetic
taaatttggatccaaaaattgcaagtgatttgaatatactaataccatgcggagtgcatttacaaaagagtggaa

SEQ ID NO: 311455 - DNA, 75 bp, Artificial Sequence
  Synthetic
tgatttgaatatactaataccatgcggagtgcatttacaaaagagtggaaatgttatgattgaagttgttgagac

SEQ ID NO: 311456 - DNA, 75 bp, Artificial Sequence
  Synthetic
cattgaaccagctgaaggatatggtggaaatggatggtgcatttcatcaaagaaatgtttaaaatgtatttcagt

SEQ ID NO: 311457 - DNA, 75 bp, Artificial Sequence
  Synthetic
ggatgaaatcattggtgttcttttcgaaaatggatttcaaagagatgagatatatttcagaccaacaaatcaaat

SEQ ID NO: 311458 - DNA, 75 bp, Artificial Sequence
  Synthetic
tatatttcagaccaacaaatcaaatcaaattaaacagtttcaacacgattccaacgctaaagctcgaggatgaat

SEQ ID NO: 311459 - DNA, 75 bp, Artificial Sequence
  Synthetic
tcaatgcagcaaatacttttatctggctttcattcaaacaagacataccgttttatccctggtatgatgatctga

SEQ ID NO: 311460 - DNA, 75 bp, Artificial Sequence
  Synthetic
aatcaccaatagctgtattgaatgattacataccaacggagagaagaaattatataacgtggaagcagaaaggct

SEQ ID NO: 311461 - DNA, 75 bp, Artificial Sequence
  Synthetic
ctggtcagtggttcacgtacatggaagataagatcatcgtaggcaaaccaacagattttgttccaagtgtgaagg

SEQ ID NO: 311462 - DNA, 75 bp, Artificial Sequence
  Synthetic
gttggattagagatcttacagccgaaggcattgaatcaaatccagggccaaattacatatcattgctgaatgaac

SEQ ID NO: 311463 - DNA, 75 bp, Artificial Sequence
  Synthetic
acgctcaaagaaataggaatcaatttccaaattattcatttgaaatgataataatggacaatgaaatattattca

SEQ ID NO: 311464 - DNA, 75 bp, Artificial Sequence
  Synthetic
catgcacgtgtaaatacatgcatatcatcgaaacctcgaatccacacaggacaaagaaagagtcaaaaaatgaag

SEQ ID NO: 311465 - DNA, 75 bp, Artificial Sequence
  Synthetic
acctcgaatccacacaggacaaagaaagagtcaaaaaatgaagcggctgaactagttgttcgtattattgagtaa

SEQ ID NO: 311466 - DNA, 75 bp, Artificial Sequence
  Synthetic
acaaatgctaaaataggaattgttgagctaaatagagatcagaaagattttagatcacaagagacaacagtatta

SEQ ID NO: 311467 - DNA, 75 bp, Artificial Sequence
  Synthetic
tccccaattgatgcaattcaaaacattaaagataggataacagatgatattgcattaagtttaaagaatttatta

SEQ ID NO: 311468 - DNA, 75 bp, Artificial Sequence
  Synthetic
agaatacgttatcttactgtctatgtggaagataaatcagataaaagagttctagttggtagacagattgacact

SEQ ID NO: 311469 - DNA, 75 bp, Artificial Sequence
  Synthetic
atattatctcaattgaaacagagaggcgcatcaactgatacaataaatattcatgtagatcaaatatcgttggaa

SEQ ID NO: 311470 - DNA, 75 bp, Artificial Sequence
  Synthetic
gcgcatcaactgatacaataaatattcatgtagatcaaatatcgttggaagctaagaagttaaaagtaaaagaat

SEQ ID NO: 311471 - DNA, 75 bp, Artificial Sequence
  Synthetic
aaggagcagatccatataaatggagatcggacacccttgaaggaatgataccgcatttcaatcacagaacgcaca

SEQ ID NO: 311472 - DNA, 75 bp, Artificial Sequence
  Synthetic
ctttaatatcatcggtaatatttgctgttatgtcacgccttgagaagtatcacagagaacaactagacgttatat

SEQ ID NO: 311473 - DNA, 75 bp, Artificial Sequence
  Synthetic
actggttgatgttaaaagtaaaacagagatttgatgatggatatttggagctatctagaaacagaaaatggaata

SEQ ID NO: 311474 - DNA, 75 bp, Artificial Sequence
  Synthetic
tatcgtacggtgatttattgacatcaaaaattaaaatatactcagctaaaattatacacgcagcattggcgatga

SEQ ID NO: 311475 - DNA, 75 bp, Artificial Sequence
  Synthetic
tatcaattgccaactcaactgacgtcatacattattttttaccacaaattattgctgtttttgaaattgtgccat

SEQ ID NO: 311476 - DNA, 75 bp, Artificial Sequence
  Synthetic
cgatagcagctaaacaactgtcatcgccgatgaccatgttcataggtatatgtcaattaaaatcaaatatagttg

SEQ ID NO: 311477 - DNA, 75 bp, Artificial Sequence
  Synthetic
tagctactacgagaccacatgagtgtgtagctacaccgagaaaaaatatatcacgattgtcggatgatcaaagga

SEQ ID NO: 311478 - DNA, 75 bp, Artificial Sequence
  Synthetic
aacaatgggaggacgaaagaaaggattatccattcgcatcgagtttaatgtttttagagatggtaaaaaatgtag

SEQ ID NO: 311479 - DNA, 75 bp, Artificial Sequence
  Synthetic
ataacgttcagataagtacgtttaggcgtatatttaactcattttcagccacttttcacgtaggtcacagaatag

SEQ ID NO: 311480 - DNA, 75 bp, Artificial Sequence
  Synthetic
ataatgctcaagacgccatagaggatcaagtgtcggtgaagtatacatcagaggttgatagagaaatgtatgacc

SEQ ID NO: 311481 - DNA, 75 bp, Artificial Sequence
  Synthetic
aatactatcatcagttgaagaacatgtttaagattgaaatatcaaggtatctagaatacatgaagaaatataata

SEQ ID NO: 311482 - DNA, 75 bp, Artificial Sequence
  Synthetic
acgatgcaacagcacaatcaatgtctgctctagctaactcatctaacggattttcaaaagaagtaactttcatcg

SEQ ID NO: 311483 - DNA, 75 bp, Artificial Sequence
  Synthetic
acaggaaaataaacacgacaaagaaaatgctgcacatggatgacgatttgctaaaacaagatttttcaaacgtta

SEQ ID NO: 311484 - DNA, 75 bp, Artificial Sequence
  Synthetic
gagaaattatagaaagaggcattccaatgggaaccagaaatgtcccggccagacaaactagaggtatatttattt

SEQ ID NO: 311485 - DNA, 75 bp, Artificial Sequence
  Synthetic
taccatggcaagtggctgtaatacagcatacgatagctgaatcaatgtattcgcatgcaaagaaaggtgattatg

SEQ ID NO: 311486 - DNA, 75 bp, Artificial Sequence
  Synthetic
gtgctacgtttgctgaagcgtatactgcgaaagcatctactttgacatacggagtgttagcgcaagcgacatcga

SEQ ID NO: 311487 - DNA, 75 bp, Artificial Sequence
  Synthetic
atgctgaacaatttatattatatacggacgtatctcagtgggatgcctcacaacacaatacagaaccatatagat

SEQ ID NO: 311488 - DNA, 75 bp, Artificial Sequence
  Synthetic
cagcgtggatcaacgcgatagatgaagtcagacaagaaaaaaacgtagataaaaagacggaacctgttgtactag

SEQ ID NO: 311489 - DNA, 75 bp, Artificial Sequence
  Synthetic
gcatgaatgtattagataagatgatggacattcagaaagcattgttaaactcaaatctaatcttaacttcacgtg

SEQ ID NO: 311490 - DNA, 75 bp, Artificial Sequence
  Synthetic
gttcacaaagagaggataaaagaattagataccatggagttgcctcaggagaaaagacgacaaaaattggaaact

SEQ ID NO: 311491 - DNA, 75 bp, Artificial Sequence
  Synthetic
cttttgctaatgtatcactcattacaactgttttaaagaaaacgatacagaaatacccacagatacgagttacac

SEQ ID NO: 311492 - DNA, 75 bp, Artificial Sequence
  Synthetic
atactagagttgatggagatgataacgtagtaactatgtattataatgattcaatgcaactattacaagaagaaa

SEQ ID NO: 311493 - DNA, 75 bp, Artificial Sequence
  Synthetic
taaagaaaaattatgagttaatgaatgcgcgtgttaaggcattagcatcatatactgggttggaaatggcaaaaa

SEQ ID NO: 311494 - DNA, 75 bp, Artificial Sequence
  Synthetic
gatttatcatatgtggaaagatattcgaaagaggcgctatatcaatatttacagccgagaggccgtatggtacag

SEQ ID NO: 311495 - DNA, 75 bp, Artificial Sequence
  Synthetic
acagatcagatcaggctattacggggtcattgttatattcagcgtcagttaacgcttatcgtggatttggagacg

SEQ ID NO: 311496 - DNA, 75 bp, Artificial Sequence
  Synthetic
aatatttgcatttcatgcaagatgtattaattccaccatcagcctccataagaatatccggtaggctgcgattgt

SEQ ID NO: 311497 - DNA, 75 bp, Artificial Sequence
  Synthetic
tattatcgccagtgactctattttcaacgggtccactatccttcgaagtaacaccagctggacttggtgggagaa

SEQ ID NO: 311498 - DNA, 75 bp, Artificial Sequence
  Synthetic
tgagattatttacaaattcagaggaaataatgacgttatataaaagtttgtctgaagcaacgatggtgtcagtag

SEQ ID NO: 311499 - DNA, 75 bp, Artificial Sequence
  Synthetic
aacctgaggaaataaattcatattcaaaaacagatatgtttaacaatagaatgacgataatgacggaagctgtga

SEQ ID NO: 311500 - DNA, 75 bp, Artificial Sequence
  Synthetic
aaaataatatgaaatctgagccacaatcagtattgaagatcatcagagaaaaagaacgtcaaaagacattaggaa

SEQ ID NO: 311501 - DNA, 75 bp, Artificial Sequence
  Synthetic
ttccaaacgttcagacagcaaaaaacagaatgcagaatgaaaaaacaaaaaagaacttagcaattatagaaagca

SEQ ID NO: 311502 - DNA, 75 bp, Artificial Sequence
  Synthetic
agttaccaatagtgaagaaattttttccggaagaactatttatgctaattaaatccatgtgtgatataaatcaac

SEQ ID NO: 311503 - DNA, 75 bp, Artificial Sequence
  Synthetic
cacactgtgttgaacatataccaatatatatgtattcttcatcattaattaagaaattgcactgtcagctaggag

SEQ ID NO: 311504 - DNA, 75 bp, Artificial Sequence
  Synthetic
ttagaatgcacgagtctccacctttgcacaaaccagtaaacattctagttaaaatggttaatgcacattcaccaa

SEQ ID NO: 311505 - DNA, 75 bp, Artificial Sequence
  Synthetic
tagcaatatcaccaagtgacatattcaatgagagtaagagttttgacctgagtacattttcagggaaaaagaaat

SEQ ID NO: 311506 - DNA, 75 bp, Artificial Sequence
  Synthetic
ttcttatatcattaggtattgttggtaatgaattaaggtattacttaaactctaaactgctaatgcatgatctag

SEQ ID NO: 311507 - DNA, 75 bp, Artificial Sequence
  Synthetic
cgttagctaaatatgacaagttgtatgaaacgccaggctttggtgcaactcagctgacgactgtaccattcgact

SEQ ID NO: 311508 - DNA, 75 bp, Artificial Sequence
  Synthetic
tgcagtctgctgaaagaatatttagactcactctaccaatgcccgcacaatattatgagatactcatgcttctct

SEQ ID NO: 311509 - DNA, 75 bp, Artificial Sequence
  Synthetic
tgacgcacgagtacattcattacattgcaaatggtggacagcgatcaactttcattatgcgcgcatatcaacaag

SEQ ID NO: 311510 - DNA, 75 bp, Artificial Sequence
  Synthetic
aagagttagcttcaaaaatatctttgattatgcgaatgattgataatttgcaattagacaaagtgaactttaaag

SEQ ID NO: 311511 - DNA, 75 bp, Artificial Sequence
  Synthetic
aaaatatctttgattatgcgaatgattgataatttgcaattagacaaagtgaactttaaagatgatgtatattag

SEQ ID NO: 311512 - DNA, 75 bp, Artificial Sequence
  Synthetic
atgttacgttctttgttgacggaaagtgctgaaatgcagttatcagcgcaagaagttgcaaacaacacaacgaat

SEQ ID NO: 311513 - DNA, 75 bp, Artificial Sequence
  Synthetic
attagaggatacacgtacaaattatataacaatgataacacagttgaaaaacaggaagtatgttacacaaactat

SEQ ID NO: 311514 - DNA, 75 bp, Artificial Sequence
  Synthetic
atgccggtagatatagaatacagaagaggaatagaccatataggaatttcatctggagcagacacacaggctgtg

SEQ ID NO: 311515 - DNA, 75 bp, Artificial Sequence
  Synthetic
tatgataactatttttggaaacatgagggtcagattgacaaagacttaataacttctcaaaggaatcaattaata

SEQ ID NO: 311516 - DNA, 75 bp, Artificial Sequence
  Synthetic
aaatattgtgatgataataatatgtacattattataaaaatacaatttttggaagatgatacaatattagcagtg

SEQ ID NO: 311517 - DNA, 75 bp, Artificial Sequence
  Synthetic
aatgttaacggtagcattacatctttaacgggagcgacatattatagtggagacagtggtataataaaaattatc

SEQ ID NO: 311518 - DNA, 75 bp, Artificial Sequence
  Synthetic
agaaccagtaataatgtaattgtatataatcagcttgaaaaaatgcctctaaaaaataaagatccatgtttattt

SEQ ID NO: 311519 - DNA, 75 bp, Artificial Sequence
  Synthetic
ctagccacagcattatttgcgaaagacgatacatacgttcacacatcaaaaaaagtcatattacagttgggctat

SEQ ID NO: 311520 - DNA, 75 bp, Artificial Sequence
  Synthetic
tcaagagaaaagaatccagaagaaatgaatgatacacttccaacaacattaataacatatgatgtagaaaataga

SEQ ID NO: 311521 - DNA, 75 bp, Artificial Sequence
  Synthetic
atgcgaacaaggaccgtatccacgagagattttaatccatcattaccatcacatcagattttgcaacaaaaagta

SEQ ID NO: 311522 - DNA, 75 bp, Artificial Sequence
  Synthetic
gaaggattttggaaaatagtatcagaagtgtttaacataaaattaaaaataactatagattccagagggattatg

SEQ ID NO: 311523 - DNA, 75 bp, Artificial Sequence
  Synthetic
ggtggaccatttggggactggctggtcgataattcattcgttactgtggaaaataaatacacatatcaaagagat

SEQ ID NO: 311524 - DNA, 75 bp, Artificial Sequence
  Synthetic
gacgaaacgataaacgctataactataactacttgttatcctagcgctcaaactggtacagaaaagccatgggca

SEQ ID NO: 311525 - DNA, 75 bp, Artificial Sequence
  Synthetic
tgggcgtcagatttcaaaggacatgcagtggcactgattccaggtgacattgtagaagtgaggtacacagaagat

SEQ ID NO: 311526 - DNA, 75 bp, Artificial Sequence
  Synthetic
aaatggacgttggctaactctttatatgcaaaagactttgatacagactctcaagcttctttcactgttcctagt

SEQ ID NO: 311527 - DNA, 75 bp, Artificial Sequence
  Synthetic
acgagagaggaggcgaagaatgatccaagtgatattaagttctacatgaattacattccagcttttgcctacata

SEQ ID NO: 311528 - DNA, 75 bp, Artificial Sequence
  Synthetic
aagaattctactggaatgtcgcatttcaaatttcattcaggaggattcacacaaattgacgcaaagggatataca

SEQ ID NO: 311529 - DNA, 75 bp, Artificial Sequence
  Synthetic
ggacttgcaatggtgtttagatttaaagctcaagagttcgataaatggaatagtaacataataaatcctgagtac

SEQ ID NO: 311530 - DNA, 75 bp, Artificial Sequence
  Synthetic
ggccatatgttttcaaatataggggatcatggtttgaatacacagtataatccagcacctggtgctcaaccaggt

SEQ ID NO: 311531 - DNA, 75 bp, Artificial Sequence
  Synthetic
tttcaagcttgttacgctgcaaggaattatgatattgatatgcgcgttgcatatacagccttaactccatcggat

SEQ ID NO: 311532 - DNA, 75 bp, Artificial Sequence
  Synthetic
cctgaattcacaaatggatcaacaaactttgtaagtacggtgacgttagatatagaaaaaactattgattcttta

SEQ ID NO: 311533 - DNA, 75 bp, Artificial Sequence
  Synthetic
caacaacacataaataaattgcaagcagaagttaacattggacaggttacgacagggatatttgaactgctaaca

SEQ ID NO: 311534 - DNA, 75 bp, Artificial Sequence
  Synthetic
aatctttacaacttacctcaaacgcttcaaggatttatgagtactttcagggacattagatcagcgattaaaaga

SEQ ID NO: 311535 - DNA, 75 bp, Artificial Sequence
  Synthetic
ttctcaaacaaaagaaaggaaatgttgaagggaagaaatagagaagccataaattcaaaatactcattagaaaat

SEQ ID NO: 311536 - DNA, 75 bp, Artificial Sequence
  Synthetic
ttactgtccacaacggatacagcatcattgaatgacgatcagctcctatcactaatgtctaagacttctaatatc

SEQ ID NO: 311537 - DNA, 75 bp, Artificial Sequence
  Synthetic
gctatgaaagctgacaatgttaatgtgttgcagccagtagtggctgcaacaatactagaatcaacaccattactt

SEQ ID NO: 311538 - DNA, 75 bp, Artificial Sequence
  Synthetic
caaaccacggttacttcgcgagtcagaaataaatttgttaagatgcaatccagagtcattccagaagaaggatca

SEQ ID NO: 311539 - DNA, 75 bp, Artificial Sequence
  Synthetic
cagagtcattccagaagaaggatcactgttagagattgattttaatcgacaacgactaacatttgcttcgcacag

SEQ ID NO: 311540 - DNA, 75 bp, Artificial Sequence
  Synthetic
atcattgttttcactacaaatgcgtaagaatgtttttaacggaagtggaataggtaagcacaccctagatgacat

SEQ ID NO: 311541 - DNA, 75 bp, Artificial Sequence
  Synthetic
aattaacgacaaaaaattattagatgtaactggacatttaactcctgatctacagcgccaattttttatagattt

SEQ ID NO: 311542 - DNA, 75 bp, Artificial Sequence
  Synthetic
catttaactcctgatctacagcgccaattttttatagattttataaaccaatatgcagctgcaatgaaactctaa

SEQ ID NO: 311543 - DNA, 75 bp, Artificial Sequence
  Synthetic
atggctggcaaagccatttcaaaaggtaaggggggtggcccccctgggaagagacccaaagtggccataagaaag

SEQ ID NO: 311544 - DNA, 75 bp, Artificial Sequence
  Synthetic
acggggcagtcggcgggactcatgccaagagttctgctgctgtcccgcatcatgggtgtgttgtggcacttgttg

SEQ ID NO: 311545 - DNA, 75 bp, Artificial Sequence
  Synthetic
tcgaacacacccagaccgcccattctaagggctttttggcgcacagttcctgtgcgacaggccatgggggtcctg

SEQ ID NO: 311546 - DNA, 75 bp, Artificial Sequence
  Synthetic
acacgcatccgtagggttgctggttccatgatgcagagccttcagggcagagggaagcgacgtgccggagagggg

SEQ ID NO: 311547 - DNA, 75 bp, Artificial Sequence
  Synthetic
ctttctgcttattggctcgcggcgctgctctgcggggtggcgttgtgcgctcatgtgcgacgggggcccgatggt

SEQ ID NO: 311548 - DNA, 75 bp, Artificial Sequence
  Synthetic
ggtatagtgatccgagcggatggaagggacgcggcaacacaactcagagttggaaatggcacatgcgccattctc

SEQ ID NO: 311549 - DNA, 75 bp, Artificial Sequence
  Synthetic
tccactgacatgggcgactggtgtgatgactcattggcgtacgagtgtgtcaccatagagggaggcgaagagcca

SEQ ID NO: 311550 - DNA, 75 bp, Artificial Sequence
  Synthetic
gtggacgtggattgtttttgccgaggggtgactggtgtgttcattgagtatggtaggtgtggaaggaaaggccac

SEQ ID NO: 311551 - DNA, 75 bp, Artificial Sequence
  Synthetic
tcaagggttaccagatcggtgcacattccatcccacgcagagcggaacatggtgggtcatggtgaacggacctgg

SEQ ID NO: 311552 - DNA, 75 bp, Artificial Sequence
  Synthetic
ctgggaacgtcaaactggaaagaacacgcaacaagagtggaaagctgggtctggaagaacaaggtcatggtgatt

SEQ ID NO: 311553 - DNA, 75 bp, Artificial Sequence
  Synthetic
gctgtggccatggcgacttggatttgcgttaagagtatgacccttcggcttcttattgtagtggcgttcttgctg

SEQ ID NO: 311554 - DNA, 75 bp, Artificial Sequence
  Synthetic
gtggcgccaggacaggcttccaggtgcactcacctggagaacagagactttgtggagggtgtaacagggacaacc

SEQ ID NO: 311555 - DNA, 75 bp, Artificial Sequence
  Synthetic
aaggttacactggtacttgaactggggggatgtgtcacggttacggccgagggcagaccctcggtggacgtttgg

SEQ ID NO: 311556 - DNA, 75 bp, Artificial Sequence
  Synthetic
cttgacagtatctaccaggagtctctggcacaggtgagggagtattgcttgcatgccaaattgagtaattcaaag

SEQ ID NO: 311557 - DNA, 75 bp, Artificial Sequence
  Synthetic
gttgcagcaagatgtccaacgatggggcccgcgaccctgccggaagaacaccaggcagacatggtatgtaagaga

SEQ ID NO: 311558 - DNA, 75 bp, Artificial Sequence
  Synthetic
gatcaaagtgatagaggatgggggaaccattgtggactatttggaaagggaagtattgtggcatgcaccaagttc

SEQ ID NO: 311559 - DNA, 75 bp, Artificial Sequence
  Synthetic
acatgtgaagaaaagaggacggccgcaggttatgtctttgatagtagcaaagtcacatttgcggtgaaagtggaa

SEQ ID NO: 311560 - DNA, 75 bp, Artificial Sequence
  Synthetic
ccacatacggggacgtacctagcggccaatgatacacatgtggatcgaaaggaagccaagttcacagcggcagct

SEQ ID NO: 311561 - DNA, 75 bp, Artificial Sequence
  Synthetic
gagaaagtaatcttgacgcttggtgactacggggacatgagtctggtgtgccgtgtcactagtggaatggacatg

SEQ ID NO: 311562 - DNA, 75 bp, Artificial Sequence
  Synthetic
gcgcagacagtgattcttgagatggacaagacaaatgagcaccttccgcaggcctggcaggtacaccggagctgg

SEQ ID NO: 311563 - DNA, 75 bp, Artificial Sequence
  Synthetic
ttcgaggatctctccctgccgtggcggcataagggagaaagtgcctggcgtgaagctcagaggcttgtggaattt

SEQ ID NO: 311564 - DNA, 75 bp, Artificial Sequence
  Synthetic
ggtcctccgcatgccgtaaagatggatgtgtataatcttggagaccagactagtgtcatgttgaaatcactgaca

SEQ ID NO: 311565 - DNA, 75 bp, Artificial Sequence
  Synthetic
ggcgccggtatggtgcgtcttgaaggcacgaaggtgttcatgcagagtgggcacataacatgtgatgtgggtctg

SEQ ID NO: 311566 - DNA, 75 bp, Artificial Sequence
  Synthetic
gagaagctgaaactcaaaggcataacatactccatgtgtgagagcggaaagttctcatggaagaggccccccacg

SEQ ID NO: 311567 - DNA, 75 bp, Artificial Sequence
  Synthetic
gatagcggtcatgacacagtggttatggaggtgagctattccggggccaccaaaccctgcaggattcctgtgatg

SEQ ID NO: 311568 - DNA, 75 bp, Artificial Sequence
  Synthetic
gcgacggctcatggtgaagaatccaacgttgcgatgctcatcacctctaatcccaccattgagacagacaaggga

SEQ ID NO: 311569 - DNA, 75 bp, Artificial Sequence
  Synthetic
gggtttatagagatgcaagtgccgcctggcgacatcaccatcaagattggagacctgaagcagcagtggtttcag

SEQ ID NO: 311570 - DNA, 75 bp, Artificial Sequence
  Synthetic
aaaggcagcacaataggaagagtgtttcagaaaactaggcgtggtgttgagcgccttgttgctgttggagaacac

SEQ ID NO: 311571 - DNA, 75 bp, Artificial Sequence
  Synthetic
gcatgggatttcggctctgtgggaggagtgttttcctctgtagcgaaggcttgccacatggtgttgggtaatcta

SEQ ID NO: 311572 - DNA, 75 bp, Artificial Sequence
  Synthetic
ttcggggccgtgttcggagggttcgggttccttcccaggatcctcattggagcaggtctcgtctggcttggactc

SEQ ID NO: 311573 - DNA, 75 bp, Artificial Sequence
  Synthetic
aatgctaggaatgtgaccttgtcggtggggttcctggccgtggggggaatccttctggcgctgaccctgggtgtg

SEQ ID NO: 311574 - DNA, 75 bp, Artificial Sequence
  Synthetic
ggggctgacgtgggctgctcaatagaccccgtgagaaaggaacttcggtgtggagagggactggcagtgtggaag

SEQ ID NO: 311575 - DNA, 75 bp, Artificial Sequence
  Synthetic
gagacgtcggagtggtatgatggatatgtgttctacccggaatcacctggggcactggcggcggccctactggat

SEQ ID NO: 311576 - DNA, 75 bp, Artificial Sequence
  Synthetic
gcatacgagagcggggtctgtgggcttgtcccccagaacagactagagatggctatgtggagagcagttgcagga

SEQ ID NO: 311577 - DNA, 75 bp, Artificial Sequence
  Synthetic
gagttgaatgtggtgctggttgagaatgacgcaaacctcactgtggtggttgatgggagagacccacaggactac

SEQ ID NO: 311578 - DNA, 75 bp, Artificial Sequence
  Synthetic
cgcgggggcagggctggacagctgggaaccggaaagaaggacatgacagttaaatggcacacatggggaaaggca

SEQ ID NO: 311579 - DNA, 75 bp, Artificial Sequence
  Synthetic
ttgttgtggacagttcctgagagccccagacgaatgcttgtaggtgtgaccaagacggatgaatgtccgatgcat

SEQ ID NO: 311580 - DNA, 75 bp, Artificial Sequence
  Synthetic
agaagactgaccaatgtgtttcaagttgcggagtttggtgtggggtttcggacgaaagtgttcttggatttccga

SEQ ID NO: 311581 - DNA, 75 bp, Artificial Sequence
  Synthetic
gacacccctacaaccctgtgcgacagtggcatgatgggagccgcagtgaagaatggttatgctgtgcatactgac

SEQ ID NO: 311582 - DNA, 75 bp, Artificial Sequence
  Synthetic
cagagcatgtggatgaggtcacacctgaatgagacgggtgttttcttggacgagctgttgctgacggacttgagg

SEQ ID NO: 311583 - DNA, 75 bp, Artificial Sequence
  Synthetic
aactgcacgtggccagggagtcacaccatcgacaatgagggagtgatagactcggagctgttccttcccgtgtcg

SEQ ID NO: 311584 - DNA, 75 bp, Artificial Sequence
  Synthetic
atggcggggcctagatccaagtataacaggattccgggatacgctgagcaagtcaagggaccttgggaccagacc

SEQ ID NO: 311585 - DNA, 75 bp, Artificial Sequence
  Synthetic
ccattacgtgtggtgagagagccgtgccctgggaccaaggtggagaaggatgcagcatgcacaaagagagggccc

SEQ ID NO: 311586 - DNA, 75 bp, Artificial Sequence
  Synthetic
tcagtgcgtagcacgacggaaagtggaaagatcataccagagtggtgctgccgggcatgtgagatgccccctgtg

SEQ ID NO: 311587 - DNA, 75 bp, Artificial Sequence
  Synthetic
acataccgtagtggcactgattgttggtatgcaatggagatacgcccgagacatgtgcagggaggtctcgtcagg

SEQ ID NO: 311588 - DNA, 75 bp, Artificial Sequence
  Synthetic
tctaccgttatggcagcgaatgaacagcttactagcgaagctggcattcctggagttgtggccataatgatactt

SEQ ID NO: 311589 - DNA, 75 bp, Artificial Sequence
  Synthetic
gtggagttgatattgcggagacgaccaggcgctggggtgaccactgtctggagtgggttgctcctgctggtgctg

SEQ ID NO: 311590 - DNA, 75 bp, Artificial Sequence
  Synthetic
atggtgctgggactcgtcactgttgagggaattctgaggtttgttgtggccgttggctcttcctttattctccag

SEQ ID NO: 311591 - DNA, 75 bp, Artificial Sequence
  Synthetic
ttggggccggacatggccaccttcgtgttgttgcaggctgcctttgacctgagggtgggcttcatgacggcattt

SEQ ID NO: 311592 - DNA, 75 bp, Artificial Sequence
  Synthetic
gtcttgaagaggacagccacccctagagaagtggtaattgtctacttttgcttgctcactcttgaacatggctta

SEQ ID NO: 311593 - DNA, 75 bp, Artificial Sequence
  Synthetic
ccaacagaaggattcgacacagccctggagtggtttgatgcggttgcggtggctgccttgaccatgaatgccagc

SEQ ID NO: 311594 - DNA, 75 bp, Artificial Sequence
  Synthetic
gttgatgaaggaaagcaggcacttggactgttggtggccggccttatggcgttgaagagcttgaggagcctgcag

SEQ ID NO: 311595 - DNA, 75 bp, Artificial Sequence
  Synthetic
ctcgggcttatggtgttcttgggactgatgtgggtgacgaccatggttggactcttcagggggcagcaggataga

SEQ ID NO: 311596 - DNA, 75 bp, Artificial Sequence
  Synthetic
aaaggctggacttacgggatccccctgtgtgggatactgggcggctctggggtcggcatacgactgttggctttc

SEQ ID NO: 311597 - DNA, 75 bp, Artificial Sequence
  Synthetic
tgggagttgaggaagaggtgcttgagaagatcaatcgaagagccattgacgatgctgggactcatgctggcagtg

SEQ ID NO: 311598 - DNA, 75 bp, Artificial Sequence
  Synthetic
tctagtggggtattaagaaactcatcaccagaggcacttgtcactgcggtggctggagcagcgatgatactggcg

SEQ ID NO: 311599 - DNA, 75 bp, Artificial Sequence
  Synthetic
ctgatcattggaaccagaaagatgcagctgacggccgaatggacgggagagatagagtggaacccagacctggtg

SEQ ID NO: 311600 - DNA, 75 bp, Artificial Sequence
  Synthetic
aacgagggaggccatgttgacctcgctgtgaggagagatgcaatgggaaatttccatgtcacggaaatagagaga

SEQ ID NO: 311601 - DNA, 75 bp, Artificial Sequence
  Synthetic
gaggagcggaagatggctgtcttcctgttcttgggccttgttgctgcagccatacactggtcgggtattctcgtg

SEQ ID NO: 311602 - DNA, 75 bp, Artificial Sequence
  Synthetic
gtttttgtcgggtggctagccgtagagacagtgtttagtggaaagagaggtgacttagtattttctggagtccct

SEQ ID NO: 311603 - DNA, 75 bp, Artificial Sequence
  Synthetic
gaggcactcgtgagagggaacgccccgttcgaagtgaaggagggcgtgtacaggatatttagacctggtctcttg

SEQ ID NO: 311604 - DNA, 75 bp, Artificial Sequence
  Synthetic
tggggacataaccagataggtgtgggatatgggaagcagggagtactgcacaccatgtggcatgtcacacgggga

SEQ ID NO: 311605 - DNA, 75 bp, Artificial Sequence
  Synthetic
gcagccattcgaatcggtgatggagtgtgtggacctcattgggcagatgtgcgtgaagacgttgtgagttatggg

SEQ ID NO: 311606 - DNA, 75 bp, Artificial Sequence
  Synthetic
ggaccctggcacttggcctcaaggtggaagggagaggttgtgcagttacatgcgttccctccaggacgtgcccat

SEQ ID NO: 311607 - DNA, 75 bp, Artificial Sequence
  Synthetic
gaggttcatcagtgtcagccaggtaggctaaagttggagaatggaaaatgcataggtgccattcccattgacatg

SEQ ID NO: 311608 - DNA, 75 bp, Artificial Sequence
  Synthetic
cccaaaggcacctcaggaagccccattcttaatgtggacggggatgttgtagggctgtatggaaacggactgaga

SEQ ID NO: 311609 - DNA, 75 bp, Artificial Sequence
  Synthetic
actaatgacacatatgtcagcggcatttctcagggatctgcggaaaagagcaaactggagatgccgttggcagtg

SEQ ID NO: 311610 - DNA, 75 bp, Artificial Sequence
  Synthetic
cagggagaagcatggttgtcgaaggggaagatcaccgtgttggacctgcaccctggggcaggaaagacccatagg

SEQ ID NO: 311611 - DNA, 75 bp, Artificial Sequence
  Synthetic
gtccttcctgatctaataaggcagtgtatcgacaagaggcttcgaactctggtgctggcgccaacgagagttgtg

SEQ ID NO: 311612 - DNA, 75 bp, Artificial Sequence
  Synthetic
cttagagaaatggaaaaagcgctacagggaaagaaggtgagattccattcgccatcagtagaccacgggagcagt

SEQ ID NO: 311613 - DNA, 75 bp, Artificial Sequence
  Synthetic
gatgcaatcgtggatgttatgtgccacgcaacttatgttaccaggcgcttgttgccgcaaggtagacagaactgg

SEQ ID NO: 311614 - DNA, 75 bp, Artificial Sequence
  Synthetic
gaagtggcaatcatggatgaggcgcattggacagacccacatagcatagcagctcggggccacctgtactcactt

SEQ ID NO: 311615 - DNA, 75 bp, Artificial Sequence
  Synthetic
gctaaggaaaacaagtgcgcgctcgtcctcatgacggcaactccacccgggcaaaatgacccatttccagagtct

SEQ ID NO: 311616 - DNA, 75 bp, Artificial Sequence
  Synthetic
aggggaaagatcgtgagtgaagagagacagatcccagatggggaatggcgtgatggatttgattggataacagag

SEQ ID NO: 311617 - DNA, 75 bp, Artificial Sequence
  Synthetic
ttcgaaggaaggacggcctggttcgtcccgtccattgcccggggagcagcaatcgcaaagactcttagacagaaa

SEQ ID NO: 311618 - DNA, 75 bp, Artificial Sequence
  Synthetic
gggaagacggtcatatgtttaaatagcaagagctttgagaaagaatatcaccgagtgcaggaggagaagcctgat

SEQ ID NO: 311619 - DNA, 75 bp, Artificial Sequence
  Synthetic
ttcgtggtcaccacagacatttcagagatgggcgccaatttggatgtccatcgagtgatagatggccggacaaat

SEQ ID NO: 311620 - DNA, 75 bp, Artificial Sequence
  Synthetic
atcaaaccagaagaggtggacggttctgtggagttgaccggggtgagacgtgtcaccacggcctccgcggcacaa

SEQ ID NO: 311621 - DNA, 75 bp, Artificial Sequence
  Synthetic
aggagaggccgggtcggaaggaaagaagggcaaacagacagttatgtctactcgggccagtgtgatgatgatgac

SEQ ID NO: 311622 - DNA, 75 bp, Artificial Sequence
  Synthetic
tccagcctggtgcagtggaaggaggcacaaatcctcttggacaacataactgcagtgcgcggaccagtcgcaacc

SEQ ID NO: 311623 - DNA, 75 bp, Artificial Sequence
  Synthetic
ttctatgggccagagcaagggaaaatgcctgaggttgccggtcactttagactaagtgaagagaagcggaaacat

SEQ ID NO: 311624 - DNA, 75 bp, Artificial Sequence
  Synthetic
tttagacatctactaagccagtgcgacttcacaccatggttggcttggaatgtggccgctaacacgacaggggtc

SEQ ID NO: 311625 - DNA, 75 bp, Artificial Sequence
  Synthetic
atggatagaagctggacatggagtggccctgagagcaatactatagacgaccagaatggagatgtggtgaagttt

SEQ ID NO: 311626 - DNA, 75 bp, Artificial Sequence
  Synthetic
aggtcaccaggtggagcggaaagaactctcaggcccctgtggaaggatgctcgcacgtttagagagggtagagac

SEQ ID NO: 311627 - DNA, 75 bp, Artificial Sequence
  Synthetic
gtgaaggagttcgtgttatatgcgtccggacgaaggagcgcaagtggaatcctggagagcatgggagccgtgccg

SEQ ID NO: 311628 - DNA, 75 bp, Artificial Sequence
  Synthetic
acactcctgagggacaagtgcgtccacgcttatgatgtgttttatacattgtacagaggaagtccaggtacaagg

SEQ ID NO: 311629 - DNA, 75 bp, Artificial Sequence
  Synthetic
gcctacgccatggcacagagggaggctcctgaggcggttctgacggcattggaagtggtgattctgggagcgctg

SEQ ID NO: 311630 - DNA, 75 bp, Artificial Sequence
  Synthetic
acgtgtggtgtgctgtggagcctgatgacaagggggtcacccggccgcatggggctgggtgtggttgtcctactg

SEQ ID NO: 311631 - DNA, 75 bp, Artificial Sequence
  Synthetic
gtctcgctgggtctcatgtgggccgggggtgtgacctatgggcagatggctggagtatcactgctgttttatgct

SEQ ID NO: 311632 - DNA, 75 bp, Artificial Sequence
  Synthetic
tttttgacagtcatacagccggagccaggaaagcagcggagcactgatgacaataagttggcctttgtgctgctg

SEQ ID NO: 311633 - DNA, 75 bp, Artificial Sequence
  Synthetic
ttcttaggagtggtcattggaggagtggcggccaacgagatggggtggttggagagaacaaagcacgacatttcc

SEQ ID NO: 311634 - DNA, 75 bp, Artificial Sequence
  Synthetic
aggttgctatggccggtgacaggagagggcggcggcgttttacaggtgtgggccgacattgacatccagcctgca

SEQ ID NO: 311635 - DNA, 75 bp, Artificial Sequence
  Synthetic
aggtcgtggggcacttatgtgtttattgtctctctgtgcacaccttaccttgtccatcagctccagaccaaggtg

SEQ ID NO: 311636 - DNA, 75 bp, Artificial Sequence
  Synthetic
cagcagctggtcaacagctcagtggcctcgggagcgcaagggatgcgcgaagtggggggaggagccccattcttt

SEQ ID NO: 311637 - DNA, 75 bp, Artificial Sequence
  Synthetic
ggagtgaagggccacgtgttgacactgggagtgacatcactggtgggagccactcctgtgtcgctgggactcgga

SEQ ID NO: 311638 - DNA, 75 bp, Artificial Sequence
  Synthetic
gcggctctggcggtttttcatctgacgctggtgctgtctggggtggaggcagaattcacgcagagggttcacaag

SEQ ID NO: 311639 - DNA, 75 bp, Artificial Sequence
  Synthetic
gcattcttttcgggaatggttaaaaaccccctggtggatggagaggtcacgtgcccctttgatggaggtgagagt

SEQ ID NO: 311640 - DNA, 75 bp, Artificial Sequence
  Synthetic
aagccagctttttatgaacggaagttaagcttgattgtggctttggcactgtgtgcgctttcgttggtgctcaac

SEQ ID NO: 311641 - DNA, 75 bp, Artificial Sequence
  Synthetic
cgcaatgcatgggccatcgccgagtcgggtgccgtgggagtggcagcccttgggcagttgatgagaccagatgaa

SEQ ID NO: 311642 - DNA, 75 bp, Artificial Sequence
  Synthetic
gagacttggtggaccatgccgatggcgtgcgggatggcaggactggttcgaggaagtctgtgggggcttctccca

SEQ ID NO: 311643 - DNA, 75 bp, Artificial Sequence
  Synthetic
ataatgcacagggcttggctgaaaacaagcggaacccgaagaggtggaggagagggcgagacacttggtgacttg

SEQ ID NO: 311644 - DNA, 75 bp, Artificial Sequence
  Synthetic
tggaaagagaaactgaatggcatgacaaaagaagagttctttcagtaccgtaggagcggtgtattggaaacagac

SEQ ID NO: 311645 - DNA, 75 bp, Artificial Sequence
  Synthetic
agaacgacggctagagaactgctgaggcgtggagagacagctatgggcttggctgtttcacgtgggacagcgaaa

SEQ ID NO: 311646 - DNA, 75 bp, Artificial Sequence
  Synthetic
ttggcatggctcgaagagcgtggctttgtcactctgaagggagaagtcgttgaccttggatgtgggcgaggaggc

SEQ ID NO: 311647 - DNA, 75 bp, Artificial Sequence
  Synthetic
tggtcctattatgcagcgtctcggccatcagtgatgggtgtgaaagcctataccatagggggacgtggccatgag

SEQ ID NO: 311648 - DNA, 75 bp, Artificial Sequence
  Synthetic
gaaccccggcttgtcacgagtctaggatggaacctggtgaagttccgtagctctatggatgtgttcaccatggat

SEQ ID NO: 311649 - DNA, 75 bp, Artificial Sequence
  Synthetic
ccccacagagcggacaccatactgtgtgacatcggagaaagcagctcgtcagcggagaaggaaggggagaggtca

SEQ ID NO: 311650 - DNA, 75 bp, Artificial Sequence
  Synthetic
cgtagagtgatttttcttatggaacaatggaaaatgaggaatccgacagcagcttgtgtgtttaaggttttagca

SEQ ID NO: 311651 - DNA, 75 bp, Artificial Sequence
  Synthetic
ccatataggccagaagtgatagaggctctccaccggtttcagttgcagtggggcggggggctggttagggtccct

SEQ ID NO: 311652 - DNA, 75 bp, Artificial Sequence
  Synthetic
ttctcacgcaactccacgcatgagatgtattattccacggccgttagcggaaacttggtgaacgctgtaaatgtg

SEQ ID NO: 311653 - DNA, 75 bp, Artificial Sequence
  Synthetic
acaacgaagaggctgatggataggatggcagactccagaggacccatcagggtgccagaagtggaccttggtgta

SEQ ID NO: 311654 - DNA, 75 bp, Artificial Sequence
  Synthetic
ggaactagatgtgtggttctagctgaggatagagtgagggaggaagatgtcattgagagggtggaggccctgaga

SEQ ID NO: 311655 - DNA, 75 bp, Artificial Sequence
  Synthetic
aagcaatatgcggacacatggcatgtggactctgaacatccgtaccgaacgtggcagtactgggggagctacaga

SEQ ID NO: 311656 - DNA, 75 bp, Artificial Sequence
  Synthetic
acaccacccatgggctcggcggcctcgctgatcaatggggttgtcaagcttctcagctggccttggaacgcccgc

SEQ ID NO: 311657 - DNA, 75 bp, Artificial Sequence
  Synthetic
gaggacgttgtcaggatggccatgactgatacaacggcatttgggcagcagagggtcttcaaggacaaggtggat

SEQ ID NO: 311658 - DNA, 75 bp, Artificial Sequence
  Synthetic
acaaaagctcaggagccacaaccgggaacccgtgtcatcatgcgctgcgtcaatgattggatgatggatagactg

SEQ ID NO: 311659 - DNA, 75 bp, Artificial Sequence
  Synthetic
gcaaaaaggagcaagccgcgcctgtgcacaaaagaagagttttgcgcaaaggtgagatcaaatgcagcgttggga

SEQ ID NO: 311660 - DNA, 75 bp, Artificial Sequence
  Synthetic
gcatggacagatgagcagaatatatggaagaacgccagggaagctgtggaagacccaggattttggaaccttgtt

SEQ ID NO: 311661 - DNA, 75 bp, Artificial Sequence
  Synthetic
gatgctgagcgtgagctacacaggcagggaagatgtgctcaatgcgtatacaacatgatggggaagcgtgagaag

SEQ ID NO: 311662 - DNA, 75 bp, Artificial Sequence
  Synthetic
aagctgggagaatttggctcggccaaaggaagcagagccatatggtacatgtggttgggcagccggtttttggag

SEQ ID NO: 311663 - DNA, 75 bp, Artificial Sequence
  Synthetic
tttgaggccctgggttttctcaatgaagaccattgggcgtcgcgagaggcttgtggagctggggtcgagggaacg

SEQ ID NO: 311664 - DNA, 75 bp, Artificial Sequence
  Synthetic
agtttgaactatctcggctggctggtgagagaactggggcagatgaatggtggcaagatgtatgctgacgacact

SEQ ID NO: 311665 - DNA, 75 bp, Artificial Sequence
  Synthetic
gctggatgggataccagaatcacgaatgccgatttggaggatgaggagcaactgttaaggcacatggaaggtgag

SEQ ID NO: 311666 - DNA, 75 bp, Artificial Sequence
  Synthetic
cacagagttttggcacgcaccatatttcagaaagcatatcacgccaaagtggtgagggtcgcaagaccatcctcc

SEQ ID NO: 311667 - DNA, 75 bp, Artificial Sequence
  Synthetic
gatgggggatgtgtgatgggcatcataacgcggagggaccaaagaggttctggtcaggtcgtgacttatgcgctg

SEQ ID NO: 311668 - DNA, 75 bp, Artificial Sequence
  Synthetic
aatactcctaccaacatcaaggtacagttgatgaggatgatggagagtgagggggtcatcggtccagctgatgca

SEQ ID NO: 311669 - DNA, 75 bp, Artificial Sequence
  Synthetic
catgaccccaggttgctgagagttgagaattggttgcagcgccatggcgaggaaaggttgaggcgtatgttggta

SEQ ID NO: 311670 - DNA, 75 bp, Artificial Sequence
  Synthetic
agtggtgatgactgcgtcgtcaagcccatagatgaccgttttgcaggggccttgtattttctcaatgacatggca

SEQ ID NO: 311671 - DNA, 75 bp, Artificial Sequence
  Synthetic
aaggtgcggaaagacaccacggaatgggaacactcacgtggatttgagagctgggaagaagtccccttctgccca

SEQ ID NO: 311672 - DNA, 75 bp, Artificial Sequence
  Synthetic
caccactttcacgagctggtcatgaaggacggacgcacgctggtggttccatgtagggatcaggatgagttggtg

SEQ ID NO: 311673 - DNA, 75 bp, Artificial Sequence
  Synthetic
gggagagccagagtgtcgccaggatgtggttggagcataagggagaccgcatgcctttccaaggcctatggacag

SEQ ID NO: 311674 - DNA, 75 bp, Artificial Sequence
  Synthetic
atgtggcttctgagttactttcacaggcgagatcttcgaactctaggactggctatatgctctgcggtgcctgtt

SEQ ID NO: 311675 - DNA, 75 bp, Artificial Sequence
  Synthetic
gattgggtgcccactggacggacgacttggagcattcacgcaagtggtgcttggatgacgacagaagacatgttg

SEQ ID NO: 311676 - DNA, 75 bp, Artificial Sequence
  Synthetic
gaggtctggaatagagtgtggattcaggacaacccctacatggaagataagagcaaggtcgcggaatggagagac

SEQ ID NO: 311677 - DNA, 75 bp, Artificial Sequence
  Synthetic
gtgccctacttgcctaaggcgcaggacatggtctgcgggtcactcataggcagggcagacagagctgaatgggcg

SEQ ID NO: 311678 - DNA, 75 bp, Artificial Sequence
  Synthetic
cggaagatatggacaggggttttgaaggtgcgggctatgattgggcatgagagataccgagactacctgtcatgc

SEQ ID NO: 311679 - DNA, 75 bp, Artificial Sequence
  Synthetic
taccgagactacctgtcatgcatggacagacatgaagctccgtggatgacggacctgaatagcgacatcctgtaa

SEQ ID NO: 311680 - DNA, 75 bp, Artificial Sequence
  Synthetic
atggcaggaaaagccatcctgaaaggtaaggggggcaacccccctcggcaaaagccgaaagtggttgcaaagaaa

SEQ ID NO: 311681 - DNA, 75 bp, Artificial Sequence
  Synthetic
tcgcggcagcgaccgactgctttgccaagagcattggtgctgtctcgtatgctggagatcgtatggcaggtcatt

SEQ ID NO: 311682 - DNA, 75 bp, Artificial Sequence
  Synthetic
acaatggccccaaggtctccggctttgaagactttctggaggattgtgccattacaacaggcacaggcagctttg

SEQ ID NO: 311683 - DNA, 75 bp, Artificial Sequence
  Synthetic
aagcgcatccggaaagtggtgggttcgctgttgcagaatcttcaaaaaagaggaaaacgcagatcggctgtggat

SEQ ID NO: 311684 - DNA, 75 bp, Artificial Sequence
  Synthetic
tggacaggagcggtcacgatggtgattgtcctccctttgtgtttggcattgaccatgcgcagtggggatggtgga

SEQ ID NO: 311685 - DNA, 75 bp, Artificial Sequence
  Synthetic
ggcaccatattacgcactgaaggaaaggacgcagcgacccaggtccgtgtgggaaatggatcatgtgtgatccta

SEQ ID NO: 311686 - DNA, 75 bp, Artificial Sequence
  Synthetic
gccacggacatgggggcatggtgtgacgattccattgcgtatgagtgtatcaccatcgagcccaatgaagaacct

SEQ ID NO: 311687 - DNA, 75 bp, Artificial Sequence
  Synthetic
gtggacgtggactgcttttgtcgaggtgttgacaatgtgtggatcgagtatggccgctgtgacaggaagagtgga

SEQ ID NO: 311688 - DNA, 75 bp, Artificial Sequence
  Synthetic
ggacggtcgcgaagatctgtgaacatacctgtgcacgtgagcaaggatctcactggaaggggtcacacttggttg

SEQ ID NO: 311689 - DNA, 75 bp, Artificial Sequence
  Synthetic
cagggcagcaatgtcaaggagcatctgacgagagtcgagagctgggtgtggaagaacaaggtcctagtgctggcc

SEQ ID NO: 311690 - DNA, 75 bp, Artificial Sequence
  Synthetic
gtttctgcgttggtttgggtgacgattgaaagcgtccccatgcgcattgtgctgatcattggtggcatgcttttg

SEQ ID NO: 311691 - DNA, 75 bp, Artificial Sequence
  Synthetic
gccccggcgtacgcgtcaagatgcgtgcacttgggaaaccgtgactttgtgacgggaacccaagggaccactgcg

SEQ ID NO: 311692 - DNA, 75 bp, Artificial Sequence
  Synthetic
gtgacgttagtgttggagctgggcgggtgtgtgacactcagtgctgaagggaaaccctccattgacttgtggttg

SEQ ID NO: 311693 - DNA, 75 bp, Artificial Sequence
  Synthetic
aaaagtatccatcaagactccctagctatcaccagagagtactgcctgcatgccaaattgacggataccaaagtg

SEQ ID NO: 311694 - DNA, 75 bp, Artificial Sequence
  Synthetic
gcggcgaggtgcccaacgactgggccagcaaccctccctgaagagcaccagaagaacatggtgtgcaaaagagat

SEQ ID NO: 311695 - DNA, 75 bp, Artificial Sequence
  Synthetic
cagagtgataggggatgggggaaccactgcgggctgttcggaaaaggtagcattgttggatgtacgaagtttgat

SEQ ID NO: 311696 - DNA, 75 bp, Artificial Sequence
  Synthetic
tgcgaggtcaacaagaaagccactgggagagtgtttgacatcaccaagattgtgtacacggtgaaggtggaacca

SEQ ID NO: 311697 - DNA, 75 bp, Artificial Sequence
  Synthetic
cacactggcacatatgtggcagcaaatgagacaaacagcgacagaaagtcagttgagttcaccgcacagtcggaa

SEQ ID NO: 311698 - DNA, 75 bp, Artificial Sequence
  Synthetic
aagaagaccatctccttggggagctatggtgaggttggactctcttgcagggtgaattctggcattgacgttgac

SEQ ID NO: 311699 - DNA, 75 bp, Artificial Sequence
  Synthetic
caaaccgtggtgctggagttggaaggccaggcactccaccccaaggggtgggctgtgcacaaagactggtttgga

SEQ ID NO: 311700 - DNA, 75 bp, Artificial Sequence
  Synthetic
gacctggcactaccatggaaacaccatgaggcggagatctgggaagacaaggaacggcttgtggaatttggacca

SEQ ID NO: 311701 - DNA, 75 bp, Artificial Sequence
  Synthetic
ccacatgcagtgaagatggacgtctacaatctgggcgatcagacagggatcttgatgaggtcactggctggggcg

SEQ ID NO: 311702 - DNA, 75 bp, Artificial Sequence
  Synthetic
tccgtggtagacgtacagggaaccaaggtctttctgcagagtggccacgtgacatgcaatgttggcctggagaaa

SEQ ID NO: 311703 - DNA, 75 bp, Artificial Sequence
  Synthetic
ctgaagttgaaaggaatgacctattccatgtgtgaagaggggaagttcgcctggaagcggcctccaactgacagt

SEQ ID NO: 311704 - DNA, 75 bp, Artificial Sequence
  Synthetic
gggcatgacacagtggtgatggaggtgacctacacgggaactgtgaaaccctgcagaatacaagtgagagctgaa

SEQ ID NO: 311705 - DNA, 75 bp, Artificial Sequence
  Synthetic
gccaagggtgcgcccaacgtcgatgtggcaaatctcataacccctaacccaaccattgagaatgaagggggtggg

SEQ ID NO: 311706 - DNA, 75 bp, Artificial Sequence
  Synthetic
tacattgagatgcaacttcctcccggggacaacacaatttatatcggcaaccttcaccaagcatggttccagaaa

SEQ ID NO: 311707 - DNA, 75 bp, Artificial Sequence
  Synthetic
gggagctccataggcagagtgtttgaaaagacacgcaaggggatccagagactggcagcagttggagagcacgca

SEQ ID NO: 311708 - DNA, 75 bp, Artificial Sequence
  Synthetic
tgggactttggttccgtgggcggcttctttgggtcaattggaaaggcagtgcacatggtactgggcggactgttc

SEQ ID NO: 311709 - DNA, 75 bp, Artificial Sequence
  Synthetic
tgtgtcttgtttggaggcattgggtttatccccaagatgctgatgggagctgccttgatttggcttggaataaac

SEQ ID NO: 311710 - DNA, 75 bp, Artificial Sequence
  Synthetic
atgaaaaacaccaccttgtctcttagctttctggccacaggtggactcatcctgatgatgacacttggcgttggg

SEQ ID NO: 311711 - DNA, 75 bp, Artificial Sequence
  Synthetic
gcagaccaaggatgttccattgacagtgagagaatggagctcagatgtggagcaggactggccgtttggaaggaa

SEQ ID NO: 311712 - DNA, 75 bp, Artificial Sequence
  Synthetic
accgcagagtggtatgacggctatgcgttccaccctgagtccccgggagagctggctgcagcgctcgtggaggca

SEQ ID NO: 311713 - DNA, 75 bp, Artificial Sequence
  Synthetic
gccaagaacaacgtgtgtggaatagtgccccaaaacaggctagaactggcaatgtggagatcgcgcagagatgag

SEQ ID NO: 311714 - DNA, 75 bp, Artificial Sequence
  Synthetic
atcaatctacacctcgctgaagcagaggccaatctcacagtgattgtggacaagatgaacccaagtgactaccgc

SEQ ID NO: 311715 - DNA, 75 bp, Artificial Sequence
  Synthetic
ggaggaatccccggcgttctcaaaaagagcgggaaggctggtcaggtgtcatggagcagttgggggagatccatt

SEQ ID NO: 311716 - DNA, 75 bp, Artificial Sequence
  Synthetic
atgtggagcatccctgaggcccagagaaggttctatgttggggtcctgaacgtgaatgagtgtccactgcacaat

SEQ ID NO: 311717 - DNA, 75 bp, Artificial Sequence
  Synthetic
aggctaacgggcgtttttagagtggctgagtttggggcaggtctccaaacaaaggtctttcttgacttccaggag

SEQ ID NO: 311718 - DNA, 75 bp, Artificial Sequence
  Synthetic
aagccaaccaacatctgtgacagtggagtcatgggggccgcggcaaaaaatggattcgcggtgcatacagaccag

SEQ ID NO: 311719 - DNA, 75 bp, Artificial Sequence
  Synthetic
agcctttggatgaagtccagaggcaatgcaaccggtttctatattcaggagctgcatgtcatggacttgcgtaac

SEQ ID NO: 311720 - DNA, 75 bp, Artificial Sequence
  Synthetic
tgcacttggccagatgagtacaccattgacaacaagggggtgatagagtcacacctgtttctcccggtgacgctg

SEQ ID NO: 311721 - DNA, 75 bp, Artificial Sequence
  Synthetic
gctgggccgagaaccatgtacaaccagatcccaggatatgctgtgcagctgtctgggccgtggaatcaaacacct

SEQ ID NO: 311722 - DNA, 75 bp, Artificial Sequence
  Synthetic
ctgcgcgtgaaacgagaaccatgccctgggacagaggtcaagattgaccctggatgtcctggcagaggagcttct

SEQ ID NO: 311723 - DNA, 75 bp, Artificial Sequence
  Synthetic
gtgcgtagcaccacggaaagcgggaaggtgattccggagtggtgctgtagaacttgcacaatgcctccggtcaca

SEQ ID NO: 311724 - DNA, 75 bp, Artificial Sequence
  Synthetic
tttcgaagcggaacagactgctggtacgccatggagattaggccaatgcatgtgcagggcggcctggtgaagtcg

SEQ ID NO: 311725 - DNA, 75 bp, Artificial Sequence
  Synthetic
accgtggtagcctgcaacggagagctgatgcaggagggaggcatccccggaatggtcgccatcttcgtggtgatg

SEQ ID NO: 311726 - DNA, 75 bp, Artificial Sequence
  Synthetic
gagtttctgatccgtagaaggccaggaactgggcattcagtcatctggagtggtatcctcctattgggtttgttg

SEQ ID NO: 311727 - DNA, 75 bp, Artificial Sequence
  Synthetic
gttctacggttggtaactgtcgagcagctgatccggtatgccatttcagtgggcataacattcgccctgcagctt

SEQ ID NO: 311728 - DNA, 75 bp, Artificial Sequence
  Synthetic
ggaccagaggtgaccatgctcgtggccttgcaggccatctttgagttgcgagctggttttttactggcgtatgtc

SEQ ID NO: 311729 - DNA, 75 bp, Artificial Sequence
  Synthetic
ttgggtggcatgctgacagcccgtgaggtggtggcagtgtactttttgctggtgacgcttgagcatggactgccc

SEQ ID NO: 311730 - DNA, 75 bp, Artificial Sequence
  Synthetic
ctggaaggttttgaacaggccctcaattggattgatgcggctgcggtgggactgttgacagtgagagcctgtgtg

SEQ ID NO: 311731 - DNA, 75 bp, Artificial Sequence
  Synthetic
caagaagggagccagacgaagggattgttactagctggattgatgaccatgaggagcataatggttgtccaccgg

SEQ ID NO: 311732 - DNA, 75 bp, Artificial Sequence
  Synthetic
gctcttatgttgtcactcggagtgttgatgtgttccacgctggttggactagccaggggtcagagtgagaggaag

SEQ ID NO: 311733 - DNA, 75 bp, Artificial Sequence
  Synthetic
ttcttaagttggggagtgccaatggctgccctattgggaggacagggagctggactgagactgctggcagcgtgg

SEQ ID NO: 311734 - DNA, 75 bp, Artificial Sequence
  Synthetic
gaactaatggaccatccaaagaggagatctatcggcgaacccgtcaccctgctagggttgatgttggccgtgacc

SEQ ID NO: 311735 - DNA, 75 bp, Artificial Sequence
  Synthetic
agtggaatactcagaagttcctcacaagaggcgttagtggctttggccgctggggctttcctccttctcatgctc

SEQ ID NO: 311736 - DNA, 75 bp, Artificial Sequence
  Synthetic
atcatcggcaccaagaaaatgcagttggtagcagagtggacaggcatcgctgaatggaacccagaactcttaaat

SEQ ID NO: 311737 - DNA, 75 bp, Artificial Sequence
  Synthetic
gagggaggggaggtgaacttgacagtgcggcaggatgccatgggaaatctgcacctaaaatatgtggaaaaagaa

SEQ ID NO: 311738 - DNA, 75 bp, Artificial Sequence
  Synthetic
gaacgtcagatggctttgtttctcctggtcggattggctgcgtcagcgtaccattggtccgggattttggtgaca

SEQ ID NO: 311739 - DNA, 75 bp, Artificial Sequence
  Synthetic
atgggcctgtgggcactgcttgagtacctcacatccccgagaagaggagagttggtcttttccggagtggggggc

SEQ ID NO: 311740 - DNA, 75 bp, Artificial Sequence
  Synthetic
agaacagaaaatgccccttttgaagtcaaggatggagtgtaccgcatttttcgcccgggcctgttttggggagct

SEQ ID NO: 311741 - DNA, 75 bp, Artificial Sequence
  Synthetic
tctcaaattggtgtgggctacgggagtcatggcgtgctccacaccatgtggcatgtgaccagaggagctgcggtt

SEQ ID NO: 311742 - DNA, 75 bp, Artificial Sequence
  Synthetic
tccattaatggaggcgcagtaggaccgtactgggcggacatcagagaggatgtagtgtgctatgggggtgcctgg

SEQ ID NO: 311743 - DNA, 75 bp, Artificial Sequence
  Synthetic
aacctgccaaccaagtgggagggcgaggtggtacagcttcatgctttccctccgggaagggctcatgagatcaag

SEQ ID NO: 311744 - DNA, 75 bp, Artificial Sequence
  Synthetic
caatgtcagcctggcagactcaacctgggtaatgggagggtcatgggagcgatacccttcgacctgcccaaggga

SEQ ID NO: 311745 - DNA, 75 bp, Artificial Sequence
  Synthetic
acatctggaagcccaattctcaatgcacaaggcgtcgttgtgggactgtacgggaacggcctgaagactaaagac

SEQ ID NO: 311746 - DNA, 75 bp, Artificial Sequence
  Synthetic
acctatgtgagtgggattgctcaaggaacaccagaggtcagtgggcacgagatgccattggtagtccagggcacc

SEQ ID NO: 311747 - DNA, 75 bp, Artificial Sequence
  Synthetic
ggatggatgtcaaaaggagagatcacggtgattgacatgcatccaggtgcggggaagactcatagagtcctccct

SEQ ID NO: 311748 - DNA, 75 bp, Artificial Sequence
  Synthetic
gaactcatcaggcaatgcatagacaggaggcttcgaaccctgattctggccccaacaagggtggttttaagggag

SEQ ID NO: 311749 - DNA, 75 bp, Artificial Sequence
  Synthetic
atggagcaggctctgaaaggcaagaaagtgcgatttcattcccccgccgtggaggcgccgcctaacagggatgct

SEQ ID NO: 311750 - DNA, 75 bp, Artificial Sequence
  Synthetic
atagttgacgtcatgtgtcatgcgacatatgtaaatcggagactaagccccacaggaagacagaattgggaagtc

SEQ ID NO: 311751 - DNA, 75 bp, Artificial Sequence
  Synthetic
gccatcatggatgagggacactggactgacccacacagcatagctgcccggggccacttgtacacactggcaaag

SEQ ID NO: 311752 - DNA, 75 bp, Artificial Sequence
  Synthetic
gacaagaaatgtgcattcgtcctcatgtcggccacaccaccaggtcagaatgagccgttcccagagtcaaaggga

SEQ ID NO: 311753 - DNA, 75 bp, Artificial Sequence
  Synthetic
cccataatcagtgaggagaaagccataccagacggagagtggcaaaatgggtttgactgggtgaccgagtatgag

SEQ ID NO: 311754 - DNA, 75 bp, Artificial Sequence
  Synthetic
ggcaggactgcctggtttgtggcctcaattgcaagaggcgcagccattgcgcggacactgagagccaagggcaag

SEQ ID NO: 311755 - DNA, 75 bp, Artificial Sequence
  Synthetic
tcggtgatttgcttgaacagcaagacctttgaaaaggactaccatcgtgtccatgaggaaaagccagatttcgtg

SEQ ID NO: 311756 - DNA, 75 bp, Artificial Sequence
  Synthetic
gtgaccacggatatctcagagatgggggccaactttgatgtcgacagggtgatcgatggcaggaataacatcaag

SEQ ID NO: 311757 - DNA, 75 bp, Artificial Sequence
  Synthetic
cctgaggaaattgacggagcagtcgaactcattggggtcaggaaagtcaccactgcgtcggctgcccagagaaga

SEQ ID NO: 311758 - DNA, 75 bp, Artificial Sequence
  Synthetic
ggcagggtggggcgcaaggaaggaagaacggaccggtatgtgtactctggccagtgtgatgatgatgacagcatg

SEQ ID NO: 311759 - DNA, 75 bp, Artificial Sequence
  Synthetic
ctggtacagtggaaagaagcccaaatgctgttggacaatatcacaacccttaggggaatggcggcagtcttttac

SEQ ID NO: 311760 - DNA, 75 bp, Artificial Sequence
  Synthetic
ggtcctgaacaggaacggatgcccgaggtggctggcttctacaggctcaccgaggagaagaggaagtacttccgg

SEQ ID NO: 311761 - DNA, 75 bp, Artificial Sequence
  Synthetic
catctcttgtcacagaatgatttcacaccctggctggcatggcatgtggctaagaacacagcgggaccgattgac

SEQ ID NO: 311762 - DNA, 75 bp, Artificial Sequence
  Synthetic
cgaagttggacttgggagggaccggagggcaacgctatagagggccagaatggtgaggtcgtccggttcagaact

SEQ ID NO: 311763 - DNA, 75 bp, Artificial Sequence
  Synthetic
cctggtggcgctgagaaaatcttgaaaccaacctggagagacatgcgcatgttccgagaggggcgtgacatccga

SEQ ID NO: 311764 - DNA, 75 bp, Artificial Sequence
  Synthetic
gagtttgtccagtatgcaagttgccgcaggggagcgtctgaactgctgatgggaatgagtgaagtcccaggtttg

SEQ ID NO: 311765 - DNA, 75 bp, Artificial Sequence
  Synthetic
atgaggaacagagtgctgggggcttatgacgtgttctacaccctcctgcatgaaaatcccggaagccgtgctctg

SEQ ID NO: 311766 - DNA, 75 bp, Artificial Sequence
  Synthetic
aagatggctgaacgggatgcgccggaggcttttctcacccttattgaggtcgtgctgctcggactggccaccctg

SEQ ID NO: 311767 - DNA, 75 bp, Artificial Sequence
  Synthetic
ggttttctgtgggtgttcctcctgagaggatcactgagcagaatggcattgggggtgctcgtgctactcatttct

SEQ ID NO: 311768 - DNA, 75 bp, Artificial Sequence
  Synthetic
ttgtgtctcatgtgggctgggggcatgtcttatggacatatggcgggggtttctctcgtcttttatgctttcctg

SEQ ID NO: 311769 - DNA, 75 bp, Artificial Sequence
  Synthetic
actgtgatacagcccgaacctggcaaacagagaagcgccgatgacaacagattggcgttcacactccttgtcctg

SEQ ID NO: 311770 - DNA, 75 bp, Artificial Sequence
  Synthetic
ggattggtaattggaacagtggcagccaatgagcttggttggcttgagaggaccaaggctgacttaggccagctt

SEQ ID NO: 311771 - DNA, 75 bp, Artificial Sequence
  Synthetic
ctctggaaacccacggaggaagccgataggggagggtggaccgagtggaccaacattgacattcagccggcacgt

SEQ ID NO: 311772 - DNA, 75 bp, Artificial Sequence
  Synthetic
tcgtggggaacttatgtgcttgtggtgtctctcttttcgccatacatgattcatcagatgcagaccagagtccaa

SEQ ID NO: 311773 - DNA, 75 bp, Artificial Sequence
  Synthetic
cgtctggtcaacagtgccgtggtgtcgggtggccagaccatccgtgagataggagggggagcacctttctttgga

SEQ ID NO: 311774 - DNA, 75 bp, Artificial Sequence
  Synthetic
gtgaaggggcacgtcatcacaatggggataagttccctagttggggcaactccactatcactgggaattggtgtg

SEQ ID NO: 311775 - DNA, 75 bp, Artificial Sequence
  Synthetic
gcattggcggcattccatctcgccttggtgttgtcaggactggaggcggagttttcacagcgtgtgcacaaggcc

SEQ ID NO: 311776 - DNA, 75 bp, Artificial Sequence
  Synthetic
atctttgccggcatggtgaaaaatccgtgcgtggacggtgatctagtcaatccctttgatggaggagagcagaaa

SEQ ID NO: 311777 - DNA, 75 bp, Artificial Sequence
  Synthetic
tcggcattgtatgaaagaaagctcagcctcatgcttgcagtcggcctgggcgccctggctgtgtccctcaacaga

SEQ ID NO: 311778 - DNA, 75 bp, Artificial Sequence
  Synthetic
actgcgtgggccttggcagaggctggggcgctgatggtggcagctgtgggtcaactggtgtcaaccgaaggcgag

SEQ ID NO: 311779 - DNA, 75 bp, Artificial Sequence
  Synthetic
ttttggtggacaatgccggtggcgtgcggaatggcaggactggcaagaggctgttggtggggtgtgctgcctata

SEQ ID NO: 311780 - DNA, 75 bp, Artificial Sequence
  Synthetic
gcccatcgggtatggctgagaacatcagagcccaggagaggtggtggcgcgggcgacaccctgggggacatttgg

SEQ ID NO: 311781 - DNA, 75 bp, Artificial Sequence
  Synthetic
aaatcacgtctaaatgcatgcagcaaggaagactttttccaataccgacgagcccatgtgttagaaaccgacagg

SEQ ID NO: 311782 - DNA, 75 bp, Artificial Sequence
  Synthetic
accaaggctagggaactcttgagacgtggagagacaaacatggggttggccgtctcacgcggaactgccaagttg

SEQ ID NO: 311783 - DNA, 75 bp, Artificial Sequence
  Synthetic
gcgtggctagaggaaagaggttatgccaccgtcaagggggaggtcgtagacctgggctgtggacgcggtggatgg

SEQ ID NO: 311784 - DNA, 75 bp, Artificial Sequence
  Synthetic
tcatactacgccgcttccagacccaccgtattgagtgtgaaggcatacaccatcggagggaaaggacacgaggaa

SEQ ID NO: 311785 - DNA, 75 bp, Artificial Sequence
  Synthetic
ccccgtatggtcaccagcttgggatggaacctcgtgaagttcagaagtggaatggatgtgttttctatggaggcc

SEQ ID NO: 311786 - DNA, 75 bp, Artificial Sequence
  Synthetic
cacagagcagacacggtgatgtgtgacattggagagagtgatccggacccagagaaggaaggggagagaagccgc

SEQ ID NO: 311787 - DNA, 75 bp, Artificial Sequence
  Synthetic
agagtgatccagctcatgagccgctggaagcagcggaacccagacgcctcctgtgtattcaaggtgctggctcct

SEQ ID NO: 311788 - DNA, 75 bp, Artificial Sequence
  Synthetic
tacagacctgatgtcattgaggcactccacagattccagctgctgtggggtggggggctggtgagaaaccctttc

SEQ ID NO: 311789 - DNA, 75 bp, Artificial Sequence
  Synthetic
tccagaaactcgacccatgagatgtactacacgacgggggtttgtggaaacatcatcaatgctgtcaatgtgaca

SEQ ID NO: 311790 - DNA, 75 bp, Artificial Sequence
  Synthetic
tcaaaacgactgttgagtaggtatggtgatgctgctggacccgtccttgttcctgaggtagatttgggaactgga

SEQ ID NO: 311791 - DNA, 75 bp, Artificial Sequence
  Synthetic
actcgttgcgtggcactggccagtgacgtggtgaagccaaaggatgtggaagagaggatcaacgccctaaagaga

SEQ ID NO: 311792 - DNA, 75 bp, Artificial Sequence
  Synthetic
cagtactcagacacgtggcatgtggacaaagaacacccatatcggacatggcagtattgggggagttaccgaaca

SEQ ID NO: 311793 - DNA, 75 bp, Artificial Sequence
  Synthetic
gcggccacaggctcggcggcgtccttgatcaatggtgtcgtgaaattgttgagctggccctggaactctagggaa

SEQ ID NO: 311794 - DNA, 75 bp, Artificial Sequence
  Synthetic
gacgtggcccgaatggcaatgacagataccacggcattcggacagcagagggtgttcaaggacaaggtggacacg

SEQ ID NO: 311795 - DNA, 75 bp, Artificial Sequence
  Synthetic
aaagcccaggagccgcagccgggcactagaatcatcatgcgtgccgtaagtgactggctcattgatagattggcc

SEQ ID NO: 311796 - DNA, 75 bp, Artificial Sequence
  Synthetic
aaggaaagacccccccgcatgtgcacccgggaagagttttgcagcaaggtgagatccaatgcagccctaggagcc

SEQ ID NO: 311797 - DNA, 75 bp, Artificial Sequence
  Synthetic
tggtctgacgaccaaaacaagtggaaaagtgccaaagaggctgtcgaggacccggccttctggaacctggttgat

SEQ ID NO: 311798 - DNA, 75 bp, Artificial Sequence
  Synthetic
gaagaacgggagctccacaggcaaggacgttgttcccaatgtgtctacaacatgatgggaaagcgtgagaaaaag

SEQ ID NO: 311799 - DNA, 75 bp, Artificial Sequence
  Synthetic
cttggggagttcggttcggccaaggggagcagggcaatttggtacatgtggttaggcagccggttcttggagttt

SEQ ID NO: 311800 - DNA, 75 bp, Artificial Sequence
  Synthetic
gaggccttggggttcttgaatgaggaccactgggcatcaagggaagcctgtggtgctggagcggagggcaccagc

SEQ ID NO: 311801 - DNA, 75 bp, Artificial Sequence
  Synthetic
ttgaactatcttggctggcttttggctggactagggaagcttcccggtgggaagttctatgcggatgacacagct

SEQ ID NO: 311802 - DNA, 75 bp, Artificial Sequence
  Synthetic
ggctgggacactcgtgtgactaatgctgacctggaagatgaagagcaattgctgcgccacatgtctggagagcat

SEQ ID NO: 311803 - DNA, 75 bp, Artificial Sequence
  Synthetic
agagtcctggctaagaccatctttgagaaagcctaccatgccaaggttgtgaaagtggcccggccctctcccgaa

SEQ ID NO: 311804 - DNA, 75 bp, Artificial Sequence
  Synthetic
gggggatgtgtcatggacataatcaccaggcgggaccaacgtgggtctggacaggttgtgacctacgctttgaac

SEQ ID NO: 311805 - DNA, 75 bp, Artificial Sequence
  Synthetic
acactcacgaacgtgaaggtacagctcatcaggatgatggaaggtgagggcgtcattgggccctctgacgcacag

SEQ ID NO: 311806 - DNA, 75 bp, Artificial Sequence
  Synthetic
gatcctaggctccgccgagttgaacaatggcttcatgcccacggggcagaaaggtcgactcggatgttggtcagt

SEQ ID NO: 311807 - DNA, 75 bp, Artificial Sequence
  Synthetic
ggtgacgactgtgtggtgagacccattgatgacaggttcggcacggccctctacttcctgaatgacatggcgaaa

SEQ ID NO: 311808 - DNA, 75 bp, Artificial Sequence
  Synthetic
gcgagaaaggacatcggcgagtgggagccatccatcggtttcgctaggtgggaggaagttccattttgctcccac

SEQ ID NO: 311809 - DNA, 75 bp, Artificial Sequence
  Synthetic
cactaccatgagcttgccatgaaggatggaagaacgctgatagtgccatgccgcgaccaagacgagcttgtgggc

SEQ ID NO: 311810 - DNA, 75 bp, Artificial Sequence
  Synthetic
agggcgagagtgtctccgggatgcggatggagtgtcagagagacagcctgtctgtcaaaggcttatgcgcagatg

SEQ ID NO: 311811 - DNA, 75 bp, Artificial Sequence
  Synthetic
tggctgctgagctatttccacaggagagacctcaggacactgggttttgcgatctgttcctcggtgccagtggat

SEQ ID NO: 311812 - DNA, 75 bp, Artificial Sequence
  Synthetic
tgggtgcccactggaagaacgacctggagcatccacgccagtggtgcctggatgacaaccgaggatatgctcagt

SEQ ID NO: 311813 - DNA, 75 bp, Artificial Sequence
  Synthetic
gtctggaacaaagtttggatcgaggacaacccccacatgagagacaagacaagagttgatgcatggagagacatc

SEQ ID NO: 311814 - DNA, 75 bp, Artificial Sequence
  Synthetic
ccttaccttcctaagtcccaggatatgttgtgcgcgtcattgattggccataccgagagggctgactgggcacgg

SEQ ID NO: 311815 - DNA, 75 bp, Artificial Sequence
  Synthetic
cacatatggactggggtcatgaaggttcgagccatgataggtagggagacgtatgtggactacctgtcgcacatg

SEQ ID NO: 311816 - DNA, 75 bp, Artificial Sequence
  Synthetic
tatgtggactacctgtcgcacatggacaggcatgaggccccatggctccctgtctacgaaagctccatcatctaa

SEQ ID NO: 311817 - DNA, 75 bp, Artificial Sequence
  Synthetic
ttaggagaacaagagctggggatggcaggaaaagccatcctgaaaggtaaggggggcaacccccctcggcaaaag

SEQ ID NO: 311818 - DNA, 75 bp, Artificial Sequence
  Synthetic
gcagcagttggagagcacgcatgggactttggttccgtgggcggcttctttgggtcaattggaaaggcagtgcac

SEQ ID NO: 311819 - DNA, 75 bp, Artificial Sequence
  Synthetic
actttggttccgtgggcggcttctttgggtcaattggaaaggcagtgcacatggtcctggggggactgttcggtg

SEQ ID NO: 311820 - DNA, 75 bp, Artificial Sequence
  Synthetic
gtggactacctgtcgcacatggacaggcatgaggccccatggctccctgtctacgaaagctccatcatctaagac

SEQ ID NO: 311821 - DNA, 75 bp, Artificial Sequence
  Synthetic
cacaattgaggggcacactggcaacacaccattggtgacgggaattaggtcgaccccgccagtgggctcctcaaa

SEQ ID NO: 311822 - DNA, 75 bp, Artificial Sequence
  Synthetic
gacagaatgtgagaccaaccaagggctgggagggcaaccagcttttgaaggacacccttgcccatactggacgca

SEQ ID NO: 311823 - DNA, 75 bp, Artificial Sequence
  Synthetic
ggcggcagcacaccattaacatcggtgacgggaagatagtcgctcccgacgcatgtggaccagtgaaaactttgt

SEQ ID NO: 311824 - DNA, 75 bp, Artificial Sequence
  Synthetic
gagactgaccatccctcaaggccgagtgggatgcgtatgaaggcccctggagagatccaggaggggggagagagg

SEQ ID NO: 311825 - DNA, 75 bp, Artificial Sequence
  Synthetic
aaaattggcagcctctctcaggagatttcctccccctataccaaattccccaggaatctggggggcggttcttgt

SEQ ID NO: 311826 - DNA, 75 bp, Artificial Sequence
  Synthetic
attggcagcctctctcaggagatttcctccccctataccaaattccccaggaatctggggggcggttcttgttct

SEQ ID NO: 311827 - DNA, 75 bp, Artificial Sequence
  Synthetic
agattttcttgcatgtgagtgagttgactttagtcagtccgctcagcaagagtgctttgatattgtttttggagc

SEQ ID NO: 311828 - DNA, 75 bp, Artificial Sequence
  Synthetic
aagtttgttaacgtgttgagaaaaagacagcttaggagaacaagagctggggatggctgggaaagccatcctgaa

SEQ ID NO: 311829 - DNA, 75 bp, Artificial Sequence
  Synthetic
aggtaaggggggcaaccctcctcggcaaaagccgaaagtggttgcaaagaaatcgcgacagcgaccagctgcttt

SEQ ID NO: 311830 - DNA, 75 bp, Artificial Sequence
  Synthetic
gccaagagcattggtgctgtcgcgtatgctggagatagtgtggcaggtcataacaatggctccaaggtctccagc

SEQ ID NO: 311831 - DNA, 75 bp, Artificial Sequence
  Synthetic
cttgaaagctttttggagaatcgtgccactgcagcaggcgcaggcagccttgaagcgtatccgcaaggtagtagg

SEQ ID NO: 311832 - DNA, 75 bp, Artificial Sequence
  Synthetic
ctcgttgctgcaaagcctccagaagagaggaaaacggcggtcgaccacagactggacagggatacttatggctgt

SEQ ID NO: 311833 - DNA, 75 bp, Artificial Sequence
  Synthetic
ggtcatccttccattgtgcctggcgttgaccatgcgcagtggggatgatgggaaactcatattgcgcaccgaagg

SEQ ID NO: 311834 - DNA, 75 bp, Artificial Sequence
  Synthetic
gaaagatgcagctacccaggcacgtgtggggaatgggtcatgtgtgatcctggccacagacatgggagcgtggtg

SEQ ID NO: 311835 - DNA, 75 bp, Artificial Sequence
  Synthetic
cgacgactccattgagtatgagtgcataaccattgagccaaacgaggaacctatagacgtagactgcttttgccg

SEQ ID NO: 311836 - DNA, 75 bp, Artificial Sequence
  Synthetic
gggcgttgacaacgtctggattgagtatggacgttgtgataggaagagtggtgagcgctctagaagatctgtgaa

SEQ ID NO: 311837 - DNA, 75 bp, Artificial Sequence
  Synthetic
catacctgtgcatgtgagcaaggacctcactggaagaggccacacatggctacagggcagtaatgttaaggagca

SEQ ID NO: 311838 - DNA, 75 bp, Artificial Sequence
  Synthetic
tctgacaagagttgagagttgggtgtggaagaacaaagtcttggtcctggccgtatccgcgctggtatgggtgat

SEQ ID NO: 311839 - DNA, 75 bp, Artificial Sequence
  Synthetic
ggttgagagcgtccccatgcgcatcgtgttgattgttggtggcatgtttttggctccggcttacgcgtcaagatg

SEQ ID NO: 311840 - DNA, 75 bp, Artificial Sequence
  Synthetic
tgtccacttggagaaccgtgactttgtgacggggacccaggggaccaccttggtgacactggtgctggagttagg

SEQ ID NO: 311841 - DNA, 75 bp, Artificial Sequence
  Synthetic
cgggtgtgtgaccctcagtgctgaggggaagccctccatagacctttggctagaaaacatccatcaggatgccct

SEQ ID NO: 311842 - DNA, 75 bp, Artificial Sequence
  Synthetic
ggctgttactagggagtactgtcttcatgccaaactaacaaataccaaggtggcagccaggtgtccaacgaccgg

SEQ ID NO: 311843 - DNA, 75 bp, Artificial Sequence
  Synthetic
acctgcgacactctccgaggaacaccagaagaacatggtgtgcaaaagagaccaaagtgacaggggttggggaaa

SEQ ID NO: 311844 - DNA, 75 bp, Artificial Sequence
  Synthetic
ccactgtggactgttcggaaaggggagcatcgtgggatgcaccaaatttgactgtgagaccaacaagaaagccac

SEQ ID NO: 311845 - DNA, 75 bp, Artificial Sequence
  Synthetic
tgggaaagtgttcgacattaccaagattgtgtacaccgtgaaggttgagccacacactggaacatatgtggcagc

SEQ ID NO: 311846 - DNA, 75 bp, Artificial Sequence
  Synthetic
gaacgagacacacagtgacaggaaaactgtagcattcactgcgcagtctgagaaaaagaccatctccatgggaaa

SEQ ID NO: 311847 - DNA, 75 bp, Artificial Sequence
  Synthetic
ctatggagaagttggactctcatgcagggtcaactccggcattgatgtggaccagaccgtggttttggagttaga

SEQ ID NO: 311848 - DNA, 75 bp, Artificial Sequence
  Synthetic
aagtcaagcactccatcccaaagggtgggcggtgcacaaggactggttcaatgacctggcgctgccgtggaaaca

SEQ ID NO: 311849 - DNA, 75 bp, Artificial Sequence
  Synthetic
tcatgaggcagaggtctgggaaagcaaagagcggcttgtggagtttggaccaccacacgcggtgaagatggacgt

SEQ ID NO: 311850 - DNA, 75 bp, Artificial Sequence
  Synthetic
cttcaacctgggtgatcaaacaggcatcctgatgaggtcattggctggagcatcagtggtggacgtccaaggcac

SEQ ID NO: 311851 - DNA, 75 bp, Artificial Sequence
  Synthetic
caaagtgtatttgcaaagcggccatgtgacatgcaatgttggcctggaaaaattgaagctgaaaggaatgaccta

SEQ ID NO: 311852 - DNA, 75 bp, Artificial Sequence
  Synthetic
ttccatgtgtgaggaaggaaagtttgcatggaagcggcccccaacggatagtggacatgacacagtggtgatgga

SEQ ID NO: 311853 - DNA, 75 bp, Artificial Sequence
  Synthetic
ggtgacctacacaggaactgtgaagccctgcagaatacaagtgagagctgaggccaagggtgcccctggtgttga

SEQ ID NO: 311854 - DNA, 75 bp, Artificial Sequence
  Synthetic
tgtggccaacctcataactcctaatccaaccattgaatatgatggaggaggatacattgagatgcagctccctcc

SEQ ID NO: 311855 - DNA, 75 bp, Artificial Sequence
  Synthetic
tggagacaacaccatctacgtaggtaagatccaccaggcatggtttcagaaagggagttccattggcagggtgtt

SEQ ID NO: 311856 - DNA, 75 bp, Artificial Sequence
  Synthetic
tgagaagacacgtaagggaatccagagattggctgctgtgggagaacacgtgtgggacttcgggtccgtgggcgg

SEQ ID NO: 311857 - DNA, 75 bp, Artificial Sequence
  Synthetic
cttcttcgggtcaattggaaaggcggcacatatggtcttgggggggctcttcggggtcctctttggaggcattgg

SEQ ID NO: 311858 - DNA, 75 bp, Artificial Sequence
  Synthetic
gtttattcccaagatgttgatgggagccgccttgatctggctcggaatcaacatgaagaacaccactctgtccct

SEQ ID NO: 311859 - DNA, 75 bp, Artificial Sequence
  Synthetic
tagttttttggccataggaggactcatcttgatgatgacactcggtgtgggagcggaccagggatgctctattga

SEQ ID NO: 311860 - DNA, 75 bp, Artificial Sequence
  Synthetic
cagtgagaggatggagctcagatgtggggcgggattggccgtctggaaagagaccactgaatggtatgatggcta

SEQ ID NO: 311861 - DNA, 75 bp, Artificial Sequence
  Synthetic
tgcgttccatcctgaatccccaggagaattggctgcagcacttgtggaggcagccaagaacaatgtgtgtggaat

SEQ ID NO: 311862 - DNA, 75 bp, Artificial Sequence
  Synthetic
cgtgcctcagaacaggctggagatggcaatgtggaggtcacgcagggatgagatcaacctgcatctggccgagac

SEQ ID NO: 311863 - DNA, 75 bp, Artificial Sequence
  Synthetic
tgatgccaacctcacggtggtcgtggataggatgaatccaagcgactaccgtggcggaacccctggggtcctcaa

SEQ ID NO: 311864 - DNA, 75 bp, Artificial Sequence
  Synthetic
gaggaatgggaaagctgggcaggtgacatggagcagttgggggaggtccatcatatggagcgtccctgaggccca

SEQ ID NO: 311865 - DNA, 75 bp, Artificial Sequence
  Synthetic
gagaaggttctacattggggtcctgaatgtgaatgaatgtccactgcgcaacaggctaacaggagtattcagagt

SEQ ID NO: 311866 - DNA, 75 bp, Artificial Sequence
  Synthetic
ggccgagtttggagctggtctccagacaaaggtttttctggacttccaagaaaagccaaccaacacctgcgacag

SEQ ID NO: 311867 - DNA, 75 bp, Artificial Sequence
  Synthetic
tggagtcatgggggccgcggtaaagaatgggtacgcggtccacacagaccagagcctctggatgaagtccaaggg

SEQ ID NO: 311868 - DNA, 75 bp, Artificial Sequence
  Synthetic
caacgcaactggcttctacatacaggagttgcatgtcacagatttgcgcaactgcacttggccagatgagtacac

SEQ ID NO: 311869 - DNA, 75 bp, Artificial Sequence
  Synthetic
cattgacaacaaaggagtaatagagtcgcacctcttcctcccggtgaaactagctggaccaaggaccatgtacaa

SEQ ID NO: 311870 - DNA, 75 bp, Artificial Sequence
  Synthetic
ccagattccaggctatgctgtgcaactgtcagggccgtgggaccagacgccgttgcgcatcaaacgggaaccatg

SEQ ID NO: 311871 - DNA, 75 bp, Artificial Sequence
  Synthetic
tcctggtacagaggtcaagattgaccccggatgccctggcagaggagcttctgtgcggagcaccacggagagtgg

SEQ ID NO: 311872 - DNA, 75 bp, Artificial Sequence
  Synthetic
gaaagtcattccggaatggtgttgtagaacctgcacaatgcccccagtcacctttcgcagtggaacagactgttg

SEQ ID NO: 311873 - DNA, 75 bp, Artificial Sequence
  Synthetic
gtatgccatggagatcaggccagtgcgtgtgcagggaggcctagtgaagtcaactgtggtggcaggcaatgtgga

SEQ ID NO: 311874 - DNA, 75 bp, Artificial Sequence
  Synthetic
gctaatgcaggaggggggcattcctgggatggtcgccatcttcgtggtgatggagttccttgtacgcaggagacc

SEQ ID NO: 311875 - DNA, 75 bp, Artificial Sequence
  Synthetic
gggggtagggtgttctatcatctggagtggcatccttctgttcggcttgctggtactgcagctggtttccgtaga

SEQ ID NO: 311876 - DNA, 75 bp, Artificial Sequence
  Synthetic
acaactgattcggtatgctgtttccgtgggcataacattcgccctacagcttggccctgaggtaagcatgcttgt

SEQ ID NO: 311877 - DNA, 75 bp, Artificial Sequence
  Synthetic
agctctacaggccatctttgagctgcgagctggatttcttctggcgtatgtcttgggtggcatgctgacagcccg

SEQ ID NO: 311878 - DNA, 75 bp, Artificial Sequence
  Synthetic
tgaggtggtggctgtgtatttcctgcttgtgacacttgagcatggactccccctagggggttttgtccaggccct

SEQ ID NO: 311879 - DNA, 75 bp, Artificial Sequence
  Synthetic
taattggattgatgctgcgacggtggggctgctgacagtgagagcgtgtgtgcaggagggagaccgggcaaaggg

SEQ ID NO: 311880 - DNA, 75 bp, Artificial Sequence
  Synthetic
actgttgttggctgcattgatggccatgaggagtatgacagttgcccatcgagcactcatgctgtcacttggggt

SEQ ID NO: 311881 - DNA, 75 bp, Artificial Sequence
  Synthetic
cctaatgtgttccacactgattggattggtccgagggcagagtgagaggaagttcctgagttggggagtgccact

SEQ ID NO: 311882 - DNA, 75 bp, Artificial Sequence
  Synthetic
cgctgctctattggggggacagggtgccggactgagattgttggcagcctgggagctgatggaacacccaaagag

SEQ ID NO: 311883 - DNA, 75 bp, Artificial Sequence
  Synthetic
aagatctatcggtgagcccatcaccctcttgggtttgatgttggctgtgaccagtggcatactcagaagctcttc

SEQ ID NO: 311884 - DNA, 75 bp, Artificial Sequence
  Synthetic
gcaagaggctctcgtagccttggctgcgggggccttcatcctccttttgctcatcatcggcaccaagaaaatgca

SEQ ID NO: 311885 - DNA, 75 bp, Artificial Sequence
  Synthetic
gctggtggctgagtggacaggcgttgcagagtggaatccggagctcctgaatgagggaggggaagtgaacttgac

SEQ ID NO: 311886 - DNA, 75 bp, Artificial Sequence
  Synthetic
agtgcggcaggatgccatgggcaacttacatctaaaagaggtggaaaaggaagaacgtcagatggccttgttcct

SEQ ID NO: 311887 - DNA, 75 bp, Artificial Sequence
  Synthetic
cttggtgggattggcggcatcggcataccactggtccggcatcctggtagcaatggggctgtgggcactccttga

SEQ ID NO: 311888 - DNA, 75 bp, Artificial Sequence
  Synthetic
gtacgcaacatctgcaaggcgaggggagttggtcttctctggagtgggggtgagagcggagagtgcccccttcga

SEQ ID NO: 311889 - DNA, 75 bp, Artificial Sequence
  Synthetic
ggtcaaggatggagtgtatcgcatctttcgcccaggcctgttctggggtgcgtctcagattggtgtggggtatgg

SEQ ID NO: 311890 - DNA, 75 bp, Artificial Sequence
  Synthetic
aagtcatggtgtgctccataccatgtggcatgtcaccagaggagccgcggtttccataaatggaggtgcggcggg

SEQ ID NO: 311891 - DNA, 75 bp, Artificial Sequence
  Synthetic
accatactgggctgacatcagagaggacgtggtgtgctatggaggcgcctggaatctaccgaccaagtgggaggg

SEQ ID NO: 311892 - DNA, 75 bp, Artificial Sequence
  Synthetic
tgaagtggtgcagctgcatgccttccctccaggaagggcccatgagatcaaacagtgtcaacctggtagactcaa

SEQ ID NO: 311893 - DNA, 75 bp, Artificial Sequence
  Synthetic
cctgggtgatgggaggatcatgggagcgatcccttttgacctacctaagggcacatctgggagtccaattctcaa

SEQ ID NO: 311894 - DNA, 75 bp, Artificial Sequence
  Synthetic
tgcacagggtgttgttgtgggcttgtacggaaatggcttaaaaaccaaggacatctacgtgagtggaattgccca

SEQ ID NO: 311895 - DNA, 75 bp, Artificial Sequence
  Synthetic
gggaacgccagaggtcggtggacatgagatgccgttggctgtgcagggtacaggatggatgtcaaaaggagagat

SEQ ID NO: 311896 - DNA, 75 bp, Artificial Sequence
  Synthetic
cactgtggttgacatgcatccaggtgcggggaagactcacagagtcctccctgaacttattagacaatgcataga

SEQ ID NO: 311897 - DNA, 75 bp, Artificial Sequence
  Synthetic
caagaggctccggaccctgattttggccccgactagggtggtcttgcgagaaatggaacaggccctgagaggaaa

SEQ ID NO: 311898 - DNA, 75 bp, Artificial Sequence
  Synthetic
gaaagtaagattccattcctcggccgtggacgtgccgcccaatagggatgccattgtggatgtcatgtgccatgc

SEQ ID NO: 311899 - DNA, 75 bp, Artificial Sequence
  Synthetic
aacctacgtgaaccggagactaagccccacagggaggcagaattgggaagtagccatcatggatgaagggcattg

SEQ ID NO: 311900 - DNA, 75 bp, Artificial Sequence
  Synthetic
gaccgatccacacagcattgcagctcggggacacttgtacacactggcaaaagataagaagtgtgcatttgtcct

SEQ ID NO: 311901 - DNA, 75 bp, Artificial Sequence
  Synthetic
gatgtcagccacaccacccggccaaaacgaaccatttccagagtcaagaggacacataatcagtgaagagaaagc

SEQ ID NO: 311902 - DNA, 75 bp, Artificial Sequence
  Synthetic
cataccagatggagagtggcagaacgggtttgactgggtcactgagtatgaaggcaggactgcatggtttgtggc

SEQ ID NO: 311903 - DNA, 75 bp, Artificial Sequence
  Synthetic
atcaattgcaagaggcgcggctatcgcacgaacactgagggccaggggcaagacagtaatatgtctgaacagcaa

SEQ ID NO: 311904 - DNA, 75 bp, Artificial Sequence
  Synthetic
gacatttgagaaggattaccaccgtgtccatgaggaaaaacctgattttgtggtgacaacggatatatcagaaat

SEQ ID NO: 311905 - DNA, 75 bp, Artificial Sequence
  Synthetic
gggggccaatctcgatgtcgatagagtgattgacggcaggaataacattaagcctgaagagatcgacggagcggt

SEQ ID NO: 311906 - DNA, 75 bp, Artificial Sequence
  Synthetic
tgaactcattggagtccggaaggtcaccacagcgtcagcggcccagaggagaggcagggtgggacgcaaggaagg

SEQ ID NO: 311907 - DNA, 75 bp, Artificial Sequence
  Synthetic
aagaacggacaggtacgtgtactctggccaatgtgacgacgatgacagcatgcttgtacagtggaaggaggccca

SEQ ID NO: 311908 - DNA, 75 bp, Artificial Sequence
  Synthetic
aatgctgcttgacaacataacaactctcagaggtatggcagcagtcttttatggtcctgaacaggaaaagatgcc

SEQ ID NO: 311909 - DNA, 75 bp, Artificial Sequence
  Synthetic
cgaggtagctggcttctacagacttccagaggagaagagaaaatacttccggcacctcttgtcacagaacgactt

SEQ ID NO: 311910 - DNA, 75 bp, Artificial Sequence
  Synthetic
tacgccctggctcgcgtggcatgtggccaagaacacagcagggccaatcgaccggagctggacctgggagggacc

SEQ ID NO: 311911 - DNA, 75 bp, Artificial Sequence
  Synthetic
ggagggcaatgccatagagggtcaggatggagaggtcatccggtttagaacccccggtggtgcggaaaaagtctt

SEQ ID NO: 311912 - DNA, 75 bp, Artificial Sequence
  Synthetic
gaaacctgcttggagggacatgcgcatgttccgggagggacgtgacatccgagagtttgtccagtatgccagcag

SEQ ID NO: 311913 - DNA, 75 bp, Artificial Sequence
  Synthetic
ccgcaggggggcatctgaactgctgatggggatgagtgaggtgccagggttgatgaggagtagggtgctgggggc

SEQ ID NO: 311914 - DNA, 75 bp, Artificial Sequence
  Synthetic
atatgacgtgttctacactctgctccatgaaaaccctgggagccgtgccttgaggatggctgagcgcgacgcacc

SEQ ID NO: 311915 - DNA, 75 bp, Artificial Sequence
  Synthetic
agaagcgtttctgaccctcattgaagtgctggtgcttgggctcgcaaccctggggctcctgtgggtgctcctctt

SEQ ID NO: 311916 - DNA, 75 bp, Artificial Sequence
  Synthetic
acgtgggtcagtgagcagaatgacgctgggggtgctggtgttgctcatctctttgtgtctcatgtgggccggcgg

SEQ ID NO: 311917 - DNA, 75 bp, Artificial Sequence
  Synthetic
catgtcctatgggcatatggccggtgtttccctcgtcttctacgccttcttgactgtgatacagcctgagccggg

SEQ ID NO: 311918 - DNA, 75 bp, Artificial Sequence
  Synthetic
caagcagagaagtgctgacgacaacagattggctttcaccctccttgtcctggggatggtgattggaacagtggc

SEQ ID NO: 311919 - DNA, 75 bp, Artificial Sequence
  Synthetic
cgctaatgagcttggttggcttgagaggaccaaggctgacctgggccagctgctctggaggcagacggaagaggt

SEQ ID NO: 311920 - DNA, 75 bp, Artificial Sequence
  Synthetic
tgatagtggtggttggactgaatggaccaacatcgacattcagccagcacggtcctggggaacctatgtgcttgt

SEQ ID NO: 311921 - DNA, 75 bp, Artificial Sequence
  Synthetic
ggtgtcacttttttcgccgtacatgatccatcagatgcagacccgggtccagcgcttggtcaatagcgctgtggt

SEQ ID NO: 311922 - DNA, 75 bp, Artificial Sequence
  Synthetic
gtcaggcggccagaccatccgtgagattggggggggagtacccttctttggagtgaaagggcatgtcgtcacaat

SEQ ID NO: 311923 - DNA, 75 bp, Artificial Sequence
  Synthetic
ggggataagttccctggttggggccaccccactctcactgggaatgggtgtggcattggcggcatttcatctggc

SEQ ID NO: 311924 - DNA, 75 bp, Artificial Sequence
  Synthetic
cctggtactgtccggactggaggcagagttctcgcagcgtgtgcacaaagccattttcgctggcatggtgaagaa

SEQ ID NO: 311925 - DNA, 75 bp, Artificial Sequence
  Synthetic
cccatgcgtggatggagatctggtcaaccccttcgatgggggggagcagaagtctgcattgtatgaaaggaagct

SEQ ID NO: 311926 - DNA, 75 bp, Artificial Sequence
  Synthetic
cagcctcttgttggctgttggcctcggcgccctggctgtgtctctcaatagaacagcgtgggctctggcggaagc

SEQ ID NO: 311927 - DNA, 75 bp, Artificial Sequence
  Synthetic
tggggcgctcatggtggcggccgtgggccagctagtgtcaactgagggtgagttctggtggacaatgccggtggc

SEQ ID NO: 311928 - DNA, 75 bp, Artificial Sequence
  Synthetic
gtgtggaatggcaggactggcgagaggctgctggtggggtgtcttgcctatagcgcaccgagtgtggctgagaac

SEQ ID NO: 311929 - DNA, 75 bp, Artificial Sequence
  Synthetic
atcagagcccaggagaggtggtggcatgggtgaaacccttggagacatctggaagacacgcttgaacgcttgcag

SEQ ID NO: 311930 - DNA, 75 bp, Artificial Sequence
  Synthetic
caaggaggacttctttcaataccgaagatcccatgtgttggagacggacaggacaaaagccagggagctcctgag

SEQ ID NO: 311931 - DNA, 75 bp, Artificial Sequence
  Synthetic
gcgcggagagacgaacatggggctggctgtttcgcgtgggacatcaaagcttgcatggctggaggagagaggata

SEQ ID NO: 311932 - DNA, 75 bp, Artificial Sequence
  Synthetic
cgccacagtcaagggcgaagtggtggacctgggctgtggacgcggtggatggtcatactatgccgcctctagacc

SEQ ID NO: 311933 - DNA, 75 bp, Artificial Sequence
  Synthetic
ttctgtgctgagtgtgaaagcatacaccattgggggaaagggacatgaagaaccccggatgattactagcttggg

SEQ ID NO: 311934 - DNA, 75 bp, Artificial Sequence
  Synthetic
atggaacctcgtgaagttccggagtggaatggacgttttctccatggatgcacacagagcagacacagtgatgtg

SEQ ID NO: 311935 - DNA, 75 bp, Artificial Sequence
  Synthetic
tgacattggggagagtgacccagatccagagaaggagggagagaggagccgcagggtgattcagctgatgagccg

SEQ ID NO: 311936 - DNA, 75 bp, Artificial Sequence
  Synthetic
ttggaagcaacggaatccagctgcctcctgtgtgttcaaggtgctggctccctacagacctgacgtcattgaggc

SEQ ID NO: 311937 - DNA, 75 bp, Artificial Sequence
  Synthetic
actccacaggttccagctgctgtggggtggagggctagttagaaaccccttctccaggaactcaacccatgagat

SEQ ID NO: 311938 - DNA, 75 bp, Artificial Sequence
  Synthetic
gtattacaccaccggggtctgtggcaacatcatcaattccgtcaacgtgacatcaaaacggctgctgagtaggtt

SEQ ID NO: 311939 - DNA, 75 bp, Artificial Sequence
  Synthetic
cggtgatgcggctggacccgtccttgttcctgagatagatctgggaactggaacgcgctgcgtggccttggccag

SEQ ID NO: 311940 - DNA, 75 bp, Artificial Sequence
  Synthetic
cgacgtggtgaaaccaaaggatgtggaggagaggatcaccgcattgaagaagcaatattcagacacatggcatgt

SEQ ID NO: 311941 - DNA, 75 bp, Artificial Sequence
  Synthetic
ggacaaagagcatccataccggacgtggcagtactgggggagttaccggacagcggccactggctctgcggcatc

SEQ ID NO: 311942 - DNA, 75 bp, Artificial Sequence
  Synthetic
cctgatcaatggtgttgtgaaattgctgagctggccctggaacgcaagagaggacgtggcacgaatggccatgac

SEQ ID NO: 311943 - DNA, 75 bp, Artificial Sequence
  Synthetic
agacactacggcatttggacaacagagggtgttcaaggataaggtggacaccaaggcccaagaaccacagccggg

SEQ ID NO: 311944 - DNA, 75 bp, Artificial Sequence
  Synthetic
caccagagtcatcatgcgtgctgtgaacgattggctcattgacagactggcaaaggagagaccccctcgcatgtg

SEQ ID NO: 311945 - DNA, 75 bp, Artificial Sequence
  Synthetic
cactcgcgaggaattttgcagtaaggtgagatccaacgcggcgctgggcgcctggtctgatgaccagaataggtg

SEQ ID NO: 311946 - DNA, 75 bp, Artificial Sequence
  Synthetic
gaaaaatgcaaaagaggccattgaggatccagctttttggaacctggttgatgaagagcgagagctccatcgaca

SEQ ID NO: 311947 - DNA, 75 bp, Artificial Sequence
  Synthetic
ggggcgctgcgcccagtgtgtttacaacatgatggggaagcgtgagaagaagcttggagagtttggttcggccaa

SEQ ID NO: 311948 - DNA, 75 bp, Artificial Sequence
  Synthetic
gggaagtagagcaatctggtacatgtggttgggcagccgattcctagagtttgaggccctggggttcctgaatga

SEQ ID NO: 311949 - DNA, 75 bp, Artificial Sequence
  Synthetic
ggaccattgggcatcaagggaagcttgtggcgccggagtggagggtaccagcctcaactatcttggctggcttct

SEQ ID NO: 311950 - DNA, 75 bp, Artificial Sequence
  Synthetic
ggccggattaggaaagatccctggggggaagttctacgcagatgacacagctggctgggacacccgagtgaccaa

SEQ ID NO: 311951 - DNA, 75 bp, Artificial Sequence
  Synthetic
tgccgacctggaagatgaggaacagcttctgcgccacatgtctggagaacacaagatcctggccaggacaatttt

SEQ ID NO: 311952 - DNA, 75 bp, Artificial Sequence
  Synthetic
tgaaaaggcttaccatgcaaaagtcgtgaaggtggctcggccctcacccgagggtggctgcgtcatggacatcat

SEQ ID NO: 311953 - DNA, 75 bp, Artificial Sequence
  Synthetic
caccagacgagaccagcgcggctcaggacaggtcgtgacctacgccttgaacacacttacaaatgtgaaggtgca

SEQ ID NO: 311954 - DNA, 75 bp, Artificial Sequence
  Synthetic
actcatcaggatgatggaaggagagggtgtcatcggggcatctgacgcacaggatcctagactccgtcgtgttga

SEQ ID NO: 311955 - DNA, 75 bp, Artificial Sequence
  Synthetic
gcagtggctcagcgtccatggagcggagagactgtccaggatgctggtcagtggtgatgactgtgtggtcaggcc

SEQ ID NO: 311956 - DNA, 75 bp, Artificial Sequence
  Synthetic
cattgacgacaggtttggcacggccctctacttcctgaacgacatggcgaaagtgagaaaggacattggcgagtg

SEQ ID NO: 311957 - DNA, 75 bp, Artificial Sequence
  Synthetic
ggagccatccattgggttctcgaggtgggaggaagttccattctgctcccatcacttccatgagcttgccatgaa

SEQ ID NO: 311958 - DNA, 75 bp, Artificial Sequence
  Synthetic
ggacggaagaacgttgatagtgccatgccgtgaccaggatgagcttgtaggcagagcgagagtgtcaccggggtg

SEQ ID NO: 311959 - DNA, 75 bp, Artificial Sequence
  Synthetic
tggatggagtgtcagagagacggcttgcctgtcaaaagcttacgcacagatgtggctactgagctacttccacag

SEQ ID NO: 311960 - DNA, 75 bp, Artificial Sequence
  Synthetic
gagagaccttaggacaatgggctttgcgatctgttcttcagtgccggtggactgggttcctaccgggcgaacaac

SEQ ID NO: 311961 - DNA, 75 bp, Artificial Sequence
  Synthetic
ctggagcatccacgctagtggcgcttggatgacaactgaagacatgctcagcgtctggaacaaagtttggattga

SEQ ID NO: 311962 - DNA, 75 bp, Artificial Sequence
  Synthetic
ggacaacccccacatgaaagacaagacgagagttgatgcatggagagacataccctaccttcccaagtcccagga

SEQ ID NO: 311963 - DNA, 75 bp, Artificial Sequence
  Synthetic
catgttgtgttcatcgctgatcggccattccgagagagccgactgggcaagacacatatggactggggtaatgaa

SEQ ID NO: 311964 - DNA, 75 bp, Artificial Sequence
  Synthetic
ggttagagccatgataggcagggagacctatgtggactatttgtcacacatggatcgccacgaggctccctggct

SEQ ID NO: 311965 - DNA, 75 bp, Artificial Sequence
  Synthetic
ccctgtctttgagagttccatcatttaagaccatgcttgaggggcacattggcaacacaccattggtgacgggat

SEQ ID NO: 311966 - DNA, 75 bp, Artificial Sequence
  Synthetic
gaggtcgaccccgccagtgagctcctcaaagacagaatgtgagaccaaccaagagctaggagggcagctagctct

SEQ ID NO: 311967 - DNA, 75 bp, Artificial Sequence
  Synthetic
tgaaggacacccatgcccatactggacgcaggcggcagcacaccaacaacatcggtgacgggaaagtagtcgctc

SEQ ID NO: 311968 - DNA, 75 bp, Artificial Sequence
  Synthetic
ccgacgcatgtggaccagtgagaaatttgtgagactaaccatccctcaaggccgagtgggatgtgtagcaaggcc

SEQ ID NO: 311969 - DNA, 75 bp, Artificial Sequence
  Synthetic
cctggagaaatccaggaggggggagagaggaaaattggcaacctctctcaggagatttcctccccctataccaaa

SEQ ID NO: 311970 - DNA, 75 bp, Artificial Sequence
  Synthetic
attggcaacctctctcaggagatttcctccccctataccaaattccccaggaaactggggggcggttcttgttct

SEQ ID NO: 311971 - DNA, 75 bp, Artificial Sequence
  Synthetic
cacttaaatttaactcctttggttcgagatgggcagcaactcattgagtatgataaaagttagattacaaaatct

SEQ ID NO: 311972 - DNA, 75 bp, Artificial Sequence
  Synthetic
ctaggacatgctagtgtccaggcagaaatggagcaagttgtggaagtctatgagtatgcacagaagttgggagga

SEQ ID NO: 311973 - DNA, 75 bp, Artificial Sequence
  Synthetic
caacctaatggcctaatagatgacaattgtgaaattaaattctccaaaaaactaagtgattcaacaatgaccaat

SEQ ID NO: 311974 - DNA, 75 bp, Artificial Sequence
  Synthetic
agaaccaccaaccaatcaatcaaccaattgatcaatcagcaccctgacaaaattaacaatatagtaacaaaaaaa

SEQ ID NO: 311975 - DNA, 75 bp, Artificial Sequence
  Synthetic
ggcattaagcctaccaagcacacacccataatatacaagtatgatctcaatccatgaatatcaaaacaagattca

SEQ ID NO: 311976 - DNA, 75 bp, Artificial Sequence
  Synthetic
tctgctatcaagagtatgtcatacattattagataagacagtatccgataatataataaatggcagatggataat

SEQ ID NO: 311977 - DNA, 75 bp, Artificial Sequence
  Synthetic
cagtgagttgattcatacaaactttctacctacatttttcacttcacaatcataatcaccaaccctctgtggttc

SEQ ID NO: 311978 - DNA, 75 bp, Artificial Sequence
  Synthetic
atccagcaaatacaccatccaacggagcacaggagacagcattgacactcctaattatgatgtgcagaaacacat

SEQ ID NO: 311979 - DNA, 75 bp, Artificial Sequence
  Synthetic
attccctatgcaggattagtattagttatcacggttactgataataaaggagcattcaaatatatcaagccacag

SEQ ID NO: 311980 - DNA, 75 bp, Artificial Sequence
  Synthetic
atcacagaagatgctaatcataaattcactgggttaataggtatgttatatgctatgtctagattaggaagagaa

SEQ ID NO: 311981 - DNA, 75 bp, Artificial Sequence
  Synthetic
tcactgggttaataggtatgttatatgctatgtctagattaggaagagaagacaccataaaaatactcaaagatg

SEQ ID NO: 311982 - DNA, 75 bp, Artificial Sequence
  Synthetic
agtggatgtaacaacacatcgtcaagacattaatgggaaagaaatgaaatttgaagtgttaacattagcaagctt

SEQ ID NO: 311983 - DNA, 75 bp, Artificial Sequence
  Synthetic
gagatagaatctagaaaatcctacaaaaaaatgctaaaagaaatgggagaggtggctccagaatacaggcatgac

SEQ ID NO: 311984 - DNA, 75 bp, Artificial Sequence
  Synthetic
taagctaagtgaacataaaacattctgtaacaaaactcttgaactaggacagatgtatcaaatcaacacatagtg

SEQ ID NO: 311985 - DNA, 75 bp, Artificial Sequence
  Synthetic
taacaactgcaatcatacaagatgcaacaagccagatcaagaacacaaccccaacatacctcacccagaatcccc

SEQ ID NO: 311986 - DNA, 75 bp, Artificial Sequence
  Synthetic
gcagtagagttgaagggatttttgcaggattgtttatgaatgcctatggtgcagggcaagtgatgttacggtggg

SEQ ID NO: 311987 - DNA, 75 bp, Artificial Sequence
  Synthetic
gggtcttagcaaaatcagttaaaaacattatgttagggcacgctagtgtgcaagcagaaatggaacaagttgtgg

SEQ ID NO: 311988 - DNA, 75 bp, Artificial Sequence
  Synthetic
atattgaacaacccaaaagcatcactattatctttgactcaatttcctcacttctctagtgtagtattaggcaat

SEQ ID NO: 311989 - DNA, 75 bp, Artificial Sequence
  Synthetic
gctgctggcctaggcataatgggagaatacagaggtacaccaaggaatcaagatttatatgatgctgcaaaagca

SEQ ID NO: 311990 - DNA, 75 bp, Artificial Sequence
  Synthetic
actatacaaagaaaccatagaaacatttgataacaatgaagaagaatctagctattcatatgaagaaataaatga

SEQ ID NO: 311991 - DNA, 75 bp, Artificial Sequence
  Synthetic
gctcgacacaaccacatcaaaacacacaatccaacagcaatccctctactcaaccacccccgaaaacacacccaa

SEQ ID NO: 311992 - DNA, 75 bp, Artificial Sequence
  Synthetic
acgcgaaaaaatgcgtacaacaaacttgcgtaaacccaaaaaatggggcaataagaatttgataagtaccactta

SEQ ID NO: 311993 - DNA, 75 bp, Artificial Sequence
  Synthetic
ctgaaacatgtaaagttcaatcgaatcgggtattttgtgacacaatgaacagtttaacattaccaagtgaagtaa

SEQ ID NO: 311994 - DNA, 75 bp, Artificial Sequence
  Synthetic
aaaattatcattttgatctaggaggaataaatttaaatccaaatctaattggtttatatgtatattaactaaact

SEQ ID NO: 311995 - DNA, 75 bp, Artificial Sequence
  Synthetic
cgacactatagttacaaaaaaagagatggggcaaatatggaaacatacgtgaacaaacttcacgagggctccaca

SEQ ID NO: 311996 - DNA, 75 bp, Artificial Sequence
  Synthetic
tcctagaaaaagacgatgatcctgcatcacttacaatatgggtgcccatgttccaatcatccatgccagcagatc

SEQ ID NO: 311997 - DNA, 75 bp, Artificial Sequence
  Synthetic
cgatactatagttacaaaaaagatggggcaaatatggaaacatacgtgaacaaacttcacgagggctccacatac

SEQ ID NO: 311998 - DNA, 75 bp, Artificial Sequence
  Synthetic
gcatgcagtctaacatgcctaaaatcaaaaaatatgttgactacagttaaagatctcactatgaaaacactcaac

SEQ ID NO: 311999 - DNA, 75 bp, Artificial Sequence
  Synthetic
cttaacagcagaagaattggaagccataaagcatcaactcaaccccaaagaagatgatgtagagctttaagttaa

SEQ ID NO: 312000 - DNA, 75 bp, Artificial Sequence
  Synthetic
cacgaaaaaaccaaccatcaagacaaccaaaaaagatctcaaacctcaaaccacaaaaccaaaggaagcacctac

SEQ ID NO: 312001 - DNA, 75 bp, Artificial Sequence
  Synthetic
aacaattcaagctatgggacaaaatggatcccattattaatggaaattctgctaatgtttatctaaccgatagtt

SEQ ID NO: 312002 - DNA, 75 bp, Artificial Sequence
  Synthetic
agattaacctttttcctctacatcaatgagtagattcatacaaactttctaactacattcttcacttcacaatca

SEQ ID NO: 312003 - DNA, 75 bp, Artificial Sequence
  Synthetic
acaccagttacactaagcaaagaccaactaagtggaatcaacaatattgcattcagcaaatagacaaaaaaccac

SEQ ID NO: 312004 - DNA, 75 bp, Artificial Sequence
  Synthetic
actttacactaatacacatgataacaacaataatctctttgataatcataatctccatcatgattgcaatactaa

SEQ ID NO: 312005 - DNA, 75 bp, Artificial Sequence
  Synthetic
acctcaagtatcacaatcaaacactaaatcgacacatcattcacaaaattaacaactggggcaaatatgtcgcga

SEQ ID NO: 312006 - DNA, 75 bp, Artificial Sequence
  Synthetic
acaaacaaatccaatcttctcacagagtcatggtgtcgcaaaaccacgctaactatcatggtagcatagagtagt

SEQ ID NO: 312007 - DNA, 75 bp, Artificial Sequence
  Synthetic
tacactaacaacggtcacagttcaaacaataaaaaaccacactgaaaaaaacatcaccacctaccttactcaagt

SEQ ID NO: 312008 - DNA, 75 bp, Artificial Sequence
  Synthetic
acaataaaaaaccacactgaaaaaaacatcaccacctaccttactcaagtctcaccagaaagggttagctcatcc

SEQ ID NO: 312009 - DNA, 75 bp, Artificial Sequence
  Synthetic
caacctgctgggccatctgcaagagaataccaaacaaaaaacctggaaagaaaaccaccaccaagcccacaaaaa

SEQ ID NO: 312010 - DNA, 75 bp, Artificial Sequence
  Synthetic
ttatagttatttaaaattaaaaattatataatttttaataacttttagtggactaatcctaaaattatcattttg

SEQ ID NO: 312011 - DNA, 75 bp, Artificial Sequence
  Synthetic
aaaaccaccaccaagcccacaaaaaaaccaaccatcaagacaaccaaaaaagatcccaaacctcaaaccacaaaa

SEQ ID NO: 312012 - DNA, 75 bp, Artificial Sequence
  Synthetic
aattggaagcacacagctacacgatttgcaatcaaacccatggaagattaacctttttcctctacatcagtgagt

SEQ ID NO: 312013 - DNA, 75 bp, Artificial Sequence
  Synthetic
ttgcaatcaaacccatggaagattaacctttttcctctacatcagtgagttgattcatacaaactttctacctac

SEQ ID NO: 312014 - DNA, 75 bp, Artificial Sequence
  Synthetic
caaaccaagctattccctaaacaacagtgctcaacagttaagaaggagctaatccattttagtaattaaaaataa

SEQ ID NO: 312015 - DNA, 75 bp, Artificial Sequence
  Synthetic
aacccaacaaaaaaaccaaccctcaagaccacagaaagagacaccagcacctcacaatccactgcactcgacaca

SEQ ID NO: 312016 - DNA, 75 bp, Artificial Sequence
  Synthetic
ctgtaacagaattgcagttgctcatgcaaagcacaccagcggccaacagtcgagccagaagagaactaccaagat

SEQ ID NO: 312017 - DNA, 75 bp, Artificial Sequence
  Synthetic
aatcgccagtggcattgccgtatccaaggtcctgcacctagaaggggaagtgaacaaaatcaaaagtgctctact

SEQ ID NO: 312018 - DNA, 75 bp, Artificial Sequence
  Synthetic
aatgcagtaacagaattacagctacttatgcaaaacacaccagctgccaacaaccgggccagaagagaagcacca

SEQ ID NO: 312019 - DNA, 75 bp, Artificial Sequence
  Synthetic
caaccgggccagaagagaagcaccacagtatatgaactacacaatcaataccactaaaaacctaaatgtatcaat

SEQ ID NO: 312020 - DNA, 75 bp, Artificial Sequence
  Synthetic
ctagagattaccagagaatttagtgttaatgcaggtgtaactacacctgtaagcacttatatgttaactaatagt

SEQ ID NO: 312021 - DNA, 75 bp, Artificial Sequence
  Synthetic
agccctccacatcaaattccacctaaaaattctagtcatatacttagttattcaaaaactacatcttggcagaga

SEQ ID NO: 312022 - DNA, 75 bp, Artificial Sequence
  Synthetic
taagcatatgaacatcttaaagtggttcaatcatgttttaaatttcagatcaacagaactaaactataatcattt

SEQ ID NO: 312023 - DNA, 75 bp, Artificial Sequence
  Synthetic
caacagaactaaactataatcatttatatatggtagaatctacatatccttatctaagtgaattgttaaacagct

SEQ ID NO: 312024 - DNA, 75 bp, Artificial Sequence
  Synthetic
caattgaataccaaattaacttactatttgtaaaaatgagaactggggcaaatatgtcacgaaggaatccttgca

SEQ ID NO: 312025 - DNA, 75 bp, Artificial Sequence
  Synthetic
gcgatgacatcaaaaaactaagggacaatgaagagccaaactcacccaaggtaagagtgtacaatactgtcatat

SEQ ID NO: 312026 - DNA, 75 bp, Artificial Sequence
  Synthetic
aaatcttaaatctatagcacaaatcacattatccattctggcaatgataatctcaacttcacttataattgtagc

SEQ ID NO: 312027 - DNA, 75 bp, Artificial Sequence
  Synthetic
caataaacaaactatccatctgttaaaaagattgccagcagacgtattgaagaaaaccatcaaaaacacattgga

SEQ ID NO: 312028 - DNA, 75 bp, Artificial Sequence
  Synthetic
aacaaagtcacactaacaactgcaatcatacaagatgcaacaagccagatcaagaacacaaccccaacatacctg

SEQ ID NO: 312029 - DNA, 75 bp, Artificial Sequence
  Synthetic
aaaagattgccagcagacgtattgaagaaaaccatcaaaaacacattggatatccacaagagcataaccatcaat

SEQ ID NO: 312030 - DNA, 75 bp, Artificial Sequence
  Synthetic
aataaaaatagcacctaatcatattcttacaatggttcactatttgaccatagataacccatctatcattggatt

SEQ ID NO: 312031 - DNA, 75 bp, Artificial Sequence
  Synthetic
tcccattattagtggaaattctgctaatgtttatctaaccgatagttatttaaaaggtgttatttctttctcaga

SEQ ID NO: 312032 - DNA, 75 bp, Artificial Sequence
  Synthetic
agcaattcattgagtatgataaaagttagattacaaaatttgtttgacaatgatgaagtagcattgttaaaaata

SEQ ID NO: 312033 - DNA, 75 bp, Artificial Sequence
  Synthetic
aggaataaatttaaatccaaatctaattggtttatatgtatattaactaaactacgagatattagtttttgacac

SEQ ID NO: 312034 - DNA, 75 bp, Artificial Sequence
  Synthetic
attttggtcttaaggggttaaataaaaatctaaaactaacaattatacatgtgcatttacaacacaacgagacat

SEQ ID NO: 312035 - DNA, 75 bp, Artificial Sequence
  Synthetic
aaaccatggttttatattgatagataatcatactcttaatggattccaatttattttgaatcaatatggttgtat

SEQ ID NO: 312036 - DNA, 75 bp, Artificial Sequence
  Synthetic
ctcacctcttcacaaaaccacatcaacatctcaccatgcaagccatcatctataccataaagtagttaattaaaa

SEQ ID NO: 312037 - DNA, 75 bp, Artificial Sequence
  Synthetic
cagaaaacggttttataatagtatgctcaacaacatcacagatgccgctaataaagctcagaaaaatctgctatc

SEQ ID NO: 312038 - DNA, 75 bp, Artificial Sequence
  Synthetic
aaccaccaccaagcccacaaaaaaaccaaccatcaagacaaccaaaaaagatcccaaacctcaaaccacaaaacc

SEQ ID NO: 312039 - DNA, 75 bp, Artificial Sequence
  Synthetic
acttcatcgaaactctcatctataaaccatctcacttacactatttaagtagattcctagttcatagttatataa

SEQ ID NO: 312040 - DNA, 75 bp, Artificial Sequence
  Synthetic
aagcagatctctacgcccaaaggaccttcactacgagtcacgatcaactcaagaagtgctgtgctggctcaaatg

SEQ ID NO: 312041 - DNA, 75 bp, Artificial Sequence
  Synthetic
aatatttggacacccaatggtagatgaaagacaagccatggatgctgttaaagttaattgcaacgagaccaaatt

SEQ ID NO: 312042 - DNA, 75 bp, Artificial Sequence
  Synthetic
tccttccttgttggaacttacagaaagagatttgattgttctatcaggactacgtttctatcgagagtttcggtt

SEQ ID NO: 312043 - DNA, 75 bp, Artificial Sequence
  Synthetic
gtgaactaatcctaaagttatcattttgatctaggaggaataaatttaaatcctaatctaattggtttatatgtg

SEQ ID NO: 312044 - DNA, 75 bp, Artificial Sequence
  Synthetic
cagccaatccaaaactagccacccggaaaaaatcgatactatagttacaaaaaaagatggggcaaatatggaaac

SEQ ID NO: 312045 - DNA, 75 bp, Artificial Sequence
  Synthetic
aagtaacaaatcaaatcgttacaatgataattacaacaattatattagtaagtgctctatcatcacagatctcag

SEQ ID NO: 312046 - DNA, 75 bp, Artificial Sequence
  Synthetic
actattcctcatgtcacaataatatgcacatataggcatgcacccccctatataaaggatcatattgtagatctt

SEQ ID NO: 312047 - DNA, 75 bp, Artificial Sequence
  Synthetic
tagagcttcaaaagatattagaattaaaagcaggaataagcaacaagtcaaatcgttataatgataactacaaca

SEQ ID NO: 312048 - DNA, 75 bp, Artificial Sequence
  Synthetic
tatatagatatcatatgggtggtatcgaagggtggtgtcaaaaactatggaccatagaagctatatcactattag

SEQ ID NO: 312049 - DNA, 75 bp, Artificial Sequence
  Synthetic
accatagaagctatatcactattagatctaatatctctcaaagggaaattctcaattactgctttaattaatggt

SEQ ID NO: 312050 - DNA, 75 bp, Artificial Sequence
  Synthetic
tgtataaagagtatgcaggaataggccacaaattaaaaggaactgagacttatatatcaagagatatgcaattta

SEQ ID NO: 312051 - DNA, 75 bp, Artificial Sequence
  Synthetic
tgtatattacccagctagtataaagaaagtcctaagagtgggaccgtggataaacactatacttgatgacttcaa

SEQ ID NO: 312052 - DNA, 75 bp, Artificial Sequence
  Synthetic
agtgagtctggaatctataggtagtttgacacaagaattagaatatagaggtgaaagtctattatgcagtttaat

SEQ ID NO: 312053 - DNA, 75 bp, Artificial Sequence
  Synthetic
acccaatcatccaaccaaacatccatccgccaatcagccaaacagccaacaaaacaaccagccaatccaaaacta

SEQ ID NO: 312054 - DNA, 75 bp, Artificial Sequence
  Synthetic
aaaacaaccagccaatccaaaactaaccacccggaaaaaatctataatatagttacaaaaaaaggaaagggtggg

SEQ ID NO: 312055 - DNA, 75 bp, Artificial Sequence
  Synthetic
aacaacaagccaagcacaaaaccacgtccaaaaaatccaccaaaaaaagatgattaccattttgaagtgttcaac

SEQ ID NO: 312056 - DNA, 75 bp, Artificial Sequence
  Synthetic
cacttaaaaaccttttttaatcttgataacattgatacagcattaacattgtatatgaatttgcccatgttattt

SEQ ID NO: 312057 - DNA, 75 bp, Artificial Sequence
  Synthetic
aactaatcacaacatctgtcaacatagacaagtcaacacgctagataaaatcaaccaatggaaaatacatccata

SEQ ID NO: 312058 - DNA, 75 bp, Artificial Sequence
  Synthetic
cactctgtgttcatacttagttattatacaaaccatgatttaaaagataaacttcaagatctgtcagatgataga

SEQ ID NO: 312059 - DNA, 75 bp, Artificial Sequence
  Synthetic
cacaagtcaagaggaaaccctccattcaacctcctccgaaggcaatacaagcccttcacaaatctatacaacatc

SEQ ID NO: 312060 - DNA, 75 bp, Artificial Sequence
  Synthetic
tgaattcgttacattgatgagagatcctcaagctttaggatctgagaggcaagctaaaattactagcgaaatcaa

SEQ ID NO: 312061 - DNA, 75 bp, Artificial Sequence
  Synthetic
gttaaattcccaaatctaattggtttatatgtacattaactaaactacgagatattagtttttgacacttttttt

SEQ ID NO: 312062 - DNA, 75 bp, Artificial Sequence
  Synthetic
aactacacactatatccaaacatcataaacatctacactacacacttcatcacacaaaccaatcccactcaaaat

SEQ ID NO: 312063 - DNA, 75 bp, Artificial Sequence
  Synthetic
aaaatagtaaatcttatatccggtacaaaatctataactaacatactggaaaagacttctgccatagacttaaca

SEQ ID NO: 312064 - DNA, 75 bp, Artificial Sequence
  Synthetic
cattaagcctacaaaacacactcctataatatacaaatatgacctcaacccgtaaattccaacaaaaaaccaacc

SEQ ID NO: 312065 - DNA, 75 bp, Artificial Sequence
  Synthetic
aataaaaccaaaatatggggtaaatagacattagttagagttcaatcaatcttaacaaccatttataccgccaat

SEQ ID NO: 312066 - DNA, 75 bp, Artificial Sequence
  Synthetic
tgaggaaaaacataactttgcttataaggatattaccattagattgtaacagagataaaagagaaatattgagta

SEQ ID NO: 312067 - DNA, 75 bp, Artificial Sequence
  Synthetic
agagataaaagagaaatattgagtatggaaaacctaagtattactgaattaagcaaatatgttagagaaagatct

SEQ ID NO: 312068 - DNA, 75 bp, Artificial Sequence
  Synthetic
gtataattatagaaaaatataatgttaatagtttaactcgtggtgaaagaggacccaccaagccatgggtaggct

SEQ ID NO: 312069 - DNA, 75 bp, Artificial Sequence
  Synthetic
tatcactttgatactagccctattaatcgcatattaacagaaaagtatggtgatgaagatattgatatagtattc

SEQ ID NO: 312070 - DNA, 75 bp, Artificial Sequence
  Synthetic
acattgaaacagttatagaattccagcagaagaacagcagattgttggaaatcaccagagaatttagtgtcaatg

SEQ ID NO: 312071 - DNA, 75 bp, Artificial Sequence
  Synthetic
tacaaaatcagaaacacaccatacaacagcacaaaccaaaggcagaaccaccacttcaacacagaccaacaagcc

SEQ ID NO: 312072 - DNA, 75 bp, Artificial Sequence
  Synthetic
atatgtttttaccagacaaaataagtttgactcaatatgtggaattattcttaagtaataaaacactcaaatctg

SEQ ID NO: 312073 - DNA, 75 bp, Artificial Sequence
  Synthetic
aatgggagaatacagaggtacaccaaggaatcaagatctatatgatgctgcaaaagcatatgctgaacaactcaa

SEQ ID NO: 312074 - DNA, 75 bp, Artificial Sequence
  Synthetic
aatccattgaatcaactgccagactgaacaaacaaacgtccatcagcagaaccaccaaccaatcaatcaaccaat

SEQ ID NO: 312075 - DNA, 75 bp, Artificial Sequence
  Synthetic
tttgactcaatatgtggaattattcttaagtaataaaacactcaaatctggatctaatgttaattctaatttaat

SEQ ID NO: 312076 - DNA, 75 bp, Artificial Sequence
  Synthetic
attggcgcataagatatctgactattttcataatacttacattttaagtactaatttagctggacattggattct

SEQ ID NO: 312077 - DNA, 75 bp, Artificial Sequence
  Synthetic
tttatgaattatacactcaacaataccaaaaacaccaatgtaacattaagcaagaaaaggaaaagaagatttctt

SEQ ID NO: 312078 - DNA, 75 bp, Artificial Sequence
  Synthetic
ataaatgatcagacaaacgataatataacagcaagattagataggattgatgagaaattaagtgaaatactagga

SEQ ID NO: 312079 - DNA, 75 bp, Artificial Sequence
  Synthetic
catgtaaagttcaatcaaatcgagtattttgtgacacaatgaacagtttaacattaccaagtgaagtaaatctct

SEQ ID NO: 312080 - DNA, 75 bp, Artificial Sequence
  Synthetic
aattcaatacatatactataaatctcaaaatgggaaatacatccatcacaatagaattcacaagcaaattttggc

SEQ ID NO: 312081 - DNA, 75 bp, Artificial Sequence
  Synthetic
acatagtcaatcaagacacaagtttgcgtagaataaaaggctgtcacagttttaagctgtggtttttaaaacgcc

SEQ ID NO: 312082 - DNA, 75 bp, Artificial Sequence
  Synthetic
caacaaattatatcatcctacaccagaaaccctagaaaatatactaaccaatccggttaaaagtaatgataaaaa

SEQ ID NO: 312083 - DNA, 75 bp, Artificial Sequence
  Synthetic
gcacaccagtcacactaagtaaggatcaactgagtggtataaataatattgcatttagtaactgaataaaaatag

SEQ ID NO: 312084 - DNA, 75 bp, Artificial Sequence
  Synthetic
tgcatgcttccttggcatcatattaatagattcaattttgtatttagttctacaggttgtaaaattagtatagag

SEQ ID NO: 312085 - DNA, 75 bp, Artificial Sequence
  Synthetic
aagacttgtacaatttatttccaattgttgtgatagacaagattatagatcattcaggtaatacagcaaaatcta

SEQ ID NO: 312086 - DNA, 75 bp, Artificial Sequence
  Synthetic
gcatcactttattgcatgcttccttggcatcatgtcaatagatttaactttgtatttagttccacaggatgcaag

SEQ ID NO: 312087 - DNA, 75 bp, Artificial Sequence
  Synthetic
tggtgaaaatttgaccattccagctacagatgcaaccaacaacattcattggtcttatttacatataaagtttgc

SEQ ID NO: 312088 - DNA, 75 bp, Artificial Sequence
  Synthetic
accaacccaacaaaaaaaccaaccctcaagaccacagaaagagacaccagcacctcacaatctactgtgctcgac

SEQ ID NO: 312089 - DNA, 75 bp, Artificial Sequence
  Synthetic
ataactaaacaatcagcatgtgttgccatgagcaaactcctcactgaactcaacagcgatgacatcaaaaaacta

SEQ ID NO: 312090 - DNA, 75 bp, Artificial Sequence
  Synthetic
cttcatcacaactttcatctataaaccatctcacttacactatttaagtagattcctattttatagttatataaa

SEQ ID NO: 312091 - DNA, 75 bp, Artificial Sequence
  Synthetic
aataagttaataaaaaatccacatggggcaaataatcattgagggaaatccaactaatcacaacatctgtcaaca

SEQ ID NO: 312092 - DNA, 75 bp, Artificial Sequence
  Synthetic
tgttagtggagatatactatcatattctatagctggacgtaatgaagttttcagcaataaacttataaatcataa

SEQ ID NO: 312093 - DNA, 75 bp, Artificial Sequence
  Synthetic
tctatagctggacgtaatgaagttttcagcaataaacttataaatcataagcatatgaacatcttaaagtggttc

SEQ ID NO: 312094 - DNA, 75 bp, Artificial Sequence
  Synthetic
gcatatgaacatcttaaagtggttcaatcatgttttaaatttcagatcaacagaattaaactataatcatttata

SEQ ID NO: 312095 - DNA, 75 bp, Artificial Sequence
  Synthetic
aatcataatctccatcatgattgcaatactaaacaaactctgtgaatataatgtattccataacaaaacctttga

SEQ ID NO: 312096 - DNA, 75 bp, Artificial Sequence
  Synthetic
taaaatcacaggtagtttgttatacaactttaataatgaataatgagcaaaaatcttataacaaaaatagctaca

SEQ ID NO: 312097 - DNA, 75 bp, Artificial Sequence
  Synthetic
aaaggtgaaataaaaatagaagaacctacttactttcagtcattacttatgacatacaagagtatgacctcgtca

SEQ ID NO: 312098 - DNA, 75 bp, Artificial Sequence
  Synthetic
cactaacattgtattcaattatagttatttaaaattaataattatataattttttaataacttctagtgaactaa

SEQ ID NO: 312099 - DNA, 75 bp, Artificial Sequence
  Synthetic
ccacatcaacatctcaccatgcaagccatcatctataccataaagtagttaattaaaaatagtcataacaatgaa

SEQ ID NO: 312100 - DNA, 75 bp, Artificial Sequence
  Synthetic
tgtatactgaaattatttcataatgaaggcttctacataataaaagaagtagaaggatttattatgtctttaatt

SEQ ID NO: 312101 - DNA, 75 bp, Artificial Sequence
  Synthetic
ttaatatctaagtatcataaaggtgaaataaaattagaagaacctacttattttcagtcattacttatgacatac

SEQ ID NO: 312102 - DNA, 75 bp, Artificial Sequence
  Synthetic
taaatcaacacatcattcacaaaactaacagctggggcaaatatgtcgcgaagaaatccttgcaaatttgagatt

SEQ ID NO: 312103 - DNA, 75 bp, Artificial Sequence
  Synthetic
cacttataattgcagccatcatattcatagcctcggcaaaccacaaagtcacactaacaactgcaatcatacaag

SEQ ID NO: 312104 - DNA, 75 bp, Artificial Sequence
  Synthetic
ccaatttcacaacaatgccagtattacaaaatggaggttatatatgggaaatgatggaattaacacactgctctc

SEQ ID NO: 312105 - DNA, 75 bp, Artificial Sequence
  Synthetic
tgttcaatgcaacatcctccatcatggttaatacattggtttaacttatacacaaaattaaacaacatattaaca

SEQ ID NO: 312106 - DNA, 75 bp, Artificial Sequence
  Synthetic
tgattttcactttgaagtgttcaactttgtaccctgcagcatatgcagcaacaatccaacctgctgggccatctg

SEQ ID NO: 312107 - DNA, 75 bp, Artificial Sequence
  Synthetic
aaactacatcttagcagagaaccgtgatctctcaagcaagaacgaaattaaatctggggcaaataaccatggagt

SEQ ID NO: 312108 - DNA, 75 bp, Artificial Sequence
  Synthetic
acccaaccatggacacaacacacaatgataccacaccacaaagactgatgatcacagacatgagaccattgtcac

SEQ ID NO: 312109 - DNA, 75 bp, Artificial Sequence
  Synthetic
atattacaatttaaccataaccatttggataaccaccagtgtttattaaatcatatatttgatgaaattcattgg

SEQ ID NO: 312110 - DNA, 75 bp, Artificial Sequence
  Synthetic
agatctggtcttacagctgtgattaggagagctaataatgtcctaaaaaatgaaatgaaacgttataaaggctta

SEQ ID NO: 312111 - DNA, 75 bp, Artificial Sequence
  Synthetic
catgcattatgtaacaataagctatatttagatatattgaaagtattaaaacacttaaaaaccttttttaatctt

SEQ ID NO: 312112 - DNA, 75 bp, Artificial Sequence
  Synthetic
acttaaaaaactgattaaaatcacaggtagtttgttatacaactttcataatgaataatgaataaaaatcttata

SEQ ID NO: 312113 - DNA, 75 bp, Artificial Sequence
  Synthetic
gcagtgcagttagcaaaggctatcttagtgctctaagaactggttggtatactagtgttataactatagaattaa

SEQ ID NO: 312114 - DNA, 75 bp, Artificial Sequence
  Synthetic
cacgcttttcaatcaaaccactagaggattaaaccaaattatcaacattgaatgacaggttcacatacatcctca

SEQ ID NO: 312115 - DNA, 75 bp, Artificial Sequence
  Synthetic
tttacttgttaagtagtttgagtatgttaagaggagcttttatatatagaattataaaagggtttgtaaataatt

SEQ ID NO: 312116 - DNA, 75 bp, Artificial Sequence
  Synthetic
ggggtcttagcaaaatcagttaaaaatattatgttaggacacgctagtgtacaagcagaaatggaacaagttgtg

SEQ ID NO: 312117 - DNA, 75 bp, Artificial Sequence
  Synthetic
aatacattatattatgtaaataagcaagaaggcaaaagtctctatgtaaaaggtgaaccaataataaatttctat

SEQ ID NO: 312118 - DNA, 75 bp, Artificial Sequence
  Synthetic
cgtacagtagtggaacttcatcctgacataagatatatttacagaagtttgaaagattgcaatgatcatagttta

SEQ ID NO: 312119 - DNA, 75 bp, Artificial Sequence
  Synthetic
agtcttaagggattaaataaaagtctaaaactaacaattacacatgtgcatttacaacacaacgagacattagtt

SEQ ID NO: 312120 - DNA, 75 bp, Artificial Sequence
  Synthetic
tccaaaagtgcacaacactataccactacagagatagatcttaatgatattatgcaaaatatagaacctacatat

SEQ ID NO: 312121 - DNA, 75 bp, Artificial Sequence
  Synthetic
tttttttggtttacgcaagtttgttgtacgcgaaaaaatgcgtacaacaaacttgcgtaaaccaaaaaaatgggg

SEQ ID NO: 312122 - DNA, 75 bp, Artificial Sequence
  Synthetic
agtgactgacaacaaaggagcattcaaatacataaagccacaaagtcaattcatagtagatcttggagcttacct

SEQ ID NO: 312123 - DNA, 75 bp, Artificial Sequence
  Synthetic
tcaatgaaatccattggacctctcaagacttgattgatgcaactcaaaattttctacaacatctaggtattactg

SEQ ID NO: 312124 - DNA, 75 bp, Artificial Sequence
  Synthetic
tacttggatttgatctcaatccataaattataataaatatcaactagcaaatcaatgtcactaacaccattagtt

SEQ ID NO: 312125 - DNA, 75 bp, Artificial Sequence
  Synthetic
gatgcaagtttacatagagtaaaaggatgtcatagcttcaaattatggtttcttaaacgtcttaatgtagcagaa

SEQ ID NO: 312126 - DNA, 75 bp, Artificial Sequence
  Synthetic
tcacccaaccccagaaactttagaaaatatgtcattaattcctgttaaaagtaataatagtaacaaacctaaatt

SEQ ID NO: 312127 - DNA, 75 bp, Artificial Sequence
  Synthetic
ctgttcctcagttaataaatgtatgttaatagtaaaatatcatgctcaagatgatattgatttcaaattagacaa

SEQ ID NO: 312128 - DNA, 75 bp, Artificial Sequence
  Synthetic
tttaatgtagtacaaaatgctaaattgatactatcaagaaccaaaaatttcatcatgcctaagaaagctgataaa

SEQ ID NO: 312129 - DNA, 75 bp, Artificial Sequence
  Synthetic
ctttcataatgaataatgaataaagatcttataataaaaattcccatagctatacactaacactgtattcaatta

SEQ ID NO: 312130 - DNA, 75 bp, Artificial Sequence
  Synthetic
taatagatgacaattgtgaaatcaaattctccaaaaaactaagcgattcaacaatgaccaactatatgaatcaat

SEQ ID NO: 312131 - DNA, 75 bp, Artificial Sequence
  Synthetic
gtcaaagatcttaccatgaagacattcaaccccactcatgagatcattgctctatgtgaatttgaaaatattatg

SEQ ID NO: 312132 - DNA, 75 bp, Artificial Sequence
  Synthetic
atatagataaacagttgttacctattgtgaacaagcaaagctgcagcatatcaaacattgaaactgtgatagagt

SEQ ID NO: 312133 - DNA, 75 bp, Artificial Sequence
  Synthetic
tccaacaaaagaacaacagactactagagattaccagggaatttagtgttaatgcaggtgtaactacacctgtaa

SEQ ID NO: 312134 - DNA, 75 bp, Artificial Sequence
  Synthetic
ctcacccagaatcctcagcttggaatcagtccctctaatccgtctgaaattacatcacaaatcaccaccatacta

SEQ ID NO: 312135 - DNA, 75 bp, Artificial Sequence
  Synthetic
attgaacaacctgttggaagggaatgatagtgacaatgatctatcacttgaagatttctgatcagttaccaatct

SEQ ID NO: 312136 - DNA, 75 bp, Artificial Sequence
  Synthetic
aaatagacatcagttagagttcaatcaatctcaacaaccatctataccgccaattcaatacatatactgtaaatc

SEQ ID NO: 312137 - DNA, 75 bp, Artificial Sequence
  Synthetic
cctataacaaatgatcagaaaaagttaatgtccaacaatgttcaaatagttagacagcaaagttactctatcatg

SEQ ID NO: 312138 - DNA, 75 bp, Artificial Sequence
  Synthetic
aaacaaatccaatcttctcacagagtcatggtgtcacaaaaccacgctaactatcatggtagtatagagtagtta

SEQ ID NO: 312139 - DNA, 75 bp, Artificial Sequence
  Synthetic
cagaaataaagatctgaacacacttgaaaatataacaaccactgaattcaaaaatgccatcacaaatgcaaaaat

SEQ ID NO: 312140 - DNA, 75 bp, Artificial Sequence
  Synthetic
attgtgaaattaaattctccaaaaaactaagtgattcaacaatgaccaactatatgaatcaattatctgaattac

SEQ ID NO: 312141 - DNA, 75 bp, Artificial Sequence
  Synthetic
tggggcaaatacaaaaatggctcttagcaaagtcaagttgaatgatacactcaacaaagatcaacttctgtcatc

SEQ ID NO: 312142 - DNA, 75 bp, Artificial Sequence
  Synthetic
acgttggggcaaatgcaaacatgtccaaaaccaaggaccaacgcaccgccaagacactagaaaggacctgggaca

SEQ ID NO: 312143 - DNA, 75 bp, Artificial Sequence
  Synthetic
acatcacctaaagatcccaagaaaaaagacagtatcatatctgtcaactcaatagatatagaagtaaccaaagaa

SEQ ID NO: 312144 - DNA, 75 bp, Artificial Sequence
  Synthetic
acaggttggtataccagtgtcataacaatagaattaagtaatataaaagaaaccaaatgcaatggaactgacact

SEQ ID NO: 312145 - DNA, 75 bp, Artificial Sequence
  Synthetic
caatgaagagccaaattcacccaaggtaagagtgtacaatactgtcatatcatatattgaaagcaacaggaaaaa

SEQ ID NO: 312146 - DNA, 75 bp, Artificial Sequence
  Synthetic
aagataataagaagagctatagaaatcagtgatgtcaaagtctatgctatattgaataaactggggctcaaagaa

SEQ ID NO: 312147 - DNA, 75 bp, Artificial Sequence
  Synthetic
aaactaaccaacccaatcatccaaccaaacatccatctgccaatcagccaaacagccaacaaaacaaccagccaa

SEQ ID NO: 312148 - DNA, 75 bp, Artificial Sequence
  Synthetic
caaacatccatctgccaatcagccaaacagccaacaaaacaaccagccaacccaaaactagccacccgggaaaaa

SEQ ID NO: 312149 - DNA, 75 bp, Artificial Sequence
  Synthetic
atgatgtaaccacaccatgtgaaatcaaggcatgcagtctaacatgtctaaaatcaaaaaatatgttgactacag

SEQ ID NO: 312150 - DNA, 75 bp, Artificial Sequence
  Synthetic
aatatctcaagtcaatgaaaaaatcaatcaaagtttagcttttattcgtagatccgatgaattattacataatgt

SEQ ID NO: 312151 - DNA, 75 bp, Artificial Sequence
  Synthetic
cattaattataacttctcagataatactcatctattaactaaacatataaggattgctaattctgaattagaaag

SEQ ID NO: 312152 - DNA, 75 bp, Artificial Sequence
  Synthetic
caatggacaaaagcatagacactttgtctgaaataagtggagctgctgaactggatagaacagaagaatatgctc

SEQ ID NO: 312153 - DNA, 75 bp, Artificial Sequence
  Synthetic
taaacactatacttgatgatttcaaagtgagtctagaatctataggtagtttgacacaagaattagaatatagag

SEQ ID NO: 312154 - DNA, 75 bp, Artificial Sequence
  Synthetic
tgaaattcattggacacctaaaaacttattagatgccactcaacaatttctccaacatcttaacatccctgaaga

SEQ ID NO: 312155 - DNA, 75 bp, Artificial Sequence
  Synthetic
atacaaaccatgatttaaaagataaacttcaagatctgtcagatgatagattgaataagttcttaacatgcataa

SEQ ID NO: 312156 - DNA, 75 bp, Artificial Sequence
  Synthetic
tcaacaactacaatcatacaagatgcaacaaaccagatcaagaacacaacccctacatatctcacccagaatcct

SEQ ID NO: 312157 - DNA, 75 bp, Artificial Sequence
  Synthetic
tggtctttatccaatatagttggtgttacatcacccagtatcatgtatacaatggacatcaaatatacaacaagc

SEQ ID NO: 312158 - DNA, 75 bp, Artificial Sequence
  Synthetic
ttttaacggcccttatcttaaaaatgattacaccaacttaattagtagacaaagcccactactagagcatatgaa

SEQ ID NO: 312159 - DNA, 75 bp, Artificial Sequence
  Synthetic
tagacaagttttaaccaaaaaacagagagatcaaatagatctattagcaaaattggattgggtgtatgcatctat

SEQ ID NO: 312160 - DNA, 75 bp, Artificial Sequence
  Synthetic
ttatacaactttaataatgaataatgagcaaaaatcttataacaaaaatagctacacactaacattgtattcaat

SEQ ID NO: 312161 - DNA, 75 bp, Artificial Sequence
  Synthetic
gaaggtaatccaagcccttctcaagtctccataacatccgagtacccatcacaaccctcatctccacccaacaca

SEQ ID NO: 312162 - DNA, 75 bp, Artificial Sequence
  Synthetic
aaagtcatgggtttatattaatagataatcaaactttaagtggttttcagtttattttaaatcaatatggttgca

SEQ ID NO: 312163 - DNA, 75 bp, Artificial Sequence
  Synthetic
aaaggagtagatactgtatcagtgggcaacactttatactatgtaaacaagctggaaggcaaaaacctttatgta

SEQ ID NO: 312164 - DNA, 75 bp, Artificial Sequence
  Synthetic
cacagctgctgttcaatacaatgtcctagaaaaagacgatgatcctgcatcacttacaatatgggtgcccatgtt

SEQ ID NO: 312165 - DNA, 75 bp, Artificial Sequence
  Synthetic
acccacaacaaacatttcaacatcacagcacaggtcgaatcatttcctcgcattatgctacccacacaactaagc

SEQ ID NO: 312166 - DNA, 75 bp, Artificial Sequence
  Synthetic
ttacttgagagataataaattcaatgaatgtgatctatacaattgtgtagtcaatcaaagctatctcaacaactc

SEQ ID NO: 312167 - DNA, 75 bp, Artificial Sequence
  Synthetic
ataaaacttgacagaagataaaaatggggcaaataaatcaattcagccgacccaaccatggacacaacacacaat

SEQ ID NO: 312168 - DNA, 75 bp, Artificial Sequence
  Synthetic
ttaaacagaatacttaagtctatggataaaagcatagatactttatcagaaataagtggagctgcagagttggac

SEQ ID NO: 312169 - DNA, 75 bp, Artificial Sequence
  Synthetic
tccacacccaagggaccttcattaagagtcatgataaactcaagaagtgcagtgctagcacaaatgcccagcaaa

SEQ ID NO: 312170 - DNA, 75 bp, Artificial Sequence
  Synthetic
atcaaccattcaatgaaatccattggacctctcaagacttgattgatgcaattcaaaattttctacaacatctag

SEQ ID NO: 312171 - DNA, 75 bp, Artificial Sequence
  Synthetic
acagatgatactgcagggaacaagcccaattatcaaagaaaacctctagtaagtttcaaagaagaccctacgcca

SEQ ID NO: 312172 - DNA, 75 bp, Artificial Sequence
  Synthetic
tcacaatcacaaacaatccgtggttcagccaatcaaacaaaacttatctaaagtcccagatcatcccaagtcatt

SEQ ID NO: 312173 - DNA, 75 bp, Artificial Sequence
  Synthetic
agttaataaaaacatacacatggggcaaataatcatcggagaaaatccaactaatcacaatatctgttaacatag

SEQ ID NO: 312174 - DNA, 75 bp, Artificial Sequence
  Synthetic
cattttttcgcgtacaacaaacttgcgtaaaccaaaaaaatggggcaaataagaatttgataagtaccacttaaa

SEQ ID NO: 312175 - DNA, 75 bp, Artificial Sequence
  Synthetic
accagatcaagaacacaaccccaacatacctcacccagaatccccagcttggaatcagcttctccaatctgtccg

SEQ ID NO: 312176 - DNA, 75 bp, Artificial Sequence
  Synthetic
aaggcaatccaagcccttctcaagtctccataacatccgagtacccatcacaaccctcatctccacccaacacac

SEQ ID NO: 312177 - DNA, 75 bp, Artificial Sequence
  Synthetic
aatagatataagcaaaccagtcagactcatggaaggtcaaactcatgctcaagcagattatttgctagcattaaa

SEQ ID NO: 312178 - DNA, 75 bp, Artificial Sequence
  Synthetic
tattagtacataaaatgtctgattattttcataatgcgtatattttaagtactaatttagctggacattggattc

SEQ ID NO: 312179 - DNA, 75 bp, Artificial Sequence
  Synthetic
ctattttcctggttacatttaactattcctcatgtcacaataatatgcacatataggcatgcacccccctatata

SEQ ID NO: 312180 - DNA, 75 bp, Artificial Sequence
  Synthetic
taaagagtatgcaggcataggccacaaattaaaaggaactgagacttatatatcaagagatatgcaatttatgag

SEQ ID NO: 312181 - DNA, 75 bp, Artificial Sequence
  Synthetic
aataaacacaaattcaatgatgaattttacacttctaatctcttctacattaattataacttctcagataatact

SEQ ID NO: 312182 - DNA, 75 bp, Artificial Sequence
  Synthetic
attgcattacaacttaaaaatcatgcattatgtaacaacaaattatatttggatatattaaaagttctaaaacac

SEQ ID NO: 312183 - DNA, 75 bp, Artificial Sequence
  Synthetic
aatgtaaatgctggtaaatccaccacaaatatcatgataactactataattatagtaattatagtaatattgtta

SEQ ID NO: 312184 - DNA, 75 bp, Artificial Sequence
  Synthetic
acaaatgagacagatgatactgtagggaacaagcccaattatcaaagaaaacctctagtaagtttcaaagaagac

SEQ ID NO: 312185 - DNA, 75 bp, Artificial Sequence
  Synthetic
gaaataagtggagctgcagagttggacagaacagaagagtatgccctcggtgtagttggagtgctagagagttat

SEQ ID NO: 312186 - DNA, 75 bp, Artificial Sequence
  Synthetic
gttcttagaatgcattggcattaagcctaccaagcacacacccataatatacaagtatgatctcaatccatgaat

SEQ ID NO: 312187 - DNA, 75 bp, Artificial Sequence
  Synthetic
atcaaacaaaactcatcaggagtctcagatcatcccaagtcattgttcatcagatccagtactcaaataagttaa

SEQ ID NO: 312188 - DNA, 75 bp, Artificial Sequence
  Synthetic
taattgtagagtcactatgtataatcaaaaaaacacactatatatcaatcaaaacaaccaaaataaccatatata

SEQ ID NO: 312189 - DNA, 75 bp, Artificial Sequence
  Synthetic
acgggaaaaaaatgcgtactacaaacttgcacattcgaaaaaaatggggcaaataagaacttgataagtgctatt

SEQ ID NO: 312190 - DNA, 75 bp, Artificial Sequence
  Synthetic
ctcaagaagtgcagtgctagcacaaatgcccagcaaatttaccatatgtgccaatgtgtccttggatgaaagaag

SEQ ID NO: 312191 - DNA, 75 bp, Artificial Sequence
  Synthetic
acgcgaaaaaatgcgtacaacaaacttgcgtaaaccaaaaaaatggggcaaataagaatttgataagtaccactt

SEQ ID NO: 312192 - DNA, 75 bp, Artificial Sequence
  Synthetic
ttgcgtaaaccaaaaaaatggggcaaataagaatttgataagtaccacttaaatttaactcctttggttagagat

SEQ ID NO: 312193 - DNA, 75 bp, Artificial Sequence
  Synthetic
aaatttaactcctttggttagagatgggcagcaactcattgagtatgataaaagttagattgcaaaatctgtttg

SEQ ID NO: 312194 - DNA, 75 bp, Artificial Sequence
  Synthetic
ccaaacaaaaaacctggaaagaaaaccaccaccaagcccacaaaaaaaccaaccatcaagacaaccaaaaaagat

SEQ ID NO: 312195 - DNA, 75 bp, Artificial Sequence
  Synthetic
atacagttaactaatgctttggctaaggcagttatacatacaatcaaattgaatggcattgtatttgtgcatgtt

SEQ ID NO: 312196 - DNA, 75 bp, Artificial Sequence
  Synthetic
aaagctcagaaaaatctgctatcaagagtatgtcatacattattagataagacaatatcagataatataataaat

SEQ ID NO: 312197 - DNA, 75 bp, Artificial Sequence
  Synthetic
ggagtctcagatcatcccaagtcattgttcatcagatctagtacttaaataagttaataaaaaaatcacatgggg

SEQ ID NO: 312198 - DNA, 75 bp, Artificial Sequence
  Synthetic
tttcgcgtaaaccaaaaaaatggggcaaataagaatttgataagtaccacttaaatttaactcctttggttagag

SEQ ID NO: 312199 - DNA, 75 bp, Artificial Sequence
  Synthetic
gtatagcagcattagtaataaccaaattagcagcaggggatagatctggtcttacagctgtgattaggagagcta

SEQ ID NO: 312200 - DNA, 75 bp, Artificial Sequence
  Synthetic
accaacacaaaggaagggtccaacatctgcttaacaagaaccgacagaggatggtactgtgacaatgcaggatca

SEQ ID NO: 312201 - DNA, 75 bp, Artificial Sequence
  Synthetic
aaattaaaattctctgatagcgataaatcaagaagagtattagagtattatttaagagataacaaattcaatgaa

SEQ ID NO: 312202 - DNA, 75 bp, Artificial Sequence
  Synthetic
atactagtgaaacaaatatccacacccaaaggaccttcattaagagtcatgataaactcaagaagtgcagtgcta

SEQ ID NO: 312203 - DNA, 75 bp, Artificial Sequence
  Synthetic
gattaacctttttcctctacatcagtgtgttaattcatacaaactttctacctacattcttcactttcaccatca

SEQ ID NO: 312204 - DNA, 75 bp, Artificial Sequence
  Synthetic
tgttaggacacgctagtgtacaagcagaaatggaacaagttgtggaggtgtatgagtatgctcagaaattgggtg

SEQ ID NO: 312205 - DNA, 75 bp, Artificial Sequence
  Synthetic
aatcaccaaccctctgtggtttaaccaatcaaacaaaacttatctggagtctcagatcatcccaagtcattgttc

SEQ ID NO: 312206 - DNA, 75 bp, Artificial Sequence
  Synthetic
agtaaccttgcatttaaaaatgaacaacccctacctctttacaacacctcattaacatcccaccatgcaaaccac

SEQ ID NO: 312207 - DNA, 75 bp, Artificial Sequence
  Synthetic
gatatcaagactaacaataacattggggcaaatgcaaacatgtccaaaaacaaggaccaacgcaccgctaagaca

SEQ ID NO: 312208 - DNA, 75 bp, Artificial Sequence
  Synthetic
caacatcaataaaacagacatcaatccattgaatcaactgccagaccgaacaaacaaacgtccatcagtagaacc

SEQ ID NO: 312209 - DNA, 75 bp, Artificial Sequence
  Synthetic
acaaaacaaaaagatacaatcaaaacaacactcttgaagaaattaatgtgttcgatgcaacatcctccatcatgg

SEQ ID NO: 312210 - DNA, 75 bp, Artificial Sequence
  Synthetic
tcaacatactagtgaagcagatctctacgcccaaaggaccttcactacgagtcacgattaactcaagaagtgctg

SEQ ID NO: 312211 - DNA, 75 bp, Artificial Sequence
  Synthetic
aaatataatgtcaacagtttaacacgtggtgagagaggacccactaaaccatgggttggttcatctacacaagag

SEQ ID NO: 312212 - DNA, 75 bp, Artificial Sequence
  Synthetic
tcattggattttcttaaaatctgaacttcatcgaaactctcatctataaaccatctcacttacactatttaagta

SEQ ID NO: 312213 - DNA, 75 bp, Artificial Sequence
  Synthetic
accacatcatcaaactattaactcaaacaattcaagccatgggacaaaatggatcccattattaatggaaattct

SEQ ID NO: 312214 - DNA, 75 bp, Artificial Sequence
  Synthetic
agaaatgtatggttatataatcaaattgctttacaactaaaaaatcatgcattatgtaacaacaaattatatttg

SEQ ID NO: 312215 - DNA, 75 bp, Artificial Sequence
  Synthetic
tctgcaacaaaactcttgaactaggacagatgtaccaaatcaacacacagagttccaccattatgctgtgtcaaa

SEQ ID NO: 312216 - DNA, 75 bp, Artificial Sequence
  Synthetic
agttccaccattatgctgtgtcaaaccataatcctgtatatacaaacaaacaaatccaatcctctcacagagtca

SEQ ID NO: 312217 - DNA, 75 bp, Artificial Sequence
  Synthetic
tgatgtcaaagtctatgctatattgaataaactggggcttaaagaaaaagacaagattaaatccaacaatggaca

SEQ ID NO: 312218 - DNA, 75 bp, Artificial Sequence
  Synthetic
ctttgtggtgtagtagcattgtgtgtttgagatgggcagcaattcattgagtatgataaaagttagattgcaaaa

SEQ ID NO: 312219 - DNA, 75 bp, Artificial Sequence
  Synthetic
gatcaagaacacaaccccaacatacctcactcagaatccccagcttggaatcagcttctccaatctgtccggaac

SEQ ID NO: 312220 - DNA, 75 bp, Artificial Sequence
  Synthetic
ttatccttccttgttggaacttacagaaagagatttgattgttttatcaggactacgtttctatcgtgagtttcg

SEQ ID NO: 312221 - DNA, 75 bp, Artificial Sequence
  Synthetic
cagagaaaatgatagctgaaaacattttacaattctttcctgaaagtcttacaagatatggtgatctagaactac

SEQ ID NO: 312222 - DNA, 75 bp, Artificial Sequence
  Synthetic
gtaagtgctctatcatcacagatctcagcaaattcaatcaagcatttcgatatgaaacatcatgtatttgtagtg

SEQ ID NO: 312223 - DNA, 75 bp, Artificial Sequence
  Synthetic
ttaatagtaaaatatcatgctcaagatgatatcgatttcaaattagacaacataactatattaaaaacttatgta

SEQ ID NO: 312224 - DNA, 75 bp, Artificial Sequence
  Synthetic
gagtctattgatgcaaatattaagagtttgataccctttctttgttaccctataacaaaaaaaggaattaatact

SEQ ID NO: 312225 - DNA, 75 bp, Artificial Sequence
  Synthetic
ttagacaatataactatattaaaaacttatgtatgcttaggcagtaagttaaagggatcggaggtttacttagtc

SEQ ID NO: 312226 - DNA, 75 bp, Artificial Sequence
  Synthetic
aatgctaaaagaaatgggagaggtggctccagaatacaggcatgactctcctgattgtggaatgataatattatg

SEQ ID NO: 312227 - DNA, 75 bp, Artificial Sequence
  Synthetic
ctaaaattatcattttgatctaggaagaataagtttaaatccaaatctaattggtttatatgtatattaactaaa

SEQ ID NO: 312228 - DNA, 75 bp, Artificial Sequence
  Synthetic
cagacatgagaccattgtcacttgagactataataacatcactaaccagagacatcataacacacagatttatat

SEQ ID NO: 312229 - DNA, 75 bp, Artificial Sequence
  Synthetic
tccctatgccaatattcatcaatcatgatgggttcttagaatgcattggcattaagcctacaaagcacactccca

SEQ ID NO: 312230 - DNA, 75 bp, Artificial Sequence
  Synthetic
taatatacaagtatgatctcaatccatgaatttcaacataagattcacactatctgaaataacaacttcatgcat

SEQ ID NO: 312231 - DNA, 75 bp, Artificial Sequence
  Synthetic
agcaaagtcaagttgaacgatacactcaacaaagatcaacttctgtcatccagcaaatacaccatccaacggagc

SEQ ID NO: 312232 - DNA, 75 bp, Artificial Sequence
  Synthetic
tgctgaacctatcagtctttttgtctgtgatgctgaattgcctgtaacagtcaactggagtaaaattataataga

SEQ ID NO: 312233 - DNA, 75 bp, Artificial Sequence
  Synthetic
aatttctccaacatcttaacatccctgaagatatatatacagtatatatattagtgtcataatgcttgaccataa

SEQ ID NO: 312234 - DNA, 75 bp, Artificial Sequence
  Synthetic
catgccaaaaataatgatactacctgacaaatatccttgtagtataaattccatactaataacaagtagttgtag

SEQ ID NO: 312235 - DNA, 75 bp, Artificial Sequence
  Synthetic
caaaacacacagaaagagacaccagcacctcacaatccattgtgcttgacacaaccacatcaaaacacacaatcc

SEQ ID NO: 312236 - DNA, 75 bp, Artificial Sequence
  Synthetic
gacagcagaagaactagaggctatcaaacatcagcttaatccaaaagataatgatgtagagctttgagttaataa

SEQ ID NO: 312237 - DNA, 75 bp, Artificial Sequence
  Synthetic
aaataagttaataaaaatacccacatggggcaaataatcatcggaggaaatccaaccaatcacaatatctgtcaa

SEQ ID NO: 312238 - DNA, 75 bp, Artificial Sequence
  Synthetic
actaatttacttaaaaagataataagaagagctatagaaatcagtgatgtcaaagtctatgctatattgaataaa

SEQ ID NO: 312239 - DNA, 75 bp, Artificial Sequence
  Synthetic
gacaaacgataatataacagcaagattagataggattgatgaaaaattaagtgaaatactaggaatgcttcacac

SEQ ID NO: 312240 - DNA, 75 bp, Artificial Sequence
  Synthetic
acatctgctcgggatggtataagagatgccatggttggtttaagagaagaaatgatagaaaaaatcagaactgaa

SEQ ID NO: 312241 - DNA, 75 bp, Artificial Sequence
  Synthetic
acaacaccaacagaagaccaacaaacaaaacaactcacctatccaaccaaacatctatctgccaatcagccaacc

SEQ ID NO: 312242 - DNA, 75 bp, Artificial Sequence
  Synthetic
caaaggaccttcattaagagtcatgataaactcaagaagtgcagtgctagcacaaatgcccagcaaattcactat

SEQ ID NO: 312243 - DNA, 75 bp, Artificial Sequence
  Synthetic
tcactatgaaaacactcaacccaacacatgacatcattgctttatgtgaatttgaaaatatagtaacatcaaaaa

SEQ ID NO: 312244 - DNA, 75 bp, Artificial Sequence
  Synthetic
tttgcaatcaaacccatggaagattaacctttttcctctacattagctagctgatccatacacaccctctaccta

SEQ ID NO: 312245 - DNA, 75 bp, Artificial Sequence
  Synthetic
agaagcaagctggcatatgatgtaaccacaccctgtgaaatcaaggcatgtagtctaacatgcctaaaatcaaaa

SEQ ID NO: 312246 - DNA, 75 bp, Artificial Sequence
  Synthetic
atggattagtaactgtttgaacacattaaataaaagcttaggcttaagatgcggattcaataatgttatcttgac

SEQ ID NO: 312247 - DNA, 75 bp, Artificial Sequence
  Synthetic
aggtaaccttgtgtttgagagcagtgtgttaattccatcatttcccatatataacctccattttgtaatactggc

SEQ ID NO: 312248 - DNA, 75 bp, Artificial Sequence
  Synthetic
gtgttaattccatcatttcccatatataacctccattttgtaatactggcattgttgtgaaattggatttcacta

SEQ ID NO: 312249 - DNA, 75 bp, Artificial Sequence
  Synthetic
tatatatcacgagatatgcaatttatgagtaaaacaattcaacataacggtgtatattacccagctagtataaag

SEQ ID NO: 312250 - DNA, 75 bp, Artificial Sequence
  Synthetic
aacaaaagcttaggcttaagatgtggattcaataatgttatcttgacacaactattcctttatggagattgtata

SEQ ID NO: 312251 - DNA, 75 bp, Artificial Sequence
  Synthetic
aagataagctccaggatcttccagatgatagactgaacaaattcttgacatgtgtcatcacatttgataaaaatc

SEQ ID NO: 312252 - DNA, 75 bp, Artificial Sequence
  Synthetic
aaaaacagagagatcaaattgatctattagcaaaattggattgggtgtatgcatctatagataacaaggatgaat

SEQ ID NO: 312253 - DNA, 75 bp, Artificial Sequence
  Synthetic
cacaaaatatggcactttccctatgccaatatttatcaatcatgatgggttcttagaatgcattggcattaagcc

SEQ ID NO: 312254 - DNA, 75 bp, Artificial Sequence
  Synthetic
caagttgaatgatacactcaacaaagatcaacttctatcatccagcaaatataccatccaacggagcacaggaga

SEQ ID NO: 312255 - DNA, 75 bp, Artificial Sequence
  Synthetic
aattatacactcaacaataccaaaaataccaatgtaacattaagcaagaaaaggaaaagaagatttcttggcttt

SEQ ID NO: 312256 - DNA, 75 bp, Artificial Sequence
  Synthetic
gagctttgagttaataaaaaagtggggcaaataaatcatcatggaaaagtttgctcctgaattccatggagaaga

SEQ ID NO: 312257 - DNA, 75 bp, Artificial Sequence
  Synthetic
tgtcctaacagaattattctcatacccaagcttaatgagatacatttgatgaaacctcccatattcacaggtgat

SEQ ID NO: 312258 - DNA, 75 bp, Artificial Sequence
  Synthetic
gtggtatcactaactggtaaagaaagagagctcagtgtgggtagaatgtttgctatgcaaccaggtatgtttagg

SEQ ID NO: 312259 - DNA, 75 bp, Artificial Sequence
  Synthetic
aaaactacatcttagcagagaaccgtgatctatcaagcaagaacgaaattaaacctggggcaaataaccatggag

SEQ ID NO: 312260 - DNA, 75 bp, Artificial Sequence
  Synthetic
tgttcttacaatggttcactatctgaccatagacaacccatctatcattggattttcttaaagtctgaacttcat

SEQ ID NO: 312261 - DNA, 75 bp, Artificial Sequence
  Synthetic
aattattttgaatggccaccccatgcactgcttgtaagacaaaactttatgttaaacagaatacttaagtctatg

SEQ ID NO: 312262 - DNA, 75 bp, Artificial Sequence
  Synthetic
tatcaacattgattatggtgaaaatttgaccattcctgctacagatgcaaccaacaacattcattggtcttattt

SEQ ID NO: 312263 - DNA, 75 bp, Artificial Sequence
  Synthetic
aacacacaaatttatatacttgataaatcatgaatgcatagtgagaaaacttgatgaaagacaggccacatttac

SEQ ID NO: 312264 - DNA, 75 bp, Artificial Sequence
  Synthetic
ttctgaattagaaaataattacaacaaattatatcatcctacaccagaaaccctagaaaatatactaaccaatcc

SEQ ID NO: 312265 - DNA, 75 bp, Artificial Sequence
  Synthetic
ggagcctgaaaattatagtaatttaaaattaaggagagatataagatagaagatggggcaaatacaaagatggct

SEQ ID NO: 312266 - DNA, 75 bp, Artificial Sequence
  Synthetic
gaactagccaatgtcaatatactagtgaaacaaatatccacacccaagggaccctcattaagagtcatgataaac

SEQ ID NO: 312267 - DNA, 75 bp, Artificial Sequence
  Synthetic
tatttaagtctaaccttttcaatcagaaatggggtgcaattcactgagcatgataaaggttagattacaaaattt

SEQ ID NO: 312268 - DNA, 75 bp, Artificial Sequence
  Synthetic
ttcataatgaataatgaataaaaatcttatattaaaaattcccatagctacacactaacactgtattcaattata

SEQ ID NO: 312269 - DNA, 75 bp, Artificial Sequence
  Synthetic
tggattcaataatgttatcttgacacaactattcctttatggagattgtatattaaaactattccacaatgaagg

SEQ ID NO: 312270 - DNA, 75 bp, Artificial Sequence
  Synthetic
ggaagaagtccttgcatatgttgtacagctacctatctatggtgtaatagatacaccttgctggaaattacacac

SEQ ID NO: 312271 - DNA, 75 bp, Artificial Sequence
  Synthetic
aaaaaccacactgagaaaaacataaccacttaccttactcaagtctcaccagaaagggttagcccatccaaacaa

SEQ ID NO: 312272 - DNA, 75 bp, Artificial Sequence
  Synthetic
aacagaagaccaacaaacaaaccaactcacccatccaaccaaacatctatctgccaatcagccaaccagccaaaa

SEQ ID NO: 312273 - DNA, 75 bp, Artificial Sequence
  Synthetic
caaacatctatctgccgattagccaaccagccaaaaaacaaccagccaatccaaaactagccacccggaaaaaat

SEQ ID NO: 312274 - DNA, 75 bp, Artificial Sequence
  Synthetic
cgtaaattccaacaaaaaaaaccaacccaaccaaaccaagctattcctcaaacaacaatgctcaatagttaagaa

SEQ ID NO: 312275 - DNA, 75 bp, Artificial Sequence
  Synthetic
cccaaccaaaccaagctattcctcaaacaacaatgctcaatagttaagaaggagctaatccattttagtaattaa

SEQ ID NO: 312276 - DNA, 75 bp, Artificial Sequence
  Synthetic
ctaaaaatttgatatggactagtttccctagaaattatatgccgtcacacatacaaaattatatagaacatgaaa

SEQ ID NO: 312277 - DNA, 75 bp, Artificial Sequence
  Synthetic
ggtcttacagcagtaattaggagggcaaacaatgtcttaaaaaacgaaataaaacgctacaagggcctcatacca

SEQ ID NO: 312278 - DNA, 75 bp, Artificial Sequence
  Synthetic
ccctgcagcatatgcagcaacaatccaacttgctgggctatctgcaaaagaataccaaacaaaaaacctggaaag

SEQ ID NO: 312279 - DNA, 75 bp, Artificial Sequence
  Synthetic
caaccatcaacaccaccaaaacaaacatcagaactacactgctcacctccaacaccacaggaaatccagaacaca

SEQ ID NO: 312280 - DNA, 75 bp, Artificial Sequence
  Synthetic
caagtcaagaggaaaccctccactcaaccacctccgaaggctatctaagcccatcacaagtctatacaacatccg

SEQ ID NO: 312281 - DNA, 75 bp, Artificial Sequence
  Synthetic
ggcaatccaagcccttcacaagtctatacaacatccgagtacctatcacaatctctatctccatccaacacaaca

SEQ ID NO: 312282 - DNA, 75 bp, Artificial Sequence
  Synthetic
acaccacaaagactgatgatcacagacatgagaccattgtcacttgagactataataacatcactaaccagagac

SEQ ID NO: 312283 - DNA, 75 bp, Artificial Sequence
  Synthetic
agccaatcaaacaaaacttatctaaagtcccagatcatcccaagtcattgtttatcagatctagtactcaaataa

SEQ ID NO: 312284 - DNA, 75 bp, Artificial Sequence
  Synthetic
ggacatattaaaggttctgaaacacttaaaaaccttttttaatcttgataatattgatacagcattaacattgta

SEQ ID NO: 312285 - DNA, 75 bp, Artificial Sequence
  Synthetic
tatctgttaactcaatagatatagaagtaactaaagagagcccgataacatctggcaccaacatcatcaatccaa

SEQ ID NO: 312286 - DNA, 75 bp, Artificial Sequence
  Synthetic
tacaatccacaatagtcaagaccaaaaacacaacaacaacccaaatacaacccagcaagcccaccacaaaacaac

SEQ ID NO: 312287 - DNA, 75 bp, Artificial Sequence
  Synthetic
ggttagagatgggcagcaattcattgagtatgataaaagttagattacaaaatttatttgacaatgatgaagtag

SEQ ID NO: 312288 - DNA, 75 bp, Artificial Sequence
  Synthetic
ccatacattagtagttgcaagtgcaggacccacttcagctcgcgatggaataagagatgctatggttggtctgag

SEQ ID NO: 312289 - DNA, 75 bp, Artificial Sequence
  Synthetic
gttatataaaacaattgaataccaaattaacttactatttgtaaaaatgagaactggggcaaatatgtcacgaag

SEQ ID NO: 312290 - DNA, 75 bp, Artificial Sequence
  Synthetic
atgggctaagagttgtttatgaaagtttacccttttataaagcagagaaaatagtaaatcttatatccggtacaa

SEQ ID NO: 312291 - DNA, 75 bp, Artificial Sequence
  Synthetic
tttacccttttataaagcagagaaaatagtaaatcttatatccggtacaaaatctataactaacatactggaaaa

SEQ ID NO: 312292 - DNA, 75 bp, Artificial Sequence
  Synthetic
tagcacaaatcacattatccattttggcaatgataatctcaacttcacttataattgcagccatcatattcattg

SEQ ID NO: 312293 - DNA, 75 bp, Artificial Sequence
  Synthetic
caagtgatgttacggtggggggtcttagcaaaatcagttaaaaatattatgttaggacacgctagtgtgcaagca

SEQ ID NO: 312294 - DNA, 75 bp, Artificial Sequence
  Synthetic
ccatactagattcaacaacaccaggagtcaagtcaaccctgcaatccacaacagtcgggaccaagaatacaacaa

SEQ ID NO: 312295 - DNA, 75 bp, Artificial Sequence
  Synthetic
aaggcaatacaagcccttcacaaatctatacaacatccgagtacctatcacaacctccatctccatccaacataa

SEQ ID NO: 312296 - DNA, 75 bp, Artificial Sequence
  Synthetic
gagaaccaccaccaagcccacaaaaaaaccaaccctaaagacaaccaaaaaagatcccaaacctcaaaccactaa

SEQ ID NO: 312297 - DNA, 75 bp, Artificial Sequence
  Synthetic
aaaccaaccctaaagacaaccaaaaaagatcccaaacctcaaaccactaaatcaaaggaggtacccaccaccaag

SEQ ID NO: 312298 - DNA, 75 bp, Artificial Sequence
  Synthetic
actactcacctccaacaccacgagaaatccagaactcacaagtcaaatggaaaccttccactcaacttcctccga

SEQ ID NO: 312299 - DNA, 75 bp, Artificial Sequence
  Synthetic
gaaaatatagcaaccaccgaattcaaaaatgctatcaccaatgcgaaaattattccctatgcaggattagtatta

SEQ ID NO: 312300 - DNA, 75 bp, Artificial Sequence
  Synthetic
catcagagaaattgaacaacctgttggaagggaatgatagtgacaatgatctatcacttgaagatttctgattag

SEQ ID NO: 312301 - DNA, 75 bp, Artificial Sequence
  Synthetic
tagtataaattccatactaataacaagtagttgtagagttactatgtataatcaaaaaaacacactatatatcaa

SEQ ID NO: 312302 - DNA, 75 bp, Artificial Sequence
  Synthetic
caacactgaatgacaggtccacatatatcctcaaactacacactatatccaaacatcatgaacatctacactaca

SEQ ID NO: 312303 - DNA, 75 bp, Artificial Sequence
  Synthetic
acttcattgcaactctcatctataaaccatctcacttacactatttaagtagattcctattttatagttatataa

SEQ ID NO: 312304 - DNA, 75 bp, Artificial Sequence
  Synthetic
ttcctcaccacacaatcataatcaccaactctctgtggttcaaccaatcaaataaaattcatcaagagtctcaga

SEQ ID NO: 312305 - DNA, 75 bp, Artificial Sequence
  Synthetic
aaacatcaccacctaccttactcaagtcccaccagaaagggttagctcatccaaacaacctacaaccacatcacc

SEQ ID NO: 312306 - DNA, 75 bp, Artificial Sequence
  Synthetic
tcacccaacacaaagtcagaaacacaccacacaacagcacaaaccaagggcagaaccaccacctcaacacagacc

SEQ ID NO: 312307 - DNA, 75 bp, Artificial Sequence
  Synthetic
aggttgtaaaattagtatagagtatattttaaaagaccttaaaattaaagatcctaattgtatagcattcatagg

SEQ ID NO: 312308 - DNA, 75 bp, Artificial Sequence
  Synthetic
cttaagatggttaacttactataaactaaacacttatccttccttgttggaacttacagaaagagatttgattgt

SEQ ID NO: 312309 - DNA, 75 bp, Artificial Sequence
  Synthetic
ggacaaaatggatcccattattaatggaaattctgctaatgtttatctaactgatagttatttaaaaggtgttat

SEQ ID NO: 312310 - DNA, 75 bp, Artificial Sequence
  Synthetic
aatccaacagcaatcccaccactcaaccacccccgaaaacacacccaattccacacaaacacccacagcatccga

SEQ ID NO: 312311 - DNA, 75 bp, Artificial Sequence
  Synthetic
tagttattaaaaaatatgcaaacttttcaataatttagcatattgattccaaaattatcattttagtcttaaggg

SEQ ID NO: 312312 - DNA, 75 bp, Artificial Sequence
  Synthetic
agatctcaagaattacataaataaccaattattacccatagtaaatcaacagagctgtcgcatctccaacattga

SEQ ID NO: 312313 - DNA, 75 bp, Artificial Sequence
  Synthetic
atggaaggtcaaactcatgctcaagcagattatttgctagcattaaatagtcttaaattactgtataaagagtat

SEQ ID NO: 312314 - DNA, 75 bp, Artificial Sequence
  Synthetic
ataatataataaatggcagatggataattctattaagtaagttccttaaattaattaagcttgcaggtgacaata

SEQ ID NO: 312315 - DNA, 75 bp, Artificial Sequence
  Synthetic
actcctttggtttgagatgggcagcaattcattaagtatgataaaagttagattacaaaatttatttgacaatga

SEQ ID NO: 312316 - DNA, 75 bp, Artificial Sequence
  Synthetic
tagggtctgaaaggcaagctaaaattactagtgagattaatagattagcagtaacagaagtcttaagtatagctc

SEQ ID NO: 312317 - DNA, 75 bp, Artificial Sequence
  Synthetic
aatcaacccacaacaaacacttcaacatcacagtacaggctgaatcatttcttcacatcatgctacccacacaac

SEQ ID NO: 312318 - DNA, 75 bp, Artificial Sequence
  Synthetic
cttagaatgcattggcattaagcctacaaagcacactcccataatatacaagtatgatctcaatccatgaatttc

SEQ ID NO: 312319 - DNA, 75 bp, Artificial Sequence
  Synthetic
gagaaagatcttggtctttatccaatatagttggtgttacatcacccagtatcatgtatacaatggacataaaat

SEQ ID NO: 312320 - DNA, 75 bp, Artificial Sequence
  Synthetic
taaatttctatgacccattagtgttcccctctgatgaatttgatgcatcaatatctcaagtcaatgagaagatta

SEQ ID NO: 312321 - DNA, 75 bp, Artificial Sequence
  Synthetic
atagataacccatctatcattggattttcttaaaatttgaacttcatcacaactttcatctataaaccatctcac

SEQ ID NO: 312322 - DNA, 75 bp, Artificial Sequence
  Synthetic
cattggcaagcttaacaactgaaattcaaatcaacattgagatagaatctagaaaatcctacaaaaaaatgctaa

SEQ ID NO: 312323 - DNA, 75 bp, Artificial Sequence
  Synthetic
atcttaacatccctgaagatagatacacaatatatatattagtgtcataatgcttggccataacgattctatatc

SEQ ID NO: 312324 - DNA, 75 bp, Artificial Sequence
  Synthetic
aggtattactgatgatatatacacaatatatatattagtgtcataacactcaatcctaatacttaccacatcatc

SEQ ID NO: 312325 - DNA, 75 bp, Artificial Sequence
  Synthetic
ctataattaaagacgacatactttcggctgtggaaagcaatcaatcacatacaaattcagacaaaaatcactcag

SEQ ID NO: 312326 - DNA, 75 bp, Artificial Sequence
  Synthetic
taatcaaagatgatatacttttagctgttaaggataatcaatctcatcttaaagcagacaaaaatcactctacaa

SEQ ID NO: 312327 - DNA, 75 bp, Artificial Sequence
  Synthetic
tgttaaggataatcaatctcatcttaaagcagacaaaaatcactctacaaaacaaaaagatacaatcaaaacaac

SEQ ID NO: 312328 - DNA, 75 bp, Artificial Sequence
  Synthetic
caacattcattggtcttatttacatataaagtttgctgaacctatcagtctttttgtctgtgatgctgaattgcc

SEQ ID NO: 312329 - DNA, 75 bp, Artificial Sequence
  Synthetic
aacagtcaagaccaaaaacacaacaacaacccaaacacaacccagcaagcccaccacaaaacaacgccaaaacaa

SEQ ID NO: 312330 - DNA, 75 bp, Artificial Sequence
  Synthetic
cacccggaaaaaatcgatactatagttacaaaaaaaggatggggcaaatatggaaacatacgtgaacaaacttca

SEQ ID NO: 312331 - DNA, 75 bp, Artificial Sequence
  Synthetic
atttagttaatatacatataaaccaattagatttggatttaaacttattcttcctagatcaaaatgataatttta

SEQ ID NO: 312332 - DNA, 75 bp, Artificial Sequence
  Synthetic
atatagtaacatcaaaaaaagtcataataccaacatacttaagatccatcagtgtcagaaataaagatctgaaca

SEQ ID NO: 312333 - DNA, 75 bp, Artificial Sequence
  Synthetic
cacctcacaatcacaatcaccaaccctctgtggtttaaccaatcaaacaaaacttatctggagtctcagatcatc

SEQ ID NO: 312334 - DNA, 75 bp, Artificial Sequence
  Synthetic
atgaaattcattggacacctaaaaacttattagatgccactcaacaatttctccaacatcttaacatccctgaag

SEQ ID NO: 312335 - DNA, 75 bp, Artificial Sequence
  Synthetic
ataaactaggactaaaggaaaaagacaagattaagcccaacaacaattcaggtgatgaaaactcagtacttacaa

SEQ ID NO: 312336 - DNA, 75 bp, Artificial Sequence
  Synthetic
ccacatggggcaaataatcatcggaggaaatccaaccaatcacaatatctgtcaacatagaccagtcaacacgcc

SEQ ID NO: 312337 - DNA, 75 bp, Artificial Sequence
  Synthetic
agtacgttgagaggtgctttcatttatagaatcataaaagggtttgtaaatacctacaacagatggcccacttta

SEQ ID NO: 312338 - DNA, 75 bp, Artificial Sequence
  Synthetic
catccataacaatagaattctcaagcaaattctggccttactttacactaatacatatgatcacaacaataatct

SEQ ID NO: 312339 - DNA, 75 bp, Artificial Sequence
  Synthetic
gattgcaatactaaacaaactctgtgaatataacgtattccataacaaaacctttgagctaccaagagctcgagt

SEQ ID NO: 312340 - DNA, 75 bp, Artificial Sequence
  Synthetic
ctatccaagcccatcacaagtctatactacatccggtcaagaggaaaccctccactcaaccaccttcgaaggcta

SEQ ID NO: 312341 - DNA, 75 bp, Artificial Sequence
  Synthetic
caacaacgttggggcaaatgcaaacatgtccaaaaccaaggaccaacgcaccgccaagacactagaaaagacctg

SEQ ID NO: 312342 - DNA, 75 bp, Artificial Sequence
  Synthetic
ttcttcaatctgtctggaactatatcacaaaccaccgccatactagctccaacaacaccaagtgtcgagccaatc

SEQ ID NO: 312343 - DNA, 75 bp, Artificial Sequence
  Synthetic
tgcagcaacaatccaacttgctgggccatctgcaaaagaataccaagcaaaaaacctggaaagaaaaccaccacc

SEQ ID NO: 312344 - DNA, 75 bp, Artificial Sequence
  Synthetic
tccagactgtgggatgataatactgtgtatagctgcacttgtaataaccaaattagcagcaggagatagatcagg

SEQ ID NO: 312345 - DNA, 75 bp, Artificial Sequence
  Synthetic
caaccatcaacatcaccaaaccaaacatcagaactacactgctcaccaacagtaccacaggaaatctagaacaca

SEQ ID NO: 312346 - DNA, 75 bp, Artificial Sequence
  Synthetic
tatgatgtacagaaacacatcaataagctatgtggcatgttattaatcacagaagatgctaatcataaattcact

SEQ ID NO: 312347 - DNA, 75 bp, Artificial Sequence
  Synthetic
ttaaaaagcgtattattgcaaaaaaccatgaccaaatcaaacagaatcaaaataagctctggggcaaataacaat

SEQ ID NO: 312348 - DNA, 75 bp, Artificial Sequence
  Synthetic
aatattaacttatatagatcttgttagaatgggattgataaatatagatagaatatacattaaaaataaacacaa

SEQ ID NO: 312349 - DNA, 75 bp, Artificial Sequence
  Synthetic
cccggaaaaaatcgatactatagttacaaaaaaagatggggcaaatatggaaacatacgtgaacaaacttcacga

SEQ ID NO: 312350 - DNA, 75 bp, Artificial Sequence
  Synthetic
tgtgcatgttattacaagtagtgatatttgccctaataataatattgtagtgaaatccaatttcacaacaatgcc

SEQ ID NO: 312351 - DNA, 75 bp, Artificial Sequence
  Synthetic
ctagaaggggaagtgaacaaaatcaaaagtgctctactatccacaaacaaggctgtagtcagcttatcaaatgga

SEQ ID NO: 312352 - DNA, 75 bp, Artificial Sequence
  Synthetic
ggctgtagtcagcttatcaaatggagttagtgtcttaaccagcaaagtgttagacctcaaaaactatatagataa

SEQ ID NO: 312353 - DNA, 75 bp, Artificial Sequence
  Synthetic
caacaacatcaataaaacagacatcaatccattgaatcaactgccagaccgaacaaacaaatgtccatcagcaga

SEQ ID NO: 312354 - DNA, 75 bp, Artificial Sequence
  Synthetic
aatccattgaatcaactgccagaccgaacaaacaaatgtccatcagcagaaccatcaaccaatcaatcaaccaat

SEQ ID NO: 312355 - DNA, 75 bp, Artificial Sequence
  Synthetic
aaaatccacatggggcaaataatcattgagggaaatctaactaatcacaacatctgtcaacatagacaagtcaac

SEQ ID NO: 312356 - DNA, 75 bp, Artificial Sequence
  Synthetic
taataaaaattcccatagctacacactaacactgtattcaattatagttatttaaaattaataattatataattt

SEQ ID NO: 312357 - DNA, 75 bp, Artificial Sequence
  Synthetic
gcaaaattatgacttcaaaaacagatgtaagcagctccgttatcacatctctaggagccattgtgtcatgctatg

SEQ ID NO: 312358 - DNA, 75 bp, Artificial Sequence
  Synthetic
aaataagaatttgataagtaccacttaaatttaactcctttggttagagatgggcagcaattcattgagtatgat

SEQ ID NO: 312359 - DNA, 75 bp, Artificial Sequence
  Synthetic
tgtaagcagctccgttatcacatctctaggagccattgtgtcatgctatggcaaaactaaatgtacagcatccaa

SEQ ID NO: 312360 - DNA, 75 bp, Artificial Sequence
  Synthetic
ctaaattttgtataagtggaaataccgaatctatgatgatgtcaacattcactaataaaatgcatattaaatctt

SEQ ID NO: 312361 - DNA, 75 bp, Artificial Sequence
  Synthetic
aggacagatgtatcaaatcaacacatagtgttctaccattatgctgtgtcaaattataatcctgtatatataaac

SEQ ID NO: 312362 - DNA, 75 bp, Artificial Sequence
  Synthetic
gaaataacaacttcatgcataactacactccatagtccaaatggagcctgaaaattatagtaatttaaaattaag

SEQ ID NO: 312363 - DNA, 75 bp, Artificial Sequence
  Synthetic
ctaggtagcaagttaaaaggatctgaagtttacttagtccttacaataggccctgcaaatatacttcctgttttt

SEQ ID NO: 312364 - DNA, 75 bp, Artificial Sequence
  Synthetic
catactaataacaagtagttgtagagttactatgtataatcaaaagaacacactatatttcaatcaaaacaacca

SEQ ID NO: 312365 - DNA, 75 bp, Artificial Sequence
  Synthetic
tcacctttttacaaaatcacatcaacatctcaccatgcaagccatcatccatactataaagtagttaattaaaaa

SEQ ID NO: 312366 - DNA, 75 bp, Artificial Sequence
  Synthetic
aaatccaccaaaaaaaccaaaagatgattaccattttgaagtgttcaattttgttccctgtagtatatgtggcaa

SEQ ID NO: 312367 - DNA, 75 bp, Artificial Sequence
  Synthetic
taattcatacaaactttctacctacattcttcacttcaccatcacaatcacaaacactctgtggttcaaccaatc

SEQ ID NO: 312368 - DNA, 75 bp, Artificial Sequence
  Synthetic
aaaatgagaactggggcaaatatgtcacgaaggaatccttgcaaatttgaaattcgaggtcattgcttgaatggt

SEQ ID NO: 312369 - DNA, 75 bp, Artificial Sequence
  Synthetic
caataatttagcatattgattccaaaattatcattttatttttaaggggttgaataaaagtctaaaactaacaat

SEQ ID NO: 312370 - DNA, 75 bp, Artificial Sequence
  Synthetic
cacaccacaaagactgatgatcacagacatgagaccattgtcacttgagactataataacatctctaaccagaga

SEQ ID NO: 312371 - DNA, 75 bp, Artificial Sequence
  Synthetic
aaaattatcattttatttttaaggggttgaataaaagtctaaaactaacaattatacatgtgtatttacaacaca

SEQ ID NO: 312372 - DNA, 75 bp, Artificial Sequence
  Synthetic
cccagtcacatgcttagttattcaaaaactacatcttaacagagaaccgtaatctatcaagcaagaataaaatta

SEQ ID NO: 312373 - DNA, 75 bp, Artificial Sequence
  Synthetic
agccaaccagccaaaaaacaaccagccaatctaaaactagccacccggaaaaaatcgatactatagttacaaaaa

SEQ ID NO: 312374 - DNA, 75 bp, Artificial Sequence
  Synthetic
aaatccaacaatgaacaagatgaaaacaactcagttattacaaccataatcaaagatgatatacttttagctgtt

SEQ ID NO: 312375 - DNA, 75 bp, Artificial Sequence
  Synthetic
gatctcaaacctcaaactacaaaaccaaaggaagcacccaccaccaagcccacagaaaagccaaccaccaacatc

SEQ ID NO: 312376 - DNA, 75 bp, Artificial Sequence
  Synthetic
gttcatcagatccagtactcaaataagttaataaaaaatccacatggggcaaataatcattgagggaaatccaac

SEQ ID NO: 312377 - DNA, 75 bp, Artificial Sequence
  Synthetic
ccaaagccaactacccaagaaaacccctagtaagcttcaaagaagatctcaccccaagtgacaaccctttttcta

SEQ ID NO: 312378 - DNA, 75 bp, Artificial Sequence
  Synthetic
ggaacttacagaaagagatttgattgttttatcaggactacgtttctatcgtgagtttcggttgcctaaaaaagt

SEQ ID NO: 312379 - DNA, 75 bp, Artificial Sequence
  Synthetic
aattggaagcacacagctacacgatttgcaatcaaacccatggaagattaacctttttcctccacatcagtgagt

SEQ ID NO: 312380 - DNA, 75 bp, Artificial Sequence
  Synthetic
aatccaacttccaaaaaattgagtgacttgttggaagacaacgatagtgacaatgatctatcacttgatgatttt

SEQ ID NO: 312381 - DNA, 75 bp, Artificial Sequence
  Synthetic
atttgtagtgatgtactggatgaactgcatggtgtacaatctctattttcctggttacatttaactattcctcat

SEQ ID NO: 312382 - DNA, 75 bp, Artificial Sequence
  Synthetic
atgcacccccctatataagagatcacattgtagatcttaacaatgtagatgaacaaagtggattatatagatatc

SEQ ID NO: 312383 - DNA, 75 bp, Artificial Sequence
  Synthetic
tcaaaaactatggaccatagaagctatatcactattggatctaatatctctcaaagggaaattctcaattactgc

SEQ ID NO: 312384 - DNA, 75 bp, Artificial Sequence
  Synthetic
tcaatatctcaagtcaatgagaagattaaccagagtctagcatttattcgtaaatccgatgaattattacataat

SEQ ID NO: 312385 - DNA, 75 bp, Artificial Sequence
  Synthetic
ccatactagcttcaacaacaccaagtgctgagtcaaccccacaatccacaacagtcaagatcaaaaacacaacaa

SEQ ID NO: 312386 - DNA, 75 bp, Artificial Sequence
  Synthetic
tcataacaatgaactaagatattaagactaacaacaacgttggggcaaatgcaaacatgtccaaaaccaaggacc

SEQ ID NO: 312387 - DNA, 75 bp, Artificial Sequence
  Synthetic
aatccagaacacacaagtcaagaggaaaccctccactcaaccacctccgaaggcaatccaagcccatcacaagtc

SEQ ID NO: 312388 - DNA, 75 bp, Artificial Sequence
  Synthetic
cctgacccagaatccccagcttggaatcagcttcttcaatctgtctggaactatatcacaaaccaccgccatact

SEQ ID NO: 312389 - DNA, 75 bp, Artificial Sequence
  Synthetic
aaacacaagtcaagaggaaaccctccactctaccacctccgaaagcaatctaagcccttcacaagtctatacaac

SEQ ID NO: 312390 - DNA, 75 bp, Artificial Sequence
  Synthetic
acctaacacaaagtcagaaacacaccatacaacagcacaacccaagagcagaaccaccacctcaacacagaccaa

SEQ ID NO: 312391 - DNA, 75 bp, Artificial Sequence
  Synthetic
taaaaaacttgacggaagataaaaatggggcaaataaatccactcagcctacccaaccatggacacgacacacaa

SEQ ID NO: 312392 - DNA, 75 bp, Artificial Sequence
  Synthetic
gaaagttttcttcaatgcttataagacctatctcttgtgttttcataaaggttacggcagagcaaagctggagtg

SEQ ID NO: 312393 - DNA, 75 bp, Artificial Sequence
  Synthetic
gtatatgtggcaacaatcaactctgcaaatccatctgcaaaacaataccaagcaataaaccaaagaaaaaaccaa

SEQ ID NO: 312394 - DNA, 75 bp, Artificial Sequence
  Synthetic
caactgtgctcgacacaaccacaacaaaacacacagaaagagacaccagcacctcacaatccattgcgctcaaca

SEQ ID NO: 312395 - DNA, 75 bp, Artificial Sequence
  Synthetic
caactgtgctcgacacaaccacatcaaaacacacagaaagagacaccagcacctcacaatccattgcgctcaaca

SEQ ID NO: 312396 - DNA, 75 bp, Artificial Sequence
  Synthetic
caactgtgctcgacacaaccacaccaaaacacacagaaagagacaccagcacctcacaatccattgcgctcaaca

SEQ ID NO: 312397 - DNA, 75 bp, Artificial Sequence
  Synthetic
caactgtgctcgacacaaccacagcaaaacacacagaaagagacaccagcacctcacaatccattgcgctcaaca

SEQ ID NO: 312398 - DNA, 75 bp, Artificial Sequence
  Synthetic
ctactgtgctcgacacaaccacaacaaaacacacagaaagagacaccagcacctcacaatccattgcgctcaaca

SEQ ID NO: 312399 - DNA, 75 bp, Artificial Sequence
  Synthetic
ctactgtgctcgacacaaccacatcaaaacacacagaaagagacaccagcacctcacaatccattgcgctcaaca

SEQ ID NO: 312400 - DNA, 75 bp, Artificial Sequence
  Synthetic
ctactgtgctcgacacaaccacaccaaaacacacagaaagagacaccagcacctcacaatccattgcgctcaaca

SEQ ID NO: 312401 - DNA, 75 bp, Artificial Sequence
  Synthetic
ctactgtgctcgacacaaccacagcaaaacacacagaaagagacaccagcacctcacaatccattgcgctcaaca

SEQ ID NO: 312402 - DNA, 75 bp, Artificial Sequence
  Synthetic
ccactgtgctcgacacaaccacaacaaaacacacagaaagagacaccagcacctcacaatccattgcgctcaaca

SEQ ID NO: 312403 - DNA, 75 bp, Artificial Sequence
  Synthetic
ccactgtgctcgacacaaccacatcaaaacacacagaaagagacaccagcacctcacaatccattgcgctcaaca

SEQ ID NO: 312404 - DNA, 75 bp, Artificial Sequence
  Synthetic
ccactgtgctcgacacaaccacaccaaaacacacagaaagagacaccagcacctcacaatccattgcgctcaaca

SEQ ID NO: 312405 - DNA, 75 bp, Artificial Sequence
  Synthetic
ccactgtgctcgacacaaccacagcaaaacacacagaaagagacaccagcacctcacaatccattgcgctcaaca

SEQ ID NO: 312406 - DNA, 75 bp, Artificial Sequence
  Synthetic
cgactgtgctcgacacaaccacaacaaaacacacagaaagagacaccagcacctcacaatccattgcgctcaaca

SEQ ID NO: 312407 - DNA, 75 bp, Artificial Sequence
  Synthetic
cgactgtgctcgacacaaccacatcaaaacacacagaaagagacaccagcacctcacaatccattgcgctcaaca

SEQ ID NO: 312408 - DNA, 75 bp, Artificial Sequence
  Synthetic
cgactgtgctcgacacaaccacaccaaaacacacagaaagagacaccagcacctcacaatccattgcgctcaaca

SEQ ID NO: 312409 - DNA, 75 bp, Artificial Sequence
  Synthetic
cgactgtgctcgacacaaccacagcaaaacacacagaaagagacaccagcacctcacaatccattgcgctcaaca

SEQ ID NO: 312410 - DNA, 75 bp, Artificial Sequence
  Synthetic
tagaaaataattacaacaaattatatcatcctacacctgaaactctagaaaatatactaaccaatccggttaaat

SEQ ID NO: 312411 - DNA, 75 bp, Artificial Sequence
  Synthetic
gtggaacttcatcctgatataagatatatttacagaagtctgaaagattgcaatgatcatagtttacctattgag

SEQ ID NO: 312412 - DNA, 75 bp, Artificial Sequence
  Synthetic
taatttagcatattgattccaaaattaccattttggtcttaagggattgaataaaaatctaaacctaacaattac

SEQ ID NO: 312413 - DNA, 75 bp, Artificial Sequence
  Synthetic
gcatatgctgaacaactcaaagaaaatggtgtgattaactacagtgtattagacttgacagcagaagaactagag

SEQ ID NO: 312414 - DNA, 75 bp, Artificial Sequence
  Synthetic
cttagtccttacaataggtcctgcaaatgtgttcccagtatttaatgtagtacaaaatgctaaattgatactatc

SEQ ID NO: 312415 - DNA, 75 bp, Artificial Sequence
  Synthetic
tcacatcatgctacccacacaactaagctagatccttaactcatagttacataaaaacctcaagtatcacaatca

SEQ ID NO: 312416 - DNA, 75 bp, Artificial Sequence
  Synthetic
aaaattaaaaattatataatttttaataacttttagtggactaatcctaaaattatcattttgatctaggaggaa

SEQ ID NO: 312417 - DNA, 75 bp, Artificial Sequence
  Synthetic
ataacttttagtggactaatcctaaaattatcattttgatctaggaggaataaatttaaatccaaatctaattgg

SEQ ID NO: 312418 - DNA, 75 bp, Artificial Sequence
  Synthetic
aaaattaataattatataatttttaattttttaataacttctagtgaactaatcctaaaattatcattttgatct

SEQ ID NO: 312419 - DNA, 75 bp, Artificial Sequence
  Synthetic
aggaagaataagtttaaatccaaatctaattggtttatatgtatattaactaaactacgagatattagtttttga

SEQ ID NO: 312420 - DNA, 75 bp, Artificial Sequence
  Synthetic
aattaaattaaacggcatagtttttatacatgttataacaagcagtgaagtgtgccctgataacaatattgtagt

SEQ ID NO: 312421 - DNA, 75 bp, Artificial Sequence
  Synthetic
gataattgtgaaatcaaattttctaaaagactaagtgactcagtaatgactgattatatgaatcaaatatctgat

SEQ ID NO: 312422 - DNA, 75 bp, Artificial Sequence
  Synthetic
tgattatatgaatcaaatatctgatttacttgggcttgatctccattcatgaattatgtttagtctaattcaata

SEQ ID NO: 312423 - DNA, 75 bp, Artificial Sequence
  Synthetic
gacatgtgtttattaccattttagttaatataaaacctcatcaaagggaaatggggcaaataaactcacccaatc

SEQ ID NO: 312424 - DNA, 75 bp, Artificial Sequence
  Synthetic
atggggcaaataaactcacccaatcaatcaaaccatgagcactacaaacgacaacaccaccatgcaaagattgat

SEQ ID NO: 312425 - DNA, 75 bp, Artificial Sequence
  Synthetic
atggattcaataataacatctctcaccaaagaaatcatcacacacaaattcatatacttgataaacaatgaatgt

SEQ ID NO: 312426 - DNA, 75 bp, Artificial Sequence
  Synthetic
ccaaagaaatcatcacacacaaattcatatacttgataaacaatgaatgtattgtaagaaaacttgatgaaagac

SEQ ID NO: 312427 - DNA, 75 bp, Artificial Sequence
  Synthetic
ccatacattagtagttgcaagtgcaggacccacttcggctcgtgatggaataagagatgctatggttggtctaag

SEQ ID NO: 312428 - DNA, 75 bp, Artificial Sequence
  Synthetic
cgtagtacaggagataatattgacactcccaattatgatgtgcaaaaacacctaaacaaactatgtggtatgcta

SEQ ID NO: 312429 - DNA, 75 bp, Artificial Sequence
  Synthetic
ctcccaattatgatgtgcaaaaacacctaaacaaactatgtggtatgctattaatcactgaagatgcaaatcata

SEQ ID NO: 312430 - DNA, 75 bp, Artificial Sequence
  Synthetic
atatgctatgtccaggttaggaagggaagacactataaagatacttaaagatgctggatatcatgttaaagctaa

SEQ ID NO: 312431 - DNA, 75 bp, Artificial Sequence
  Synthetic
tggagtagatataacaacataccgtcaagatataaatggaaaggaaatgaaattcgaagtattaacattatcaag

SEQ ID NO: 312432 - DNA, 75 bp, Artificial Sequence
  Synthetic
cttgacatcagaaatacaagtcaatattgagatagaatctagaaagtcctacaaaaaaatgctaaaagagatggg

SEQ ID NO: 312433 - DNA, 75 bp, Artificial Sequence
  Synthetic
ataatattgcatttagtaactgaataaaaatagcacctaatcatattcttacaatggttcactatttgaccatag

SEQ ID NO: 312434 - DNA, 75 bp, Artificial Sequence
  Synthetic
aaccaaattagcagcaggagatagatcaggtcttacagcagtaattaggagggcaaacaatgtcttaaaaaacga

SEQ ID NO: 312435 - DNA, 75 bp, Artificial Sequence
  Synthetic
atgaagtgtttgaaaaacaccctcatcttatagatgtttttgtgcactttggcattgcacaatcatccacaagag

SEQ ID NO: 312436 - DNA, 75 bp, Artificial Sequence
  Synthetic
catatattgaacaatccaaaagcatcattgctgtcattaactcaatttcctaacttctcaagtgtggtcctaggc

SEQ ID NO: 312437 - DNA, 75 bp, Artificial Sequence
  Synthetic
cattgctgtcattaactcaatttcctaacttctcaagtgtggtcctaggcaatgcagcaggtctaggcataatgg

SEQ ID NO: 312438 - DNA, 75 bp, Artificial Sequence
  Synthetic
tcaacatggagaagtttgcacctgaatttcatggagaagatgcaaataacaaagctaccaaattcctagaatcaa

SEQ ID NO: 312439 - DNA, 75 bp, Artificial Sequence
  Synthetic
ctgcaaggccagaagcacaccagtcacagtcatagatgattacctgagtggtataaataatatttcatttattta

SEQ ID NO: 312440 - DNA, 75 bp, Artificial Sequence
  Synthetic
aagtcactaaagagagcccgataacatctggcaccaacattatcaatccaacaagtgaagtcgacagtaccccag

SEQ ID NO: 312441 - DNA, 75 bp, Artificial Sequence
  Synthetic
gttcttacaatagtttactatctgactatagataacccatccatcattggattttctcaaaatttgaacttcatg

SEQ ID NO: 312442 - DNA, 75 bp, Artificial Sequence
  Synthetic
taactttcatctataaacattatcattatcatttttaaagtagagtcctattttatagttatataaaacaattga

SEQ ID NO: 312443 - DNA, 75 bp, Artificial Sequence
  Synthetic
aagttacatattcaatggtccttatctcaaaaatgattataccaacttaattagtagacaaaatccattaataga

SEQ ID NO: 312444 - DNA, 75 bp, Artificial Sequence
  Synthetic
atgatcaaacaaatgacaacattacagcaagactagatagaattgatgaaaaattaagtgaaatattaggaatgc

SEQ ID NO: 312445 - DNA, 75 bp, Artificial Sequence
  Synthetic
tctagctactcatatgaggagatcaatgatcaaacaaatgacaacattacagcaagactagatagaattgatgaa

SEQ ID NO: 312446 - DNA, 75 bp, Artificial Sequence
  Synthetic
tccatacattagtagttgcaagtgcaggacctacttcggctcgtgatggaataagagatgctatggttggtctaa

SEQ ID NO: 312447 - DNA, 75 bp, Artificial Sequence
  Synthetic
aaaagacacttcagatgaagtgtctctcaatccaacctccaaaaaattgagtgacttgttggaagacaacgatag

SEQ ID NO: 312448 - DNA, 75 bp, Artificial Sequence
  Synthetic
acaatatttaagtgttaactatttgcatcgccttacagtcagtagtagaccatgtgaattccctgcatcaatacc

SEQ ID NO: 312449 - DNA, 75 bp, Artificial Sequence
  Synthetic
ttttgatcagtgatcaactcactcagcaatcaacaacatcaataaaacagacaccaatccattgaatcaactgcc

SEQ ID NO: 312450 - DNA, 75 bp, Artificial Sequence
  Synthetic
gtgtttgaaaaatatcctcactttatagatgtttttgttcattttggtatagcacaatcttctaccagaggtggc

SEQ ID NO: 312451 - DNA, 75 bp, Artificial Sequence
  Synthetic
gcagaaccaccaaccaatcaatcaaccaattgatcaatcagcgccctgacaaaattaacaatatagtaacaaaaa

SEQ ID NO: 312452 - DNA, 75 bp, Artificial Sequence
  Synthetic
agtacaatgttctagaaaaagatgatgatcccgcatcactaacaatatgggtgcctatgttccagtcatctgtgc

SEQ ID NO: 312453 - DNA, 75 bp, Artificial Sequence
  Synthetic
agtaatttcatcataagtgcaaatgtatcattagatgaaagaagcaaattagcatatgatgtaactacaccttgt

SEQ ID NO: 312454 - DNA, 75 bp, Artificial Sequence
  Synthetic
tatcattagatgaaagaagcaaattagcatatgatgtaactacaccttgtgaaatcaaagcatgcagtctaacat

SEQ ID NO: 312455 - DNA, 75 bp, Artificial Sequence
  Synthetic
agcatatgatgtaactacaccttgtgaaatcaaagcatgcagtctaacatgcttaaaagtaaaaagtatgttaac

SEQ ID NO: 312456 - DNA, 75 bp, Artificial Sequence
  Synthetic
tctctaattttaaatataacagaagaagatcaattcagaaaacggttttataatagtatgctcaacaacatcaca

SEQ ID NO: 312457 - DNA, 75 bp, Artificial Sequence
  Synthetic
acattcaaccccactcatgagatcattgctctatgtgaatttgaaaatattatgacatcaaaaagagtaataata

SEQ ID NO: 312458 - DNA, 75 bp, Artificial Sequence
  Synthetic
taaaattttccgagagtgataaatcaagaagagtattagagtattatttaagagataacaaattcaatgaatgtg

SEQ ID NO: 312459 - DNA, 75 bp, Artificial Sequence
  Synthetic
tcacaatagaattcacaagcaaattttggccctattttacactaatacatatgatcttaactctaatctctttac

SEQ ID NO: 312460 - DNA, 75 bp, Artificial Sequence
  Synthetic
ttggccctattttacactaatacatatgatcttaactctaatctctttactaattataatcactattatgattgc

SEQ ID NO: 312461 - DNA, 75 bp, Artificial Sequence
  Synthetic
gaattattagtatgggatcaaaaacaacattggggcaaatgcaaccatgtccaaaaacaagaatcaacgcactgc

SEQ ID NO: 312462 - DNA, 75 bp, Artificial Sequence
  Synthetic
ccaaaaacaagaatcaacgcactgccaggactctagaaaagacctgggatactcttaatcatctaattgtaatat

SEQ ID NO: 312463 - DNA, 75 bp, Artificial Sequence
  Synthetic
tcagttttggcaatgataatctcaacctctctcataattgcagccataatattcatcatctctgccaatcacaaa

SEQ ID NO: 312464 - DNA, 75 bp, Artificial Sequence
  Synthetic
tggacaagatgaagacaactcagttattactaccataatcaaagatgatatacttttagctgtcaaggataatca

SEQ ID NO: 312465 - DNA, 75 bp, Artificial Sequence
  Synthetic
gtctcaccagaaagggttagcccatccaaacaacccacaaccacaccaccaatccacacaaattcagccacaata

SEQ ID NO: 312466 - DNA, 75 bp, Artificial Sequence
  Synthetic
caagaccacagaaagagacaccagcaccccacaatccactgtgctcgacacaaccacatcaaaacacacagaaag

SEQ ID NO: 312467 - DNA, 75 bp, Artificial Sequence
  Synthetic
agtgcaatcttcctaactcttgctattaatgcattgtacctcacctcaagtcagaatataactgaggagttttac

SEQ ID NO: 312468 - DNA, 75 bp, Artificial Sequence
  Synthetic
gtcataacaatgaactaggatattaagaccaaaaacaacgttggggcaaatgcaaacatgtccaaaaccaaggac

SEQ ID NO: 312469 - DNA, 75 bp, Artificial Sequence
  Synthetic
ccaaatgcaatggaactgacactaaagtaaaacttataaaacaagaattagataagtataagaatgcagtaacag

SEQ ID NO: 312470 - DNA, 75 bp, Artificial Sequence
  Synthetic
aaatgtatcaataagcaagaagaggaaacgaagatttctgggcttcttgttaggtgtaggatctgcaatagcaag

SEQ ID NO: 312471 - DNA, 75 bp, Artificial Sequence
  Synthetic
caaagctgtagtcagtctatcaaatggggtcagtgttttaaccagcaaagtgttagatctcaagaattatataaa

SEQ ID NO: 312472 - DNA, 75 bp, Artificial Sequence
  Synthetic
ggggtcagtgttttaaccagcaaagtgttagatctcaagaattatataaacaaccaattattacctatagtaaat

SEQ ID NO: 312473 - DNA, 75 bp, Artificial Sequence
  Synthetic
aatcacgtttgacaaaaaccctaatgctgaattcgttacattgatgagagatcctcaagctttaggatctgagag

SEQ ID NO: 312474 - DNA, 75 bp, Artificial Sequence
  Synthetic
tgttcttacaatggttcactatctgaccatagataacccatctatcattggattttcttaaaatttgaacttcat

SEQ ID NO: 312475 - DNA, 75 bp, Artificial Sequence
  Synthetic
actgtgataatgcaggatcagtatccttctttccacaggctgacacttgtaaagtacagtccaatcgagtatttt

SEQ ID NO: 312476 - DNA, 75 bp, Artificial Sequence
  Synthetic
ctttcaagaactaaaaatttcattatgcctaaaaaaactgacaaggaatctatcgatgcaaatattaaaagctta

SEQ ID NO: 312477 - DNA, 75 bp, Artificial Sequence
  Synthetic
gtgacactatgaacagtttgacattaccaagtgaagtcagcctttgtaacactgacatattcaattccaagtatg

SEQ ID NO: 312478 - DNA, 75 bp, Artificial Sequence
  Synthetic
accaagtgaagtcagcctttgtaacactgacatattcaattccaagtatgactgcaaaattatgacatcaaaaac

SEQ ID NO: 312479 - DNA, 75 bp, Artificial Sequence
  Synthetic
agacataagcagctcagtaattacttctctaggagctatagtgtcatgctatggtaaaactaaatgcactgcatc

SEQ ID NO: 312480 - DNA, 75 bp, Artificial Sequence
  Synthetic
acattttctaatggttgtgattatgtgtcaaacaaaggagtagatactgtatcagtgggcaacactttatactat

SEQ ID NO: 312481 - DNA, 75 bp, Artificial Sequence
  Synthetic
ctacattcttcacttcacaatcataatcaccaactctgtggttcaaccaatcaaacaaaacttatctgatgtctc

SEQ ID NO: 312482 - DNA, 75 bp, Artificial Sequence
  Synthetic
aaaagaatcaactgttagtgatacaaacgaccatgccaaaaataatgatactacctgacaaatatccttgtagta

SEQ ID NO: 312483 - DNA, 75 bp, Artificial Sequence
  Synthetic
tagctattggtttactgttgtattgcaaagccaaaaacacaccagttacactaagcaaagaccaactaagtggaa

SEQ ID NO: 312484 - DNA, 75 bp, Artificial Sequence
  Synthetic
aaaggatgtcatagcttcaaactgtggtttcttaaacgtcttaatgtagcagaattcacagtttgcccttgggtt

SEQ ID NO: 312485 - DNA, 75 bp, Artificial Sequence
  Synthetic
caatctgatgactcaaaacagtaaccttgcatttgtaagtgaataaccctcacctctttacaaaaccacatcaac

SEQ ID NO: 312486 - DNA, 75 bp, Artificial Sequence
  Synthetic
agttacataaaaacctcaaatatcgcaatcaacactaaatcaacacatcattcacaaaactaacagctggggcaa

SEQ ID NO: 312487 - DNA, 75 bp, Artificial Sequence
  Synthetic
aatggtagaagatgccactacagtcataattactttgaatggcctcctcatgcattactagtgaggcaaaacttc

SEQ ID NO: 312488 - DNA, 75 bp, Artificial Sequence
  Synthetic
gatagaacagaagaatatgctcttggtatagttggagtgctagagagttacataggatctataaacaacataaca

SEQ ID NO: 312489 - DNA, 75 bp, Artificial Sequence
  Synthetic
ccacaaagactgatgatcacagacatgagaccattatcacttgagactataataacatctctaaccagagatatc

SEQ ID NO: 312490 - DNA, 75 bp, Artificial Sequence
  Synthetic
aatgaagaacccaattcacctaagataagagtgtacaatactgttatatcatacatcgagagcaatagaaaaaac

SEQ ID NO: 312491 - DNA, 75 bp, Artificial Sequence
  Synthetic
atccacaaaagcataaccataagcaacccaaaagagtcaaccgtaagtgatcaaaatgaccaaaccaaaaataat

SEQ ID NO: 312492 - DNA, 75 bp, Artificial Sequence
  Synthetic
tcaaaatgaccaaaccaaaaataatgatattaccggataaatatccttgtagtatatcatccatattgatctcaa

SEQ ID NO: 312493 - DNA, 75 bp, Artificial Sequence
  Synthetic
gatattaccggataaatatccttgtagtatatcatccatattgatctcaagtgaaagcatgattgctacattcaa

SEQ ID NO: 312494 - DNA, 75 bp, Artificial Sequence
  Synthetic
caaagtgttagacctcaaaaactatatagataaacagttgttacctattgtgaacaagcaaagctgcagcatatc

SEQ ID NO: 312495 - DNA, 75 bp, Artificial Sequence
  Synthetic
aactgaaattagaagaaccaacttatttccagtcattacttatgacatataaaagcatgtcctcgtctgaacaaa

SEQ ID NO: 312496 - DNA, 75 bp, Artificial Sequence
  Synthetic
aataatacgaagagctatagaaataagtgatgtaaaggtgtacgccatcttgaataaactaggactaaaggaaaa

SEQ ID NO: 312497 - DNA, 75 bp, Artificial Sequence
  Synthetic
aacaacactcttaaaaaaattgatgtgttcaatgcaacatcctccatcatggttaatacactggttcaatttata

SEQ ID NO: 312498 - DNA, 75 bp, Artificial Sequence
  Synthetic
tgttcaatgcaacatcctccatcatggttaatacactggttcaatttatatacaaaattaaataacatattaaca

SEQ ID NO: 312499 - DNA, 75 bp, Artificial Sequence
  Synthetic
tggtataaataatattgcatttagtaactgaataaaaatagcacctaatcatgttcttacaatggttcactatct

SEQ ID NO: 312500 - DNA, 75 bp, Artificial Sequence
  Synthetic
ttgacatggaaagacatcagccttagcagattaaatgtttgcttaattacttggataagtaattgtttaaataca

SEQ ID NO: 312501 - DNA, 75 bp, Artificial Sequence
  Synthetic
cacaatccgaaataacaacttcatgcataaccacactctatagtccaaatggagcctaaaaattatagtaattta

SEQ ID NO: 312502 - DNA, 75 bp, Artificial Sequence
  Synthetic
ttggataagtaattgtttaaatacattaaataaaagcttagggttgagatgcggattcaataatgttgtgttatc

SEQ ID NO: 312503 - DNA, 75 bp, Artificial Sequence
  Synthetic
taaatccaaatctaattggtttatatgtatattaactaaactacgagatattagtttttgacactttttttctcg

SEQ ID NO: 312504 - DNA, 75 bp, Artificial Sequence
  Synthetic
aggatttattatgtctttaattctaaacataacagaagaagatcaatttaggaaacgattttataatagcatgct

SEQ ID NO: 312505 - DNA, 75 bp, Artificial Sequence
  Synthetic
aacataacagaagaagatcaatttaggaaacgattttataatagcatgctaaataacatcacagatgcagctatt

SEQ ID NO: 312506 - DNA, 75 bp, Artificial Sequence
  Synthetic
catcgttacattattaaatcaaacaattcaagttgtgggacaaaatggatcccattattaatggaaattctgcta

SEQ ID NO: 312507 - DNA, 75 bp, Artificial Sequence
  Synthetic
aatttcttaaattgattaagcttgcaggtgataataatctcaataacttgagtgagctatattttctcttcagaa

SEQ ID NO: 312508 - DNA, 75 bp, Artificial Sequence
  Synthetic
ggcaaattcacatcacctaaagatcccaagaaaaaagatagtatcatatctgtcaactcaatagatatagaagta

SEQ ID NO: 312509 - DNA, 75 bp, Artificial Sequence
  Synthetic
ataaattcactggggtaataggtatgttatatgctatgtctagattaggaagagaagacaccataaaaatactca

SEQ ID NO: 312510 - DNA, 75 bp, Artificial Sequence
  Synthetic
aactattataaacttaatacttatccatctctacttgaaatcacagaaaatgatttgattattttatcaggattg

SEQ ID NO: 312511 - DNA, 75 bp, Artificial Sequence
  Synthetic
acagtatcgatcaaatgaggtaaaaaaccatgggtttacattgatagataatcaaactcttagtggatttcaatt

SEQ ID NO: 312512 - DNA, 75 bp, Artificial Sequence
  Synthetic
ccaaaagatctaatatggactagttttcctagaaattacatgccatcacatatacaaaattatatagaacatgaa

SEQ ID NO: 312513 - DNA, 75 bp, Artificial Sequence
  Synthetic
tcacttgaagatttctgattagctaccaaactgtacatcaaaacacaacaccaatagaaaaccaacaaacaaacc

SEQ ID NO: 312514 - DNA, 75 bp, Artificial Sequence
  Synthetic
aaaatgatagccgaaaatattttacaattcttccctgagagtttgacaagatatggtgatctagagcttcaaaag

SEQ ID NO: 312515 - DNA, 75 bp, Artificial Sequence
  Synthetic
tgttctataataacagatcttagcaaatttaatcaagcatttagatatgaaacatcatgtatctgcagtgatgta

SEQ ID NO: 312516 - DNA, 75 bp, Artificial Sequence
  Synthetic
tacaaatgagacagatgatactgcagggaacaagcccaattatcaaagaaaacctctagtgagtttcaaagaaga

SEQ ID NO: 312517 - DNA, 75 bp, Artificial Sequence
  Synthetic
tatatcccgagatatgcagttcatgagcaaaacaatccagcacaatggagtgtactatccagccagtatcaaaaa

SEQ ID NO: 312518 - DNA, 75 bp, Artificial Sequence
  Synthetic
tgtactatccagccagtatcaaaaaagtcctgagagtaggtccatggataaatacaatacttgatgattttaaag

SEQ ID NO: 312519 - DNA, 75 bp, Artificial Sequence
  Synthetic
aagtatatattatgttacaacaaattggaagcacacagctacacgatttgcaatcaaacccatggaagattaacc

SEQ ID NO: 312520 - DNA, 75 bp, Artificial Sequence
  Synthetic
aacacaggagttagaatacagaggagaaagcttattatgcagtttaatatttaggaacatttggttatacaatca

SEQ ID NO: 312521 - DNA, 75 bp, Artificial Sequence
  Synthetic
atatgaacttgcctatgctgtttggtggtggtgatcctaatttgttatatcgaagcttttataggagaactccag

SEQ ID NO: 312522 - DNA, 75 bp, Artificial Sequence
  Synthetic
cgaagcttttataggagaactccagacttccttacagaagctatagtacattcagtgttcgtgttgagctattat

SEQ ID NO: 312523 - DNA, 75 bp, Artificial Sequence
  Synthetic
tccaggatcttccagatgatagactgaacaaattcttgacttgtgtcatcacatttgataaaaatccaaatgccg

SEQ ID NO: 312524 - DNA, 75 bp, Artificial Sequence
  Synthetic
agtttgtaacattgatgagggatccacaggctttagggtctgaaaggcaagctaaaattactagtgagattaata

SEQ ID NO: 312525 - DNA, 75 bp, Artificial Sequence
  Synthetic
ccaccaagcccacgaaaaaaccaaccatcaagacaaccaaaaaagatctcaaacctaaaaccacaaaacccaagg

SEQ ID NO: 312526 - DNA, 75 bp, Artificial Sequence
  Synthetic
actagcttcaacaacaccaagtgtcgaatcaaccctgctatccacaacagtcaagaccaaaaacacaacaactac

SEQ ID NO: 312527 - DNA, 75 bp, Artificial Sequence
  Synthetic
gtttacctttttataaagcagaaaaaatagttaatcttatatcaggaacaaaatccataactaatatacttgaaa

SEQ ID NO: 312528 - DNA, 75 bp, Artificial Sequence
  Synthetic
aaatccataactaatatacttgaaaaaacatcagcgatagatacaactgatattaatagggctactgatatgatg

SEQ ID NO: 312529 - DNA, 75 bp, Artificial Sequence
  Synthetic
ggatacttccattagattgtaacaaagacaaaagagagttattaagtttagaaaatcttagcataactgaattaa

SEQ ID NO: 312530 - DNA, 75 bp, Artificial Sequence
  Synthetic
agacaaaagagagttattaagtttagaaaatcttagcataactgaattaagcaagtatgtaagagaaagatcttg

SEQ ID NO: 312531 - DNA, 75 bp, Artificial Sequence
  Synthetic
cctgctgggctatctgcaaaagaataccaaacaaaaaacctggaaagaaaaccaccaccaagcccacaaaaaaac

SEQ ID NO: 312532 - DNA, 75 bp, Artificial Sequence
  Synthetic
atcatacaagatgcaacgaaccagatcaagaacacaaccccaacatacctcacccagaatccccagcttggaatc

SEQ ID NO: 312533 - DNA, 75 bp, Artificial Sequence
  Synthetic
gtggtgaaagaggacctactaagccatgggtaggttcatctacgcaggagaaaaaaacaatgccagtgtacaata

SEQ ID NO: 312534 - DNA, 75 bp, Artificial Sequence
  Synthetic
gacaagttttaaccaaaaagcaaagagaccaaatagatttattagcaaaattagactgggtatatgcatccatag

SEQ ID NO: 312535 - DNA, 75 bp, Artificial Sequence
  Synthetic
aacaaatccaatcttctcacagagtcatggtatcacaaaaccatgccaaccattatggtagcatagagtagttat

SEQ ID NO: 312536 - DNA, 75 bp, Artificial Sequence
  Synthetic
taccagcttatagaacaacaaattatcattttgatactagtcctatcaatcatgtattaacagaaaagtatggag

SEQ ID NO: 312537 - DNA, 75 bp, Artificial Sequence
  Synthetic
caaacatatgtcctaatagaattattctcataccgaagctgaatgagatacatttgatgaaacctcctatattta

SEQ ID NO: 312538 - DNA, 75 bp, Artificial Sequence
  Synthetic
tcccacatcaactctaatctaatattagtacataaaatgtctgattattttcataatgcgtatattttaagtact

SEQ ID NO: 312539 - DNA, 75 bp, Artificial Sequence
  Synthetic
ggtaaaattaataaaacaagaattagataaatataaaaatgctgtaacagaattgcagttgctcatgcaaagcac

SEQ ID NO: 312540 - DNA, 75 bp, Artificial Sequence
  Synthetic
aattagaatgtgatatgaacacttcagatcttctttgtgttttggagttaatagacagtagctactggaaatcta

SEQ ID NO: 312541 - DNA, 75 bp, Artificial Sequence
  Synthetic
acatagattatcacccaacacacatgaaagctatattatcttacatagatttagttagaatggggttaataaatg

SEQ ID NO: 312542 - DNA, 75 bp, Artificial Sequence
  Synthetic
tgacacaaccacatcaaaacacacaacccaacagcaatccctatactcaaccacccccgaaaacacaccaaactc

SEQ ID NO: 312543 - DNA, 75 bp, Artificial Sequence
  Synthetic
tagataaattaaccattaaaaataaaaacaaattcaatgatgaattttacacatcaaatctcttttacattagtt

SEQ ID NO: 312544 - DNA, 75 bp, Artificial Sequence
  Synthetic
gctaacaaaacaaataagaattgctaattcagaattagaagataattataacaaactatatcacccaaccccaga

SEQ ID NO: 312545 - DNA, 75 bp, Artificial Sequence
  Synthetic
tcattaatcaatgatatgcctataacaaatgatcagaaaaagttaatgtccaacaatgttcaaatagttagacag

SEQ ID NO: 312546 - DNA, 75 bp, Artificial Sequence
  Synthetic
aaccccacaatccacaacagtcaagatcaaaaacacaacaacaacccaaatactacctagcaaacccaccacaaa

SEQ ID NO: 312547 - DNA, 75 bp, Artificial Sequence
  Synthetic
accacttcacatcagacatctttagtaaggaatagtgcatcactttattgcatgcttccttggcatcatgtcaat

SEQ ID NO: 312548 - DNA, 75 bp, Artificial Sequence
  Synthetic
gtgaaggagctggtaacttattattacgtacggtagtagaacttcatcctgacataagatatatttacagaagtt

SEQ ID NO: 312549 - DNA, 75 bp, Artificial Sequence
  Synthetic
gacataagatatatttacagaagtttaaaagattgcaatgatcatagtttacctattgaatttctaaggttatac

SEQ ID NO: 312550 - DNA, 75 bp, Artificial Sequence
  Synthetic
acctattgaatttctaaggttatacaacgggcatataaacatagattatggtgagaatttaaccattcctgctac

SEQ ID NO: 312551 - DNA, 75 bp, Artificial Sequence
  Synthetic
aacgggcatataaacatagattatggtgagaatttaaccattcctgctacagatgcaactaacaacatacattgg

SEQ ID NO: 312552 - DNA, 75 bp, Artificial Sequence
  Synthetic
tcttatttacatataaaatttgcagaacctattagtatctttgtctgcgatgctgaattacctgtcacagccaat

SEQ ID NO: 312553 - DNA, 75 bp, Artificial Sequence
  Synthetic
gtaagcatgtaagaaagtgcaaatactgttcttctgtaaatagatgcattttaattgcaaaatatcatgctcaag

SEQ ID NO: 312554 - DNA, 75 bp, Artificial Sequence
  Synthetic
attatagtaatattgttatcattaattgcagttggactgcttctatactgcaaggccagaagcacaccagtcaca

SEQ ID NO: 312555 - DNA, 75 bp, Artificial Sequence
  Synthetic
ccaaccctcaagacaaccaaaaaagatcccaaacctcaaaccacaaaaccaaaggaagtactcaccaccaagccc

SEQ ID NO: 312556 - DNA, 75 bp, Artificial Sequence
  Synthetic
gcttaatacctttcctttgttaccctataacaaaaaatggaattaagacttcattgtcaaaattgaagagtgtag

SEQ ID NO: 312557 - DNA, 75 bp, Artificial Sequence
  Synthetic
ttaatggagatatattatcatattctatagctggacgtaatgaagtattcagcaacaagcttataaaccacaagc

SEQ ID NO: 312558 - DNA, 75 bp, Artificial Sequence
  Synthetic
tgtcgcatctccaacattgaaacagttatagaattccagcagaagaacagcagattgttggaaatcaccagagaa

SEQ ID NO: 312559 - DNA, 75 bp, Artificial Sequence
  Synthetic
aagtgaattgttaaatagtttaacaaccaatgagcttaagaagctgattaaaataacaggtagtgtactatacaa

SEQ ID NO: 312560 - DNA, 75 bp, Artificial Sequence
  Synthetic
atatcattaacaagtttggtcaaatttagatgctaacacatcattatattatagttattaaaaaatatgcaaact

SEQ ID NO: 312561 - DNA, 75 bp, Artificial Sequence
  Synthetic
caaaattatcattttagtcttaagggattaaataaaagtctaaaactaacaattacacatgtgcatttacaacac

SEQ ID NO: 312562 - DNA, 75 bp, Artificial Sequence
  Synthetic
aataaaagtctaaaactaacaattacacatgtgcatttacaacacaacgagacattagtttttgacacttttttt

SEQ ID NO: 312563 - DNA, 75 bp, Artificial Sequence
  Synthetic
tcttgaagaaattaatgtgttcgatgcaacatcctccatcatggttaatacattggtttaatttatacacaaaat

SEQ ID NO: 312564 - DNA, 75 bp, Artificial Sequence
  Synthetic
gcaacatcctccatcatggttaatacattggtttaatttatacacaaaattaaacagcatattaacacagtatcg

SEQ ID NO: 312565 - DNA, 75 bp, Artificial Sequence
  Synthetic
tgaatggcctcctcatgcattactagtgaggcaaaacttcatgttaaacaagatactcaagtcaatggacaagag

SEQ ID NO: 312566 - DNA, 75 bp, Artificial Sequence
  Synthetic
acaatctgctgaccaccaatcccaaatcaacttacaacaaatacttcaacatcacagcacaggctgaatcatttc

SEQ ID NO: 312567 - DNA, 75 bp, Artificial Sequence
  Synthetic
atagtgagaaaacttgatgaaagacaggccacatttacattcctggtcaactatgaaatgaaactattgcacaaa

SEQ ID NO: 312568 - DNA, 75 bp, Artificial Sequence
  Synthetic
tgcataactacactccatagtccaaatggagcctgaaaattatagtaatttaaaattaaggagagacataagatg

SEQ ID NO: 312569 - DNA, 75 bp, Artificial Sequence
  Synthetic
aaaccatgagcactacaaatgacaacactactatgcaaagattaatgatcacagacatgagacccctgtcgatgg

SEQ ID NO: 312570 - DNA, 75 bp, Artificial Sequence
  Synthetic
aaaactcagtacttacaaccataattaaagatgatatactctcagctgtggaaaacaatcaatcatatacaaatt

SEQ ID NO: 312571 - DNA, 75 bp, Artificial Sequence
  Synthetic
tttatagatgtttttgttcattttggtatagcacaatcttctaccagaggtggcagtagagttgaagggattttt

SEQ ID NO: 312572 - DNA, 75 bp, Artificial Sequence
  Synthetic
ttgcccttgggttgttaacatagattatcatccaacacatatgaaagcaatattaacttatatagatcttgttag

SEQ ID NO: 312573 - DNA, 75 bp, Artificial Sequence
  Synthetic
tcacctttttacaaaaccacatcaacatctcaccatgcaagccatcatccatactataaagtagttaattaaaaa

SEQ ID NO: 312574 - DNA, 75 bp, Artificial Sequence
  Synthetic
acaatgatctatcacttgaagatttctgatcagttaccaatctgcacatcaacacacaacaccaacagaagacca

SEQ ID NO: 312575 - DNA, 75 bp, Artificial Sequence
  Synthetic
acaaacaaaacaactcacctatccaaccaaacatccatctgccaatcagccaaccagccaaaaaaacaaccagcc

SEQ ID NO: 312576 - DNA, 75 bp, Artificial Sequence
  Synthetic
gatggggcaaatatggaaacatacgtgaacaaacttcacgaaggctccacatacacagctgctgttcaatacaat

SEQ ID NO: 312577 - DNA, 75 bp, Artificial Sequence
  Synthetic
cctcaaactacacactatatccaaacatcatgaacatatacactacatacttcatcacacaaaccaatcccactc

SEQ ID NO: 312578 - DNA, 75 bp, Artificial Sequence
  Synthetic
taataattatataatttttttaataacttctagtgaactaatcctaaaattatcattttgatctaggaagaataa

SEQ ID NO: 312579 - DNA, 75 bp, Artificial Sequence
  Synthetic
tcaatcagaaatggggtgcaattcattgagcatgataaaggttagattacaaaatttatttgacaatgacgaagt

SEQ ID NO: 312580 - DNA, 75 bp, Artificial Sequence
  Synthetic
ttatagagggtcagacccatgctcaagcagattatttgttagcattaaatagccttaaattgctatataaagagt

SEQ ID NO: 312581 - DNA, 75 bp, Artificial Sequence
  Synthetic
cactaacaccattagttaatataaaacttaacagaagacaaaaatggggcaaataaatcaattcagccaacccaa

SEQ ID NO: 312582 - DNA, 75 bp, Artificial Sequence
  Synthetic
atgcattagccaaagcaacaatacatacaattaaattaaacggcatagtttttatacatgttataacaagcagtg

SEQ ID NO: 312583 - DNA, 75 bp, Artificial Sequence
  Synthetic
agtgaaatctaactttacaacaatgccaatattacaaaatggaggatacatatgggaattgattgagttgacaca

SEQ ID NO: 312584 - DNA, 75 bp, Artificial Sequence
  Synthetic
acatgtaaagttcaatcgaatcgagtattttgtgacacaatgaacagtttaacattaccaagtgaagtaaatctc

SEQ ID NO: 312585 - DNA, 75 bp, Artificial Sequence
  Synthetic
atgggttcttagaatgcattggcattaagcctacaaagcatactcccataatatacaagtatgatctcaatccat

SEQ ID NO: 312586 - DNA, 75 bp, Artificial Sequence
  Synthetic
atatacaagtatgatctcaatccataaatttcaacacaatattcacacaatctaaaacaacaactctatgcataa

SEQ ID NO: 312587 - DNA, 75 bp, Artificial Sequence
  Synthetic
tctaaaacaacaactctatgcataactatactccatagtccagatggagcctgaaaattatagtaatttaaaatt

SEQ ID NO: 312588 - DNA, 75 bp, Artificial Sequence
  Synthetic
tcaaccacccccgaaaacacacccaactccacacaaacacccacagcatccgagccctccacatcaaattccacc

SEQ ID NO: 312589 - DNA, 75 bp, Artificial Sequence
  Synthetic
caccaagcccacagaaaagccaaccatcaacatcaccaaaccaaacatcagaactacactgctcaccaacagtac

SEQ ID NO: 312590 - DNA, 75 bp, Artificial Sequence
  Synthetic
ccaaaattatcatgttggtcttcaggggttgaataaaaatctaaaactaacaattatacatgtgcatttacaaca

SEQ ID NO: 312591 - DNA, 75 bp, Artificial Sequence
  Synthetic
actagtcctatcaatcatgtattaacagaaaagtatggagatgaagatatcgacattgtgtttcaaaattgcata

SEQ ID NO: 312592 - DNA, 75 bp, Artificial Sequence
  Synthetic
agggggtagtagagttgaaggaatctttgcaggattgtttatgaatgcctatggttcagggcaagtaatgctaag

SEQ ID NO: 312593 - DNA, 75 bp, Artificial Sequence
  Synthetic
tatacaacatccgagtacctatcacaacctccatctccatccaacataacagaccagtagtcattaaaaagcgta

SEQ ID NO: 312594 - DNA, 75 bp, Artificial Sequence
  Synthetic
gaaaaagattggggagaggggtatataactgatcatatgttcattaatttgaatgttttctttaatgcttataag

SEQ ID NO: 312595 - DNA, 75 bp, Artificial Sequence
  Synthetic
gaaacatttgataacaatgaagaagaatctagctactcatatgaggagataaatgatcaaacaaatgacaacatt

SEQ ID NO: 312596 - DNA, 75 bp, Artificial Sequence
  Synthetic
caatcagcaccctgacgaaattaacaatatagtaacaaaaaaagaacaagatggggcaaatatggaaacatacgt

SEQ ID NO: 312597 - DNA, 75 bp, Artificial Sequence
  Synthetic
ctctcaatccaacctccaaaaaattgagtgacctgttggaagacaacgacagcgataatgatctatcactcgatg

SEQ ID NO: 312598 - DNA, 75 bp, Artificial Sequence
  Synthetic
tagcatatgtagtacaattaccactatatggtgtaatagatacaccttgttggaaactacacacatcccctctat

SEQ ID NO: 312599 - DNA, 75 bp, Artificial Sequence
  Synthetic
tagagatgggcagcaattcattgagtatgataaaagttagattacaaaatttatttgacaatgatgaagtagcat

SEQ ID NO: 312600 - DNA, 75 bp, Artificial Sequence
  Synthetic
aaacaaaacttatctggagtctcagatcatcccaagtcattgttcatcagatctagtactcaaataagttaataa

SEQ ID NO: 312601 - DNA, 75 bp, Artificial Sequence
  Synthetic
attggaggaaatccaactaatcacaatatctgttaacatagacaagtccacacaccatacagaatcaaccaatgg

SEQ ID NO: 312602 - DNA, 75 bp, Artificial Sequence
  Synthetic
aatatacttcctgtttttgatgttgtgcaaaatgctaaattgattctttcaagaactaaaaatttcattatgcct

SEQ ID NO: 312603 - DNA, 75 bp, Artificial Sequence
  Synthetic
acaaaacctttgagttaccaagagctcgagtcaacacatagcattcatcaatccaacagcccaaaacagtaacct

SEQ ID NO: 312604 - DNA, 75 bp, Artificial Sequence
  Synthetic
cattaagcctacaaaacatactcctataatatacaaatatgacctcaacccgtaaattccaacaaaaaaaccaac

SEQ ID NO: 312605 - DNA, 75 bp, Artificial Sequence
  Synthetic
tgggcttgatctcaattcatgaattatgtttagtctaattcaatagacatgtgtttattaccattttagttaata

SEQ ID NO: 312606 - DNA, 75 bp, Artificial Sequence
  Synthetic
ccaaacatcataaacatctacactacacactttatcacacaaaccaatccccctcaaaatccaaaatcacctcca

SEQ ID NO: 312607 - DNA, 75 bp, Artificial Sequence
  Synthetic
gactaacaataacattggggcaaatgcaaacatgtccaaaaacaaggaccaacgcaccgctaagacattagaaag

SEQ ID NO: 312608 - DNA, 75 bp, Artificial Sequence
  Synthetic
gaacagtaacttaaaatatcattaacaagtttggtcaaatttagatgctaacacatcattatattatagttatta

SEQ ID NO: 312609 - DNA, 75 bp, Artificial Sequence
  Synthetic
cgaatagataaataaaactaaaatatggggtaaatagacatcagttagagttcaatccatctcaacaaccatcca

SEQ ID NO: 312610 - DNA, 75 bp, Artificial Sequence
  Synthetic
atcagtccctctaatccgtctgaaattacatcacaaatcaccaccatactagcttcaacaacaccaggagtcaag

SEQ ID NO: 312611 - DNA, 75 bp, Artificial Sequence
  Synthetic
gccaaccagccaaaaaaacacccagccaatccaaaattagtcacccggaaaaaatcgatactatagttacaaaaa

SEQ ID NO: 312612 - DNA, 75 bp, Artificial Sequence
  Synthetic
gacctgggacactctcaatcatctattattcatatcatcgtgcttatataagttaaatcttaaatctatagcaca

SEQ ID NO: 312613 - DNA, 75 bp, Artificial Sequence
  Synthetic
aggttatatatgggaaatgatggaattaacacactgctctcaacctaatggcctaatagatgacaattgtgaaat

SEQ ID NO: 312614 - DNA, 75 bp, Artificial Sequence
  Synthetic
caaacctcaaaccactaaaccaaaggaagtacccaccaccaagcccacagaaaagccaaccatcaacaccaccaa

SEQ ID NO: 312615 - DNA, 75 bp, Artificial Sequence
  Synthetic
aaagatgattaccattttgaagtgttcaacttcgttccctgtagtatatgtggcaacaatcaactttgcaaatcc

SEQ ID NO: 312616 - DNA, 75 bp, Artificial Sequence
  Synthetic
taataatgaataatgagcaaaaattttataataaaaataaaaatagctacacactaacactgtattcaattatag

SEQ ID NO: 312617 - DNA, 75 bp, Artificial Sequence
  Synthetic
accacaaacaaaagagacccaaaaacaccagcaaaaccactgaaaaaagaaaacaccaccaacccaacaagaaaa

SEQ ID NO: 312618 - DNA, 75 bp, Artificial Sequence
  Synthetic
aacaaccactgaattcaaaaatgccatcacaaatgcaaaaatcatcccttactcaggattactgttagtcatcac

SEQ ID NO: 312619 - DNA, 75 bp, Artificial Sequence
  Synthetic
catagtgttctcccattatgctgtgtcaaattataatcttgtatatataaataaacaaatccaatcttctcacag

SEQ ID NO: 312620 - DNA, 75 bp, Artificial Sequence
  Synthetic
taagaagaaagatagcataatatctgttaactcaatagatatagaagtcactaaagagagcccgataacatctgg

SEQ ID NO: 312621 - DNA, 75 bp, Artificial Sequence
  Synthetic
agagggttttattatgtctctaattttaaacataacagaagaagatcaattcagaaaacggttttataatagtat

SEQ ID NO: 312622 - DNA, 75 bp, Artificial Sequence
  Synthetic
catagacgacccatctatcattggactttcccaaagtctgaacttcatcgcaactctcatctataaaccatctca

SEQ ID NO: 312623 - DNA, 75 bp, Artificial Sequence
  Synthetic
aagcaaagaccaactaagtggaatcaataatattgcattcagcaaatagacaaaaaactacctgatcatgtttca

SEQ ID NO: 312624 - DNA, 75 bp, Artificial Sequence
  Synthetic
atgaagaacccaattcacctaagataagagtgtacaatactgttatatcatacattgagagcaatagaaaaaaca

SEQ ID NO: 312625 - DNA, 75 bp, Artificial Sequence
  Synthetic
taaggttatgggacaaaatggatcccattattaatggaagctctgctaatgtgtatctaactgatagttatctaa

SEQ ID NO: 312626 - DNA, 75 bp, Artificial Sequence
  Synthetic
attgaataagttcttaacatgcataatcacgtttgacaaaaaccctaatgctgaattcgtaacattgatgagaga

SEQ ID NO: 312627 - DNA, 75 bp, Artificial Sequence
  Synthetic
aatacaaaatcagaaacacaccatacaacagcacaaaccaaaggcagaaccaccactccaacacagaacaacaag

SEQ ID NO: 312628 - DNA, 75 bp, Artificial Sequence
  Synthetic
gtacccaccaccaagcccacagaagagccaaccatcaacaccaccaaaacaaacatcataactacactactcacc

SEQ ID NO: 312629 - DNA, 75 bp, Artificial Sequence
  Synthetic
aaacatcataactacactactcacctccaacaccacaggaaatccagaactcacaagtcaaatggaaaccttcca

SEQ ID NO: 312630 - DNA, 75 bp, Artificial Sequence
  Synthetic
gtgatgaagatattgatatagtattccaaaactgtataagttttggccttagcttaatgtcagtagtagagcaat

SEQ ID NO: 312631 - DNA, 75 bp, Artificial Sequence
  Synthetic
gtcatatgaaaaagccaaaaagttgtttccacaatatctaagtgtcaattatttacaccgtttaacagtcagtag

SEQ ID NO: 312632 - DNA, 75 bp, Artificial Sequence
  Synthetic
tccacacaaattcagctacaacatcacccaatacaaaatcagaaacacaccatacaacagcacaaaccaaaggca

SEQ ID NO: 312633 - DNA, 75 bp, Artificial Sequence
  Synthetic
cagcaaaatctaaccaactttacaccaccacttcacatcagacatctttagtaaggaatagtgcatcactttatt

SEQ ID NO: 312634 - DNA, 75 bp, Artificial Sequence
  Synthetic
tggggcaaataaccatggagttgctgatccacagatcaagtgcaatcttcctaactcttgctattaatgcattgt

SEQ ID NO: 312635 - DNA, 75 bp, Artificial Sequence
  Synthetic
aactggagtaaaattataatagagtggagcaagcatgtaagaaaatgcaagtactgttcctcagttaataaatgt

SEQ ID NO: 312636 - DNA, 75 bp, Artificial Sequence
  Synthetic
ctccaaacaaaatattctccaaaagtgcacaacactataccactacagagatagatctaaatgatattatgcaaa

SEQ ID NO: 312637 - DNA, 75 bp, Artificial Sequence
  Synthetic
atgaattattacataatgtaaatgctggtaaatccaccacaaatatcatgataactaccataattatagtaatta

SEQ ID NO: 312638 - DNA, 75 bp, Artificial Sequence
  Synthetic
caaatcgttataatgataactacaacaattatatcagtaaatgttctataataacagatcttagcaaattcaatc

SEQ ID NO: 312639 - DNA, 75 bp, Artificial Sequence
  Synthetic
caacttatgaaagattctaaaggtatttttgaaaaagattggggagagggatatataactgatcatatgttcatt

SEQ ID NO: 312640 - DNA, 75 bp, Artificial Sequence
  Synthetic
aagcttcaaggaagatctcaccccaagtgataaccctttctctaagttgtacaaagaaaccatagaaacatttga

SEQ ID NO: 312641 - DNA, 75 bp, Artificial Sequence
  Synthetic
ataaaacctcatcaaagggaaatggggcaaataaactcacctaatcaatcaaaccatgagcactacaaatgacaa

SEQ ID NO: 312642 - DNA, 75 bp, Artificial Sequence
  Synthetic
acaagacttgtacaatttatttccaattgttgtgatagacaggattatagatcattcaggtaatacagcaaaatc

SEQ ID NO: 312643 - DNA, 75 bp, Artificial Sequence
  Synthetic
acatagtcaatcaagacacaagtttgcatagaataaaaggctgtcacagttttaagttgtggtttttaaaacgcc

SEQ ID NO: 312644 - DNA, 75 bp, Artificial Sequence
  Synthetic
ctctcaagacttgattgatgcaactcaaaattttctacaacatctaggtattactgatgatatatacacaatata

SEQ ID NO: 312645 - DNA, 75 bp, Artificial Sequence
  Synthetic
catccaaactaagctattccccaaacaacagtgctcaacggttaagaaggagctaatccattttagtaattaaaa

SEQ ID NO: 312646 - DNA, 75 bp, Artificial Sequence
  Synthetic
tagcatattgattccaaaattatcattttagtcttaaggggttgaataaaagtctaaaactaacaattatacatg

SEQ ID NO: 312647 - DNA, 75 bp, Artificial Sequence
  Synthetic
accccagttgtatagcattcataggtgaaggagctggtaacttattattacgtacggtagtagaacttcatcctg

SEQ ID NO: 312648 - DNA, 75 bp, Artificial Sequence
  Synthetic
tatgaatatgcccaaaaattgggtggtgaagcaggattctaccatatattgaacaacccaaaagcatcattatta

SEQ ID NO: 312649 - DNA, 75 bp, Artificial Sequence
  Synthetic
aaagcatcaactcaaccccaaagaagatgatgtagagctttaagttaacaaaaaatacggggcaaataagtcaac

SEQ ID NO: 312650 - DNA, 75 bp, Artificial Sequence
  Synthetic
tttgacaatgatgaagtagcattgttaaaaataacatgctatactgacaaattaatacatttaactaatgctttg

SEQ ID NO: 312651 - DNA, 75 bp, Artificial Sequence
  Synthetic
aaagtttgctcctgaattccatggagaagatgcaaacaacagggctactaaattcctagaatcaataaagggcaa

SEQ ID NO: 312652 - DNA, 75 bp, Artificial Sequence
  Synthetic
gaataagtttaaaacccaaatctaattggtttatatgtatattaactaaactacgagatattagtttttgacact

SEQ ID NO: 312653 - DNA, 75 bp, Artificial Sequence
  Synthetic
aagcattaatgaccaatgataggttagaggctatggcaagacttaggaatgaggaaagcgaaaaaatggcaaaag

SEQ ID NO: 312654 - DNA, 75 bp, Artificial Sequence
  Synthetic
gaaagtcttacaagatatggtgatctagaactacagaaaatattagaattgaaagcaggaataagtaacaaatca

SEQ ID NO: 312655 - DNA, 75 bp, Artificial Sequence
  Synthetic
attgagtaaaagtctaaaactaacaattacatatgtgcatttacaacacgacgagacattagtttttgacacttt

SEQ ID NO: 312656 - DNA, 75 bp, Artificial Sequence
  Synthetic
tgatcaatcagcaccctgacaaaattaacaatatagtaacaaaaaaagaacaagatggggcaaatatggaaacat

SEQ ID NO: 312657 - DNA, 75 bp, Artificial Sequence
  Synthetic
atatagttacaaaaaaaggaaagggtggggcaaatatggaaacatacgtgaacaagcttcacgaaggctccacat

SEQ ID NO: 312658 - DNA, 75 bp, Artificial Sequence
  Synthetic
tggggcaaatatggaaacatacgtgaacaagcttcacgaaggctccacatacacagctgctgttcaatacaatgt

SEQ ID NO: 312659 - DNA, 75 bp, Artificial Sequence
  Synthetic
ctcctgattgtgggatgataatattatgtatagcagcattagtaataaccaaattagcagcaggggatagatctg

SEQ ID NO: 312660 - DNA, 75 bp, Artificial Sequence
  Synthetic
ctatctaagatcaattagtgtcaaaaacaaggatctgaactcactagaaaatatagcaaccaccgaattcaaaaa

SEQ ID NO: 312661 - DNA, 75 bp, Artificial Sequence
  Synthetic
attcaaatatatcaagccacagagtcaatttatagtagatcttggtgcctacctagaaaaagagagcatatatta

SEQ ID NO: 312662 - DNA, 75 bp, Artificial Sequence
  Synthetic
tgaatcatttcctcgcatcatgctacccacacaactaagctagatccttaactcatagttacataaaaacctcaa

SEQ ID NO: 312663 - DNA, 75 bp, Artificial Sequence
  Synthetic
tctgctagacctagagtgcgaataggtaaataaaaccaaaatatggggtaaatagacattagttagagttcaatc

SEQ ID NO: 312664 - DNA, 75 bp, Artificial Sequence
  Synthetic
gaacaagcccaattatcaaagaaaacctctagtaagtttcaaagaagaccctacgccaagtgataatcccttttc

SEQ ID NO: 312665 - DNA, 75 bp, Artificial Sequence
  Synthetic
caaaatgggaaatacatccatcacaatagaattcacaagcaaattttggccctattttacactaatacatatgat

SEQ ID NO: 312666 - DNA, 75 bp, Artificial Sequence
  Synthetic
aaataaaaccaaaatatggggtaaatagacattagttagagttcaatcaatctcaacaaccatttataccgccaa

SEQ ID NO: 312667 - DNA, 75 bp, Artificial Sequence
  Synthetic
agtgttctaccattatgctgtgtcaaattataatcctgtatatataaacaaacaaatccaatcttctcacagagt

SEQ ID NO: 312668 - DNA, 75 bp, Artificial Sequence
  Synthetic
atcatggtagcatagagtagttatttaaaaattaacataatgatgaattattagtatgggatcaaaaacaacatt

SEQ ID NO: 312669 - DNA, 75 bp, Artificial Sequence
  Synthetic
aaatagtcataacaatgaactaggatatcaagactaacaataacattggggcaaatgcaaacatgtccaaaaaca

SEQ ID NO: 312670 - DNA, 75 bp, Artificial Sequence
  Synthetic
aataagctaagtgaacataaaacattctgtaacaatactcttgaactaggacagatgcatcaaatcaacacatag

SEQ ID NO: 312671 - DNA, 75 bp, Artificial Sequence
  Synthetic
tgctctaccatcatgctgtgtcaaattataatcctgtatatataaacaaacaaatccaatcttctcacagagtca

SEQ ID NO: 312672 - DNA, 75 bp, Artificial Sequence
  Synthetic
gttacaacaaattggaagcacacagctacacgatttgcaatcaaacccatggaagattaaccttttccctctaca

SEQ ID NO: 312673 - DNA, 75 bp, Artificial Sequence
  Synthetic
tctacctacattcttcacttcacaatcataatcaccaaccctctgtggtttaaccaatcaaacaaaacttatctg

SEQ ID NO: 312674 - DNA, 75 bp, Artificial Sequence
  Synthetic
accgacccaacaaaagaaccaacccccaagaccacggaaagagacaccagcacctcacggtccactgtgctcgac

SEQ ID NO: 312675 - DNA, 75 bp, Artificial Sequence
  Synthetic
ctacaacatccgagtacccatcacaaccttcatctccacccaacacaccacgccagtagttacttaaaaacatat

SEQ ID NO: 312676 - DNA, 75 bp, Artificial Sequence
  Synthetic
aaacagaatcaaaataaactctggggcaaataacaatggagttgctaatcctcaaagcaaatgcaattaccacaa

SEQ ID NO: 312677 - DNA, 75 bp, Artificial Sequence
  Synthetic
aatcacatgcttagttattcaaaaactacatcttagcagaaaaccgtgacctatcaagcaagaacgaaattaaac

SEQ ID NO: 312678 - DNA, 75 bp, Artificial Sequence
  Synthetic
ttcctaactcttgctattaatgcattgtacctcacctcaagtcagaacataactgaggagttttaccaatcgaca

SEQ ID NO: 312679 - DNA, 75 bp, Artificial Sequence
  Synthetic
taattaaagatgatatactttcagctgtggaaaacaatcaatcatatacaaattcagacaaaaatcactcagtaa

SEQ ID NO: 312680 - DNA, 75 bp, Artificial Sequence
  Synthetic
tgtagtgcagttagcagaggttattttagtgctttacgaacaggttggtatactagtgtcataacaatagaatta

SEQ ID NO: 312681 - DNA, 75 bp, Artificial Sequence
  Synthetic
agcttggaatcagcttctccaatctgtctgaaactacatcacaaaccaccaccatactagcttcaacaacaccaa

SEQ ID NO: 312682 - DNA, 75 bp, Artificial Sequence
  Synthetic
gctattaaggctcaaaaggacctactatcaagagtatgtcacactttattagacaagacagtgtctgataatatc

SEQ ID NO: 312683 - DNA, 75 bp, Artificial Sequence
  Synthetic
taagtagtctaagtacgttgagaggtgctttcatttatagaatcataaaagggtttgtaaatacctacaacagat

SEQ ID NO: 312684 - DNA, 75 bp, Artificial Sequence
  Synthetic
tcagatagtaaggcaacaaagttattctatcatgtctataataaaggaagaagtccttgcatatgttgtacagct

SEQ ID NO: 312685 - DNA, 75 bp, Artificial Sequence
  Synthetic
aacatctgtttaacaagaactgacagaggatggtactgtgacaatgcaggatcagtatctttcttcccacaagct

SEQ ID NO: 312686 - DNA, 75 bp, Artificial Sequence
  Synthetic
gcgacagatcaagaagagtactagagtattacttgagagataataaattcaatgaatgtgatctatacaattgtg

SEQ ID NO: 312687 - DNA, 75 bp, Artificial Sequence
  Synthetic
gctatagtgtcatgctatggtaaaactaaatgcactgcatccaacaaaaatcgtgggattataaagacattttct

SEQ ID NO: 312688 - DNA, 75 bp, Artificial Sequence
  Synthetic
aatggttgtgactatgtgtcaaacaaaggagtagatactgtatcagtgggcaacactttatactatgtaaacaag

SEQ ID NO: 312689 - DNA, 75 bp, Artificial Sequence
  Synthetic
cacacaaattcagccacaatatcacctggtacagagtcagagacacaccatgcaacagcacaaaccaggggcaga

SEQ ID NO: 312690 - DNA, 75 bp, Artificial Sequence
  Synthetic
agcttttattcgtagatctgatgaattactacataatgtaaatgctggcaaatctactacaaatattatgataac

SEQ ID NO: 312691 - DNA, 75 bp, Artificial Sequence
  Synthetic
tggtccttatctcaaaaatgattataccaacttaattagtagacaaaatccattaatagaacacataaatctaaa

SEQ ID NO: 312692 - DNA, 75 bp, Artificial Sequence
  Synthetic
gaccaactaagtggaatcaataatattgcattcagcaaatagaaaaaaaccacctgatcatgtttcaacaacaat

SEQ ID NO: 312693 - DNA, 75 bp, Artificial Sequence
  Synthetic
cacctgatcatgtttcaacaacaatccgctgaccaccaatcccaaatcaacccacaacaaacatttcaacatcac

SEQ ID NO: 312694 - DNA, 75 bp, Artificial Sequence
  Synthetic
ccgctgaccaccaatcccaaatcaacccacaacaaacatttcaacatcacagcacaggtcgaatcatttcctcgc

SEQ ID NO: 312695 - DNA, 75 bp, Artificial Sequence
  Synthetic
agatccttaactcatagttacataaaaacctcaagtatcacaatcaaccactaaatcaacacatcattcacaaaa

SEQ ID NO: 312696 - DNA, 75 bp, Artificial Sequence
  Synthetic
acaacccaaaagaatcaactgttagtgatacaaatgaccatgccaaaaataatgatactacctgacaaatatcct

SEQ ID NO: 312697 - DNA, 75 bp, Artificial Sequence
  Synthetic
actgagtggtataaataatattgcatttagtaactgaataaaaatagcacctaatcatgttcttacaatggttca

SEQ ID NO: 312698 - DNA, 75 bp, Artificial Sequence
  Synthetic
taacagctggggcaaatatgtcgcgaagaaatccttgtaaatttgagattagaggtcattgcttgaatggtagaa

SEQ ID NO: 312699 - DNA, 75 bp, Artificial Sequence
  Synthetic
taatcaaaagaacacactatatttcaatcaaaacaacccaaataaccatatgtactcaccgaatcaaacattcaa

SEQ ID NO: 312700 - DNA, 75 bp, Artificial Sequence
  Synthetic
ttgattgacacaattcaaaattttctacaacatctaggtattattgaggatatatatacaatatatatattagtg

SEQ ID NO: 312701 - DNA, 75 bp, Artificial Sequence
  Synthetic
aatcaaaacaaccaaaataaccatatatactcaccgaatcaaccattcaatgaaatccattggacctctcaagac

SEQ ID NO: 312702 - DNA, 75 bp, Artificial Sequence
  Synthetic
ttggataaccaccagtgtttattaaatcatatatttgatgaaattcattggacacctaaaaacttattagatgcc

SEQ ID NO: 312703 - DNA, 75 bp, Artificial Sequence
  Synthetic
aaaaaccatggttttatattgatagataatcatactctcaatggattccaatttattttgaatcaatatggttgt

SEQ ID NO: 312704 - DNA, 75 bp, Artificial Sequence
  Synthetic
tatatatattagtgtcataatgcttgatcataacgattctatatcatccaaccataaaactatcttaataaggtt

SEQ ID NO: 312705 - DNA, 75 bp, Artificial Sequence
  Synthetic
caaagaaagagaactcagtgtaggtagaatgtttgcaatgcaaccaggaatgttcagacaagttcaaatattggc

SEQ ID NO: 312706 - DNA, 75 bp, Artificial Sequence
  Synthetic
attttctcttcagaatctttggacatccaatggttgatgaaagacaagcaatggatgctgtaagaattaactgta

SEQ ID NO: 312707 - DNA, 75 bp, Artificial Sequence
  Synthetic
tccaatggttgatgaaagacaagcaatggatgctgtaagaattaactgtaatgaaactaagttctacttattaag

SEQ ID NO: 312708 - DNA, 75 bp, Artificial Sequence
  Synthetic
gctgaattcgtaacattgatgagagatcctcaagctttaggatctgagaggcaagctaaaattactagcgaaatc

SEQ ID NO: 312709 - DNA, 75 bp, Artificial Sequence
  Synthetic
ccacttaccttactcaagtctcaccagaaagggttagcccatccaaacaacccacagccacaccaccaatccaca

SEQ ID NO: 312710 - DNA, 75 bp, Artificial Sequence
  Synthetic
attcaataatgttgtgttatcacaattattcctttatggagattgtatactgaaattatttcataatgaaggctt

SEQ ID NO: 312711 - DNA, 75 bp, Artificial Sequence
  Synthetic
tattttatcaggattgcggttctatcgtgagtttcatctgcctaaaaaagtggatcttgaaatgataataaatga

SEQ ID NO: 312712 - DNA, 75 bp, Artificial Sequence
  Synthetic
tgaacaaagtggattatacagatatcatatgggtggtattgagggctggtgtcaaaaactgtggaccattgaagc

SEQ ID NO: 312713 - DNA, 75 bp, Artificial Sequence
  Synthetic
catatgggtggtattgagggctggtgtcaaaaactgtggaccattgaagctatatcattattagatctaatatct

SEQ ID NO: 312714 - DNA, 75 bp, Artificial Sequence
  Synthetic
ctctgataaatggtgataatcagtcaattgatataagtaaaccagttagacttatagagggtcagacccatgctc

SEQ ID NO: 312715 - DNA, 75 bp, Artificial Sequence
  Synthetic
ttacttaagtgaattgttaaatagtttaacaaccaatgagctcaagaagctgattaaaataacaggtagtgtact

SEQ ID NO: 312716 - DNA, 75 bp, Artificial Sequence
  Synthetic
catataattttttaaataacttttagtgaactaatcctaaagttatcattttaatcttggaggaataaatttaaa

SEQ ID NO: 312717 - DNA, 75 bp, Artificial Sequence
  Synthetic
gtgaactaatcctaaagttatcattttaatcttggaggaataaatttaaaccctaatctaattggtttatatgtg

SEQ ID NO: 312718 - DNA, 75 bp, Artificial Sequence
  Synthetic
aaaccctaatctaattggtttatatgtgtattaactaaattacgagatattagtttttgacactttttttctcgt

SEQ ID NO: 312719 - DNA, 75 bp, Artificial Sequence
  Synthetic
atctaaatgacattatgcaaaatatagaaccaacttaccctcatggattaagagttgtttatgaaagtttacctt

SEQ ID NO: 312720 - DNA, 75 bp, Artificial Sequence
  Synthetic
agtattatgttcacaatggacattaaatatacaactagcactatagccagtggtataattatagaaaaatataat

SEQ ID NO: 312721 - DNA, 75 bp, Artificial Sequence
  Synthetic
aaatcttataataaaaattcccatagctacacactaacactgtattcaattatagttatttaaaattaaaaatta

SEQ ID NO: 312722 - DNA, 75 bp, Artificial Sequence
  Synthetic
agcacttaaatctggatctcacatcaactctaatttaatattagtacataaaatgtctgattattttcataatgc

SEQ ID NO: 312723 - DNA, 75 bp, Artificial Sequence
  Synthetic
ttgcattcagcaaataggcaaaaaaccactgatcatgttcaacaacaatctgctgaccaccaatcccaaatcaac

SEQ ID NO: 312724 - DNA, 75 bp, Artificial Sequence
  Synthetic
aaaaatgcgtactacaaacttgcgtaaaccaaaaaaatggggcaaataagaatttgataagtaccactttaattt

SEQ ID NO: 312725 - DNA, 75 bp, Artificial Sequence
  Synthetic
ctataacaaaaaagggaattaatactgcattgtcaaaactaaagagtgttgttagtggagatatactatcatatt

SEQ ID NO: 312726 - DNA, 75 bp, Artificial Sequence
  Synthetic
aataaacttataaatcataagcatatgaacatcttaaagtggttcaatcatgttttaaatttcagatcaacagaa

SEQ ID NO: 312727 - DNA, 75 bp, Artificial Sequence
  Synthetic
aacaacagtgctcaatagttaagaaggagctaatccattttagtaattaaaaataaaggtaaagccaataacata

SEQ ID NO: 312728 - DNA, 75 bp, Artificial Sequence
  Synthetic
acgcgaaaaaatgcgtactacaaacttgcacactcgaaaaaaaatggggcaaataagaatttgataagtgctatt

SEQ ID NO: 312729 - DNA, 75 bp, Artificial Sequence
  Synthetic
ttttcttaaagtctgaacttcatcgcaactctcatctataaaccatctcacttacactatttaagtagattccta

SEQ ID NO: 312730 - DNA, 75 bp, Artificial Sequence
  Synthetic
aaaggttagattacaaaatttgtttgacaatgacgaagtagcattgttaaaaataacatgttatactgacaaatt

SEQ ID NO: 312731 - DNA, 75 bp, Artificial Sequence
  Synthetic
taccctgcagcatatgcagcaacaatccaacctgctgggccatctgcaaaagaataccaaacaaaaaacctggaa

SEQ ID NO: 312732 - DNA, 75 bp, Artificial Sequence
  Synthetic
gcaaataaataaactcagccgacccaaccatggacacaacacacaatggtactacaccacaaagactgatgatca

SEQ ID NO: 312733 - DNA, 75 bp, Artificial Sequence
  Synthetic
agatcagtatagagtatattttaaaagatcttaagattaaggatcccagttgtatagcattcataggtgaaggag

SEQ ID NO: 312734 - DNA, 75 bp, Artificial Sequence
  Synthetic
attaaaaagcgtattattgcaaaaagccatgaccaaatcaaacagaatcaaaatcaactctggggcaaataacaa

SEQ ID NO: 312735 - DNA, 75 bp, Artificial Sequence
  Synthetic
aaatccagaaaacacaagtcaaaaggaaaccctccactcaaccactcccgaaggcaatccaagcccttcacaagt

SEQ ID NO: 312736 - DNA, 75 bp, Artificial Sequence
  Synthetic
catcatctctgccaatcacaaagttacactaacaacggtcacagttcaaacaataaaaaaccacactgaaaaaaa

SEQ ID NO: 312737 - DNA, 75 bp, Artificial Sequence
  Synthetic
aaatggagcctgaaaattatagtaatttaaaattaaggagagacataagatgaaagatggggcaaatacaaaaat

SEQ ID NO: 312738 - DNA, 75 bp, Artificial Sequence
  Synthetic
tgtaaatagatgcattttaattgcaaaatatcatgctcaagatgatattgatttcaaattagataacattactat

SEQ ID NO: 312739 - DNA, 75 bp, Artificial Sequence
  Synthetic
accaccaacccaacaaaaaaaccaaccctcaagaccacagaaagagacaccagcacctcacaatccactgtgctc

SEQ ID NO: 312740 - DNA, 75 bp, Artificial Sequence
  Synthetic
actcctaattatgatgtgcagaaacacatcaacaagttatgtggcatgttattaatcacagaagatgctaatcat

SEQ ID NO: 312741 - DNA, 75 bp, Artificial Sequence
  Synthetic
ttaacagtcagtagtagaccatgtgaattccctgcctcaataccagcttatagaacaacaaattatcattttgat

SEQ ID NO: 312742 - DNA, 75 bp, Artificial Sequence
  Synthetic
aaaccaaccatcaaacccacaaacaaaccaaccaccaaaaccacaaacaaaagagacccaaaaacaccagccaaa

SEQ ID NO: 312743 - DNA, 75 bp, Artificial Sequence
  Synthetic
aatagaaaaccaacaaacaaaccaactcacccatccaaccaaacatctatctgccgattagccaaccagccaaaa

SEQ ID NO: 312744 - DNA, 75 bp, Artificial Sequence
  Synthetic
aaactttagatcagctgaacttaattacaatcatttatacatgatagagtccacatatccttacttaagtgaatt

SEQ ID NO: 312745 - DNA, 75 bp, Artificial Sequence
  Synthetic
ttagcatattgattccaaaattatcattttagtcttaagggattaaataaaagtctaaaactaacaattacacat

SEQ ID NO: 312746 - DNA, 75 bp, Artificial Sequence
  Synthetic
agacaaaatcaaccaatggaaaatacatccataactatagaattctcaagcaaattctggccttactttacacta

SEQ ID NO: 312747 - DNA, 75 bp, Artificial Sequence
  Synthetic
gataacccatccatcattggaccttctcaaaatttgaacttcatcgcaactttcatccataaaccatctcactta

SEQ ID NO: 312748 - DNA, 75 bp, Artificial Sequence
  Synthetic
aaaaacacaacaacaacccaaatacaacctagcaaacccaccacaaaacaacgccaaaacaaaccacaaaacaaa

SEQ ID NO: 312749 - DNA, 75 bp, Artificial Sequence
  Synthetic
tcaaatatttgtttaacaaggactgatagaggatggtattgtgataatgcaggatcagtatccttctttccacag

SEQ ID NO: 312750 - DNA, 75 bp, Artificial Sequence
  Synthetic
aaaacacaccagttacattaagcaaagaccaactaagtggaatcaataatattgcattcagcaaatagacaaaaa

SEQ ID NO: 312751 - DNA, 75 bp, Artificial Sequence
  Synthetic
aaaattatcgatttgatctaggaggaataaatttaaaaccaaacctaattggtttatatgtatattaactaaact

SEQ ID NO: 312752 - DNA, 75 bp, Artificial Sequence
  Synthetic
atccatctgctcaaaagactaccagcagacgtgctgaagaagacaataaagaacacattagatatccacaaaagc

SEQ ID NO: 312753 - DNA, 75 bp, Artificial Sequence
  Synthetic
cttgctgggccatctgcaaaagaataccaagcaaaaaacctggaaagaaaaccaccaccaagcccacgaaaaaac

SEQ ID NO: 312754 - DNA, 75 bp, Artificial Sequence
  Synthetic
agatttctgatcagttaccaatctgcacatcaacacacaacaccaacagaagaccaacaaacaaaacaactcacc

SEQ ID NO: 312755 - DNA, 75 bp, Artificial Sequence
  Synthetic
tatccaaccaaacatctatctgccaatcagccaaccagccaaaaaaaacacccagccaatccaaaattagtcacc

SEQ ID NO: 312756 - DNA, 75 bp, Artificial Sequence
  Synthetic
ataactatagaattaagtaatatcaaggaaaataagtgtaatggaacagatgctaaggtaaaattgataaaacaa

SEQ ID NO: 312757 - DNA, 75 bp, Artificial Sequence
  Synthetic
gtgcccatgttccaatcatccatgccagcagatttacttataaaagaactagctaatgtcaacatactagtgaaa

SEQ ID NO: 312758 - DNA, 75 bp, Artificial Sequence
  Synthetic
aaaacacaacaccaatagaaaaccaacaaacaaaccaactcacccatccaaccaaacatctatctgccgattagc

SEQ ID NO: 312759 - DNA, 75 bp, Artificial Sequence
  Synthetic
atcgatactatagttacaaaaaaagatggggcaaatatggaaacatacgtgaacaaacttcacgagggctccaca

SEQ ID NO: 312760 - DNA, 75 bp, Artificial Sequence
  Synthetic
aaccaacacaaaggaagggtccaacatctgtttaacaagaaccgacagaggatggtactgtgacaatgcaggatc

SEQ ID NO: 312761 - DNA, 75 bp, Artificial Sequence
  Synthetic
caataccaagcaataaaccaaagaaaaaaccaaccatcaaacccacaaacaaaccacccaccaaaaccacaaaca

SEQ ID NO: 312762 - DNA, 75 bp, Artificial Sequence
  Synthetic
acacccacagcatccgagccctccacatcaaattccacccaaaaactctagtcatatgcttagttattcaaaaac

SEQ ID NO: 312763 - DNA, 75 bp, Artificial Sequence
  Synthetic
taaagctatatcacctcctaaaaatttaatatggactagtttccctagaaattatatgccgtcacacatacaaaa

SEQ ID NO: 312764 - DNA, 75 bp, Artificial Sequence
  Synthetic
gttgcctaaaaaagtggatcttgaaatgatcataaatgataaggctatatcacctcctaaaaatttgatatggac

SEQ ID NO: 312765 - DNA, 75 bp, Artificial Sequence
  Synthetic
atactgcaaggccagaagcacaccagtcacactaagcaaggatcaactgagtggtataaataatattgcatttag

SEQ ID NO: 312766 - DNA, 75 bp, Artificial Sequence
  Synthetic
gatttgcaatcaaacccatggaagattaaccttcttcaattacatcggtgtgttaattcatacaaactttctacc

SEQ ID NO: 312767 - DNA, 75 bp, Artificial Sequence
  Synthetic
ccaaacatcagaactacactgctcaccaacagcaccacaggaaatctagaacacacaagtcaagaggaaaccctc

SEQ ID NO: 312768 - DNA, 75 bp, Artificial Sequence
  Synthetic
ttataacagaaagccatgaccaactcaaatagaatcaatataaactctggggcaaataacaatggagttgccaat

SEQ ID NO: 312769 - DNA, 75 bp, Artificial Sequence
  Synthetic
aatctacaacagtcaagaccaaaaacacaacaacaacccaaatacaacccagcaagcccaccacaaaacaacgcc

SEQ ID NO: 312770 - DNA, 75 bp, Artificial Sequence
  Synthetic
cctgatcatgtttcaacaacaatccgctgaccactaatcccaaatcaacttacaacaaatatttcaacatcacag

SEQ ID NO: 312771 - DNA, 75 bp, Artificial Sequence
  Synthetic
aataagtaacaaatcaaatcgttacaatgacaattacaacaattacatcagtaagtgctctatcatcacagatct

SEQ ID NO: 312772 - DNA, 75 bp, Artificial Sequence
  Synthetic
catctaggtattactgatgatatatatacaatatatatattagtgtcataacactcaataccaatacttaccaca

SEQ ID NO: 312773 - DNA, 75 bp, Artificial Sequence
  Synthetic
aattacatcactaattaccaccatactagattcaacaacaccaggagtcaagtcaaccctgcaatccacaacagt

SEQ ID NO: 312774 - DNA, 75 bp, Artificial Sequence
  Synthetic
ttactaccaaaggatatagccaacagcttctatgaagtgtttgaaaaatatcctcactttatagatgtttttgtt

SEQ ID NO: 312775 - DNA, 75 bp, Artificial Sequence
  Synthetic
gttgctcatgcaaagcacaccagcagccaacaatcgagccagaagagaactaccaaggtttatgaattatacact

SEQ ID NO: 312776 - DNA, 75 bp, Artificial Sequence
  Synthetic
ttagagatgggcagcaactcattgagtatgataaaagttagattgcaaaatctgtttgacaatgatgaagtagca

SEQ ID NO: 312777 - DNA, 75 bp, Artificial Sequence
  Synthetic
tcagaactagtactcaaataagttaataaaaatacccacatggggcaaataatcattggaggaaatccaactaat

SEQ ID NO: 312778 - DNA, 75 bp, Artificial Sequence
  Synthetic
tcagcacgccagacaaaatcaaccaatggaaaatacatccataacaatagaattctcaagcaaattctggcctta

SEQ ID NO: 312779 - DNA, 75 bp, Artificial Sequence
  Synthetic
acagatcttagcaaattcaatcaagcatttagatatgaaacatcatgtatctgcagtgatgtattagatgaactg

SEQ ID NO: 312780 - DNA, 75 bp, Artificial Sequence
  Synthetic
tagagagttatataggatcaataaataatataactaaacaatcagcatgtgttgccatgagcaaactcctcactg

SEQ ID NO: 312781 - DNA, 75 bp, Artificial Sequence
  Synthetic
catacctcacccagaatccccagcttggaatcagcttctccaatctgtccgaaaccacatcacaacccaccacca

SEQ ID NO: 312782 - DNA, 75 bp, Artificial Sequence
  Synthetic
aataagctatatttagatatattgaaagtattaaaacacttaaaaactttttttaatcttgatagtatcgatacg

SEQ ID NO: 312783 - DNA, 75 bp, Artificial Sequence
  Synthetic
ggggcaaataaatcatcatggaaaagtttgctcctgaattccatggagaagatgcaaacaacagagccactaaat

SEQ ID NO: 312784 - DNA, 75 bp, Artificial Sequence
  Synthetic
gatctcctatgtgtattggaattaatagacagtagttattggaagtctatgtctaaggtatttttagaacaaaaa

SEQ ID NO: 312785 - DNA, 75 bp, Artificial Sequence
  Synthetic
cacaaaacaacgccaaaacaaaccaccaaacaaacccaacaatgattttcactttgaagtgttcaactttgtacc

SEQ ID NO: 312786 - DNA, 75 bp, Artificial Sequence
  Synthetic
caatagatatagaagtaaccaaagaaagccctataacatcaaattcaaccattataaacccaacaaatgagacag

SEQ ID NO: 312787 - DNA, 75 bp, Artificial Sequence
  Synthetic
aatacagccaaatctaaccaactttacactactacttctcatcaaatatctttagtacacaatagcacatcactt

SEQ ID NO: 312788 - DNA, 75 bp, Artificial Sequence
  Synthetic
acagaaaagccaaccatcaacaccaccaaaacaaacatcagaactacactgctcaccaccaataccacaggaaat

SEQ ID NO: 312789 - DNA, 75 bp, Artificial Sequence
  Synthetic
ctccatctccatccaacacaacaaactagtagtcattaaaaagcgtattattgcaaaaagccatgaccaaatcaa

SEQ ID NO: 312790 - DNA, 75 bp, Artificial Sequence
  Synthetic
tgtgatgctgaattgcctgtaacagtcaactggagtaaaattataatagagtggagcaagcatgtaagaaaatgc

SEQ ID NO: 312791 - DNA, 75 bp, Artificial Sequence
  Synthetic
ccaatctgcacatcaacacacaacaccaacagaagaccaacaaacaaaccaactcacccatccaaccaaacatct

SEQ ID NO: 312792 - DNA, 75 bp, Artificial Sequence
  Synthetic
ctcaaaagaattactgtgacaacctataatcaattcttgacatggaaagatattagccttagtagattaaatgtt

SEQ ID NO: 312793 - DNA, 75 bp, Artificial Sequence
  Synthetic
actccatagtccaaatggagcctgaaaattatagttatttaaaattaaggagagacataagatgaaagatggggc

SEQ ID NO: 312794 - DNA, 75 bp, Artificial Sequence
  Synthetic
tctcacttacactatttaagtagattcctattttatagttatataaaacaattgaataccagattaacttactat

SEQ ID NO: 312795 - DNA, 75 bp, Artificial Sequence
  Synthetic
tctttgtctgcgatgctgaattacctgtcacagccaattggagtaaaattataattgaatggagtaagcatgtaa

SEQ ID NO: 312796 - DNA, 75 bp, Artificial Sequence
  Synthetic
ataaatgataaagctatttcacctcctaaaaatttgatatggactagtttccctagaaattacatgccatcacac

SEQ ID NO: 312797 - DNA, 75 bp, Artificial Sequence
  Synthetic
gatagaattatagatcattcaggcaatacagccaaatccaaccaactttacactactacttcccaccaaatatct

SEQ ID NO: 312798 - DNA, 75 bp, Artificial Sequence
  Synthetic
agtggatgtaacaacacatcgtcaagacattaatgggaaagaaatgaaatttgaagtgttaacattggcaagctt

SEQ ID NO: 312799 - DNA, 75 bp, Artificial Sequence
  Synthetic
tacttaccaccaagcccacagaaaagccaactatcaacaccaccagaacaaacatcggaactacactgctcacca

SEQ ID NO: 312800 - DNA, 75 bp, Artificial Sequence
  Synthetic
cacaagtcaaaaggaaaccctccactcaacctcccccgaaggcaatccaagcccttcacaagtctatacaacatc

SEQ ID NO: 312801 - DNA, 75 bp, Artificial Sequence
  Synthetic
aacaacaccaagtgctgagtcaaccccacaatccacaacagtcaagatcaaaaacacaacaacaacccaaataca

SEQ ID NO: 312802 - DNA, 75 bp, Artificial Sequence
  Synthetic
tttcctctacatcaatgagcagattcacacaaactttccaaccacattcttcactccacaatcacaatcaccaac

SEQ ID NO: 312803 - DNA, 75 bp, Artificial Sequence
  Synthetic
caaaactcatcaggagtttcagatcatcccaagtcattgttcatcagatccagtactcaaataagttaataaaaa

SEQ ID NO: 312804 - DNA, 75 bp, Artificial Sequence
  Synthetic
aaaggaggaagtcttagcatatgtagtacagttaccactgtatggtgtaatagatacaccctgctggaaactgca

SEQ ID NO: 312805 - DNA, 75 bp, Artificial Sequence
  Synthetic
tgtaacattaagcaagaaaaggaaaagaagatttcttggatttttgttaggtgttggatctgcaatcgccagtgg

SEQ ID NO: 312806 - DNA, 75 bp, Artificial Sequence
  Synthetic
acaattaccactatatggtgtaatagatacaccttgttggaaactacacacatcccctctatgtacaaccaacac

SEQ ID NO: 312807 - DNA, 75 bp, Artificial Sequence
  Synthetic
gatcagtcaccaatctgcacatcaacacacaacatcaacagaggaccaacaaacaaaccaactcactcatccaac

SEQ ID NO: 312808 - DNA, 75 bp, Artificial Sequence
  Synthetic
cagtcagtagtagaccatgtgaattccctgcatcaataccagcttatagaactacaaattatcactttgatacta

SEQ ID NO: 312809 - DNA, 75 bp, Artificial Sequence
  Synthetic
atccaaccaaacatctatctgccaatcagccaaccagccaaaaaaacacccagccaatccaaaattaatcacccg

SEQ ID NO: 312810 - DNA, 75 bp, Artificial Sequence
  Synthetic
tcttaaaatttgaacttcatcgcaactttcatctataaaccatctcacttacactatttaagtagactcctattt

SEQ ID NO: 312811 - DNA, 75 bp, Artificial Sequence
  Synthetic
ctttcatctataaaccatctcacttacactatttaagtagactcctattttatagttatataaaacaattgaata

SEQ ID NO: 312812 - DNA, 75 bp, Artificial Sequence
  Synthetic
gtattattgatgatatatacacaatatatatattagtgtcataacactcaatcctaatacttaccacatcatcaa

SEQ ID NO: 312813 - DNA, 75 bp, Artificial Sequence
  Synthetic
actagaggattaaaccaaattatcaacattgaatgacaggttcacatatatcctcaactgcacaccatatctaaa

SEQ ID NO: 312814 - DNA, 75 bp, Artificial Sequence
  Synthetic
tgtataggtaaaaatgttgactcaataatgttaccattgttatctaataagaagcttattaaatcgtctacaatg

SEQ ID NO: 312815 - DNA, 75 bp, Artificial Sequence
  Synthetic
taatgttaccattgttatctaataagaagcttattaaatcgtctacaatgattagaaccaattacagcaaacaag

SEQ ID NO: 312816 - DNA, 75 bp, Artificial Sequence
  Synthetic
aaaatccaaaatcacttccagccactgtctgccagacccagagtgcgaatagataaataaaaccagaatatgggg

SEQ ID NO: 312817 - DNA, 75 bp, Artificial Sequence
  Synthetic
aatagcacctaatcatattcttacaatggttcgctatttgaccatagataacccatctatcattagattatccta

SEQ ID NO: 312818 - DNA, 75 bp, Artificial Sequence
  Synthetic
aactggggcaaatatgtcacgaaggaatccttgcaaattcgaaattcgaggtcattgcttgaatggtaaaaggtg

SEQ ID NO: 312819 - DNA, 75 bp, Artificial Sequence
  Synthetic
ataccaaacaaaaaacctggaaagaaaaccacaaccaagcccacaaaaagaccaaccaccaggacaaccaaaaaa

SEQ ID NO: 312820 - DNA, 75 bp, Artificial Sequence
  Synthetic
caaagggaacactcaccaccaagcctacagaaaagtcaaccatcaacgccaccaaaacaaacatcagaactacaa

SEQ ID NO: 312821 - DNA, 75 bp, Artificial Sequence
  Synthetic
tacagaaaagtcaaccatcaacgccaccaaaacaaacatcagaactacaatgcccatcaacaataccacaggaaa

SEQ ID NO: 312822 - DNA, 75 bp, Artificial Sequence
  Synthetic
accctccactcaacctcctctgagggcaatccaagccctccacaagtctacacaacatccgagtacccatcacaa

SEQ ID NO: 312823 - DNA, 75 bp, Artificial Sequence
  Synthetic
gcaatccaagccctccacaagtctacacaacatccgagtacccatcacaacctccatctccgttcaacacaacag

SEQ ID NO: 312824 - DNA, 75 bp, Artificial Sequence
  Synthetic
tttgtttgtgatgctgaattgcctgtaacagtcaactggagtaaaattataatagagtggagcaagcatgtaaga

SEQ ID NO: 312825 - DNA, 75 bp, Artificial Sequence
  Synthetic
aataatgttatcttgacacaactattcctttatggagattgtatactaaaactatttcacaatgaggggttctac

SEQ ID NO: 312826 - DNA, 75 bp, Artificial Sequence
  Synthetic
aaaccaaccataaaacccacaaacaaaccacccaccaaaaccacaaacaaaagagacccaaaaacaccagccaaa

SEQ ID NO: 312827 - DNA, 75 bp, Artificial Sequence
  Synthetic
aaccacccccgaaaacacacccaactccacacaaacatctacagcatctgagccctccacatcaaattccaccta

SEQ ID NO: 312828 - DNA, 75 bp, Artificial Sequence
  Synthetic
acgagaaaaaaagtgtcaaaaactaatatctcgtaatttagttaatacacatataaaccaattagattagggttt

SEQ ID NO: 312829 - DNA, 75 bp, Artificial Sequence
  Synthetic
atatctcgtaatttagttaatacacatataaaccaattagattagggtttaaatttattcctccaagattaaaat

SEQ ID NO: 312830 - DNA, 75 bp, Artificial Sequence
  Synthetic
atataaaccaattagattagggtttaaatttattcctccaagattaaaatgataactttaggattagttcactaa

SEQ ID NO: 312831 - DNA, 75 bp, Artificial Sequence
  Synthetic
tttaatttttaataactataattgaatacagtgttagtgtatagctatgggaatttttattataagatctttatt

SEQ ID NO: 312832 - DNA, 75 bp, Artificial Sequence
  Synthetic
atacagtgttagtgtatagctatgggaatttttattataagatctttattcattattcattatgaaagttgtata

SEQ ID NO: 312833 - DNA, 75 bp, Artificial Sequence
  Synthetic
aatgatggaattaacacattgctctcaacctaatggcctaatagatgacaattgtgaaattaaattctccaaaaa

SEQ ID NO: 312834 - DNA, 75 bp, Artificial Sequence
  Synthetic
ttttttaagttcattggttgtcaagctgtttaacaattcacttaggtaaggatatgtagattctaccatatataa

SEQ ID NO: 312835 - DNA, 75 bp, Artificial Sequence
  Synthetic
ctgtttaacaattcacttaggtaaggatatgtagattctaccatatataaatggttatagtttagttctgttgat

SEQ ID NO: 312836 - DNA, 75 bp, Artificial Sequence
  Synthetic
attttaagatgttcatatgcttatgatttataagtttattgctgaaaacttcattacgtccagctatagaatatg

SEQ ID NO: 312837 - DNA, 75 bp, Artificial Sequence
  Synthetic
atttataagtttattgctgaaaacttcattacgtccagctatagaatatgatagtatatctccactaacaacact

SEQ ID NO: 312838 - DNA, 75 bp, Artificial Sequence
  Synthetic
attcctttttttgttatagggtaacaaagaaagggtatcaaacttttaatatttgcatcaatagactctttatca

SEQ ID NO: 312839 - DNA, 75 bp, Artificial Sequence
  Synthetic
aaagaaagggtatcaaacttttaatatttgcatcaatagactctttatcagctttcttaggcatgatgaaatttt

SEQ ID NO: 312840 - DNA, 75 bp, Artificial Sequence
  Synthetic
attttgtactacattaaatactgggaatatattcgcaggacctattgtaaggactaagtaaacctccgatccctt

SEQ ID NO: 312841 - DNA, 75 bp, Artificial Sequence
  Synthetic
aatatattcgcaggacctattgtaaggactaagtaaacctccgatccctttaacttactgcctaagcatacataa

SEQ ID NO: 312842 - DNA, 75 bp, Artificial Sequence
  Synthetic
atttgaaatcaatatcatcttgagcatgatattttactattaacatacatttattaactgaggaacagtacttgc

SEQ ID NO: 312843 - DNA, 75 bp, Artificial Sequence
  Synthetic
atgatattttactattaacatacatttattaactgaggaacagtacttgcactttcttacatgcttgctccattc

SEQ ID NO: 312844 - DNA, 75 bp, Artificial Sequence
  Synthetic
gttacagacaattcggcatcacagacaaaaagactgataggttcagcaaactttatatgtaaataagaccaatga

SEQ ID NO: 312845 - DNA, 75 bp, Artificial Sequence
  Synthetic
taagagtgtacaatactgtcatatcatatattgaaagcaacaggaaaaacaataaacaaactatccatctgttaa

SEQ ID NO: 312846 - DNA, 75 bp, Artificial Sequence
  Synthetic
atcaacaacatcaataaaacagacaccaatccattgaatcaacctccagaccaaaaaaacaaacatccatcaaca

SEQ ID NO: 312847 - DNA, 75 bp, Artificial Sequence
  Synthetic
caaaaagactgataggttcagcaaactttatatgtaaataagaccaatgaatgttgttggttgcatctgtagcag

SEQ ID NO: 312848 - DNA, 75 bp, Artificial Sequence
  Synthetic
aatgttgatatgtccattgtacagccttaaaaactcaataggtaaactatgatcattgcaatctttcagacttct

SEQ ID NO: 312849 - DNA, 75 bp, Artificial Sequence
  Synthetic
cttaaaaactcaataggtaaactatgatcattgcaatctttcagacttctgtaaatatatcttatgtcaggatga

SEQ ID NO: 312850 - DNA, 75 bp, Artificial Sequence
  Synthetic
aattccctgctccttcacctatgaatgctatacaattgggatctttaattttaagatcttttaaaatatactcta

SEQ ID NO: 312851 - DNA, 75 bp, Artificial Sequence
  Synthetic
aaaaagaaaccaccatcaacccaacaaaaaaaccaacccccaagaccacagaaagagacaccagcaccccacaat

SEQ ID NO: 312852 - DNA, 75 bp, Artificial Sequence
  Synthetic
tgctatacaattgggatctttaattttaagatcttttaaaatatactctatactaattttacaacctgtagaact

SEQ ID NO: 312853 - DNA, 75 bp, Artificial Sequence
  Synthetic
atgagacagatgatactgcagggaacaagcccaattatcaaagaaagcctctagtaagtttcaaagaagacccta

SEQ ID NO: 312854 - DNA, 75 bp, Artificial Sequence
  Synthetic
tgatgccaaggaagcatgcagtaaagtgatgtgctattgtgcactaaagatatttggtgggaagtagtagtgtaa

SEQ ID NO: 312855 - DNA, 75 bp, Artificial Sequence
  Synthetic
gtgatgtgctattgtgcactaaagatatttggtgggaagtagtagtgtaaagttggttggatttggctgtattgc

SEQ ID NO: 312856 - DNA, 75 bp, Artificial Sequence
  Synthetic
tatgtgtattggaattaatagacagtagttattggaaatctatgtctaaggtatttttagaacaaaaagttatca

SEQ ID NO: 312857 - DNA, 75 bp, Artificial Sequence
  Synthetic
cacaaccatagggaataaattatacaaatcttgtttgctgtaattggttctaatcattgcagacgatttaataag

SEQ ID NO: 312858 - DNA, 75 bp, Artificial Sequence
  Synthetic
aaatcttgtttgctgtaattggttctaatcattgcagacgatttaataagcttcttattagataacaatggtaac

SEQ ID NO: 312859 - DNA, 75 bp, Artificial Sequence
  Synthetic
tgagattagaggtcattgcttgaatggtagaagatgtcactacagtcataattactttgaatggcctcctcatgc

SEQ ID NO: 312860 - DNA, 75 bp, Artificial Sequence
  Synthetic
tacaatagtcattcagtgtctttttgtcattacttttaatcggattggctagtatattctctagggtttctggtg

SEQ ID NO: 312861 - DNA, 75 bp, Artificial Sequence
  Synthetic
gtcattacttttaatcggattggctagtatattctctagggtttctggtgtaggatgatataatttgttgtaatt

SEQ ID NO: 312862 - DNA, 75 bp, Artificial Sequence
  Synthetic
aggaactcttgggttaacatatgagaaggccaaaaaattatttccacaatatttaagtgttaactatttgcatcg

SEQ ID NO: 312863 - DNA, 75 bp, Artificial Sequence
  Synthetic
cttatatatttagttaatagatgagtattatctgagaagttataattaatgtagaagagattagaagtataaaat

SEQ ID NO: 312864 - DNA, 75 bp, Artificial Sequence
  Synthetic
tattatctgagaagttataattaatgtagaagagattagaagtataaaattcatcattgaatttgtgtttatttt

SEQ ID NO: 312865 - DNA, 75 bp, Artificial Sequence
  Synthetic
caatcccattctaacaagatctatataagttaatattgctttcatatgtgttggatgataatctatgttaacaac

SEQ ID NO: 312866 - DNA, 75 bp, Artificial Sequence
  Synthetic
taagttaatattgctttcatatgtgttggatgataatctatgttaacaacccaagggcaaactgtgaattctgct

SEQ ID NO: 312867 - DNA, 75 bp, Artificial Sequence
  Synthetic
atttgaagctatgacatccttttactctatgtaaacttgcatcttggctaagaatgtatttgataactttttgtt

SEQ ID NO: 312868 - DNA, 75 bp, Artificial Sequence
  Synthetic
tctatgtaaacttgcatcttggctaagaatgtatttgataactttttgttctaaaaataccttagacatagactt

SEQ ID NO: 312869 - DNA, 75 bp, Artificial Sequence
  Synthetic
aatacacatagaagatctgaagtgttcatatcacactccagctttgctttgccataacctttatgaaaacacaag

SEQ ID NO: 312870 - DNA, 75 bp, Artificial Sequence
  Synthetic
tcatatcacactccagctttgctttgccataacctttatgaaaacacaagagataggtcttataagcattgaaga

SEQ ID NO: 312871 - DNA, 75 bp, Artificial Sequence
  Synthetic
taaaccaaaaaaatggggcaaataagaatttgataagtaccacttaaatttaactcctttggttagagatgggca

SEQ ID NO: 312872 - DNA, 75 bp, Artificial Sequence
  Synthetic
atcagttatatatccctctccccaatctttttcaaaaatacctttagaatctttcataagttgtataatcagaat

SEQ ID NO: 312873 - DNA, 75 bp, Artificial Sequence
  Synthetic
tctttttcaaaaatacctttagaatctttcataagttgtataatcagaatccaatgtccagctaaattagtactt

SEQ ID NO: 312874 - DNA, 75 bp, Artificial Sequence
  Synthetic
cagatattttatgtgccaatattaaattagaattaacatgagatccagatttgagtgttttattacttaagaata

SEQ ID NO: 312875 - DNA, 75 bp, Artificial Sequence
  Synthetic
attagaattaacatgagatccagatttgagtgttttattacttaagaataattccacatattgagtcaaacttat

SEQ ID NO: 312876 - DNA, 75 bp, Artificial Sequence
  Synthetic
ttttgtatcacttgttttaacttgtgaatatcaacatcacctgtgaatatgggaggtttcatcaaatgtatctca

SEQ ID NO: 312877 - DNA, 75 bp, Artificial Sequence
  Synthetic
gaatatcaacatcacctgtgaatatgggaggtttcatcaaatgtatctcattaagcttaggtatgagaataattc

SEQ ID NO: 312878 - DNA, 75 bp, Artificial Sequence
  Synthetic
ttctactactgacattaaactaaggccaaagcttatacagttttggaatactatgtcaatatcttcatcaccata

SEQ ID NO: 312879 - DNA, 75 bp, Artificial Sequence
  Synthetic
ccaaagcttatacagttttggaatactatgtcaatatcttcatcaccatacttttctgttaatatgcgattaata

SEQ ID NO: 312880 - DNA, 75 bp, Artificial Sequence
  Synthetic
caaacaaaccacccaccaaaaccacaaacaaaagaaacccaaaaacaccagccaaaccaccgaaaaaagaaacca

SEQ ID NO: 312881 - DNA, 75 bp, Artificial Sequence
  Synthetic
ccccaagaccacagaaagatacaccagcacttcacaatccactatgctcgacacaaccacatcaagacacacaat

SEQ ID NO: 312882 - DNA, 75 bp, Artificial Sequence
  Synthetic
ttgttctataagctggtattgatgcagggaattcacatggtctactactgactgtaaggcgatgcaaataattga

SEQ ID NO: 312883 - DNA, 75 bp, Artificial Sequence
  Synthetic
agcacttcacaatccactatgctcgacacaaccacatcaagacacacaatccaacagcaatccctccactcaacc

SEQ ID NO: 312884 - DNA, 75 bp, Artificial Sequence
  Synthetic
agggaattcacatggtctactactgactgtaaggcgatgcaaataattgacacttaaatattgtggaaataattt

SEQ ID NO: 312885 - DNA, 75 bp, Artificial Sequence
  Synthetic
gtgttcccctctgatgaatttgatgcatcaatatctcaagtcaatgagaagattaatcagagtctagcatttatc

SEQ ID NO: 312886 - DNA, 75 bp, Artificial Sequence
  Synthetic
agggttcctatgctgagttcttccatgaattcatccttgttatctatagatgcatacacccaatccaattttgct

SEQ ID NO: 312887 - DNA, 75 bp, Artificial Sequence
  Synthetic
tgaattcatccttgttatctatagatgcatacacccaatccaattttgctaatagatctatttgatctctctgtt

SEQ ID NO: 312888 - DNA, 75 bp, Artificial Sequence
  Synthetic
aactggcattgtttttttctcttgtgtagatgaaccaacccatggtttagtgggtcctctctcaccacgtgttaa

SEQ ID NO: 312889 - DNA, 75 bp, Artificial Sequence
  Synthetic
gtagatgaaccaacccatggtttagtgggtcctctctcaccacgtgttaaactgttaacattatatttctctata

SEQ ID NO: 312890 - DNA, 75 bp, Artificial Sequence
  Synthetic
acggttgtgattgataaaattatagatcattcaggtaatacagccaaatctaaccaactttacactactacttct

SEQ ID NO: 312891 - DNA, 75 bp, Artificial Sequence
  Synthetic
tagtatatttgatgtccattgtatacatgatactgggtgatgtaacaccaactatattggataaagaccaagatc

SEQ ID NO: 312892 - DNA, 75 bp, Artificial Sequence
  Synthetic
catgatactgggtgatgtaacaccaactatattggataaagaccaagatctttccctaacatatttgcttaattc

SEQ ID NO: 312893 - DNA, 75 bp, Artificial Sequence
  Synthetic
aatatctctcttttatctctgttacaatccaatggaagtatccttataagcaaagttatgtttttcctcatcatc

SEQ ID NO: 312894 - DNA, 75 bp, Artificial Sequence
  Synthetic
aaatcaagaagagtattagagtactatttaagagataacaaattcaatgaatgtgatttatacaactgtgtagtt

SEQ ID NO: 312895 - DNA, 75 bp, Artificial Sequence
  Synthetic
aatccaatggaagtatccttataagcaaagttatgtttttcctcatcatctcagtggctctatcaatatctgtta

SEQ ID NO: 312896 - DNA, 75 bp, Artificial Sequence
  Synthetic
caatcttctcacagagtcatggtatcacaaaaccatgccaaccatcatggtagcatagagtagttatttaaaaat

SEQ ID NO: 312897 - DNA, 75 bp, Artificial Sequence
  Synthetic
tatgttagttatagattttgtacctgatataagatttactattttctctgctttataaaagggtaaactttcata

SEQ ID NO: 312898 - DNA, 75 bp, Artificial Sequence
  Synthetic
gatataagatttactattttctctgctttataaaagggtaaactttcataaacaactcttagcccatgaggatat

SEQ ID NO: 312899 - DNA, 75 bp, Artificial Sequence
  Synthetic
catttagatctatctctgtagtagtataatgttgtgcacttttggagaatattttgtttggagctgtactcaaaa

SEQ ID NO: 312900 - DNA, 75 bp, Artificial Sequence
  Synthetic
ataatgttgtgcacttttggagaatattttgtttggagctgtactcaaaacctctgtaactgccagtctattgat

SEQ ID NO: 312901 - DNA, 75 bp, Artificial Sequence
  Synthetic
ataaactcacctaatcagtcaaaccatgagcactacaaatgacaacactactatgcaaagattgatgatcacaga

SEQ ID NO: 312902 - DNA, 75 bp, Artificial Sequence
  Synthetic
tcagaccctaaagcttgaggatctctcatcaatgttacgaattcagcattagggtttttgtcaaacgtgattatg

SEQ ID NO: 312903 - DNA, 75 bp, Artificial Sequence
  Synthetic
tcatcaatgttacgaattcagcattagggtttttgtcaaacgtgattatgcatgttaagaacttattcaatctat

SEQ ID NO: 312904 - DNA, 75 bp, Artificial Sequence
  Synthetic
aaacactagccaaaacaccgaaaaaagaaaccaccattaacccaacaaaaaaaccaacccccaagaccacagaaa

SEQ ID NO: 312905 - DNA, 75 bp, Artificial Sequence
  Synthetic
ttttaagtcatggtttgtataataactaagtatgaacacagagtgaactatagcctctgtgaggaagtcaggagt

SEQ ID NO: 312906 - DNA, 75 bp, Artificial Sequence
  Synthetic
cacacagaaagagacaccagcacctcacaatccattgcgcttgacacaaccacatcaaaacacacaatccaacag

SEQ ID NO: 312907 - DNA, 75 bp, Artificial Sequence
  Synthetic
tctgccgattagccaaccagccaaaaaacaaccagccaatctaaaactagccacccggaaaaaaatcgatactat

SEQ ID NO: 312908 - DNA, 75 bp, Artificial Sequence
  Synthetic
ctaagtatgaacacagagtgaactatagcctctgtgaggaagtcaggagttcttctatagaaacttcgatataac

SEQ ID NO: 312909 - DNA, 75 bp, Artificial Sequence
  Synthetic
acatgggtaaattcatatacaatgttaatgctgtatcaatattatcaagattaaaaaaggtttttaagtgtttca

SEQ ID NO: 312910 - DNA, 75 bp, Artificial Sequence
  Synthetic
taatgctgtatcaatattatcaagattaaaaaaggtttttaagtgtttcagaacctttaatatgtccaaatatag

SEQ ID NO: 312911 - DNA, 75 bp, Artificial Sequence
  Synthetic
tttaattgtagagcaatctgattatataaccatacatttctaaatattaaactgcataatagactttcacctcta

SEQ ID NO: 312912 - DNA, 75 bp, Artificial Sequence
  Synthetic
ataaccatacatttctaaatattaaactgcataatagactttcacctctatattctaattcttgtgtcaaactac

SEQ ID NO: 312913 - DNA, 75 bp, Artificial Sequence
  Synthetic
aatattgcattcagcaaatagacaaaaaaccacctgatcatgtttcaacaacaatccgctgaccaccaatcccaa

SEQ ID NO: 312914 - DNA, 75 bp, Artificial Sequence
  Synthetic
atcatcaagtatagtgtttatccacggtcccactcttaggactttctttatactagctgggtaatatacaccgtt

SEQ ID NO: 312915 - DNA, 75 bp, Artificial Sequence
  Synthetic
ggtcccactcttaggactttctttatactagctgggtaatatacaccgttatgttgaattgttttactcataaat

SEQ ID NO: 312916 - DNA, 75 bp, Artificial Sequence
  Synthetic
cagttccttttaatttgtggcctatgcctgcatactctttatacagtaatttaaggctatttaatgctagcaaat

SEQ ID NO: 312917 - DNA, 75 bp, Artificial Sequence
  Synthetic
gcctgcatactctttatacagtaatttaaggctatttaatgctagcaaataatctgcttgagcatgagtttgacc

SEQ ID NO: 312918 - DNA, 75 bp, Artificial Sequence
  Synthetic
atatctattgattgattgtcaccattaattaaagcagtaattgagaatttccctttgagagatattagatccaat

SEQ ID NO: 312919 - DNA, 75 bp, Artificial Sequence
  Synthetic
ggcaccgcaggaaatccagaacacacaagtcaagaggaaaccctccactcgaccacctccgaaggcaatctaggc

SEQ ID NO: 312920 - DNA, 75 bp, Artificial Sequence
  Synthetic
taattaaagcagtaattgagaatttccctttgagagatattagatccaatagtgatatagcttctatggtccata

SEQ ID NO: 312921 - DNA, 75 bp, Artificial Sequence
  Synthetic
acccatgtgatatctatataatccactttgttcatctacattgttaagatctacaatatgatctcctatataggg

SEQ ID NO: 312922 - DNA, 75 bp, Artificial Sequence
  Synthetic
ctttgttcatctacattgttaagatctacaatatgatctcctatataggggggtgcatgcctatatgtgcatatt

SEQ ID NO: 312923 - DNA, 75 bp, Artificial Sequence
  Synthetic
gtaaccaggaaaatagagattgtacaccatgcagttcatccagcacatcactacaaatacatgacgtttcatatc

SEQ ID NO: 312924 - DNA, 75 bp, Artificial Sequence
  Synthetic
accatgcagttcatccagcacatcactacaaatacatgacgtttcatatcgaaatgcttgattgaatttgctgag

SEQ ID NO: 312925 - DNA, 75 bp, Artificial Sequence
  Synthetic
atgtaattgttgtaattatcattgtagcgatttgatttgttacttattcctgctttcaattctaatattttttgt

SEQ ID NO: 312926 - DNA, 75 bp, Artificial Sequence
  Synthetic
agcgatttgatttgttacttattcctgctttcaattctaatattttttgtagttctagatcaccatatcttgtaa

SEQ ID NO: 312927 - DNA, 75 bp, Artificial Sequence
  Synthetic
gttttcagctatcattttctctgccaatatttgaacctgtctgaacattcccggttgcattgcaaacattctacc

SEQ ID NO: 312928 - DNA, 75 bp, Artificial Sequence
  Synthetic
aatatttgaacctgtctgaacattcccggttgcattgcaaacattctacctacactgagttctctttctttgcct

SEQ ID NO: 312929 - DNA, 75 bp, Artificial Sequence
  Synthetic
tgttgagataactttgattaactacacagttgtataaatcacattcattgaatttgttatctcttaaataatact

SEQ ID NO: 312930 - DNA, 75 bp, Artificial Sequence
  Synthetic
acagttgtataaatcacattcattgaatttgttatctcttaaataatactctaatactcttcttgatttatcact

SEQ ID NO: 312931 - DNA, 75 bp, Artificial Sequence
  Synthetic
acaaagaaacaatagaaacatttgataacaatgaagaagaatctagctactcatatgaagaaataaatgatcaaa

SEQ ID NO: 312932 - DNA, 75 bp, Artificial Sequence
  Synthetic
tctatatagttttgtatgtgtgatggcatgtaatttctagggaaactagtccatatcaaatttttaggaggtgat

SEQ ID NO: 312933 - DNA, 75 bp, Artificial Sequence
  Synthetic
gcatgtaatttctagggaaactagtccatatcaaatttttaggaggtgatatagctttatcatttataatcattt

SEQ ID NO: 312934 - DNA, 75 bp, Artificial Sequence
  Synthetic
aacttaattagtagacaaagcccactactagagcatatgaatcttaaaaaactaactataacacagtcattaata

SEQ ID NO: 312935 - DNA, 75 bp, Artificial Sequence
  Synthetic
aaactcacgatagaaacgtagtcctgataacacaatcaaatctctttctgtaagttccaacaaagaaggataagt

SEQ ID NO: 312936 - DNA, 75 bp, Artificial Sequence
  Synthetic
gataacacaatcaaatctctttctgtaagttccaacaaagaaggataagtgtttagtttatagtaagttaaccat

SEQ ID NO: 312937 - DNA, 75 bp, Artificial Sequence
  Synthetic
gtgaattatattttttgttcagaatatttggacaccctatggtagatgaaagacaagccatggatgctgttaaag

SEQ ID NO: 312938 - DNA, 75 bp, Artificial Sequence
  Synthetic
ttaaagtaggccatctgttgtaattatttacaaacccttttataattctatatataaaggcacctcttaacatac

SEQ ID NO: 312939 - DNA, 75 bp, Artificial Sequence
  Synthetic
atttacaaacccttttataattctatatataaaggcacctcttaacatactcagactgcttaacaagtaaaattt

SEQ ID NO: 312940 - DNA, 75 bp, Artificial Sequence
  Synthetic
gcatccatggcttgtctttcatctaccattgggtgtccaaatattctgaacaaaaaatatagttcactcagattg

SEQ ID NO: 312941 - DNA, 75 bp, Artificial Sequence
  Synthetic
ccattgggtgtccaaatattctgaacaaaaaatatagttcactcagattgttaaggttattgtcacctgcaagct

SEQ ID NO: 312942 - DNA, 75 bp, Artificial Sequence
  Synthetic
tagaattatccatctgccatttattatattatcggacactgtcttatctaataatgtatgacatactcttgatag

SEQ ID NO: 312943 - DNA, 75 bp, Artificial Sequence
  Synthetic
atattatcggacactgtcttatctaataatgtatgacatactcttgatagcagatttttctgagctttattagca

SEQ ID NO: 312944 - DNA, 75 bp, Artificial Sequence
  Synthetic
tattataaaatcgttttctgaattgatcttcttctgttatatttaaaattagagacataataaatccctctacct

SEQ ID NO: 312945 - DNA, 75 bp, Artificial Sequence
  Synthetic
atcttcttctgttatatttaaaattagagacataataaatccctctacctcttttattatgtagaacccctcatt

SEQ ID NO: 312946 - DNA, 75 bp, Artificial Sequence
  Synthetic
ccataaaggaatagttgtgtcaagataacattattgaatccgcatcttaagcctaagcttttatttaatgtgttc

SEQ ID NO: 312947 - DNA, 75 bp, Artificial Sequence
  Synthetic
taacattattgaatccgcatcttaagcctaagcttttatttaatgtgttcaagcagttactaatccatgtaatta

SEQ ID NO: 312948 - DNA, 75 bp, Artificial Sequence
  Synthetic
aatatctttccatgtcaagaattgattataggttgtcacagtaattcttttgagttccttatgataaactataca

SEQ ID NO: 312949 - DNA, 75 bp, Artificial Sequence
  Synthetic
ttataggttgtcacagtaattcttttgagttccttatgataaactatacaaccatattggttcaaaataaattga

SEQ ID NO: 312950 - DNA, 75 bp, Artificial Sequence
  Synthetic
ggaaaaagagagcatatattatgtgactacaaattggaagcatacagctacacgtttttcaatcaaaccactaga

SEQ ID NO: 312951 - DNA, 75 bp, Artificial Sequence
  Synthetic
tcaatgtaaacccatggttttttacctcatttgatcgatactgtgttaatatgttgtttaattttgtgtataagt

SEQ ID NO: 312952 - DNA, 75 bp, Artificial Sequence
  Synthetic
ctcatttgatcgatactgtgttaatatgttgtttaattttgtgtataagttaaaccaatgtattaaccatgatgg

SEQ ID NO: 312953 - DNA, 75 bp, Artificial Sequence
  Synthetic
acaacataacaaaacaatcagcatgtgttgctatgagtaaacttcttattgagatcaatagtgatgacattaaaa

SEQ ID NO: 312954 - DNA, 75 bp, Artificial Sequence
  Synthetic
ttcttcaagagtgttgttttgattgtgtctttttgttttgtagagtgatttttgtctgctttaagatgagattga

SEQ ID NO: 312955 - DNA, 75 bp, Artificial Sequence
  Synthetic
tgtctttttgttttgtagagtgatttttgtctgctttaagatgagattgattatctttaacagctgaaagtatat

SEQ ID NO: 312956 - DNA, 75 bp, Artificial Sequence
  Synthetic
tgagttgtcttcatcttgtccattgttggatttaatcttgtccttttctttaagccctagtttattcaatatagc

SEQ ID NO: 312957 - DNA, 75 bp, Artificial Sequence
  Synthetic
ttggatttaatcttgtccttttctttaagccctagtttattcaatatagcatagactttgacatcacttatttct

SEQ ID NO: 312958 - DNA, 75 bp, Artificial Sequence
  Synthetic
gtaaattagtggtagcaatctgttctgacgaggtcatactcttgtatgtcataagtaatgactgaaaataagtag

SEQ ID NO: 312959 - DNA, 75 bp, Artificial Sequence
  Synthetic
tgacgaggtcatactcttgtatgtcataagtaatgactgaaaataagtaggttcttctaattttatttcaccttt

SEQ ID NO: 312960 - DNA, 75 bp, Artificial Sequence
  Synthetic
gttatatttagtttctttagattcatgtgttctattaatggattttgtctactaattaagttggtataatcattt

SEQ ID NO: 312961 - DNA, 75 bp, Artificial Sequence
  Synthetic
tgtgttctattaatggattttgtctactaattaagttggtataatcatttttgagataaggaccattgaatatgt

SEQ ID NO: 312962 - DNA, 75 bp, Artificial Sequence
  Synthetic
gaaagagataacaccttttaaataactatcggttagataaacattagcagaatttccattaataatgggatccat

SEQ ID NO: 312963 - DNA, 75 bp, Artificial Sequence
  Synthetic
ctatcggttagataaacattagcagaatttccattaataatgggatccattttgtcccacaacttgaattgtttg

SEQ ID NO: 312964 - DNA, 75 bp, Artificial Sequence
  Synthetic
gtgttagaattgagtgttatgacactaatatatatattgtatatatatcctcaataatacctagatgttgtagaa

SEQ ID NO: 312965 - DNA, 75 bp, Artificial Sequence
  Synthetic
taatatatatattgtatatatatcctcaataatacctagatgttgtagaaaattttgaattgtgtcaatcaattc

SEQ ID NO: 312966 - DNA, 75 bp, Artificial Sequence
  Synthetic
aatgtttgattcggtgagtacatatggttatttgggttgttttgattgaaatatagtgtgttcttttgattatac

SEQ ID NO: 312967 - DNA, 75 bp, Artificial Sequence
  Synthetic
cctacaaccacatcaccaatccacacaaattcagctacaatatcaccaaatacaaaatcagaaacacaccataca

SEQ ID NO: 312968 - DNA, 75 bp, Artificial Sequence
  Synthetic
cctcacctctccacaaaaccacatcaacatcccaccatgcgagccatcatccatactacaaagtagttaattaaa

SEQ ID NO: 312969 - DNA, 75 bp, Artificial Sequence
  Synthetic
ggttatttgggttgttttgattgaaatatagtgtgttcttttgattatacatagtaactctacatctacttgtta

SEQ ID NO: 312970 - DNA, 75 bp, Artificial Sequence
  Synthetic
atatttgtcaggtagtatcattatttttggcatggtcatttgtatcactaacagttgattcttttgggttgttga

SEQ ID NO: 312971 - DNA, 75 bp, Artificial Sequence
  Synthetic
tttggcatggtcatttgtatcactaacagttgattcttttgggttgttgatggttatgctcttatggatatccaa

SEQ ID NO: 312972 - DNA, 75 bp, Artificial Sequence
  Synthetic
acgtctgctggcaatctttttaacagatggatagtttgtttattgtttttcctgttgctttcaatatatgatatg

SEQ ID NO: 312973 - DNA, 75 bp, Artificial Sequence
  Synthetic
aaaaccaaccatcaaacccacaaacaaaccaaccatcaaaaccacaaacaaaagagacccaaaaacaccagccaa

SEQ ID NO: 312974 - DNA, 75 bp, Artificial Sequence
  Synthetic
gatggatagtttgtttattgtttttcctgttgctttcaatatatgatatgacagtattgtacactcttatcttgg

SEQ ID NO: 312975 - DNA, 75 bp, Artificial Sequence
  Synthetic
cagctttttgatatcatcactattgagttcagtgaggagtttgctcatggcaacacatgctgattgtttagttat

SEQ ID NO: 312976 - DNA, 75 bp, Artificial Sequence
  Synthetic
agttcagtgaggagtttgctcatggcaacacatgctgattgtttagttatattgtttattgatcctatataactc

SEQ ID NO: 312977 - DNA, 75 bp, Artificial Sequence
  Synthetic
agcaatccctccactcaaccacctccgaaaacacacccaactccacacaaatacccacagcatccgagccctcca

SEQ ID NO: 312978 - DNA, 75 bp, Artificial Sequence
  Synthetic
cgaaaacacacccaactccacacaaatacccacagcatccgagccctccacatcaaattctacttaaaaaaccta

SEQ ID NO: 312979 - DNA, 75 bp, Artificial Sequence
  Synthetic
catactcttctgttctgtccaactctgcagctccacttatttctgataaggtatctatacttttatccatagact

SEQ ID NO: 312980 - DNA, 75 bp, Artificial Sequence
  Synthetic
tgcagctccacttatttctgataaggtatctatacttttatccatagacttaagtattctgtttaacataaagtt

SEQ ID NO: 312981 - DNA, 75 bp, Artificial Sequence
  Synthetic
gtcacatgcttagttattcaaaaactacatcttagcagagaaccgtgatctatcaagcaagaacgaaattaaatc

SEQ ID NO: 312982 - DNA, 75 bp, Artificial Sequence
  Synthetic
ggccattcaaaataattatgactaaaatgacacctcttaccatttaagcaatgacctcgaatttcaaatttgcaa

SEQ ID NO: 312983 - DNA, 75 bp, Artificial Sequence
  Synthetic
aatgacacctcttaccatttaagcaatgacctcgaatttcaaatttgcaaggattccttcgtgacatatttgccc

SEQ ID NO: 312984 - DNA, 75 bp, Artificial Sequence
  Synthetic
gttaatctggcattcaattgtgttttatataactataaactaggaatctacttaaatagtgtaagtgagatggtt

SEQ ID NO: 312985 - DNA, 75 bp, Artificial Sequence
  Synthetic
acccttcactcaacctcctccgaaggcaatccaagcccttcacaagtctatacaacatccgagtacctatcacaa

SEQ ID NO: 312986 - DNA, 75 bp, Artificial Sequence
  Synthetic
tatataactataaactaggaatctacttaaatagtgtaagtgagatggtttatagatgagagtttcgatgaagtt

SEQ ID NO: 312987 - DNA, 75 bp, Artificial Sequence
  Synthetic
gatgggttgtctatgagcagatagtaaaccattgtaagaacatgattaggtgctatttttatttagttactaaat

SEQ ID NO: 312988 - DNA, 75 bp, Artificial Sequence
  Synthetic
aaaccattgtaagaacatgattaggtgctatttttatttagttactaaatgcaatattatttataccactcagtt

SEQ ID NO: 312989 - DNA, 75 bp, Artificial Sequence
  Synthetic
gcttccagtcaaaacatcactgaagaattttatcaatcaacatgcagtgcagttagcaaaggctatcttagtgct

SEQ ID NO: 312990 - DNA, 75 bp, Artificial Sequence
  Synthetic
gcttctggccttacagtataagagcagtccaacagcaattaatgataacaatattactataatcactataattat

SEQ ID NO: 312991 - DNA, 75 bp, Artificial Sequence
  Synthetic
agtccaacagcaattaatgataacaatattactataatcactataattatagtagttatcatgatatttatggtg

SEQ ID NO: 312992 - DNA, 75 bp, Artificial Sequence
  Synthetic
tttttaataacttctagtgaactaatcctaaaattatcattttgatctaggaagaataagtttaaatccaaatct

SEQ ID NO: 312993 - DNA, 75 bp, Artificial Sequence
  Synthetic
ataattcatcggatttacgaataaatgctaggctctggttaatcttctcgttgacttgagatattgatgcatcaa

SEQ ID NO: 312994 - DNA, 75 bp, Artificial Sequence
  Synthetic
gaaagtgaaaagatggcaaaagacacatcagatgaagtgtctctcaatccaacatcagagaaattgaacaacctg

SEQ ID NO: 312995 - DNA, 75 bp, Artificial Sequence
  Synthetic
tgctaggctctggttaatcttctcgttgacttgagatattgatgcatcaaattcatcagaggggaatactaatgg

SEQ ID NO: 312996 - DNA, 75 bp, Artificial Sequence
  Synthetic
ttggaagggaatgatagtgacaatgatctatcacttgaagatttctgatcagttaccaatctgcacatcaacaca

SEQ ID NO: 312997 - DNA, 75 bp, Artificial Sequence
  Synthetic
ccttttacatagagacttttaccttcttgcttatttacataatataatgtgttacctacagacacagtgtccacc

SEQ ID NO: 312998 - DNA, 75 bp, Artificial Sequence
  Synthetic
cttgcttatttacataatataatgtgttacctacagacacagtgtccacccctttatttgatacataatcgcacc

SEQ ID NO: 312999 - DNA, 75 bp, Artificial Sequence
  Synthetic
acgatttttattggatgctgtacatttagttttgccatagcatgacacaatggctcctagagatgtgataacgga

SEQ ID NO: 313000 - DNA, 75 bp, Artificial Sequence
  Synthetic
ttagttttgccatagcatgacacaatggctcctagagatgtgataacggagctgcttacatctgtttttgaagtc

SEQ ID NO: 313001 - DNA, 75 bp, Artificial Sequence
  Synthetic
tgaatatgtcaacattgcagagatttacttcacttggtaatgttaaactgttcattgtgtcacaaaatactcgat

SEQ ID NO: 313002 - DNA, 75 bp, Artificial Sequence
  Synthetic
tacttcacttggtaatgttaaactgttcattgtgtcacaaaatactcgatttgattgaactttacatgtttcagc

SEQ ID NO: 313003 - DNA, 75 bp, Artificial Sequence
  Synthetic
gcattgtcacagtaccatcctctgtcagttcttgttaaacagatgttggacccttcttttgtgttggttgtacat

SEQ ID NO: 313004 - DNA, 75 bp, Artificial Sequence
  Synthetic
gttatcaaatacattcttagccaggatgcaagtttacatagagtaaaaggatgtcatagcttcaaactatggttt

SEQ ID NO: 313005 - DNA, 75 bp, Artificial Sequence
  Synthetic
cagttcttgttaaacagatgttggacccttcttttgtgttggttgtacatagaggggatgtgtgtagtttccaac

SEQ ID NO: 313006 - DNA, 75 bp, Artificial Sequence
  Synthetic
gctgaccaccaatccctaatcaacttaacaacaaatatttcaacatcatagcacaggctgaatcatttcctcaca

SEQ ID NO: 313007 - DNA, 75 bp, Artificial Sequence
  Synthetic
aaaaattcccacagctacacactaacactgtattcaattatagttatttaaaattaaaaattatataatttttaa

SEQ ID NO: 313008 - DNA, 75 bp, Artificial Sequence
  Synthetic
acttcctcttttattatggacatgatagagtaactttgctgtctaactatttgaacattgttggacattaacttt

SEQ ID NO: 313009 - DNA, 75 bp, Artificial Sequence
  Synthetic
tggtaattgtactacatatgctaagacttcctcttttattatggacatgatagagtaactttgctgtctaactat

SEQ ID NO: 313010 - DNA, 75 bp, Artificial Sequence
  Synthetic
cattgattaatgacaataattcactattagttaacatgtaagtgcttacaggtgtagttacacctgcattaacac

SEQ ID NO: 313011 - DNA, 75 bp, Artificial Sequence
  Synthetic
attagttaacatgtaagtgcttacaggtgtagttacacctgcattaacactaaattccctggtaatctctagtag

SEQ ID NO: 313012 - DNA, 75 bp, Artificial Sequence
  Synthetic
ataaaagtccaaaactaacaattacatatgtgcacctacaacacgacgagacattagtttttgacactttttttc

SEQ ID NO: 313013 - DNA, 75 bp, Artificial Sequence
  Synthetic
atcacagttgctatatttgatatgctgcagctttgcttgttcacaataggtaacaattgtttatctatatagttt

SEQ ID NO: 313014 - DNA, 75 bp, Artificial Sequence
  Synthetic
caaacaatctgaaataataactttatgcacaatcacactccatagtccaaatggagcctgaaaattatagtaatt

SEQ ID NO: 313015 - DNA, 75 bp, Artificial Sequence
  Synthetic
tgcagctttgcttgttcacaataggtaacaattgtttatctatatagtttttgaggtctaacactttgctggtta

SEQ ID NO: 313016 - DNA, 75 bp, Artificial Sequence
  Synthetic
gactacagccttgtttgtggatagtagagcacttttgatcttgttcacttccccttctaggtgcaggaccttaga

SEQ ID NO: 313017 - DNA, 75 bp, Artificial Sequence
  Synthetic
agagcacttttgatcttgttcacttccccttctaggtgcaggaccttagatacagcaacgccactggcgattgca

SEQ ID NO: 313018 - DNA, 75 bp, Artificial Sequence
  Synthetic
gaaatcttcttttccttttcttgcttaatgttacattggtttttttggcattgttgagtgtataattcataaacc

SEQ ID NO: 313019 - DNA, 75 bp, Artificial Sequence
  Synthetic
taatgttacattggtttttttggcattgttgagtgtataattcataaaccttggtagttctcttctggctcgatt

SEQ ID NO: 313020 - DNA, 75 bp, Artificial Sequence
  Synthetic
tgaaggagcagggaatttattattgcgtacagtagtggaacttcatcctgatataagatatatttacagaagtct

SEQ ID NO: 313021 - DNA, 75 bp, Artificial Sequence
  Synthetic
agcaactgcaattctgttacagcatttttatatttatctaattcttgttttatcaattttaccttagcatctgtt

SEQ ID NO: 313022 - DNA, 75 bp, Artificial Sequence
  Synthetic
ttttatatttatctaattcttgttttatcaattttaccttagcatctgttccattacacttattttccttgatat

SEQ ID NO: 313023 - DNA, 75 bp, Artificial Sequence
  Synthetic
accaacagtaccacaggaaatctagaacacacaagtcaagaggaaaccctccattcaacctcctccgaaggcaat

SEQ ID NO: 313024 - DNA, 75 bp, Artificial Sequence
  Synthetic
ggtataccaaccagttctcagagcactaagatagcctttgctaactgcactgcatgttgattgataaaattcttc

SEQ ID NO: 313025 - DNA, 75 bp, Artificial Sequence
  Synthetic
ctaagatagcctttgctaactgcactgcatgttgattgataaaattcttcagtgatgttttgaccagaagcaaaa

SEQ ID NO: 313026 - DNA, 75 bp, Artificial Sequence
  Synthetic
tggtaattgcatttgctttgaggattagcaactccattgttatttgccccagagtttattttgattctgtttaag

SEQ ID NO: 313027 - DNA, 75 bp, Artificial Sequence
  Synthetic
tagcaactccattgttatttgccccagagtttattttgattctgtttaagttggtcatggctttttgtgataata

SEQ ID NO: 313028 - DNA, 75 bp, Artificial Sequence
  Synthetic
tgtgttgggtggagatgaaggttgtgatgggtactcggatgttgtagagacttgagaagggcttggattgccttc

SEQ ID NO: 313029 - DNA, 75 bp, Artificial Sequence
  Synthetic
gatgggtactcggatgttgtagagacttgagaagggcttggattgccttcggaggaagttgagtggaaggtttcc

SEQ ID NO: 313030 - DNA, 75 bp, Artificial Sequence
  Synthetic
ctgtggtgttggaggtgagtagtgtagttatgatgtttgttttggtggtgttgatggttggctcttctgtgggct

SEQ ID NO: 313031 - DNA, 75 bp, Artificial Sequence
  Synthetic
tgagctattatactggtcacgatctacaagataagctccaggatcttccagatgatagactgaacaaattcttga

SEQ ID NO: 313032 - DNA, 75 bp, Artificial Sequence
  Synthetic
agttatgatgtttgttttggtggtgttgatggttggctcttctgtgggcttggtggtgggtacttcctttgattt

SEQ ID NO: 313033 - DNA, 75 bp, Artificial Sequence
  Synthetic
ttggttgtcttgagggttggtttttttgtgggcttggtagtggttttctttcctggttttttgtttggtattctt

SEQ ID NO: 313034 - DNA, 75 bp, Artificial Sequence
  Synthetic
ttgtgggcttggtagtggttttctttcctggttttttgtttggtattcttttgcagatagcccagcaggttggat

SEQ ID NO: 313035 - DNA, 75 bp, Artificial Sequence
  Synthetic
tgagattaatagattagcagtaacagaagtcttaagtatagctccaaacaaaatattttctaaaagtgcgcaaca

SEQ ID NO: 313036 - DNA, 75 bp, Artificial Sequence
  Synthetic
aaagttgaacacttcaaagtgaaaatcattattgggtttgcttggtggtttgttttggcgttgttttgtggtggg

SEQ ID NO: 313037 - DNA, 75 bp, Artificial Sequence
  Synthetic
tcattattgggtttgcttggtggtttgttttggcgttgttttgtggtgggcttgctgggttgtgtttgagttgtt

SEQ ID NO: 313038 - DNA, 75 bp, Artificial Sequence
  Synthetic
taaaattatcattttgatctaggaagaataagtttaaatccaaatctaattggtttatatgtatattaactaaac

SEQ ID NO: 313039 - DNA, 75 bp, Artificial Sequence
  Synthetic
tggattgcagggttgacttgactcctggtgttgttgaagctagtatggtggtgatttgtgatgtaatttcagacg

SEQ ID NO: 313040 - DNA, 75 bp, Artificial Sequence
  Synthetic
agtaccacttaaatttaactcctttggtttgagatgggcagcaattcattgagtatgataaaagttagattacaa

SEQ ID NO: 313041 - DNA, 75 bp, Artificial Sequence
  Synthetic
tggtgttgttgaagctagtatggtggtgatttgtgatgtaatttcagacggattagagggactgattccaagctg

SEQ ID NO: 313042 - DNA, 75 bp, Artificial Sequence
  Synthetic
tatactaaaactatttcacaatgaggggttctacataataaaagaggtagagggatttattatgtctctaatttt

SEQ ID NO: 313043 - DNA, 75 bp, Artificial Sequence
  Synthetic
gttgtgttcttgatctggcttgttgcatcttgtatgattgcagttgttggtgtgactttgtggtttgccgaggct

SEQ ID NO: 313044 - DNA, 75 bp, Artificial Sequence
  Synthetic
catcttgtatgattgcagttgttggtgtgactttgtggtttgccgaggctatgaatatgatggctgcaattataa

SEQ ID NO: 313045 - DNA, 75 bp, Artificial Sequence
  Synthetic
aatggataatgtgatttgtgctacagatttaagatttaacttatataagcacgatgatatgaataataaatgatt

SEQ ID NO: 313046 - DNA, 75 bp, Artificial Sequence
  Synthetic
gatttaagatttaacttatataagcacgatgatatgaataataaatgattgagagtgtcccaggtcctttctaat

SEQ ID NO: 313047 - DNA, 75 bp, Artificial Sequence
  Synthetic
ttttggacatgtttgcatttgccccaatgttattgttagtcttgatatcctagttcattgttatgactattttta

SEQ ID NO: 313048 - DNA, 75 bp, Artificial Sequence
  Synthetic
aatgttattgttagtcttgatatcctagttcattgttatgactatttttaattaactactttatagtatggatag

SEQ ID NO: 313049 - DNA, 75 bp, Artificial Sequence
  Synthetic
aggtgttgtaaagaggtaggggttgttcatttttaaatgcaaggttactgttttgggctgttggattgatgaatg

SEQ ID NO: 313050 - DNA, 75 bp, Artificial Sequence
  Synthetic
ttcatttttaaatgcaaggttactgttttgggctgttggattgatgaatgctatgtgttgactcgagctcttggt

SEQ ID NO: 313051 - DNA, 75 bp, Artificial Sequence
  Synthetic
cgttatattcacaaagtttgtttagtattgcaatcatgatggagattatgattagcaaagagattattgttgtga

SEQ ID NO: 313052 - DNA, 75 bp, Artificial Sequence
  Synthetic
tattgcaatcatgatggagattatgattagcaaagagattattgttgtgatcatgtgtattagtgtaaagtaagg

SEQ ID NO: 313053 - DNA, 75 bp, Artificial Sequence
  Synthetic
gttatggatgtattttccattggttgattctgtatggtgtgtggacttgtctatgttaacagatattgtgattag

SEQ ID NO: 313054 - DNA, 75 bp, Artificial Sequence
  Synthetic
gattctgtatggtgtgtggacttgtctatgttaacagatattgtgattagttggatttcctccaatgattatttg

SEQ ID NO: 313055 - DNA, 75 bp, Artificial Sequence
  Synthetic
ttatttgagtactagatctgataaacaatgacttgggatgatctgggacttcagataagttttgtttgattggtt

SEQ ID NO: 313056 - DNA, 75 bp, Artificial Sequence
  Synthetic
atcatcaagttgaagcaagtgatacaaaaacagcatatgttcctaccagataaaataagtttaacccaatatgta

SEQ ID NO: 313057 - DNA, 75 bp, Artificial Sequence
  Synthetic
caatgacttgggatgatctgggacttcagataagttttgtttgattggttgaaccacagagtgtttgtgattgtg

SEQ ID NO: 313058 - DNA, 75 bp, Artificial Sequence
  Synthetic
aaagtttgtatgaattaacacactgatgtagaggaaaaaggttaatcttccatgggtttgattgcaaatcgtgta

SEQ ID NO: 313059 - DNA, 75 bp, Artificial Sequence
  Synthetic
atgtagaggaaaaaggttaatcttccatgggtttgattgcaaatcgtgtagctgtgtgcttccaatttgtggtaa

SEQ ID NO: 313060 - DNA, 75 bp, Artificial Sequence
  Synthetic
gtaagctccaagatctactatgaattgactttgtggctttatgtatttgaatgctcctttgttgtcagtcactgt

SEQ ID NO: 313061 - DNA, 75 bp, Artificial Sequence
  Synthetic
acagtaccccagaaaccaaagccaactacccaagaaaacccctagtaagcttcaaagaagatctcaccccaagtg

SEQ ID NO: 313062 - DNA, 75 bp, Artificial Sequence
  Synthetic
tgactttgtggctttatgtatttgaatgctcctttgttgtcagtcactgtgatgactaatagtaatcctgagtaa

SEQ ID NO: 313063 - DNA, 75 bp, Artificial Sequence
  Synthetic
actcaaccacccccgaaaacacacccaactccacacaaacacccacagcatccgagccctccacatcaaattcca

SEQ ID NO: 313064 - DNA, 75 bp, Artificial Sequence
  Synthetic
catttttgaattcagtggttgttatattttcaagtgtgttcagatctttatttctgacactgatggatcttaggt

SEQ ID NO: 313065 - DNA, 75 bp, Artificial Sequence
  Synthetic
attttcaagtgtgttcagatctttatttctgacactgatggatcttaggtatgttggtattatgactttttttga

SEQ ID NO: 313066 - DNA, 75 bp, Artificial Sequence
  Synthetic
aaagcaataatatcatgtgtagggttgagtgtcttcatagtgagatctttaactgtagtcaacatattttttgat

SEQ ID NO: 313067 - DNA, 75 bp, Artificial Sequence
  Synthetic
atacaaatatgacctcaacccgtaaattccaacaaaaaactaacccatccaaactaagctattcctcaaacaaca

SEQ ID NO: 313068 - DNA, 75 bp, Artificial Sequence
  Synthetic
tgagtgtcttcatagtgagatctttaactgtagtcaacatattttttgattttaggcatgttagactacatgcct

SEQ ID NO: 313069 - DNA, 75 bp, Artificial Sequence
  Synthetic
atatgctagtttgcttctttcatccaaggacacattagcgcatatggtaaatttgctgggcatttgtgctagcac

SEQ ID NO: 313070 - DNA, 75 bp, Artificial Sequence
  Synthetic
aaggacacattagcgcatatggtaaatttgctgggcatttgtgctagcactgcacttcttgagtttatcatgact

SEQ ID NO: 313071 - DNA, 75 bp, Artificial Sequence
  Synthetic
ccaaaaaattgagtgacttgttggaagacaacgatagcgacaatgatctatcacttgatgatttttgatcagtga

SEQ ID NO: 313072 - DNA, 75 bp, Artificial Sequence
  Synthetic
aagttaataaaaatccacatggggcaaataatcattgagaggaatccaactaaccacaacatctgtcaacataga

SEQ ID NO: 313073 - DNA, 75 bp, Artificial Sequence
  Synthetic
atatttgtttcactagtatgttgacattagctagttcttttataagtaaatctgctggcatagatgattggaaca

SEQ ID NO: 313074 - DNA, 75 bp, Artificial Sequence
  Synthetic
attagctagttcttttataagtaaatctgctggcatagatgattggaacatgggcacccatattgtaagtgatgc

SEQ ID NO: 313075 - DNA, 75 bp, Artificial Sequence
  Synthetic
accaatggaaaatacatccataacaatagaattctcaagcaaattctggccttactttacactaatacacatgat

SEQ ID NO: 313076 - DNA, 75 bp, Artificial Sequence
  Synthetic
ttgtattgaacagcagctgtgtatgtggagccttcgtgaagcttgttcacgtatgtttccatatttgccccaccc

SEQ ID NO: 313077 - DNA, 75 bp, Artificial Sequence
  Synthetic
tggagccttcgtgaagcttgttcacgtatgtttccatatttgccccaccctttcctttttttgtaactatattat

SEQ ID NO: 313078 - DNA, 75 bp, Artificial Sequence
  Synthetic
ggattggctggttgttttgttggctgtttggctgattggcggatggatgtttggttggatgattgggttggttag

SEQ ID NO: 313079 - DNA, 75 bp, Artificial Sequence
  Synthetic
gtttggctgattggcggatggatgtttggttggatgattgggttggttagtttgttggtcttctgttggtattgt

SEQ ID NO: 313080 - DNA, 75 bp, Artificial Sequence
  Synthetic
atcagaaatcttcaagtgatagatcattgtcactatcattcccttccaataggttgttcaatttctctgatgttg

SEQ ID NO: 313081 - DNA, 75 bp, Artificial Sequence
  Synthetic
attgtcactatcattcccttccaataggttgttcaatttctctgatgttggattgagagacacttcatctgatgt

SEQ ID NO: 313082 - DNA, 75 bp, Artificial Sequence
  Synthetic
tacatagtcaatcaagacacaagtttgcatagaataaaaggttgtcatagttttaagttgtggtttttaaaacgc

SEQ ID NO: 313083 - DNA, 75 bp, Artificial Sequence
  Synthetic
tcattcctgagtcttgccatagcttctaatctgtcattggtcattaatgcttcagttctgattttttctatcatt

SEQ ID NO: 313084 - DNA, 75 bp, Artificial Sequence
  Synthetic
aatgaacatatgatagttatatacccctctctgtctgcttgtctctctttctatcattttctctgctaagatttg

SEQ ID NO: 313085 - DNA, 75 bp, Artificial Sequence
  Synthetic
ctaatctgtcattggtcattaatgcttcagttctgattttttctatcatttcttctcttaaaccaaccatggcat

SEQ ID NO: 313086 - DNA, 75 bp, Artificial Sequence
  Synthetic
tggcaatgataatctcaacttcacttataattgcagccatcatattcatagcctcggcaaaccacaaagtcacac

SEQ ID NO: 313087 - DNA, 75 bp, Artificial Sequence
  Synthetic
aggtcctgcacttgccactactaatgtgtgaagcattcctagtatttcacttaatttttcatcaatcctatctaa

SEQ ID NO: 313088 - DNA, 75 bp, Artificial Sequence
  Synthetic
gtgtgaagcattcctagtatttcacttaatttttcatcaatcctatctaatcttgctgttatattatcgtttgtc

SEQ ID NO: 313089 - DNA, 75 bp, Artificial Sequence
  Synthetic
agctggattcttcttcattgttatcaaatgtttctatggtttctttgtatagtttagaaaagggattatcacttg

SEQ ID NO: 313090 - DNA, 75 bp, Artificial Sequence
  Synthetic
aaatgtttctatggtttctttgtatagtttagaaaagggattatcacttggtgtagggtcttctttgaaacttac

SEQ ID NO: 313091 - DNA, 75 bp, Artificial Sequence
  Synthetic
caatccaaactaagctattccttaaacaacagtgatcaacagttaagaaggagctaatccattttagtaattaaa

SEQ ID NO: 313092 - DNA, 75 bp, Artificial Sequence
  Synthetic
ttgttccctgcagtatcatctgtctcatttgttgggttgataatagttgaatttgatgttatagggctttctttg

SEQ ID NO: 313093 - DNA, 75 bp, Artificial Sequence
  Synthetic
catttgttgggttgataatagttgaatttgatgttatagggctttctttggttacttctatatctattgagttga

SEQ ID NO: 313094 - DNA, 75 bp, Artificial Sequence
  Synthetic
aataaaggtaaagccaataacataaattggggcaaatacaaagatggctcttagcaaagtcaagttaaatgatac

SEQ ID NO: 313095 - DNA, 75 bp, Artificial Sequence
  Synthetic
gggatctttgggtgatgtgaatttgccctttattgattctaggaatttagtagccctgttgtttgcatcttctcc

SEQ ID NO: 313096 - DNA, 75 bp, Artificial Sequence
  Synthetic
ccctttattgattctaggaatttagtagccctgttgtttgcatcttctccatggaattcaggagcaaacttttcc

SEQ ID NO: 313097 - DNA, 75 bp, Artificial Sequence
  Synthetic
tattaactcaaagctctacatcattatcttttggattaagctgatgtttgatagcctctagttcttctgctgtca

SEQ ID NO: 313098 - DNA, 75 bp, Artificial Sequence
  Synthetic
atcttttggattaagctgatgtttgatagcctctagttcttctgctgtcaagtctagtacactgtagttaatcac

SEQ ID NO: 313099 - DNA, 75 bp, Artificial Sequence
  Synthetic
gctaccagactgcacatcaaaacacaacaccaacagaaaaccaacaaacaaaccaactcacccatccaaccaaat

SEQ ID NO: 313100 - DNA, 75 bp, Artificial Sequence
  Synthetic
tatgcctttgctgcatcatatagatcttgattcctcggtgtacctctgtactctcccattatgcctaggccagca

SEQ ID NO: 313101 - DNA, 75 bp, Artificial Sequence
  Synthetic
cttgattcctcggtgtacctctgtactctcccattatgcctaggccagcagcattgcctaatactacactggaga

SEQ ID NO: 313102 - DNA, 75 bp, Artificial Sequence
  Synthetic
taatgatgcttttgggttgttcaatatatggtagaatcctgcttcaccacccaatttttgggcatattcataaac

SEQ ID NO: 313103 - DNA, 75 bp, Artificial Sequence
  Synthetic
atatggtagaatcctgcttcaccacccaatttttgggcatattcataaacctcaacaacttgttccatttctgct

SEQ ID NO: 313104 - DNA, 75 bp, Artificial Sequence
  Synthetic
caagtttggtcaaatttagatgctaacacatcattatattatagttattaaaaaatatatatgcaaacttttcaa

SEQ ID NO: 313105 - DNA, 75 bp, Artificial Sequence
  Synthetic
gggcaaataacaatggagttgccaatcctcaaaacaaatgctattaccacaatccttgctgcagtcacactctgt

SEQ ID NO: 313106 - DNA, 75 bp, Artificial Sequence
  Synthetic
aagggaccttcactaagagtcatgataaactcaagaagtgcagtgctagcacaaatgcccagcaaatttaccata

SEQ ID NO: 313107 - DNA, 75 bp, Artificial Sequence
  Synthetic
tatttttaattgattttgctaagactccccaccgtaacatcacttgccctgcaccataggcattcataaacaatc

SEQ ID NO: 313108 - DNA, 75 bp, Artificial Sequence
  Synthetic
tccccaccgtaacatcacttgccctgcaccataggcattcataaacaatcctgcaaaaatcccttcaactctact

SEQ ID NO: 313109 - DNA, 75 bp, Artificial Sequence
  Synthetic
cacaaaaccatgccaactatcatggtagcatagagtagttatttaaaaattaacataatgatgaattattagtat

SEQ ID NO: 313110 - DNA, 75 bp, Artificial Sequence
  Synthetic
ataccaaaatgaacaaaaacatctataaagtggggatgtttttcaaacacttcatagaagctgttggctatgtcc

SEQ ID NO: 313111 - DNA, 75 bp, Artificial Sequence
  Synthetic
taaagtggggatgtttttcaaacacttcatagaagctgttggctatgtccttgggtagtaagcctttgtaacgtt

SEQ ID NO: 313112 - DNA, 75 bp, Artificial Sequence
  Synthetic
agctctcctaatcacggctgtaagaccagatctgtcccctgctgctaatttagttattactaatgctgctataca

SEQ ID NO: 313113 - DNA, 75 bp, Artificial Sequence
  Synthetic
ccagatctgtcccctgctgctaatttagttattactaatgctgctatacataatattatcatcccacaatcagga

SEQ ID NO: 313114 - DNA, 75 bp, Artificial Sequence
  Synthetic
ccaacagaagaccaacaaacaaaccaacccactcatccaaccaaacatccatccgccaatcagccaaacagccaa

SEQ ID NO: 313115 - DNA, 75 bp, Artificial Sequence
  Synthetic
cctctcccatttcttttagcatttttttgtaggattttctagattctatctcaatgttgatttgaatttcagttg

SEQ ID NO: 313116 - DNA, 75 bp, Artificial Sequence
  Synthetic
tttgtaggattttctagattctatctcaatgttgatttgaatttcagttgttaagcttgccaatgttaacacttc

SEQ ID NO: 313117 - DNA, 75 bp, Artificial Sequence
  Synthetic
gataaacaatgaatgtattgtaagaaaacttgatgaaagacaagctacatttacattcctagtcaattatgagat

SEQ ID NO: 313118 - DNA, 75 bp, Artificial Sequence
  Synthetic
tcttgacgatgtgttgttacatctactccatttgcttttacatgatatcccgcatctctgagtatttttatggtg

SEQ ID NO: 313119 - DNA, 75 bp, Artificial Sequence
  Synthetic
ctccatttgcttttacatgatatcccgcatctctgagtatttttatggtgtcttctcttcctaacctagacatcg

SEQ ID NO: 313120 - DNA, 75 bp, Artificial Sequence
  Synthetic
actatacattatatccaaacatcatgagcatttacactacacacttttaccatataaatcaatctcatttaaaat

SEQ ID NO: 313121 - DNA, 75 bp, Artificial Sequence
  Synthetic
gaatttatgattagcatcttctgtgattaataacatgccacataacttattgatgtgtttctgcacatcataatt

SEQ ID NO: 313122 - DNA, 75 bp, Artificial Sequence
  Synthetic
caaaaccacaaacaaaagagaccccaaaacactagccaaaacaccgaaaaaagaaaccaccatcaacccaacaaa

SEQ ID NO: 313123 - DNA, 75 bp, Artificial Sequence
  Synthetic
attaataacatgccacataacttattgatgtgtttctgcacatcataattaggagtatcaatactatctcctgtg

SEQ ID NO: 313124 - DNA, 75 bp, Artificial Sequence
  Synthetic
atgacagaagttgatctttgttgagtgtatcattcaacttgactttgctaagagccatctttgtatttgccccat

SEQ ID NO: 313125 - DNA, 75 bp, Artificial Sequence
  Synthetic
tgtatcattcaacttgactttgctaagagccatctttgtatttgccccatcttctatcttatatctctccttaat

SEQ ID NO: 313126 - DNA, 75 bp, Artificial Sequence
  Synthetic
ccatctggactatggagtatagttatgcatagagttgttgttttagattgtgtgaatattgtgttgaaatttatg

SEQ ID NO: 313127 - DNA, 75 bp, Artificial Sequence
  Synthetic
tgcatagagttgttgttttagattgtgtgaatattgtgttgaaatttatggattgagatcatacttgtatattat

SEQ ID NO: 313128 - DNA, 75 bp, Artificial Sequence
  Synthetic
caagattcaaacaatccgaaataacaactttatgcataatcacactccatagtccaaatggagcctgaaaattat

SEQ ID NO: 313129 - DNA, 75 bp, Artificial Sequence
  Synthetic
catgatagcatagagtagttatttaaaaattaacataatgatgaattattggtatgagatcaggaacaacattgg

SEQ ID NO: 313130 - DNA, 75 bp, Artificial Sequence
  Synthetic
ccaatgcattctaagaacccatcatgattgatgaatattggcatagggaaagtgccatattttgtgttgtattca

SEQ ID NO: 313131 - DNA, 75 bp, Artificial Sequence
  Synthetic
aaaattaacataatgatgaattattggtatgagatcaggaacaacattggggcaaatgcagccatgtccaagcac

SEQ ID NO: 313132 - DNA, 75 bp, Artificial Sequence
  Synthetic
gattgatgaatattggcatagggaaagtgccatattttgtgttgtattcagtatattttttatatttagtgcttc

SEQ ID NO: 313133 - DNA, 75 bp, Artificial Sequence
  Synthetic
atgtgactacaaattggaagcatacagctacacgtttttcaatcaaaccgctagaagattaaacttaattatcaa

SEQ ID NO: 313134 - DNA, 75 bp, Artificial Sequence
  Synthetic
atagttgaccaggaatgtaaatgtggcctgtctttcatcaagttttctcactatgcattcatgatttatcaagta

SEQ ID NO: 313135 - DNA, 75 bp, Artificial Sequence
  Synthetic
gcctgtctttcatcaagttttctcactatgcattcatgatttatcaagtatataaatttgtgtgttatgatgtct

SEQ ID NO: 313136 - DNA, 75 bp, Artificial Sequence
  Synthetic
gtattccataacaaaacctttgagctaccaagagctcgagtcaatacatagcattcaccaatctgatggctcaaa

SEQ ID NO: 313137 - DNA, 75 bp, Artificial Sequence
  Synthetic
caagtgacaacggtctcatgtctgtgatcatcagtctttgtggtgtattatcattgtgggttgtgtccatggttg

SEQ ID NO: 313138 - DNA, 75 bp, Artificial Sequence
  Synthetic
gatcatcagtctttgtggtgtattatcattgtgggttgtgtccatggttgggttggctgaattgatttatttgcc

SEQ ID NO: 313139 - DNA, 75 bp, Artificial Sequence
  Synthetic
atattaactaatggtgttagtgacattgatttgctagttgatattaattataatttatggattaagatcaaatcc

SEQ ID NO: 313140 - DNA, 75 bp, Artificial Sequence
  Synthetic
aagtaattcagataattgattcatataattggtcattgttgaatcacttagttttttggagaatttaatttcaca

SEQ ID NO: 313141 - DNA, 75 bp, Artificial Sequence
  Synthetic
agatgtagagttactatgtataatcaaaagaacacactatatttcaatcaaaacaacccaaataaccatatgtac

SEQ ID NO: 313142 - DNA, 75 bp, Artificial Sequence
  Synthetic
atgcacaaacacaatgccattcaatttgattgtatgtatcactgccttagccaaagcattagttaaatgtattaa

SEQ ID NO: 313143 - DNA, 75 bp, Artificial Sequence
  Synthetic
aacccagcaaaaaaaccaaccctcaagaccacagaaagagacaccagcatttcacaatccaccgtgctcgacaca

SEQ ID NO: 313144 - DNA, 75 bp, Artificial Sequence
  Synthetic
gactctagaaaagacctgggatactcttaatcatctaattgtaatatcctcttgtttatacagattaaacttaaa

SEQ ID NO: 313145 - DNA, 75 bp, Artificial Sequence
  Synthetic
ttgattgtatgtatcactgccttagccaaagcattagttaaatgtattaatttatcagtatagcatgttattttt

SEQ ID NO: 313146 - DNA, 75 bp, Artificial Sequence
  Synthetic
acaaattttgtaatctaacttttatcatactcaatgaattgctgcccatctctaaccaagggagttaaatttaag

SEQ ID NO: 313147 - DNA, 75 bp, Artificial Sequence
  Synthetic
acaacagtcaagaccaaaaacacaacaacaacccaaatacaacccagcaagcccaccacaaaacaacgccaaaac

SEQ ID NO: 313148 - DNA, 75 bp, Artificial Sequence
  Synthetic
aagtggtacttatcaaattcttatttgccccatttttttggtttatgcaagtttgttgtacgcattttttcgcgt

SEQ ID NO: 313149 - DNA, 75 bp, Artificial Sequence
  Synthetic
gacaagattaaatccaacaatggacaagatgaagacaactcagttattactaccataatcaaagatgatatactt

SEQ ID NO: 313150 - DNA, 75 bp, Artificial Sequence
  Synthetic
atacaacagcacaacccaaaggcagaatcaccacttcaacacagaccaacaagccaagcacaaaatcacgttcaa

SEQ ID NO: 313151 - DNA, 75 bp, Artificial Sequence
  Synthetic
aatcaccacttcaacacagaccaacaagccaagcacaaaatcacgttcaaaaaatccaccaaaaaaaccaaaaga

SEQ ID NO: 313152 - DNA, 75 bp, Artificial Sequence
  Synthetic
aaaaagatctcaaacctcaaaccacaaaaccaaaggaagcacctaccaccaagcccacagataagccaaccatca

SEQ ID NO: 313153 - DNA, 75 bp, Artificial Sequence
  Synthetic
tgattaccattttgaagtgttcaattttgttccatgtagtatatgtggcaacaatcaactttgcaaatccatctg

SEQ ID NO: 313154 - DNA, 75 bp, Artificial Sequence
  Synthetic
cctcaaggccacggaaagagacaccagcacctcacaatctactgtgctcgacacaaccacatcaaatcacacaat

SEQ ID NO: 313155 - DNA, 75 bp, Artificial Sequence
  Synthetic
attattatagtaatcattgtagtattgttatcattaatagctattggtttactgttgtattgcaaagccaaaaac

SEQ ID NO: 313156 - DNA, 75 bp, Artificial Sequence
  Synthetic
ctctactatccacaaacaaggctgtagtcagcttatcaaatggagttagtgtcttaaccagcaaagtgttagacc

SEQ ID NO: 313157 - DNA, 75 bp, Artificial Sequence
  Synthetic
acaatccttgctgcagtcacactctgtttcgcttccagtcaaaacatcactgaagaattttatcaatcaacatgc

SEQ ID NO: 313158 - DNA, 75 bp, Artificial Sequence
  Synthetic
cattatgtaacaacaaattatatttggacatattaaaggttctaaaacacttaaaaaccttttttaatcttgata

SEQ ID NO: 313159 - DNA, 75 bp, Artificial Sequence
  Synthetic
tgagatcaatagtgatgacattaaaaagctaagagacaatgaagaacccaattcacctaagataagagtgtacaa

SEQ ID NO: 313160 - DNA, 75 bp, Artificial Sequence
  Synthetic
aaaaggaaaagaagatttcttggttttttgttaggtgttggatctgcaatcgccagtggcattgctgtatctaag

SEQ ID NO: 313161 - DNA, 75 bp, Artificial Sequence
  Synthetic
atcgacattgtgtttcaaaattgcataagttttggtcttagcttgatgtcagttgtggaacaattcacatcaagc

SEQ ID NO: 313162 - DNA, 75 bp, Artificial Sequence
  Synthetic
atgaacatccacaccacacacctcatcacacaaaccaatcccactcaaaatccaaaatcacctccagccattgtc

SEQ ID NO: 313163 - DNA, 75 bp, Artificial Sequence
  Synthetic
gggtgtgattatgtatcaaataagggggtggacactgtatctgtaggtaatacattatattatgtaaataagcaa

SEQ ID NO: 313164 - DNA, 75 bp, Artificial Sequence
  Synthetic
tctgaacttcatcgcaactctcatctataaaccatctcacttacactatttaagtagattcctattttatagtta

SEQ ID NO: 313165 - DNA, 75 bp, Artificial Sequence
  Synthetic
cttatgacatataaaagcatgtcctcgtctgaacaaattgctacaactaacttacttaaaaaaataatacgaaga

SEQ ID NO: 313166 - DNA, 75 bp, Artificial Sequence
  Synthetic
caactgagtggtataaataatattgcatttagtaactgaataaaaatagtacctaatcatgttcttacaatggtt

SEQ ID NO: 313167 - DNA, 75 bp, Artificial Sequence
  Synthetic
taaaaacctcaagtatcacaatcaaccactaaatcgacacatcactcacaaaattaacaactggggcaaatatgt

SEQ ID NO: 313168 - DNA, 75 bp, Artificial Sequence
  Synthetic
aaaaaagatcccaaacctcaaaccacaaaaccaaaggaagtactcactaccaagcctacaggaaagccaaccatc

SEQ ID NO: 313169 - DNA, 75 bp, Artificial Sequence
  Synthetic
ggcaaatatgtcacgaaggaatccttgcaaatttgaaattcgaggtcattgcttgaatggtaagaggtgtcattt

SEQ ID NO: 313170 - DNA, 75 bp, Artificial Sequence
  Synthetic
agtctatacaacatccggtcaagaggaaaccctccactcaacctcctccgaaggctatctaagcccatcacaagt

SEQ ID NO: 313171 - DNA, 75 bp, Artificial Sequence
  Synthetic
ataggtaaataaaaccagaatatggggtaaatagatatcagttagagttcaatcaatctcaacaaccatctatac

SEQ ID NO: 313172 - DNA, 75 bp, Artificial Sequence
  Synthetic
aatgattacaccaacttaattagtagacaaaatccattaatagaacacataaatctaaagaaattaaatataaca

SEQ ID NO: 313173 - DNA, 75 bp, Artificial Sequence
  Synthetic
cttgacatggaaagatattagccttagtagattaaatgtttgtttaattacatggattagtaactgcttgaacac

SEQ ID NO: 313174 - DNA, 75 bp, Artificial Sequence
  Synthetic
tggtataagtggaaataccgaatctatgatgacgtcaacattctccaataaaacgcatattaaatcttccgctgt

SEQ ID NO: 313175 - DNA, 75 bp, Artificial Sequence
  Synthetic
taatcgcatattaacagaaaagtatggtgatgaagatattgatatagtattccaaaactgtataagctttggcct

SEQ ID NO: 313176 - DNA, 75 bp, Artificial Sequence
  Synthetic
attttcataatacttacattttaagtactaatttagctggacattggattctgattatacaacttatgaaagatt

SEQ ID NO: 313177 - DNA, 75 bp, Artificial Sequence
  Synthetic
accaagcaataaaccaaagaaaaaaccaaccataaaacccacaaacaaaccacccaccaaaaccacaaacaaaag

SEQ ID NO: 313178 - DNA, 75 bp, Artificial Sequence
  Synthetic
cattgtatatgaatttgcccatgttatttggtggtggtgatcccaacttgttatatcgaagtttctatagaagaa

SEQ ID NO: 313179 - DNA, 75 bp, Artificial Sequence
  Synthetic
aagatgaattcatggaagaactgagtactggaacacttggactgtcatatgaaaaagccaaaaaattgtttccac

SEQ ID NO: 313180 - DNA, 75 bp, Artificial Sequence
  Synthetic
cagcacctcacaatccactgtgctcgacacaaccacatcaaaacacacaatccaacagcaatccctccactcaac

SEQ ID NO: 313181 - DNA, 75 bp, Artificial Sequence
  Synthetic
caagatgatatcgatttcaaattagacaacataactatattaaaaacttatgtatgcttaggcagtaagttaaag

SEQ ID NO: 313182 - DNA, 75 bp, Artificial Sequence
  Synthetic
atctatgatgacgtcaacattctccaataaaatgcatattaaatcttccactgttaccacaagattcaactatag

SEQ ID NO: 313183 - DNA, 75 bp, Artificial Sequence
  Synthetic
attatagttatttaaaattaataattatataatttttaataacttctagtgaactaatcctaaaattatcatttt

SEQ ID NO: 313184 - DNA, 75 bp, Artificial Sequence
  Synthetic
ctagcaaatcaatgtcactaacaccattagttaatataaaacttgacagaagataaaaatggggcaaataaatca

SEQ ID NO: 313185 - DNA, 75 bp, Artificial Sequence
  Synthetic
tactcatctattaactaaacatataaggattgctaattctgaattagaaaataattacaacaaattatatcatcc

SEQ ID NO: 313186 - DNA, 75 bp, Artificial Sequence
  Synthetic
atatcacctaatacaaaatcagaaacacaccatacaacagcacaaaccaaaggcagaacctctacttcaacacag

SEQ ID NO: 313187 - DNA, 75 bp, Artificial Sequence
  Synthetic
atatcacctaatacaaaatcagaaacacaccatacaacagcacaaaccaaaggcagaacctctacttcaacactg

SEQ ID NO: 313188 - DNA, 75 bp, Artificial Sequence
  Synthetic
atatcacctaatacaaaatcagaaacacaccatacaacagcacaaaccaaaggcagaacctctacttcaacaccg

SEQ ID NO: 313189 - DNA, 75 bp, Artificial Sequence
  Synthetic
atatcacctaatacaaaatcagaaacacaccatacaacagcacaaaccaaaggcagaacctctacttcaacacgg

SEQ ID NO: 313190 - DNA, 75 bp, Artificial Sequence
  Synthetic
tcaataatttagcatattgattccaaaattatcatgttggtcttcaggggttgaataaaaatctaaaactaacaa

SEQ ID NO: 313191 - DNA, 75 bp, Artificial Sequence
  Synthetic
tcaagcagattatttgttagcattaaatagccttaaattgctatataaagagtatgcaggcataggccataagct

SEQ ID NO: 313192 - DNA, 75 bp, Artificial Sequence
  Synthetic
acttatgtatgcttaggcagtaagttaaaggggtctgaagtttacttagtccttacaataggtcctgcaaatgtg

SEQ ID NO: 313193 - DNA, 75 bp, Artificial Sequence
  Synthetic
cttgcatttgtaagtgaacaaccctcacctctttacaaaaccacatcaacatctcaccatgcaagccatcatcca

SEQ ID NO: 313194 - DNA, 75 bp, Artificial Sequence
  Synthetic
tgattaaaatcacaggtagtttgttatacaactttcataatgaataatgaataaaaatcttatattaaaaattcc

SEQ ID NO: 313195 - DNA, 75 bp, Artificial Sequence
  Synthetic
acgcgaaaaaatgcgtactacaaacttgcacactcgaaaaaaatggggcaaataagaatttgataagtgctattt

SEQ ID NO: 313196 - DNA, 75 bp, Artificial Sequence
  Synthetic
aaaaaaagatggggcaaatatggaaacatacgtgaacaaacttcacgagggctccacatacacagctgctgttca

SEQ ID NO: 313197 - DNA, 75 bp, Artificial Sequence
  Synthetic
accaaaggaagtacctaccaccaatccaacagaaaagtcaaccatcaacaccaccaaaacaaacatcagaactac

SEQ ID NO: 313198 - DNA, 75 bp, Artificial Sequence
  Synthetic
ttagtctaattcaatagacatgtgtttattaccattttagttaatataaaacctcatcaaagggaaatggggcaa

SEQ ID NO: 313199 - DNA, 75 bp, Artificial Sequence
  Synthetic
cctacattcttcacttcacaatcacaatcaccaaccctctgtggtttaaccaatcaaacaaaacttatctggagt

SEQ ID NO: 313200 - DNA, 75 bp, Artificial Sequence
  Synthetic
cacaatcataatcaccaaccctctgtggttcaatcaatcaaacaaaactcatcaggagttccagatcatcccaag

SEQ ID NO: 313201 - DNA, 75 bp, Artificial Sequence
  Synthetic
gggtttctagaatgtattggcattaagcctacaaaacatactcctataatatacaaatatgacctcaacccgtaa

SEQ ID NO: 313202 - DNA, 75 bp, Artificial Sequence
  Synthetic
agcctacaaaacatactcctataatatacaaatatgacctcaacccgtaacttccagcaaaaaaaccaactcatc

SEQ ID NO: 313203 - DNA, 75 bp, Artificial Sequence
  Synthetic
atatcaaacattgaaactgtgatagagttccaacaaaagaacaacagactactagagattaccagggaatttagt

SEQ ID NO: 313204 - DNA, 75 bp, Artificial Sequence
  Synthetic
ggtggagaagcaggattctaccatatattgaacaacccaaaagcatcattattatctttgactcaatttcctcac

SEQ ID NO: 313205 - DNA, 75 bp, Artificial Sequence
  Synthetic
atagccaacagtttttatgaagtgtttgaaaaacacccccatcttatagatgtttttgtgcactttggcattgca

SEQ ID NO: 313206 - DNA, 75 bp, Artificial Sequence
  Synthetic
aacaaaccaactcacccattcaaccaaatatctatctgccgattagccaaccagccaaaaaacaaccagccaatc

SEQ ID NO: 313207 - DNA, 75 bp, Artificial Sequence
  Synthetic
acaacaacaacccaaatacaacccagcaagcccaccacaaaacaacgccaaaacaaaccaccaaacaaacccaat

SEQ ID NO: 313208 - DNA, 75 bp, Artificial Sequence
  Synthetic
attggggcaaatacaaagatggctcttagcaaagtcaagctgaatgatacattaaataaggatcagctgctgtca

SEQ ID NO: 313209 - DNA, 75 bp, Artificial Sequence
  Synthetic
ctaaaaaatgaaatgaaacgttataaaggcttactacccaaggatatagccaacagcttctatgaagtgtttgaa

SEQ ID NO: 313210 - DNA, 75 bp, Artificial Sequence
  Synthetic
tacctctttacaacacctcattaacatcccaccatgcaagccactttctatcctataaagtagttaattaaaaat

SEQ ID NO: 313211 - DNA, 75 bp, Artificial Sequence
  Synthetic
ctaagatcaattagtgtcaaaaacaaggacctgaactcactagaaaatatagcaaccaccgaattcaaaaatgct

SEQ ID NO: 313212 - DNA, 75 bp, Artificial Sequence
  Synthetic
aatccaccacaaatatcatgataactactataattatagtaattatagtaatattgttatcattaattgcagttg

SEQ ID NO: 313213 - DNA, 75 bp, Artificial Sequence
  Synthetic
catacaacagcacaaaccaaaggcagaacctctactccaacacagaacaacaagccaagcacaaaaccacgtcca

SEQ ID NO: 313214 - DNA, 75 bp, Artificial Sequence
  Synthetic
agttatttaaaattaaaaattatataattttttaataacttttagtgaactaatcctaaaattatcattttgatc

SEQ ID NO: 313215 - DNA, 75 bp, Artificial Sequence
  Synthetic
aagcacaccagtcacattaagtaaggatcaactgagtggtataaataatattgcatttagtaactgaataaaaat

SEQ ID NO: 313216 - DNA, 75 bp, Artificial Sequence
  Synthetic
gcaagactcaggaatgaggaaagtgaaaagatggcaaaagacacatcagatgaagtgtctctcaatccaacatca

SEQ ID NO: 313217 - DNA, 75 bp, Artificial Sequence
  Synthetic
ataaaaccagaatatggggtaaatagatatcagttagagttcaatcaatctcaacaaccatctataccgccaatt

SEQ ID NO: 313218 - DNA, 75 bp, Artificial Sequence
  Synthetic
aggaagcattcaccaccaagcccacagaaaagccaactatcaacaccaccaaaacaaacatcggaactacacagc

SEQ ID NO: 313219 - DNA, 75 bp, Artificial Sequence
  Synthetic
ctccactcaacctcctccgaaggcaatccaagcccttcacaagtctatacaacatctgagtacccatcacaacct

SEQ ID NO: 313220 - DNA, 75 bp, Artificial Sequence
  Synthetic
aacatcacagcacaggctgaatcatttccttgcatcatgctacccacacaactaagctagatccttaactcatag

SEQ ID NO: 313221 - DNA, 75 bp, Artificial Sequence
  Synthetic
aaaagccaaccatcaacaccaccaaaacaaacatcaaaactacactgctcacctccaacaccacaggaaatccag

SEQ ID NO: 313222 - DNA, 75 bp, Artificial Sequence
  Synthetic
atcattgctttatgtgaatttgaaaatatagtaacatcaaaaaaagtcataataccaacatacctaagatccatc

SEQ ID NO: 313223 - DNA, 75 bp, Artificial Sequence
  Synthetic
tatatattatgttacaacaaattggaagcacacagctacacgatttgcaatcaaacctatggaagattaaccttt

SEQ ID NO: 313224 - DNA, 75 bp, Artificial Sequence
  Synthetic
acttaccacatcatcaaattattaactcaaacaattcaagctatgggacaaaatggatcccattattagtggaaa

SEQ ID NO: 313225 - DNA, 75 bp, Artificial Sequence
  Synthetic
acaactgtcacagttcaaacaataaaaaaccacactgagaaaaacataaccacttaccttactcaagtctcacca

SEQ ID NO: 313226 - DNA, 75 bp, Artificial Sequence
  Synthetic
atacaaactttctacctacattcttcacttcacaatcataatcaccaaccctctgtggttcaaccaatcaaacaa

SEQ ID NO: 313227 - DNA, 75 bp, Artificial Sequence
  Synthetic
caaaaaaaccaacccccaagaccacagaaagagacaccagcaccccacaatccactgtgctcgacacaaccacat

SEQ ID NO: 313228 - DNA, 75 bp, Artificial Sequence
  Synthetic
ccaaaacaaaccacaaaacaaacccaataatgattttcactttgaagtgttcaattttgtaccctgcagcatatg

SEQ ID NO: 313229 - DNA, 75 bp, Artificial Sequence
  Synthetic
ttacacatgtgcatttacaacacaacgagacattagtttttgacactttttttctcgttttaacaagtactccag

SEQ ID NO: 313230 - DNA, 75 bp, Artificial Sequence
  Synthetic
aactaatgctttggctaaggcagtgatacatacaatcaaattgaatggcattgtatttgtgcatgttattacaag

SEQ ID NO: 313231 - DNA, 75 bp, Artificial Sequence
  Synthetic
aaaccacaaaaccaaaggaagtactcaccaccaagcccacagaaaagccaaccatcaacaccaccaaaacaaaca

SEQ ID NO: 313232 - DNA, 75 bp, Artificial Sequence
  Synthetic
aaagactgatgatcacagacatgagaccattgtcacttgagaccataataacatcactaaccagagacatcataa

SEQ ID NO: 313233 - DNA, 75 bp, Artificial Sequence
  Synthetic
aggatcaaatatttgtttaacaaggactgatagaggatggtactgtgataatgcaggatcagtatccttctttcc

SEQ ID NO: 313234 - DNA, 75 bp, Artificial Sequence
  Synthetic
aaggggaacctataataaattactatgaccctctagtgtttccttctgatgagtttgatgcatcaatatctcaag

SEQ ID NO: 313235 - DNA, 75 bp, Artificial Sequence
  Synthetic
accttgcatttgtaagtgaactaccctcacctcttcacaaaaccacatcaacatctcaccatgcaagccatcatc

SEQ ID NO: 313236 - DNA, 75 bp, Artificial Sequence
  Synthetic
acatcaaaaaactaagggacagtgaagagccaaattcacccaaggtaagagtttacaatactgtcacatcatata

SEQ ID NO: 313237 - DNA, 75 bp, Artificial Sequence
  Synthetic
aagatactcaagtcaatggacaagagcatagacactttgtctgaaataagtggagctgctgaacttgatagaaca

SEQ ID NO: 313238 - DNA, 75 bp, Artificial Sequence
  Synthetic
tgagacttatatatcaagagatatgcaatttatgagtaaaacgatccaacataacggtgtatattacccagctag

SEQ ID NO: 313239 - DNA, 75 bp, Artificial Sequence
  Synthetic
tatagttcactctgtgttcatacttagttattatacaaaccatgatttaaaagataaacttcaagatctgtcaga

SEQ ID NO: 313240 - DNA, 75 bp, Artificial Sequence
  Synthetic
atatatattagtgtcataatgcttgatcataacgattctatatcatccaaccataaaactgtcttaataaggtta

SEQ ID NO: 313241 - DNA, 75 bp, Artificial Sequence
  Synthetic
aaaattttctacaacatctaggtattactgatgatatatacacaatatatatattagtgtcataacactcaatcc

SEQ ID NO: 313242 - DNA, 75 bp, Artificial Sequence
  Synthetic
tacatacaatcaatttttgacatggaaagacatcagccttagcagattaaatgtttgcttaattacttggataag

SEQ ID NO: 313243 - DNA, 75 bp, Artificial Sequence
  Synthetic
tgccatagacttaacagatattgatagagccactgagatgatgaggaaaaacataactttgcttataaggatatt

SEQ ID NO: 313244 - DNA, 75 bp, Artificial Sequence
  Synthetic
cttggttgcatttaacaatacctcttgtcacaataatatgtacatatagacatgcacctccttttataaaggatc

SEQ ID NO: 313245 - DNA, 75 bp, Artificial Sequence
  Synthetic
gtcaaaaactgtggaccattgaagccatatcattattagatctaatatctcttaaaggtaaattctccatcacag

SEQ ID NO: 313246 - DNA, 75 bp, Artificial Sequence
  Synthetic
ctgattagctacctatctgcacatcaaaacacaacatcaatagaagactaacaaacaaaccaattcacccatcca

SEQ ID NO: 313247 - DNA, 75 bp, Artificial Sequence
  Synthetic
caaccagccaaaaaaacaaccagccaatccaaaactagccacccggaaaaaatcgatactatagttacaaaaaaa

SEQ ID NO: 313248 - DNA, 75 bp, Artificial Sequence
  Synthetic
aattagaaagtaattacaacaaattatatcatcctacaccagaaaccctagaaaatatactaaccaatccggtta

SEQ ID NO: 313249 - DNA, 75 bp, Artificial Sequence
  Synthetic
aggaggaataaatttaaaaccaaacctaattggtttatatgtatattaactaaactacgagatattagtttttga

SEQ ID NO: 313250 - DNA, 75 bp, Artificial Sequence
  Synthetic
acaacaaacttgcgtaaaccaaaaaaatggggcaaataagaatttgataagtaccacttaaatttaactcctttg

SEQ ID NO: 313251 - DNA, 75 bp, Artificial Sequence
  Synthetic
ctaataagaagcttattaaatcgtctacaatgattagaaccaattacagcagacaagatttgtataatttatttc

SEQ ID NO: 313252 - DNA, 75 bp, Artificial Sequence
  Synthetic
cataatcacactccatagtccaaatggagcctgaaaattatagtaatttaaaattaaggagagacataagatgaa

SEQ ID NO: 313253 - DNA, 75 bp, Artificial Sequence
  Synthetic
atccagcaaatacaccatccaacggagcacaggagatagcattgacactcctaattatgatgtgcagaaacacat

SEQ ID NO: 313254 - DNA, 75 bp, Artificial Sequence
  Synthetic
aaaatgcatattaaatcttccactgttaccacaagattcaattatagcagacaagacttgtacaatttatttcca

SEQ ID NO: 313255 - DNA, 75 bp, Artificial Sequence
  Synthetic
aaaaaactgattaaaatcacaggtagtttgttatacaactttaataatgaataatgagcaaaaatcttataataa

SEQ ID NO: 313256 - DNA, 75 bp, Artificial Sequence
  Synthetic
gtttgttatacaactttaataatgaataatgagcaaaaatcttataataaaaatagctacacactaacactgtat

SEQ ID NO: 313257 - DNA, 75 bp, Artificial Sequence
  Synthetic
cagaagaccaacaaacaaaacaactcacctatccaaccaaacatctatctgccaatcagccaaccagccaaaaaa

SEQ ID NO: 313258 - DNA, 75 bp, Artificial Sequence
  Synthetic
atacaacatccggtcaagaggaaaccctccactcaaccacctccgaaggctatccaagcccatcacaagtccata

SEQ ID NO: 313259 - DNA, 75 bp, Artificial Sequence
  Synthetic
aaaaactatatagataaacagttgttacctattgtgaacaagcaaagctgcagcatatcaaacattgaaactgtg

SEQ ID NO: 313260 - DNA, 75 bp, Artificial Sequence
  Synthetic
ctttacaacaatgccaatattacaaaatggaggatacatatgggaattgattgagttgacacactgctctcaatt

SEQ ID NO: 313261 - DNA, 75 bp, Artificial Sequence
  Synthetic
tgaaatgaaactattgcacaaagtgggaagcactaaatataaaaaatatactgaatacaacacaaaatatggcac

SEQ ID NO: 313262 - DNA, 75 bp, Artificial Sequence
  Synthetic
cgacagaggatggtactgtgacaatgcaggatcagtatctttcttcccacaagctgaaacatgtaaagttcaatc

SEQ ID NO: 313263 - DNA, 75 bp, Artificial Sequence
  Synthetic
agcctacaaaacatactcctataatatacaaatatgacctcaacccgtaaattccaacaaaaaaccaactcatcc

SEQ ID NO: 313264 - DNA, 75 bp, Artificial Sequence
  Synthetic
atccattttagtaattaaaaataagggtaaagccagtaacataaattggggcaaatacaaagatggctcttagca

SEQ ID NO: 313265 - DNA, 75 bp, Artificial Sequence
  Synthetic
ggtaaagccagtaacataaattggggcaaatacaaagatggctcttagcaaagtcaagttaaatgatacattaaa

SEQ ID NO: 313266 - DNA, 75 bp, Artificial Sequence
  Synthetic
taataatgtcttaaaaaatgaaatgaaacgttataaaggcttactacccaaggacatagccaacagcttctatga

SEQ ID NO: 313267 - DNA, 75 bp, Artificial Sequence
  Synthetic
attacataatgtaaatgctggtaaatccaccacaaatatcatgataactactataattatagtgattatagtaat

SEQ ID NO: 313268 - DNA, 75 bp, Artificial Sequence
  Synthetic
catgaccaaatcaaacagaatcaaaataagctctggggcaaataacaatggagttgccaatcctcaaaacaaatg

SEQ ID NO: 313269 - DNA, 75 bp, Artificial Sequence
  Synthetic
tatgatgcagccaaagcatatgcagagcaactcaaagaaaatggagtaataaactacagtgtattagacttaaca

SEQ ID NO: 313270 - DNA, 75 bp, Artificial Sequence
  Synthetic
cagacaaatgacaatataacggcaagattagataggattgatgaaaagttaagtgaaatactaggaatgcttcac

SEQ ID NO: 313271 - DNA, 75 bp, Artificial Sequence
  Synthetic
tattattgcaaaaagccatgaccaaatcaaacagaatcaaaatcaactctggggcaaataacaatggagttgcca

SEQ ID NO: 313272 - DNA, 75 bp, Artificial Sequence
  Synthetic
atcaaacagaatcaaaatcaactctggggcaaataacaatggagttgccaatcctcaaaacaaatgctattacca

SEQ ID NO: 313273 - DNA, 75 bp, Artificial Sequence
  Synthetic
aagaaagatagcataatatctgtcaactcaatagacatagaagtcactaaagagagcccgataacatctggcacc

SEQ ID NO: 313274 - DNA, 75 bp, Artificial Sequence
  Synthetic
ttataataaaaatagctacacactaacactgtattcaattatagttatttaaaattaataattataaatttaatt

SEQ ID NO: 313275 - DNA, 75 bp, Artificial Sequence
  Synthetic
agaagagctatagaaattagtgatgtcaaagtctatgctatattgaataaactggggcttaaagaaaaagacaag

SEQ ID NO: 313276 - DNA, 75 bp, Artificial Sequence
  Synthetic
aacaaaacctttgagctaccaagagctcgagtcaatacatagcattcaccaatctgatagctcaaaacagtaacc

SEQ ID NO: 313277 - DNA, 75 bp, Artificial Sequence
  Synthetic
aacaaacatccatcagcagaaccaccagccaatcaatcaaccaatcgatcaatcagcaccctgacaaatttaaca

SEQ ID NO: 313278 - DNA, 75 bp, Artificial Sequence
  Synthetic
taaagatctcactatgaagacacttaaccctacacatgatattattgctttatgtgaatttgaaaacatagtaac

SEQ ID NO: 313279 - DNA, 75 bp, Artificial Sequence
  Synthetic
gttaccacaaattggaagcacacagctacaagatttgcaatcaaacccatggaagattaaccttcttcaattaca

SEQ ID NO: 313280 - DNA, 75 bp, Artificial Sequence
  Synthetic
ggaagattaaccttcttcaattacatcggtgtgttaattcatacaaactttctacctacattcttcacttcacta

SEQ ID NO: 313281 - DNA, 75 bp, Artificial Sequence
  Synthetic
ctaatcacaatatctgttaacatagacaagtcaacacaccatacagaatcaaccgatggaaaatacatccataac

SEQ ID NO: 313282 - DNA, 75 bp, Artificial Sequence
  Synthetic
aaacaaacatcagaactacactgctcacctccaacaccacaggaaatccagaacacacaagtcaagaggaaaccc

SEQ ID NO: 313283 - DNA, 75 bp, Artificial Sequence
  Synthetic
cagtaaccttgtatttaaaagtgaacaacccctgcctctttataacaccttatcaacgtcccaccatgcaaacca

SEQ ID NO: 313284 - DNA, 75 bp, Artificial Sequence
  Synthetic
gattaactcactatttgtaaaaattagaaatggggcaaatatgtcacgaaggaatccttgcaaatttgaaattcg

SEQ ID NO: 313285 - DNA, 75 bp, Artificial Sequence
  Synthetic
tactaattggaagcatacagctacacgtttttcaatcaaaccactagaggattaaacccaattatcaacattgaa

SEQ ID NO: 313286 - DNA, 75 bp, Artificial Sequence
  Synthetic
caacccctgcctctttataacaccttatcaacgtcccaccatgcaaaccaccatccatactataaagtagttaat

SEQ ID NO: 313287 - DNA, 75 bp, Artificial Sequence
  Synthetic
aaatcacttccagccattgtctgccagacctagagtgcgaataggtaaataaaaccagaatatggggtaaataga

SEQ ID NO: 313288 - DNA, 75 bp, Artificial Sequence
  Synthetic
agacctagagtgcgaataggtaaataaaaccagaatatggggtaaatagacatcagttagagttcaatcaatctc

SEQ ID NO: 313289 - DNA, 75 bp, Artificial Sequence
  Synthetic
accatactagatccaacaacaccaggagtcaagtcaaccctgcaatccacagcagtcaggaccaagaatacaaca

SEQ ID NO: 313290 - DNA, 75 bp, Artificial Sequence
  Synthetic
aagggttctacataataaaagaggtagagggatttattatgtctctaattttaaatataacagaagaagatcaat

SEQ ID NO: 313291 - DNA, 75 bp, Artificial Sequence
  Synthetic
aaaaccaaccttaaagacaaccaaaaaagatcccaaacctcaaaccactaaatcaaaggaggtacccaccaccaa

SEQ ID NO: 313292 - DNA, 75 bp, Artificial Sequence
  Synthetic
tgaattgttaaacagcttgacaaccaatgaacttaaaaaactgattaaaatcacaggtagtttgttatacaactt

SEQ ID NO: 313293 - DNA, 75 bp, Artificial Sequence
  Synthetic
accaccaaaacaaacatcataaccacaccactcacctccaacaccacgagaaatccagaactcacaagtcaaatg

SEQ ID NO: 313294 - DNA, 75 bp, Artificial Sequence
  Synthetic
tagggcaaataagaatttgataagtaccacttaaatttaactcctttggttagagatgggcagcaattcattgag

SEQ ID NO: 313295 - DNA, 75 bp, Artificial Sequence
  Synthetic
tcaaatagaatcaatataaactctggggcaaataacaatggagttgccaattatcaaagcgaatgcaattaccac

SEQ ID NO: 313296 - DNA, 75 bp, Artificial Sequence
  Synthetic
cacaaaaccacgtccaaaaaatccaccaaaaaaaccaaaagatgattaccattttgaagtgttcaacttcgttcc

SEQ ID NO: 313297 - DNA, 75 bp, Artificial Sequence
  Synthetic
tcaattatgagatgaagctattgcacaaagtagggagtaccaaatacaaaaaatacactgaatataatacaaaat

SEQ ID NO: 313298 - DNA, 75 bp, Artificial Sequence
  Synthetic
aaatacactgaatataatacaaaatatggcactttccctatgcctatatttatcaatcatggcgggtttctagaa

SEQ ID NO: 313299 - DNA, 75 bp, Artificial Sequence
  Synthetic
aagaaggagctaatccattttagtaattaaaaataagggtgaagccagtaacataaattggggcaaatacaaaga

SEQ ID NO: 313300 - DNA, 75 bp, Artificial Sequence
  Synthetic
gggagtcttagcaaaatcagttaaaaatattatgctaggacatgctagtgtgcaagcagaaatggaacaagttgt

SEQ ID NO: 313301 - DNA, 75 bp, Artificial Sequence
  Synthetic
caacagcaatccctccactcaaccacttccgaaaccacacccaacttcacacaaatacccacagcatccgagcct

SEQ ID NO: 313302 - DNA, 75 bp, Artificial Sequence
  Synthetic
ggtgtaggatctgcaatagcaagtggtatagctgtatccaaagttctacaccttgaaggagaagtgaacaagatc

SEQ ID NO: 313303 - DNA, 75 bp, Artificial Sequence
  Synthetic
agtttgagtatgttaagaggtgcctttatatatagaattataaaagggtttgtaaataattacaacagatggcct

SEQ ID NO: 313304 - DNA, 75 bp, Artificial Sequence
  Synthetic
agcaaaattggattgggtgtatgcatctatagataacaaggatgaattcatggaggaacttagcataggaactct

SEQ ID NO: 313305 - DNA, 75 bp, Artificial Sequence
  Synthetic
tttagtaactaaataaagatagcatctaatcatgttcttatgatggtttactatcaactcatagacaacccatct

SEQ ID NO: 313306 - DNA, 75 bp, Artificial Sequence
  Synthetic
ctaatcatgttcttatgatggtttactatcaactcatagacaacccatctgtcattggattttcctaaaatctga

SEQ ID NO: 313307 - DNA, 75 bp, Artificial Sequence
  Synthetic
accatctcacttacactatttaagtagattcctagttcatagttatataaaacataattgaatgccagattaact

SEQ ID NO: 313308 - DNA, 75 bp, Artificial Sequence
  Synthetic
attgtagatcttaacaatgtagatgaacaaagtggattatatagatatcatatgggtggtatcgaagggtggtgt

SEQ ID NO: 313309 - DNA, 75 bp, Artificial Sequence
  Synthetic
gaagattaacctttttcctctacatcagttagttgattcatacacactttctacctacattcttcacttcacaat

SEQ ID NO: 313310 - DNA, 75 bp, Artificial Sequence
  Synthetic
ttcatcagatctagtactcaaataagttaataaaaatacccacatggggcaaataatcatcggaggaaatccaac

SEQ ID NO: 313311 - DNA, 75 bp, Artificial Sequence
  Synthetic
acaaaattaacaatatagtaacaaaaaaagaacaagatggggcaaatatggaaacatacgtgaacaagcttcacg

SEQ ID NO: 313312 - DNA, 75 bp, Artificial Sequence
  Synthetic
gtgaactaatcctaaaattatcattttgatctaggaggaataaatttaaatccaaatctaattggtttatatgta

SEQ ID NO: 313313 - DNA, 75 bp, Artificial Sequence
  Synthetic
ataatcaaaagaacacactatatttcaatcaaaataatccaaataaccatatgtactcactaaatcaaacattca

SEQ ID NO: 313314 - DNA, 75 bp, Artificial Sequence
  Synthetic
ggtctcatgtctgtgatcatcagtctttgtttgagatgggcagcaattcattgagtatgataaaagttagattac

SEQ ID NO: 313315 - DNA, 75 bp, Artificial Sequence
  Synthetic
acttaacaacaaatatttcaacatcatagcacaggctgaatcatatcctcacatcatgctacctacacaactaag

SEQ ID NO: 313316 - DNA, 75 bp, Artificial Sequence
  Synthetic
tttgattgacacaattcaaagttttctacaacatctaggtatcaccgaggatatatatacaatatatatattagt

SEQ ID NO: 313317 - DNA, 75 bp, Artificial Sequence
  Synthetic
aaaccactagaggattaaacccaattatcaacattgaatgacaggttcacatatatcctcaactgcacactatat

SEQ ID NO: 313318 - DNA, 75 bp, Artificial Sequence
  Synthetic
attacatggattagtaactgcttgaacacattaaataaaagcttaggcttaagatgcggattcaataatgttatc

SEQ ID NO: 313319 - DNA, 75 bp, Artificial Sequence
  Synthetic
aactgatcatatgttcattaatttgaaagttttcttcaatgcttataagacctatctcttgtgttttcataaagg

SEQ ID NO: 313320 - DNA, 75 bp, Artificial Sequence
  Synthetic
atgcaaagcacaccagcagccaacaatcgagccagaagagaactaccaaggtttatgaattatacactcaacaat

SEQ ID NO: 313321 - DNA, 75 bp, Artificial Sequence
  Synthetic
acaatctctattttcctggttacatttaactattcctcatgttacaataatatgtacatataggcacgcaccccc

SEQ ID NO: 313322 - DNA, 75 bp, Artificial Sequence
  Synthetic
atatttgtttaacaaggactgatagaggatggtactgtgacaatgcaggatcagtatccttctttccacaggctg

SEQ ID NO: 313323 - DNA, 75 bp, Artificial Sequence
  Synthetic
gtatctaaagtcctgcacctagaaggggaagtgaacaaaatcaaaagtgctctactatccacaaacaaggctgta

SEQ ID NO: 313324 - DNA, 75 bp, Artificial Sequence
  Synthetic
aaccataaaaccaacaaacaaaccacccaccaaaaccacaaacaaaagagacccaaaaacaccagccaaaacacc

SEQ ID NO: 313325 - DNA, 75 bp, Artificial Sequence
  Synthetic
atacccaagcttaatgagatacatttgatgaaacctcccatattcacaggtgatgttgatattcacaagttaaaa

SEQ ID NO: 313326 - DNA, 75 bp, Artificial Sequence
  Synthetic
ggttaacatatgaaaaggccaagaaattatttccacaatatttaagtgtcaactatttgcatcgacttacagtca

SEQ ID NO: 313327 - DNA, 75 bp, Artificial Sequence
  Synthetic
tctgctaatgtgtatctaactgatagttatctaaaaggtgttatctctttttcagaatgtaatgctttagggagt

SEQ ID NO: 313328 - DNA, 75 bp, Artificial Sequence
  Synthetic
tatgtttattaatttgaaagttttcttcaatgcttataagacctatctcttgtgttttcataaaggttatggcaa

SEQ ID NO: 313329 - DNA, 75 bp, Artificial Sequence
  Synthetic
tagaaataagtgatgtaaaggtgtacgccatcttgaataaactaggactaaaggaaaaggacagagttaagccca

SEQ ID NO: 313330 - DNA, 75 bp, Artificial Sequence
  Synthetic
ttaatagattcaattttgtatttagttctacaggttgtaaaattagtatagagtatattttaaaagatcttaaaa

SEQ ID NO: 313331 - DNA, 75 bp, Artificial Sequence
  Synthetic
cgtaacttccaacaaaaaaaccaactcatccaaaccaagctattctctaaacaacaatgctcaacagttaagaag

SEQ ID NO: 313332 - DNA, 75 bp, Artificial Sequence
  Synthetic
taaattgatactatcaagaaccaaaaatttcatcatgcctaagaaagctgataaagagtctattgatgcaaatat

SEQ ID NO: 313333 - DNA, 75 bp, Artificial Sequence
  Synthetic
taaagatcttataataaagactcctatagctatacactatcattgtattaaattatagttattaaaaattaaaaa

SEQ ID NO: 313334 - DNA, 75 bp, Artificial Sequence
  Synthetic
ctagtactcaaataagttaataaaaatacccacatggggcaaataatcatcggaggaaatccaaccaatcacaat

SEQ ID NO: 313335 - DNA, 75 bp, Artificial Sequence
  Synthetic
aagacactgaatgactattgtataggtaaaaatgttgactcaataatgttaccattgttatctaataagaagctt

SEQ ID NO: 313336 - DNA, 75 bp, Artificial Sequence
  Synthetic
gtaaaaatgttgactcaataatgttaccattgttatctaataagaagcttattaaatcgtctacaatgattagaa

SEQ ID NO: 313337 - DNA, 75 bp, Artificial Sequence
  Synthetic
tccgagtacctatcacaacctccatctccatccaacataacagaccagtagtcattaaaaagcgtattattgcaa

SEQ ID NO: 313338 - DNA, 75 bp, Artificial Sequence
  Synthetic
caggacaagtaatgctaagatggggagttttagccaaatctgtaaaaaatatcatgctaggacatgctagtgtcc

SEQ ID NO: 313339 - DNA, 75 bp, Artificial Sequence
  Synthetic
caagaaaaaagatagtatcatatctgtcaactcaatagatatagaagtaaccaaagaaagccctataacttcaaa

SEQ ID NO: 313340 - DNA, 75 bp, Artificial Sequence
  Synthetic
aaaactaaatgtacagcatccaataaaaatcgtgggatcataaagacattttctaacgggtgtgattatgtatca

SEQ ID NO: 313341 - DNA, 75 bp, Artificial Sequence
  Synthetic
aatgatctatcacttgatgatttttgatcagtgatcaactcactcagcaatcaacaacatcaataaaacagacac

SEQ ID NO: 313342 - DNA, 75 bp, Artificial Sequence
  Synthetic
ttgcacactcgaaaaaaatggggcaaataagaatttgataagtgctatttaagtctaaccttttcaatcagaaat

SEQ ID NO: 313343 - DNA, 75 bp, Artificial Sequence
  Synthetic
aataagaatttgataagtgctatttaagtctaaccttttcaatcagaaatggggtgcaattcactgagcatgata

SEQ ID NO: 313344 - DNA, 75 bp, Artificial Sequence
  Synthetic
ctatgttccagtcatctgtgccagcagacttgctcataaaagaacttgcaagcatcaacatactagtaaagcaga

SEQ ID NO: 313345 - DNA, 75 bp, Artificial Sequence
  Synthetic
cattcaaatatatcaaaccacagagtcaatttatagtggatcttggtgcctacctagaaaaagagagcatatatt

SEQ ID NO: 313346 - DNA, 75 bp, Artificial Sequence
  Synthetic
cggttaaaagtaatgacaaaaagacactgaatgactattgtataggtaaaaatgttgactcaataatgttaccat

SEQ ID NO: 313347 - DNA, 75 bp, Artificial Sequence
  Synthetic
atctagaaagtcctacaaaaaaatgctaaaagagatgggagaagtggctccagaatataggcatgattctccaga

SEQ ID NO: 313348 - DNA, 75 bp, Artificial Sequence
  Synthetic
tcatcacacaaaccaatcccactcaaaatccaaaatcacttccagccattgtctgccagacctagagtgcgaata

SEQ ID NO: 313349 - DNA, 75 bp, Artificial Sequence
  Synthetic
cacatcaacatctcaccatgcaagccatcatccatactataaagtagttaattaaaaatagtcataacaatgaac

SEQ ID NO: 313350 - DNA, 75 bp, Artificial Sequence
  Synthetic
acacaaccacatcaaaacacacaatccaacagcaatccctccactcaaccacccccgaaaacacacccaactcca

SEQ ID NO: 313351 - DNA, 75 bp, Artificial Sequence
  Synthetic
ccaacagcaatccctccactcaaccacccccgaaaacacacccaactccacacaaacacccacagcatccgagcc

SEQ ID NO: 313352 - DNA, 75 bp, Artificial Sequence
  Synthetic
tccgagtacctatcacaatctccatcttcatccaacacaacaaaatgatagtcattaaaaagcgtattgttgcaa

SEQ ID NO: 313353 - DNA, 75 bp, Artificial Sequence
  Synthetic
atgtaaaagcaaatggagtggatgtaacaacacatcgtcaagacattaatgggaaagaaatgaaatttgaagtgt

SEQ ID NO: 313354 - DNA, 75 bp, Artificial Sequence
  Synthetic
ccacacaaacacccacagcatccgagccctccacatcaaattccacctaaaaactccagtcatatgcttagttat

SEQ ID NO: 313355 - DNA, 75 bp, Artificial Sequence
  Synthetic
gccctccacatcaaattccacctaaaaactccagtcatatgcttagttatttaaaaactacatcttagcagagaa

SEQ ID NO: 313356 - DNA, 75 bp, Artificial Sequence
  Synthetic
gcaaatatggaaacatacgtgaacaagcttcacgaaggctccacatacacagcagctgttcagtacaatgttcta

SEQ ID NO: 313357 - DNA, 75 bp, Artificial Sequence
  Synthetic
tactcaccaccaagcccacagaaaagccaaccatcaacaccaccaaaacaaacatcaaaactacactgctcacct

SEQ ID NO: 313358 - DNA, 75 bp, Artificial Sequence
  Synthetic
agaatatagaggtgaaagtctattatgcagtttaatatttagaaatgtatggttatataatcaaattgctttaca

SEQ ID NO: 313359 - DNA, 75 bp, Artificial Sequence
  Synthetic
caacttacaacaaatacttcaacatcacagcacaggctgaatcatttcctcgcatcatgctacccacacaactaa

SEQ ID NO: 313360 - DNA, 75 bp, Artificial Sequence
  Synthetic
cgcatcatgctacccacacaactaagctagatccttaactcatagttacataaaaacctcaaatatcgcaatcaa

SEQ ID NO: 313361 - DNA, 75 bp, Artificial Sequence
  Synthetic
ccatccaacacaacaaaatggtagtcattaaaaagcgtattgttgcaaaaagccatgaccaaatcaaacagaatc

SEQ ID NO: 313362 - DNA, 75 bp, Artificial Sequence
  Synthetic
ctgaactcactagaaaatatagcaaccaccgaattcaaaaatgctatcaccaatgctaaaattattccctatgca

SEQ ID NO: 313363 - DNA, 75 bp, Artificial Sequence
  Synthetic
tgaaactgtgatagagttccaacaaaagaacaacagactactagagattaccagggaatttagtgttaatgcagg

SEQ ID NO: 313364 - DNA, 75 bp, Artificial Sequence
  Synthetic
tcatgataactactataattatagtaattatagtaatattgttagcattaattgcagttggactgcttctatact

SEQ ID NO: 313365 - DNA, 75 bp, Artificial Sequence
  Synthetic
gcttcttcaatctgtctggaactacatcacaaaccaccgccatactagctttaacaacaccaagtgtcgagtcaa

SEQ ID NO: 313366 - DNA, 75 bp, Artificial Sequence
  Synthetic
acttgacagaagataaaaatggggcaaataaatcaactcagccgacccaaccatggacacgacacacaatgatac

SEQ ID NO: 313367 - DNA, 75 bp, Artificial Sequence
  Synthetic
agcaaaccatccatctgctcaaacgattaccagcagacgtgctgaagaagacaataaagaatacattagatatcc

SEQ ID NO: 313368 - DNA, 75 bp, Artificial Sequence
  Synthetic
tttaaccattcctgctacagatgcaactaacaacatacattggtcttatttacatataaaatttgcagaacctat

SEQ ID NO: 313369 - DNA, 75 bp, Artificial Sequence
  Synthetic
taagcctacaaagcatactcccataatatacaagtatgatctcaatccatgaatttcaacacaagattcacacaa

SEQ ID NO: 313370 - DNA, 75 bp, Artificial Sequence
  Synthetic
agaaaaagacgatgatcctgcatcacttacaatatgggtgcccatgttccaatcatccatgccagcagatttact

SEQ ID NO: 313371 - DNA, 75 bp, Artificial Sequence
  Synthetic
aaattaattaagcttgcaggtgacaataaccttaacaatctgagtgaattatattttttgttcagaatatttgga

SEQ ID NO: 313372 - DNA, 75 bp, Artificial Sequence
  Synthetic
ggaaatcaccagagaatttagtgtcaatgcaggtgtaacaacacctttaagcacttacatgttaacaaacagtga

SEQ ID NO: 313373 - DNA, 75 bp, Artificial Sequence
  Synthetic
tatcttaacaaccctaatcatgtggtatcattgacaggcaaagaaagagaactcagtgtaggtagaatgtttgca

SEQ ID NO: 313374 - DNA, 75 bp, Artificial Sequence
  Synthetic
ttaaaggttctaaaacacttaaaaaccttttttaatcttgataatattgatacagcattaacattgtatatgaat

SEQ ID NO: 313375 - DNA, 75 bp, Artificial Sequence
  Synthetic
atgtcacactttattagacaagacagtgtctgataatatcataaatggtaaatggataattctattaagtaaatt

SEQ ID NO: 313376 - DNA, 75 bp, Artificial Sequence
  Synthetic
ttattcatatcatcgtgcttatacaagttaaatcttaaatctatagcacaaatcacattatccattttggcaatg

SEQ ID NO: 313377 - DNA, 75 bp, Artificial Sequence
  Synthetic
agttaaatcttaaatctatagcacaaatcacattatccattttggcaatgataatctcaacttcacttataattg

SEQ ID NO: 313378 - DNA, 75 bp, Artificial Sequence
  Synthetic
tatagtaatcattgtagtattgttatcattaatagctattggtttactgttgtattgcaaagccaaaaacacacc

SEQ ID NO: 313379 - DNA, 75 bp, Artificial Sequence
  Synthetic
ggtgctttcatttatagaatcataaaagggtttgtaaatacctacaacagatggcccactttaaggaatgctatt

SEQ ID NO: 313380 - DNA, 75 bp, Artificial Sequence
  Synthetic
aacacacaagtcaaaaggaaaccctccactcaaccacctccgaaggcaatccaagcccttcacaagtctatacaa

SEQ ID NO: 313381 - DNA, 75 bp, Artificial Sequence
  Synthetic
tgcaaagattgatgatcacagacatgagacccctgtcgatggattcaataataacatctctcaccaaagaaatca

SEQ ID NO: 313382 - DNA, 75 bp, Artificial Sequence
  Synthetic
acaaactttgtgaatataacgtattccataacaaaacctttgagttaccaagagctcgagtcaacacatagcatt

SEQ ID NO: 313383 - DNA, 75 bp, Artificial Sequence
  Synthetic
caaaccaagctattctctaaacaacagtgctcaacagttaagaaggagctaatccattttagtaattaaaaataa

SEQ ID NO: 313384 - DNA, 75 bp, Artificial Sequence
  Synthetic
tatgtaataataagctatatttagatatattgaaagtattaaaacacttaaaaaccttttttaatcttgatagta

SEQ ID NO: 313385 - DNA, 75 bp, Artificial Sequence
  Synthetic
tattatgtgactactaattggaagcatacagctacacgtttttcaatcaaaccactagaggattaaactcaatta

SEQ ID NO: 313386 - DNA, 75 bp, Artificial Sequence
  Synthetic
aaacatcataaacatctacactacacacttcatcacacaaaccaatcccactcaaaatccaaaatcacttccagc

SEQ ID NO: 313387 - DNA, 75 bp, Artificial Sequence
  Synthetic
aataggtaaataaaacaagaatatggggtaaatagatatcagttagagttcaaccaatttcaacaaccatctata

SEQ ID NO: 313388 - DNA, 75 bp, Artificial Sequence
  Synthetic
cacagaagagccaaccatcaacaccaccaaaacaaacatcacaactacactgctcaccaacaacaccacaggaaa

SEQ ID NO: 313389 - DNA, 75 bp, Artificial Sequence
  Synthetic
accttccactcaacctcctccgaaggcaatctaagcccttctcaagtctccacaacatccgagcacccatcacaa

SEQ ID NO: 313390 - DNA, 75 bp, Artificial Sequence
  Synthetic
cacaacatccgagcacccatcacaaccctcatctccacccaacacaacacgccagtagttattaaaaaacatatt

SEQ ID NO: 313391 - DNA, 75 bp, Artificial Sequence
  Synthetic
gctatggcaagacttaggaatgaggaaagcgaaaaaatggcaaaagacacctcagatgaagtgtctctcaatcca

SEQ ID NO: 313392 - DNA, 75 bp, Artificial Sequence
  Synthetic
tctgtaacaaaactcttgaacaaggacagatgtatcaaatcaacacatagtgttctcccattatgctgtgtcaaa

SEQ ID NO: 313393 - DNA, 75 bp, Artificial Sequence
  Synthetic
ctagaaaagacctgggatactcttaatcatctaattgtaatatcctcttgtttatacaaattaaatttaaaatct

SEQ ID NO: 313394 - DNA, 75 bp, Artificial Sequence
  Synthetic
atcaataaaacagacaccaatccattgaatcaattgccagactgaaaaaacaaacatccatcagcagaaccacca

SEQ ID NO: 313395 - DNA, 75 bp, Artificial Sequence
  Synthetic
gtacaatctctgttctcttggttgcatttaacaatacctcttgtcacaataatatgtacatatagacatgcacct

SEQ ID NO: 313396 - DNA, 75 bp, Artificial Sequence
  Synthetic
cacttaaatttaactcctttggttagagatgggcagcaattcattgagtatgataaaagttagattgcaaaattt

SEQ ID NO: 313397 - DNA, 75 bp, Artificial Sequence
  Synthetic
tgactcaataatgttaccatcgttatctaataagaagcttattaaatcgtctacaatgattagaaccaattacag

SEQ ID NO: 313398 - DNA, 75 bp, Artificial Sequence
  Synthetic
aagaccacagaaagagacaccagcaccccacaatccaccgtgctcgacacaaccacatcaaaacacacagaaaga

SEQ ID NO: 313399 - DNA, 75 bp, Artificial Sequence
  Synthetic
ttaaaagtaataatagaaacaaacctaaattttgtataagtggaaatactgaatctatgatgacgtcaacattct

SEQ ID NO: 313400 - DNA, 75 bp, Artificial Sequence
  Synthetic
acagcatctaggtgttattgaggatatatatacaatatatatattagtgtcataacactcaatcctaatactgac

SEQ ID NO: 313401 - DNA, 75 bp, Artificial Sequence
  Synthetic
taacaaaaatagctacacactaacattgtattcaattatagttatttaaaattaataattatataattttttaat

SEQ ID NO: 313402 - DNA, 75 bp, Artificial Sequence
  Synthetic
cgatttgcaatcaaacccatggaagattaacctctttcctccacataagtgagtcgaatcacacaaacttcttac

SEQ ID NO: 313403 - DNA, 75 bp, Artificial Sequence
  Synthetic
tccatagacaacaaagatgaattcatggaagaactgagtactggaacacttggactgtcatatgaaaaagccaaa

SEQ ID NO: 313404 - DNA, 75 bp, Artificial Sequence
  Synthetic
agtgttcaacttcgttccctgtagtatatgtggcaacaatcaactctgcaaatccatttgcaaaacaataccaag

SEQ ID NO: 313405 - DNA, 75 bp, Artificial Sequence
  Synthetic
ttgataagtaccacttaaatttaactcctttggttagagatgggcagcaattcattgagtatgataaaagttaga

SEQ ID NO: 313406 - DNA, 75 bp, Artificial Sequence
  Synthetic
tcaatcaatctcaacaaccatctataccgccaattcaatacatatactgcaaatctcaaaatgggaaacacatcc

SEQ ID NO: 313407 - DNA, 75 bp, Artificial Sequence
  Synthetic
aaatctcaaaatgggaaacacatccatcacaatagaattcacaagcaaattttggccctattttacactaataca

SEQ ID NO: 313408 - DNA, 75 bp, Artificial Sequence
  Synthetic
tcacaatatctgtcaacatagacaagtcaacacgccaaacaaaatcaaccaatggaaaatacatccataacaata

SEQ ID NO: 313409 - DNA, 75 bp, Artificial Sequence
  Synthetic
atatgaatcaattatctgaattacttggatttgaccttaatccataaattataataaatatcaactagcaaatca

SEQ ID NO: 313410 - DNA, 75 bp, Artificial Sequence
  Synthetic
caatccacacaaactcagccacaatatcacctaatacaaaatcagaaacacaccatacaacagcacaaaccaaag

SEQ ID NO: 313411 - DNA, 75 bp, Artificial Sequence
  Synthetic
ctttaagcacttacatgttaacaaacagtgagttactatcattaatcaatgatatgcctataacaaatgatcaga

SEQ ID NO: 313412 - DNA, 75 bp, Artificial Sequence
  Synthetic
gttatttaaaaactacatcttagcagagaaccgtgatccctcaagcaagaacgaaattaaatctggggcaaataa

SEQ ID NO: 313413 - DNA, 75 bp, Artificial Sequence
  Synthetic
taccagcagacgtgctgaagaagacaataaagaacacattagatatccacaaaagcataaccataagcaacccaa

SEQ ID NO: 313414 - DNA, 75 bp, Artificial Sequence
  Synthetic
ttgctacattcaatcataaagacatattacaatttaaccacaaccatttggataaccaccagtgtttattaaatc

SEQ ID NO: 313415 - DNA, 75 bp, Artificial Sequence
  Synthetic
caatgatagattagaagctatggcaagactcaggaatgaggaaagtgaaaagatggcaaaagacacatcagatga

SEQ ID NO: 313416 - DNA, 75 bp, Artificial Sequence
  Synthetic
aagctaaaattactagcgaaatcaatagactggcagttacagaggttttgagcacagctccaaacaaaatattct

SEQ ID NO: 313417 - DNA, 75 bp, Artificial Sequence
  Synthetic
attaggcaatgctgctggcctaggcataatgggagaatacagaggtacaccaaggaatcaagatctatatgatgc

SEQ ID NO: 313418 - DNA, 75 bp, Artificial Sequence
  Synthetic
cttataacaaaaatagctacacactaacattgtattcaattatagttatttaaaattaataattatataattttt

SEQ ID NO: 313419 - DNA, 75 bp, Artificial Sequence
  Synthetic
tggggcaaataagaatttgataagtgctatttaagtctaacctttttaatcagaaatggggtgcaattcactgag

SEQ ID NO: 313420 - DNA, 75 bp, Artificial Sequence
  Synthetic
attctgaattagaaaataattacaacaaattatatcatcctacaccagaaactctagaaaatatactaaccaatc

SEQ ID NO: 313421 - DNA, 75 bp, Artificial Sequence
  Synthetic
atatggtagaatctacatatccttacctaagtgaattgttaaacagcttgacaactaatgaacttaaaaaactga

SEQ ID NO: 313422 - DNA, 75 bp, Artificial Sequence
  Synthetic
actttagaaaatatatcattaatccctgttaaaagtaataatagtaacaaacctaaattttgtataagtggaaat

SEQ ID NO: 313423 - DNA, 75 bp, Artificial Sequence
  Synthetic
aagatcttataataaaaattcctatagctatacactagcactgtattcaattatagttattaaaaaattaaaaat

SEQ ID NO: 313424 - DNA, 75 bp, Artificial Sequence
  Synthetic
gataaaaatccaaatgccgagtttgtaacattgatgagggatccacaggctttagggtctgaaaggcaagctaaa

SEQ ID NO: 313425 - DNA, 75 bp, Artificial Sequence
  Synthetic
gtattttgtgacacaatgaacagtttaacattaccaagtgaagtaaatctctgcaacattgacatattcaacccc

SEQ ID NO: 313426 - DNA, 75 bp, Artificial Sequence
  Synthetic
attacaaccataatcaaagatgatatacttttagctgttaaggataatcaatctcatcttaaagcagacaaaaat

SEQ ID NO: 313427 - DNA, 75 bp, Artificial Sequence
  Synthetic
cacaaatatcatgataactactataattatagtaattatagtaatattgttatcattaattgcagttggactgct

SEQ ID NO: 313428 - DNA, 75 bp, Artificial Sequence
  Synthetic
aaatattatgttaggacacgctagtgtgcaagcagaaatggaacaagttgtggaggtttatgaatatgcccaaaa

SEQ ID NO: 313429 - DNA, 75 bp, Artificial Sequence
  Synthetic
ccctacaatatcagggtatggaacatggccgcaggcgctggcaagaccacccgcatcctcgctgccttcacgcgc

SEQ ID NO: 313430 - DNA, 75 bp, Artificial Sequence
  Synthetic
aggactcctattcccatggagaaactcctagatgaggttcttgcccccggtgggccttataacttaaccgtcggc

SEQ ID NO: 313431 - DNA, 75 bp, Artificial Sequence
  Synthetic
tcctagatgaggttcttgcccccggtgggccttataacttaaccgtcggcagttgggtaagagaccacgtccgct

SEQ ID NO: 313432 - DNA, 75 bp, Artificial Sequence
  Synthetic
cgccagcgacgtgctgcccggccactggctccaaggcggctggggttgctacaacctgagcgactggcaccaggg

SEQ ID NO: 313433 - DNA, 75 bp, Artificial Sequence
  Synthetic
agttgggtaagagaccacgtccgctcaattgtcgagggcgcgtgggaagtgcgcgatgttgttaccgctgcccaa

SEQ ID NO: 313434 - DNA, 75 bp, Artificial Sequence
  Synthetic
atgggacgcgcgacttgctccccagcctcggccctctggctcgccacagcgaacgcgctgtctcttgaccacgcg

SEQ ID NO: 313435 - DNA, 75 bp, Artificial Sequence
  Synthetic
caattgtcgagggcgcgtgggaagtgcgcgatgttgttaccgctgcccaaaagcgggccatcgtagccgtgatac

SEQ ID NO: 313436 - DNA, 75 bp, Artificial Sequence
  Synthetic
aagcgggccatcgtagccgtgatacccagacctgtgttcacgcagatgcaggttagtgatcacccagcactccac

SEQ ID NO: 313437 - DNA, 75 bp, Artificial Sequence
  Synthetic
tgtctgtcacaccaagcacatggatttctggtgcgtggagcacgaccgaccgccgcccgccaccccgacgcctct

SEQ ID NO: 313438 - DNA, 75 bp, Artificial Sequence
  Synthetic
ctatggcgaggaggctttcacctacctctgcactgcaccggggtgcgccactcaaacacctgtccccgtgcgcct

SEQ ID NO: 313439 - DNA, 75 bp, Artificial Sequence
  Synthetic
ctcaaacacctgtccccgtgcgcctcgctggcgtccgctttgagtccaagatcgtggacggcggctgctttgccc

SEQ ID NO: 313440 - DNA, 75 bp, Artificial Sequence
  Synthetic
caccaccgcggctaactccacgcccgccgccacccccgccactgcgccggccccttgctacgccggcctcaatga

SEQ ID NO: 313441 - DNA, 75 bp, Artificial Sequence
  Synthetic
gccgccacccccgccactgcgccggccccttgctacgccggcctcaatgacagctgcggcggtttcctgtctggg

SEQ ID NO: 313442 - DNA, 75 bp, Artificial Sequence
  Synthetic
tgttcccgtgggtcctgatattcatggtgtgccgccgcgcctgtcgccgccgcggcgccgccgccgccctcaccg

SEQ ID NO: 313443 - DNA, 75 bp, Artificial Sequence
  Synthetic
actcctctggcgggtacgcgcagctggcctcttacttcaaccctggcggcagctactacaagcagtaccacccca

SEQ ID NO: 313444 - DNA, 75 bp, Artificial Sequence
  Synthetic
actgtgcctccacaggacggcacgcaaactcgccaccgccctggccgagacggccagcgaggcgtggcacgccga

SEQ ID NO: 313445 - DNA, 75 bp, Artificial Sequence
  Synthetic
agctactacaagcagtaccaccccaccgcgtgcgaggttgaacctgccttcggacacagcgacgcggcctgctgg

SEQ ID NO: 313446 - DNA, 75 bp, Artificial Sequence
  Synthetic
ggcctcttacttcaaccctggcggcagctactacaagcagtaccaccccaccgcgtgcgaggttgaacctgcctt

SEQ ID NO: 313447 - DNA, 75 bp, Artificial Sequence
  Synthetic
ccgagcggccccttctacgtccaccctgaggacgtcccgcacggcggtcgcgccgtggcggacagatgcttgctc

SEQ ID NO: 313448 - DNA, 75 bp, Artificial Sequence
  Synthetic
gtcaagtttcatacagagactaggaccgtctggcaactctccgtagccggcgtgtcgtgcgatgtcaccactgaa

SEQ ID NO: 313449 - DNA, 75 bp, Artificial Sequence
  Synthetic
cgccgtggcggacagatgcttgctctactacacacccatgcagatgtgcgagctgatgcgcaccattgacgccac

SEQ ID NO: 313450 - DNA, 75 bp, Artificial Sequence
  Synthetic
tacgcgcatacaccgtgcgcgaggcccagggtatgagcgtcggcaccgcctgcatccatgtaggcagagacggca

SEQ ID NO: 313451 - DNA, 75 bp, Artificial Sequence
  Synthetic
cgccgtggcggacagatgcttgctttactacacacccatgcagatgtgcgagctgatgcgcaccattgacgccac

SEQ ID NO: 313452 - DNA, 75 bp, Artificial Sequence
  Synthetic
tactacacacccatgcagatgtgcgagctgatgcgcaccattgacgccaccttgctcgtggcggttgacttgtgg

SEQ ID NO: 313453 - DNA, 75 bp, Artificial Sequence
  Synthetic
cggacgttgccctggcgctgacacgcgacctcgccatcgtcagcctgacccgggcctccgacgcactctacctcc

SEQ ID NO: 313454 - DNA, 75 bp, Artificial Sequence
  Synthetic
tgcatccatgtaggcagagacggcacggacgttgccctggcgctgacacgcgacctcgccatcgtcagcctgacc

SEQ ID NO: 313455 - DNA, 75 bp, Artificial Sequence
  Synthetic
cccccgaaatcgccgccccgccctgagatcgccgcgacttggatcgtccacgcggccagcgcagaccgccattgt

SEQ ID NO: 313456 - DNA, 75 bp, Artificial Sequence
  Synthetic
attatgaattacaccggcaatcaacagtcccggtggggcctcgggagcccgaactgtcatggccccgattgggcc

SEQ ID NO: 313457 - DNA, 75 bp, Artificial Sequence
  Synthetic
gaacgcgctgtctcttgaccacgcccttgcggcctttgtcctgctggttccgtgggtcctgatattcatggtgtg

SEQ ID NO: 313458 - DNA, 75 bp, Artificial Sequence
  Synthetic
agctgatgcgcaccattgacgccaccttgctcgtggcggttgacttgtggccggtcgcccttgcggcccacgtcg

SEQ ID NO: 313459 - DNA, 75 bp, Artificial Sequence
  Synthetic
cgggcctccgacgcactctacctccacgagctcgaggacggctcactgcgcgctgcggggctcagcgcgttcctc

SEQ ID NO: 313460 - DNA, 75 bp, Artificial Sequence
  Synthetic
gccgtagccgaactttcatgggaggtcgcccaacattgcgggcaccaggcgcgtattcgcgccgtgcgatgcgcc

SEQ ID NO: 313461 - DNA, 75 bp, Artificial Sequence
  Synthetic
caccccgcaatgtgcgtgtgaccggttgctaccagtgcggtacccccgcgctggtggaaggccttgccccagggg

SEQ ID NO: 313462 - DNA, 75 bp, Artificial Sequence
  Synthetic
tcctcaacacccccccgccctaccaagtcagctgcgggggcgagagcgatcgcgcgagcgcgcgggtcattgacc

SEQ ID NO: 313463 - DNA, 75 bp, Artificial Sequence
  Synthetic
gtgggccggtggcggtggttcagcctcccccgccccgtgttccagcgcatgctgtcctactgcaagaccctgagc

SEQ ID NO: 313464 - DNA, 75 bp, Artificial Sequence
  Synthetic
ggtgtatggcacacacaccactgctgtgtcggagacccggcagacctgggcggagtgggctgctgctcattggtg

SEQ ID NO: 313465 - DNA, 75 bp, Artificial Sequence
  Synthetic
tcgatcgcggcccccttgaggacggcgggcaccacttggccaccgtgcaacctcccaagccgccgccccgccctg

SEQ ID NO: 313466 - DNA, 75 bp, Artificial Sequence
  Synthetic
tgttcaagttcaagaacgccctgagccacagcatcacgctcgcgggcaatgtgctgcaagaggggtggaagggca

SEQ ID NO: 313467 - DNA, 75 bp, Artificial Sequence
  Synthetic
gtgctgcaagaggggtggaagggcacgtgcgccgaggaagacgcgctgtgcgcatacgtggccttccgcgcgtgg

SEQ ID NO: 313468 - DNA, 75 bp, Artificial Sequence
  Synthetic
gcgtgcgccccccgctgcgacgtcccacgcgaacgcccttctgcgcctccgggcccgccagatgacgaggcgctc

SEQ ID NO: 313469 - DNA, 75 bp, Artificial Sequence
  Synthetic
cacgcgaacgcccttctgcgcctccgggcccgccagatgacgaggcgctcatcccgccgtggctgttcgccgagc

SEQ ID NO: 313470 - DNA, 75 bp, Artificial Sequence
  Synthetic
cagtctaacgccaggttggcggggattatgaaaagcgcgaagcgctgcgccgccgactctttgagcgtggccggc

SEQ ID NO: 313471 - DNA, 75 bp, Artificial Sequence
  Synthetic
tggctggacaccatttgggacgccattaagcggttcttcggcagcgtgcccctcgccgagcgcatggaggagtgg

SEQ ID NO: 313472 - DNA, 75 bp, Artificial Sequence
  Synthetic
cctcgccgagcgcatggaggagtgggaacaggacgccgcggtcgccgccttcgaccgcggccccctcgaggacgg

SEQ ID NO: 313473 - DNA, 75 bp, Artificial Sequence
  Synthetic
gaacaggacgccgcggtcgccgccttcgaccgcggccccctcgaggacggcgggcgccacttggacaccgtgcaa

SEQ ID NO: 313474 - DNA, 75 bp, Artificial Sequence
  Synthetic
tcgaccgcggccccctcgaggacggcgggcgccacttggacaccgtgcaacccccaaaatcgccgccccgccctg

SEQ ID NO: 313475 - DNA, 75 bp, Artificial Sequence
  Synthetic
ggccctggtcttatgcgacccacttggccagccgctccggggccccgagcgccatttcgccgccggtgcgcacat

SEQ ID NO: 313476 - DNA, 75 bp, Artificial Sequence
  Synthetic
cccccaaaatcgccgccccgccctgagatcgccgcgacctggatcgtccacgcagccagcgcagaccgccattgc

SEQ ID NO: 313477 - DNA, 75 bp, Artificial Sequence
  Synthetic
agatcgccgcgacctggatcgtccacgcagccagcgcagaccgccattgcgcgtgcgctccccgctgcgacgccc

SEQ ID NO: 313478 - DNA, 75 bp, Artificial Sequence
  Synthetic
ccgagcgcccctgggctgacgggggcgctagaacgtgggcgaagttcttccgcagctgcgcctgggcacagcgct

SEQ ID NO: 313479 - DNA, 75 bp, Artificial Sequence
  Synthetic
cgcagccagcgcagaccgccattgcgcgtgcgctccccgctgcgacgccccgcgcgaacgtccttccgcgcccgc

SEQ ID NO: 313480 - DNA, 75 bp, Artificial Sequence
  Synthetic
ctacgtgtgcgcgctgcgtggcgcaccgagcggccctttctacgtccaccctgaggacgtcccgcgcggcggtcg

SEQ ID NO: 313481 - DNA, 75 bp, Artificial Sequence
  Synthetic
agtcccggtggggcctagggagcccgaactgtcacggccccgattgggcctccccggtttgccaacgtcattctc

SEQ ID NO: 313482 - DNA, 75 bp, Artificial Sequence
  Synthetic
atcccgccgtggctgttcgccgagcgccgtgccctccgctgccgcgagtgggatttcgaggctctccgcgcgcgc

SEQ ID NO: 313483 - DNA, 75 bp, Artificial Sequence
  Synthetic
cgggcgccacttggacaccgtgcaacccccaaaatcgccgccccgccctgagatcgccgcgacctggatcgtcca

SEQ ID NO: 313484 - DNA, 75 bp, Artificial Sequence
  Synthetic
ccggttgccctcgcggcccacgtcggcgacgactgggacgacctgggcatcgcgtggcacctcgaccatgacggc

SEQ ID NO: 313485 - DNA, 75 bp, Artificial Sequence
  Synthetic
gcgcggtgaccgccgccgtgcgcgcgggctccggtcagcctgcgccggccgcaccccccccggacgattcctcgc

SEQ ID NO: 313486 - DNA, 75 bp, Artificial Sequence
  Synthetic
gcaccccccccggacgattcctcgccaccccgccgtgcacggcggtcgcggcgacccccggacacccgcggcctt

SEQ ID NO: 313487 - DNA, 75 bp, Artificial Sequence
  Synthetic
ctgcgcgaactgggctccactgagaccggctgcgagcgcacaagcggcgagcccgccacgctgctgcacaacacc

SEQ ID NO: 313488 - DNA, 75 bp, Artificial Sequence
  Synthetic
gcgacgactgggacgacctgggcatcgcgtggcacctcgaccatgacggcggttgccccgctgattgccgcgggg

SEQ ID NO: 313489 - DNA, 75 bp, Artificial Sequence
  Synthetic
ggccagccgctccggggccctgaacgccacttcgccgccggcgcgcatatgtgcgcgcaggcgcgggggctccag

SEQ ID NO: 313490 - DNA, 75 bp, Artificial Sequence
  Synthetic
gccccagccaccctgggggagccggtggatcgcgcgcgtgacgccgagctggaagtcgcctgcgacccgagcggc

SEQ ID NO: 313491 - DNA, 75 bp, Artificial Sequence
  Synthetic
tggatcgcgcgcgtgacgccgagctggaagtcgcctgcgacccgagcggcccccccgcgccaaccagggcggacc

SEQ ID NO: 313492 - DNA, 75 bp, Artificial Sequence
  Synthetic
cagacagcgacattgtcgaaagctacgcccgcgccgccggtcctgtgcaccttcgcgttcgcgacatcatggacc

SEQ ID NO: 313493 - DNA, 75 bp, Artificial Sequence
  Synthetic
cgcggctgcgcctgggcgcagcgcttgctcggcgagccggcagtcatgcacctcccatacaccgatggcgacgtg

SEQ ID NO: 313494 - DNA, 75 bp, Artificial Sequence
  Synthetic
cgtgcgctgaggaggacgcgctgtgcgcatacgtagccttccgcgcgtggcagtccaacgccaggctggcaggga

SEQ ID NO: 313495 - DNA, 75 bp, Artificial Sequence
  Synthetic
cagtccaacgccaggctggcagggatcatgaaaggcgcgaagcgctgcgccgccgactctctgagtgtggccggc

SEQ ID NO: 313496 - DNA, 75 bp, Artificial Sequence
  Synthetic
gactacagcgcggagcgcgtcctcgccatcgtgcgcgaacttaccgcgtacgcgcgggggcgcggcctcgaccac

SEQ ID NO: 313497 - DNA, 75 bp, Artificial Sequence
  Synthetic
cgcgcgggggcgcggcctcgaccacccggccaccatcggcgcgctcgaggagattcagaccccctacgcgcgcgc

SEQ ID NO: 313498 - DNA, 75 bp, Artificial Sequence
  Synthetic
ccagcgcagcgcgtcaccccccgctaccccctctggggaggccaccgcgcctgagtcgcgcgggtgccaggggtg

SEQ ID NO: 313499 - DNA, 75 bp, Artificial Sequence
  Synthetic
cctcgccgagcgcatggaggagtgggaacaggacgctgccgtcgccgccttcgaccgcggcccccttgaggacgg

SEQ ID NO: 313500 - DNA, 75 bp, Artificial Sequence
  Synthetic
gtccttcccacttccgcggggccggcggatcgcgcgcgtcacgccgagctggaggtcgcttacgaaccgagcgac

SEQ ID NO: 313501 - DNA, 75 bp, Artificial Sequence
  Synthetic
accgttgtttcgccgcatctggtgggtaccccacttttgccattcgggagagccccagggtgcccgaatggcttc

SEQ ID NO: 313502 - DNA, 75 bp, Artificial Sequence
  Synthetic
ccactatagtgtgctcaagcccgcggaggtgaggcccccgcggggcatgtgcgggagtgacatgtggcgctgccg

SEQ ID NO: 313503 - DNA, 75 bp, Artificial Sequence
  Synthetic
ccccccacgccaaccaaggcagacccagacagcgacatcgttgaaagttacgcccgcgccgccggacccgtgcac

SEQ ID NO: 313504 - DNA, 75 bp, Artificial Sequence
  Synthetic
cagacagcgacatcgttgaaagttacgcccgcgccgccggacccgtgcacctccgagtccgcgacatcatggacc

SEQ ID NO: 313505 - DNA, 75 bp, Artificial Sequence
  Synthetic
cgcagccagtgcggaccgccattgcgcgtgcgctccccgctgcgacgccccgcgcgagcgtccttccgcgcctgc

SEQ ID NO: 313506 - DNA, 75 bp, Artificial Sequence
  Synthetic
cgcccgcgccgccggacccgtgcacctccgagtccgcgacatcatggacccaccgcccggctgcaaggtcgtggt

SEQ ID NO: 313507 - DNA, 75 bp, Artificial Sequence
  Synthetic
gcgtgcgctccccgctgcgacgccccgcgcgagcgtccttccgcgcctgccgccccgccggaagacgaggcgctt

SEQ ID NO: 313508 - DNA, 75 bp, Artificial Sequence
  Synthetic
cgctgcagactgccggcgcctcgccccatgccccaccggcgaggcagtggcgacacccggccacggctgcgggta

SEQ ID NO: 313509 - DNA, 75 bp, Artificial Sequence
  Synthetic
ccatgccccaccggcgaggcagtggcgacacccggccacggctgcgggtacacccacatcatccacgccgtcgcg

SEQ ID NO: 313510 - DNA, 75 bp, Artificial Sequence
  Synthetic
gccacttcgccgccggcgcgcacatgtgcgcgcaggcgcgcgggctccaggcttttgtccgtgttgtgcctccac

SEQ ID NO: 313511 - DNA, 75 bp, Artificial Sequence
  Synthetic
ccgcggcgtcctcgggaccccgccgccctcgaggagggcgaagcgctgctcgagcgcgcctaccgcagcatcgtc

SEQ ID NO: 313512 - DNA, 75 bp, Artificial Sequence
  Synthetic
ccctcgaggagggcgaagcgctgctcgagcgcgcctaccgcagcatcgtcgcgctagccgccgcgcgtcggtggg

SEQ ID NO: 313513 - DNA, 75 bp, Artificial Sequence
  Synthetic
cgagcgcgcctaccgcagcatcgtcgcgctagccgccgcgcgtcggtgggcgtgtgtcgcgtgccccctcctcgg

SEQ ID NO: 313514 - DNA, 75 bp, Artificial Sequence
  Synthetic
cgtgtgtcgcgtgccccctcctcggcgctggcgtctacggctggtctgctgcggagtccctccgagccgcgctcg

SEQ ID NO: 313515 - DNA, 75 bp, Artificial Sequence
  Synthetic
cgctggcgtctacggctggtctgctgcggagtccctccgagccgcgctcgcggctacgcgcgccgagcccgccga

SEQ ID NO: 313516 - DNA, 75 bp, Artificial Sequence
  Synthetic
tcgttgccagccaaaccaccgcggaggtgatctgcgtcggcgatcgggaccagtgcggcccgcactacgctaaca

SEQ ID NO: 313517 - DNA, 75 bp, Artificial Sequence
  Synthetic
gcgcgtgagcctgcacatctgccaccccgaccgcgccacgctgacgcacgcctccgtgctcgtcggcgcggggct

SEQ ID NO: 313518 - DNA, 75 bp, Artificial Sequence
  Synthetic
cccgaccgcgccacgctgacgcacgcctccgtgctcgtcggcgcggggctcgctgccaggcgcgtcagtcctcct

SEQ ID NO: 313519 - DNA, 75 bp, Artificial Sequence
  Synthetic
cctccgtgctcgtcggcgcggggctcgctgccaggcgcgtcagtcctcctccgaccgagcccctcgcatcttgcc

SEQ ID NO: 313520 - DNA, 75 bp, Artificial Sequence
  Synthetic
cacccccccactcgacgaggacggccgctgggaccctgcgctcatgtacaacccttgcgggcctgagccgcccgc

SEQ ID NO: 313521 - DNA, 75 bp, Artificial Sequence
  Synthetic
ccgaccgagcccctcgcatcttgccccgccggcgacccgggccgaccggctcagcgcagcgcgtcgcccccagcg

SEQ ID NO: 313522 - DNA, 75 bp, Artificial Sequence
  Synthetic
atgcggtcaccgccgccgtgcgcgctggccccggccagtccgcgcccgcatcaccgccacccggcgaccccccgc

SEQ ID NO: 313523 - DNA, 75 bp, Artificial Sequence
  Synthetic
tcagcgcagcgcgtcgcccccagcgaccccccttggggatgccaccgcgcccgagccccgcggatgccaggggtg

SEQ ID NO: 313524 - DNA, 75 bp, Artificial Sequence
  Synthetic
cacgtcggccgggacggcacggacgtggccctggcgctgacacgcgacctcgccatcgtcagcctgacccgggcc

SEQ ID NO: 313525 - DNA, 75 bp, Artificial Sequence
  Synthetic
cgccgcgccgcactcggcgatcgcagcggcactcggacgcctgcggcacaccgccccccgcgcccgcgcgcgacc

SEQ ID NO: 313526 - DNA, 75 bp, Artificial Sequence
  Synthetic
cgaactctgccggtacacgcgcgtcaccaatgaccgcgcctatgtcaacctgtggctcgagcgcgaccgcggcgc

SEQ ID NO: 313527 - DNA, 75 bp, Artificial Sequence
  Synthetic
cgccaccgcccgcccccagcccgcccgcaccaccccgcgcgggcgacccggcccctcccacccccgcggggtcgg

SEQ ID NO: 313528 - DNA, 75 bp, Artificial Sequence
  Synthetic
tgtggctcgagcgcgaccgcggcgccaccagctgggcgatgcgcattcccgaggtggtcgtctacgggccggagc

SEQ ID NO: 313529 - DNA, 75 bp, Artificial Sequence
  Synthetic
caccagctgggcgatgcgcattcccgaggtggtcgtctacgggccggagcacctcgccacgcattttccattaaa

SEQ ID NO: 313530 - DNA, 75 bp, Artificial Sequence
  Synthetic
cgtccgtgcgtacaatcaacctgccggcgatgtcaggggcgtttggggcaaaggggagcgcacctacgccgagca

SEQ ID NO: 313531 - DNA, 75 bp, Artificial Sequence
  Synthetic
acctcgccacgcattttccattaaaccactacagtgtgctcaagcccgcggaggtcaggcccccgcgaggcatgt

SEQ ID NO: 313532 - DNA, 75 bp, Artificial Sequence
  Synthetic
gcccctcccacccccgcggggtcggcggatcgtgcgcacgacgccgagctggaggtcgcctgcgaaccgagcggc

SEQ ID NO: 313533 - DNA, 75 bp, Artificial Sequence
  Synthetic
ggggcactggcggagctcaaggaggtccccgccggcatcgaccgcgtcgttgccgtcgagcaggcgccgccacca

SEQ ID NO: 313534 - DNA, 75 bp, Artificial Sequence
  Synthetic
cgcgccaccccgcgcgggtgacctggccccccccattctcgcggggccggcggatcgcgcgcgtgacgccgagct

SEQ ID NO: 313535 - DNA, 75 bp, Artificial Sequence
  Synthetic
ccgccgcagcccccccgtgcgcacgggcagcattacggccaccaccaccaccaactgccattcctcggacacgac

SEQ ID NO: 313536 - DNA, 75 bp, Artificial Sequence
  Synthetic
caacgccgccaacgaggggctgctcgccggctctggcgtgtgcggcgccatcttcgccaacgccacggcggccct

SEQ ID NO: 313537 - DNA, 75 bp, Artificial Sequence
  Synthetic
ccacacccggccacggctgcgggtacgcccacatcatccacgccgtagcgccgcggcgtcctcgggaccccgccg

SEQ ID NO: 313538 - DNA, 75 bp, Artificial Sequence
  Synthetic
cactcatgtctgtcacaccaagcacatggacttctggtgtgtggagcacgaccgaccgccgcccgcgaccccgac

SEQ ID NO: 313539 - DNA, 75 bp, Artificial Sequence
  Synthetic
atggacttctggtgtgtggagcacgaccgaccgccgcccgcgaccccgacgcctctcaccaccgcggcgaactcc

SEQ ID NO: 313540 - DNA, 75 bp, Artificial Sequence
  Synthetic
ctgagccagcggtggagcgcgagccacgccgatgcctcccctgacggcaccggagatcccctcgaccccctgatg

SEQ ID NO: 313541 - DNA, 75 bp, Artificial Sequence
  Synthetic
gcctctcaccaccgcggcgaactccacgaccgccgccacccccgccactgcgccggccccctgccacgccggcct

SEQ ID NO: 313542 - DNA, 75 bp, Artificial Sequence
  Synthetic
cggagatcccctcgaccccctgatggagaccgtgggatgcgcctgttcgcgcgtgtgggtcggctccgagcacga

SEQ ID NO: 313543 - DNA, 75 bp, Artificial Sequence
  Synthetic
gagaccgtgggatgcgcctgttcgcgcgtgtgggtcggctccgagcacgaggccccgcccgaccacctcctggtg

SEQ ID NO: 313544 - DNA, 75 bp, Artificial Sequence
  Synthetic
tccaaccaggtcatcacccaccgttgtttcgccgcatctggtgggtaccgcactcttgccattcgggagagcccc

SEQ ID NO: 313545 - DNA, 75 bp, Artificial Sequence
  Synthetic
ggccccgcccgaccacctcctggtgtccctccaccgtgcccccaatggtccgtggggcgtagtgctcgaggtgcg

SEQ ID NO: 313546 - DNA, 75 bp, Artificial Sequence
  Synthetic
gcggagtccctccgagccgcgctcgcggctatgcgcaccgagcctgccgagcgcgtgagcttgcacatttgccac

SEQ ID NO: 313547 - DNA, 75 bp, Artificial Sequence
  Synthetic
gattttccagggtgacgacatggtcatctttctccctgagggcgcacgcagcgcggcactcaagtggaccccctc

SEQ ID NO: 313548 - DNA, 75 bp, Artificial Sequence
  Synthetic
ccgccggcgacccgggccggccggctcagcgcagcgcgtcgcccccagcgaaaccccttggggatgccgccgcgc

SEQ ID NO: 313549 - DNA, 75 bp, Artificial Sequence
  Synthetic
accggccacttcgtctgcgcggtcggcggcggcccacgccgcgtctcggaccgcccccacctttggctcgcggtc

SEQ ID NO: 313550 - DNA, 75 bp, Artificial Sequence
  Synthetic
cgctgccaggcgcgtcagtcctcctccgactgagcccctcgcatcttgccccgccagtgatccgggccgactggc

SEQ ID NO: 313551 - DNA, 75 bp, Artificial Sequence
  Synthetic
accgcccgccccgaagacggctggacttgccgcggcgtgcccgcccatccaggtacccgctgccccgaactggtg

SEQ ID NO: 313552 - DNA, 75 bp, Artificial Sequence
  Synthetic
tcccccctgggaactggtcgtccttaccgcccgccccgaagacggctggacttgccgcggcgtgcccgcccatcc

SEQ ID NO: 313553 - DNA, 75 bp, Artificial Sequence
  Synthetic
ccccagcctcggccctctggctcgccacagcgaacgcgctgtctcttgaccacgccctcgcggccttcgtcctgc

SEQ ID NO: 313554 - DNA, 75 bp, Artificial Sequence
  Synthetic
tggcccgggcggccctcgcatcagtccaacgccctcgcaaaggcccctacaatatcagggtatggaacatggccg

SEQ ID NO: 313555 - DNA, 75 bp, Artificial Sequence
  Synthetic
tgccaacgccgcgtactacgactacagcgcggagcgcgtcctcgccatcgtgcgcgaactcaccgcatacgcgcg

SEQ ID NO: 313556 - DNA, 75 bp, Artificial Sequence
  Synthetic
tccgcgccgccgccaacgttgcgcaggctgcgcgcgcctgcggcgcctacacgagcgccgggtgccccaagtgcg

SEQ ID NO: 313557 - DNA, 75 bp, Artificial Sequence
  Synthetic
cgagctctgccggtacacgcgcgtcactaacgatcgcgcctatgtcaatctgtggctcgagcgcgaccgcggcgc

SEQ ID NO: 313558 - DNA, 75 bp, Artificial Sequence
  Synthetic
caccagctgggctatgcgcattcctgaagtggttgtctacgggccggagcacctcgccacgcatttccccctaaa

SEQ ID NO: 313559 - DNA, 75 bp, Artificial Sequence
  Synthetic
ctttacgtctgccccaccaatgcgctcctgcacgagatccaggccaaactccgcgcgcgcgatatcgacatcaag

SEQ ID NO: 313560 - DNA, 75 bp, Artificial Sequence
  Synthetic
cggctggcagggcatgccgcaggtgcggtgcaccccctccaacgctcacgccgccctgtgccgcacaggcgtccc

SEQ ID NO: 313561 - DNA, 75 bp, Artificial Sequence
  Synthetic
aacgccgccacctacgagcgcgcgctgacgaaaccgctcgccgcctaccgccgcatctacattgatgaggcgttc

SEQ ID NO: 313562 - DNA, 75 bp, Artificial Sequence
  Synthetic
gcgcctcgctggcgtccgctttgagtccaagattgtggacggcggctgctttgccccatgggacctcgaggccac

SEQ ID NO: 313563 - DNA, 75 bp, Artificial Sequence
  Synthetic
tttcgccgcatctggtgggtacttcactcctgccatttgggagagccccagggtgcccaaatggcttccactacc

SEQ ID NO: 313564 - DNA, 75 bp, Artificial Sequence
  Synthetic
actctcggcggcgagtactgcgcgttcgttgccagccaaaccaccgcggaggtgatctgcgtcggtgatcgggac

SEQ ID NO: 313565 - DNA, 75 bp, Artificial Sequence
  Synthetic
ccgcacccatgaggacttcgccgcgctgagccagcggtggagcgcgagccacgcggatgcctcccctgacggcac

SEQ ID NO: 313566 - DNA, 75 bp, Artificial Sequence
  Synthetic
acttggcgcttccccgactgctgggcggcccgcctgcgcgcggggctcgattatgacatcgagggcgagcgcacc

SEQ ID NO: 313567 - DNA, 75 bp, Artificial Sequence
  Synthetic
ctccggagacgattctggccgcgactcgggagggcctcgccgccgccgcggcaaccggggccgcggccagcgtca

SEQ ID NO: 313568 - DNA, 75 bp, Artificial Sequence
  Synthetic
cgccttctcgcgcgaaaccgtgcgccgccttcacgaggctggcatacgcgcatacaccgtgcgcgaggcccaggg

SEQ ID NO: 313569 - DNA, 75 bp, Artificial Sequence
  Synthetic
tgcgcgccccgaggggggcaaccccaccggccacttcgtctgcgcagtcggcggcggcccacgccgcgtctcgga

SEQ ID NO: 313570 - DNA, 75 bp, Artificial Sequence
  Synthetic
cccccgcgcatgcaaaccgggcgcggaggcactgccccgcgccccgagctggggccaccgactaacccattccag

SEQ ID NO: 313571 - DNA, 75 bp, Artificial Sequence
  Synthetic
cagtgcggcccacactacgccaacaactgccgcacccctgtccccgaccgctggcctaccgagcgctcacgccac

SEQ ID NO: 313572 - DNA, 75 bp, Artificial Sequence
  Synthetic
cgccttcacgaggctggcatacgcgcatacaccgtgcgcgaggcccagggtatgagcgtcggcaccgcctgcatc

SEQ ID NO: 313573 - DNA, 75 bp, Artificial Sequence
  Synthetic
catacaccgtgcgcgaggcccagggtatgagcgtcggcaccgcctgcatccatgtaggcagagacggcacggacg

SEQ ID NO: 313574 - DNA, 75 bp, Artificial Sequence
  Synthetic
cgccgccgcccgcccccagcccgcccgcgccaccccgcgcgggtgactcggcccctcccacccctgcggggccgg

SEQ ID NO: 313575 - DNA, 75 bp, Artificial Sequence
  Synthetic
cctcgctgccttcacgcgcgaagacctgtatgtctgccccaccaacgcgcttctgcacgaaatccaggccaaact

SEQ ID NO: 313576 - DNA, 75 bp, Artificial Sequence
  Synthetic
tcgaggacggctcactgcgcgctgcggggctcagcgcgttcctcgacgccggggcactggcggagctcaaggagg

SEQ ID NO: 313577 - DNA, 75 bp, Artificial Sequence
  Synthetic
ggggctcagcgcgttcctcgacgccggggcactggcggagctcaaggaggttcccgccggcattgaccgcgttgt

SEQ ID NO: 313578 - DNA, 75 bp, Artificial Sequence
  Synthetic
atcagcagtcccggtggggcctcgggagcccgaattgtcatggccccgattgggcctccccggtttgccaacgcc

SEQ ID NO: 313579 - DNA, 75 bp, Artificial Sequence
  Synthetic
gtccgcgcgtacaaccaacctgccggcgacgtcaggggtgtctggggcaagggcgagcgcacctacgccgagcag

SEQ ID NO: 313580 - DNA, 75 bp, Artificial Sequence
  Synthetic
ttgccctggcgctgacacgcgaccttgccatcgtcagcctgacccgggcctccgacgcgctctacctccacgagc

SEQ ID NO: 313581 - DNA, 75 bp, Artificial Sequence
  Synthetic
ttgccgcccgccgacggcatccccgaggcccaagacgtgccgcccttctgcccccgcactctggaggagctcgtc

SEQ ID NO: 313582 - DNA, 75 bp, Artificial Sequence
  Synthetic
acctggcgcttccccgactgctgggcagcccgcctgcgcgcggggctcgattatgacgtcgagggcgagcgcacc

SEQ ID NO: 313583 - DNA, 75 bp, Artificial Sequence
  Synthetic
gccgtgcggcgctaccgcgcgggcgaggatgggtcgaccctccgcactgctgtggcccgccagcacccgcgccct

SEQ ID NO: 313584 - DNA, 75 bp, Artificial Sequence
  Synthetic
cttggggctgaagttcaagacagttcgcccggtggccctgccacgcgcgttagcgccacctcgcaatgtgcgtgt

SEQ ID NO: 313585 - DNA, 75 bp, Artificial Sequence
  Synthetic
tgtggcccgccagcacccgcgccctttccgccagatcccacccccgcgcgtcactgctggggtcgcccaggagtg

SEQ ID NO: 313586 - DNA, 75 bp, Artificial Sequence
  Synthetic
tagcgccacctcgcaatgtgcgtgtgaccggctgctaccagtgcggtacccccgcgctggtggaaggccttgccc

SEQ ID NO: 313587 - DNA, 75 bp, Artificial Sequence
  Synthetic
gagcgactggcaccagggcactcatgtctgtcacactaagcacatggacttctggtgcgtggagcacgaccggcc

SEQ ID NO: 313588 - DNA, 75 bp, Artificial Sequence
  Synthetic
ttccgccagatcccacccccgcgcgtcactgctggggtcgcccaggagtggcgcatgacgtacttgcgggaacgg

SEQ ID NO: 313589 - DNA, 75 bp, Artificial Sequence
  Synthetic
aggatgggtcgaccctccgcactgctgtggcccgccagcacccgcgccctttccgccagatcccacccccgcgcg

SEQ ID NO: 313590 - DNA, 75 bp, Artificial Sequence
  Synthetic
cttcctcaaagccaccctgaagtgcgtagacgccgccctcggccccagcgacaccgaggactgtcacgccgccca

SEQ ID NO: 313591 - DNA, 75 bp, Artificial Sequence
  Synthetic
caccgaccgctacgcgcgccgctatcctgagatcttcgccggcatgtgtaccgcccagagcctgagcgtccccgc

SEQ ID NO: 313592 - DNA, 75 bp, Artificial Sequence
  Synthetic
ggcgcactggcggagctcaaggaggttcccgctggcatcgaccgcgtcgtagccgtcgagcaggcaccaccaccg

SEQ ID NO: 313593 - DNA, 75 bp, Artificial Sequence
  Synthetic
ttatgtccccgcatttccgcgcgatccagaagatcatcatgcgcgccctgcgcccgcaattccttgtggccgctg

SEQ ID NO: 313594 - DNA, 75 bp, Artificial Sequence
  Synthetic
cgctgcccagaactggtgagccccatggggcgcgcgacttgctccccagcttcggccctctggcttgccacagcc

SEQ ID NO: 313595 - DNA, 75 bp, Artificial Sequence
  Synthetic
cgcccgcaattccttgtggccgctggccatacggagcccgaggtcgatgcgtggtggcaggctcactacaccacc

SEQ ID NO: 313596 - DNA, 75 bp, Artificial Sequence
  Synthetic
gccatgtgcatggctatgcgcatggtccccaaaggcgtgcgctgggccgggattttccagggcgacgacatggtc

SEQ ID NO: 313597 - DNA, 75 bp, Artificial Sequence
  Synthetic
aacatcagagtatggaacatggccgcgggcgctggcaagaccacccgcatcctcgctgccttcacgcgcgaagac

SEQ ID NO: 313598 - DNA, 75 bp, Artificial Sequence
  Synthetic
aacgccatcgaggtcgacttcactgagttcgacatgaaccagaccctcgctactcgggacgtcgagctcgagatt

SEQ ID NO: 313599 - DNA, 75 bp, Artificial Sequence
  Synthetic
gggcgaacgagaagtgcggtacatgcgcatctcgcgtcacctgctcaacaagaaccacaccgaaatgcctggaac

SEQ ID NO: 313600 - DNA, 75 bp, Artificial Sequence
  Synthetic
ccagaagatcatcatgcgcgccctgcgcccgcaattccttgtggccgctggccatacggagcccgaggtcgatgc

SEQ ID NO: 313601 - DNA, 75 bp, Artificial Sequence
  Synthetic
agcgccgctctcttgggcctcccttgcgccgaagactaccgcgcgctccgcgccggcagctactgcaccctgcgc

SEQ ID NO: 313602 - DNA, 75 bp, Artificial Sequence
  Synthetic
gccgtgcggcgctaccgcgcgggcgaggacgggtcgaccctccgcaccgctgtggcccgccagcacccgcgccct

SEQ ID NO: 313603 - DNA, 75 bp, Artificial Sequence
  Synthetic
ctacccccagtttctgcgggcacgtcggcaccgcggccggcctcttccatgatgtcatgcaccaggcgatcaagg

SEQ ID NO: 313604 - DNA, 75 bp, Artificial Sequence
  Synthetic
cgccggcagctactgcaccctgcgcgaactgggctccactgagaccggctgcgagcgcacaagcggcgagcccgc

SEQ ID NO: 313605 - DNA, 75 bp, Artificial Sequence
  Synthetic
gcgagcgcacaagcggcgagcccgccacgctgctacacaacaccaccgtggccatgtgcatggccatgcgcatgg

SEQ ID NO: 313606 - DNA, 75 bp, Artificial Sequence
  Synthetic
cgcctcgcagacgcgccggccgcggccgccgcgacagcgcgactccagcacctccggagacgactccggccgtga

SEQ ID NO: 313607 - DNA, 75 bp, Artificial Sequence
  Synthetic
cccgagatcttcgccggcatgtgcaccgcccagagcctgagcgtccccgccttcctcaaggccaccttgaagtgc

SEQ ID NO: 313608 - DNA, 75 bp, Artificial Sequence
  Synthetic
tccccaaaggcgtgcgctgggccgggattttccagggtgacgatatggtcatcttcctccccgagggcgcgcgca

SEQ ID NO: 313609 - DNA, 75 bp, Artificial Sequence
  Synthetic
cccggaagagcggcaagaaagccgctcccagactccggccccgaagccatcgcgggcgccgccacaacagcctca

SEQ ID NO: 313610 - DNA, 75 bp, Artificial Sequence
  Synthetic
cgaggtgggcttgttcggcttccacatcccggtgaagcatgtgagcaccccaacccccagcttctgcgggcacgt

SEQ ID NO: 313611 - DNA, 75 bp, Artificial Sequence
  Synthetic
acgccgaagaatgccatgccgcccaggggaaagccggccttgagattcgggcgtgggctaaggaatgggttcagg

SEQ ID NO: 313612 - DNA, 75 bp, Artificial Sequence
  Synthetic
cttgctcgtggcggtcgacctctggccggtcgcccttgccgcgcacgtcggcgatgactgggacgacctgggcat

SEQ ID NO: 313613 - DNA, 75 bp, Artificial Sequence
  Synthetic
cggcaccgcggccggcctcttccatgatgtcatgcaccaggcgatcaaggtgctttgccgccgtttcgacccaga

SEQ ID NO: 313614 - DNA, 75 bp, Artificial Sequence
  Synthetic
tcatgtccccgcacttccgcgcgatccagaagatcatcatgcgcgccttgcgcccgcaattcctcgtcgccgctg

SEQ ID NO: 313615 - DNA, 75 bp, Artificial Sequence
  Synthetic
gatgtcatgcaccaggcgatcaaggtgctttgccgccgtttcgacccagatgtgctcgaagaacagcaggtggcc

SEQ ID NO: 313616 - DNA, 75 bp, Artificial Sequence
  Synthetic
gcgatgactgggacgacctgggcatcgcctggcacctcgaccacgacggcggttgtcccgccgactgccgtgggg

SEQ ID NO: 313617 - DNA, 75 bp, Artificial Sequence
  Synthetic
ctcctcgaccgcctccggggggtctacgcggctctgcctgacaccgttgccgccaatgctgcgtactacgactac

SEQ ID NO: 313618 - DNA, 75 bp, Artificial Sequence
  Synthetic
atccgttctgtaacacgccgcacggacaactcgaggtccaggtcccgcccgaccccggcgacctggttgagtata

SEQ ID NO: 313619 - DNA, 75 bp, Artificial Sequence
  Synthetic
cgccaatgctgcgtactacgactacagcgcggagcgcgtcctcgctatcgtgcgcgaacttaccgcgtacgcgcg

SEQ ID NO: 313620 - DNA, 75 bp, Artificial Sequence
  Synthetic
aactgccacggccccgactgggcctccccggtttgccagcgccactctcccgactgttcgcggctcgtgggggcc

SEQ ID NO: 313621 - DNA, 75 bp, Artificial Sequence
  Synthetic
agcgccgccctcttgggcctcccttgcgccgaagactaccgcgcgctccgcgccggcagctactgcaccctgcgc

SEQ ID NO: 313622 - DNA, 75 bp, Artificial Sequence
  Synthetic
atcccgggcgcctctaccggtgcgggccccgcctgtggacacgcgattgcgccgtggccgaactctcatgggagg

SEQ ID NO: 313623 - DNA, 75 bp, Artificial Sequence
  Synthetic
acgccagagcgcccccggctgcgcctcgtcgatgctgacgacccccttctgcgcactgccccggggccgggcgag

SEQ ID NO: 313624 - DNA, 75 bp, Artificial Sequence
  Synthetic
gccgtggccgaactctcatgggaggtcgcccaacactgcgggcaccaggcgcgcctccgcgccgtgcgatgtacc

SEQ ID NO: 313625 - DNA, 75 bp, Artificial Sequence
  Synthetic
ctccccatccgccatgtgcgcagcctccaacccagcgcgcgggtccgactcccggaccttgtccacctcgccgaa

SEQ ID NO: 313626 - DNA, 75 bp, Artificial Sequence
  Synthetic
acgtggggcctttaatcttacctactctaaccaggtcatcacccaccgttgtttcgccgcatctggtgggtaccc

SEQ ID NO: 313627 - DNA, 75 bp, Artificial Sequence
  Synthetic
catacgcgccggaccgtacggccacgccactgtcgaaatgcctgagtggatccacgcccacaccaccagcgatcc

SEQ ID NO: 313628 - DNA, 75 bp, Artificial Sequence
  Synthetic
cacctttgccactcgggagagccccagggtgcccgaatggcttctactacccccatcaccatggaggacctccag

SEQ ID NO: 313629 - DNA, 75 bp, Artificial Sequence
  Synthetic
ttgctcgccgcggtcgccgtaggcaccgcgcgcgccgggctccagccccgcgctgacatggcggcacccccagtg

SEQ ID NO: 313630 - DNA, 75 bp, Artificial Sequence
  Synthetic
ccccatcaccatggaggacctccagaaggccctcgaggcacaatcccgcgccctgcgcgcggaactcgccgccgg

SEQ ID NO: 313631 - DNA, 75 bp, Artificial Sequence
  Synthetic
ccacagcattacgctcgcgggtaacgtgctgcaggaggggtggaagggcacgtgcgccgaggaagatgcgctctg

SEQ ID NO: 313632 - DNA, 75 bp, Artificial Sequence
  Synthetic
gcgggcccgagccgcccgcccacgtcgtccgcgcgtacaatcaacccgccggcgacgtcaggggcgtttggggta

SEQ ID NO: 313633 - DNA, 75 bp, Artificial Sequence
  Synthetic
cgggcaccacttggataccgtgcaacctcccaaaccgccgccccgccccgagatcgccgcaacgtggatcgtcca

SEQ ID NO: 313634 - DNA, 75 bp, Artificial Sequence
  Synthetic
ctgggaattggtcgttctcaccgcccgccctgaagacggctggacctgccgcggcgtgcccgcccacccaggcac

SEQ ID NO: 313635 - DNA, 75 bp, Artificial Sequence
  Synthetic
gggggctctgccccgcgccccgagctggggccgccgaccaacccgttccaagcagccgtggcgcgtggcctgcgc

SEQ ID NO: 313636 - DNA, 75 bp, Artificial Sequence
  Synthetic
cgccgcgagcgcggaccgccactgtgcgtgcgccccccgctgcgacgttccacgcgaactcccttccgcgcctgc

SEQ ID NO: 313637 - DNA, 75 bp, Artificial Sequence
  Synthetic
caccaccgcggcgaacgccacgaccgccgccacccccaccactgtgccggccccttgccacgccggcctcaatga

SEQ ID NO: 313638 - DNA, 75 bp, Artificial Sequence
  Synthetic
tctaaccaggtcatcacccaccgttgtttcgccgcatctggtgggtacccaacttgccattcgggagagccccag

SEQ ID NO: 313639 - DNA, 75 bp, Artificial Sequence
  Synthetic
gggcccgccagatgacgaggcgcttatcccgccgtggctgttcgcggagcgccgtgccctccgctgccgcgagtg

SEQ ID NO: 313640 - DNA, 75 bp, Artificial Sequence
  Synthetic
aggcacccaccgaggcctgcgtgacctcatggctttggagcgagggcgaaggcgcggtcttttaccgcgtcgacc

SEQ ID NO: 313641 - DNA, 75 bp, Artificial Sequence
  Synthetic
ggcgcggtcttttaccgcgtcgacctgcatttcaccaacctgggcacccccccactcgacgaggacggccgctgg

SEQ ID NO: 313642 - DNA, 75 bp, Artificial Sequence
  Synthetic
cccactcgacgaggacggccgctgggaccctgcgctcatgtacaacccttgcgggcccgagccgcccgctcacgt

SEQ ID NO: 313643 - DNA, 75 bp, Artificial Sequence
  Synthetic
cgcgtggcatctcgaccatgacggcagttgccccgccgattgccgcggggccggcgccgggcccacacccggcta

SEQ ID NO: 313644 - DNA, 75 bp, Artificial Sequence
  Synthetic
cgtccgcgcgtacaatcaacctgccggcgacgtcaggggcgtttggggtaaaggtgagcgcacctacgccgagca

SEQ ID NO: 313645 - DNA, 75 bp, Artificial Sequence
  Synthetic
catgggacctcgaggccactggagcctgcatttgcgagatccccaccgacgtctcgtgcgagggcttgggggcct

SEQ ID NO: 313646 - DNA, 75 bp, Artificial Sequence
  Synthetic
aaggtgagcgcacctacgccgagcaggatttccgcgtcggcggcacgcgctggcaccgactgctgcgcatgccag

SEQ ID NO: 313647 - DNA, 75 bp, Artificial Sequence
  Synthetic
ctccctatccgccacgtgcgcagcctccaacctagcgcgcgggtccgactcccggacctcgtccatctcgccgag

SEQ ID NO: 313648 - DNA, 75 bp, Artificial Sequence
  Synthetic
ccgaggagcggcaagaaagccgctcccagaccccggccccgaagccattgcgggccccgccgcaacagcctcaac

SEQ ID NO: 313649 - DNA, 75 bp, Artificial Sequence
  Synthetic
tgcttggcgagccggcagtcatgcacctcccgtacaccgatggcgacgtgccgcagttgatcgcgctggctctgc

SEQ ID NO: 313650 - DNA, 75 bp, Artificial Sequence
  Synthetic
gggccaccgaccaacccgttccaggcagccgtggcgcgtggcctgcgcccgcctctccacgaccctgacaccgag

SEQ ID NO: 313651 - DNA, 75 bp, Artificial Sequence
  Synthetic
gcgtgttcgcccttgccagctacgtccagcaccctcacaagaccgtccgggtcaagttccatacagagaccagga

SEQ ID NO: 313652 - DNA, 75 bp, Artificial Sequence
  Synthetic
gcacactggcccaacagggggccgccttggcgctttcggtgcgtgacctgcccgggggcgcagcgttcgacgcaa

SEQ ID NO: 313653 - DNA, 75 bp, Artificial Sequence
  Synthetic
cccccaggccttcctcgccgggctcttgctcgccgcggtcgccgtcggcaccgcgcgcgccgggctccagccccg

SEQ ID NO: 313654 - DNA, 75 bp, Artificial Sequence
  Synthetic
acgcggtcaccgccgccgtgcgcgcaggctccagtcagccagcgcctacgtcgcccccgccggacaaccccccgc

SEQ ID NO: 313655 - DNA, 75 bp, Artificial Sequence
  Synthetic
cctcgccgagcgcatggaggagtgggagcaggacgctgctgtcgccgccttcgaccgcggcccccttgaggatgg

SEQ ID NO: 313656 - DNA, 75 bp, Artificial Sequence
  Synthetic
cgacgtgctgcccggccactggctccaaggcggctggggttgctacaacctgagcgactggcaccagggcactca

SEQ ID NO: 313657 - DNA, 75 bp, Artificial Sequence
  Synthetic
cgtcgcgccgcgcacggcgatcgcagcgaccgtcggacacccgcggccctccgccctccgcgcccgtccgcaacc

SEQ ID NO: 313658 - DNA, 75 bp, Artificial Sequence
  Synthetic
agtcccggtggggcctcgggagcccgaattgccatggccccgattgggcctccccggtttgtcaacgccattccc

SEQ ID NO: 313659 - DNA, 75 bp, Artificial Sequence
  Synthetic
cgccgccgcccgcccccagtccgcccacgccaccccgcgcgggcgacccggccccagccattttggaggagccgg

SEQ ID NO: 313660 - DNA, 75 bp, Artificial Sequence
  Synthetic
gccccagccattttggaggagccggcggatcgcgcgcgcgacgccgagctggaggtcgcctgcgaaccgagcggc

SEQ ID NO: 313661 - DNA, 75 bp, Artificial Sequence
  Synthetic
atttccgcgtcggtggcacgcgctggcaccgactgctgcgcatgccggtgcgcggcctcgacggcgacagcgccc

SEQ ID NO: 313662 - DNA, 75 bp, Artificial Sequence
  Synthetic
cgccccgctggacgacgaggcgctcattccgccgtggctgttcgccgagcgccgcgccctccgctgtcgcgagtg

SEQ ID NO: 313663 - DNA, 75 bp, Artificial Sequence
  Synthetic
gccgccacccccgccactgcgccggccccctgccacgccggcctcaatgacagctgcggcggcttcttgtccggg

SEQ ID NO: 313664 - DNA, 75 bp, Artificial Sequence
  Synthetic
cgctccccccccacaccaccgagcgcattgagacccgctcggcgcgccatccttggcgcatccgcttcggtgccc

SEQ ID NO: 313665 - DNA, 75 bp, Artificial Sequence
  Synthetic
gcgcgcgccgggctccagccccgcgctgacatggcggcacctcccacgctgccgcagccccctcgtgcgcacggg

SEQ ID NO: 313666 - DNA, 75 bp, Artificial Sequence
  Synthetic
gccggttccggcgtctgcggtgccatctttgccaacgctgccgcggccctcgctgaagattgccggcgcctcgcc

SEQ ID NO: 313667 - DNA, 75 bp, Artificial Sequence
  Synthetic
cagtacccgcctacccggtttggctgcgctatgcggtggggcctccccccctgggaactggtcgtccttaccgcc

SEQ ID NO: 313668 - DNA, 75 bp, Artificial Sequence
  Synthetic
ccatgccccactggcgaggcagtcgcgacgcccggccacggctgcgggtatacacatatcatccacgcagtcgcg

SEQ ID NO: 313669 - DNA, 75 bp, Artificial Sequence
  Synthetic
ccgctgccccgaactggtgagccccatgggacgcgcgacttgctccccagcctcggccctctggctcgccacagc

SEQ ID NO: 313670 - DNA, 75 bp, Artificial Sequence
  Synthetic
cctcggcgtccccgggaccccgccgccctcgagcagagcgaggcgctgctcgaacgcgcctaccgcagcatcgtc

SEQ ID NO: 313671 - DNA, 75 bp, Artificial Sequence
  Synthetic
cgtgggtcctgatattcatggtgtgccgccgcgcctgtcgccgccgcggcgccgccgccgccctcaccgcggtcg

SEQ ID NO: 313672 - DNA, 75 bp, Artificial Sequence
  Synthetic
ccgccgcgcctgtcgccgccgcggcgccgccgccgccctcaccgcggtcgtcctgcaggggtacaacccccccgc

SEQ ID NO: 313673 - DNA, 75 bp, Artificial Sequence
  Synthetic
acgctggccgccgcgcgccggtggacgtgtgtcgcgtgccccctcctcggagctggtatctacggctggtctgcc

SEQ ID NO: 313674 - DNA, 75 bp, Artificial Sequence
  Synthetic
tggccccggccagtcctcgcccacgtcaccgccacccggcgaccccccgccgccgcgccgcacacggcgatcgca

SEQ ID NO: 313675 - DNA, 75 bp, Artificial Sequence
  Synthetic
ctccccatccgccacgtgcgcagcctccaacccagcgcgcgggtccggctcccggaccttgttcacctcgccgaa

SEQ ID NO: 313676 - DNA, 75 bp, Artificial Sequence
  Synthetic
ccctgccacgccggcctcaatgacagctgcggcggcttcttgtctgggtgcgggccgatgcgcctgcgccacggc

SEQ ID NO: 313677 - DNA, 75 bp, Artificial Sequence
  Synthetic
gcggcgctcggccgcctgcggcactccgccccccgcgcccgcgcgcgacccgccgccgcccgcccccagtccgcc

SEQ ID NO: 313678 - DNA, 75 bp, Artificial Sequence
  Synthetic
tctgtcacaccaagcacatggacttctggtgcgtggagcacgaccgaccgccgcccgcgaccccgacgcctttca

SEQ ID NO: 313679 - DNA, 75 bp, Artificial Sequence
  Synthetic
attgtggacggcggctgctttgccccatgggacctcgaggccactggagcctgcatttgcgagatccccactgat

SEQ ID NO: 313680 - DNA, 75 bp, Artificial Sequence
  Synthetic
cgctgccaggcgcgtcagtcctcccccgaccgagcctcctgcatcctgccccgttggtcacccaggccgatcaac

SEQ ID NO: 313681 - DNA, 75 bp, Artificial Sequence
  Synthetic
cgcgccaccctgcgcgggcgacccggcccctcccacctccgcggggccggcggatcgcgcgcacgacgccgagct

SEQ ID NO: 313682 - DNA, 75 bp, Artificial Sequence
  Synthetic
ccgttggtcacccaggccgatcaacccagcgcagcgcgtcacccccgacgaccccctctggggatgccaccgcgc

SEQ ID NO: 313683 - DNA, 75 bp, Artificial Sequence
  Synthetic
ctgcatttgcgagatccccactgatgtctcgtgcgagggcttgggggcctgggtacccacagccccttgcgcgcg

SEQ ID NO: 313684 - DNA, 75 bp, Artificial Sequence
  Synthetic
cagacggcgacatcgttgaaagttacacccgcgccgccggacccgtgcaccttcgggtccgcgacattatggacc

SEQ ID NO: 313685 - DNA, 75 bp, Artificial Sequence
  Synthetic
tgcaccttctgggctgtcaacgcctactcctctggcgggtacgcgcagctggcctcttacttcaaccctggcggc

SEQ ID NO: 313686 - DNA, 75 bp, Artificial Sequence
  Synthetic
gctgccccgaactggtgagccccatgggacgcgcgacttgttcccctgcctcggccctctggctcgccacggcga

SEQ ID NO: 313687 - DNA, 75 bp, Artificial Sequence
  Synthetic
tctggctcgagcgcgaccgcggcgccaccggctgggcgatgcgcatccccgaagtggtcgtctacgggccggagc

SEQ ID NO: 313688 - DNA, 75 bp, Artificial Sequence
  Synthetic
tcggccctctggctcgccacggcgaacgcgctgtctctcgatcacgccctcgcggccgctgtcctgctggtcccg

SEQ ID NO: 313689 - DNA, 75 bp, Artificial Sequence
  Synthetic
ccgcgtgcgaggttgaacctgccttcggacacagcgacgcggcctgctggggcttccccaccgacaccgtgatga

SEQ ID NO: 313690 - DNA, 75 bp, Artificial Sequence
  Synthetic
cgctgcagactgccggcgcctcgccccatgccccaccggcgaggcagttgccacacccggccacggctgcgggta

SEQ ID NO: 313691 - DNA, 75 bp, Artificial Sequence
  Synthetic
gaagtggtcgtctacgggccggagcacctcgccgcgcacttcccattaaaccactacagtgtgctcaaacccgca

SEQ ID NO: 313692 - DNA, 75 bp, Artificial Sequence
  Synthetic
gcgtgttcgcccttgctagctacgtccagcaccctcacaagaccgtccgggtcaagttccatacagagaccagga

SEQ ID NO: 313693 - DNA, 75 bp, Artificial Sequence
  Synthetic
tgggtcctgatattcatggtgtgccgccgcgcttgtcgccgccgcggcgccgccgccgccctcaccgcggtcgtc

SEQ ID NO: 313694 - DNA, 75 bp, Artificial Sequence
  Synthetic
cggtgcaccccctccaatgctcacgccgccctgtgccgtacaggcgtaccccctcgggtgagcacgcgaggcgac

SEQ ID NO: 313695 - DNA, 75 bp, Artificial Sequence
  Synthetic
gtcaagttccatacagagaccaggaccgtctggcaactctccgttgccggcgcgtcgtgcaacgtcaccacagaa

SEQ ID NO: 313696 - DNA, 75 bp, Artificial Sequence
  Synthetic
gccgcgcttgtcgccgccgcggcgccgccgccgccctcaccgcggtcgtcttgcaggggtataccccccccgcct

SEQ ID NO: 313697 - DNA, 75 bp, Artificial Sequence
  Synthetic
caggcacctgtccccgtgcgcctcgccggcgtccgctttgagtctaagattgtcgacggcggctgctttgccccg

SEQ ID NO: 313698 - DNA, 75 bp, Artificial Sequence
  Synthetic
acgagtgccgggtgccctaggtgcgcctacggccgcgccctcagcgaagcccgcactcatgaggacttcgccgcc

SEQ ID NO: 313699 - DNA, 75 bp, Artificial Sequence
  Synthetic
cgctgccaggcgcgtcagtcctcccccgaccgagcccctcgcatcttgccccgccagtgacccgggccggccggc

SEQ ID NO: 313700 - DNA, 75 bp, Artificial Sequence
  Synthetic
ctgactgctcgcggcttgtgggggccacgccagagcgtccccggctgcgcctggtcgacgccgacgaccccctgc

SEQ ID NO: 313701 - DNA, 75 bp, Artificial Sequence
  Synthetic
caccttttgggctgtcaacgcctactcctctggcgggtacgcgcagctggcctcttacttcaaccctggcggcag

SEQ ID NO: 313702 - DNA, 75 bp, Artificial Sequence
  Synthetic
cacgccagagcgtccccggctgcgcctggtcgacgccgacgaccccctgctgcgcactgcccctgggcccggcga

SEQ ID NO: 313703 - DNA, 75 bp, Artificial Sequence
  Synthetic
cctcttacttcaaccctggcggcagttactataagcagtaccaccccaccgcgtgcgaggtcgaaccagccttcg

SEQ ID NO: 313704 - DNA, 75 bp, Artificial Sequence
  Synthetic
gcgtatgggtcggctccgagcacgaggccccgcccgaccacctcctggtgtccctccaccgcgcgcctaatggtc

SEQ ID NO: 313705 - DNA, 75 bp, Artificial Sequence
  Synthetic
ccgagcgcccctgggccgacgggggcgccagagcgtgggcgaagttcttttgcggctgcgcctgggcgcagcgcc

SEQ ID NO: 313706 - DNA, 75 bp, Artificial Sequence
  Synthetic
ccgcccccacctttggctcgcggtccctctctcccggggcggcggcacttgcgccgcgaccgacgaggggctggc

SEQ ID NO: 313707 - DNA, 75 bp, Artificial Sequence
  Synthetic
agcaccctcacaagaccgtccgggtcaagttccatacagagaccaggaccgtctggcaactctccgtcgccggcg

SEQ ID NO: 313708 - DNA, 75 bp, Artificial Sequence
  Synthetic
cgccgcgccgcgcacggcgatcgcaacggcactcggacgcccgcggtactccgcccctcgcgcctgcgcccgacc

SEQ ID NO: 313709 - DNA, 75 bp, Artificial Sequence
  Synthetic
ccaagcgtactacgacgaccttgaggtgcgccgccttggggacgacgccatggcccgggcggccctcgccgcggt

SEQ ID NO: 313710 - DNA, 75 bp, Artificial Sequence
  Synthetic
cctggcacccaccgggccccttggggctgaagttcaagacagttcgcccggtggccctgccacgcgcgttagcgc

SEQ ID NO: 313711 - DNA, 75 bp, Artificial Sequence
  Synthetic
gtgcgccgccttggggacgacgccatggcccgggcggccctcgccgcggtccaacgcccccgcaaaggcccctac

SEQ ID NO: 313712 - DNA, 75 bp, Artificial Sequence
  Synthetic
ctggtggaaggccttgcccccgggggagggaattgccatctcaccgtcaatggcgaggacgtcggcgccttcccc

SEQ ID NO: 313713 - DNA, 75 bp, Artificial Sequence
  Synthetic
tccctccaccgtgcccccaatggaccgtggggcgtagtgctcgaggtgcgcgcgcgccccgaggggggcaacccc

SEQ ID NO: 313714 - DNA, 75 bp, Artificial Sequence
  Synthetic
attcacgcccacaccaccagcgacccctggcacccaccgggccccttggggctgaagttcaagacagttcgcccg

SEQ ID NO: 313715 - DNA, 75 bp, Artificial Sequence
  Synthetic
tggcgaggacgtcggcgccttcccccctgggaagttcgtcaccgccgccctcctcaacacccccccgccctacca

SEQ ID NO: 313716 - DNA, 75 bp, Artificial Sequence
  Synthetic
cgcgccaccccgcgcgggtgccccggtccctcctacttccgcggggccggcggatcgcgcgcgcgacgccgagct

SEQ ID NO: 313717 - DNA, 75 bp, Artificial Sequence
  Synthetic
cgccggagcgtccccggctgcgcctggttgatgccgacgaccccttgctgcgcagtgcccctgggcccggcgagg

SEQ ID NO: 313718 - DNA, 75 bp, Artificial Sequence
  Synthetic
cggagtgggctgctgcccattggtggcagctcactctgggcgccatttgcgccctcctactcgctggcttactcg

SEQ ID NO: 313719 - DNA, 75 bp, Artificial Sequence
  Synthetic
tgtgggtcacgcccgtcataggctctcaggcgcgtaagtgtggactccacatacgcgccggaccgtacggccacg

SEQ ID NO: 313720 - DNA, 75 bp, Artificial Sequence
  Synthetic
caccgcccggctgcaaggtcgtggtcaacgccgccaacgagggactgctggccggctctggcgtgtgcggtgcca

SEQ ID NO: 313721 - DNA, 75 bp, Artificial Sequence
  Synthetic
cgaccgtcgaaatgcccgagtggatccacgcccacaccaccagcgatccttggcacccaccgggccccttggggc

SEQ ID NO: 313722 - DNA, 75 bp, Artificial Sequence
  Synthetic
gcagctcactctgggcgccatttgcgccctcctactcgctggcttactcgcttgctgtgccaaatgcttgtacta

SEQ ID NO: 313723 - DNA, 75 bp, Artificial Sequence
  Synthetic
tggcacccaccgggccccttggggctgaagttcaagacagttcgcccggtggtcctgccacgcgcgttggcgcca

SEQ ID NO: 313724 - DNA, 75 bp, Artificial Sequence
  Synthetic
cggctcgtctgcgcgcggggctcgactacgacgtcgagggcgagcatgctggcacctttgcctgcaacctctggg

SEQ ID NO: 313725 - DNA, 75 bp, Artificial Sequence
  Synthetic
ccggccgagcccctcgcatctcgccctgccggcgccccgggcccaccgactcagcccagctcgtcgcctccagcg

SEQ ID NO: 313726 - DNA, 75 bp, Artificial Sequence
  Synthetic
ggcacctttgcctgcaacctctgggacggtcgccaagtcgaccttcacctcgccttttcgcgcgagaccgtgcgc

SEQ ID NO: 313727 - DNA, 75 bp, Artificial Sequence
  Synthetic
ctatgacatcgagggcgagtgcaccggcacctttgcctgcaacctgtgggacggccgtcaggtcgaccttcacct

SEQ ID NO: 313728 - DNA, 75 bp, Artificial Sequence
  Synthetic
tatagcgccgcgctagtgggcccctgcgtgaaacccgcactagcccactagattcccgcacccgttgctgcatag

SEQ ID NO: 313729 - DNA, 75 bp, Artificial Sequence
  Synthetic
cctcgcaatgtgcgtgtgaccgggtgctaccagtgcggcactcccgcgctggtggaaggccttgcccccggggga

SEQ ID NO: 313730 - DNA, 75 bp, Artificial Sequence
  Synthetic
tggctggacaccatttgggacgccatcaagcggttcttcggcagcgtgcccctcgccgagcgcatggaggagtgg

SEQ ID NO: 313731 - DNA, 75 bp, Artificial Sequence
  Synthetic
ttcccgctggcattgaccgcgtcgtagccgttgagcaggcaccaccaccgctgccgcccgccgacggcattcccg

SEQ ID NO: 313732 - DNA, 75 bp, Artificial Sequence
  Synthetic
cgtggggcgtagtgctcgaggtgcgcgcgcgccccgaagggggcaaccccaccggccatttcgtctgcgcggttg

SEQ ID NO: 313733 - DNA, 75 bp, Artificial Sequence
  Synthetic
tgcgcggcgccattgcgccgcgctagtgggcccccgcgcgaaacccgcactagcccactagatccccgcacccgt

SEQ ID NO: 313734 - DNA, 75 bp, Artificial Sequence
  Synthetic
cattgcgccgcgctagtgggcccccgcgcgaaacccgcactagcccactagatccccgcacccgttgctgcatag

SEQ ID NO: 313735 - DNA, 75 bp, Artificial Sequence
  Synthetic
ccgccctgtgccgcacaggcgtgccccctcgggtgagcacgcgaggcggcgagctagacccaaacacctgctggc

SEQ ID NO: 313736 - DNA, 75 bp, Artificial Sequence
  Synthetic
gccgtgcggcgctaccgcgcgggtgaggacgggtcgaccctccgcaccgctgtggcccgccagcacccacgtccc

SEQ ID NO: 313737 - DNA, 75 bp, Artificial Sequence
  Synthetic
agaatcacaccgagatgcccgggacggagcgcgtcctcagtgctgtttgcgccgtgcggcgctaccgcgcgggtg

SEQ ID NO: 313738 - DNA, 75 bp, Artificial Sequence
  Synthetic
tcgttgccagccaaaccaccgcggaggtgatttgcgtcggtgaccgagaccagtgcggcccacattatgccaaca

SEQ ID NO: 313739 - DNA, 75 bp, Artificial Sequence
  Synthetic
cggcccgcctgcgcgcggggctcgattatgacatcgagggcgagcgcaccggcaccttcgcctgcagtctctggg

SEQ ID NO: 313740 - DNA, 75 bp, Artificial Sequence
  Synthetic
ccgcactcatgaggacttcgccgcgctgagccagcggtggagcgcgagccacgccgatgcctcccctgacggcac

SEQ ID NO: 313741 - DNA, 75 bp, Artificial Sequence
  Synthetic
ttccgccagatcccacccccgcgcgtcactgccggggtcgctcaggagtggcgcatgacgtacctgcgggaacga

SEQ ID NO: 313742 - DNA, 75 bp, Artificial Sequence
  Synthetic
ccggtcgccctcgcggcccacgtcggcgacgactgggacgacctgggcatcgcctggcatctcgaccatgacggc

SEQ ID NO: 313743 - DNA, 75 bp, Artificial Sequence
  Synthetic
gtggacgccgctctcggtcccagggacaccgaagactgccatgccgcccaggggaaaaccggccttgagatccgg

SEQ ID NO: 313744 - DNA, 75 bp, Artificial Sequence
  Synthetic
cagtctaacgccaggttggcggggatcatgaaaggcgcgaagcgctgcgccgccgactctctgagcgtggccggc

SEQ ID NO: 313745 - DNA, 75 bp, Artificial Sequence
  Synthetic
cctgagatcttcgccggcatgtgcaccgcccagagcctgagcgtccccgccttcctcaaagccaccttgaagtgc

SEQ ID NO: 313746 - DNA, 75 bp, Artificial Sequence
  Synthetic
gcgcggcactcaagtggacccccgctgaggtgggcctgtttggcttccacatccccgtgaagcatgtgagcactc

SEQ ID NO: 313747 - DNA, 75 bp, Artificial Sequence
  Synthetic
tcatgtccccgcatttccgcgcgatccagaagatcatcatgcgcgccttgcgcccgcaattccttgtggccgctg

SEQ ID NO: 313748 - DNA, 75 bp, Artificial Sequence
  Synthetic
acgcggctctgcctgacaccgttgccgccaatgctgcgtactacgactacagcgcggagcgcgtcctcgccatcg

SEQ ID NO: 313749 - DNA, 75 bp, Artificial Sequence
  Synthetic
gaccgaccgctacgcgcgccgctaccccgagatcttcgccggcatgtgtaccgcccagagcctgagcgtccccgc

SEQ ID NO: 313750 - DNA, 75 bp, Artificial Sequence
  Synthetic
caatgggagctatcggacctcgcttaggactcctattcccatggagaaactcctagatgaggttcttgcccccgg

SEQ ID NO: 313751 - DNA, 75 bp, Artificial Sequence
  Synthetic
gccatgtgcatggctatgcgcatggtccccaaaggcgtacgctgggccgggattttccagggcgacgacatggtc

SEQ ID NO: 313752 - DNA, 75 bp, Artificial Sequence
  Synthetic
tccccaaaggcgtacgctgggccgggattttccagggcgacgacatggtcatcttcctccccgagggcgcacgca

SEQ ID NO: 313753 - DNA, 75 bp, Artificial Sequence
  Synthetic
cgaggtcggcttgtttggcttccacatcccagtgaagcacgtaagcacccctacccccagcttctgtgggcacgt

SEQ ID NO: 313754 - DNA, 75 bp, Artificial Sequence
  Synthetic
gtgtgcgcaggcgcgggggctccaggcctttgtccgtgtcgtgccgccacccgagcgcccctgggccgacggggg

SEQ ID NO: 313755 - DNA, 75 bp, Artificial Sequence
  Synthetic
ccacgacgctgactaatgccctcgcacgtagggcctttaatctcacttactctaaccaggtcatcacccaccgtt

SEQ ID NO: 313756 - DNA, 75 bp, Artificial Sequence
  Synthetic
cggcaccgcggctggcctctttcatgatgtcatgcaccaagcaatcaaggtgctttgccgccgcttcgaccccga

SEQ ID NO: 313757 - DNA, 75 bp, Artificial Sequence
  Synthetic
gcaatctcgcggtatacccgccgccactggatcgagtggggccccaaagaggccctacacgtcctcatcgaccca

SEQ ID NO: 313758 - DNA, 75 bp, Artificial Sequence
  Synthetic
gtttcgtcgcatctggtgggtacccaactcgcaattcgggagagccccagggtgcccgaatggcctctactaccc

SEQ ID NO: 313759 - DNA, 75 bp, Artificial Sequence
  Synthetic
gtttcgtcgcatctggtgggtacccaactcgctattcgggagagccccagggtgcccgaatggcctctactaccc

SEQ ID NO: 313760 - DNA, 75 bp, Artificial Sequence
  Synthetic
gtttcgtcgcatctggtgggtacccaactcgccattcgggagagccccagggtgcccgaatggcctctactaccc

SEQ ID NO: 313761 - DNA, 75 bp, Artificial Sequence
  Synthetic
gtttcgtcgcatctggtgggtacccaactcgcgattcgggagagccccagggtgcccgaatggcctctactaccc

SEQ ID NO: 313762 - DNA, 75 bp, Artificial Sequence
  Synthetic
ctacgtgtgcgcgctgcgtggcgcaccgagcggccccttctacgtccaccctgaggacgtcccgcacggcggtcg

SEQ ID NO: 313763 - DNA, 75 bp, Artificial Sequence
  Synthetic
cgccaatgccgcgtactacgattacagcgcggagcgcgtcctcgcgatcgtgcgcgaactcaccgcatacgcgcg

SEQ ID NO: 313764 - DNA, 75 bp, Artificial Sequence
  Synthetic
cctgctcgtggcggttgacttgtggccggtcgcccttgcggcccacgtcggcgacgactgggacgacctgggcat

SEQ ID NO: 313765 - DNA, 75 bp, Artificial Sequence
  Synthetic
tcaccgccacccggcgaccccccgccgccgcgccgcgcacggcgatcgcagcggcgctcggacacctgcggcact

SEQ ID NO: 313766 - DNA, 75 bp, Artificial Sequence
  Synthetic
ttttgccgcttctggtgggtactccactcctgccatttgggagagccccagggtgcccaaatggcttctactacc

SEQ ID NO: 313767 - DNA, 75 bp, Artificial Sequence
  Synthetic
ccgccccccgcgcccgcgcgcgacccgccgccgcccgcccccagcccgcccgcgccaccccgcgcgggtgacccg

SEQ ID NO: 313768 - DNA, 75 bp, Artificial Sequence
  Synthetic
ggttgccccgccgattgccgcggagccggcgctgggcccacgcccggctacacccgcccctgcaccacacgcatc

SEQ ID NO: 313769 - DNA, 75 bp, Artificial Sequence
  Synthetic
ccggcgctgggcccacgcccggctacacccgcccctgcaccacacgcatctaccaagtcctgccggacaccgccc

SEQ ID NO: 313770 - DNA, 75 bp, Artificial Sequence
  Synthetic
cgcgccaccccgcgcgggtgacccggccccccccacttccgcggggtcggcggatcgcgcgcgcgacgccgagct

SEQ ID NO: 313771 - DNA, 75 bp, Artificial Sequence
  Synthetic
gggccaccgaccaacccgttccaggcggccgtggcgcgtggcctgcgcccgcctctccacgaccctgacactgag

SEQ ID NO: 313772 - DNA, 75 bp, Artificial Sequence
  Synthetic
gcctcgcaggcacgccggccgcggccgccgcgacagcgcgactccagcacctccggcgacgattctggccgtgac

SEQ ID NO: 313773 - DNA, 75 bp, Artificial Sequence
  Synthetic
taccaagtcctgccggacaccgcccaccccgggcgcctctaccggtgcgggccccgcctgtggacgcgcgactgc

SEQ ID NO: 313774 - DNA, 75 bp, Artificial Sequence
  Synthetic
cgcccgcgccgccggacccgtgcacctccgggtccgcgacatcatggacccaccgcccggctgcaaggtcgtggt

SEQ ID NO: 313775 - DNA, 75 bp, Artificial Sequence
  Synthetic
tctggagggccccgccgccgccgcggcaaccggggccgcggccagcgcaaagactggtccaaggccccgcctccc

SEQ ID NO: 313776 - DNA, 75 bp, Artificial Sequence
  Synthetic
ccggaggagcggcaagacagccgctcccagactccggcccccaagccatcgcgggcgccgccacagccgcctcaa

SEQ ID NO: 313777 - DNA, 75 bp, Artificial Sequence
  Synthetic
gaccctgcgctcatgtacaacccttgcgggcccgagccgcccgctcacgtcgtccgcgcgtacaaccaacctgcc

SEQ ID NO: 313778 - DNA, 75 bp, Artificial Sequence
  Synthetic
tcccccgccccgtgttccagcgcatgctgtcctactgcaagaccctgagccccgacgcgtactacagcgagcgcg

SEQ ID NO: 313779 - DNA, 75 bp, Artificial Sequence
  Synthetic
cccccgcgcatgcaaaccgggcgcgggggcactgccccgcgccccgagctggggccgccgaccaacccattccag

SEQ ID NO: 313780 - DNA, 75 bp, Artificial Sequence
  Synthetic
gctgtcctactgcaagaccctgagccccgacgcgtactacagcgagcgcgtgttcaagttcaagaatgccctgag

SEQ ID NO: 313781 - DNA, 75 bp, Artificial Sequence
  Synthetic
gcggccgtggcgcggggcctgcgcccgcccctccatgaccccgacaccgaggcgcccactgaggcttgtgtgacc

SEQ ID NO: 313782 - DNA, 75 bp, Artificial Sequence
  Synthetic
tgagcgcgcctaccgcagcatcgtcgcgctggccgccgcgcgtcggtgggcgtgcgtcgcgtgccccctcctcgg

SEQ ID NO: 313783 - DNA, 75 bp, Artificial Sequence
  Synthetic
tcatggctctggagcgagggcgaaggcgctgtcttctaccgcgtcgacctgcatttcaccaacctgggcactccc

SEQ ID NO: 313784 - DNA, 75 bp, Artificial Sequence
  Synthetic
cagtccaacgccaggttggcggggattatgaaaggcgccaagcgctgcgctgccgattctttgagcgtagccggc

SEQ ID NO: 313785 - DNA, 75 bp, Artificial Sequence
  Synthetic
gcggagtccctccgagccgcgctcgcggctacgcgcaccgagcctgccgagcgcgtgagcctgcacatctgccac

SEQ ID NO: 313786 - DNA, 75 bp, Artificial Sequence
  Synthetic
cgctggcgtctacggatggtctgctgcggagtccctccgagccgcgctcgcggctacgcgcaccgagcctgccga

SEQ ID NO: 313787 - DNA, 75 bp, Artificial Sequence
  Synthetic
tgctgcccggcgcgtgagtcctcctccgaccgagcccctcgcatctcgccccgccagtgatccgggccgaccggc

SEQ ID NO: 313788 - DNA, 75 bp, Artificial Sequence
  Synthetic
tcgaccgcggccccctcgaggacggcgggcgcgacttggacaccgtgcaacccccgaaatcgccgccccgccctg

SEQ ID NO: 313789 - DNA, 75 bp, Artificial Sequence
  Synthetic
tctgtcacaccaagcacatggacttctggtgcgtggagcacgaccgaccgccgcctacaaccccgacgcctttca

SEQ ID NO: 313790 - DNA, 75 bp, Artificial Sequence
  Synthetic
tctgtcacaccaagcacatggacttctggtgcgtggagcacgaccgaccgccgcctactaccccgacgcctttca

SEQ ID NO: 313791 - DNA, 75 bp, Artificial Sequence
  Synthetic
tctgtcacaccaagcacatggacttctggtgcgtggagcacgaccgaccgccgcctaccaccccgacgcctttca

SEQ ID NO: 313792 - DNA, 75 bp, Artificial Sequence
  Synthetic
tctgtcacaccaagcacatggacttctggtgcgtggagcacgaccgaccgccgcctacgaccccgacgcctttca

SEQ ID NO: 313793 - DNA, 75 bp, Artificial Sequence
  Synthetic
ccagcgcagcgcgtcgcccccagcgaccccccctggggatgccaccgcgcccgagccccgcggatgccaggggtg

SEQ ID NO: 313794 - DNA, 75 bp, Artificial Sequence
  Synthetic
agatcgccgcgacttggatcgtccacgcggccagcgccgaccgccattgtgcgtgcgctccccgctgcgacgccc

SEQ ID NO: 313795 - DNA, 75 bp, Artificial Sequence
  Synthetic
gcgcggccttgacggcgacagcgccccgctccccccccacactaccgaacgcatcgagacccgctcggcgcgcca

SEQ ID NO: 313796 - DNA, 75 bp, Artificial Sequence
  Synthetic
tccttggcgcattcgcttcggtgcccctcaggttttcctcgccgggctcttgctcgcggccgtcgccgtcggcac

SEQ ID NO: 313797 - DNA, 75 bp, Artificial Sequence
  Synthetic
cgtccgcgcgtacaatcaacccgccggcgacgtcaggggtgtttggggtaaaggtgagcgcacttacgccgaaca

SEQ ID NO: 313798 - DNA, 75 bp, Artificial Sequence
  Synthetic
gccgtcccctccgctgccgcgagtgggattttgaggctctccgcgcgcgcgccgatacggcggccgcgcccgccc

SEQ ID NO: 313799 - DNA, 75 bp, Artificial Sequence
  Synthetic
cgcgcgcgctgggctccaaccccgcgccgacattgcggcgcctccggcgccgccgcaggccccccgcgcgcacgg

SEQ ID NO: 313800 - DNA, 75 bp, Artificial Sequence
  Synthetic
ctcaggcacctgtccccgtgcgcctcgctggcgtccgctttgagtccaagattgtggacggcggctgctttgccc

SEQ ID NO: 313801 - DNA, 75 bp, Artificial Sequence
  Synthetic
cgctggctccacgccctgcgcggcaccccaccgtgctctaccgccaccccgcccaccatggtccgtggctcaccc

SEQ ID NO: 313802 - DNA, 75 bp, Artificial Sequence
  Synthetic
cgccgcaggccccccgcgcgcacgggaagcattacgggcaccaccaccatcaactgccgtttcttgggcacgacg

SEQ ID NO: 313803 - DNA, 75 bp, Artificial Sequence
  Synthetic
gctgccccgaattggtgagccccatgggacgcgcgacttgttccccagcctcggctctctggctcgcgacggcga

SEQ ID NO: 313804 - DNA, 75 bp, Artificial Sequence
  Synthetic
ggccctggtcttatgcgacccacttggccagccgctccggggccctgaacgccacttcgccgccggcgcgcacat

SEQ ID NO: 313805 - DNA, 75 bp, Artificial Sequence
  Synthetic
gacgtgctgcccggccactggctccaaggtggctggggttgctacaacctgagcgactggcaccagggcacccat

SEQ ID NO: 313806 - DNA, 75 bp, Artificial Sequence
  Synthetic
gtctgtcacaccaaacacatggacttctggtgcgtggagcatgaccgaccgccgcccgtgaccccgacgcctccc

SEQ ID NO: 313807 - DNA, 75 bp, Artificial Sequence
  Synthetic
accaccgcggcgaactccacgaccgttgccaccctcgctactacgccggcgccctgccacgccggccttaatgat

SEQ ID NO: 313808 - DNA, 75 bp, Artificial Sequence
  Synthetic
acggcgaggaggccttcacctacctctgcactgcaccggggtgcgccactcaggcccctgtccccgtgcgcctcg

SEQ ID NO: 313809 - DNA, 75 bp, Artificial Sequence
  Synthetic
agctgcggtggctttctgtccgggtgtgggccgatgcgcttgcgccatggcgctgacacccggtgcggtcggtta

SEQ ID NO: 313810 - DNA, 75 bp, Artificial Sequence
  Synthetic
gatctgcgggctgtccaccaccgcccagtacccgcctacccggttcggctgcgctatgcggtggggccttccccc

SEQ ID NO: 313811 - DNA, 75 bp, Artificial Sequence
  Synthetic
ccacagctgatcgcgctggctttgcgcacgctggcgcaacagggggccgccttggcgctctcggtgcgtgacctg

SEQ ID NO: 313812 - DNA, 75 bp, Artificial Sequence
  Synthetic
gcacgctggcgcaacagggggccgccttggcgctctcggtgcgtgacctgcccgggggtgcagcgttcgacgcaa

SEQ ID NO: 313813 - DNA, 75 bp, Artificial Sequence
  Synthetic
ctcgtgcgagggcttgggggcctgggtacccacagccccatgcgcgcgcatctggaacggcacacagcgcgcctg

SEQ ID NO: 313814 - DNA, 75 bp, Artificial Sequence
  Synthetic
acgcggtcactgccgccgtgcgcgccgcccccggccagtccgcggccacgtcaccgccgcccggtgaccccccgc

SEQ ID NO: 313815 - DNA, 75 bp, Artificial Sequence
  Synthetic
ctggcctaccgagcgctcacgccacacctggcgcttccccgactgctgggcagcccgcctgcgcgcggggctcga

SEQ ID NO: 313816 - DNA, 75 bp, Artificial Sequence
  Synthetic
caccttttgggccgttaacgcctactcctcgggcgggtatgcgcagctggcctcttacttcaaccctggcggcag

SEQ ID NO: 313817 - DNA, 75 bp, Artificial Sequence
  Synthetic
cgccgcgccgcgcacgacgatcgcaacggcactcggacgcccgcggcactccaccccccgcgcctgcacgcgacc

SEQ ID NO: 313818 - DNA, 75 bp, Artificial Sequence
  Synthetic
atccacgcccacaccaccagtgacccctggcacccaccgggccccttggggctgaagttcaagacagttcgcccg

SEQ ID NO: 313819 - DNA, 75 bp, Artificial Sequence
  Synthetic
cgctgcccagaactggtgagccctatggggcgtgcgacctgttccccagcctcggccctctggctcgctacagcc

SEQ ID NO: 313820 - DNA, 75 bp, Artificial Sequence
  Synthetic
cgccgccccccgccccaagcccacccgcgccgccccgcgcgggcgatcccgtccctcccacttccccagggccgg

SEQ ID NO: 313821 - DNA, 75 bp, Artificial Sequence
  Synthetic
gtccctcccacttccccagggccggcggatcgcgcgcatgacgcggagctggaggtcgcctgcgaaccgagcggc

SEQ ID NO: 313822 - DNA, 75 bp, Artificial Sequence
  Synthetic
tcgcggccgttgtcctgctggtcccgtgggttttgatattcatggtatgccgccgcgcctgtcgccgccgcggcg

SEQ ID NO: 313823 - DNA, 75 bp, Artificial Sequence
  Synthetic
tgttatgcaacgtcaccaccgagcaccccttctgcaacacgccgcacggacaacttgaagtccaggtcccgcccg

SEQ ID NO: 313824 - DNA, 75 bp, Artificial Sequence
  Synthetic
ccccccacgacaaccaaggcagacccagacagcgacatcgtagaaagttacgcccgcgccgccgggcccgtgcac

SEQ ID NO: 313825 - DNA, 75 bp, Artificial Sequence
  Synthetic
ctccgagtccgcgacatcatggacccaccgcctggctgcaaagtcgtagtgaacgcagccaacgaggggctgctc

SEQ ID NO: 313826 - DNA, 75 bp, Artificial Sequence
  Synthetic
gccggctccggcgtgtgcggtgcgatctttgccaaggccacggcggcccttgctgcggactgccggcgcctcgcc

SEQ ID NO: 313827 - DNA, 75 bp, Artificial Sequence
  Synthetic
gactgctcgcggcttgtgggggccacgccagagcgtccccggctgcgcctggtcgatgccgacgaccccttgctg

SEQ ID NO: 313828 - DNA, 75 bp, Artificial Sequence
  Synthetic
tgctgcggactgccggcgcctcgccccatgccccaccggcgaggcagtggtgacacccggccacggctgcgggta

SEQ ID NO: 313829 - DNA, 75 bp, Artificial Sequence
  Synthetic
ccatgccccaccggcgaggcagtggtgacacccggccacggctgcgggtacacccacatcatccacgccgtcgcg

SEQ ID NO: 313830 - DNA, 75 bp, Artificial Sequence
  Synthetic
ggtacctgcagccccgtgcgcgcgcatctggaacggcacgcagcgcgcatgcaccttctgggcggtcaatgccta

SEQ ID NO: 313831 - DNA, 75 bp, Artificial Sequence
  Synthetic
aaactcgccaccgccctggccgagacggccggcgaggcgtggcacgccgactacgtgtgcgcgctgcgtggcgca

SEQ ID NO: 313832 - DNA, 75 bp, Artificial Sequence
  Synthetic
gcggagtccctgcgagccgcgctcgcggctacgcgcaccgagcccgccgagcgcgtgagcctccatatctgccac

SEQ ID NO: 313833 - DNA, 75 bp, Artificial Sequence
  Synthetic
cccgaccgcgccacgctgacgcacgcctctgtgctcgtcggcgcggggctcgctgccaggcgcgtcagtcctcct

SEQ ID NO: 313834 - DNA, 75 bp, Artificial Sequence
  Synthetic
cctctgtgctcgtcggcgcggggctcgctgccaggcgcgtcagtcctcctccgaccgagccccccgcaccttgcc

SEQ ID NO: 313835 - DNA, 75 bp, Artificial Sequence
  Synthetic
gctgaaattcaagaccgttcgcccggtcgccctgccacgcgcgttagcgccgccccgcaatgtgcgtgtgaccgg

SEQ ID NO: 313836 - DNA, 75 bp, Artificial Sequence
  Synthetic
acccgttctgcaacacgccgcacggacaactcgaggttcaggtcccgcccgaccccggtgacctagttgagtata

SEQ ID NO: 313837 - DNA, 75 bp, Artificial Sequence
  Synthetic
gccatacggagcccgaggtcgatgcgtggtggcaggctcattacaccaccaacgccatcgaggtcgacttcactg

SEQ ID NO: 313838 - DNA, 75 bp, Artificial Sequence
  Synthetic
ccgccggcgacccgggccgaccggctcagcgcagcgcgtcgcccccagcgtccccccttggggacgctaccgccc

SEQ ID NO: 313839 - DNA, 75 bp, Artificial Sequence
  Synthetic
gccccgcctgtggacacgcgattgcgccgtggccgaactctcatgggaggttgcccaacactgcgggcaccaggc

SEQ ID NO: 313840 - DNA, 75 bp, Artificial Sequence
  Synthetic
ccccggtttgccagcgccactcccctgactgttcgcggctcgtgggggctacgccagagcgcccccggctgcgcc

SEQ ID NO: 313841 - DNA, 75 bp, Artificial Sequence
  Synthetic
accaatgaccgcgcctatgtcaacttgtggctcgagcgcgatcgcggcgccaccagctgggccatgcgcatcccc

SEQ ID NO: 313842 - DNA, 75 bp, Artificial Sequence
  Synthetic
caccagctgggccatgcgcatccccgaggtggttgtctacgggccggagcacctcgccacgcattttccattaaa

SEQ ID NO: 313843 - DNA, 75 bp, Artificial Sequence
  Synthetic
tcccccgccccgtgttccagcgcatgctgtcctactgcaagactctcagccctgatgcgtactacagcgagcgcg

SEQ ID NO: 313844 - DNA, 75 bp, Artificial Sequence
  Synthetic
tgactgttcgcggctcgtgggggctacgccagagcgcccccggctgcgcctcgtcgatgctgatgacccccttct

SEQ ID NO: 313845 - DNA, 75 bp, Artificial Sequence
  Synthetic
tatagcgccgcgctagtgggcccccgcgcgaaacccgcactagcccactggattcccgcacccgctgctgcatag

SEQ ID NO: 313846 - DNA, 75 bp, Artificial Sequence
  Synthetic
tgtccgcgcgtacaatcaacccgccggcgacgtcaggggtatctggggtaagggtgagcgcacctacgccgagca

SEQ ID NO: 313847 - DNA, 75 bp, Artificial Sequence
  Synthetic
tccacgcccacaccaccagtgacccctggcacccgcccggccccctgggattgaagttcaagacagtccgcccgg

SEQ ID NO: 313848 - DNA, 75 bp, Artificial Sequence
  Synthetic
ccctcgggtgagcacgcgaggcggcgagctagacccaaacacctgctggctccgcgccgccgccaacgttgcgca

SEQ ID NO: 313849 - DNA, 75 bp, Artificial Sequence
  Synthetic
gagctagacccaaacacctgctggctccgcgccgccgccaacgttgcgcaggctgcgcgcgcctgcggcgcctac

SEQ ID NO: 313850 - DNA, 75 bp, Artificial Sequence
  Synthetic
tgcgcgaactcaccgcgtacgcgcgggggcgcggcctcgaccacccggccaccatcggcgcgctcgaggagattc

SEQ ID NO: 313851 - DNA, 75 bp, Artificial Sequence
  Synthetic
tggccctaccacgcgcgttagcgcctccccgcaacgtgcgcgtgactggctgctaccagtgcggtacccccgcgc

SEQ ID NO: 313852 - DNA, 75 bp, Artificial Sequence
  Synthetic
tccccgcaacgtgcgcgtgactggctgctaccagtgcggtacccccgcgctggtggagggcctcgccccaggagg

SEQ ID NO: 313853 - DNA, 75 bp, Artificial Sequence
  Synthetic
gaacaggacgccgcggtcgccgccttcgaccgcgggccccttgaggacggcgggcaccacctggacaccgtgcaa

SEQ ID NO: 313854 - DNA, 75 bp, Artificial Sequence
  Synthetic
cctccaaaaccgccgccccgccccgagatcgccgcaacctggatcgtccacgccgcgagcgcagaccgctattgc

SEQ ID NO: 313855 - DNA, 75 bp, Artificial Sequence
  Synthetic
agatcgccgcaacctggatcgtccacgccgcgagcgcagaccgctattgcgcatgcgcccctcgctgtgacgttc

SEQ ID NO: 313856 - DNA, 75 bp, Artificial Sequence
  Synthetic
ggccccgcccgaccacctcctggtgtccctccaccgcgcccccaacggtccgtggggcgtagtgctcgaggtgcg

SEQ ID NO: 313857 - DNA, 75 bp, Artificial Sequence
  Synthetic
cacgcgaacgtccccccgcacctgcggacccgccggatgacgaggcgcttattccgccgtggctgtttgccgagc

SEQ ID NO: 313858 - DNA, 75 bp, Artificial Sequence
  Synthetic
cttgcgcggcgctatagcgccgcgctagtgggcccccgcgtgaaacccgcactagcccactagattcccgcaccc

SEQ ID NO: 313859 - DNA, 75 bp, Artificial Sequence
  Synthetic
cagctcaccctcggcgctatttgcgccctcctatttgctggcctgctcgcttgctgtgccaaatgcttatactac

SEQ ID NO: 313860 - DNA, 75 bp, Artificial Sequence
  Synthetic
gccgtgccctccgctgccgcgcgtgggacttcgaggctctccgcgcgcgcgccgatacggcggccacgcctgccc

SEQ ID NO: 313861 - DNA, 75 bp, Artificial Sequence
  Synthetic
gcggcggcccacgccgcgtctcggaccgcccccacctttggctcgcggtccccctgtctcggggcggcggcacct

SEQ ID NO: 313862 - DNA, 75 bp, Artificial Sequence
  Synthetic
ttgcgcggcgctacagcgccgcgctagtgggtccccgcgcgaaacccgcaccagcccactagatttctgcacccg

SEQ ID NO: 313863 - DNA, 75 bp, Artificial Sequence
  Synthetic
cgctggccccacgccccgcgcggtaccccactgtgctctaccgccaccccgcccaccacggcccgtggctcaccc

SEQ ID NO: 313864 - DNA, 75 bp, Artificial Sequence
  Synthetic
cccctgtctcggggcggcggcacctgtgccgcgaccgacgaggggctggcccaggcgtactacgacgacctcgag

SEQ ID NO: 313865 - DNA, 75 bp, Artificial Sequence
  Synthetic
agattgccgcgacctggatcgtccacgcagccagcgcagaccgccattgcgcgtgcgccccccgctgcgacgttc

SEQ ID NO: 313866 - DNA, 75 bp, Artificial Sequence
  Synthetic
ggacttcgaggctctccgcgcgcgcgccgatacggcggctgcgcccgctccgctggctccacgccctgcgcgata

SEQ ID NO: 313867 - DNA, 75 bp, Artificial Sequence
  Synthetic
ggccctggtcttatgcgacccacttggccagccgcttcggggccccgaacgccacttctccgccggtgcgcacat

SEQ ID NO: 313868 - DNA, 75 bp, Artificial Sequence
  Synthetic
cgcagccagcgcagaccgccattgcgcgtgcgccccccgctgcgacgttccgcgcgagcgtccttccgcacccgc

SEQ ID NO: 313869 - DNA, 75 bp, Artificial Sequence
  Synthetic
tacagcgccgcgctagtgggtccccgcgcgaaacccgcaccagcccactagatttctgcacccgttgctgtatag

SEQ ID NO: 313870 - DNA, 75 bp, Artificial Sequence
  Synthetic
gcccaccacggtccgtggctcacccttgatgagccgggcgaggctgacgcggccctggtcttatgcgacccgctt

SEQ ID NO: 313871 - DNA, 75 bp, Artificial Sequence
  Synthetic
gtgcgcgcaggcgcgagggctccaggcctttgtccgcgtcgtacctccgcccgagcgcccctgggctgacggggg

SEQ ID NO: 313872 - DNA, 75 bp, Artificial Sequence
  Synthetic
atcgacctcactgacgtctatacacagatgggcgtggccgcgcgggagctcaccgaccgctacgcgcgccgctac

SEQ ID NO: 313873 - DNA, 75 bp, Artificial Sequence
  Synthetic
ccgagcgcccctgggctgacgggggcgctagagcgtgggcgaagttcttccgcggctgcgcttgggcgcagcgct

SEQ ID NO: 313874 - DNA, 75 bp, Artificial Sequence
  Synthetic
tcctgcacgagatccaggccaaactccgcgcgcgcgacatcgacatcaagaacgccgccacttacgagcgcgcgc

SEQ ID NO: 313875 - DNA, 75 bp, Artificial Sequence
  Synthetic
ggtgagcgcacctacgccgagcaggatttccgcgtcggcggcacgcgctggcaccgactgctgcgcatgccagtg

SEQ ID NO: 313876 - DNA, 75 bp, Artificial Sequence
  Synthetic
tactcggcgagcctgcggtcatgcacctcccgtacaccgacggcgacgtgccaaagctgattgcactggccttgc

SEQ ID NO: 313877 - DNA, 75 bp, Artificial Sequence
  Synthetic
gcaccgactgctgcgcatgccagtgcgcggcctcgacggcgacagcgccccgctccccccccacaccaccgagcg

SEQ ID NO: 313878 - DNA, 75 bp, Artificial Sequence
  Synthetic
tcgttgccagccaaaccaccgcggaggtgatctgtgtcggtgaccgggaccagtgcggcccacactatgccaata

SEQ ID NO: 313879 - DNA, 75 bp, Artificial Sequence
  Synthetic
atgcggtcaccgccgccgtgcgcgctgaccccggccagcgcgctgcgacgtcatcgccgccggacaaccccccgc

SEQ ID NO: 313880 - DNA, 75 bp, Artificial Sequence
  Synthetic
tgaccccggccagcgcgctgcgacgtcatcgccgccggacaaccccccgccgtcgcgccgcgcacggcgatcgca

SEQ ID NO: 313881 - DNA, 75 bp, Artificial Sequence
  Synthetic
acggcccccggacgcccgcggcactccgcccccggcgcctgcgcgcgacccgccgccgcccgcccccagtccgcc

SEQ ID NO: 313882 - DNA, 75 bp, Artificial Sequence
  Synthetic
ccgcccccggcgcctgcgcgcgacccgccgccgcccgcccccagtccgcctgcgccaccccgcgcgaacgacctg

SEQ ID NO: 313883 - DNA, 75 bp, Artificial Sequence
  Synthetic
cgccgccgcccgcccccagtccgcctgcgccaccccgcgcgaacgacctggccccgcccacctcggcggagccgg

SEQ ID NO: 313884 - DNA, 75 bp, Artificial Sequence
  Synthetic
ttcccgctggcatcgaccgcgttgtcgccgtcgagcaggcaccaccaccgttgccgcccgccgacggcatccccg

SEQ ID NO: 313885 - DNA, 75 bp, Artificial Sequence
  Synthetic
tcaagttccacacggaaaccagaaccgtctggcagctctccgtggccggcgtgtcgtgcaacgtcacgaccgaac

SEQ ID NO: 313886 - DNA, 75 bp, Artificial Sequence
  Synthetic
acaactcgaggtccaggtcccgcccgaccccggcgacctggttgagtacattatgaattacaccggcaaccaaca

SEQ ID NO: 313887 - DNA, 75 bp, Artificial Sequence
  Synthetic
cgccgtcgagcaggcaccaccaccgttgccgcccgccgacggcatccccgaggcccaggacgtgccgcccttctg

SEQ ID NO: 313888 - DNA, 75 bp, Artificial Sequence
  Synthetic
cccccgcaccctggaggagctcgttttcggccgcgccggccacccccattacgcggaccttaaccgcgtgaccga

SEQ ID NO: 313889 - DNA, 75 bp, Artificial Sequence
  Synthetic
ccaccgcggcgaacaccacgcccgccgccacccccgccactgtgccggccccctgccacgccggcctcaatgaca

SEQ ID NO: 313890 - DNA, 75 bp, Artificial Sequence
  Synthetic
ggaggtcgcctgcgaaccgagcggcccccccacgtcaaccaaggcagacccagacagcgacatcgttgaaagtta

SEQ ID NO: 313891 - DNA, 75 bp, Artificial Sequence
  Synthetic
gctgacacccggtgcggtcggttgatctgcgggctgtccaccaccgcccagtacccgcctacccggttcggctgc

SEQ ID NO: 313892 - DNA, 75 bp, Artificial Sequence
  Synthetic
cgggccgcgcgcggcgtgccgagctagaggtcgcctgcgaacctagcggccccgccacgccagcccgggcggacc

SEQ ID NO: 313893 - DNA, 75 bp, Artificial Sequence
  Synthetic
caacgctgccaacgaggggctgctggccggttctggcgtctgcggtgccatttttgccaacgccgcggcggccct

SEQ ID NO: 313894 - DNA, 75 bp, Artificial Sequence
  Synthetic
cagacagcgacatcgttgaaagttatgcccgcgcggccggacccgtgcacctccgagtccgtgacatcatggacc

SEQ ID NO: 313895 - DNA, 75 bp, Artificial Sequence
  Synthetic
agaggtcgcctgcgaacctagcggccccgccacgccagcccgggcggacccagacagcgacatcgtcgaaagcta

SEQ ID NO: 313896 - DNA, 75 bp, Artificial Sequence
  Synthetic
cggcccgccggatgacgaggcgatcatcccgccgtggctgttcgccgagcgccgcgcccttcgctgccgcgagtg

SEQ ID NO: 313897 - DNA, 75 bp, Artificial Sequence
  Synthetic
ggcgtgcccgcccatccaggcacccgctgccccgaactggtgagccccatgggacgcgcgacttgttccccagcc

SEQ ID NO: 313898 - DNA, 75 bp, Artificial Sequence
  Synthetic
tctttgccagcgccacggcggcccttgctgcagactgccggcgcctcgctccatgccccaccggcgaggcagtgg

SEQ ID NO: 313899 - DNA, 75 bp, Artificial Sequence
  Synthetic
caacacccggccacggctgcgggtacacgcacatcatccacgctgtcgcgccgcggcgtcctcgggaccccgccg

SEQ ID NO: 313900 - DNA, 75 bp, Artificial Sequence
  Synthetic
cttgctcgtggcggttgacttgtggccggtcgcccttgcggcccacgtcggcgacgactgggacgacctgggcat

SEQ ID NO: 313901 - DNA, 75 bp, Artificial Sequence
  Synthetic
cgtgtgtcgcgtgccccctccttggcgctggcgtttacggctggtccgccgcggagtcccttcgggccgcgctca

SEQ ID NO: 313902 - DNA, 75 bp, Artificial Sequence
  Synthetic
gcgacgactgggacgacctgggcatcgcctggcatctcgaccatgacggcggctgccccgccgattgccgcggag

SEQ ID NO: 313903 - DNA, 75 bp, Artificial Sequence
  Synthetic
ccctcgaggagggcgaggcactgctcgagcgcgcctaccgcagcatcgtcgcgctagccgctgcgcgtaggtggg

SEQ ID NO: 313904 - DNA, 75 bp, Artificial Sequence
  Synthetic
ctgcaggggtataccccccccgcctacggagaggaggccttcacctacctctgcactgcaccggggtgcgccact

SEQ ID NO: 313905 - DNA, 75 bp, Artificial Sequence
  Synthetic
cggccacgcgcgccgagcccgccgagcgtgtgagcctgcacatctgccaccccgaccgcgccacattgatgcacg

SEQ ID NO: 313906 - DNA, 75 bp, Artificial Sequence
  Synthetic
taccaagtcttgccggacaccgcccaccccgggcgcctctaccgatgcgggccccgcctgtggacgcgcgattgc

SEQ ID NO: 313907 - DNA, 75 bp, Artificial Sequence
  Synthetic
cctctgtgctcgttggcgcggggctcgctgccaggcgcgtcagccctcctccgaccgagcccctcgcatcttgcc

SEQ ID NO: 313908 - DNA, 75 bp, Artificial Sequence
  Synthetic
ctccggagggccccgccgccgccgcggcaatcggggccgtggccagcgtaaggactggtccagggccccgccccc

SEQ ID NO: 313909 - DNA, 75 bp, Artificial Sequence
  Synthetic
tcatgtccccgcatttccgcgcgatccagaagatcatcatgcgcgccttgcgcccgcagttccttgtcgccgccg

SEQ ID NO: 313910 - DNA, 75 bp, Artificial Sequence
  Synthetic
ccaccggtggcccaggccgctcgactcagcgcagcgcgtcacccccggtgaccccccctgaggaagtcaccgcgc

SEQ ID NO: 313911 - DNA, 75 bp, Artificial Sequence
  Synthetic
tcagcgcagcgcgtcacccccggtgaccccccctgaggaagtcaccgcgcctgagccgcgcggatgccaggggtg

SEQ ID NO: 313912 - DNA, 75 bp, Artificial Sequence
  Synthetic
cgccgcgccgcgcacggcgatcgcaacggcttatggacgcccgcggtactccgccccccgtgcctgcgcgcgacc

SEQ ID NO: 313913 - DNA, 75 bp, Artificial Sequence
  Synthetic
cttcctcaaggccaccttgaagtgcgtagacgccgccctcggccccagggacaccgaggactgcaacgccgccca

SEQ ID NO: 313914 - DNA, 75 bp, Artificial Sequence
  Synthetic
cgccgccgcccgcccccagcccgcccgcgcccccctgcgccggtgacccggcccctcccccttccgcggggtcgg

SEQ ID NO: 313915 - DNA, 75 bp, Artificial Sequence
  Synthetic
gcgccgaagactaccgcgcgctccgcgccggcagctactgcaccctgcgcgaactgggcaccactgagaccggct

SEQ ID NO: 313916 - DNA, 75 bp, Artificial Sequence
  Synthetic
cggaccgcgtgcgtgacgcggagttggaggtcgcctgcgaaccgggcggcccccctacgccaaccaaggcagacc

SEQ ID NO: 313917 - DNA, 75 bp, Artificial Sequence
  Synthetic
cggcccgcccgatgacgaggcgctcatcccgccgtggctgttcgccgagcgccgtgccctccgctgccgcgagtg

SEQ ID NO: 313918 - DNA, 75 bp, Artificial Sequence
  Synthetic
ccactacagtgtgcttaagcccgcggaagtcaggcccccgcgaggtatgtgcgggagcgatatgtggcgctgccg

SEQ ID NO: 313919 - DNA, 75 bp, Artificial Sequence
  Synthetic
gtctggcaactctccgtcgccggcgtgtcatgcaacgtcaccaccgagcaccccttctgcaacacgccgcacgga

SEQ ID NO: 313920 - DNA, 75 bp, Artificial Sequence
  Synthetic
gattttccagggcgacgacatggtcatcttcctccccgagggcgcgcgcagtgcggcgctcaagtggacccccgc

SEQ ID NO: 313921 - DNA, 75 bp, Artificial Sequence
  Synthetic
cggctggcagggcatgccgcaggtgcggtgcaccccctctaatgcacacgccgccctgtgccgcacaggcgtacc

SEQ ID NO: 313922 - DNA, 75 bp, Artificial Sequence
  Synthetic
ccatgccccaccggcgaggccgtggcgacgcccggccacggctgcgggtacgcccacatcatccacgccgtcgca

SEQ ID NO: 313923 - DNA, 75 bp, Artificial Sequence
  Synthetic
cgaggtgggcttgttcggcttccacatcccggtgaagcatgtgagcactcccacccccagcttttgcgggcacgt

SEQ ID NO: 313924 - DNA, 75 bp, Artificial Sequence
  Synthetic
gaacaagacccaaacacctgctggctccgcgccgccgccaacgttgcgcaggccgcacgcgcatgcggcgcctac

SEQ ID NO: 313925 - DNA, 75 bp, Artificial Sequence
  Synthetic
ccctcgaggagggtgaagcgctgctcgagcgcgcctaccgcagcatcgtcgcgctggccgccgcgcgccgatggg

SEQ ID NO: 313926 - DNA, 75 bp, Artificial Sequence
  Synthetic
gatgtcatgcaccaggcgatcaaggtgctttgccgccgtttcgatccagacgtgcttgaggaacagcaggtggcc

SEQ ID NO: 313927 - DNA, 75 bp, Artificial Sequence
  Synthetic
gtgcgcgcaggcgcgggggctccaggctttcgtccgtgtcgtgcctccacccgagcgcccctgggccgacggggg

SEQ ID NO: 313928 - DNA, 75 bp, Artificial Sequence
  Synthetic
cctcccatacaccgatggcgatgtgccacagctgatcgcgctggccttgcgcacgctggcccaacagggggccgc

SEQ ID NO: 313929 - DNA, 75 bp, Artificial Sequence
  Synthetic
ccaaccgagcccctcgcatcctgctccgccggcgacccggaccgaccggctcggcgcagcgcgtcgcccccagtg

SEQ ID NO: 313930 - DNA, 75 bp, Artificial Sequence
  Synthetic
ggggcgcggcctcgaccacccggccactatcggcgcgctcgaggagattcagaccccctatgcgcgcgccaatct

SEQ ID NO: 313931 - DNA, 75 bp, Artificial Sequence
  Synthetic
atgcggtcactgccgctgtgcgcgctggccccggccagcccgcggccacgccaccgccacctggcgaccccccgc

SEQ ID NO: 313932 - DNA, 75 bp, Artificial Sequence
  Synthetic
tcgttgccagccaaaccaccgcggaggtgatctgcgtcggtgaccgagaccagtgcggcccacactacgccaaca

SEQ ID NO: 313933 - DNA, 75 bp, Artificial Sequence
  Synthetic
tctaaccaggtcatcacccaccgttgtttcgccgcatctggtgggtacccaacctttgccattcgggagagcccc

SEQ ID NO: 313934 - DNA, 75 bp, Artificial Sequence
  Synthetic
gtgggccgatgcgcttgcgccatggcgctgacacccggtgcggtcggttaatttgcgggctgtctactaccgccc

SEQ ID NO: 313935 - DNA, 75 bp, Artificial Sequence
  Synthetic
agggtgcccgaatggcctccaccacccccattaccatggaggacctccagaaggccctcgaggcacaatcccgcg

SEQ ID NO: 313936 - DNA, 75 bp, Artificial Sequence
  Synthetic
aaggccctcgaggcacaatcccgcgctctgcgcgcggaactcgccgccggcgccgcgcagtcgcgccggccgcgg

SEQ ID NO: 313937 - DNA, 75 bp, Artificial Sequence
  Synthetic
gtgcgccgcctcggggacgatgccatggcccgggcggcgctcgcatcggtccaacgcccccgtaaaggcccctac

SEQ ID NO: 313938 - DNA, 75 bp, Artificial Sequence
  Synthetic
gcccctcccacccctgcggggccggcggatcgcgcgcgcgacgccgagctggaggtcgcctgcgaaccgagcggc

SEQ ID NO: 313939 - DNA, 75 bp, Artificial Sequence
  Synthetic
cggatcgcgcgcgcgacgccgagctggaggtcgcctgcgaaccgagcggcccccccgcggcagccaaggcagacc

SEQ ID NO: 313940 - DNA, 75 bp, Artificial Sequence
  Synthetic
ccgccgcgacagcgcgactcgagcgcctccggagatgactccggacgcgactccggagggccccgccgccgccgc

SEQ ID NO: 313941 - DNA, 75 bp, Artificial Sequence
  Synthetic
ggcaaccggggccgcggccagcgcagggactggtcccgtgccccgccccccccggaagagcggcaagagagtcgc

SEQ ID NO: 313942 - DNA, 75 bp, Artificial Sequence
  Synthetic
ctctacgtctgccccaccaacgcgcttctacacgagatccaggccaaactccgtgcgcgcgacatcgacatcaag

SEQ ID NO: 313943 - DNA, 75 bp, Artificial Sequence
  Synthetic
cctcctactcgctggcttacttgcttgctgtgccaaatgcttgtactacttgcgcggcgctatagcgccgcgcta

SEQ ID NO: 313944 - DNA, 75 bp, Artificial Sequence
  Synthetic
tcccagactccggccccgaagccatcgcgggcgccaacacaacagcctcaacccccgcgcatgcagaccgggcgt

SEQ ID NO: 313945 - DNA, 75 bp, Artificial Sequence
  Synthetic
ccgaacccatgaggacttcgccgccctgagccagcggtggagtgcgagtcacgccgatgcctcccatgacggcac

SEQ ID NO: 313946 - DNA, 75 bp, Artificial Sequence
  Synthetic
tgacgaaaccgctcgccgcctatcgccgcatctacattgatgaggcgttcactcttggtggcgagtattgcgctt

SEQ ID NO: 313947 - DNA, 75 bp, Artificial Sequence
  Synthetic
gggggctccgccccgcgccccgagctggggccgccgaccaacccgttccaagcagccgtggcgcgtggcctgcgc

SEQ ID NO: 313948 - DNA, 75 bp, Artificial Sequence
  Synthetic
ccctcgaggagggcgaagcactgctcgagcgcgcctaccgcagcatcgtcgcgctggccgctgcgcgcgggtggg

SEQ ID NO: 313949 - DNA, 75 bp, Artificial Sequence
  Synthetic
agctcactctgggcgctatctgcgccctcctactcgctggcttacttgcttgctgtgccaaatgcttgtactact

SEQ ID NO: 313950 - DNA, 75 bp, Artificial Sequence
  Synthetic
gtgccgcgaccgacgaggggctggcccaggcgtactacgacgatctcgaggtgcgccgcctcggggatgacgcca

SEQ ID NO: 313951 - DNA, 75 bp, Artificial Sequence
  Synthetic
tgcatttcaccaacctgggcacccccccactcgacgaggacggccgctgggaccccgcgctcatgtacaaccctt

SEQ ID NO: 313952 - DNA, 75 bp, Artificial Sequence
  Synthetic
acttggcgcttccccgactgttgggcggcccgcctgcgcgcggggctcgattatgacgtcgagggcgagcacgcc

SEQ ID NO: 313953 - DNA, 75 bp, Artificial Sequence
  Synthetic
ccggccgagcccctcgcaccttgccccgccggtgccccgggcccaccggctcagcgcagctcgtcgcctccagcg

SEQ ID NO: 313954 - DNA, 75 bp, Artificial Sequence
  Synthetic
acaccccttggggatgccaccgcgcccgagcctcgcggatgccaggggtgcgaactctgccggtacacgcgcgtc

SEQ ID NO: 313955 - DNA, 75 bp, Artificial Sequence
  Synthetic
gcgacgactgggacgacctgggcatcgcctggcacctcgaccacgacgggggctgccccgccgactgccgtggcg

SEQ ID NO: 313956 - DNA, 75 bp, Artificial Sequence
  Synthetic
ggggctcagcgcgttcctcgacgccggggcactggcagagctcaaggaggtccccgccagcactgaccgcgttgt

SEQ ID NO: 313957 - DNA, 75 bp, Artificial Sequence
  Synthetic
ccactacagcgtgctcaagcccgcggaggtcaggcccccgcgaggcatgtgcgggagtgacatgtggcgctgccg

SEQ ID NO: 313958 - DNA, 75 bp, Artificial Sequence
  Synthetic
ccgccgcagctcccccgtgcgcacgggcagcattacggccaccaccaccatcagctgccattcctcgggcacgac

SEQ ID NO: 313959 - DNA, 75 bp, Artificial Sequence
  Synthetic
ggccaccatggcggcaccctgcgcgtcggccagcatcaccgaaacgccagtgacgtgctgcccggccactggctc

SEQ ID NO: 313960 - DNA, 75 bp, Artificial Sequence
  Synthetic
cggtgcaccccctccaacgcccacgccgccctgtgccgcacaggcgtgccccctcgagtgagcacgcgaggcagc

SEQ ID NO: 313961 - DNA, 75 bp, Artificial Sequence
  Synthetic
tccccgctggcatcgaccgcgtcgtcgccgttgagcaggctccaccaccgctgccgcccgccgacggcatccctg

SEQ ID NO: 313962 - DNA, 75 bp, Artificial Sequence
  Synthetic
caaggcggctggggttgctacaacctgagcgactggcaccagggcactcatgtctgccacaccaagcacatggac

SEQ ID NO: 313963 - DNA, 75 bp, Artificial Sequence
  Synthetic
gtgggccggtggcggtggttcagcctcccccgccccgtgtttcagcgtatgctgtcctactgcaagaccctgagc

SEQ ID NO: 313964 - DNA, 75 bp, Artificial Sequence
  Synthetic
gctgtcctactgcaagaccctgagcccggacgcgtactacagcgagcgcgtgttcaagttcaagaacgccctgag

SEQ ID NO: 313965 - DNA, 75 bp, Artificial Sequence
  Synthetic
cgcatttcgcggcacctgctcaataagaatcataccgagatgcccggaacagaacgtgttctcagtgctgtttgc

SEQ ID NO: 313966 - DNA, 75 bp, Artificial Sequence
  Synthetic
agggtgcccgaatggcttccactacccccatcaccatggaggacctccagaaggccctcgaggcacaatcccgcg

SEQ ID NO: 313967 - DNA, 75 bp, Artificial Sequence
  Synthetic
cgccccccgcgaccccgacgcctcttaccaccgcggcgaattccacgaccgccgccactcccgccactgcgccgg

SEQ ID NO: 313968 - DNA, 75 bp, Artificial Sequence
  Synthetic
cgcgtacgtggccttccgcgcgtggcagtccaacgcgaggctggccgggatcatgaaaggcgcgaagcgctgcgc

SEQ ID NO: 313969 - DNA, 75 bp, Artificial Sequence
  Synthetic
cagtccaacgcgaggctggccgggatcatgaaaggcgcgaagcgctgcgccgccgactccctgagcgtggccggc

SEQ ID NO: 313970 - DNA, 75 bp, Artificial Sequence
  Synthetic
tccctccaccgtgcccccaacggtccctggggcgtagtgctcgaggtgcgcgcgcgccccgaagggggcaacccc

SEQ ID NO: 313971 - DNA, 75 bp, Artificial Sequence
  Synthetic
accggccatttcgtctgcgcggttggcggtggcccacgccgcgtctcggaccgcccccacctttggctcgcggtc

SEQ ID NO: 313972 - DNA, 75 bp, Artificial Sequence
  Synthetic
gcggtgtgcccgcccatccgggcacccgctgccccgaactggtgagccccatgggacgagcgacctgctccccag

SEQ ID NO: 313973 - DNA, 75 bp, Artificial Sequence
  Synthetic
tgggcaccacttggccaccgtgcaacctcccaagctgccgccccgccccgagatcgctgcaacgtggatcgttca

SEQ ID NO: 313974 - DNA, 75 bp, Artificial Sequence
  Synthetic
cctctgccttctggctcgccacagcgaacgcgctgtctcttgaccacgccctcgcggccttcgttttgctggtcc

SEQ ID NO: 313975 - DNA, 75 bp, Artificial Sequence
  Synthetic
gtgcgtcgcctcggggatgacgccatggcccgggcggccctcgcatcagtccaacgccctcgcaaaggcccctac

SEQ ID NO: 313976 - DNA, 75 bp, Artificial Sequence
  Synthetic
ggggaaagctggccttgagatccgggcatgggccaaagagtgggttcaggttatgtccccgcacttccgcgcgat

SEQ ID NO: 313977 - DNA, 75 bp, Artificial Sequence
  Synthetic
ccagaagatcatcatgcgcgccctgcgcccgcaattcctcgtggccgccgggcacacggagcccgaggtcgacgc

SEQ ID NO: 313978 - DNA, 75 bp, Artificial Sequence
  Synthetic
ggcacacggagcccgaggtcgacgcgtggtggcaggcccattacactaccaacgccatcgaggtcgacttcaccg

SEQ ID NO: 313979 - DNA, 75 bp, Artificial Sequence
  Synthetic
gccgacacggcggccacgcccgcccccttggctccacgccccgcgcgccaccccaccgtgctctaccgccacccc

SEQ ID NO: 313980 - DNA, 75 bp, Artificial Sequence
  Synthetic
ccccaccgtgctctaccgccaccccgcccaccacggcccgtggctcacccttgacgagcccggcgaggccgacgc

SEQ ID NO: 313981 - DNA, 75 bp, Artificial Sequence
  Synthetic
cgctggcgtccgcttcgagtccaagattgtggacggcggctgctttgccccatgggacctcgaggccaccggagc

SEQ ID NO: 313982 - DNA, 75 bp, Artificial Sequence
  Synthetic
agcgccgctctcctgggccttccttgcgccgaggactaccgcgcgcttcgcgccggcagctactgcactctgcgc

SEQ ID NO: 313983 - DNA, 75 bp, Artificial Sequence
  Synthetic
gcccaccacggcccgtggctcacccttgacgagcccggcgaggccgacgcggccctggtcctatgcgacccactc

SEQ ID NO: 313984 - DNA, 75 bp, Artificial Sequence
  Synthetic
gaactgggctccacagagaccggttgcgagcgcacaagcggcgaacctgccacgctactacacaacaccaccgtg

SEQ ID NO: 313985 - DNA, 75 bp, Artificial Sequence
  Synthetic
gccgccacccccgccaccgtgccggccccctgccacgccggcctcaatgacagctgcggcggcttcctgtcaggg

SEQ ID NO: 313986 - DNA, 75 bp, Artificial Sequence
  Synthetic
ttatgacatcgagggcgagcgcgccggcaccttcgcctgcaacctttgggacggccgccaggtcgaccttcacct

SEQ ID NO: 313987 - DNA, 75 bp, Artificial Sequence
  Synthetic
agaccccctacgcgcgcgccaacctccacgacgctgactaacgcccctgcacgtagggcctttaatcttacctac

SEQ ID NO: 313988 - DNA, 75 bp, Artificial Sequence
  Synthetic
caatacccgcctacccggttcggctgcgccatgcggtggggccttcccccttgggaattggtcgtcctcaccgcc

SEQ ID NO: 313989 - DNA, 75 bp, Artificial Sequence
  Synthetic
ccgcagttgattgcgctggccctgcgcacactggcccaacagggggccgccttggcactctcggtgcgtgatctg

SEQ ID NO: 313990 - DNA, 75 bp, Artificial Sequence
  Synthetic
atcttcctccccgagggcgcgcgcagtgcggcgctcaagtggaccccctctgaggtcggcttgtttggattccac

SEQ ID NO: 313991 - DNA, 75 bp, Artificial Sequence
  Synthetic
cgccttcacgaagctggcatacgcgcgtacaccgtgcgcgaggcccagggtatgagtgttggcaccgcctgcatc

SEQ ID NO: 313992 - DNA, 75 bp, Artificial Sequence
  Synthetic
cgtgtcctgcaacgtcaccactgaacacccgttctgcaacacgccgcacggacaactcgaggtccaggtcccgcc

SEQ ID NO: 313993 - DNA, 75 bp, Artificial Sequence
  Synthetic
caccacgccgcgcacggcgatcgcggcgacccccggacacccgcggccctccgccctccgcgcccgcccgcgacc

SEQ ID NO: 313994 - DNA, 75 bp, Artificial Sequence
  Synthetic
cccccgcactctggaggagctcgtcttcggccgtgctggccacccccactacgcggacctcaaccgcgtgactga

SEQ ID NO: 313995 - DNA, 75 bp, Artificial Sequence
  Synthetic
cgccaacgccgcgtattacgactacagcgcggagcgtgtcctcgcgatcgtacgcgaactcaccgcgtacgcgcg

SEQ ID NO: 313996 - DNA, 75 bp, Artificial Sequence
  Synthetic
cgccgccgcctgcccccagtccgcccgcgccaccctgcgcgggcggcccggccccagccactctggaggagccgg

SEQ ID NO: 313997 - DNA, 75 bp, Artificial Sequence
  Synthetic
ctgactgctcgcggcttgtcggggccacgccagagcgcccccggctgcgcctggtcgacgccgacgaccccctgc

SEQ ID NO: 313998 - DNA, 75 bp, Artificial Sequence
  Synthetic
cacgccagagcgcccccggctgcgcctggtcgacgccgacgaccccctgctgcgcaccgcccctggacccggcga

SEQ ID NO: 313999 - DNA, 75 bp, Artificial Sequence
  Synthetic
cggatcgcgcgcgtgacgccgagctggaggttgcctgcgacccgagcggccccgccgcgccaaccagggcggacc

SEQ ID NO: 314000 - DNA, 75 bp, Artificial Sequence
  Synthetic
ccacgatgctgactagcgcccctgcacgtggggcctttaatcttacttactctaaccaggtcatcacccaccgtt

SEQ ID NO: 314001 - DNA, 75 bp, Artificial Sequence
  Synthetic
ttccgccagatcccacccccgcgcgtcaccgccggggtcgctcaggagtggcgcatgacgtacttgcgggaacgg

SEQ ID NO: 314002 - DNA, 75 bp, Artificial Sequence
  Synthetic
cccgccgcgccaaccagggcggacccagacagcgacatcgtcgaaagttacgcccgcgccgccggtcctgtgcac

SEQ ID NO: 314003 - DNA, 75 bp, Artificial Sequence
  Synthetic
gtttcgccgcttccggtgggtacctcactcttgctatttgggagagccccagggtgcccaaatggctaccaccgc

SEQ ID NO: 314004 - DNA, 75 bp, Artificial Sequence
  Synthetic
tctcaggcgcgcaagtgcgggctccacatacgcgctggaccgtacggccatgctaccgtcgaaatgcccgagtgg

SEQ ID NO: 314005 - DNA, 75 bp, Artificial Sequence
  Synthetic
caacgccgcgaacgaggggctgctcgccggatctggcgtctgcggtgccatctttgccaacgctgccgcggccct

SEQ ID NO: 314006 - DNA, 75 bp, Artificial Sequence
  Synthetic
ggggaaagccggccttgagatccgggcgtgggccaaggagtgggttcaggtcatgtccccgcatttccgtgcgat

SEQ ID NO: 314007 - DNA, 75 bp, Artificial Sequence
  Synthetic
gcgtgggccaaggagtgggttcaggtcatgtccccgcatttccgtgcgatccagaagatcatcatgcgcgccctg

SEQ ID NO: 314008 - DNA, 75 bp, Artificial Sequence
  Synthetic
ccgctccccccccacaccaccgagcgcattgagactcgctcggcgcgccatccgtggcgcatccgcttcggtgcc

SEQ ID NO: 314009 - DNA, 75 bp, Artificial Sequence
  Synthetic
cctccggggacgactctggtcgtgactccggagggccccgccgccgccgcggcaatcggggccgtggccagcgta

SEQ ID NO: 314010 - DNA, 75 bp, Artificial Sequence
  Synthetic
ccatgccccaccggcgaggcagtggcgacgcccggccacggctgcgggtatgcgcacatcatccacgcggtcgct

SEQ ID NO: 314011 - DNA, 75 bp, Artificial Sequence
  Synthetic
ccctcgagcagagcgaagccctgctcgaacgcgcctaccgcagcatcgtcgcgctggccgccgcgcgcgggtggg

SEQ ID NO: 314012 - DNA, 75 bp, Artificial Sequence
  Synthetic
aatgccatcgaagtcgacttcaccgagttcgacatgaaccagaccctcgccactcgggacgtcgagctcgagatt

SEQ ID NO: 314013 - DNA, 75 bp, Artificial Sequence
  Synthetic
gtgtcggagacccggcagacctgggcggagtgggctgctgcccattggtggcagctcactctgggcgctatctgc

SEQ ID NO: 314014 - DNA, 75 bp, Artificial Sequence
  Synthetic
ggtgtatggcacacacaccactgccgtgtcggagacccggcagacctgggcggagtgggctgctgcccattggtg

SEQ ID NO: 314015 - DNA, 75 bp, Artificial Sequence
  Synthetic
gcgctggccgccgcgcgcgggtgggcgtgcgttgcgtgccccctcctcggcgctggcgtctacggctggtccgcc

SEQ ID NO: 314016 - DNA, 75 bp, Artificial Sequence
  Synthetic
gtgttaccagtgcggtacccccgcgctggtggaaggccttgcccccggggggggcaattgccatctcaccgtcaa

SEQ ID NO: 314017 - DNA, 75 bp, Artificial Sequence
  Synthetic
cttgctgtgccaaatgcttgtactacttgcgcggcgctatagcgccgcgctagtgggcccccgcgcgaaacccgc

SEQ ID NO: 314018 - DNA, 75 bp, Artificial Sequence
  Synthetic
ctggtggaaggccttgcccccggggggggcaattgccatctcaccgtcaatggcgaggacgtcggcgccttcccc

SEQ ID NO: 314019 - DNA, 75 bp, Artificial Sequence
  Synthetic
tatagcgccgcgctagtgggcccccgcgcgaaacccgcattggctcactagatttccgcacccgttgctgcatag

SEQ ID NO: 314020 - DNA, 75 bp, Artificial Sequence
  Synthetic
gccgcccgcgactccgacgcctcttaccaccgcggcgaactccacgaccgccgctacccccgccaccgtgccggc

SEQ ID NO: 314021 - DNA, 75 bp, Artificial Sequence
  Synthetic
gtgtcggagacccggcagacctgggcggagtgggctgctgcccattggtggcagctcactctgggcgctatttgc

SEQ ID NO: 314022 - DNA, 75 bp, Artificial Sequence
  Synthetic
cctccgtgctcgtgggcgcggggctcgctgccaggcgcgtcagccctcccccgaccgagccccgcgcatcccgcc

SEQ ID NO: 314023 - DNA, 75 bp, Artificial Sequence
  Synthetic
ccgtcagcgacccgggccgatcgacccagcgcagcgcgtcacccccggctaccccctccggggaggccaccgcgc

SEQ ID NO: 314024 - DNA, 75 bp, Artificial Sequence
  Synthetic
ccgcccctccatgaccccgacaccgaggcacccactgaggcctgcgtgacctcgtggctctggagccagggcgaa

SEQ ID NO: 314025 - DNA, 75 bp, Artificial Sequence
  Synthetic
accctcctactcgctggcttactcgcttgctgtgccaaatgcttgtactacttgcgcggcgctatagcgccgcgc

SEQ ID NO: 314026 - DNA, 75 bp, Artificial Sequence
  Synthetic
ccagacctgtgttcacgcagatgcaggtcagtgatcacccagcactccacgcaatttcgcggtatacccgccgcc

SEQ ID NO: 314027 - DNA, 75 bp, Artificial Sequence
  Synthetic
gcgggcctgagccgcccgctcacgtcgtccgcgcgtacaatcaacctgccggcgacgttaggggtatttggggta

SEQ ID NO: 314028 - DNA, 75 bp, Artificial Sequence
  Synthetic
attggatcgagtggggccctaaagaagccctacacgtcctcatcgacccaagcccgggcctgctccgcgaggtcg

SEQ ID NO: 314029 - DNA, 75 bp, Artificial Sequence
  Synthetic
agggcgagcgcacctatgctgagcaggacttccgcgtcggcggcacgcgctggcaccgactgctgcgcatgccgg

SEQ ID NO: 314030 - DNA, 75 bp, Artificial Sequence
  Synthetic
agcccgggcctgctccgcgaggtcgctcgcgttgagcgccgctgggtcgcactgtgcctccacaggacggcacgc

SEQ ID NO: 314031 - DNA, 75 bp, Artificial Sequence
  Synthetic
ctcgcgttgagcgccgctgggtcgcactgtgcctccacaggacggcacgcaaactcgccaccgccctggccgaga

SEQ ID NO: 314032 - DNA, 75 bp, Artificial Sequence
  Synthetic
tgcgcggcctcgacggcgacagcgccccgctccccccccacaccaccgagcgcatcgagacacgctcggcgcgcc

SEQ ID NO: 314033 - DNA, 75 bp, Artificial Sequence
  Synthetic
ggaacgcgttctcagtgccgtttgcgccgtgcggcgctaccgcgcgggcgaggatgggtcgaccctccgcaccgc

SEQ ID NO: 314034 - DNA, 75 bp, Artificial Sequence
  Synthetic
ggggcgcggcctcgaccacccggccaccatcggcgcgctcgaggagatccagaccccctacgcgcgcgccaacct

SEQ ID NO: 314035 - DNA, 75 bp, Artificial Sequence
  Synthetic
acccttggcgcatccgctttggcgcccctcaggtcttcctcgccgggctcttgctcgctgcggtcgccgtcggca

SEQ ID NO: 314036 - DNA, 75 bp, Artificial Sequence
  Synthetic
acgtggggcctttaatcttacctactccaaccaggtcatcacccaccgttgtttcgccgcatctggtgggtaccg

SEQ ID NO: 314037 - DNA, 75 bp, Artificial Sequence
  Synthetic
ccgcgcgcgctgggctccaaccccgcgctgatattgcggcacccccttcgccgccgcagcccccccgcgcgcacg

SEQ ID NO: 314038 - DNA, 75 bp, Artificial Sequence
  Synthetic
tgcctggcatctcgaccatgacggcggttgccccgccgattgccgcggagccggcgctgggcccacgcccggcta

SEQ ID NO: 314039 - DNA, 75 bp, Artificial Sequence
  Synthetic
ccggtcgcccttgcggcccacgtcggcgacgactgggacgacctgggcattgcctggcatctcgaccatgacggc

SEQ ID NO: 314040 - DNA, 75 bp, Artificial Sequence
  Synthetic
gccgtggccgaactctcatgggaggttgcccaacactgcgggcaccaggcgcgcgtgcgcgccgtgcgatgcacc

SEQ ID NO: 314041 - DNA, 75 bp, Artificial Sequence
  Synthetic
ctgagccagcggtggagcgcaagccacgccgacgcctcccctgacggcaccggagaccccctcgaccccctgatg

SEQ ID NO: 314042 - DNA, 75 bp, Artificial Sequence
  Synthetic
cgctgatattgcggcacccccttcgccgccgcagcccccccgcgcgcacgggaagcactacggccaccaccacca

SEQ ID NO: 314043 - DNA, 75 bp, Artificial Sequence
  Synthetic
ccacgacgctgactaacgcccccgtacgtagggcctttatctcacctactctaaccaggtcatcacccaccgttg

SEQ ID NO: 314044 - DNA, 75 bp, Artificial Sequence
  Synthetic
cgtggggcgtggtgctcgaagtgcgcgcgcgccccgaggggggcaaccccaccggccactttgtttgcgcggtcg

SEQ ID NO: 314045 - DNA, 75 bp, Artificial Sequence
  Synthetic
cgtgcgccgaggaagacgcgctgtgcgcatacgtagccttccgcgcgtggcagtctaacgccaggttggcgggga

SEQ ID NO: 314046 - DNA, 75 bp, Artificial Sequence
  Synthetic
tgtttgccacaccaagcacatggacttctggtgcgtggagcacgaccgaccgccgcccgtgacctcgacgcccct

SEQ ID NO: 314047 - DNA, 75 bp, Artificial Sequence
  Synthetic
gcggcggcccacgccgtgtctcggaccgcccccacctctggctcgcggttcccctctcccggggcggtggcactt

SEQ ID NO: 314048 - DNA, 75 bp, Artificial Sequence
  Synthetic
ggcaaccggggccgtggccagcgtagggactggtccagggccccgccccccccggaagagcggcaagaaagtcgc

SEQ ID NO: 314049 - DNA, 75 bp, Artificial Sequence
  Synthetic
caccaccgcggcgaacgccacgaccgccgccacccccgccactacgccggccccttgccatgccggcctcaatga

SEQ ID NO: 314050 - DNA, 75 bp, Artificial Sequence
  Synthetic
cgcgcgccccgaggggggcaaccccaccggccactttgtttgcgcggtcggcggcggcccacgccgtgtctcgga

SEQ ID NO: 314051 - DNA, 75 bp, Artificial Sequence
  Synthetic
ccaggcgtattacgacgaccttgaggtgcgccgcctcggggacgacgccatggctcgggcggccctcgccgcggt

SEQ ID NO: 314052 - DNA, 75 bp, Artificial Sequence
  Synthetic
aggcacccaccgaggcctgcgtaacctcatggctttggagcgaaggcgaaggcgcggtcttctaccgcgtcgacc

SEQ ID NO: 314053 - DNA, 75 bp, Artificial Sequence
  Synthetic
cagtacccgcccacccgcttcggctgcgctatgcggtggggcctccccccctgggaactggtcgttcttacggcc

SEQ ID NO: 314054 - DNA, 75 bp, Artificial Sequence
  Synthetic
tacacttcaccaacctgggcaccccccccctcgacgaggacggccgctgggaccctgcgctcatgtacaaccctt

SEQ ID NO: 314055 - DNA, 75 bp, Artificial Sequence
  Synthetic
ctgggaactggtcgttcttacggcccgccccgaagacggctggacttgccgcggcgtgcccgctcacccaggtac

SEQ ID NO: 314056 - DNA, 75 bp, Artificial Sequence
  Synthetic
ccgctgcccagaactggtgagccccatggggcgcgcgacctgttctccggcctcggccctttggctcgccacagc

SEQ ID NO: 314057 - DNA, 75 bp, Artificial Sequence
  Synthetic
gcccaccacggcccgtggctcacccttgacgagccgggcgaggctgacgcggccctggtcttatgcgacccactt

SEQ ID NO: 314058 - DNA, 75 bp, Artificial Sequence
  Synthetic
cctcggccctttggctcgccacagcgaacgcactgtctattgaccacgcgctcgcggcccttgtcctgctggtcc

SEQ ID NO: 314059 - DNA, 75 bp, Artificial Sequence
  Synthetic
tgctatcagtgcggcacccccgcgctggtggaaggccttgcccccggggggggaaattgccatctcactgttaac

SEQ ID NO: 314060 - DNA, 75 bp, Artificial Sequence
  Synthetic
ggatttccgcgtcggtggcacgcgctggcaccgactgctgcgcatgccagtgcgcggcctcgacggcgacagcgc

SEQ ID NO: 314061 - DNA, 75 bp, Artificial Sequence
  Synthetic
cagtgcggcccgcactacgctaacaactgccgcacccccgtccctgaccgctggcccaccgagcgctcacgccac

SEQ ID NO: 314062 - DNA, 75 bp, Artificial Sequence
  Synthetic
tgctcggcgagccagcagttatgcacctcccatacaccgatggcgacgtgccacagctgatcgcactggctttgc

SEQ ID NO: 314063 - DNA, 75 bp, Artificial Sequence
  Synthetic
gcacgctggcccaacagggggccgccttggcactctcggtgcgtgacctgcccgggggtgcagcgttcgacgcaa

SEQ ID NO: 314064 - DNA, 75 bp, Artificial Sequence
  Synthetic
cggctcgtttgcgcgcggggctcgactacgatgtcgagggcgagcacgccggcacttttgcctgcaacctctggg

SEQ ID NO: 314065 - DNA, 75 bp, Artificial Sequence
  Synthetic
cgctgatatggcggccccgcctgcgccgccgcagcccccccgtgcgcacgggcagcactacggccatcaccacca

SEQ ID NO: 314066 - DNA, 75 bp, Artificial Sequence
  Synthetic
actgccgcacccccgtccctgaccgctggcccaccgagcgctcacgccacacctggcgcttccccgattgctggg

SEQ ID NO: 314067 - DNA, 75 bp, Artificial Sequence
  Synthetic
cgctggcgtccgcttcgagtccaagatcgtggacggtggctgctttgccccctgggacctcgaggccaccggggc

SEQ ID NO: 314068 - DNA, 75 bp, Artificial Sequence
  Synthetic
tcaccgccacccggcgaccccccgccgccgcgccgcgcacggcgatcgcaacggcactcggacgctcgcggcact

SEQ ID NO: 314069 - DNA, 75 bp, Artificial Sequence
  Synthetic
ctgcatctgcgagatccccactgatatctcgtgcgagggcttgggggcctgggtgcccacggccccgtgcgcgcg

SEQ ID NO: 314070 - DNA, 75 bp, Artificial Sequence
  Synthetic
aagcgggccatcgtagccgtgatacccagacctgttttcacgcagatgcaggtcagcgatcacccagcactccac

SEQ ID NO: 314071 - DNA, 75 bp, Artificial Sequence
  Synthetic
cgcgccaccccgcgctggtgacccggtccctcccattcccgcggggccggcggatcgcgcgcgtgacgccgagct

SEQ ID NO: 314072 - DNA, 75 bp, Artificial Sequence
  Synthetic
ttctggtgtgtggagcacgaccgaccgccgcctgcgaccccgacgcctctcaccaccgcggcgaacgccacgacc

SEQ ID NO: 314073 - DNA, 75 bp, Artificial Sequence
  Synthetic
tgcaccttctgggctgttaacgcctactcctccggcgggtacgcgcagttggcatcctacttcaaccctggcggt

SEQ ID NO: 314074 - DNA, 75 bp, Artificial Sequence
  Synthetic
caccaccgcggcgaacgccacgaccgccgccacccccaccactgcgccggccccctgccacgccggccttaatga

SEQ ID NO: 314075 - DNA, 75 bp, Artificial Sequence
  Synthetic
tccccgccggcattgaccgcgtcgttgccgtcgagcaggcgccgccaccattaccgcccgccgacggcatccccg

SEQ ID NO: 314076 - DNA, 75 bp, Artificial Sequence
  Synthetic
gccgcccgcgaccccgacgtctctcaccaccgcggcgaactccactaccgccgccacccccgccactgcgccgcc

SEQ ID NO: 314077 - DNA, 75 bp, Artificial Sequence
  Synthetic
cagctgcggcggcttcctgtcagggtgcgggccgatgcgcctgcgccacggcgccgacacccggtgcggtcggct

SEQ ID NO: 314078 - DNA, 75 bp, Artificial Sequence
  Synthetic
tccgacgccctctacctccacgagctcgaggacggctcactgcgcgctgctgggcttagcgcctttctcgacgcc

SEQ ID NO: 314079 - DNA, 75 bp, Artificial Sequence
  Synthetic
ttaccgcccgccgacggcatccccgaggcccaggacgtgccgcccttctgtccccgcactttggaggagctcgtc

SEQ ID NO: 314080 - DNA, 75 bp, Artificial Sequence
  Synthetic
cgctatgcggtggggcctccccccctgggaactggtcgttcttaccgcccgccccgaagacggctggacttgccg

SEQ ID NO: 314081 - DNA, 75 bp, Artificial Sequence
  Synthetic
gggcgagcgagaagtgcggtacatgcgcatttcgcgtcacctgctcaacaagaaccacaccgagatgcccgggac

SEQ ID NO: 314082 - DNA, 75 bp, Artificial Sequence
  Synthetic
ccagcaccctcacaagaccgtcagggtcaagttccacacggagaccaggaccgtctggcagctttccgtggccgg

SEQ ID NO: 314083 - DNA, 75 bp, Artificial Sequence
  Synthetic
cgctgccaggcgcgtcagtcctcctccgaccgagcccctcgcatcttgccccgccggtgacccgggccgaccggc

SEQ ID NO: 314084 - DNA, 75 bp, Artificial Sequence
  Synthetic
ccacagcattacgctcgcgggcaacgtgctgcaagaggggtggaagggcacgtgcgccgaagaagacgcgctgtg

SEQ ID NO: 314085 - DNA, 75 bp, Artificial Sequence
  Synthetic
gaatgcgctgtctcttgatcacgcccttgcggccgccgtcctgctggtcccgtgggtcctgatattcatggtgtg

SEQ ID NO: 314086 - DNA, 75 bp, Artificial Sequence
  Synthetic
tgttcaagttcaagaacgctctgagccacagcattacgctcgcgggcaacgtgctgcaagaggggtggaagggca

SEQ ID NO: 314087 - DNA, 75 bp, Artificial Sequence
  Synthetic
cggctacgcgcgccgagcccgccgagcgcgtgagcctgcacatctgccaccccgaccgcgccacgctgacgcacg

SEQ ID NO: 314088 - DNA, 75 bp, Artificial Sequence
  Synthetic
tccccggtttgccaacgccactcccccgactgttcgcggctcgtgggggccacgccagagcgtccccggctgcgc

SEQ ID NO: 314089 - DNA, 75 bp, Artificial Sequence
  Synthetic
tcctgcagggttacaacccccccgcctatggcgaggaggctttcacctacctctgtactgcaccggggtgcgcca

SEQ ID NO: 314090 - DNA, 75 bp, Artificial Sequence
  Synthetic
cttgtcgatgccgacgacccccttctgcgcaccgcccctgggcccggcgaggtgtgggtcacgcccgtcataggc

SEQ ID NO: 314091 - DNA, 75 bp, Artificial Sequence
  Synthetic
cgcaaacacctgtccccgtgcgcctcactggcgtccgctttgagtccaagattgtggacggcggctgctttgccc

SEQ ID NO: 314092 - DNA, 75 bp, Artificial Sequence
  Synthetic
acaccgaggactgccacgccgcccaggggaaagccggcctcgagatccgcgcatgggccaaagagtgggttcagg

SEQ ID NO: 314093 - DNA, 75 bp, Artificial Sequence
  Synthetic
cgccaccgtcgaaatgcctgagtggatccacgcccacaccactagcgacccctggcacccgccgggccccttggg

SEQ ID NO: 314094 - DNA, 75 bp, Artificial Sequence
  Synthetic
actcctctggtgggtacgcgcagctggcctcttacttcaaccctggcggtagctactacaagcagtaccatccta

SEQ ID NO: 314095 - DNA, 75 bp, Artificial Sequence
  Synthetic
gcatgggccaaagagtgggttcaggtcatgtccccgcactttcgcgcgatccagaagatcattatgcgcgccttg

SEQ ID NO: 314096 - DNA, 75 bp, Artificial Sequence
  Synthetic
actgaagtttaagacggttcgcccggtggccctgccgcgcgcgttagcgccaccccgcaacgtgcgcgtaaccgg

SEQ ID NO: 314097 - DNA, 75 bp, Artificial Sequence
  Synthetic
ccgcgtgcgaggttgagcccgccttcggacacagcgacgcggcctgctggggcttccccaccgacactgtgatga

SEQ ID NO: 314098 - DNA, 75 bp, Artificial Sequence
  Synthetic
ggcacacggagcccgaggttgacgcgtggtggcaggctcactacaccaccaatgccatcgaggtcgatttcaccg

SEQ ID NO: 314099 - DNA, 75 bp, Artificial Sequence
  Synthetic
ctgctaccagtgcggcacccccgcgctggtggaaggcctcgccccggggggagggaattgccatcttaccgtcaa

SEQ ID NO: 314100 - DNA, 75 bp, Artificial Sequence
  Synthetic
gagggaattgccatcttaccgtcaacggcgaggacgtcggcgccttcccccctgggaagttcgtcaccgccgccc

SEQ ID NO: 314101 - DNA, 75 bp, Artificial Sequence
  Synthetic
gtgcgccgcctcggggatgacgccatggcccgggcggccctcgcatcagtccaacgccctcgcaaaggcccttac

SEQ ID NO: 314102 - DNA, 75 bp, Artificial Sequence
  Synthetic
cacccattctgcaacacgccgcacggacaactcgaggtccaggtcccgcccgaccccggggacctggttgagtac

SEQ ID NO: 314103 - DNA, 75 bp, Artificial Sequence
  Synthetic
aatatcagggtatggaacatggccgcaggcgctggcaagactacccgcatcctcgctgccttcacgcgcgaagac

SEQ ID NO: 314104 - DNA, 75 bp, Artificial Sequence
  Synthetic
caggcgctggcaagactacccgcatcctcgctgccttcacgcgcgaagacctttacgtctgccccaccaatgcgc

SEQ ID NO: 314105 - DNA, 75 bp, Artificial Sequence
  Synthetic
cgcgcgagcgcgcgggtcattgaccccgccgcgcagtcgttcaccggcgtggtgtatggcacacacaccactgct

SEQ ID NO: 314106 - DNA, 75 bp, Artificial Sequence
  Synthetic
gaattgccacggccccgattgggcctccccggtttgtcagcgccattcccctgactgctcgcggcttgtgggggc

SEQ ID NO: 314107 - DNA, 75 bp, Artificial Sequence
  Synthetic
cctcgctgccttcacgcgcgaagacctttacgtctgccccaccaatgcgctcctgcacgagatccaggccaaact

SEQ ID NO: 314108 - DNA, 75 bp, Artificial Sequence
  Synthetic
tcccaaagggcgtacgctgggccgggattttccagggcgacgacatggtcatctttctccctgagggcgcacgca

SEQ ID NO: 314109 - DNA, 75 bp, Artificial Sequence
  Synthetic
cggagtgggccgctgctcattggtggcagctcactctgggcatcatttccgccctcctacttgctggcttgctcg

SEQ ID NO: 314110 - DNA, 75 bp, Artificial Sequence
  Synthetic
cgccgccgcccgcccccagtccgcctgcgccactccgcgcgagcgacctggccccgcccgcctcggcggagccgc

SEQ ID NO: 314111 - DNA, 75 bp, Artificial Sequence
  Synthetic
cggcaccgcggccggcctcttccacgatgtcatgcaccaggcgatcaaggtgctctgccgccgctttgaccccga

SEQ ID NO: 314112 - DNA, 75 bp, Artificial Sequence
  Synthetic
aggcccaagacgtgccgcccttctgcccccgcactctggaggagctcgtcttcggccgtgccggccacccccatt

SEQ ID NO: 314113 - DNA, 75 bp, Artificial Sequence
  Synthetic
ttcggccgtgccggccacccccattacgcggacctcaaccgcgtgactgagggcgaacgagaagtgcggtacatg

SEQ ID NO: 314114 - DNA, 75 bp, Artificial Sequence
  Synthetic
acgcggacctcaaccgcgtgactgagggcgaacgagaagtgcggtacatgcgcatctcgcgtcacctgctcaaca

SEQ ID NO: 314115 - DNA, 75 bp, Artificial Sequence
  Synthetic
cgcatctcgcgtcacctgctcaacaagaatcacaccgagatgcccggaacggaacgcgttctcagtgccgtttgc

SEQ ID NO: 314116 - DNA, 75 bp, Artificial Sequence
  Synthetic
ggaacgcgttctcagtgccgtttgcgccgtgcggcgctaccgcgcgggcgaggatgggtcgaccctccgcactgc

SEQ ID NO: 314117 - DNA, 75 bp, Artificial Sequence
  Synthetic
gtcagctgcgggggcgagagcgatcgcgcgagcgcgcgggtcattgaccccgccgcgcaatcgtttaccggcgtg

SEQ ID NO: 314118 - DNA, 75 bp, Artificial Sequence
  Synthetic
cggagtgggctgctgcccattggtggcagctcactctgggcgccatctgcaccctcctacttgctggcttactcg

SEQ ID NO: 314119 - DNA, 75 bp, Artificial Sequence
  Synthetic
acaccgaggactgccacgccgctcaggggaaagccggccttgagatccgggcgtgggccaaggagtgggttcagg

SEQ ID NO: 314120 - DNA, 75 bp, Artificial Sequence
  Synthetic
ccctcctactcgctggcttactcgcttgctgtgccaaatgcttgtactacttgcgcggcgctatagcgccgcgct

SEQ ID NO: 314121 - DNA, 75 bp, Artificial Sequence
  Synthetic
tcactgctggggtcgcccaggagtggcgcatgacgtacttgcgggaacggatcgacctcactgacgtctacacgc

SEQ ID NO: 314122 - DNA, 75 bp, Artificial Sequence
  Synthetic
ccagaagatcatcatgcgcgccttgcgcccgcaattccttgtggccgctggccatacggagcccgaggtcgatgc

SEQ ID NO: 314123 - DNA, 75 bp, Artificial Sequence
  Synthetic
aggactcctattcccatggagaaactcctggatgaggttcttgcccccggtgggccttacaatttaaccgtcggc

SEQ ID NO: 314124 - DNA, 75 bp, Artificial Sequence
  Synthetic
actgtgcctccacaggacggcacgcaaactcgccaccgccctggccgagacggccagtgaggcgtggcacgccga

SEQ ID NO: 314125 - DNA, 75 bp, Artificial Sequence
  Synthetic
gcgcggcactcaagtggacccccgccgaggtgggcttgtttggcttccacatcccggtgaagcacgtgagcaccc

SEQ ID NO: 314126 - DNA, 75 bp, Artificial Sequence
  Synthetic
gcgggcgccgccacaactgccccaacccccgcgaatgcaaaccgggggcgggggcactgccccgcgccccgagct

SEQ ID NO: 314127 - DNA, 75 bp, Artificial Sequence
  Synthetic
ggggccgccaactaacccattccaggcggccgtggggcgtggcctgcgcccgcccctccacgaccccgaaaccga

SEQ ID NO: 314128 - DNA, 75 bp, Artificial Sequence
  Synthetic
gcggccgtggggcgtggcctgcgcccgcccctccacgaccccgaaaccgaggcacccaccgaagcctgtgtgacc

SEQ ID NO: 314129 - DNA, 75 bp, Artificial Sequence
  Synthetic
cgtgcttgaagaacagcaggtggccctcctcgaccgcctccggggggtctacgcggctctgcctgacaccgttgc

SEQ ID NO: 314130 - DNA, 75 bp, Artificial Sequence
  Synthetic
gccccgcctgtggacacgcgattgcgccatagccgaactttcatgggaggtcgcccaacactgcgggcaccaggc

SEQ ID NO: 314131 - DNA, 75 bp, Artificial Sequence
  Synthetic
accccgggcgcctttaccgatgcgggccccgcctgtggacgcgcgattgcgccgtggccgaactctcatgggagg

SEQ ID NO: 314132 - DNA, 75 bp, Artificial Sequence
  Synthetic
ccactcgacgaggacggccgctgggacccggcgctcatgtacaacccttgcgggcccgagccgcccgctcacgtc

SEQ ID NO: 314133 - DNA, 75 bp, Artificial Sequence
  Synthetic
gcgccgcgaccgacgaagggctggcccaggcgtactacgacgaccttgaggtgcgccgcctcggggacgacgcca

SEQ ID NO: 314134 - DNA, 75 bp, Artificial Sequence
  Synthetic
ccgccgcgacagcgcgactccagcacctccggagatgactccggccgtgactccggagggccccgccgccgccgc

SEQ ID NO: 314135 - DNA, 75 bp, Artificial Sequence
  Synthetic
gggcgagcgcacctacgccgagcaggacttccgcgtcggtggcacgcgctggcaccgactgctgcgcatgccagt

SEQ ID NO: 314136 - DNA, 75 bp, Artificial Sequence
  Synthetic
cgtgcgccgaggaagacgcgctgtgcgcatatgtagccttccgcgcgtggcagtccaacgctaggttggcgggga

SEQ ID NO: 314137 - DNA, 75 bp, Artificial Sequence
  Synthetic
ggcaccgactgctgcgcatgccagtgcgcggccttgacggcgacagcgccccactccccccccacactaccgagc

SEQ ID NO: 314138 - DNA, 75 bp, Artificial Sequence
  Synthetic
tcccagactccggccccgaagccatcgcgggcgccgccacaacagcctcaacccccgcgcatgcaaaccgggcgt

SEQ ID NO: 314139 - DNA, 75 bp, Artificial Sequence
  Synthetic
aacatcagggtatggaacatggccgcaggcgctggtaagaccacccgcatcctcgctgccttcacgcgcgaggat

SEQ ID NO: 314140 - DNA, 75 bp, Artificial Sequence
  Synthetic
ccggagggccccgccgccgccgcggcaaccggggccgtggccagcgcagggactggtccagggccccgccccccc

SEQ ID NO: 314141 - DNA, 75 bp, Artificial Sequence
  Synthetic
cctcaggtcttcctcgccgggctcttgctcgcggccgttgccgtcggcaccgcgcgcgccgggcttcagccccgc

SEQ ID NO: 314142 - DNA, 75 bp, Artificial Sequence
  Synthetic
tgctcgcggccgttgccgtcggcaccgcgcgcgccgggcttcagccccgcgctgatatagcggcgcctcctgcgc

SEQ ID NO: 314143 - DNA, 75 bp, Artificial Sequence
  Synthetic
cgcgcgcgccgggcttcagccccgcgctgatatagcggcgcctcctgcgccgccgcaggccccccgtgggcacgg

SEQ ID NO: 314144 - DNA, 75 bp, Artificial Sequence
  Synthetic
ttgacgagccgggcgaggctgacgcggccctggtcttatgcgacccgctcggccagccgctccggggccccgaac

SEQ ID NO: 314145 - DNA, 75 bp, Artificial Sequence
  Synthetic
cccgcttcccccccacaccaccgagcgcattgagacccgctcggcgcgccatccttggcgcatccgcttcggtgc

SEQ ID NO: 314146 - DNA, 75 bp, Artificial Sequence
  Synthetic
gtgcgcgcaggcgcgggggctccaggcctttgtccgtgtcgtgcctccacccgagcgcccctgggccgacggggg

SEQ ID NO: 314147 - DNA, 75 bp, Artificial Sequence
  Synthetic
cggtcagcaccaccgaaacgccagcgacgtgctgcccggccactggctccaaggggggtggggttgttacaacct

SEQ ID NO: 314148 - DNA, 75 bp, Artificial Sequence
  Synthetic
gcacgctggcccaacagggggccgccttggcactctcggtgcgtgacttgcccgggggtacaacgttcgacgcaa

SEQ ID NO: 314149 - DNA, 75 bp, Artificial Sequence
  Synthetic
accaccgcggcgaactccacgaccgccgccacccccgctactacgccggcaccctgccacgccggcctcaatgat

SEQ ID NO: 314150 - DNA, 75 bp, Artificial Sequence
  Synthetic
accctgccacgccggcctcaatgatagctgcggcggtttcctgtccgggtgcgggccgatgcgcctgcgccatgg

SEQ ID NO: 314151 - DNA, 75 bp, Artificial Sequence
  Synthetic
cgctgccaggcgcgtcagcccccccccgaccgagcccctcgcaccccgccccgtcagcgacccgggccgatcgac

SEQ ID NO: 314152 - DNA, 75 bp, Artificial Sequence
  Synthetic
tgggaacttgtcgtccttacggcccgtcccgaggacggctggacttgccgcggcgtgcccgcccatccgggtacc

SEQ ID NO: 314153 - DNA, 75 bp, Artificial Sequence
  Synthetic
tggggcgcgccacttgctccccagcttcggccctctggcttgccacagccaacgcgctgtcccttgaccacgcgc

SEQ ID NO: 314154 - DNA, 75 bp, Artificial Sequence
  Synthetic
gcgctatgcggtggggccttcccccctgggaactggtcgtccttaccgcccgccccgaagacggctggacttgcc

SEQ ID NO: 314155 - DNA, 75 bp, Artificial Sequence
  Synthetic
caacgccgccaacgaggggctgctggccggctctggcgtgtgtggcgccatctttgccaacgccacggcggccct

SEQ ID NO: 314156 - DNA, 75 bp, Artificial Sequence
  Synthetic
cgtgcttgaagaacagcaggtggccctcctcgaccgcctccggggagtctacgcggctctgcccgacaccgtcgc

SEQ ID NO: 314157 - DNA, 75 bp, Artificial Sequence
  Synthetic
cgccgcgcctgtcgccgccgcggcgccgccgctgccctcaccgcggtcgtcctgcaggggtacaccccccccgcc

SEQ ID NO: 314158 - DNA, 75 bp, Artificial Sequence
  Synthetic
atcgacctcactgatgtctacacgcagatgggcgtggccgcgcgggagctcaccgaccgctacgcgcgccgctac

SEQ ID NO: 314159 - DNA, 75 bp, Artificial Sequence
  Synthetic
tcaaacacccgtccctgtgcgcctcgccggcgtccgctttgagtccaagattgtggacggcggctgctttgcccc

SEQ ID NO: 314160 - DNA, 75 bp, Artificial Sequence
  Synthetic
atgggacctcgaggccaccggagcctgcatctgcgagatccccaccgatgtctcgtgcgagggcttgggggcctg

SEQ ID NO: 314161 - DNA, 75 bp, Artificial Sequence
  Synthetic
gtcaagttccatacagagaccaggaccgtctggcaactctccgttgccggcgtgtcgtgcaacgtcaccactgaa

SEQ ID NO: 314162 - DNA, 75 bp, Artificial Sequence
  Synthetic
cacccgttctgcaacacgccgcacggacaactcgaggtccaggtcccgcccgaccccggggacctggttgagtac

SEQ ID NO: 314163 - DNA, 75 bp, Artificial Sequence
  Synthetic
cgaccccggggacctggttgagtacattatgaattacaccggcaatcagcagtcccggtggggcctcgggagccc

SEQ ID NO: 314164 - DNA, 75 bp, Artificial Sequence
  Synthetic
attatgaattacaccggcaatcagcagtcccggtggggcctcgggagcccgaattgccacggccccgattgggcc

SEQ ID NO: 314165 - DNA, 75 bp, Artificial Sequence
  Synthetic
cagcaccctcacaagaccgtcagggtcaagttccatacagaaaccaggaccgtctggcagctctccgtagccggc

SEQ ID NO: 314166 - DNA, 75 bp, Artificial Sequence
  Synthetic
tcaagttccatacagaaaccaggaccgtctggcagctctccgtagccggcgtgtcgtgcaacgtcacgaccgaac

SEQ ID NO: 314167 - DNA, 75 bp, Artificial Sequence
  Synthetic
tccccggtttgccaacgccattcccctgactgctcgcggcttgtgggggccacgccagagcgcccccggctgcgc

SEQ ID NO: 314168 - DNA, 75 bp, Artificial Sequence
  Synthetic
ggtgtgggtcacgcctgtcataggctctcaggcgcgcaagtgcggactccacatacgcgctggaccgtacggcca

SEQ ID NO: 314169 - DNA, 75 bp, Artificial Sequence
  Synthetic
tcatgaattacaccggcaaccaacagtcccggtggggcctcgggagcccgaactgtcacggccccgactgggcct

SEQ ID NO: 314170 - DNA, 75 bp, Artificial Sequence
  Synthetic
tcgtcgatgctgacgacccccttctgcgcaccgccccggggccgggcgaggtgtgggtcacgcctgtcataggct

SEQ ID NO: 314171 - DNA, 75 bp, Artificial Sequence
  Synthetic
catacgcgccggaccgtacggccacgccaccgtcgaaatgcctgagtggatccacgcccacactaccagtgaccc

SEQ ID NO: 314172 - DNA, 75 bp, Artificial Sequence
  Synthetic
tcagctgccgttccttgggcacgacggccatcacggcggcaccttgcgcgtcggcgagcaccaccgaaacgccag

SEQ ID NO: 314173 - DNA, 75 bp, Artificial Sequence
  Synthetic
tgaggtcggcttgtttggcttccacatcccagtgaagcacgtgagcaccccaacccccagcttctgcggacatgt

SEQ ID NO: 314174 - DNA, 75 bp, Artificial Sequence
  Synthetic
atcccagtgaagcacgtgagcaccccaacccccagcttctgcggacatgtcggcaccgcggccggcctcttccac

SEQ ID NO: 314175 - DNA, 75 bp, Artificial Sequence
  Synthetic
gaacgcgctgtctcttgatcacgccctcgcggcctttgtcctgctggtcccgtgggtcctgatattcatggtgtg

SEQ ID NO: 314176 - DNA, 75 bp, Artificial Sequence
  Synthetic
ctcgcggcctttgtcctgctggtcccgtgggtcctgatattcatggtgtgccgccgcgcctgtcgccgccgcggc

SEQ ID NO: 314177 - DNA, 75 bp, Artificial Sequence
  Synthetic
tatagcgcctcgctagtgggcccccgcgcgaaacccgcactaggccactagatccccgcacctgttgctgtatag

SEQ ID NO: 314178 - DNA, 75 bp, Artificial Sequence
  Synthetic
cagctcactctgggcgtcatttgcgccctcctgcttgctggcctacttgcttgctgtgccaaatgcttatactac

SEQ ID NO: 314179 - DNA, 75 bp, Artificial Sequence
  Synthetic
gcgatgactgggacgacctgggcattgcctggcacctcgaccatgacggcggttgccccgccgattgccgcggag

SEQ ID NO: 314180 - DNA, 75 bp, Artificial Sequence
  Synthetic
caatgggagctactggacctcgcttgggactcctattcccatggagaaactcctagacgaggttcttgcccccgg

SEQ ID NO: 314181 - DNA, 75 bp, Artificial Sequence
  Synthetic
ggatttcgaggctctccgcgcgcgcgccgacacggcggccgcgcccgccccgctggctccacgccctgcgcggta

SEQ ID NO: 314182 - DNA, 75 bp, Artificial Sequence
  Synthetic
ccccaccgtgctctaccgccaccccgcccaccacggtccgtggctcacccttgacgagccgggcgaggctgacgc

SEQ ID NO: 314183 - DNA, 75 bp, Artificial Sequence
  Synthetic
ccacagctgatcgcactggccttgcgcacgctggcccaacagggggccgccttggcactctcggtgcgtgacctg

SEQ ID NO: 314184 - DNA, 75 bp, Artificial Sequence
  Synthetic
gattttccagggcgacgatatggtcatcttcctccctgagggcgcgcgcagcgcggcactcaagtggacccccgc

SEQ ID NO: 314185 - DNA, 75 bp, Artificial Sequence
  Synthetic
ggctttcccaccgacaccgtgatgagcgtgttcgccctcgctagctacgtccagcaccctcacaagaccgtcagg

SEQ ID NO: 314186 - DNA, 75 bp, Artificial Sequence
  Synthetic
gcgcggcactcaagtggacccccgccgaggtgggcttgttcggcttccacatcccggtgaagcatgtgagcaccc

SEQ ID NO: 314187 - DNA, 75 bp, Artificial Sequence
  Synthetic
tggccccggccagtccgcggccacgtcaccgccacccggcgaccccccgccgccgcgccgcgcacggcgatcgca

SEQ ID NO: 314188 - DNA, 75 bp, Artificial Sequence
  Synthetic
caccccgcaatgtgcgtgtgaccgggtgctaccagtgcggcacccccgcgctggtggaaggccttgcccccgggg

SEQ ID NO: 314189 - DNA, 75 bp, Artificial Sequence
  Synthetic
ccacccccagtttctgcgggcacgtcggcactgcggccggcctcttccatgatgtcatgcaccaggcgattaagg

SEQ ID NO: 314190 - DNA, 75 bp, Artificial Sequence
  Synthetic
attatgaattacaccggcaaccaacagtcccggtggggcctcgggagcccgaactgtcacggccccgactgggcc

SEQ ID NO: 314191 - DNA, 75 bp, Artificial Sequence
  Synthetic
actgtgcctccacaggacggcacgcaaacttgccaccgccttggccgagacggccggcgaggcctggcatgccga

SEQ ID NO: 314192 - DNA, 75 bp, Artificial Sequence
  Synthetic
tgctttgccgccgtttcgacccggacgtgcttgaagaacagcaggtggccctcctcgaccgcctccggggggtct

SEQ ID NO: 314193 - DNA, 75 bp, Artificial Sequence
  Synthetic
ccggtcgcccttgcggcgcatgttggcgacgactgggacgacctgggcatcgcctggcatcttgaccacgacggc

SEQ ID NO: 314194 - DNA, 75 bp, Artificial Sequence
  Synthetic
gcgacgactgggacgacctgggcatcgcctggcatcttgaccacgacggcggctgtcccgccgattgccgtgggg

SEQ ID NO: 314195 - DNA, 75 bp, Artificial Sequence
  Synthetic
agctgatgcgcaccatcgacgccaccctgctcgtggcggttgacttgtggccggtcgcccttgcggcgcacgttg

SEQ ID NO: 314196 - DNA, 75 bp, Artificial Sequence
  Synthetic
ccggcgctgggcccatgcccggctatacccgcccctgcaccacgcgcatctaccaggtcctgccggacaccgccc

SEQ ID NO: 314197 - DNA, 75 bp, Artificial Sequence
  Synthetic
tacccgcccctgcaccacgcgcatctaccaggtcctgccggacaccgcccaccccgggcggctctaccggtgcgg

SEQ ID NO: 314198 - DNA, 75 bp, Artificial Sequence
  Synthetic
gccccgcctgtggacacgtgattgcgccgtggctgagctctcgtgggaggtcgcccagcactgcgggcaccaggc

SEQ ID NO: 314199 - DNA, 75 bp, Artificial Sequence
  Synthetic
cgaactctgccggtatacgcgcgtcaccaatgaccgcgcctacgtcaacctgtggctcgagcgcgaccgcggcgc

SEQ ID NO: 314200 - DNA, 75 bp, Artificial Sequence
  Synthetic
gcgcgtgcgcgccgtgcgatgtaccctccccattcgccatgtgcgcagcctccaacccagcgcgcgggtccgcct

SEQ ID NO: 314201 - DNA, 75 bp, Artificial Sequence
  Synthetic
ctccccattcgccatgtgcgcagcctccaacccagcgcgcgggtccgcctcccggaccttgtccacctcgctgag

SEQ ID NO: 314202 - DNA, 75 bp, Artificial Sequence
  Synthetic
tgtggctcgagcgcgaccgcggcgccaccagctgggcgatgcgcattcccgaggtggttgtctacgggccggagc

SEQ ID NO: 314203 - DNA, 75 bp, Artificial Sequence
  Synthetic
ctgagccagcggtggagcgcgagccacgccgatgcctcccctgacggcaccggggatcccctcgaccccctgatg

SEQ ID NO: 314204 - DNA, 75 bp, Artificial Sequence
  Synthetic
ccggacgcgtactacagcgagcgcgtgttcaagttcaagaacgccctgagccacagcatcacgctcgcgggcaac

SEQ ID NO: 314205 - DNA, 75 bp, Artificial Sequence
  Synthetic
gagaccgtgggatgcgcctgctcgcgcgtgtgggtcggctccgagcacgaggccccgcccgaccacctcctggtg

SEQ ID NO: 314206 - DNA, 75 bp, Artificial Sequence
  Synthetic
cccgcttcccccccacaccaccgagcgcattgagacccgctcggcgcgccatccttggcgcatccgcttcggcgc

SEQ ID NO: 314207 - DNA, 75 bp, Artificial Sequence
  Synthetic
tcgcgcgcgcgatatcgacatcaagaacgccgccacctacgagcgcgcgctgacgaaaccgctcgccgcctaccg

SEQ ID NO: 314208 - DNA, 75 bp, Artificial Sequence
  Synthetic
cagtccaacgccaggctagccggggtcatgaaaggcgcgaagcgctgcgccgccgactccctgagcgtggccggc

SEQ ID NO: 314209 - DNA, 75 bp, Artificial Sequence
  Synthetic
cagtgcggcccacactacgccaacaactgccgcacccccgtccctgaccgctggcctaccgagcgctcacgccac

SEQ ID NO: 314210 - DNA, 75 bp, Artificial Sequence
  Synthetic
cgccgactccctgagcgtggccggctggctgggcacggtttgggacgccattaagcggtttttcggcagcgtgcc

SEQ ID NO: 314211 - DNA, 75 bp, Artificial Sequence
  Synthetic
cctccaaagccgccgccccgccccgagatcgctgcaacgtggattgtccacgccgcgagcgcagaccgccactgt

SEQ ID NO: 314212 - DNA, 75 bp, Artificial Sequence
  Synthetic
ccagctgcccttcctcgggcacgacggccatcacggcggcaccctgcgcgtcggccagcatcaccgcaacgccag

SEQ ID NO: 314213 - DNA, 75 bp, Artificial Sequence
  Synthetic
gccgtgcggcgctaccgcgcgggcgaggatgggtcgaccctccgcaccgctgtggcccgccagcacccgcgccct

SEQ ID NO: 314214 - DNA, 75 bp, Artificial Sequence
  Synthetic
tcgaccgcggccccctcgaggatggcgggcaccacctggacaccgtgcaacctcccaaaccgctgccccgccccg

SEQ ID NO: 314215 - DNA, 75 bp, Artificial Sequence
  Synthetic
tgcgggccgatgcgcctgcgccacggcgccgacacccggtgcggtcggctgatctgcgggctgtccaccaccgcc

SEQ ID NO: 314216 - DNA, 75 bp, Artificial Sequence
  Synthetic
gcgtgcgccccccgctgcgacgttccacgcgaacgtccttccgcgcctgcgggcccgccagatgacgaggcgatt

SEQ ID NO: 314217 - DNA, 75 bp, Artificial Sequence
  Synthetic
cagtacccgcctacccggttcggctgcgttatgcggtggggccttcccccttgggaactggtcgtccttaccgcc

SEQ ID NO: 314218 - DNA, 75 bp, Artificial Sequence
  Synthetic
atcccaccgtggctgttcgccgagtgccgtacccttcgctgccgcgagtgggatttcgaggccctccgcgcgcgc

SEQ ID NO: 314219 - DNA, 75 bp, Artificial Sequence
  Synthetic
ggatttcgaggccctccgcgcgcgcgccgacacggcggccacgcccgccccgctggccccacgccccgcgcggca

SEQ ID NO: 314220 - DNA, 75 bp, Artificial Sequence
  Synthetic
cactcggcgagccagcagtcatgcacctcccgtataccgacggcgacgtgccgcagctgattgcgctggccctcc

SEQ ID NO: 314221 - DNA, 75 bp, Artificial Sequence
  Synthetic
ccccaccgtgctctaccgccaccccgcccaccatggcccgtggctcacccttgatgagccgggcgaggccgatgc

SEQ ID NO: 314222 - DNA, 75 bp, Artificial Sequence
  Synthetic
gcccaccatggcccgtggctcacccttgatgagccgggcgaggccgatgccgccctcgtcttgtgcgacccactc

SEQ ID NO: 314223 - DNA, 75 bp, Artificial Sequence
  Synthetic
ggccagccgctccggggcccagagcgccacttcgctgtcggtgcgcacatgtgcgcgcaggcgcgcgggctccag

SEQ ID NO: 314224 - DNA, 75 bp, Artificial Sequence
  Synthetic
gcgccccccccagacaattcctcgccaccacgccgtgcacggcggtcgcggcgactcccggacacccgcggcccg

SEQ ID NO: 314225 - DNA, 75 bp, Artificial Sequence
  Synthetic
gccacttcgctgtcggtgcgcacatgtgcgcgcaggcgcgcgggctccaggctttcgtccgtgtcgtgcctccac

SEQ ID NO: 314226 - DNA, 75 bp, Artificial Sequence
  Synthetic
ccgccttccgcgcccgcccgcgacccgccgccccccgcccccagtccgcccacgccaccccgcgcgcgcggcccg

SEQ ID NO: 314227 - DNA, 75 bp, Artificial Sequence
  Synthetic
ctccggggggccccgccgccgccgcggcaaccggggccgtggccagcgcagggactggtccagggccccgccccc

SEQ ID NO: 314228 - DNA, 75 bp, Artificial Sequence
  Synthetic
tgctcggcgagccggcagtcatgcatctcccgtacaccgacggcgacgtgccgcagttgatcgcgctggccctgc

SEQ ID NO: 314229 - DNA, 75 bp, Artificial Sequence
  Synthetic
gccccagccactctggaggagccggcggatcgcgtgcgtgacgccgagctggaggtcgcctccgacccgagcggc

SEQ ID NO: 314230 - DNA, 75 bp, Artificial Sequence
  Synthetic
cggatcgcgtgcgtgacgccgagctggaggtcgcctccgacccgagcggccccgccgcgcctacgagggcggacc

SEQ ID NO: 314231 - DNA, 75 bp, Artificial Sequence
  Synthetic
gcacgctggcccaacagggggccgctttggcactctcggtgcgcgacctccctgggggcgccgcgttcgacgcga

SEQ ID NO: 314232 - DNA, 75 bp, Artificial Sequence
  Synthetic
cttcgcgttcgcgacatcatggaccccccgcccggctgcaaggtcgtggtcaacgccgcgaacgaggggctgctc

SEQ ID NO: 314233 - DNA, 75 bp, Artificial Sequence
  Synthetic
acgcggttaccgccgccgtgcgcgcagaccccggccagctcgcactgacgtcaccgccgccggacaaccctccgc

SEQ ID NO: 314234 - DNA, 75 bp, Artificial Sequence
  Synthetic
cgccgcgccgcgcacgccggtcgcaacggcacgcggacgcccgcggccctccgccccccgcgcccgcgcgcgacc

SEQ ID NO: 314235 - DNA, 75 bp, Artificial Sequence
  Synthetic
ccatgccccaccggcgaggcagtggcgacgcccggccacggctgcgggtacgcgcacatcatccacgcggtcgct

SEQ ID NO: 314236 - DNA, 75 bp, Artificial Sequence
  Synthetic
ggtgtgggtcacgcctgtcataggctctcaggcgcgcaagtgcgggctccacatacgcgctggaccgtacggcca

SEQ ID NO: 314237 - DNA, 75 bp, Artificial Sequence
  Synthetic
gctgaaattcaagaccgttcgcccggttgccctgccacgcgcgttcgcaccaccccgcaatgtgcgtgtgaccgg

SEQ ID NO: 314238 - DNA, 75 bp, Artificial Sequence
  Synthetic
gcctctcccatttcggccgagccggcggatcgcgcgcgtgacgccgagccggaggttgcctgtgaaccgggcggc

SEQ ID NO: 314239 - DNA, 75 bp, Artificial Sequence
  Synthetic
cccgccacgccagccagggcggacccagacagcgacattgttgaaagctacgcccgcgccgccgggcctgtgcac

SEQ ID NO: 314240 - DNA, 75 bp, Artificial Sequence
  Synthetic
ctccgagtgcgcaacatcatggaccccccgcccggctgcaaggtcgtggtcaacgccgccaacgaggggctgctg

SEQ ID NO: 314241 - DNA, 75 bp, Artificial Sequence
  Synthetic
cgctgccaggcgcgtcagccctcccccgaccgagcccttcgcaccccgccccgtcagcgacccgggccgaccggc

SEQ ID NO: 314242 - DNA, 75 bp, Artificial Sequence
  Synthetic
caacgccgccaacgaggggctgctggccggttctggcgtctgtggtgccatctttgccagcgccgccgcgagcct

SEQ ID NO: 314243 - DNA, 75 bp, Artificial Sequence
  Synthetic
ccgtcagcgacccgggccgaccggcccagcgcagcgcgtcacccccggctaccccctctggggaggccgccgcgc

SEQ ID NO: 314244 - DNA, 75 bp, Artificial Sequence
  Synthetic
cgctgaggactgccggcgcctcgccccatgccccactggcgaagcagtggcgacgcccggccacggctgcgggta

SEQ ID NO: 314245 - DNA, 75 bp, Artificial Sequence
  Synthetic
cacccgcccctgcaccacacgcatctaccaggtcctgccggacaccgcccaccccgggcgcctctaccggtgcgg

SEQ ID NO: 314246 - DNA, 75 bp, Artificial Sequence
  Synthetic
ctgagtcacgcgggtgccaagggtgcgaactctgtcggtatacgcgcgtcaccaatgaccgcgcgtatgtcaacc

SEQ ID NO: 314247 - DNA, 75 bp, Artificial Sequence
  Synthetic
tgcgcacatcatccacgcagtcgcgcctcggcgccctcaggaccctgccgcccttgagcagagcgaggccctgct

SEQ ID NO: 314248 - DNA, 75 bp, Artificial Sequence
  Synthetic
taccaggtcctgccggacaccgcccaccccgggcgcctctaccggtgcgggccccgcctgtggacgcgcgattgc

SEQ ID NO: 314249 - DNA, 75 bp, Artificial Sequence
  Synthetic
cgctggcatctacggctggtctgccgcggagtcccttcgagccgcgcttgcggccgcgcgcactgagcccgctga

SEQ ID NO: 314250 - DNA, 75 bp, Artificial Sequence
  Synthetic
ccccaccgtgctctaccgccaccctgcccaccacggtccgtggctcaccctcgacgagccgggcgaggccgacgc

SEQ ID NO: 314251 - DNA, 75 bp, Artificial Sequence
  Synthetic
gcgcgtgagcctgcacatctgccaccccgaccgcgccacactgatgcacgcttccgtgctcgtgggcgcggggct

SEQ ID NO: 314252 - DNA, 75 bp, Artificial Sequence
  Synthetic
cttccgtgctcgtgggcgcggggctcgctgccaggcgcgtcagtccccccccgaccgagcctcccgcatcccgcc

SEQ ID NO: 314253 - DNA, 75 bp, Artificial Sequence
  Synthetic
gccgatacggcggccgcgcccgccccgctggctccacgccctgcgcggtaccccactgtgctctaccgccacccc

SEQ ID NO: 314254 - DNA, 75 bp, Artificial Sequence
  Synthetic
ccgccgacgacccaggccgatcggcccagcgtaccgcgccgcccccggcggccccccctggggacgccgccgcgc

SEQ ID NO: 314255 - DNA, 75 bp, Artificial Sequence
  Synthetic
cgcgcgccccgaggggggcaaccccaccggccacttagtctgcgcggtcggcggcggcccacgccgtgtctccga

SEQ ID NO: 314256 - DNA, 75 bp, Artificial Sequence
  Synthetic
cgcgcgccccgaggggggcaaccccaccggccactttgtctgcgcggtcggcggcggcccacgccgtgtctccga

SEQ ID NO: 314257 - DNA, 75 bp, Artificial Sequence
  Synthetic
cgcgcgccccgaggggggcaaccccaccggccacttcgtctgcgcggtcggcggcggcccacgccgtgtctccga

SEQ ID NO: 314258 - DNA, 75 bp, Artificial Sequence
  Synthetic
cgcgcgccccgaggggggcaaccccaccggccacttggtctgcgcggtcggcggcggcccacgccgtgtctccga

SEQ ID NO: 314259 - DNA, 75 bp, Artificial Sequence
  Synthetic
tatagcgccgcgctagtgggcccccgcgcgaaacccgcactagcccactagattcccgcacctgttgctgcatag

SEQ ID NO: 314260 - DNA, 75 bp, Artificial Sequence
  Synthetic
cttggcactctcggtgcgcgacctgcccgggggtgcggcgttcgacgcaaacgcggtcaccgccgccgtgcgcgc

SEQ ID NO: 314261 - DNA, 75 bp, Artificial Sequence
  Synthetic
cggccccggccggcccgcggccacgccaccgccgcccggcgaccccccgccgccacgccgcgcacgacgatcgca

SEQ ID NO: 314262 - DNA, 75 bp, Artificial Sequence
  Synthetic
gcggcactcggacgcccgcggcacccccccccccgcgcctgcgcgcgacccaccgccccccgccccaagcccgcc

SEQ ID NO: 314263 - DNA, 75 bp, Artificial Sequence
  Synthetic
gcggcactcggacgcccgcggcacccccccccccgcgcctgcgcgcgaccctccgccccccgccccaagcccgcc

SEQ ID NO: 314264 - DNA, 75 bp, Artificial Sequence
  Synthetic
gcggcactcggacgcccgcggcacccccccccccgcgcctgcgcgcgaccccccgccccccgccccaagcccgcc

SEQ ID NO: 314265 - DNA, 75 bp, Artificial Sequence
  Synthetic
gcggcactcggacgcccgcggcacccccccccccgcgcctgcgcgcgacccgccgccccccgccccaagcccgcc

SEQ ID NO: 314266 - DNA, 75 bp, Artificial Sequence
  Synthetic
gaagtggtcgtctacgggccggagcaccttgctgcgcacttcccactgaatcactacagcgtgctcaagcccgcg

SEQ ID NO: 314267 - DNA, 75 bp, Artificial Sequence
  Synthetic
agttgggtaagagaccatgtccgctcaattgtcgagggtgcgtgggaagtgcgcgatgttgtttccgctgcccaa

SEQ ID NO: 314268 - DNA, 75 bp, Artificial Sequence
  Synthetic
accaacgaccgcgcgtacgtcaacctgtggctcgagcgcgaccgcggcgccaccggctgggcgatgcgcatcccc

SEQ ID NO: 314269 - DNA, 75 bp, Artificial Sequence
  Synthetic
tcctggatgaggttcttgcccccggtgggccttacaatttgaccgtcggcagttgggtaagagaccatgtccgct

SEQ ID NO: 314270 - DNA, 75 bp, Artificial Sequence
  Synthetic
gcgggagtgacatgtggcgctgccgtggctggcagggcatgccgcaggtgcggtgcaccccttccaacgcccacg

SEQ ID NO: 314271 - DNA, 75 bp, Artificial Sequence
  Synthetic
cccccccccgcgcctgcgcgcgacccaccgccccccgccccaagcccgcccgcgccaccccgcgcgggtgtcccg

SEQ ID NO: 314272 - DNA, 75 bp, Artificial Sequence
  Synthetic
cccccccccgcgcctgcgcgcgaccctccgccccccgccccaagcccgcccgcgccaccccgcgcgggtgtcccg

SEQ ID NO: 314273 - DNA, 75 bp, Artificial Sequence
  Synthetic
cccccccccgcgcctgcgcgcgaccccccgccccccgccccaagcccgcccgcgccaccccgcgcgggtgtcccg

SEQ ID NO: 314274 - DNA, 75 bp, Artificial Sequence
  Synthetic
cccccccccgcgcctgcgcgcgacccgccgccccccgccccaagcccgcccgcgccaccccgcgcgggtgtcccg

SEQ ID NO: 314275 - DNA, 75 bp, Artificial Sequence
  Synthetic
aacgccgccacctacgagcgcgcgctgacgaaaccgcttgccgcctaccgccgcatctacatcgacgaggcgttc

SEQ ID NO: 314276 - DNA, 75 bp, Artificial Sequence
  Synthetic
ccgccctgtgccgcataggcataccccctcgggtgagcacgcgcggcgacgaacgagacccgaacacctgctggc

SEQ ID NO: 314277 - DNA, 75 bp, Artificial Sequence
  Synthetic
aggcccaagacgtgccgcccttctgcccccgcactctggaggagctcgttttcggccgtgccggccaccctcact

SEQ ID NO: 314278 - DNA, 75 bp, Artificial Sequence
  Synthetic
tccgcgccgccgccaacgtcgcgcaggctgcgcgcgcctgcggcgcatacacgagcgccgggtgcccgaagtgcg

SEQ ID NO: 314279 - DNA, 75 bp, Artificial Sequence
  Synthetic
cgctgccaggcgcgtcagccctcctccgaccgagcccctcgcaacttgccccgccggtgacccgggccgaccggc

SEQ ID NO: 314280 - DNA, 75 bp, Artificial Sequence
  Synthetic
cctacggtcgcgccctgagcgaagcccgcactcatgaggacttcgccgcactgagccagcggtggatcgcaagcc

SEQ ID NO: 314281 - DNA, 75 bp, Artificial Sequence
  Synthetic
ctacgtgtgcgcgctgcgtggcgcaccgagcggccccttttacgtccacccagaggacgtcccgcacggcggtcg

SEQ ID NO: 314282 - DNA, 75 bp, Artificial Sequence
  Synthetic
ctgagccagcggtggatcgcaagccacgccgacgcctccctcgacggcactggagaccccctcgaccccctgatg

SEQ ID NO: 314283 - DNA, 75 bp, Artificial Sequence
  Synthetic
ccctcgaggagggcgaggcgctgctcgagcgcgcctaccgcagcatcgtcgcgctagccgccgcgcgtcggtggg

SEQ ID NO: 314284 - DNA, 75 bp, Artificial Sequence
  Synthetic
ccgccggcgacccgggccgaccggctcagcgtggcgcgtcgcccccagcgacccccctcggggatgccaccgcac

SEQ ID NO: 314285 - DNA, 75 bp, Artificial Sequence
  Synthetic
ccgccggcgacccgggccgaccggctcagcgtggcgcgtcgcccccagcgtcccccctcggggatgccaccgcac

SEQ ID NO: 314286 - DNA, 75 bp, Artificial Sequence
  Synthetic
ccgccggcgacccgggccgaccggctcagcgtggcgcgtcgcccccagcgccccccctcggggatgccaccgcac

SEQ ID NO: 314287 - DNA, 75 bp, Artificial Sequence
  Synthetic
ccgccggcgacccgggccgaccggctcagcgtggcgcgtcgcccccagcggcccccctcggggatgccaccgcac

SEQ ID NO: 314288 - DNA, 75 bp, Artificial Sequence
  Synthetic
ctttacgtctgccccaccaatgcgctcctgcacgagatccaggccaaactccgcgcgcgcgacatcgacatcaag

SEQ ID NO: 314289 - DNA, 75 bp, Artificial Sequence
  Synthetic
ccgcgcgcgcgacatcgacatcaagaacgccgccacctacgagcgcgcgctgacgaaaccgctcgccgcctaccg

SEQ ID NO: 314290 - DNA, 75 bp, Artificial Sequence
  Synthetic
cgtggggcgtagtgctcgaggtgcgcgcgcgccctgaggggggcaaccccaccggccactttgtctgcgcggtcg

SEQ ID NO: 314291 - DNA, 75 bp, Artificial Sequence
  Synthetic
gcggcggcccacgccgcgtctcggaccgcccccatctctggctcgcggtccctctgtcccgaggcggcggcactt

SEQ ID NO: 314292 - DNA, 75 bp, Artificial Sequence
  Synthetic
ccggcgctgggcccacgcccggctacacccgcccctgcaccacgcgcatctaccaagtcctgccggacaccgccc

SEQ ID NO: 314293 - DNA, 75 bp, Artificial Sequence
  Synthetic
cgcctggcacctcgaccacgacgggggctgccccgccgactgccgcggcgccggcgctgggcccacgcccggcta

SEQ ID NO: 314294 - DNA, 75 bp, Artificial Sequence
  Synthetic
actgccgcacccccgtccctgaccgctggcccaccgagcgctcacgccacacttggcgcttccccgactgctggg

SEQ ID NO: 314295 - DNA, 75 bp, Artificial Sequence
  Synthetic
gtgccgcgaccgacgaggggctggcccaggcgtactacgacgacctcgaggtgcgccgcctcggggacgacgcca

SEQ ID NO: 314296 - DNA, 75 bp, Artificial Sequence
  Synthetic
tggcccgggcggccctcgcctccgtccaacgcccccgcaaaggcccctataacatcaaagtgtggaacatggccg

SEQ ID NO: 314297 - DNA, 75 bp, Artificial Sequence
  Synthetic
gaggtcaggcccccgcgaggcatgtgcgggagcgacatgtggcgctgccgcggctggcagggcatgccgcaggtg

SEQ ID NO: 314298 - DNA, 75 bp, Artificial Sequence
  Synthetic
ccaacgcccccgcaaaggcccctataacatcaaagtgtggaacatggccgcgggtgccggcaagaccacccgcat

SEQ ID NO: 314299 - DNA, 75 bp, Artificial Sequence
  Synthetic
aggacgggtcgaccctccgcactgctgtggcccgccagcacccgcgccctttccgccagatcccacccccgcgcg

SEQ ID NO: 314300 - DNA, 75 bp, Artificial Sequence
  Synthetic
cctcgctgccttcacgcgcgaggacctgtacgtctgtcccactaacgcgctcctgcatgagattcaggccaaact

SEQ ID NO: 314301 - DNA, 75 bp, Artificial Sequence
  Synthetic
ccgcgcccgcgacatagacatcaagaacgccgccacctacgagcgcgcgctgacgaaaccgctcgccgcctaccg

SEQ ID NO: 314302 - DNA, 75 bp, Artificial Sequence
  Synthetic
actctcggcggcgagtattgcgcctttgtcgccagccaaaccaccgcggaggtgatttgtgtcggcgatcgggac

SEQ ID NO: 314303 - DNA, 75 bp, Artificial Sequence
  Synthetic
agttcgacatgaaccagaccctcgctactcgggacgtcgagctcgagattagcgccgctctcttgggcctcccct

SEQ ID NO: 314304 - DNA, 75 bp, Artificial Sequence
  Synthetic
cggcccgcctgcgcgcggggctcgactacgacgtcgagggcgaacatgccggcacctttgcctgcaacctctggg

SEQ ID NO: 314305 - DNA, 75 bp, Artificial Sequence
  Synthetic
gaacaggacgccgcggtcgcggccttcgatcgcggcccccttgaggacggcgggcaccacctggccaccgtgcaa

SEQ ID NO: 314306 - DNA, 75 bp, Artificial Sequence
  Synthetic
cgcccacaattcctcgtggccgccgggcacacggagcccgaggttgacgcgtggtggcaggctcactacaccacc

SEQ ID NO: 314307 - DNA, 75 bp, Artificial Sequence
  Synthetic
cgggcaccacctggccaccgtgcaacccccgaagccgccgccccgccccgagatcgctgcaacgtggattgtcca

SEQ ID NO: 314308 - DNA, 75 bp, Artificial Sequence
  Synthetic
catacaccgtgcgcgaagcccagggtatgagcgtcggcactgcgtgcatccatgtcggccgggacggcacggacg

SEQ ID NO: 314309 - DNA, 75 bp, Artificial Sequence
  Synthetic
cgccgcgagcgcagaccgccactgtgcgtgcgccccccgctgcgacgtcccacgcgaacgcccttctgcgcctcc

SEQ ID NO: 314310 - DNA, 75 bp, Artificial Sequence
  Synthetic
tggccctggcgctgacacgcgatctcgccatcgtcagtctcacccgggcctccgacgccctctacctccacgagc

SEQ ID NO: 314311 - DNA, 75 bp, Artificial Sequence
  Synthetic
atcccgccgtggctgttcgccgagcaccgcgccctccgttgccgcgagtgggacttcgaggcccttcgtgcgcgc

SEQ ID NO: 314312 - DNA, 75 bp, Artificial Sequence
  Synthetic
ggggcactggcggagcttaaggaggtccccgccggcattgaccgcgtcgtcgccgtcgagcaggcgccgccacca

SEQ ID NO: 314313 - DNA, 75 bp, Artificial Sequence
  Synthetic
tccccgccggcattgaccgcgtcgtcgccgtcgagcaggcgccgccaccattgccgcctgccgacggcattcccg

SEQ ID NO: 314314 - DNA, 75 bp, Artificial Sequence
  Synthetic
aggcccaagatgtgccgcccttttgcccccgcacgcttgaggagcttgtcttcggccgtgccggccacccccact

SEQ ID NO: 314315 - DNA, 75 bp, Artificial Sequence
  Synthetic
ttgacgagcccggcgaggccgacgcggccctggtcttgtgtgacccactcggccagccgctccggggccccgagc

SEQ ID NO: 314316 - DNA, 75 bp, Artificial Sequence
  Synthetic
ggccagccgctccggggccccgagcgccatttcgctgccggtgcgcacatgtgcgcgcaggcgcgggggctccag

SEQ ID NO: 314317 - DNA, 75 bp, Artificial Sequence
  Synthetic
atgcggaccttaaccgcgtaaccgagggcgaacgagaagtgcggtacatgcgcatttcgcgccacctgctcaaca

SEQ ID NO: 314318 - DNA, 75 bp, Artificial Sequence
  Synthetic
gtgcgcgcaggcgcgggggctccaggcctttgtccgcgtcgtgcctccacccgagcgcccctgggctgacggggg

SEQ ID NO: 314319 - DNA, 75 bp, Artificial Sequence
  Synthetic
ttgccctggcgctgacacgcgaccttgccatcgtcagcctcacccgggcctccgacgcactctaccttcacgagc

SEQ ID NO: 314320 - DNA, 75 bp, Artificial Sequence
  Synthetic
cgcatttcgcgccacctgctcaacaagaaccacaccgagatgcccgggaccgaacgcgtcctcagtgctgtttgc

SEQ ID NO: 314321 - DNA, 75 bp, Artificial Sequence
  Synthetic
ctctgcactgcaccggggtgcgccactcaaacacctgtccccgtgcgcctcgctggcgtccgcttcgagtccaag

SEQ ID NO: 314322 - DNA, 75 bp, Artificial Sequence
  Synthetic
gcacgctggcccaacagggggccgccttggcactctcggtgcgcgacctgcccgggggcgcggcgttcgacgcca

SEQ ID NO: 314323 - DNA, 75 bp, Artificial Sequence
  Synthetic
cccgggggcgcggcgttcgacgccaacgcggtcaccgccgccgtgcgcgcgggctccagtcagcctgcgccggcc

SEQ ID NO: 314324 - DNA, 75 bp, Artificial Sequence
  Synthetic
acgcggtcaccgccgccgtgcgcgcgggctccagtcagcctgcgccggccgcaccccccccggacaattcctcgc

SEQ ID NO: 314325 - DNA, 75 bp, Artificial Sequence
  Synthetic
gcaccccccccggacaattcctcgcccccacgccgtgcacggcggtcgcggcgcctcccggacacccgcggctcg

SEQ ID NO: 314326 - DNA, 75 bp, Artificial Sequence
  Synthetic
tcatggctctggagcgagggcgagggcgccgtcttctaccgcgtcgacctgcatttcaccaacttgggcaccccc

SEQ ID NO: 314327 - DNA, 75 bp, Artificial Sequence
  Synthetic
cttcctcaaggccaccttgaagtgcgtagacgccgctctcggccctagggacaccgaagattgccacgccgccca

SEQ ID NO: 314328 - DNA, 75 bp, Artificial Sequence
  Synthetic
ccgccctccgcgcccgcccgcgacccgccgccgcccgcccccagcccgcccacgccaccccgcgtgcgcggcccg

SEQ ID NO: 314329 - DNA, 75 bp, Artificial Sequence
  Synthetic
cgccgccgcccgcccccagcccgcccacgccaccccgcgtgcgcggcccggccccagccactctgggggagccgg

SEQ ID NO: 314330 - DNA, 75 bp, Artificial Sequence
  Synthetic
ggggaaggccggcctcgagatccgggcatgggccaaagagtgggttcaggtcatgtccccgcacttccgcgccat

SEQ ID NO: 314331 - DNA, 75 bp, Artificial Sequence
  Synthetic
ccgctccccccccacactaccgagcgcatcgagacccgctcggcgcgccacccttggcgcatccgcttcggagcc

SEQ ID NO: 314332 - DNA, 75 bp, Artificial Sequence
  Synthetic
ggcacacggagcccgaggtcgacgcgtggtggcaggcccattacaccaccaacgccatcgaggtcgatttcaccg

SEQ ID NO: 314333 - DNA, 75 bp, Artificial Sequence
  Synthetic
aacgccatcgaggtcgatttcaccgagtttgatatgaaccagacccttgctacccgcgacgtggagctcgagatc

SEQ ID NO: 314334 - DNA, 75 bp, Artificial Sequence
  Synthetic
cgcgcgcgccgggcttcagccccgcgctgacatagcggcgcctactgcgccgccgcaggccccccgcgtgcacgg

SEQ ID NO: 314335 - DNA, 75 bp, Artificial Sequence
  Synthetic
tctttgccaacgctgccgcggccctcgccgaagactgccggcgcctcgccccatgccccaccggcgaggctgtgg

SEQ ID NO: 314336 - DNA, 75 bp, Artificial Sequence
  Synthetic
gaactgggttccactgagaccggctgcgagcgcaccagcggcgagcccgccacgctactacacaataccaccgtg

SEQ ID NO: 314337 - DNA, 75 bp, Artificial Sequence
  Synthetic
gaactgggtaccactgagaccggctgcgagcgcacaagcggcgagccagccacgctgctgcacaacaccaccgtg

SEQ ID NO: 314338 - DNA, 75 bp, Artificial Sequence
  Synthetic
gatcttccagggcgacgacatggtcatcttcctccccgaaggcgcacgcagcgcggcactcaagtggaccccctc

SEQ ID NO: 314339 - DNA, 75 bp, Artificial Sequence
  Synthetic
atcttcctccccgaaggcgcacgcagcgcggcactcaagtggaccccctccgaggtcggcctgtttggctcccac

SEQ ID NO: 314340 - DNA, 75 bp, Artificial Sequence
  Synthetic
cgtgtgttgcgtgccccctcctcggcgctggcgtctacggctggtctgccgcggagtcccttcgagccgcgctcg

SEQ ID NO: 314341 - DNA, 75 bp, Artificial Sequence
  Synthetic
actgcccgtgaccccaacgcctcccaccaccgcggcgaactccacgaccgccgccccctccgctactacgccggc

SEQ ID NO: 314342 - DNA, 75 bp, Artificial Sequence
  Synthetic
gcggagtcccttcgagccgcgctcgcggccacgcgcgccgagcccgccgagcgcgtgagcttgcatatatgccac

SEQ ID NO: 314343 - DNA, 75 bp, Artificial Sequence
  Synthetic
cgaacgcgcctaccgcagcatcgtcgcgctggccgccgcgcgcgggtgggcgtgtgttgcgtgccccctcctcgg

SEQ ID NO: 314344 - DNA, 75 bp, Artificial Sequence
  Synthetic
gacgtcatgcaccaggcaattaaggtgctttgccgccgcttcgaccccgacgtgcttgaagagcagcaggtagcc

SEQ ID NO: 314345 - DNA, 75 bp, Artificial Sequence
  Synthetic
ctcctcgaccgcctccggggggtctacgcggctctgcctgacaccgtcgccgccaatgctgcgtactacgactac

SEQ ID NO: 314346 - DNA, 75 bp, Artificial Sequence
  Synthetic
acgcggtcaccgccgccgtgcgcgctggccccggccagcccgcggccacgtcaccgccacccggcgaccccccgc

SEQ ID NO: 314347 - DNA, 75 bp, Artificial Sequence
  Synthetic
agcgcggagcgtgtcctcgcgattgtgcgtgaactcaccgcatacgcgcggggtcgcggcctcgaccacccggcc

SEQ ID NO: 314348 - DNA, 75 bp, Artificial Sequence
  Synthetic
aacgcgctgtcccttgaccatgcgctcgcggccgttgtcctgctggtcccgtgggttttgatactcatggtatgc

SEQ ID NO: 314349 - DNA, 75 bp, Artificial Sequence
  Synthetic
cgaactctgtcggtacacgcgcgtcaccaatgaccgcgcgtatgtcaacctctggctcgagcgcgaccgcggcgc

SEQ ID NO: 314350 - DNA, 75 bp, Artificial Sequence
  Synthetic
agactccctacgcgcgcgccaatctccacgacgctgactaatgcccccgcacgtagggcctttaatcttacttaa

SEQ ID NO: 314351 - DNA, 75 bp, Artificial Sequence
  Synthetic
accatcggcgcactcgaggagattcagactccctacgcgcgcgccaatctccacgacgctgactaatgcccccgc

SEQ ID NO: 314352 - DNA, 75 bp, Artificial Sequence
  Synthetic
tccaaccaggtcatcacccaccgttgtttcgccgcttccggtgggtactccacttttgccatttgggagagcccc

SEQ ID NO: 314353 - DNA, 75 bp, Artificial Sequence
  Synthetic
agggtgcccaaatggcttccaccacccccatcaccatggaggacctccagaaggccctcgaggcacaatcccgcg

SEQ ID NO: 314354 - DNA, 75 bp, Artificial Sequence
  Synthetic
cggctggcagggcatgccgcaggtgcggtgcaccccctccaatgctcacgccgccctgtgccgcacaggcgtgcc

SEQ ID NO: 314355 - DNA, 75 bp, Artificial Sequence
  Synthetic
cccggaagagcggcaagaaggtcgctcccagactccggccccgaagccatcgcgggcaccgacacaacagcctca

SEQ ID NO: 314356 - DNA, 75 bp, Artificial Sequence
  Synthetic
ctcgtccggcgggtacgcgcagctggcatcctatttcaaccctggcgggagctactacaagcaataccaccccac

SEQ ID NO: 314357 - DNA, 75 bp, Artificial Sequence
  Synthetic
ccctcgagtgagcacgcgaggcgatgagcgagaccctaacacctgctggctccgcgccgccgccaacgtcgcgca

SEQ ID NO: 314358 - DNA, 75 bp, Artificial Sequence
  Synthetic
gagcgagaccctaacacctgctggctccgcgccgccgccaacgtcgcgcaggccgcgcgcgcctgcggcgcctac

SEQ ID NO: 314359 - DNA, 75 bp, Artificial Sequence
  Synthetic
ctccggagggccccgccgccgccgcggcaaccggggccgtggccagcgcaaagactggtccaaggcccccccccc

SEQ ID NO: 314360 - DNA, 75 bp, Artificial Sequence
  Synthetic
gcatcctatttcaaccctggcgggagctactacaagcaataccaccccaccgcgtgcgacgtcgaacctgccttc

SEQ ID NO: 314361 - DNA, 75 bp, Artificial Sequence
  Synthetic
gcgcatgacgtacttgcgggagcggatcgacctcactgatgtctacacgcagatgggcgtggccgcgcgggagct

SEQ ID NO: 314362 - DNA, 75 bp, Artificial Sequence
  Synthetic
acgagtgccgggtgcccccggtgcgcctacggccgcgctctcagcgaagcccgcacccacgaggacttcgccgcc

SEQ ID NO: 314363 - DNA, 75 bp, Artificial Sequence
  Synthetic
ccgcacccacgaggacttcgccgccctgagccagcggtggagcgcaagccacgctgacgcctcccctgacggcac

SEQ ID NO: 314364 - DNA, 75 bp, Artificial Sequence
  Synthetic
cccggaagagcggcaggagagccgctcccagactccggtcccgaagccgccgcgggcgccgccacagccgcccca

SEQ ID NO: 314365 - DNA, 75 bp, Artificial Sequence
  Synthetic
cgcgggcgccgccacagccgccccaacccccgcgtatgcaaaccgggcgcgggggcactgccccgcgccctgagc

SEQ ID NO: 314366 - DNA, 75 bp, Artificial Sequence
  Synthetic
cggggaccccctcgaccccctgatggagaccgtgggctgcgcctgttcgcgcgtatgggtcggctccgagcacga

SEQ ID NO: 314367 - DNA, 75 bp, Artificial Sequence
  Synthetic
gagaccgtgggctgcgcctgttcgcgcgtatgggtcggctccgagcacgaggccccgcccgaccacctcctggtg

SEQ ID NO: 314368 - DNA, 75 bp, Artificial Sequence
  Synthetic
tggggccgccgaccaaccccttccaggctgccgtggcgcgtggcttgcgcccgcccctccatgaccctgacaccg

SEQ ID NO: 314369 - DNA, 75 bp, Artificial Sequence
  Synthetic
cccatcaccatggaggacctccagaaggccctcgaggcacaatcccgcgccctgcgcgcggaactcgccgccggc

SEQ ID NO: 314370 - DNA, 75 bp, Artificial Sequence
  Synthetic
tccctccaccgtgcgcccaacggcccgtggggcgtggtgctcgaagtgcgcgcgcgccccgaggggggtaacccc

SEQ ID NO: 314371 - DNA, 75 bp, Artificial Sequence
  Synthetic
cctgcgcgcggaactcgccgccggcgcctcgcagtcgcgccggccgcggccgccgcgacagcgcgactccagcac

SEQ ID NO: 314372 - DNA, 75 bp, Artificial Sequence
  Synthetic
aggcgcccaccgaggcctgtgtgacctcatggctctggagcgagggcgaaggcgccgtcttctaccgcgtcgacc

SEQ ID NO: 314373 - DNA, 75 bp, Artificial Sequence
  Synthetic
accggccactttgtttgtgcggtcggcggcggcccacgccgcgtttcggaccgcccccacctctggctcgcggtc

SEQ ID NO: 314374 - DNA, 75 bp, Artificial Sequence
  Synthetic
tgcacttcaccaacctgggcacccgcccacttgatgaggacggccgctgggaccctgcgctcatgtacaatcctt

SEQ ID NO: 314375 - DNA, 75 bp, Artificial Sequence
  Synthetic
ccgcccccacctctggctcgcggtcccactctcccggggcggaggcacttgcgccgcgaccgacgaggggctggc

SEQ ID NO: 314376 - DNA, 75 bp, Artificial Sequence
  Synthetic
gcaaccggggccgtggccagcgcagggactggtccagggccccgccccccccggaagagcggcaagaaagtcgct

SEQ ID NO: 314377 - DNA, 75 bp, Artificial Sequence
  Synthetic
gcgggcctgagccgcctgctcacgttgtccgcgcgtacaatcaacccgccggcgacgtcaggggtatctggggta

SEQ ID NO: 314378 - DNA, 75 bp, Artificial Sequence
  Synthetic
tccccaggcgttccttgccgggctcttgctcgccgcggtcgccgttggcaccgcgcgcgccgggctccagccccg

SEQ ID NO: 314379 - DNA, 75 bp, Artificial Sequence
  Synthetic
ttgctcgccgcggtcgccgttggcaccgcgcgcgccgggctccagccccgcgctgacatggcggcacctcctacg

SEQ ID NO: 314380 - DNA, 75 bp, Artificial Sequence
  Synthetic
tggctcgggcggccctcgccgcggtccaacgcccccgcaagggcccctacaacattatggtatggaacatggccg

SEQ ID NO: 314381 - DNA, 75 bp, Artificial Sequence
  Synthetic
tgcgcggccttgacggcgacagcgccccgctccccccccacactaccgagcgtatcgagacccgctcggcgcgcc

SEQ ID NO: 314382 - DNA, 75 bp, Artificial Sequence
  Synthetic
agggaactgccatcttaccgtcaacggcgaggacgtcggcgccttcccccctgggaagttcgtcaccgccgccct

SEQ ID NO: 314383 - DNA, 75 bp, Artificial Sequence
  Synthetic
caggcgccggcaagaccactcgcatcctcgccgccttcacgcgcgaagacctgtacgtctgccccaccaacgcgc

SEQ ID NO: 314384 - DNA, 75 bp, Artificial Sequence
  Synthetic
gcagccgtggcgcgtggcctgcgcccgcctctccacgaccctgacaccgaggcacccaccgaggcctgcgtgacc

SEQ ID NO: 314385 - DNA, 75 bp, Artificial Sequence
  Synthetic
ggggctctgccccgcgccccgagctggggccaccgaccaacccgttccaagcagccgtggcgcgtggcctgcgcc

SEQ ID NO: 314386 - DNA, 75 bp, Artificial Sequence
  Synthetic
ctgtacgtctgccccaccaacgcgctcctgcacgagatccaggccaaactccgcgcgcgcgacatcgacatcaag

SEQ ID NO: 314387 - DNA, 75 bp, Artificial Sequence
  Synthetic
acccttggcgcattcgcttcggtgccccccaggtcttccttgccgggctcctgcttgcggctgtcgccgtcggca

SEQ ID NO: 314388 - DNA, 75 bp, Artificial Sequence
  Synthetic
ctgcttgcggctgtcgccgtcggcaccgcgcgggctggcctccagccccgcaccgacattgcggcaccccctgcg

SEQ ID NO: 314389 - DNA, 75 bp, Artificial Sequence
  Synthetic
ccgccgcaggcccctcgcgcgcacgggaagcattacggccaccaccaccatcagctgccgttccttgggcacgac

SEQ ID NO: 314390 - DNA, 75 bp, Artificial Sequence
  Synthetic
cgggcccgagccgcccgctcacgtcgtccgcgcgtacaatcaacctgccggcgacgtcaggggcgtttggggtaa

SEQ ID NO: 314391 - DNA, 75 bp, Artificial Sequence
  Synthetic
ggccaccacggcggcaccctgcgcgtcggccagcaccatcgaaacgccagcgacgtgctgcccggccactggctc

SEQ ID NO: 314392 - DNA, 75 bp, Artificial Sequence
  Synthetic
cgacgtgctgcccggccactggctccaaggcagctggggttgctacaacctgagcgactggcaccaaggcactca

SEQ ID NO: 314393 - DNA, 75 bp, Artificial Sequence
  Synthetic
acctggcgcttccccgattgctgggcggctcgtttgcgcgcggggctcgactatgatgtcgagggcgagcccgcc

SEQ ID NO: 314394 - DNA, 75 bp, Artificial Sequence
  Synthetic
cgtctgtcacaccaagcacatggacttctggtgcgtggagcacgaccgaccgccgcccgtgacccccacgccgct

SEQ ID NO: 314395 - DNA, 75 bp, Artificial Sequence
  Synthetic
ccccaggccttccttgccgggctcttgctcgccgcggtcgccgttggcaccgcgcgcgccgggctccagccccgc

SEQ ID NO: 314396 - DNA, 75 bp, Artificial Sequence
  Synthetic
cgccgcccgtgacccccacgccgctcaccaccgccgcgaactccacgaccgccgccacccctgccaccacgccgg

SEQ ID NO: 314397 - DNA, 75 bp, Artificial Sequence
  Synthetic
acggccgccaggtcgaccttcacctcgccttctcgcgcgagaccgtgcgccgccttcacgaggccggcatacgcg

SEQ ID NO: 314398 - DNA, 75 bp, Artificial Sequence
  Synthetic
ccccctgccacgccggccttaatgacagctgcggcggcttcctgtccgggtgtgggccgatgcgcctgcgccacg

SEQ ID NO: 314399 - DNA, 75 bp, Artificial Sequence
  Synthetic
tgctcgccgcggtcgccgttggcaccgcgcgcgccgggctccagccccgcgctgatatggcggcacctcctacgc

SEQ ID NO: 314400 - DNA, 75 bp, Artificial Sequence
  Synthetic
cgccttctcgcgcgagaccgtgcgccgccttcacgaggccggcatacgcgcatacaccgtgcgcgaggcccaggg

SEQ ID NO: 314401 - DNA, 75 bp, Artificial Sequence
  Synthetic
cagctgccgttcctcgggcacgacggccatcatggcggcaccttgcgcgtcggccagcatcaccgaaacgccagc

SEQ ID NO: 314402 - DNA, 75 bp, Artificial Sequence
  Synthetic
gcgccgatacccggtgcggtcggttgatctgcgggctgtccaccaccgcccagtacccacccacccgattcggct

SEQ ID NO: 314403 - DNA, 75 bp, Artificial Sequence
  Synthetic
cgccatcgtcagcctgacccgggcctccgacgccctctacctccacgagctcgaggacggctcactgcgcgctgc

SEQ ID NO: 314404 - DNA, 75 bp, Artificial Sequence
  Synthetic
gtactatgcggtggggcctccctccttgggaactggtcgtccttacggcccgccccgaggacggctggacttgcc

SEQ ID NO: 314405 - DNA, 75 bp, Artificial Sequence
  Synthetic
gagcgactggcaccagggcactcatgtctgtcacaccaagcacatggacttctggtgtgtggagcacgaccgacc

SEQ ID NO: 314406 - DNA, 75 bp, Artificial Sequence
  Synthetic
gcggcgtacccgctcacccaggtacccgttgcccagaactggtgagccctatggggcacgcgacttgctccccag

SEQ ID NO: 314407 - DNA, 75 bp, Artificial Sequence
  Synthetic
tgccgtcgagcaggcgccgccaccattaccgcccgccgacggtatccccgaggcccaggacgtgccgcccttctg

SEQ ID NO: 314408 - DNA, 75 bp, Artificial Sequence
  Synthetic
cttctgctctctggctcgctacagcgaacgcgctgtctcttgaccacgcgctcgcggccgtcgtcctgttggtcc

SEQ ID NO: 314409 - DNA, 75 bp, Artificial Sequence
  Synthetic
aggcccaggacgtgccgcccttctgcccccgcaccttggaggagctcgtcttcggccgcgccggccacccccatt

SEQ ID NO: 314410 - DNA, 75 bp, Artificial Sequence
  Synthetic
cgtgggtcttgatattcatgttgtgccgccgcgcctgccgccgccgcggcgccgccgccgccctcacagcggtgg

SEQ ID NO: 314411 - DNA, 75 bp, Artificial Sequence
  Synthetic
gggcgagcgagaagtgcggtacatgcgcatctcgcgtcacctgctcaacaagaaccacactgagatgcccgggac

SEQ ID NO: 314412 - DNA, 75 bp, Artificial Sequence
  Synthetic
ttctccaggggtacaacccccccgcctacggcgaggaggctttcacctacctctgcactgcgccggggtgcgcca

SEQ ID NO: 314413 - DNA, 75 bp, Artificial Sequence
  Synthetic
tgggaactggtcgtccttaccgcccgccccgaagacggctggacttgccgcggcgtgcccgcccatccaggcacc

SEQ ID NO: 314414 - DNA, 75 bp, Artificial Sequence
  Synthetic
ggaacgcgtcctcagcgctgtatgcgctgtgcggcgctaccgcgcgggtgaggacgggtcgaccctccgcaccgc

SEQ ID NO: 314415 - DNA, 75 bp, Artificial Sequence
  Synthetic
gctgtgcggcgctaccgcgcgggtgaggacgggtcgaccctccgcaccgccgtggcccgccagcacccgcgccct

SEQ ID NO: 314416 - DNA, 75 bp, Artificial Sequence
  Synthetic
ttccgccagatcccacccccgcgcgtcactgctggagtcgctcaagagtggcgcctcacgtacctgcgggagcga

SEQ ID NO: 314417 - DNA, 75 bp, Artificial Sequence
  Synthetic
tcactgctggagtcgctcaagagtggcgcctcacgtacctgcgggagcgaatcgacctcactgacgtctatacac

SEQ ID NO: 314418 - DNA, 75 bp, Artificial Sequence
  Synthetic
catctggaacggtacgcagcgcgcgtgcaccttctgggctgttaacgcctactcctccggcgggtacgcgcagct

SEQ ID NO: 314419 - DNA, 75 bp, Artificial Sequence
  Synthetic
tgcaccttctgggctgttaacgcctactcctccggcgggtacgcgcagctggcgtcctatttcaatcccggcggc

SEQ ID NO: 314420 - DNA, 75 bp, Artificial Sequence
  Synthetic
tctcaggcgcgcaagtgcggactccacatacgcgctggaccgtacggccatgccaccgtcgaaatgcccgagtgg

SEQ ID NO: 314421 - DNA, 75 bp, Artificial Sequence
  Synthetic
cccgagattttcgccggcatgtgcaccgcgcagagcctgagcgtccccgccttcctcaaagccaccttgaagtgc

SEQ ID NO: 314422 - DNA, 75 bp, Artificial Sequence
  Synthetic
actcctccggcgggtacgcgcagctggcgtcctatttcaatcccggcggcagctattataagcaataccacccca

SEQ ID NO: 314423 - DNA, 75 bp, Artificial Sequence
  Synthetic
agctattataagcaataccaccccaccgcgtgcgacgtcgagcctgccttcgggcatagcgacgcagcctgctgg

SEQ ID NO: 314424 - DNA, 75 bp, Artificial Sequence
  Synthetic
gcctgcgccccccgctgcgacgtcccacgcgaacgtccttccgcgcctgcgggcccgccagatgacgaggcgctg

SEQ ID NO: 314425 - DNA, 75 bp, Artificial Sequence
  Synthetic
ggcttccccaccgacaccgtgatgagcgtgttcgccctcgccagttacgttcagcaccccgacaagaccgtcagg

SEQ ID NO: 314426 - DNA, 75 bp, Artificial Sequence
  Synthetic
tcagcaccccgacaagaccgtcagggtcaaattccacacggaaaccaggaccgtgtggcaactctccgtagctgg

SEQ ID NO: 314427 - DNA, 75 bp, Artificial Sequence
  Synthetic
tcatgtccccgcactttcgcgcaatccagaagatcattatgcgcgccttgcgcccacaattcctcgtggccgccg

SEQ ID NO: 314428 - DNA, 75 bp, Artificial Sequence
  Synthetic
gcccatcacggcccgtggctcacccttgatgagccgggcgaggccgatgcggccctcgtcttgtgcgacccactc

SEQ ID NO: 314429 - DNA, 75 bp, Artificial Sequence
  Synthetic
gacaactcgaggtccaggtcccgcctgaccctggggatctagtcgagtatatcatgaactacaccggcaaccaac

SEQ ID NO: 314430 - DNA, 75 bp, Artificial Sequence
  Synthetic
caatggaagctaacggacctcgcttaggactcctattcccatggagaaactcctggatgaggttcttgcccccgg

SEQ ID NO: 314431 - DNA, 75 bp, Artificial Sequence
  Synthetic
agttcgacatgaatcagacccttgccactcgggacgtcgagctcgagatcagtgccgctctcctgggcctcccct

SEQ ID NO: 314432 - DNA, 75 bp, Artificial Sequence
  Synthetic
agtcccggtggggcctcgggagcccgaactgtcacggccccgattgggcctccccggtttgccagcgccactccc

SEQ ID NO: 314433 - DNA, 75 bp, Artificial Sequence
  Synthetic
cccggaccttgtccacctcgccgaggtgggccggtggcggtggttcagcctcccccgcccagtttttcagcgtat

SEQ ID NO: 314434 - DNA, 75 bp, Artificial Sequence
  Synthetic
ccgactgttcgcggctcgtgggggccacgccagagcgcccccggctgcgcctcgtcgatgctgacgacccccttc

SEQ ID NO: 314435 - DNA, 75 bp, Artificial Sequence
  Synthetic
gaccccggggacctggttgagtacatcatgaattacaccggcaatcagcagtcccggtggggcctcgggagcccg

SEQ ID NO: 314436 - DNA, 75 bp, Artificial Sequence
  Synthetic
gcgcggcactcaagtggaccccctctgaggtcggcttgttcggcttccacatcccagtgaagcacgtgagcaccc

SEQ ID NO: 314437 - DNA, 75 bp, Artificial Sequence
  Synthetic
cctggcacccgccgggccccctgggactgaagttcaagacggtccgccccgtggccttgccacgcgcgttagcgc

SEQ ID NO: 314438 - DNA, 75 bp, Artificial Sequence
  Synthetic
cgccgccgcttccccccagcccgcccgcgccacgccgcgcgggcgacccggcctctcctatttcggccgagccgg

SEQ ID NO: 314439 - DNA, 75 bp, Artificial Sequence
  Synthetic
cagatcgcgcgcgtgacgccgagccggaggttgcctgcgaaccgggcggccccgccacgccaaccagggcggacc

SEQ ID NO: 314440 - DNA, 75 bp, Artificial Sequence
  Synthetic
ctcctcgcaacgtgcgtgtaaccggctgctaccagtgcggcactcccgcgctggtggaaggcctcgccccagggg

SEQ ID NO: 314441 - DNA, 75 bp, Artificial Sequence
  Synthetic
ctgctaccagtgcggcactcccgcgctggtggaaggcctcgccccagggggcggcaattgccacctcaccgttaa

SEQ ID NO: 314442 - DNA, 75 bp, Artificial Sequence
  Synthetic
cagacagcgacattgtcgaaagctacgcccgcgccgccggacctgtgcacctccgagtgcgcaacattatggacc

SEQ ID NO: 314443 - DNA, 75 bp, Artificial Sequence
  Synthetic
tgtgctcgaggaacagcaggtagccctccttgaccgcctccggggagtctacgcggccctgcccgacaccgttgc

SEQ ID NO: 314444 - DNA, 75 bp, Artificial Sequence
  Synthetic
tccacgcccacaccaccagcgacccctggcacccaccgggccccttggggctgaagttcaagacagttcgcccgg

SEQ ID NO: 314445 - DNA, 75 bp, Artificial Sequence
  Synthetic
cctgggaagttcgtcaccgccgccctcctcaacactccaccgccctaccaagtgagttgcgggggtgagagcgat

SEQ ID NO: 314446 - DNA, 75 bp, Artificial Sequence
  Synthetic
ctccccccggctgcaaggtcgtggtcaacgccgccaacgaggggctgctggccggttctggcgtctgtggcgcca

SEQ ID NO: 314447 - DNA, 75 bp, Artificial Sequence
  Synthetic
accccgcaatgtgcgtgtgaccgggtgctaccagtgcggtacccccgcgctggtggaaggccttgcccccggggg

SEQ ID NO: 314448 - DNA, 75 bp, Artificial Sequence
  Synthetic
ctgaagttcaagacagttcgcccggtggccctgccacgcgcgttagcgccaccccgcaatgtgcgtgtgaccggg

SEQ ID NO: 314449 - DNA, 75 bp, Artificial Sequence
  Synthetic
ggggcgcggccttgatcatccggccaccattggcgcgcttgaggaaattcagaccccctacgcgcgcgccaacct

SEQ ID NO: 314450 - DNA, 75 bp, Artificial Sequence
  Synthetic
agtgagttgcgggggtgagagcgatcgcgcgagcgcacgggtcattgaccccgccgcgcagtcatttaccggcgt

SEQ ID NO: 314451 - DNA, 75 bp, Artificial Sequence
  Synthetic
tggcgaggacgtcggcgccttcccccctgggaagttcgtcaccgccgccctcctcaacactccaccgccctacca

SEQ ID NO: 314452 - DNA, 75 bp, Artificial Sequence
  Synthetic
tacgcacatcatccacgcagtcgcgcctcggcgccctcaggaccccgccgccctcgagcagagcgaagccctgct

SEQ ID NO: 314453 - DNA, 75 bp, Artificial Sequence
  Synthetic
gcagctcactttgggcgccatctgcgccctcctacttgctggcctactcgcttgctgtgccaaatgcttatacca

SEQ ID NO: 314454 - DNA, 75 bp, Artificial Sequence
  Synthetic
caacgccgccaacgaggggctgctggccggttctggcgtctgtggcgccatctttgccagcgctgccgcgaccct

SEQ ID NO: 314455 - DNA, 75 bp, Artificial Sequence
  Synthetic
agaccccctacgcgcgcgccaacctccacgacgctgactaatgcccctgcacgtagggcctttaatcttactact

SEQ ID NO: 314456 - DNA, 75 bp, Artificial Sequence
  Synthetic
gccctcctacttgctggcctactcgcttgctgtgccaaatgcttataccacctgcgcggcgccatagcgccgcgc

SEQ ID NO: 314457 - DNA, 75 bp, Artificial Sequence
  Synthetic
tgggcccccgcgcgaaacccgcactagcccactagatccctgcacccgttgctgcatacaaaaaaaaaaaaaaaa

SEQ ID NO: 314458 - DNA, 75 bp, Artificial Sequence
  Synthetic
cccatcactatggaggacctccagaaggccctcgaggcacaatcccgcgccctccgcgcggaactcgccgccggc

SEQ ID NO: 314459 - DNA, 75 bp, Artificial Sequence
  Synthetic
ctccggagacgactctggccgcgactcaggagggcctcgccgccgccgcggcaaccggggccgcggccagcgcca

SEQ ID NO: 314460 - DNA, 75 bp, Artificial Sequence
  Synthetic
agactggtccaaggccccgcccccccccgaagagcggcaggagagccgctcccagactccggcccctaagccgcc

SEQ ID NO: 314461 - DNA, 75 bp, Artificial Sequence
  Synthetic
ccgagtcacgcggatgccaggggtgcgagctctgccggtacacgcgcgtcaccaacgaccgcgcgtacgtcaacc

SEQ ID NO: 314462 - DNA, 75 bp, Artificial Sequence
  Synthetic
gcgggcgccgccacaggtgccccaacccccgcgcatgcagaccgggcgcggaggcactgccccgcgccccgagct

SEQ ID NO: 314463 - DNA, 75 bp, Artificial Sequence
  Synthetic
gcggccgtggcgcgtggcctgcgcccgcccctccatgaccccgacaccgaggcacccactgaggcctgtgtgacc

SEQ ID NO: 314464 - DNA, 75 bp, Artificial Sequence
  Synthetic
ggttgccccgccgactgccgcggagccggcgctgggcccacgcccggctacacccgcccctgcaccacacgcatc

SEQ ID NO: 314465 - DNA, 75 bp, Artificial Sequence
  Synthetic
atcccgggcgcctctaccggtgcgggccccgcctgtggacgcgcgattgcgccgtggccgaactctcatgggagg

SEQ ID NO: 314466 - DNA, 75 bp, Artificial Sequence
  Synthetic
cgggcgccacctggacaccgtgcaacctccaaagccgccgccccgccctgagatcgccgcgacctggatcgtcca

SEQ ID NO: 314467 - DNA, 75 bp, Artificial Sequence
  Synthetic
gcatcgagacccgctcggcgcgccatccttggcgcatccgcttcagtgcccctcaggtcttcctcgccgggctct

SEQ ID NO: 314468 - DNA, 75 bp, Artificial Sequence
  Synthetic
cagtctaacgccaggttggcggggatcatgaaaaacgcaaagcgttgcgcggccgactctttgagcgtggccggc

SEQ ID NO: 314469 - DNA, 75 bp, Artificial Sequence
  Synthetic
cgcgcgcgccgggcttcagccccgcgccgacttggcggcgccccctgcgccgccgcaggtcccccgcgcgcacgg

SEQ ID NO: 314470 - DNA, 75 bp, Artificial Sequence
  Synthetic
aaggcgggtggggttgttacaacctgagcgattggcaccagggcactcacgtctgccacaccaggcacatggact

SEQ ID NO: 314471 - DNA, 75 bp, Artificial Sequence
  Synthetic
gcgtgcgctccccgctgcgacgtcccgcgcgaacgtccctccgcgcccgccggcccgccggacgacgaggcgctc

SEQ ID NO: 314472 - DNA, 75 bp, Artificial Sequence
  Synthetic
tctggtgcgtggagcacgatcggccgctgcccgtgaccccgacgcctcccaccaccgcggcgaactccacgaccg

SEQ ID NO: 314473 - DNA, 75 bp, Artificial Sequence
  Synthetic
gctgcccgtgaccccgacgcctcccaccaccgcggcgaactccacgaccgccgcggcccccgctactacgccggc

SEQ ID NO: 314474 - DNA, 75 bp, Artificial Sequence
  Synthetic
acttggcgcttccccgactgctgggcggcccgcctgcgcgcggggcttgactatgacgtcgagggcgaacatgcc

SEQ ID NO: 314475 - DNA, 75 bp, Artificial Sequence
  Synthetic
accctgtcacgccggcctcaatgacagctgcggcggcttcctgtccgggtgcgggccgatgcgactgcgccatgg

SEQ ID NO: 314476 - DNA, 75 bp, Artificial Sequence
  Synthetic
ccacagctgatcgcgctggccttgcgcaccctggcccagcagggggccgccttggcactctcggtgcgagacctg

SEQ ID NO: 314477 - DNA, 75 bp, Artificial Sequence
  Synthetic
ggatttcgaggctctccgcgcgcgtgccgatgcggcggccgcgcccgccccgttggctccacgcccagcgcggta

SEQ ID NO: 314478 - DNA, 75 bp, Artificial Sequence
  Synthetic
cgcggacacccggtgcggtcggttaatctgcgggctgtccaccaccgcccagtacccgcccacccgattcggctg

SEQ ID NO: 314479 - DNA, 75 bp, Artificial Sequence
  Synthetic
cccgggggtgcagcgttcgacgcgaatgcggtcaccgccgcagtgcgcgccggccccggccagtccgcggccacg

SEQ ID NO: 314480 - DNA, 75 bp, Artificial Sequence
  Synthetic
ccccaccgtgctctaccgccaccccgcccatcacggtccgtggctcacccttgacgagcctggcgaggctgacgc

SEQ ID NO: 314481 - DNA, 75 bp, Artificial Sequence
  Synthetic
cgccatgcggtggggccttcccccttgggaactggtcgtccttacggcccgccccgaggacggctggacttgccg

SEQ ID NO: 314482 - DNA, 75 bp, Artificial Sequence
  Synthetic
cggcgtgcccgcccacccaggcacccgctgcccagaactggtgagccccatggggcgcgcgacctgctccccagc

SEQ ID NO: 314483 - DNA, 75 bp, Artificial Sequence
  Synthetic
tcatgaaaggcgccaagcgctgcgccgccgactctttgagcgtggccggctggctggacaccatttgggacgcca

SEQ ID NO: 314484 - DNA, 75 bp, Artificial Sequence
  Synthetic
cgccgccgcccgcccccagcccgcccgcgccaccccgcgcgggtgacctggcccctcccattcttgcggggccgg

SEQ ID NO: 314485 - DNA, 75 bp, Artificial Sequence
  Synthetic
gcccctcccattcttgcggggccggcggatcgcgcgcgtgacgctgagctggaggtcgcctgcgaactgagcggc

SEQ ID NO: 314486 - DNA, 75 bp, Artificial Sequence
  Synthetic
ttcggccctctggctcgccacagccaacgcgctgtcccttgaccatgcgctcgcggccgttgtcctgctggtccc

SEQ ID NO: 314487 - DNA, 75 bp, Artificial Sequence
  Synthetic
cttggcactctcggtgcgtgacctgcccgggggtgtagcgttcgacgcaagcgcggtcaccgccgccgtgcgcgc

SEQ ID NO: 314488 - DNA, 75 bp, Artificial Sequence
  Synthetic
gcgcggtcaccgccgccgtgcgcgctggctccggccagcccgccaccacgcctccgccacccggcgacccctcgc

SEQ ID NO: 314489 - DNA, 75 bp, Artificial Sequence
  Synthetic
tccccgccggcattgaccgcgtcgtcgccgtcgaacaggcgccgccaccattgccgcccgccgatggcatccccg

SEQ ID NO: 314490 - DNA, 75 bp, Artificial Sequence
  Synthetic
cctccgccacccggcgacccctcgccgccgcgccgcgcgcggcgatcgcaacggctcacggacgcccgcggtccc

SEQ ID NO: 314491 - DNA, 75 bp, Artificial Sequence
  Synthetic
ctccgggtccgtgacatcatggacccaccgcccgggtgcaaggtcgtggtcaacgccgccaacgaggggctgctg

SEQ ID NO: 314492 - DNA, 75 bp, Artificial Sequence
  Synthetic
cgcgccaccccgcgcgggtgaccccgcccctcccccctccgcggggccggcggatcgcgcgcgtgacgcggagct

SEQ ID NO: 314493 - DNA, 75 bp, Artificial Sequence
  Synthetic
tgcatctgcgagatccccaccgatgtctcgtgcgagggcttgggggcctgggtacccgcagccccgtgcgcgcgc

SEQ ID NO: 314494 - DNA, 75 bp, Artificial Sequence
  Synthetic
tctcgtgcgagggcttgggggcctgggtacccgcagccccgtgcgcgcgcatctggaacggcacgcagcgcgcat

SEQ ID NO: 314495 - DNA, 75 bp, Artificial Sequence
  Synthetic
ggtacccgcagccccgtgcgcgcgcatctggaacggcacgcagcgcgcatgcaccttctgggctgtcaacgccta

SEQ ID NO: 314496 - DNA, 75 bp, Artificial Sequence
  Synthetic
tcactgccggagtcgctcaggagtggcgcatgacgtacctgcgggagcggatcgaccttactgatgtctacacgc

SEQ ID NO: 314497 - DNA, 75 bp, Artificial Sequence
  Synthetic
cagacagcgacatcgttgaaagctacgcccgcgccgccggacccgtgcaccttcgggtgcgcgacatcatggatc

SEQ ID NO: 314498 - DNA, 75 bp, Artificial Sequence
  Synthetic
caccgcccggctgcaaggtcgtggtcaacgccgccaacgaggggctgctggccggctccggcgtgtgcggtgcga

SEQ ID NO: 314499 - DNA, 75 bp, Artificial Sequence
  Synthetic
gcgctagccgctgcgcgtaggtggacgtgtgttgcgtgtcccctcctcggcgctggtgtctacggctggtctgct

SEQ ID NO: 314500 - DNA, 75 bp, Artificial Sequence
  Synthetic
cctgaccgcgccacgctgacgcacgcctccgtgctcgttggcgcggggctcgccgccaggcgcgtcagcccccct

SEQ ID NO: 314501 - DNA, 75 bp, Artificial Sequence
  Synthetic
cgcgtgcgacgttgaacctgcctttggacacagcgacgcggcctgctggggcttccccaccgacaccgtgatgag

SEQ ID NO: 314502 - DNA, 75 bp, Artificial Sequence
  Synthetic
cttcctcaaggccaccttgaagtgcgtggacgccgccctcggccctagagacaccgaagactgccacgccgccca

SEQ ID NO: 314503 - DNA, 75 bp, Artificial Sequence
  Synthetic
ccagccgagcccctcgcatcttgccccgccggtgacccgagccggccggctcagcgcagtgcgtcgcccccagcg

SEQ ID NO: 314504 - DNA, 75 bp, Artificial Sequence
  Synthetic
caacgccgccaacgaggggctgctggccggctccggcgtgtgcggtgcgatctttgcccgcgccacggcggccct

SEQ ID NO: 314505 - DNA, 75 bp, Artificial Sequence
  Synthetic
cgcccacatcatccacgccgtcgcgccgcggcgtcctcgggaccctgccgccctcgaggagggtgaagcgctgct

SEQ ID NO: 314506 - DNA, 75 bp, Artificial Sequence
  Synthetic
ccctcgaggagggtgaagcgctgctcgagcgcgcctatcgcagcatcgtcgcgctggctgccgcgcgccgctggg

SEQ ID NO: 314507 - DNA, 75 bp, Artificial Sequence
  Synthetic
cgtgcgtcgcgtgccccctccttggtgctggcgtctacggctggtccgctgcggagtccctccgagccgcgctcg

SEQ ID NO: 314508 - DNA, 75 bp, Artificial Sequence
  Synthetic
aacgccatcgaggtcgatttcaccgagttcgacatgaaccagaccctcgccacccgtgacgtggagctcgagatc

SEQ ID NO: 314509 - DNA, 75 bp, Artificial Sequence
  Synthetic
gtcccggtggggcctcgggagcccgaactgccacggccccgactgggcctccccggtttgccagcgccactctcc

SEQ ID NO: 314510 - DNA, 75 bp, Artificial Sequence
  Synthetic
cgctgccagacgcgtcagccctcctccgaccgaacccctcgcatcccgccccgccggtgacccggaccgaccggc

SEQ ID NO: 314511 - DNA, 75 bp, Artificial Sequence
  Synthetic
cgaactctgccggtacacgcgcgtcaccaatgaccgcgcctatgtcaacctgtggctcgagcgcgaccgcggtgc

SEQ ID NO: 314512 - DNA, 75 bp, Artificial Sequence
  Synthetic
atcttcctccccgaaggcgcacgcagcgcggcactcaagtggaccccctccgaggtcggcctgttcggctttcac

SEQ ID NO: 314513 - DNA, 75 bp, Artificial Sequence
  Synthetic
ctggcacccgcccggccccttgggactcaagttcaagacagtccgcccggtggtcctaccacgcgcgttagcgcc

SEQ ID NO: 314514 - DNA, 75 bp, Artificial Sequence
  Synthetic
ccctcgcaacgtgcgcgtaactggctgctaccagtgcggtacccccgcgctggtggagggccttgccccaggagg

SEQ ID NO: 314515 - DNA, 75 bp, Artificial Sequence
  Synthetic
agggaactgccacctcaccgtcaacggcgaggacgtcggcgccttcccccctgggaagttcgtcaccgccgccct

SEQ ID NO: 314516 - DNA, 75 bp, Artificial Sequence
  Synthetic
ccctcgggtgagcacgcgaggcggcgcgctagacccaaacacctgttggctccgtgccgccgctaacgtcgcgca

SEQ ID NO: 314517 - DNA, 75 bp, Artificial Sequence
  Synthetic
cctcaacacccccccgccctaccaggtgagttgcgggggtgagagcgaccgcgcgagcgcgcgggtcattgaccc

SEQ ID NO: 314518 - DNA, 75 bp, Artificial Sequence
  Synthetic
cctacggccgcgccctgagcgaagcccgaacccatgaggacttcgccgcgctgagccagcggtggagcgcgagtc

SEQ ID NO: 314519 - DNA, 75 bp, Artificial Sequence
  Synthetic
ccgcatctacatcgatgaggcgttcaccctcggcggcgagtactgcgcgttcgttgccagccaaaccaccgcgga

SEQ ID NO: 314520 - DNA, 75 bp, Artificial Sequence
  Synthetic
gtgtatggcacacacaccactgctgtatcggagacccggcagacctgggcggagtgggctgctgctcattggtgg

SEQ ID NO: 314521 - DNA, 75 bp, Artificial Sequence
  Synthetic
tccaaccaggtcatcacccaccgttgttttgccgcttccggtgggtaccccactcttgctatttgggagagcccc

SEQ ID NO: 314522 - DNA, 75 bp, Artificial Sequence
  Synthetic
cggagatcccctcgatcccctgatggagaccgtagggtgcgcctgctcgcgcgtgtgggtcggctctgagcatga

SEQ ID NO: 314523 - DNA, 75 bp, Artificial Sequence
  Synthetic
ccctcctgcttgctggcctacttgcttgctgtgccaaatgcttatactacttgcgcggcgctatagcgccgcgct

SEQ ID NO: 314524 - DNA, 75 bp, Artificial Sequence
  Synthetic
tgggcccccgcgcgaaacccgcattagcccactagattcccgcacccgttgctgcatagaaaaaaaaaaaaaaaa

SEQ ID NO: 314525 - DNA, 75 bp, Artificial Sequence
  Synthetic
ttctgcacgagatccaggccaaactccgcgcgcgcgatatcgacatcaagaacgccgccacctacgagcgcgcgc

SEQ ID NO: 314526 - DNA, 75 bp, Artificial Sequence
  Synthetic
ccgcatctacatcgatgaggcgttcaccctcggcggtgagtactgcgcgttcgttgccagccaaaccaccgcgga

SEQ ID NO: 314527 - DNA, 75 bp, Artificial Sequence
  Synthetic
actctcggcggcgagtactgcgcgttcgttgccagccaaaccaccgcggaggtgatctgcgtcggcgatcgggac

SEQ ID NO: 314528 - DNA, 75 bp, Artificial Sequence
  Synthetic
gggcgaacgggaagtgcggtatatgcgcatctcgcgccacctgctcaacaagaatcacaccgagatgcccgggac

SEQ ID NO: 314529 - DNA, 75 bp, Artificial Sequence
  Synthetic
ggcaccttcgcctgcaacctctgggacggccgccaggtcgaccttcacctcgccttctcgcgcgaaaccgtgcgc

SEQ ID NO: 314530 - DNA, 75 bp, Artificial Sequence
  Synthetic
ggaaccttcgcctgcaacctctgggacggccgccaggtcgacctccacctcgccttctcgcgcgaaaccgtgcgc

SEQ ID NO: 314531 - DNA, 75 bp, Artificial Sequence
  Synthetic
acggccgccaggtcgacctccacctcgccttctcgcgcgaaaccgtgcgccgcctccacgaggctggcatacgcg

SEQ ID NO: 314532 - DNA, 75 bp, Artificial Sequence
  Synthetic
catacaccgtgcgcgaggcccagggcatgagcgtcggcaccgcctgcatccacgtaggcagagacggcacggacg

SEQ ID NO: 314533 - DNA, 75 bp, Artificial Sequence
  Synthetic
atccttggcgcattcgcttcggtgcccctcaggtcttccttgccgggctcctgctcgcggccgttgccgtcggca

SEQ ID NO: 314534 - DNA, 75 bp, Artificial Sequence
  Synthetic
ttcccgctggcatcgaccgcgttgtcgcggttgagcaggctccaccaccgttgccgcccgctgacggcatccctg

SEQ ID NO: 314535 - DNA, 75 bp, Artificial Sequence
  Synthetic
ctgctcgcggccgttgccgtcggcaccgcgcgggctggcctccagccccgcactgacatcgcggcaccccctgcg

SEQ ID NO: 314536 - DNA, 75 bp, Artificial Sequence
  Synthetic
tccaacccagcgcgcgggtccgactcccggaccttgtccatctcgccgaggtgggccggtggcggtggttcagcc

SEQ ID NO: 314537 - DNA, 75 bp, Artificial Sequence
  Synthetic
ccgcccagagcctgagcgtccccgccttccttaaggccaccctgaagtgcgttgatgccgccctcggtcccaggg

SEQ ID NO: 314538 - DNA, 75 bp, Artificial Sequence
  Synthetic
cgcatctcgcgtcacctgctcaacaagaatcacaccgagatgcccgggacggaacgcgttcttagcgccgtttgc

SEQ ID NO: 314539 - DNA, 75 bp, Artificial Sequence
  Synthetic
aggatgggtcgaccctccgcactgctgtggcccgccagcacccgcgcccgttccgtcagatcccacccccgcgca

SEQ ID NO: 314540 - DNA, 75 bp, Artificial Sequence
  Synthetic
cggtccgcccgatgacgaggcgctcatcccgccgtggctcttcgccgagcgccgcgccctccgctgccgcgagtg

SEQ ID NO: 314541 - DNA, 75 bp, Artificial Sequence
  Synthetic
atcccgccgtggctcttcgccgagcgccgcgccctccgctgccgcgagtgggacttcgaggctctccgcgtgcgc

SEQ ID NO: 314542 - DNA, 75 bp, Artificial Sequence
  Synthetic
attcctcaaagccaccttgaagtgcgtagacgccgccctcggccccagggacaccgaggactgccacgccgcaca

SEQ ID NO: 314543 - DNA, 75 bp, Artificial Sequence
  Synthetic
ggggaaagccggcctcgagatccgggcgtgggccaaggagtgggtacaggttatgtccccgcatttccgcgcgat

SEQ ID NO: 314544 - DNA, 75 bp, Artificial Sequence
  Synthetic
cttctgccctctggctcgccacagcgaacgcgctgtcccttgaccacgcgctcgcagccgttgtcttgctggtcc

SEQ ID NO: 314545 - DNA, 75 bp, Artificial Sequence
  Synthetic
ggccagccgctccggggccccgaacgccacttcgccgccggcgcgcatatgtgcgcgcaggcgcgggggctccag

SEQ ID NO: 314546 - DNA, 75 bp, Artificial Sequence
  Synthetic
gcttttgtccgtgtcgtgcctccacccgagcgcccctgggccgacgggggcgccagagcgtgggcaaagttcttc

SEQ ID NO: 314547 - DNA, 75 bp, Artificial Sequence
  Synthetic
ccgagcgcccctgggccgacgggggcgccagagcgtgggcaaagttcttccgcggctgcgcctgggcgcagcgct

SEQ ID NO: 314548 - DNA, 75 bp, Artificial Sequence
  Synthetic
aacgccatcgaggtcgacttcactgagttcgacatgaaccagaccctcgctacccgggacgtggagctcgagatt

SEQ ID NO: 314549 - DNA, 75 bp, Artificial Sequence
  Synthetic
ctcatggctttggagcgaaggtgaaggcgcggtcttttaccgcgtcgatttacacttcaccaacctgggcacccc

SEQ ID NO: 314550 - DNA, 75 bp, Artificial Sequence
  Synthetic
tcccagactccggctccgaagccaccgcgggcgccgccacagcagccccaacccccgcgcatgcaaaccgggcgt

SEQ ID NO: 314551 - DNA, 75 bp, Artificial Sequence
  Synthetic
acccccgcgcatgcaaaccgggcgtgggggctctgccccgcgccccgagctggggccgccgaccaacccgttcca

SEQ ID NO: 314552 - DNA, 75 bp, Artificial Sequence
  Synthetic
aaggtgagcgcacttacgccgagcaggatttccgcgtcggcggcacgcgctggcaccgactgctgcgcatgccag

SEQ ID NO: 314553 - DNA, 75 bp, Artificial Sequence
  Synthetic
agcagccgtggcgcgtggcctgcgcccgccgctccacgatcctgacaccgaggcacccaccgaggcctgcgtaac

SEQ ID NO: 314554 - DNA, 75 bp, Artificial Sequence
  Synthetic
cgcgccaccccgcgcgggtgacccggcccctcccactcctgcggggccggcggatcgcgcgcgtgacgccgagct

SEQ ID NO: 314555 - DNA, 75 bp, Artificial Sequence
  Synthetic
agctattacaagcaataccaccccactgcgtgcgacgtcgaacctgcctttgggcatagcgacgcagcgtgctgg

SEQ ID NO: 314556 - DNA, 75 bp, Artificial Sequence
  Synthetic
cgcatcgagacccgctcggcgcgccatccctggcgcatccgcttcggcgctccccaggccttccttgccgggctc

SEQ ID NO: 314557 - DNA, 75 bp, Artificial Sequence
  Synthetic
ttgctcgccgcggtcgccgttggcaccgcgcgcgccgggctccagccccgcgccgagatggcggcaccgcctgtg

SEQ ID NO: 314558 - DNA, 75 bp, Artificial Sequence
  Synthetic
ccccccacgccaactaaggccgacccagacagcgacatcgttgaaagttacgcccgcgccaccggacccgtgcac

SEQ ID NO: 314559 - DNA, 75 bp, Artificial Sequence
  Synthetic
ccgccgcagcccccccgtgcgcacgggcagcattacggccatcaccaccatcagctgccgttcctcgggcacgac

SEQ ID NO: 314560 - DNA, 75 bp, Artificial Sequence
  Synthetic
tcagcaccccgacaagaccgtcagggtcaagttccacaccgaaaccaggaccgtgtggcaactctccgtagcggg

SEQ ID NO: 314561 - DNA, 75 bp, Artificial Sequence
  Synthetic
cgtgtcgtgcaacgtcaccaccgaacatccgttctgcaacacgccgcacggacaactcgaggtccaggtcccgcc

SEQ ID NO: 314562 - DNA, 75 bp, Artificial Sequence
  Synthetic
ttctggtgtgtggagcacgaccgaccgccgcccgcgactccgacgcctctcaccaccgcggcgaacgctacaacc

SEQ ID NO: 314563 - DNA, 75 bp, Artificial Sequence
  Synthetic
cgacacccggccacggctgcgggtacacccacatcatccacgccgttgcgccgcggcgtcctcgggaccccgccg

SEQ ID NO: 314564 - DNA, 75 bp, Artificial Sequence
  Synthetic
acttttgccactcgggagagccccagggtgcccgaatggcttctactacccccatcactatggaggacctccaga

SEQ ID NO: 314565 - DNA, 75 bp, Artificial Sequence
  Synthetic
cgtgtgtcgcgtgccccctcctcggcgctggcgtctacggctggtctgctgcggagtccctccgagccgcgcttg

SEQ ID NO: 314566 - DNA, 75 bp, Artificial Sequence
  Synthetic
gcaaccggggccgtggccagcgcagggactggtccagggccccgccccctcccgaagagcgacaagaaagtcgct

SEQ ID NO: 314567 - DNA, 75 bp, Artificial Sequence
  Synthetic
cgctgccaggcgcgttagccctcctccggccgagcccctcgcaccttgccccgccagtgacccgggccgaccggc

SEQ ID NO: 314568 - DNA, 75 bp, Artificial Sequence
  Synthetic
ccgccgcgcctgccgccgccgcggcgccgccgccgccctcaccgcggtcgtcctgcaggggtacaacccccccgc

SEQ ID NO: 314569 - DNA, 75 bp, Artificial Sequence
  Synthetic
ctacggcgaggaggcttttacctacctctgcactgcgccggggtgcgccactcagacacctgtccccgtgcgcct

SEQ ID NO: 314570 - DNA, 75 bp, Artificial Sequence
  Synthetic
gtctcgtgcgagggcttgggggcctgggtacccacagccccttgcgcgcgcatctggaacggcacacagcgcgcg

SEQ ID NO: 314571 - DNA, 75 bp, Artificial Sequence
  Synthetic
gggtacccacagccccttgcgcgcgcatctggaacggcacacagcgcgcgtgcaccttctgggctgtcaacgcct

SEQ ID NO: 314572 - DNA, 75 bp, Artificial Sequence
  Synthetic
cgggcccgagccgcccgctcacgtcgtccgcgcgtacaatcaacccgccggcgacgtcaggggcgtttggggtaa

SEQ ID NO: 314573 - DNA, 75 bp, Artificial Sequence
  Synthetic
cggtgcaccccttccaacgcccacgccgccctgtgccgcacaggcgtgcccccccgagtgagcacgcggggcggc

SEQ ID NO: 314574 - DNA, 75 bp, Artificial Sequence
  Synthetic
tgggtccccgcgcgaaacccgcaccagcccactagatttctgcacccgctgctgcatagaaaaaaaaaaaaaaaa

SEQ ID NO: 314575 - DNA, 75 bp, Artificial Sequence
  Synthetic
cctacggccgcgccctgagcgaagcccgcactcatgaggactttgccgccctgagccagcggtggagcgcgagcc

SEQ ID NO: 314576 - DNA, 75 bp, Artificial Sequence
  Synthetic
ctgactgctcgcggcttgtgggggccacgccagagcgtccccggctgcgcctggttgacgccgacgaccccctgc

SEQ ID NO: 314577 - DNA, 75 bp, Artificial Sequence
  Synthetic
cgctggcgtccgctttgagtccaagattgtggacggcggctgctttgccccatgggacctcgaggccactggagc

SEQ ID NO: 314578 - DNA, 75 bp, Artificial Sequence
  Synthetic
gctgacatggcggcaccccctatgccgccgcagcccccccgcgcgcacgggcagcattacggccaccatcaccat

SEQ ID NO: 314579 - DNA, 75 bp, Artificial Sequence
  Synthetic
tccctccaccgtgcccccaatggtccgtggggcgtagtgctcgaggtgcgcgcgcgccctgaagggggcaaccca

SEQ ID NO: 314580 - DNA, 75 bp, Artificial Sequence
  Synthetic
atccacgctcacaccaccagtgacccctggcacccaccgggccccttggggctgaagtttaagacagttcgcccg

SEQ ID NO: 314581 - DNA, 75 bp, Artificial Sequence
  Synthetic
gcgtgcgccccccgctgcgacgtcccacgcgaacgtccctccgcgcctgccggcccgccggatgacgaggcgctt

SEQ ID NO: 314582 - DNA, 75 bp, Artificial Sequence
  Synthetic
cccggaccttgtccatctcgccgaggtgggccggtggcggtggttcagcctcccccgccccgtctttcagcgtat

SEQ ID NO: 314583 - DNA, 75 bp, Artificial Sequence
  Synthetic
gttgcgctgccacgcgcgttagcgccaccccgcaatgtgcgcgtgaccgggtgctaccagtgcggtacccccgcg

SEQ ID NO: 314584 - DNA, 75 bp, Artificial Sequence
  Synthetic
cccctgccacgccggcctcaatgacagctgcggcggcttcctgtctgggtgcgggccgatgcgcctacgccacgg

SEQ ID NO: 314585 - DNA, 75 bp, Artificial Sequence
  Synthetic
cgctgacacccggtgcggtcggttgatctgtgggttgtccaccaccgcccagtacccgccaacccggtttggctg

SEQ ID NO: 314586 - DNA, 75 bp, Artificial Sequence
  Synthetic
ctggcctaccgagcgctcacgccacacttggcgcttccccgactgctgggccgcccgcctgcgcgcggggctcga

SEQ ID NO: 314587 - DNA, 75 bp, Artificial Sequence
  Synthetic
gagcaggacgccgcggtcgcggcctttgatcgcggcccccttgaggacggcgggcaccacttggtaaccgtgcaa

SEQ ID NO: 314588 - DNA, 75 bp, Artificial Sequence
  Synthetic
tatagcgccgcgctagtgggcccccgcgcgaaacccgcattagcccactagattcccgcacctgttgctgcatag

SEQ ID NO: 314589 - DNA, 75 bp, Artificial Sequence
  Synthetic
agatcgccgcaacgtggattgtccacgccgcgagcgcagaccgccactgtgcgtgcgccccccgctgcgacgtcc

SEQ ID NO: 314590 - DNA, 75 bp, Artificial Sequence
  Synthetic
gcaatttcgcggtatacccgccgccattggattgagtggggccctaaagaagccctacacgtcctcatcgaccca

SEQ ID NO: 314591 - DNA, 75 bp, Artificial Sequence
  Synthetic
cgccgtcgaacaggcaccaccaccgttgccgcccgccgacggcatccccgaggcccaagacgtgccgcccttctg

SEQ ID NO: 314592 - DNA, 75 bp, Artificial Sequence
  Synthetic
tctgcactgcaccggggtgcgccactcaaacgcctgtccccgtgcgcctcgctggcgtccgcttcgagtccaaga

SEQ ID NO: 314593 - DNA, 75 bp, Artificial Sequence
  Synthetic
ggatttcgaggcccttcgcgcgcgcgccgacacggcggccacgcccgccccactagccccacgccccgcgcgcca

SEQ ID NO: 314594 - DNA, 75 bp, Artificial Sequence
  Synthetic
tccccgcactctggaggagctcgtcttcggccgtgccggccacccccattacgcggacctcaaccgcgtgactga

SEQ ID NO: 314595 - DNA, 75 bp, Artificial Sequence
  Synthetic
gcgtattcgcgccgtgcgatgcgccctcgccattcgccatgtgcgcagcctccaacccagcgcgcgcgtccggct

SEQ ID NO: 314596 - DNA, 75 bp, Artificial Sequence
  Synthetic
cgtggggcgtagtgctcgaggtgcgcgcgcgccccgaggggggcaaccccaccggccacttcgtctgcgcggtcg

SEQ ID NO: 314597 - DNA, 75 bp, Artificial Sequence
  Synthetic
cgcatttcgcgccacctgctcaacaagaatcacaccgagatgcccgggacggaacgcgttctcagtgccgtttgc

SEQ ID NO: 314598 - DNA, 75 bp, Artificial Sequence
  Synthetic
ggccctggtcttatgcgacccacttggccagccgctccggggcccggagcgccatttcaccgccggcgcgcacat

SEQ ID NO: 314599 - DNA, 75 bp, Artificial Sequence
  Synthetic
gtgctgcaggaggggtggaagggcacgtgcgccgaggaagacgcgttgtgcgcgtacgtggccttccgcgcgtgg

SEQ ID NO: 314600 - DNA, 75 bp, Artificial Sequence
  Synthetic
ttccgccagatcccacctccgcgcgtcactgctggggtcgcccaggagtggcgcatgacgtacttgcgggaacgg

SEQ ID NO: 314601 - DNA, 75 bp, Artificial Sequence
  Synthetic
atcgacctcactgatgtctacacgcagatgggtgtggccgcgcgggagctcaccgaccgctacgcgcgccgctac

SEQ ID NO: 314602 - DNA, 75 bp, Artificial Sequence
  Synthetic
ccgcccagagcctgagcgtccccgccttcctcaaggccaccctgaagtgcgtagacgccgccctcggccccaggg

SEQ ID NO: 314603 - DNA, 75 bp, Artificial Sequence
  Synthetic
cgccgccgcccgcccccagcccgcccacgccaccccgcgcgcgcggcccggccccagccaccctagaggagcccg

SEQ ID NO: 314604 - DNA, 75 bp, Artificial Sequence
  Synthetic
accgcgccctccgttgccgcgagtgggatttcgaggcccttcgtgcgcgcgccgacacggcggccacgcccgccc

SEQ ID NO: 314605 - DNA, 75 bp, Artificial Sequence
  Synthetic
agttcgacatgaaccagacccttgctactcgggacgtcgagctcgagatcagcgccgctctcttgggcctccctt

SEQ ID NO: 314606 - DNA, 75 bp, Artificial Sequence
  Synthetic
aacgccatcgaggtcgacttcaccgagttcgacatgaaccagacccttgctactcgggacgtcgagctcgagatc

SEQ ID NO: 314607 - DNA, 75 bp, Artificial Sequence
  Synthetic
gcgccgaagactaccgtgcgctccgcgctggcagctactgcaccctgcgcgaactgggtaccactgagaccggct

SEQ ID NO: 314608 - DNA, 75 bp, Artificial Sequence
  Synthetic
cttcgcgtccgcgacatcatggaccccccacctggttgcaaggtcgtggtcaatgccgcgaacgaggggctgctc

SEQ ID NO: 314609 - DNA, 75 bp, Artificial Sequence
  Synthetic
gcgagcgcacaagcggcgagcccgccacgctgctgcacaacaccaccgtggccatgtgcatggctatgcgcatgg

SEQ ID NO: 314610 - DNA, 75 bp, Artificial Sequence
  Synthetic
ggggcgcggcctcgaccacccggccaccatcggcgcgctcgaggagattcagactccctacgcgcgcgccaatct

SEQ ID NO: 314611 - DNA, 75 bp, Artificial Sequence
  Synthetic
cacgctgctgcacaacaccaccgtggccatgtgcatggctatgcgcatggtccccaaaggcgtgcgctgggccgg

SEQ ID NO: 314612 - DNA, 75 bp, Artificial Sequence
  Synthetic
gccggatctggcgtctgcggtgccatcttcgccaaagccgccgcggccctcgccgaggactgccggcgcctcgcc

SEQ ID NO: 314613 - DNA, 75 bp, Artificial Sequence
  Synthetic
tactcggcgagccggcagtcatgcacctcccgtacactgacggcgacgtgccgcagctgattgcgctggccctgc

SEQ ID NO: 314614 - DNA, 75 bp, Artificial Sequence
  Synthetic
gcggagtcccttcgagccgcgctcgcggccacgcgcgccgagcccgccgagcgcgtgagcctgcatatatgccac

SEQ ID NO: 314615 - DNA, 75 bp, Artificial Sequence
  Synthetic
tggggccgccgaccaacccgttccaggcagccgtggcgcgtggcctgcgcccgcctctccatgaccctgacaccg

SEQ ID NO: 314616 - DNA, 75 bp, Artificial Sequence
  Synthetic
gcgcgtgagcctgcatatatgccaccccgaccgcgccacgctgacgcacgcctccgtgctcgtgggcgcggggct

SEQ ID NO: 314617 - DNA, 75 bp, Artificial Sequence
  Synthetic
gtcagctgcgggggtgagagcgaccgcgcgagcgcgcgggtcattgaccccgccgcgcaatcgttcaccggcgtg

SEQ ID NO: 314618 - DNA, 75 bp, Artificial Sequence
  Synthetic
gctatgcggtggggcctgcccccatgggaactggttgtcctcaccgcccgccccgaagacggctggacttgccgc

SEQ ID NO: 314619 - DNA, 75 bp, Artificial Sequence
  Synthetic
cccgccgcgccaaccagggcggaccccgacagcgacatcgtcgaaagctacgcccgcgccgccggtcctgtgcac

SEQ ID NO: 314620 - DNA, 75 bp, Artificial Sequence
  Synthetic
accatcggcgcgctcgaggagatccagaccccctacgcgcgcgccaatctccacgacgctgactaacgcccctgt

SEQ ID NO: 314621 - DNA, 75 bp, Artificial Sequence
  Synthetic
cgcccgcgccgccggtcctgtgcacctccgcgttcgcgacattatggaccccccacccggctgcaaggtcgtggt

SEQ ID NO: 314622 - DNA, 75 bp, Artificial Sequence
  Synthetic
acgtggggcctttaatcttacctactctaaccaggtcatcacccaccgctgtttcgccgcatctggtgggtaccc

SEQ ID NO: 314623 - DNA, 75 bp, Artificial Sequence
  Synthetic
tatagcgccgcgctagtgggcccccgcgtgaaacccgcactagcctactagattcccgcacctgttgctgtatag

SEQ ID NO: 314624 - DNA, 75 bp, Artificial Sequence
  Synthetic
cgacgcccggccacggctgcgggtacgcgcacatcatccacgcggtcgctcctcggcgtcctccggaccccgccg

SEQ ID NO: 314625 - DNA, 75 bp, Artificial Sequence
  Synthetic
cactcttgccattcgggagagccccagggtgcccgaatggcttctactgcccccatcaccatggaggacctccag

SEQ ID NO: 314626 - DNA, 75 bp, Artificial Sequence
  Synthetic
cctcggcgtcctccggaccccgccgccctcgagcagagcgaaggcctgctcgaacgcgcctaccgcagcatcgtc

SEQ ID NO: 314627 - DNA, 75 bp, Artificial Sequence
  Synthetic
cgcgcgccccgaggggggtaaccccaccggccactttgtttgcgcggtcggtggcggcccacgccgtgtttcgga

SEQ ID NO: 314628 - DNA, 75 bp, Artificial Sequence
  Synthetic
cccggaagagcggcaagaaagtcgctcccagactccggccccgaagccatcgcgggcgccgccacaacagcctca

SEQ ID NO: 314629 - DNA, 75 bp, Artificial Sequence
  Synthetic
ccagcgcagcgcgtcacccccgactcccccttctggggaggccaccgcgcctgagtcacgcgggtgccaagggtg

SEQ ID NO: 314630 - DNA, 75 bp, Artificial Sequence
  Synthetic
agatcgccgcgacctggatcgtccacgcagccagcgcagaccgccattgtgcgtgcgctccccgctgcgacgtcc

SEQ ID NO: 314631 - DNA, 75 bp, Artificial Sequence
  Synthetic
caccggttgggcgatgcgcatccccgaagtggtcgtctacgggccggaacacctcgccgcgcacttcccactaaa

SEQ ID NO: 314632 - DNA, 75 bp, Artificial Sequence
  Synthetic
gcgtgcgctccccgctgcgacgtcccgcgcgaacgtccttccgcgcccgccggcccgccggatgacgaggcgctc

SEQ ID NO: 314633 - DNA, 75 bp, Artificial Sequence
  Synthetic
cgcgcgaacgtccttccgcgcccgccggcccgccggatgacgaggcgctcatcccgccgtggctgttcgccgagc

SEQ ID NO: 314634 - DNA, 75 bp, Artificial Sequence
  Synthetic
cccgcttcccccccacaccaccgagcgcattgagacccgctcggcgcgccatccttggcgcatccgctttggcgc

SEQ ID NO: 314635 - DNA, 75 bp, Artificial Sequence
  Synthetic
ggcacttttgcctgcaacctctgggacggccgccaggtcgacctccacctcgccttctcgcgcgagaccgtgcgc

SEQ ID NO: 314636 - DNA, 75 bp, Artificial Sequence
  Synthetic
ccgcgcgcgccgggctccagccccgcgctgacatggcggcaccacctgcgccgccccagcccccccgtgcgcacg

SEQ ID NO: 314637 - DNA, 75 bp, Artificial Sequence
  Synthetic
ggcagcattacggccaccaccaccatcagctgccgttcctcgggcacgacggccatcacggcggcaccttgcgcg

SEQ ID NO: 314638 - DNA, 75 bp, Artificial Sequence
  Synthetic
acggcactcggacgcccgcggcactccgccccccgcgcctgcgcgcgacccgccgccgcccgcccccagcccgcc

SEQ ID NO: 314639 - DNA, 75 bp, Artificial Sequence
  Synthetic
ccgtatctacatcgacgaggcgttcaccctcggcggcgagtattgcgcgttcgttgccagccaaaccaccgcgga

SEQ ID NO: 314640 - DNA, 75 bp, Artificial Sequence
  Synthetic
tcagctgccgttcctcgggcacgacggccatcacggcggcaccttgcgcgtcggccagcatcaccgaaacgccag

SEQ ID NO: 314641 - DNA, 75 bp, Artificial Sequence
  Synthetic
ttctggtgtgtggagcacgaccgaccgccgcctgcgatcccgacgcctcccaccactgcggcgaacgccacgacc

SEQ ID NO: 314642 - DNA, 75 bp, Artificial Sequence
  Synthetic
ctccgagtccgcgacatcatggacccaccgcccggctgcaaggtcgtggtcaacgccgccaacgaggggctgctg

SEQ ID NO: 314643 - DNA, 75 bp, Artificial Sequence
  Synthetic
cgccttcacgaggctggcatacgcgcatacaccgtgcgcgaggcccagggcatgagcgttggcaccgcctgcatc

SEQ ID NO: 314644 - DNA, 75 bp, Artificial Sequence
  Synthetic
caacgccgccaacgaggggctgctggccggctctggcgtgtgcggtgccatctttgccaacgccacggcggccct

SEQ ID NO: 314645 - DNA, 75 bp, Artificial Sequence
  Synthetic
gccggctctggcgtgtgcggtgccatctttgccaacgccacggcggccctcgctgcagactgccggcgcctcgcc

SEQ ID NO: 314646 - DNA, 75 bp, Artificial Sequence
  Synthetic
ttcggccgcgccggccacccccattacgcggatctcaaccgcgtaaccgagggcgagcgagaagtgcggtacatg

SEQ ID NO: 314647 - DNA, 75 bp, Artificial Sequence
  Synthetic
gccgccacccccgccactgtgccggccccctgccacgccggcctcaatgacagctgcggcggcttcttgtcaggg

SEQ ID NO: 314648 - DNA, 75 bp, Artificial Sequence
  Synthetic
cgagcgcgcctaccgcagcatcgtcgcgctagccgccgcgcgtcggtgggcgcgtgtcgcgtgccccctcctcgg

SEQ ID NO: 314649 - DNA, 75 bp, Artificial Sequence
  Synthetic
cgcatctcgcgtcacctgctcaacaagaaccacactgaaatgcccgggacggaacgcgttctgagcgccgtttgc

SEQ ID NO: 314650 - DNA, 75 bp, Artificial Sequence
  Synthetic
cagtacccgcctacccggttcggctgcgttatgcggtggggccttcccccctgggaactggccgtcctcaccgcc

SEQ ID NO: 314651 - DNA, 75 bp, Artificial Sequence
  Synthetic
ggctgcgcgcgcctgcggcgcctacacgagtgccgggtgccccaggtgcgcctacggccgcgccctgagcgaagc

SEQ ID NO: 314652 - DNA, 75 bp, Artificial Sequence
  Synthetic
cttcctcaaagccaccttgaagtgcgtggacgccgccctcggccccagggacaccgaagactgccatgccgccca

SEQ ID NO: 314653 - DNA, 75 bp, Artificial Sequence
  Synthetic
aacgccgccacctacgagcgcgcgctgacgaaaccgctcgccgcctaccgccgcatctacatcgatgaggcgttc

SEQ ID NO: 314654 - DNA, 75 bp, Artificial Sequence
  Synthetic
gggtacccacagccccttgcgcgcgcatttggaacggcacacagcgcgcgtgcaccttctgggctgtcaacgcct

SEQ ID NO: 314655 - DNA, 75 bp, Artificial Sequence
  Synthetic
catttggaacggcacacagcgcgcgtgcaccttctgggctgtcaacgcctactcctctggtgggtacgcgcagct

SEQ ID NO: 314656 - DNA, 75 bp, Artificial Sequence
  Synthetic
ccacgacgctgactaacgcccctgcacgtagggcctttaatcttactactctaaccaggtcatcacccaccgttg

SEQ ID NO: 314657 - DNA, 75 bp, Artificial Sequence
  Synthetic
cgcctggcatcttgaccatgacggcggttgccctgccgactgccgcggagccggtgctggacccacgcccggcta

SEQ ID NO: 314658 - DNA, 75 bp, Artificial Sequence
  Synthetic
gccttgcagtcgcgccggccgcggccacagcgacagcgcgactccagcacctccggagacgattctggccgcgac

SEQ ID NO: 314659 - DNA, 75 bp, Artificial Sequence
  Synthetic
tccccggtttgtcaacgccattcccctgactgctcgcggcttgtgggggccacgccagagcgtccccggctgcgc

SEQ ID NO: 314660 - DNA, 75 bp, Artificial Sequence
  Synthetic
tgcgcactgcccctgggcccggcgaggtgtgggtcacgcctgtcataggctctcaggcgcgcaagtgcggactcc

SEQ ID NO: 314661 - DNA, 75 bp, Artificial Sequence
  Synthetic
gtccgcgcgtacaaccaacctgccggcgacgtcaggggtatctggggcaagggcgagcgcacctacgccgagcag

SEQ ID NO: 314662 - DNA, 75 bp, Artificial Sequence
  Synthetic
acccccgcgtatgcaaaccgggcgtgggggctctgccccgcgccccgagctggggccaccgaccaacccgttcca

SEQ ID NO: 314663 - DNA, 75 bp, Artificial Sequence
  Synthetic
tgctaccgtcgaaatgcccgagtggatccacgcccacaccaccagcgacccctggcacccaccgggccccttggg

SEQ ID NO: 314664 - DNA, 75 bp, Artificial Sequence
  Synthetic
ccacgacgccgactagcgcccgtgcacgtagggcctttaatcttactactctaaccaggtcatcacccaccgttg

SEQ ID NO: 314665 - DNA, 75 bp, Artificial Sequence
  Synthetic
cgctgatatggcggcacctcctacgctgccgcagcccccccgtgcgcacgggcagcattacggccaccaccacca

SEQ ID NO: 314666 - DNA, 75 bp, Artificial Sequence
  Synthetic
gaagcactacggtcatcaccaccatcaattgccgtttcttgggcacgacggccaccacgggggcaccttgcgcgt

SEQ ID NO: 314667 - DNA, 75 bp, Artificial Sequence
  Synthetic
cgggcgccacttagacactgtgcaacccccgaaatcgccgccccgccccgagatcgccgcgacctggatcgtcca

SEQ ID NO: 314668 - DNA, 75 bp, Artificial Sequence
  Synthetic
gttgccctgccacgcgcgttagcgccaccccgcaacgtgcgtgtgaccgggtgttaccagtgtggcacccccgcg

SEQ ID NO: 314669 - DNA, 75 bp, Artificial Sequence
  Synthetic
cgccgcaggtcccccgcgcgcacgggaagcactacggtcatcaccaccatcaattgccgtttcttgggcacgacg

SEQ ID NO: 314670 - DNA, 75 bp, Artificial Sequence
  Synthetic
atcccgccgtggctgttcgctgagcgtcgccccctccgttgccgcgagtgggatctcgaggctctccgcgcgcgc

SEQ ID NO: 314671 - DNA, 75 bp, Artificial Sequence
  Synthetic
tgggaactggtcgtccttacggcccgccccgaggacggctggacttgccgcggcgtgcccgcccacccaggtacc

SEQ ID NO: 314672 - DNA, 75 bp, Artificial Sequence
  Synthetic
cgccgcgcctgtcgccgccgcggcgccgccgccgccctcaccgcggtcgtcctgcaggggtacaccccccccgcc

SEQ ID NO: 314673 - DNA, 75 bp, Artificial Sequence
  Synthetic
atgggacctcgaggccaccggagcctgcatctgcgagatccccactgatgtctcgtgcgagggcttgggggcctg

SEQ ID NO: 314674 - DNA, 75 bp, Artificial Sequence
  Synthetic
gcacgctggcccaacagggggccgccctggcactctcggtgcgtgacctacccgggggcgcagcgttcgacgcaa

SEQ ID NO: 314675 - DNA, 75 bp, Artificial Sequence
  Synthetic
ggacacagcgacgcggcctgctggggcttccccaccgacaccgtgatgagtgtgttcgccctcgccagctacgtc

SEQ ID NO: 314676 - DNA, 75 bp, Artificial Sequence
  Synthetic
gcttccccaccgacaccgtgatgagtgtgttcgccctcgccagctacgtccagcaccccgacaagaccgtcaggg

SEQ ID NO: 314677 - DNA, 75 bp, Artificial Sequence
  Synthetic
tcgcttaggactcctatccccatggagaaactcctagatgaggttcttgcccccggtgggccttataacttaacc

SEQ ID NO: 314678 - DNA, 75 bp, Artificial Sequence
  Synthetic
cccgacgcgtactacagcgagcgcgtgttcaagttcaagaacgccctgagccacagcatcacgctcgcgggcaat

SEQ ID NO: 314679 - DNA, 75 bp, Artificial Sequence
  Synthetic
ggccctcccacttccgcggggccggcggatcgcgcgcacgacgccgagctcgagatcgcctacgaaccgagcggc

SEQ ID NO: 314680 - DNA, 75 bp, Artificial Sequence
  Synthetic
cagacagcgacatcgttgaaagttacgcccgcgccgccggacccgtgcacctccgcgttcgcgacattatggacc

SEQ ID NO: 314681 - DNA, 75 bp, Artificial Sequence
  Synthetic
accgcccgccaccccgacgcctcccaccaccgcggcgaactccacgactgccgccacccccgctactacgccggc

SEQ ID NO: 314682 - DNA, 75 bp, Artificial Sequence
  Synthetic
ggcgaggacgtcggcgccttcccccctgggaagttcgtcaccgccgccctcctcaacacccccccgccctaccaa

SEQ ID NO: 314683 - DNA, 75 bp, Artificial Sequence
  Synthetic
caacgccgccaacgagggactgctggccggctctggcgtgtgcggagccattttcgccaacgccacgccggccct

SEQ ID NO: 314684 - DNA, 75 bp, Artificial Sequence
  Synthetic
gccgatacggcggccgcgcccgccccgctggctccacgccctgcgcggtaccccaccgtgctctaccgccacccc

SEQ ID NO: 314685 - DNA, 75 bp, Artificial Sequence
  Synthetic
tatagcgccgcgctagtgggcccccgcgcgaaacccgcattagcccactagattcccgcacccgttgctgcatag

SEQ ID NO: 314686 - DNA, 75 bp, Artificial Sequence
  Synthetic
caacacccggccacggctgcgggtacacccacatcatccacgcggtggcgccgcggcgccctcgggaccccgccg

SEQ ID NO: 314687 - DNA, 75 bp, Artificial Sequence
  Synthetic
cttggcactctcggtgcgtgacctgcccgggggtgcagcgttcgacgcaaatgcggtcaccgccgccgtgcgcgc

SEQ ID NO: 314688 - DNA, 75 bp, Artificial Sequence
  Synthetic
agttgggtaagagaccatgtccgctcaattgtcgagggcgcgtgggaagtgcgcgatgttgttaccgctgcccaa

SEQ ID NO: 314689 - DNA, 75 bp, Artificial Sequence
  Synthetic
atgcggtcaccgccgccgtgcgcgctggccccggccagctcgcggccacgtcaccgccacccggcgaccccccgc

SEQ ID NO: 314690 - DNA, 75 bp, Artificial Sequence
  Synthetic
cctgcaggggtacaccccccccgcctacggcgaggaggctttcacctacctctgcactgcaccggggtgtgccac

SEQ ID NO: 314691 - DNA, 75 bp, Artificial Sequence
  Synthetic
acggcactcggacgcccgcggcactccgccccccgcgcctgtgcgcgacccgccgccgcccgcccccagcccgcc

SEQ ID NO: 314692 - DNA, 75 bp, Artificial Sequence
  Synthetic
ccagcgcagcgcgtcgcccccagcgaccccccttggggatgccgctgcgcccgagccccgcgggtgccaggggtg

SEQ ID NO: 314693 - DNA, 75 bp, Artificial Sequence
  Synthetic
gtgctgcaagaggggtggaagggcacgtgcgccgaagaagacgcgctgtgcgcatacgtggccttccgcgcgtgg

SEQ ID NO: 314694 - DNA, 75 bp, Artificial Sequence
  Synthetic
cgcatctaccaagtcctgccggacaccgcccaccccgggcgcctctaccggtgcgggccccgcctgtggacgcgc

SEQ ID NO: 314695 - DNA, 75 bp, Artificial Sequence
  Synthetic
ctcgtccggcgggtacgcgcagctggcgtcctatttcaaccccggcggcagctactacaagcaataccaccccac

SEQ ID NO: 314696 - DNA, 75 bp, Artificial Sequence
  Synthetic
gggaggtcgcccaacactgcgggcaccaggcgcgcgtgcgcgccgtgcgatgcaccctccctatccgccacgtgc

SEQ ID NO: 314697 - DNA, 75 bp, Artificial Sequence
  Synthetic
ccaggcgcgcgtgcgcgccgtgcgatgcaccctccctatccgccacgtgcgcagcctccaacccagcgcgcgggt

SEQ ID NO: 314698 - DNA, 75 bp, Artificial Sequence
  Synthetic
gcgcatgctgtcctactgcaagaccctgagcccggacgcgtactacagcgagcgcgtgttcaagttcaagaacgc

SEQ ID NO: 314699 - DNA, 75 bp, Artificial Sequence
  Synthetic
catacgcgccggaccgtacggccacgccaccgtcgaaatgcctgagtggatccacgcccacactaccagcgaccc

SEQ ID NO: 314700 - DNA, 75 bp, Artificial Sequence
  Synthetic
tcaccgccacccggcgaccccccgccgccgcgccgcgcacggcgatcgcaacggccctcggacgcccgcggcact

SEQ ID NO: 314701 - DNA, 75 bp, Artificial Sequence
  Synthetic
cgcgccaccccgcgcgggtgacccggtccctcccacttccgcggagccggcggatcgcgcgcgtcacgccgagct

SEQ ID NO: 314702 - DNA, 75 bp, Artificial Sequence
  Synthetic
ccctcgcaacgtgcgcgtaaccggctgctaccagtgtgggacccccgcgctggtggagggccttgccccaggagg

SEQ ID NO: 314703 - DNA, 75 bp, Artificial Sequence
  Synthetic
tgctaccagtgtgggacccccgcgctggtggagggccttgccccaggaggagggaactgccatctcaccatcaac

SEQ ID NO: 314704 - DNA, 75 bp, Artificial Sequence
  Synthetic
cggagaccccctcgaccccctgatggagaccgtgggatgcgcctgttcgcgcgtatgggtcggctccgagcaaga

SEQ ID NO: 314705 - DNA, 75 bp, Artificial Sequence
  Synthetic
cgacgcggccctggtcttatgcgacccacttggccagccgctccggggccctgaacgccacttcgccgccggcgc

SEQ ID NO: 314706 - DNA, 75 bp, Artificial Sequence
  Synthetic
acgagtgccgggtgccctaagtgcgcctacggccgcgccctgagcgaagcccgcactcatgaggacttcgccgcg

SEQ ID NO: 314707 - DNA, 75 bp, Artificial Sequence
  Synthetic
cgggggcgccagagcgtgggcgaagttcttccgcggctgcgcctgggcgcagcgcttgctcggcgagccggcagt

SEQ ID NO: 314708 - DNA, 75 bp, Artificial Sequence
  Synthetic
ctccacccgagcgcccctgggccgacgggggcgccagagcgtgggcgaagttcttccgcggctgcgcctgggcgc

SEQ ID NO: 314709 - DNA, 75 bp, Artificial Sequence
  Synthetic
tccgacgccctctacctccacgagctcgaggacggctcactgcgcgctgcggggctcagcgcgttcctcgacgct

SEQ ID NO: 314710 - DNA, 75 bp, Artificial Sequence
  Synthetic
cgccatcgtcagcctgacccgggcctccgatgcactctacctccacgagctcgaggacggctcattgcgcgccgc

SEQ ID NO: 314711 - DNA, 75 bp, Artificial Sequence
  Synthetic
ccccgccgccgcgccgcgcacggcgatcgcaacggcactcggacgcccgcggcactccgccccccgcgcctgcgc

SEQ ID NO: 314712 - DNA, 75 bp, Artificial Sequence
  Synthetic
cgacgcccggccacggctgcgggtatgcgcacatcatccacgcggtcgctcctcggcgccctccggaccccgccg

SEQ ID NO: 314713 - DNA, 75 bp, Artificial Sequence
  Synthetic
acaccgaggactgccacgccgctcaggggaaagccggccttgagattcgggcatgggccaaggagtgggtccagg

SEQ ID NO: 314714 - DNA, 75 bp, Artificial Sequence
  Synthetic
cgagctggaggtcgtctacgaaccgagcggcccccccacgtcaaccaaggcagacccagacagcgacatcgttga

SEQ ID NO: 314715 - DNA, 75 bp, Artificial Sequence
  Synthetic
caccgaccgctacgcgcgccgctatcccgagatctttgccggcatgtgcaccgcccagagcctgagcgtccccgc

SEQ ID NO: 314716 - DNA, 75 bp, Artificial Sequence
  Synthetic
gtggtggcaggctcattacaccaccaacgccatcgaggtcgacttcactgagttcgacatgaaccagaccctcgc

SEQ ID NO: 314717 - DNA, 75 bp, Artificial Sequence
  Synthetic
gcgccgaagactaccgcgcgctccgcgccggcagctattgcactctgcgcgaactgggctccactgagaccggct

SEQ ID NO: 314718 - DNA, 75 bp, Artificial Sequence
  Synthetic
tccccaaaggcgtgcgctgggccgggattttccagggcgacgatatggtcatcttcctccccgagggcgcgcgca

SEQ ID NO: 314719 - DNA, 75 bp, Artificial Sequence
  Synthetic
ggccctcgctgcagactgccggcgcctcgccccatgccccaccggcgaggcggtggcgacacccggccacggctg

SEQ ID NO: 314720 - DNA, 75 bp, Artificial Sequence
  Synthetic
ggtgggcgtgtgtcgcgtgccccctcctcggcgctggcgtctacggctggtctgctgcggagtcccttcgagccg

SEQ ID NO: 314721 - DNA, 75 bp, Artificial Sequence
  Synthetic
attccagtgaagcatgtgagcaccccaacccccagcttctgcgggcacgtcggcaccgcggccggcctcttccat

SEQ ID NO: 314722 - DNA, 75 bp, Artificial Sequence
  Synthetic
cgggtacacccacatcatccacgccgtcgcgccgcggcgtcctcgggaccccgccgccctcgaggagggcgaagc

SEQ ID NO: 314723 - DNA, 75 bp, Artificial Sequence
  Synthetic
cgctcgcggctacgcgcgccgagcccgccgagcgcgtgagcctgcacatctgccaccccgaccgcgccacgctga

SEQ ID NO: 314724 - DNA, 75 bp, Artificial Sequence
  Synthetic
gcgcggcactcaagtggacccccgccgaggtgggtttgttcggctttcacattccggtgaagcacgtgagcaccc

SEQ ID NO: 314725 - DNA, 75 bp, Artificial Sequence
  Synthetic
cacgctactgcacaacaccaccgtggccatgtgcatggctatgcgcatggtccccaaaggcgtgcgctgggccgg

SEQ ID NO: 314726 - DNA, 75 bp, Artificial Sequence
  Synthetic
tgctttgccgccgtttcgaccccgacgtgcttgaagaacagcaggtggccctcctcgaccgcctccggggggtct

SEQ ID NO: 314727 - DNA, 75 bp, Artificial Sequence
  Synthetic
ccgcgcccgagccccgcggatgccaggggtgcgaactctgccggtacacgcgcgtcaccaatgaccgcgcctatg

SEQ ID NO: 314728 - DNA, 75 bp, Artificial Sequence
  Synthetic
ccagcgacccccctcggggatgccaccgcgcccgagccccgcggatgccaggggtgcgaactctgccggtacacg

SEQ ID NO: 314729 - DNA, 75 bp, Artificial Sequence
  Synthetic
cgcgtcaccaatgaccgcgcctatgtcaacttgtggctcgagcgcgaccgcggtgccaccagctgggcgatgcgc

SEQ ID NO: 314730 - DNA, 75 bp, Artificial Sequence
  Synthetic
ctccggagggccccgccgccgccgcggcaaccggggccgtggccagcgcaaggactggtccagggccccgccccc

SEQ ID NO: 314731 - DNA, 75 bp, Artificial Sequence
  Synthetic
agaccccctacgcgcgcgccaatctccatgatgccgactaacaccctcgtacgtagggcctttaatcttacctac

SEQ ID NO: 314732 - DNA, 75 bp, Artificial Sequence
  Synthetic
ccacgacgctgactaacgcccccgtacgtagggcctttaatcttacctactctaaccaggtcatcacccaccgtt

SEQ ID NO: 314733 - DNA, 75 bp, Artificial Sequence
  Synthetic
aaggccctcgaggcacaatcccgcgccctgcgcgcggaactcgccgccggcgcctcgcagccgcgccggccgcgg

SEQ ID NO: 314734 - DNA, 75 bp, Artificial Sequence
  Synthetic
ctcgaggtgcgccgcctcggggatgacgccatggcccgggcggccctcgcatcagtccaacgccctcgcaaaggc

SEQ ID NO: 314735 - DNA, 75 bp, Artificial Sequence
  Synthetic
gcatgtgcgggagtgacatgtggcgctgccgcggctggcagggcatgccgcaggtgcggtgcaccccctccaacg

SEQ ID NO: 314736 - DNA, 75 bp, Artificial Sequence
  Synthetic
acccccgcgcatgcaaaccgggcgtgggggctctgccccgcgccctgagctggggccgccgaccaacccgttcca

SEQ ID NO: 314737 - DNA, 75 bp, Artificial Sequence
  Synthetic
ccccgccttcctcaaagccaccttgaagtgcgtagacgccgccctcggccccagggacaccgaggactgccacgc

SEQ ID NO: 314738 - DNA, 75 bp, Artificial Sequence
  Synthetic
ctcatggctttggagcgagggcgaaggcgcggtcttctaccgcgtcgacctgcatttcaccaacctgggcacccc

SEQ ID NO: 314739 - DNA, 75 bp, Artificial Sequence
  Synthetic
ccagggacaccgaggactgccacgccgctcaggggaaagccggccttgagatccgggcatgggccaaggagtggg

SEQ ID NO: 314740 - DNA, 75 bp, Artificial Sequence
  Synthetic
tcccagaccccggccccgaagccatcgcgggccccgccgcaacagccccaacccccgcgtatgcaaaccgggcgt

SEQ ID NO: 314741 - DNA, 75 bp, Artificial Sequence
  Synthetic
cgaagcccgcactcatgaggacttcgccgcgctgagccagcggtggagcgcgagccacgccgatgcctcccctga

SEQ ID NO: 314742 - DNA, 75 bp, Artificial Sequence
  Synthetic
tggggccaccgaccaacccgttccaggcagccgtggcgcgcggcctgcgcccgcccctccacgaccctgacgtcg

SEQ ID NO: 314743 - DNA, 75 bp, Artificial Sequence
  Synthetic
ggcgacgtcaggggcgtttggggtaaaggcgagcgcacctacgccgagcaggatttccgcgtcggcggcacgcgc

SEQ ID NO: 314744 - DNA, 75 bp, Artificial Sequence
  Synthetic
cgcattgagacccgctcggcgcgccatccttggcgcatccgcttcggtgccccccaggccttcctcgccgggctc

SEQ ID NO: 314745 - DNA, 75 bp, Artificial Sequence
  Synthetic
gcacgtcggcaccgcggccggcctcttccatgatgtcatgcaccaggcaatcaaggtgctttgccgccgtttcga

SEQ ID NO: 314746 - DNA, 75 bp, Artificial Sequence
  Synthetic
aaccccaccggccacttcgtctgcgcggtcggcggcggcccacgccgcgtctcggaccgcccccacctttggctc

SEQ ID NO: 314747 - DNA, 75 bp, Artificial Sequence
  Synthetic
ttgctcgccgcggtcgccgttggcaccgcgcgcgccgggctccagccccgcgttgatatggcggcaccccctacg

SEQ ID NO: 314748 - DNA, 75 bp, Artificial Sequence
  Synthetic
ccgccgcagcccccccgtgcgcacgggcagcattacggtcaccaccaccatcagctgccgttcctcgggcacgac

SEQ ID NO: 314749 - DNA, 75 bp, Artificial Sequence
  Synthetic
cgcaccggggatcctaggcagaaccgtaacttaaacttctggcagtcatgcaagaccccctcttaggaaccctgt

SEQ ID NO: 314750 - DNA, 75 bp, Artificial Sequence
  Synthetic
cattaaagtcaggaactcttattaaataacacagcttttcccagagctctaaatcataccttttaagaacactgc

SEQ ID NO: 314751 - DNA, 75 bp, Artificial Sequence
  Synthetic
ctgaattaaaggatttggttagaaaaaccataccagatgtaattgagcttgcatatcaaaaggacgcattacttt

SEQ ID NO: 314752 - DNA, 75 bp, Artificial Sequence
  Synthetic
tacaaattgaaagccacttttcattggtggtcagtttttgcctgatcaacttattagcagtgaggatgtccaaca

SEQ ID NO: 314753 - DNA, 75 bp, Artificial Sequence
  Synthetic
cacaagtgcatccaagatcagtgttaattgaggggtttaaacttttatctttgttggtggagttggagtcctgta

SEQ ID NO: 314754 - DNA, 75 bp, Artificial Sequence
  Synthetic
cccgatcattgacaagtaatatcatttgtccaactattaatcctgcattctttaggttcctgataactgtgctat

SEQ ID NO: 314755 - DNA, 75 bp, Artificial Sequence
  Synthetic
aggtaaatgcatgccatcataattacgaacaaaaatttatagatgtgattctttccgatggtggcattctctgtc

SEQ ID NO: 314756 - DNA, 75 bp, Artificial Sequence
  Synthetic
cttttaccatctcatcaacaacgaagttcaacatgattaagtctaaaaacaatagtgtgttcctcctggtattaa

SEQ ID NO: 314757 - DNA, 75 bp, Artificial Sequence
  Synthetic
caactctgcctaaggtggtgccagatggttacaacctgatgggaaagactctcatcttgttggagacttttgtta

SEQ ID NO: 314758 - DNA, 75 bp, Artificial Sequence
  Synthetic
agatctttgaacctttaatcttattgcacatggacaacacattcaggtaagattgcactgatgagtgtaaagttt

SEQ ID NO: 314759 - DNA, 75 bp, Artificial Sequence
  Synthetic
gagtaaatccagacgactttgaaaagaaatggaaggctgatatgagcaaattaatctctctaaaaacagacctag

SEQ ID NO: 314760 - DNA, 75 bp, Artificial Sequence
  Synthetic
tagtcccatcaaggttcagcccccttgtgagcacatcctcatgcatcttgactgataatttgaaacacaactcca

SEQ ID NO: 314761 - DNA, 75 bp, Artificial Sequence
  Synthetic
gcaagataggtgttacattagtccccgttgtagatggccgcagcaattacaataccagcttcgtgtctgattgga

SEQ ID NO: 314762 - DNA, 75 bp, Artificial Sequence
  Synthetic
aaattctagaggaacaaaaggcacagtctaggctatcattctcctcatgggagcctaatgtgattaactgagaca

SEQ ID NO: 314763 - DNA, 75 bp, Artificial Sequence
  Synthetic
ccacagaaaggttgaggtggttgttaatagaggtgttgaaaggtatgaagactacttcagaactagaaattgaag

SEQ ID NO: 314764 - DNA, 75 bp, Artificial Sequence
  Synthetic
gcaggacctttttgtctgttttcacaaactttcccaaacctttctcataaacttcacttttgtaccaaattttca

SEQ ID NO: 314765 - DNA, 75 bp, Artificial Sequence
  Synthetic
aacaagaatatcatagattaatccatagtttggccaagaccaacaatcaaagccttggttttgaaaatcttgaat

SEQ ID NO: 314766 - DNA, 75 bp, Artificial Sequence
  Synthetic
atcttataagctcctccatcacttttgattctttcacatcattcttaactccaactaacaatgaggaatccagca

SEQ ID NO: 314767 - DNA, 75 bp, Artificial Sequence
  Synthetic
gtctcaagaggaatatgttatcctatgatcagttgctggattcctcattgttagttggagttaagaatgatgtga

SEQ ID NO: 314768 - DNA, 75 bp, Artificial Sequence
  Synthetic
actgatcataggataacatattcctcttgagacattcaagattttcaaaaccaaggctttgattgttggtcttgg

SEQ ID NO: 314769 - DNA, 75 bp, Artificial Sequence
  Synthetic
aagaatcaaaagtgatggaggagcttataagattgaaaatttggtacaaaagtgaagtttatgagaaaggtttgg

SEQ ID NO: 314770 - DNA, 75 bp, Artificial Sequence
  Synthetic
ccaaactatggattaatctatgatattcttgttcttcaatttctagttctgaagtagtcttcatacctttcaaca

SEQ ID NO: 314771 - DNA, 75 bp, Artificial Sequence
  Synthetic
gaaagtttgtgaaaacagacaaaaaggtcctgctgtctcagttaatcacattaggctcccatgaggagaatgata

SEQ ID NO: 314772 - DNA, 75 bp, Artificial Sequence
  Synthetic
cctctattaacaaccacctcaacctttctgtggtccaatcagacacgaagctggtattgtaattgctgcggccat

SEQ ID NO: 314773 - DNA, 75 bp, Artificial Sequence
  Synthetic
gcctagactgtgccttttgttcctctagaattttggagttgtgtttcaaattatcagtcaagatgcatgaggatg

SEQ ID NO: 314774 - DNA, 75 bp, Artificial Sequence
  Synthetic
ctacaacggggactaatgtaacacctatcttgcctaggtctgtttttagagagattaatttgctcatatcagcct

SEQ ID NO: 314775 - DNA, 75 bp, Artificial Sequence
  Synthetic
tgctcacaagggggctgaaccttgatgggactaaaactttacactcatcagtgcaatcttacctgaatgtgttgt

SEQ ID NO: 314776 - DNA, 75 bp, Artificial Sequence
  Synthetic
tccatttcttttcaaagtcgtctggatttactctaacaaaagtctccaacaagatgagagtctttcccatcaggt

SEQ ID NO: 314777 - DNA, 75 bp, Artificial Sequence
  Synthetic
ccatgtgcaataagattaaaggttcaaagatctttaataccaggaggaacacactattgtttttagacttaatca

SEQ ID NO: 314778 - DNA, 75 bp, Artificial Sequence
  Synthetic
tgtaaccatctggcaccaccttaggcagagttggacagagaatgccaccatcggaaagaatcacatctataaatt

SEQ ID NO: 314779 - DNA, 75 bp, Artificial Sequence
  Synthetic
tgttgaacttcgttgttgatgagatggtaaaagatagcacagttatcaggaacctaaagaatgcaggattaatag

SEQ ID NO: 314780 - DNA, 75 bp, Artificial Sequence
  Synthetic
tttgttcgtaattatgatggcatgcatttaccttacaggactccaactccaccaacaaagataaaagtttaaacc

SEQ ID NO: 314781 - DNA, 75 bp, Artificial Sequence
  Synthetic
ttggacaaatgatattacttgtcaatgatcgggtgttggacatcctcactgctaataagttgatcaggcaaaaac

SEQ ID NO: 314782 - DNA, 75 bp, Artificial Sequence
  Synthetic
cctcaattaacactgatcttggatgcacttgtgaaagtaatgcgtccttttgatatgcaagctcaattacatctg

SEQ ID NO: 314783 - DNA, 75 bp, Artificial Sequence
  Synthetic
tgaccaccaatgaaaagtggctttcaatttgtagcagtgttcttaaaaggtatgatttagagctctgggaaaagc

SEQ ID NO: 314784 - DNA, 75 bp, Artificial Sequence
  Synthetic
gtatggtttttctaaccaaatcctttaattcagacagggttcctaagagggggtcttgcatgactgccagaagtt

SEQ ID NO: 314785 - DNA, 75 bp, Artificial Sequence
  Synthetic
tgtgttatttaataagagttcctgactttaatgaacttttccaactcgcaaaggagttagtctcagacaggccta

SEQ ID NO: 314786 - DNA, 75 bp, Artificial Sequence
  Synthetic
taattcagacagggttcctaagagggggtcttgcatgactgccagaagtttaagttacggttctgcctaggatcc

SEQ ID NO: 314787 - DNA, 75 bp, Artificial Sequence
  Synthetic
ccggtccggggatcctaggcgttttttagtcacgcttaaatctttgattgcgtcaatcatgggtcaattgttcag

SEQ ID NO: 314788 - DNA, 75 bp, Artificial Sequence
  Synthetic
ttagtcacgcttaaatctttgattgcgtcaatcatgggtcaattgttcagcttttttgaagaagttccgaatatc

SEQ ID NO: 314789 - DNA, 75 bp, Artificial Sequence
  Synthetic
tgatgaggtattctgttcacaaagcagaggaacgacaatgttgccataaagcaatggagaacttcactgacgatg

SEQ ID NO: 314790 - DNA, 75 bp, Artificial Sequence
  Synthetic
acagggttcctaagagggggtcttgcatgactgccagaagtttaagttacggttctgcctaggatcctcggtgcg

SEQ ID NO: 314791 - DNA, 75 bp, Artificial Sequence
  Synthetic
atccatgaggctatcaacatagctctgatagcagtgagcttaattgctgccttgaaagggatgattaacttgtgg

SEQ ID NO: 314792 - DNA, 75 bp, Artificial Sequence
  Synthetic
acttcaagataatgttaaaggccttgtctcatctttcattaggcttgatcaattcaatgaagacatcattttcct

SEQ ID NO: 314793 - DNA, 75 bp, Artificial Sequence
  Synthetic
aagagtggccttttccaattgatattctttttgactctagcaggaagatcgtgttcttttagaattggaaggagc

SEQ ID NO: 314794 - DNA, 75 bp, Artificial Sequence
  Synthetic
ctcggttacttattaatgagagagattattcacgatattttggtaatgtgagacttagggaatgttatatccaac

SEQ ID NO: 314795 - DNA, 75 bp, Artificial Sequence
  Synthetic
acagaattgcaaaacataacgtttgatatgttgaaggtattcgaggaccaccccacatcttgcatggtgaatcat

SEQ ID NO: 314796 - DNA, 75 bp, Artificial Sequence
  Synthetic
gattccctatcacaaacaacataataggtttactgttttaccaaaagacaggagaaagatctagatgttactcac

SEQ ID NO: 314797 - DNA, 75 bp, Artificial Sequence
  Synthetic
tccacctactatgtccatgaaaacaaaaatgccacttggtgtcttgaggtgtctgtgactgatgttaccctgctc

SEQ ID NO: 314798 - DNA, 75 bp, Artificial Sequence
  Synthetic
tttatattgcagaaaatggtgagttgactgagatcggatctttttactgtgatcctaaaagatactttgtgccta

SEQ ID NO: 314799 - DNA, 75 bp, Artificial Sequence
  Synthetic
atggctgaacatgatcgtcaagtcctcaacaatctgtcaaactgtgtgcaccctgcagttgagcacagaagcagg

SEQ ID NO: 314800 - DNA, 75 bp, Artificial Sequence
  Synthetic
ttttttctgaagctgtgatcacatcaatgtgtgaagaaatgatcaactggttgaactttgattcagagttggtga

SEQ ID NO: 314801 - DNA, 75 bp, Artificial Sequence
  Synthetic
atggttggcttacttgagtggatttttagagccctaaagtatgacttcaatcatgatccaacaccgttgtgtcaa

SEQ ID NO: 314802 - DNA, 75 bp, Artificial Sequence
  Synthetic
gaatagtatccactcaattaaaaacactcatgttactactgctctgttctccttcgaagagaaatcagacattcc

SEQ ID NO: 314803 - DNA, 75 bp, Artificial Sequence
  Synthetic
aagcaaacttcaacagtgaatgaaacacgtgtgcagataaacatcactgaggggtttgggtctcacgggtttgaa

SEQ ID NO: 314804 - DNA, 75 bp, Artificial Sequence
  Synthetic
ttcaaggtttgaggtattttataatggcatatgtcaaccaagcacaccacattgaccttatgtctaagttggcag

SEQ ID NO: 314805 - DNA, 75 bp, Artificial Sequence
  Synthetic
gataccatccttcaaagactaggggttctattcggttcaagaattgcattttcaaatatccaggatttaggtaaa

SEQ ID NO: 314806 - DNA, 75 bp, Artificial Sequence
  Synthetic
ttgagtgtaagtctagctcagaaatccaattgcaaagattatgtgtcagattgtttgtttcgattttatctggtg

SEQ ID NO: 314807 - DNA, 75 bp, Artificial Sequence
  Synthetic
aaaaggtttttattgattagaaattcaacttggaaaaatcaatgcgaaatgaatcatgtaaactccatgcattta

SEQ ID NO: 314808 - DNA, 75 bp, Artificial Sequence
  Synthetic
acaatgagatagaatatgggttcacaagaagattcaagtttctactgaacattagttacctttgccactttatta

SEQ ID NO: 314809 - DNA, 75 bp, Artificial Sequence
  Synthetic
atgttggcgaatgctggtcgctcttctggttctagaagaccactcggcattttctcctggacaataactgatgca

SEQ ID NO: 314810 - DNA, 75 bp, Artificial Sequence
  Synthetic
caaaagaaactccagataggctaacagatcaaattaaatgttttgagaaattcttggaacccaaattgaaattta

SEQ ID NO: 314811 - DNA, 75 bp, Artificial Sequence
  Synthetic
gtgggcaatgacatgcctggtggttattgtcttgaaagatggatgctagtgacgtcagatcttaagtgctttgga

SEQ ID NO: 314812 - DNA, 75 bp, Artificial Sequence
  Synthetic
atagtgtcattgtgaatccgtcattgaacggaaccttgacagaatctcaggagcaccaaatgatttctagtattg

SEQ ID NO: 314813 - DNA, 75 bp, Artificial Sequence
  Synthetic
aacacagcactagcaaaatgtaaccttgaccacgattcggaattctgtgacatgttgaaattgtttgagttcaac

SEQ ID NO: 314814 - DNA, 75 bp, Artificial Sequence
  Synthetic
atagattcttttccaaagagttgcttgatcaatctgatgtgaaggagcctggtgtctctagagaactacttggat

SEQ ID NO: 314815 - DNA, 75 bp, Artificial Sequence
  Synthetic
aaaaaagcgatagagacattgaatgacaatacaaaaaacaaggtaaacttgctgacccactcaattaatgcatta

SEQ ID NO: 314816 - DNA, 75 bp, Artificial Sequence
  Synthetic
actgtgtttcattgttcaatagaggcaaattgagagtgtcaggggatttgaaagtagatccctttcgtcctactt

SEQ ID NO: 314817 - DNA, 75 bp, Artificial Sequence
  Synthetic
atatctgacaacttactgatgaagaatcgacttaaagaattgttgaacactccttattgtaattacaccaaattt

SEQ ID NO: 314818 - DNA, 75 bp, Artificial Sequence
  Synthetic
tcacaagtactgctttagacatctcgagcaataaaagtgttgttgtcccaaaattagatgaacttggaaatattg

SEQ ID NO: 314819 - DNA, 75 bp, Artificial Sequence
  Synthetic
tggtatgtcaatcacacagcatcaggggaacactcattgccacggtgctggcttgttagaaataatagctacttg

SEQ ID NO: 314820 - DNA, 75 bp, Artificial Sequence
  Synthetic
tagataaatataataaacagttaatggtatcatcatgtgtcacatcacttgtagaaatgtttaagaccaaaggta

SEQ ID NO: 314821 - DNA, 75 bp, Artificial Sequence
  Synthetic
aatgaaagtgaatttagaaatgattggattattgagagtgatcatttattgtctgaaatgctcaataaagaatac

SEQ ID NO: 314822 - DNA, 75 bp, Artificial Sequence
  Synthetic
ggtacaatttagatcctgattctattgatttccttgtgttaaaaaacctcacaaacttggtaagtgcaaatgtac

SEQ ID NO: 314823 - DNA, 75 bp, Artificial Sequence
  Synthetic
atagatagacagggaaagacaccgttgactttggtggatatctgtttctggagcactttgtttttcacaacaaca

SEQ ID NO: 314824 - DNA, 75 bp, Artificial Sequence
  Synthetic
ctcaagaaaagtctcaagaagaattgtcaacattgtatgaagcactgactgaggaccaaatttctgcattcgaac

SEQ ID NO: 314825 - DNA, 75 bp, Artificial Sequence
  Synthetic
ctgtttcttcacctggtaggctttccaactcatagacacatacgtggtgaaccctgcccactaccccataggctc

SEQ ID NO: 314826 - DNA, 75 bp, Artificial Sequence
  Synthetic
aggtgagggatgaagtacagttagcattacacaaaatgaaaagttcagatgctagagaagaaaggttgcaggatc

SEQ ID NO: 314827 - DNA, 75 bp, Artificial Sequence
  Synthetic
aacagtagaggaggatgtagatgtgggaaataccctgaactaaaaaagccaatcacctggcacaagaaccactag

SEQ ID NO: 314828 - DNA, 75 bp, Artificial Sequence
  Synthetic
caaaaagaaatgagaagaatgcttcaaaagggaagatactggaatctctttggtcacctcatcaggtaaacagag

SEQ ID NO: 314829 - DNA, 75 bp, Artificial Sequence
  Synthetic
aaggacaatcattgtctcccaccgacccgggcaatgcccgggtcggtgtggccccccagtccgcggcaaatgccg

SEQ ID NO: 314830 - DNA, 75 bp, Artificial Sequence
  Synthetic
ccataaaaaatgaggcctcaatccatgaaattaaagattttgatcctgacattttagatagtcatcttgttgaaa

SEQ ID NO: 314831 - DNA, 75 bp, Artificial Sequence
  Synthetic
cggactggggagcaccaatctagatggtgaatgctgcctccagtgtgaagagcaatgcatcaggcaataaacctt

SEQ ID NO: 314832 - DNA, 75 bp, Artificial Sequence
  Synthetic
aactttgtcatgaggtgtataattcatcacaaaagtcactgtttttccttgatgaaccgttaaaatctgttccat

SEQ ID NO: 314833 - DNA, 75 bp, Artificial Sequence
  Synthetic
ccagtttggtttgaggtggttggcctgctatggctgactgaaacattagacaatcaagtagggcacagtgtggct

SEQ ID NO: 314834 - DNA, 75 bp, Artificial Sequence
  Synthetic
tggaaatgttgttgatcaatttaactaccatagcctatgaagaggaagagttctttgagtgttttaagtacctat

SEQ ID NO: 314835 - DNA, 75 bp, Artificial Sequence
  Synthetic
ctgaggactgtgggatgtctttgtctttctttttctttggcacaataactccattgtgtttcttacagaggtgac

SEQ ID NO: 314836 - DNA, 75 bp, Artificial Sequence
  Synthetic
taatacaaggagactttgatcaaaagctaggtacatatgaacacaagagtagatcaagattagggctgagttcag

SEQ ID NO: 314837 - DNA, 75 bp, Artificial Sequence
  Synthetic
tttctttttctttggcacaataactccattgtgtttcttacagaggtgaccaaaatctgaccagatttgctcctc

SEQ ID NO: 314838 - DNA, 75 bp, Artificial Sequence
  Synthetic
aggcacttaaggtacaagagaatgcaagagttagcacaagagaaagcaatgctgaggcaatagcaaaaaaacttg

SEQ ID NO: 314839 - DNA, 75 bp, Artificial Sequence
  Synthetic
aaactttctcgcctgttcagatgccaatttaatgtcgacaatctttaagtctttgcgaccgtgtgtatctactaa

SEQ ID NO: 314840 - DNA, 75 bp, Artificial Sequence
  Synthetic
atagaactttctttacaagtgcagctttacgaaatctttgcttttactcagaagattccccaactgaattcacta

SEQ ID NO: 314841 - DNA, 75 bp, Artificial Sequence
  Synthetic
gcgccttatatcatctgaaccttgggtggtgaggaccatgttttgaggaaggagccctataacatagctgagcaa

SEQ ID NO: 314842 - DNA, 75 bp, Artificial Sequence
  Synthetic
gtgtaagcaccaacactggcaatctgaaatttgggttaagttataaagaacaggttgggtctaacagggagcttt

SEQ ID NO: 314843 - DNA, 75 bp, Artificial Sequence
  Synthetic
gcctggctgtgcagattctaggtcctttagcaacatcccatgtgaatgcctgctaccatttttgaaccccttctc

SEQ ID NO: 314844 - DNA, 75 bp, Artificial Sequence
  Synthetic
atgtgggagatcttaacactaagcttatgactagattggtagaggatttctcagaagtggtcacaggatcaatga

SEQ ID NO: 314845 - DNA, 75 bp, Artificial Sequence
  Synthetic
atcatgtggtttcctataacagaggatataattacctgtgtctggttggtacaatgctaattcaaccggatcatt

SEQ ID NO: 314846 - DNA, 75 bp, Artificial Sequence
  Synthetic
ggttctcttgtttgaattctgagaaggaatttgaaagggcaatttgtgatatgaaaatggcagtaaacaatggtg

SEQ ID NO: 314847 - DNA, 75 bp, Artificial Sequence
  Synthetic
actggtaccctcaatgtcaatccatgttgtcagagttgggtcaatcttacccattgcctctctcacaactgactc

SEQ ID NO: 314848 - DNA, 75 bp, Artificial Sequence
  Synthetic
actttagtctttccatggaccactcaaagtggggaccccacatgagccctgctctgttttttacatttttagcca

SEQ ID NO: 314849 - DNA, 75 bp, Artificial Sequence
  Synthetic
ttgcaactcagtcaagtgggagagtctaatgttctgacctgccttttctggtgttctcggcccttgttggggctt

SEQ ID NO: 314850 - DNA, 75 bp, Artificial Sequence
  Synthetic
atttgaatcttactgagcccaagagtagaacaaggctgaaccttgatcctttacttaatatactgaagtggcact

SEQ ID NO: 314851 - DNA, 75 bp, Artificial Sequence
  Synthetic
tgtgcttaaatcaacagtggtgttttcccatgacctacccttgatctgggatctggagccaatgtaaggccaacc

SEQ ID NO: 314852 - DNA, 75 bp, Artificial Sequence
  Synthetic
tacacaaaacagtagaggttccttttaatgttgcacaggcttactgtatagggaagcttaaaagaagtcttgggt

SEQ ID NO: 314853 - DNA, 75 bp, Artificial Sequence
  Synthetic
ttctcctgaaaggcagattttgtacagaaggttttcataagggtttctatttccaggtttctcatctacaaacat

SEQ ID NO: 314854 - DNA, 75 bp, Artificial Sequence
  Synthetic
tgatggaatgtcagtgttcaagtctcacagaggaattttatcatagctaccttcagattcaagatgaaatcccaa

SEQ ID NO: 314855 - DNA, 75 bp, Artificial Sequence
  Synthetic
gccttcctttttctttatggatagggttgtctttatgatctgagaaaagttgtcaggagtgatccttatggtttc

SEQ ID NO: 314856 - DNA, 75 bp, Artificial Sequence
  Synthetic
gtcatataatgtctgtacttgacatgggccaaggcatattacacaatttgtcagacttgtatgcattaataactg

SEQ ID NO: 314857 - DNA, 75 bp, Artificial Sequence
  Synthetic
cagcatgttaccaccatccagaagcgttgcaccagctttaacagctgcagaaagactatagttatatcctgagat

SEQ ID NO: 314858 - DNA, 75 bp, Artificial Sequence
  Synthetic
aacaattccttaattatgtaatacacaaactgtttgatattgatgtcacttcttacacatctagtgatgaccaaa

SEQ ID NO: 314859 - DNA, 75 bp, Artificial Sequence
  Synthetic
gttcaagccgctctcatctttagtcactatttgaagacagtcatgttctgctgtaagtttttctaggtcaatcag

SEQ ID NO: 314860 - DNA, 75 bp, Artificial Sequence
  Synthetic
tttcaatcatgaaattgccactgagtacaaaagaaaatgatgaagattttgactggttggaaatcatctgtttcc

SEQ ID NO: 314861 - DNA, 75 bp, Artificial Sequence
  Synthetic
gttggggaacttaactgtataaagaagtcccaaagatgttagtgcctgaacaacatcccccatggtattgtcact

SEQ ID NO: 314862 - DNA, 75 bp, Artificial Sequence
  Synthetic
atgagtacctatcttcaaaattgaacaaatttgtaagtccaaagagtgtggtggggaattttgttgctgagttca

SEQ ID NO: 314863 - DNA, 75 bp, Artificial Sequence
  Synthetic
ttgtttagtcatacaagcgattgtcagtgcagggacagatccaaattgattattcagcctgttcggatcagctac

SEQ ID NO: 314864 - DNA, 75 bp, Artificial Sequence
  Synthetic
aatcgagattttttgtaatgggtgaggaaactcccttgttgaccaagtttgtggccgcagcattacataatgtga

SEQ ID NO: 314865 - DNA, 75 bp, Artificial Sequence
  Synthetic
gtcccaaatccttacaacccctggagacctcacttgctgctgttgaaaaccaagtttccttaaaagatcagacct

SEQ ID NO: 314866 - DNA, 75 bp, Artificial Sequence
  Synthetic
agtgtaaaacaccaactcaattagcagagactattgataccatttgtgatcagtgtgtggccaatggtgtaggag

SEQ ID NO: 314867 - DNA, 75 bp, Artificial Sequence
  Synthetic
tttggtgagctgtgattgggaaaggtttcccaggtacacacctcctgaggctgatctttctgtttgtccaacttt

SEQ ID NO: 314868 - DNA, 75 bp, Artificial Sequence
  Synthetic
tggatattgtctcaagaatatcagagagggtgaatcgattgattagctattctggctataaagagacgcctttcc

SEQ ID NO: 314869 - DNA, 75 bp, Artificial Sequence
  Synthetic
tcttttcagtttctccaggtctgatgcaagatccatcagttcagatttgttgagatcaccaagttttaagattgt

SEQ ID NO: 314870 - DNA, 75 bp, Artificial Sequence
  Synthetic
tgaccattgtcaaccaagatgtcaaagattggacagatggatcgaggggttatcgtctccagagaaatatagaga

SEQ ID NO: 314871 - DNA, 75 bp, Artificial Sequence
  Synthetic
gtctctttgggaactcttcatgctcatcaggttgtccacttctttatttaggtctctcagtttatcaagatctcc

SEQ ID NO: 314872 - DNA, 75 bp, Artificial Sequence
  Synthetic
attcttttggcaatcaggaactgcttcgtttgataaggaggggggcaagaaaagtatttttggaaataaagaagg

SEQ ID NO: 314873 - DNA, 75 bp, Artificial Sequence
  Synthetic
atcattccttttagactttctaaggatcctttgaacaagagagacttgattgaaatcaagaccatcaagtatcat

SEQ ID NO: 314874 - DNA, 75 bp, Artificial Sequence
  Synthetic
gtcatgtgtttgaagaaaatttgattggtttgattggcagggggggtgatgaagctttaagagggtttttattgt

SEQ ID NO: 314875 - DNA, 75 bp, Artificial Sequence
  Synthetic
tttggcatccctcagaacatcggtcttcaccggtgttgtgaactcactgagccctcttctcagggattgagtcca

SEQ ID NO: 314876 - DNA, 75 bp, Artificial Sequence
  Synthetic
atgcaggatttgctgaaaatgacattgttgaggctttaaggcataaatggttgaatccgtccacttttggagatt

SEQ ID NO: 314877 - DNA, 75 bp, Artificial Sequence
  Synthetic
tctgaagctggggatttcctttgagttgctcattgtggaaaagacttgctgaccagtaaaggtagacaatttgcc

SEQ ID NO: 314878 - DNA, 75 bp, Artificial Sequence
  Synthetic
tcctttgagttgctcattgtggaaaagacttgctgaccagtaaaggtagacaatttgcctaggatccactgtgcg

SEQ ID NO: 314879 - DNA, 75 bp, Artificial Sequence
  Synthetic
tgagactggttttaaggacaaaaattatgtctagtaaaagaatcttggaaagagaaagtgtaccaagtctgataa

SEQ ID NO: 314880 - DNA, 75 bp, Artificial Sequence
  Synthetic
gcgcaccggggatcctaggcgttttttagtcacgcttaaatctttgattgcgtcaatcatgggtcaattgttcag

SEQ ID NO: 314881 - DNA, 75 bp, Artificial Sequence
  Synthetic
tttctttttctttggcacaataactccattgtgtttcttacagaggtgaccaaaatctgaccagattggctcctc

SEQ ID NO: 314882 - DNA, 75 bp, Artificial Sequence
  Synthetic
agacactacaatccagaatgtcaaagaactttataaagggggcaaaaaagattttagcagaatcaataaataagt

SEQ ID NO: 314883 - DNA, 75 bp, Artificial Sequence
  Synthetic
gcgcacagtggatcctaggcattgctttcacgctttgaggtgaaccacctcactggagcaccagatttcatctaa

SEQ ID NO: 314884 - DNA, 75 bp, Artificial Sequence
  Synthetic
acagtttgtgtattacataattaaggaattgttcagttattaatgcatacaagtctgacaaattgtgtaggatgc

SEQ ID NO: 314885 - DNA, 75 bp, Artificial Sequence
  Synthetic
cagcatttcagtcatctgtggcctcaggtttcatagggttctgtaaaagtatgggtagtaaatgtgtgagagacg

SEQ ID NO: 314886 - DNA, 75 bp, Artificial Sequence
  Synthetic
acagggttcctaagagggggtcttgcatgactgccagaagtttaagttacggttctgcctaggatccactgtgcg

SEQ ID NO: 314887 - DNA, 75 bp, Artificial Sequence
  Synthetic
gcaaaggaggttttatgtatctgaaagaattgtacaataatgtgaataagtgtggatgctgtatatgtttggaat

SEQ ID NO: 314888 - DNA, 75 bp, Artificial Sequence
  Synthetic
ggccaggtgttgtttactgtcaggattctctagcaaaaatttcacaatttgcaagatctattttatgggattact

SEQ ID NO: 314889 - DNA, 75 bp, Artificial Sequence
  Synthetic
tcacattagttctcactaacgcatgtgaaatcggagaatgggttttctctgatgtgaaatctccttctgcacctc

SEQ ID NO: 314890 - DNA, 75 bp, Artificial Sequence
  Synthetic
ctattttaagtaatccaaatctcttttgggctgtcaagcccaagattcaaaaacatattgaagatagactaagtc

SEQ ID NO: 314891 - DNA, 75 bp, Artificial Sequence
  Synthetic
taaatcatattttacactctattaaaaggaactatccctatttatttgaagaacatctagcaccgtttatgagtg

SEQ ID NO: 314892 - DNA, 75 bp, Artificial Sequence
  Synthetic
atttgcaattcaatcagatgatgaacccatcacatgtcaaattcctggatgtatgtatagcattggatatgatga

SEQ ID NO: 314893 - DNA, 75 bp, Artificial Sequence
  Synthetic
atgagaatctaggcataataggtcatcttttgcgtggtagaaatcatttcatatacatagttaaacagagtgagt

SEQ ID NO: 314894 - DNA, 75 bp, Artificial Sequence
  Synthetic
gtgcttctgcacacataaggcaatctgactatgtggaccatgagcttggtttaagtcctcagcaagtttgctaca

SEQ ID NO: 314895 - DNA, 75 bp, Artificial Sequence
  Synthetic
attttaaagttcaatttttgttttcttcgatgattgatcccctcatagtttctacgtcaacattaaagacatttt

SEQ ID NO: 314896 - DNA, 75 bp, Artificial Sequence
  Synthetic
tctggtttaatgaggttttaagtatagaggaagaagatcagatagatttgggagaattgactgacttcacattgt

SEQ ID NO: 314897 - DNA, 75 bp, Artificial Sequence
  Synthetic
ttataaaaacagggcatctgaatagggccatgacagctgatgacataacaatgggttatgtgtgttccaacctcg

SEQ ID NO: 314898 - DNA, 75 bp, Artificial Sequence
  Synthetic
cagaagaaataatcacactgaattcctatggatcattccaagaattcagatcaaatcatccatccaagaatgatt

SEQ ID NO: 314899 - DNA, 75 bp, Artificial Sequence
  Synthetic
tatcagacatcttaaagactctcactagtgaatcaataaaactcacattagacatacaaattgtccatatgagaa

SEQ ID NO: 314900 - DNA, 75 bp, Artificial Sequence
  Synthetic
attctactaagtacaacattagtaggaagattgtttatactcttaaggcactctgtgctctaccacttgaggact

SEQ ID NO: 314901 - DNA, 75 bp, Artificial Sequence
  Synthetic
gcttcactaaagacccagtggctttggtggaatccttggagttgtttgcttctggtgtaaatggaggacacctgc

SEQ ID NO: 314902 - DNA, 75 bp, Artificial Sequence
  Synthetic
agttggatggtgtaaccatggtttcagttttgcctttgctgagagggaagaaggcagtgaatttagctcagattc

SEQ ID NO: 314903 - DNA, 75 bp, Artificial Sequence
  Synthetic
taatggataacgatttagctgcgaccaatgatcacaatgtgatggaatctgtaacacttgatttcaccaaatttc

SEQ ID NO: 314904 - DNA, 75 bp, Artificial Sequence
  Synthetic
atgatgaactaggtgacaaattctgctactcattagttggtcctgaggaccagggcaatccaattgtcctccaca

SEQ ID NO: 314905 - DNA, 75 bp, Artificial Sequence
  Synthetic
acggcatgtttatgattgataatcagaagttgtcttacttaaaggtggagatttttggtgacaccataattaagg

SEQ ID NO: 314906 - DNA, 75 bp, Artificial Sequence
  Synthetic
cacttggggcactggacagccccagggagattgggagtcttctacatgggctctggccttatctgaaggctacca

SEQ ID NO: 314907 - DNA, 75 bp, Artificial Sequence
  Synthetic
agcaaatcattaattttgatcaaacagactttgaaatgatttatgatcttcacagagttgttttgttggaatcaa

SEQ ID NO: 314908 - DNA, 75 bp, Artificial Sequence
  Synthetic
ttgctcagtttggagattgggttgaatttgccagttttaaggttgcattcagcaaacattacaaagacattgttg

SEQ ID NO: 314909 - DNA, 75 bp, Artificial Sequence
  Synthetic
ttgctgataatctaggaaacttaaggctcaagggtgttacctgcagactatttagacagcagcagtccgttgaag

SEQ ID NO: 314910 - DNA, 75 bp, Artificial Sequence
  Synthetic
acattgagtaaaccacaccaccccggggactccccgcggggggcccctgtggggccccccgggggtgtacccgga

SEQ ID NO: 314911 - DNA, 75 bp, Artificial Sequence
  Synthetic
cacgatttagtcttctggaggtggagcacttggttcgatgggcaccacaatggatgtggggagctcttcaccaca

SEQ ID NO: 314912 - DNA, 75 bp, Artificial Sequence
  Synthetic
aatgtcacaaaaagaagacttccccaacattatgttcaaacattttagacaaatataatggtcggaacattttat

SEQ ID NO: 314913 - DNA, 75 bp, Artificial Sequence
  Synthetic
tagatttgtattggcgaaccagcagcacctgcagttgtgtcttccatacagactaggttcagcctgtctctttaa

SEQ ID NO: 314914 - DNA, 75 bp, Artificial Sequence
  Synthetic
aatggctacctgtttggtgctattgactgtttgctgttcatactggttagcagacagctttgattttgacttgga

SEQ ID NO: 314915 - DNA, 75 bp, Artificial Sequence
  Synthetic
gttacccattagatgaaatctggtgctccagtgaggtggttcacctcaaagcgtgaaagcaatgcctaggatccc

SEQ ID NO: 314916 - DNA, 75 bp, Artificial Sequence
  Synthetic
attagatgaaatctggtgctccagtgaggtggttcacctcaaagcgtgaaagcaatgcctaggatccccggtgcg

SEQ ID NO: 314917 - DNA, 75 bp, Artificial Sequence
  Synthetic
gcgcaccggggatcctaggcattgctttcacgctttgaggtgaaccacctcactggagcaccagatttcatctaa

SEQ ID NO: 314918 - DNA, 75 bp, Artificial Sequence
  Synthetic
tttcacgctttgaggtgaaccacctcactggagcaccagatttcatctaatgggtaactccaagtcaaaatcaaa

SEQ ID NO: 314919 - DNA, 75 bp, Artificial Sequence
  Synthetic
gctgtctgctaaccagtatgaacagcaaacagtcaatagcaccaaacaggtagccattttaaagagacaggctga

SEQ ID NO: 314920 - DNA, 75 bp, Artificial Sequence
  Synthetic
acctagtctgtatggaagacacaactgcaggtgctgctggttcgccaatacaaatctaataaaatgttccgacca

SEQ ID NO: 314921 - DNA, 75 bp, Artificial Sequence
  Synthetic
ttatatttgtctaaaatgtttgaacataatgttggggaagtcttctttttgtgacatttgtggtgaagagctccc

SEQ ID NO: 314922 - DNA, 75 bp, Artificial Sequence
  Synthetic
cacatccattgtggtgcccatcgaaccaagtgctccacctccagaagactaaatcgtgtccgggtacacccccgg

SEQ ID NO: 314923 - DNA, 75 bp, Artificial Sequence
  Synthetic
ggggccccacaggggccccccgcggggagtccccggggtggtgtggtttactcaatgtcttcaacggactgctgc

SEQ ID NO: 314924 - DNA, 75 bp, Artificial Sequence
  Synthetic
tgtctaaatagtctgcaggtaacacccttgagccttaagtttcctagattatcagcaacaacaatgtctttgtaa

SEQ ID NO: 314925 - DNA, 75 bp, Artificial Sequence
  Synthetic
tgtttgctgaatgcaaccttaaaactggcaaattcaacccaatctccaaactgagcaattgattccaacaaaaca

SEQ ID NO: 314926 - DNA, 75 bp, Artificial Sequence
  Synthetic
actctgtgaagatcataaatcatttcaaagtctgtttgatcaaaattaatgatttgcttggtagccttcagataa

SEQ ID NO: 314927 - DNA, 75 bp, Artificial Sequence
  Synthetic
ggccagagcccatgtagaagactcccaatctccctggggctgtccagtgccccaagtgccttaattatggtgtca

SEQ ID NO: 314928 - DNA, 75 bp, Artificial Sequence
  Synthetic
ccaaaaatctccacctttaagtaagacaacttctgattatcaatcataaacatgccgttgtggaggacaattgga

SEQ ID NO: 314929 - DNA, 75 bp, Artificial Sequence
  Synthetic
ttgccctggtcctcaggaccaactaatgagtagcagaatttgtcacctagttcatcatgaaatttggtgaaatca

SEQ ID NO: 314930 - DNA, 75 bp, Artificial Sequence
  Synthetic
agtgttacagattccatcacattgtgatcattggtcgcagctaaatcgttatccattagaatctgagctaaattc

SEQ ID NO: 314931 - DNA, 75 bp, Artificial Sequence
  Synthetic
actgccttcttccctctcagcaaaggcaaaactgaaaccatggttacaccatccaactgcaggtgtcctccattt

SEQ ID NO: 314932 - DNA, 75 bp, Artificial Sequence
  Synthetic
acaccagaagcaaacaactccaaggattccaccaaagccactgggtctttagtgaagcagtcctcaagtggtaga

SEQ ID NO: 314933 - DNA, 75 bp, Artificial Sequence
  Synthetic
gcacagagtgccttaagagtataaacaatcttcctactaatgttgtacttagtagaatttctcatatggacaatt

SEQ ID NO: 314934 - DNA, 75 bp, Artificial Sequence
  Synthetic
tgtatgtctaatgtgagttttattgattcactagtgagagtctttaagatgtctgataaatcattcttggatgga

SEQ ID NO: 314935 - DNA, 75 bp, Artificial Sequence
  Synthetic
tgatttgatctgaattcttggaatgatccataggaattcagtgtgattatttcttctgcgaggttggaacacaca

SEQ ID NO: 314936 - DNA, 75 bp, Artificial Sequence
  Synthetic
taacccattgttatgtcatcagctgtcatggccctattcagatgccctgtttttataaacaatgtgaagtcagtc

SEQ ID NO: 314937 - DNA, 75 bp, Artificial Sequence
  Synthetic
aattctcccaaatctatctgatcttcttcctctatacttaaaacctcattaaaccagaaaaatgtctttaatgtt

SEQ ID NO: 314938 - DNA, 75 bp, Artificial Sequence
  Synthetic
gacgtagaaactatgaggggatcaatcatcgaagaaaacaaaaattgaactttaaaattgtagcaaacttgctga

SEQ ID NO: 314939 - DNA, 75 bp, Artificial Sequence
  Synthetic
ggacttaaaccaagctcatggtccacatagtcagattgccttatgtgtgcagaagcacactcactctgtttaact

SEQ ID NO: 314940 - DNA, 75 bp, Artificial Sequence
  Synthetic
atgtatatgaaatgatttctaccacgcaaaagatgacctattatgcctagattctcattcatcatatccaatgct

SEQ ID NO: 314941 - DNA, 75 bp, Artificial Sequence
  Synthetic
atacatacatccaggaatttgacatgtgatgggttcatcatctgattgaattgcaaatcactcataaacggtgct

SEQ ID NO: 314942 - DNA, 75 bp, Artificial Sequence
  Synthetic
agatgttcttcaaataaatagggatagttccttttaatagagtgtaaaatatgatttagacttagtctatcttca

SEQ ID NO: 314943 - DNA, 75 bp, Artificial Sequence
  Synthetic
atatgtttttgaatcttgggcttgacagcccaaaagagatttggattacttaaaataggaggtgcagaaggagat

SEQ ID NO: 314944 - DNA, 75 bp, Artificial Sequence
  Synthetic
ttcacatcagagaaaacccattctccgatttcacatgcgttagtgagaactaatgtgaagtaatcccataaaata

SEQ ID NO: 314945 - DNA, 75 bp, Artificial Sequence
  Synthetic
gatcttgcaaattgtgaaatttttgctagagaatcctgacagtaaacaacacctggccattccaaacatatacag

SEQ ID NO: 314946 - DNA, 75 bp, Artificial Sequence
  Synthetic
catccacacttattcacattattgtacaattctttcagatacataaaacctcctttgccgtctctcacacattta

SEQ ID NO: 314947 - DNA, 75 bp, Artificial Sequence
  Synthetic
ctacccatacttttacagaaccctatgaaacctgaggccacagatgactgaaatgctgacttatttattgattct

SEQ ID NO: 314948 - DNA, 75 bp, Artificial Sequence
  Synthetic
gctaaaatcttttttgccccctttataaagttctttgacattctggattgtagtgtctttatcagacttggtaca

SEQ ID NO: 314949 - DNA, 75 bp, Artificial Sequence
  Synthetic
ctttctctttccaagattcttttactagacataatttttgtccttaaaaccagtctcaaatctccaaaagtggac

SEQ ID NO: 314950 - DNA, 75 bp, Artificial Sequence
  Synthetic
ggattcaaccatttatgccttaaagcctcaacaatgtcattttcagcaaatcctgcatacaataaaaaccctctt

SEQ ID NO: 314951 - DNA, 75 bp, Artificial Sequence
  Synthetic
aaagcttcatcaccccccctgccaatcaaaccaatcaaattttcttcaaacacatgacccttctttatttccaaa

SEQ ID NO: 314952 - DNA, 75 bp, Artificial Sequence
  Synthetic
aatacttttcttgcccccctccttatcaaacgaagcagttcctgattgccaaaagaattctctatatttctctgg

SEQ ID NO: 314953 - DNA, 75 bp, Artificial Sequence
  Synthetic
agacgataacccctcgatccatctgtccaatctttgacatcttggttgacaatggtcaggaaaggcgtctcttta

SEQ ID NO: 314954 - DNA, 75 bp, Artificial Sequence
  Synthetic
tagccagaatagctaatcaatcgattcaccctctctgatattcttgagacaatatccactcctacaccattggcc

SEQ ID NO: 314955 - DNA, 75 bp, Artificial Sequence
  Synthetic
acacactgatcacaaatggtatcaatagtctctgctaattgagttggtgttttacacttcacattatgtaatgct

SEQ ID NO: 314956 - DNA, 75 bp, Artificial Sequence
  Synthetic
gcggccacaaacttggtcaacaagggagtttcctcacccattacaaaaaatctcgatttgaactcagcaacaaaa

SEQ ID NO: 314957 - DNA, 75 bp, Artificial Sequence
  Synthetic
ttccccaccacactctttggacttacaaatttgttcaattttgaagataggtactcatggaaacagatgatttcc

SEQ ID NO: 314958 - DNA, 75 bp, Artificial Sequence
  Synthetic
aaccagtcaaaatcttcatcattttcttttgtactcagtggcaatttcatgattgaaatttggtcatcactagat

SEQ ID NO: 314959 - DNA, 75 bp, Artificial Sequence
  Synthetic
gtgtaagaagtgacatcaatatcaaacagtttgtgtattacataattaaggaattgttcagttattaatgcatac

SEQ ID NO: 314960 - DNA, 75 bp, Artificial Sequence
  Synthetic
acagtttgtgtattacataattaaggaattgttcagttattaatgcatacaagtctgacaaattgtgtaatatgc

SEQ ID NO: 314961 - DNA, 75 bp, Artificial Sequence
  Synthetic
cttggcccatgtcaagtacagacattatatgacttgggatttcatcttgaatctgaaggtagctatgataaaatt

SEQ ID NO: 314962 - DNA, 75 bp, Artificial Sequence
  Synthetic
cctctgtgagacttgaacactgacattccatcaacccaagacttcttttaagcttccctatacagtaagcctgtg

SEQ ID NO: 314963 - DNA, 75 bp, Artificial Sequence
  Synthetic
caacattaaaaggaacctctactgttttgtgtaagtgccacttcagtatattaagtaaaggatcaaggttcagcc

SEQ ID NO: 314964 - DNA, 75 bp, Artificial Sequence
  Synthetic
ttgttctactcttgggctcagtaagattcaaattggctaaaaatgtaaaaaacagagcagggctcatgtggggtc

SEQ ID NO: 314965 - DNA, 75 bp, Artificial Sequence
  Synthetic
cccactttgagtggtccatggaaagactaaagtcaccattgtttactgccattttcatatcacaaattgcccttt

SEQ ID NO: 314966 - DNA, 75 bp, Artificial Sequence
  Synthetic
caaattccttctcagaattcaaacaagagaacctcattgatcctgtgaccacttctgagaaatcctctaccaatc

SEQ ID NO: 314967 - DNA, 75 bp, Artificial Sequence
  Synthetic
tagtcataagcttagtgttaagatctcccacataaagctccctgttagacccaacctgttctttataacttaacc

SEQ ID NO: 314968 - DNA, 75 bp, Artificial Sequence
  Synthetic
caaatttcagattgccagtgttggtgcttacactagtgaattcagttggggaatcttctgagtaaaagcaaagat

SEQ ID NO: 314969 - DNA, 75 bp, Artificial Sequence
  Synthetic
ttcgtaaagctgcacttgtaaagaaagttctatcaagtttttttgctattgcctcagcattgctttctcttgtgc

SEQ ID NO: 314970 - DNA, 75 bp, Artificial Sequence
  Synthetic
taactcttgcattctcttgtaccttaagtgcctctgaactcagccctaatcttgatctactcttgtgttcatatg

SEQ ID NO: 314971 - DNA, 75 bp, Artificial Sequence
  Synthetic
tacctagcttttgatcaaagtctccttgtattaataggtacttaaaacactcaaagaactcttcctcttcatagg

SEQ ID NO: 314972 - DNA, 75 bp, Artificial Sequence
  Synthetic
ctatggtagttaaattgatcaacaacatttccaatggaacagattttaacggttcatcaaggaaaaacagtgact

SEQ ID NO: 314973 - DNA, 75 bp, Artificial Sequence
  Synthetic
tttgtgatgaattatacacctcatgacaaagtttttcaacaagatgactatctaaaatgtcaggatcaaaatctt

SEQ ID NO: 314974 - DNA, 75 bp, Artificial Sequence
  Synthetic
taatttcatggattgaggtctcattttttatggctctgtttacctgatgaggtgaccaaagagattccagtatct

SEQ ID NO: 314975 - DNA, 75 bp, Artificial Sequence
  Synthetic
tcccttttgatgcattcttctcatttctttttggatcctgcaacctttcttctctagcatctgaacttttcattt

SEQ ID NO: 314976 - DNA, 75 bp, Artificial Sequence
  Synthetic
tgtgtaatgctaactgtacttcatccctcacctgttcgaatgcagaaatttggtcctcagtcagtgcttcataca

SEQ ID NO: 314977 - DNA, 75 bp, Artificial Sequence
  Synthetic
atgttgacaattcttcttgagacttttcttgaggtacatttgcacttaccaagtttgtgaggttttttaacacaa

SEQ ID NO: 314978 - DNA, 75 bp, Artificial Sequence
  Synthetic
ggaaatcaatagaatcaggatctaaattgtacctacctttggtcttaaacatttctacaagtgatgtgacacatg

SEQ ID NO: 314979 - DNA, 75 bp, Artificial Sequence
  Synthetic
atgataccattaactgtttattatatttatctacaatatttccaagttcatctaattttgggacaacaacacttt

SEQ ID NO: 314980 - DNA, 75 bp, Artificial Sequence
  Synthetic
tattgctcgagatgtctaaagcagtacttgtgaaagtaggacgaaagggatctactttcaaatcccctgacactc

SEQ ID NO: 314981 - DNA, 75 bp, Artificial Sequence
  Synthetic
tcaatttgcctctattgaacaatgaaacacagtatccaagtagttctctagagacaccaggctccttcacatcag

SEQ ID NO: 314982 - DNA, 75 bp, Artificial Sequence
  Synthetic
attgatcaagcaactctttggaaaagaatctatcaatactagaaatcatttggtgctcctgagattctgtcaagg

SEQ ID NO: 314983 - DNA, 75 bp, Artificial Sequence
  Synthetic
ttccgttcaatgacggattcacaatgacactattaaatttcaatttgggttccaagaatttctcaaaacatttaa

SEQ ID NO: 314984 - DNA, 75 bp, Artificial Sequence
  Synthetic
tttgatctgttagcctatctggagtttcttttgtaataaagtggcaaaggtaactaatgttcagtagaaacttga

SEQ ID NO: 314985 - DNA, 75 bp, Artificial Sequence
  Synthetic
atcttcttgtgaacccatattctatctcattgtcaccagataaaatcgaaacaaacaatctgacacataatcttt

SEQ ID NO: 314986 - DNA, 75 bp, Artificial Sequence
  Synthetic
gcaattggatttctgagctagacttacactcaactgccaacttagacataaggtcaatgtggtgtgcttggttga

SEQ ID NO: 314987 - DNA, 75 bp, Artificial Sequence
  Synthetic
catatgccattataaaatacctcaaaccttgaaggaatgtctgatttctcttcgaaggagaacagagcagtagta

SEQ ID NO: 314988 - DNA, 75 bp, Artificial Sequence
  Synthetic
acatgagtgtttttaattgagtggatactattctcaccaactctgaatcaaagttcaaccagttgatcatttctt

SEQ ID NO: 314989 - DNA, 75 bp, Artificial Sequence
  Synthetic
cacacattgatgtgatcacagcttcagaaaaaataggcacaaagtatcttttaggatcacagtaaaaagatccga

SEQ ID NO: 314990 - DNA, 75 bp, Artificial Sequence
  Synthetic
tctcagtcaactcaccattttctgcaatataaagtgagtaacatctagatctttctcctgtcttttggtaaaaca

SEQ ID NO: 314991 - DNA, 75 bp, Artificial Sequence
  Synthetic
gtaaacctattatgttgtttgtgatagggaatcgttggatataacattccctaagtctcacattaccaaaatatc

SEQ ID NO: 314992 - DNA, 75 bp, Artificial Sequence
  Synthetic
gtgaataatctctctcattaataagtaaccgagaggaaaatgatgtcttcattgaattgatcaagcctaatgaaa

SEQ ID NO: 314993 - DNA, 75 bp, Artificial Sequence
  Synthetic
gatgagacaaggcctttaacattatcttgaagtcatcgtcagtgaagttctccattgctttatggcaacattgtc

SEQ ID NO: 314994 - DNA, 75 bp, Artificial Sequence
  Synthetic
gttcctctgctttgtgaacagaatacctcatcataggcctgtctgagactaactcctttgcgagttggaaaagtt

SEQ ID NO: 314995 - DNA, 75 bp, Artificial Sequence
  Synthetic
accaaacaagacaatctaaagatactatataaccttttactcattttgaaaacgtaggattaagaatctcagcta

SEQ ID NO: 314996 - DNA, 75 bp, Artificial Sequence
  Synthetic
taggagacccggtaactgcatccttcgcagaccttaagcgattgatcacaagcggagtcttgcacccctcagtgt

SEQ ID NO: 314997 - DNA, 75 bp, Artificial Sequence
  Synthetic
gaagggagggttttggtgcaggggacatcacaatgtcaactgttttgagcacattgaaggcctccaagcatggca

SEQ ID NO: 314998 - DNA, 75 bp, Artificial Sequence
  Synthetic
tagggcaaatttttgcccagaagcccgggacttccaaatttctagattgggcaagtgacccgtattcggcaaatc

SEQ ID NO: 314999 - DNA, 75 bp, Artificial Sequence
  Synthetic
agctaacaagagtagaagccgccactagcggcatacacatgcttggactaaagtcatcattgttgatacctgttc

SEQ ID NO: 315000 - DNA, 75 bp, Artificial Sequence
  Synthetic
ttccttctgcgcaaagcatcactaagctaataaagaacttaacaggtcgggtggttttaagccaaagtcctaatc

SEQ ID NO: 315001 - DNA, 75 bp, Artificial Sequence
  Synthetic
caggggttaaaggaatcaacttgagatggaaactcttgttgaagttgctaagaatcatatcaaattcaaagagct

SEQ ID NO: 315002 - DNA, 75 bp, Artificial Sequence
  Synthetic
cccttttacaggggttgtttcatattaattcagaggaggaggatgaagctcttgctaaatttttaatggacagat

SEQ ID NO: 315003 - DNA, 75 bp, Artificial Sequence
  Synthetic
caagtagtatcgttacaggtgcaattatgtgtgtcctggtactatttgcagagtcaccgggtgctttaatccaga

SEQ ID NO: 315004 - DNA, 75 bp, Artificial Sequence
  Synthetic
ctataattattccacgggctgctcatgaaatactggctaattcaatgactggcgctagagagtctcttgcagggt

SEQ ID NO: 315005 - DNA, 75 bp, Artificial Sequence
  Synthetic
ggattgttgatgacccagatgtatccattaggctagtcgatgtaatagaggacaaagacggtgagctgacgtttg

SEQ ID NO: 315006 - DNA, 75 bp, Artificial Sequence
  Synthetic
tgctggatactaccaaaggactaattaaaactggactaatgaatggaggattatcccataatctacttaagaaat

SEQ ID NO: 315007 - DNA, 75 bp, Artificial Sequence
  Synthetic
cttcacgtggtctagatctggcaggtaaggcaaatgattactttgctttagggagacgctattatgccggtgaag

SEQ ID NO: 315008 - DNA, 75 bp, Artificial Sequence
  Synthetic
tacagaactacgactatacacaattcagtcatttattatgtctcctgactgttaagcctgctaatattaaggtaa

SEQ ID NO: 315009 - DNA, 75 bp, Artificial Sequence
  Synthetic
aattgaaaagtccctttctaaaccctgatcgaataccacgtgaaattgaggacccggatgagtttaacttgattc

SEQ ID NO: 315010 - DNA, 75 bp, Artificial Sequence
  Synthetic
gtgtggattattgttcagttgacctagcaattatgttgagacaccagatgcggcgagatctcgcattgggaaggc

SEQ ID NO: 315011 - DNA, 75 bp, Artificial Sequence
  Synthetic
tggcatcagtttgtactcaaatatggacccttcttgccaaggccgttacagctccagccactgctcaggactcag

SEQ ID NO: 315012 - DNA, 75 bp, Artificial Sequence
  Synthetic
caatttatggtctcgaggtccctgatatgctcgaatgtatgaccggtgtgttgttaaggggggcgaccttgtgtc

SEQ ID NO: 315013 - DNA, 75 bp, Artificial Sequence
  Synthetic
aagaccgtagatggacaaaatatactcagcaacgaagagttcatagtgacatcagactatccaaagagtggacag

SEQ ID NO: 315014 - DNA, 75 bp, Artificial Sequence
  Synthetic
agcagtgtgctatagggtcacaatattatggctggttttttgtcccagcagaactagagctggatgaggtccatg

SEQ ID NO: 315015 - DNA, 75 bp, Artificial Sequence
  Synthetic
acacagtcagggccaaaatttcccagagcctctcattgaggagatttatggtaaatttgatgatagaagttaaaa

SEQ ID NO: 315016 - DNA, 75 bp, Artificial Sequence
  Synthetic
gatcatcaaactccataagggtgccatatactgggtcggtgacagaagagagaactgaaatccaagtaggtcaat

SEQ ID NO: 315017 - DNA, 75 bp, Artificial Sequence
  Synthetic
agactcctggtcataagcccagattagccgaacttatcattgatgtggacaattacatagaagaggcagggctgg

SEQ ID NO: 315018 - DNA, 75 bp, Artificial Sequence
  Synthetic
ctagacactcttctaggtcactaaaagccgctatcaggattgctaccgtgtacacgtgggcattcggtgactccg

SEQ ID NO: 315019 - DNA, 75 bp, Artificial Sequence
  Synthetic
caggctttatccttacagttaaatatgccatagacactaaatacccagcaattgctttacatgaattccagggag

SEQ ID NO: 315020 - DNA, 75 bp, Artificial Sequence
  Synthetic
accaatcttgggaggaatcctggtaccttgcatctcaaagagcgaatttaactatcgatgagttgaagctgctca

SEQ ID NO: 315021 - DNA, 75 bp, Artificial Sequence
  Synthetic
aacttacaactttagagcacctgatgaagctttatctggaaatgggccaacatgctccttacatggtaatcttag

SEQ ID NO: 315022 - DNA, 75 bp, Artificial Sequence
  Synthetic
ctcctgtctcgactgctactaacttggctcaccgtctccgggataggaacacacaagtgaagtatagtgcaacat

SEQ ID NO: 315023 - DNA, 75 bp, Artificial Sequence
  Synthetic
agaattcactacagaacaagtttagtccgggaaattacccgttgatctggagctatgctattggtgtgggggtcg

SEQ ID NO: 315024 - DNA, 75 bp, Artificial Sequence
  Synthetic
cccaggctagggtatctcgttacaccaccatatccaatgataaactctcatttgagatagatggtgataaagtag

SEQ ID NO: 315025 - DNA, 75 bp, Artificial Sequence
  Synthetic
agctggaaaagtcaatggcaggattaaattacaaccgaccctattttgacatgtcatactttcgtttaggacagg

SEQ ID NO: 315026 - DNA, 75 bp, Artificial Sequence
  Synthetic
acacaaacttcatttaccaacaatctatgttactaggcctttctatcctggaggattttttccgtgttcagaatt

SEQ ID NO: 315027 - DNA, 75 bp, Artificial Sequence
  Synthetic
agatggtccggagatttgcaggtgtggtgagtcatcgtgttgcggaggagcttaacatatcagaagaggagcgtg

SEQ ID NO: 315028 - DNA, 75 bp, Artificial Sequence
  Synthetic
ttacaggtacattgaacactatcctccatttacatgctgatgttcattgttgtgtcaagaaaatgattgatcatc

SEQ ID NO: 315029 - DNA, 75 bp, Artificial Sequence
  Synthetic
aaattctaaaggaagtatctcgggcagctggcacccataaatccactacaaaggaaggtccgagacaatcctctt

SEQ ID NO: 315030 - DNA, 75 bp, Artificial Sequence
  Synthetic
ctaaagttgaaccttatcgaccacttccaactttgacctcggtgacttgcaaccgtttactttatgatgatgagc

SEQ ID NO: 315031 - DNA, 75 bp, Artificial Sequence
  Synthetic
tagggtatcttggtacggatccagaacggatgactactgatgaacagcttaccagaggggtgagccggagcaatg

SEQ ID NO: 315032 - DNA, 75 bp, Artificial Sequence
  Synthetic
ccttaggctcggaagaccaaaatcggctgtatcatcaaatatttcaatcttctatgcctcatttcccactatggg

SEQ ID NO: 315033 - DNA, 75 bp, Artificial Sequence
  Synthetic
cagaggatgatcgggaatcagttaatttgaccttgatggacgacagtgattatgatgatgaccagtatgaagaag

SEQ ID NO: 315034 - DNA, 75 bp, Artificial Sequence
  Synthetic
acaggacagagttcccactatgggacaggacagagcttatcaacactctggcgtccagtttggcttctactgtga

SEQ ID NO: 315035 - DNA, 75 bp, Artificial Sequence
  Synthetic
gtccatcccaatcatatcgagttgatgattcgtcaaagaaagggaaagatactgggatgagagcaagggggttgg

SEQ ID NO: 315036 - DNA, 75 bp, Artificial Sequence
  Synthetic
ttgatgttatctcccaatctgagcacgatcaccttaatgaatcactagctctgcaagcccctgatgatataggaa

SEQ ID NO: 315037 - DNA, 75 bp, Artificial Sequence
  Synthetic
aatacctccgctccttaatggtaggaactaaggaacctaaagatcgggaagaaatatctgcggacaagactacaa

SEQ ID NO: 315038 - DNA, 75 bp, Artificial Sequence
  Synthetic
cattaataaccgagcacctcttagtagatccaaggaaatactcgctctacttaggcctctatatcgcaacgaatt

SEQ ID NO: 315039 - DNA, 75 bp, Artificial Sequence
  Synthetic
acccaacaagcagcggcaagtctgatatccctacggcaaaccaagcacttgatggagagaccgagaaatctactt

SEQ ID NO: 315040 - DNA, 75 bp, Artificial Sequence
  Synthetic
gggcattggagattcattataggcgacctgaagggcgatcagagatgagagacaccttatacggattacttatca

SEQ ID NO: 315041 - DNA, 75 bp, Artificial Sequence
  Synthetic
tggatctttagttaattaacctgatcttcttaaccctgtcctctctgtcttagcttacacctatcaaaaaaaact

SEQ ID NO: 315042 - DNA, 75 bp, Artificial Sequence
  Synthetic
ggactagcagagcttccttcggaatccttatcaatgcattgacacatccaaagatattcaataaatggttagcaa

SEQ ID NO: 315043 - DNA, 75 bp, Artificial Sequence
  Synthetic
taggatacaggaatccaagactgcatccaaatcaggactccctcccctcgagctccactcagccttctcaaaaca

SEQ ID NO: 315044 - DNA, 75 bp, Artificial Sequence
  Synthetic
ttggattgatttcacctgcatttgggccaaccctccagacccaagatcttcacaagctcgttgtaaattatttgt

SEQ ID NO: 315045 - DNA, 75 bp, Artificial Sequence
  Synthetic
cccgttatgtcagatgaaaatagaacacttgtcaagaatgctctcaaggttcttgcagatcttaaaaagcaagag

SEQ ID NO: 315046 - DNA, 75 bp, Artificial Sequence
  Synthetic
gtgattgctatgacatgtatatgcttggatggcttcagggtcatagcgtagatttaaaatatctaatatgtgagt

SEQ ID NO: 315047 - DNA, 75 bp, Artificial Sequence
  Synthetic
aataaacccattggagaaccaagaatcacattacagaaccttagagagcattacggaaaaaacgactatgccaaa

SEQ ID NO: 315048 - DNA, 75 bp, Artificial Sequence
  Synthetic
ccgatgaatatgtcatccaatctagaatagacctggtccaagccaggcacctggcctttttggtagatctctatt

SEQ ID NO: 315049 - DNA, 75 bp, Artificial Sequence
  Synthetic
ttcggggaagacctccaagaagtccatttatctctgcaaaagagaccccagtgcaatgtcgaactccgccagccg

SEQ ID NO: 315050 - DNA, 75 bp, Artificial Sequence
  Synthetic
catgttcgaaagcctgtccgagaatccgcggattaacttcaatagagaagtgcgcagtacttgatcaatacatca

SEQ ID NO: 315051 - DNA, 75 bp, Artificial Sequence
  Synthetic
ggtggagatcaagacaatagcccacgaattaagacaggaaatcaggaaggaaatctccaagtggatacagaaaca

SEQ ID NO: 315052 - DNA, 75 bp, Artificial Sequence
  Synthetic
agatggcacaaacagaaaatgttggcgggaaacattggtacttaaagattaaacaaatcgaatgttacccatcta

SEQ ID NO: 315053 - DNA, 75 bp, Artificial Sequence
  Synthetic
acaggtgaagtcagttgtaccgcaggatcttcatgtggagactcagattctcctcacgatgctgagcaggctagc

SEQ ID NO: 315054 - DNA, 75 bp, Artificial Sequence
  Synthetic
ctttgacatatttaaggagaggtgttgttaagcagatacgcttaagaggtataagtaatctaggggatcttggac

SEQ ID NO: 315055 - DNA, 75 bp, Artificial Sequence
  Synthetic
agaaggggagttgctgacgcaggactggcagcgttctgtactgaaggaaattcaggattcagcaatcacatgcga

SEQ ID NO: 315056 - DNA, 75 bp, Artificial Sequence
  Synthetic
aagcattcaaatctaaagaagttgaagcctgtgacgacctccctttaagaaacgcaccgggagattccttttccc

SEQ ID NO: 315057 - DNA, 75 bp, Artificial Sequence
  Synthetic
ggtcatggaccagttagtggcgatgattttggacttgttcccgcgaaagtaccacgatcaagtgcaagggatcca

SEQ ID NO: 315058 - DNA, 75 bp, Artificial Sequence
  Synthetic
actcaaataacaccagtgtggaagatgtaactagtgtatttcgtgaattagaaacaaatcacaagcggacaccaa

SEQ ID NO: 315059 - DNA, 75 bp, Artificial Sequence
  Synthetic
acctattccagtgatgttaggggtgtgagtaaactggatgattttgctgacatactgctgactgttggggcgtct

SEQ ID NO: 315060 - DNA, 75 bp, Artificial Sequence
  Synthetic
ttggatcagttgttacagagttctatgcatttcattcatttcgaagaattggtgtgaattctacagcatgttata

SEQ ID NO: 315061 - DNA, 75 bp, Artificial Sequence
  Synthetic
gaattcagctttgatcatattgtttcgactgcgcaggctgatcttgaggagtctctctctcttcaacctgcaccc

SEQ ID NO: 315062 - DNA, 75 bp, Artificial Sequence
  Synthetic
aaggcttggaaatttgccggtttttgacaacatcattgaattataacacaccccgcttgtttgtgggcgaaggag

SEQ ID NO: 315063 - DNA, 75 bp, Artificial Sequence
  Synthetic
attaatgaggaagccttgccctccacatccacaggggctcctgagaatggagataaacaggaggcgattaaaaag

SEQ ID NO: 315064 - DNA, 75 bp, Artificial Sequence
  Synthetic
caggatcgattatgtccacatttagtctgtacttccccggaagcacaacgtactataatacaggtgtgagtagtg

SEQ ID NO: 315065 - DNA, 75 bp, Artificial Sequence
  Synthetic
gggtctcgtcaccgacgtgagtactcaattatctgggattctgaaggaattcaaattgaatcctggtgcaatccc

SEQ ID NO: 315066 - DNA, 75 bp, Artificial Sequence
  Synthetic
aagtaggtatcgggcaaagagagttaaccgtagaacctgctgaaccttacttaattaatcgaacccgggcatcag

SEQ ID NO: 315067 - DNA, 75 bp, Artificial Sequence
  Synthetic
gtttgttccaaagtcagatcaacaccaagaagagaaaaatgccggtgtgggaaatgtccggctcggtgctccgaa

SEQ ID NO: 315068 - DNA, 75 bp, Artificial Sequence
  Synthetic
gttcaatgaacaaaattgagtacatccctctgtttaatggatcccctgatgtaacatggattgggaatgatcaga

SEQ ID NO: 315069 - DNA, 75 bp, Artificial Sequence
  Synthetic
tgtggagatgactgagatatccaaaggacgagcagagcttgtagatcccgcaccagttgtaaaaccacgacgctt

SEQ ID NO: 315070 - DNA, 75 bp, Artificial Sequence
  Synthetic
cttatatttatatcttgtctgccattaaaccatcatcattgggtctcatgcactctgatatagagggatcttggg

SEQ ID NO: 315071 - DNA, 75 bp, Artificial Sequence
  Synthetic
gaatcctttgcacctacctatagtacctcactcctcgccaaaccctcacgacaaggatactccattaaagtcccg

SEQ ID NO: 315072 - DNA, 75 bp, Artificial Sequence
  Synthetic
aaaaatcacctgagcaaattgcacgagagtatgcacatatattgagtctctcgctcctgctattggacctagacg

SEQ ID NO: 315073 - DNA, 75 bp, Artificial Sequence
  Synthetic
tcacaaacaactttcttccgaccaagtcaccccttcaggctctgcagattacaatccagattctgatgcttctaa

SEQ ID NO: 315074 - DNA, 75 bp, Artificial Sequence
  Synthetic
gcatccttgtacagaaattgatgcctaaaggaaatgaccacacagtatcctatataaagttaattttgcaatatt

SEQ ID NO: 315075 - DNA, 75 bp, Artificial Sequence
  Synthetic
acatgtatcgattgatgaagtctacaacctcctaatcaccatcttggaagaacagagagaattacaaagcaaagt

SEQ ID NO: 315076 - DNA, 75 bp, Artificial Sequence
  Synthetic
tctcaggagtttactttttttacccaacatactcaaatccatgctccactgaggtgtacttggttgctctttacc

SEQ ID NO: 315077 - DNA, 75 bp, Artificial Sequence
  Synthetic
agaaggattatacaagatccaaggtgagatagaccaggtcaagaaaaatatgctaaaggttctgactcagatctc

SEQ ID NO: 315078 - DNA, 75 bp, Artificial Sequence
  Synthetic
caaggatgaataaactaatctctccagataagatattcactgctatacttagaccagcagagaattggggaagct

SEQ ID NO: 315079 - DNA, 75 bp, Artificial Sequence
  Synthetic
catcgttgaaggccatctgtctacggtaatgttggcaatcccgagctctggcaaggatcccgactcatcttttcg

SEQ ID NO: 315080 - DNA, 75 bp, Artificial Sequence
  Synthetic
cattagtagaacacattttgtcagtcaagggcaagcatttagtgcgataccaaagtgctcttacctccactgtca

SEQ ID NO: 315081 - DNA, 75 bp, Artificial Sequence
  Synthetic
taacccagatttacgccccgttttaggtagagataaggcaagaggggtgatcgatctactgggctctaagaaagt

SEQ ID NO: 315082 - DNA, 75 bp, Artificial Sequence
  Synthetic
aagattcccgaactgatatgtctctcaaccgtctaaatgacatggagaagtggcttctaaaccaagggtttgaat

SEQ ID NO: 315083 - DNA, 75 bp, Artificial Sequence
  Synthetic
tacgattgacttagataaacctactccctcaagtagctccgaaccaagagtgattctcaaagccaataaggatgc

SEQ ID NO: 315084 - DNA, 75 bp, Artificial Sequence
  Synthetic
tgaatggtccttgggtgttggagaaatttgcatgttctcaattattaacagacgaggatgctttctcacgatcga

SEQ ID NO: 315085 - DNA, 75 bp, Artificial Sequence
  Synthetic
attgcagttggaaggtccagatcaatctagcagcaattcttcacactacattgtcggggatcctaaaattgctaa

SEQ ID NO: 315086 - DNA, 75 bp, Artificial Sequence
  Synthetic
ttcaatcacaattgagagaggcagcctactggatcaaggaagggttacctgatagtctctttatgatgccttatc

SEQ ID NO: 315087 - DNA, 75 bp, Artificial Sequence
  Synthetic
gcaaatcctcaaatctctaatcacttcaagtaaattatcacctgaaattcaaactaatcttttggatgatctcag

SEQ ID NO: 315088 - DNA, 75 bp, Artificial Sequence
  Synthetic
aagttagatttgagagtcaaatcgccgagactcttagatcattggcacgaagggttactgtgctttggtttttta

SEQ ID NO: 315089 - DNA, 75 bp, Artificial Sequence
  Synthetic
tctgattgggtccaaatctgatctccaagagttccaccgacttttaatcgatttattgtctggtgataacggtgg

SEQ ID NO: 315090 - DNA, 75 bp, Artificial Sequence
  Synthetic
gaagctctagggaggaaggctgctctttattaaggtcaattgttcgctctaggaagttagtggtatcttctgtct

SEQ ID NO: 315091 - DNA, 75 bp, Artificial Sequence
  Synthetic
caccagcacacaattcagtcagtaaacgcttctagaaggtctccaatcactactgttatctttcaatcagtctaa

SEQ ID NO: 315092 - DNA, 75 bp, Artificial Sequence
  Synthetic
ctcctcagtcagtttttttaaggaataaatcttacacagcgatcatttgggattacctaggtccagcagggatca

SEQ ID NO: 315093 - DNA, 75 bp, Artificial Sequence
  Synthetic
tcaccgaacttgattgatttgcttttatcattaaataactcttaaaatcactaaaaaaaacctaggactcaagag

SEQ ID NO: 315094 - DNA, 75 bp, Artificial Sequence
  Synthetic
tcatccacctcgaaacgcctgaacagaaattatggcagaagttgtttgggtatagatgcttgcttacagacacga

SEQ ID NO: 315095 - DNA, 75 bp, Artificial Sequence
  Synthetic
aacgagacccaagacagtccgacaagcccggaaccctcccaagagaggaacgaaagccgacaccccgagaaccca

SEQ ID NO: 315096 - DNA, 75 bp, Artificial Sequence
  Synthetic
cgtagtcattctcctagttggctggactgcttccgattctgaccccttcatgctctgtatatatttttattaaaa

SEQ ID NO: 315097 - DNA, 75 bp, Artificial Sequence
  Synthetic
ccaagatccaacaacaaccgagccacacccaccacaccgccagaaatccagacaaagccccgaaacaatcacact

SEQ ID NO: 315098 - DNA, 75 bp, Artificial Sequence
  Synthetic
catgctctgtatatatttttattaaaaaaaagaaaaatttaaaatcattagtatctttagcttctcttgtttggt

SEQ ID NO: 315099 - DNA, 75 bp, Artificial Sequence
  Synthetic
cctagccatccacagcggcctccttcccaacgaattggaaacgccacccaccacgtgtcatccctgacacttggg

SEQ ID NO: 315100 - DNA, 75 bp, Artificial Sequence
  Synthetic
cataggcaatcaactcactccataagtagtaaatatggcagacgtgtacaattttccttctgcctgttgggaaga

SEQ ID NO: 315101 - DNA, 75 bp, Artificial Sequence
  Synthetic
taaagggagcctggaagccattgatccagaagtggacggtaagggaaagctagtccccaaggtccgtgtaataga

SEQ ID NO: 315102 - DNA, 75 bp, Artificial Sequence
  Synthetic
tcctggcctggggactagaaagagcggacaatacttatacttacttcttcatgggttaattgaagaccttgaggt

SEQ ID NO: 315103 - DNA, 75 bp, Artificial Sequence
  Synthetic
tgtggctgtacctcaaccaagaactttctgtgcgttacccttaggggtagcgcagtctcacgcatctcctgaaag

SEQ ID NO: 315104 - DNA, 75 bp, Artificial Sequence
  Synthetic
tctcctcgcagagtgtcttaagctgaatctcagcgtacggaggactgctggtgctgaggagaaattagttatctt

SEQ ID NO: 315105 - DNA, 75 bp, Artificial Sequence
  Synthetic
caacaccaaaccgcttgatttgctatcaccatggaaaaaagtcttagcacaaggcgcagtctaccctgccaccaa

SEQ ID NO: 315106 - DNA, 75 bp, Artificial Sequence
  Synthetic
aatatgcaattcaattgagcgagtccctctagaagttcctctcaggatgaggccgttatttctcacaattactgt

SEQ ID NO: 315107 - DNA, 75 bp, Artificial Sequence
  Synthetic
gctcagcgattctggattttatcaaattccacggcctctgcaggagttcagagtgcgaaacggagtctccttcaa

SEQ ID NO: 315108 - DNA, 75 bp, Artificial Sequence
  Synthetic
tttgctatttcacattgctctaggagatgatttggagtcagtcggaatcaagggtgtgattgatgatgatgggca

SEQ ID NO: 315109 - DNA, 75 bp, Artificial Sequence
  Synthetic
gaggattatgaccgttttgattcatcttgggaattttattcggaaacgaggtaaaacctatacaaatgattattg

SEQ ID NO: 315110 - DNA, 75 bp, Artificial Sequence
  Synthetic
taaacgcaagattgagcgaatgaagttgacctttgccctgggtgcagttggcggagcaagtatccatatcaaagt

SEQ ID NO: 315111 - DNA, 75 bp, Artificial Sequence
  Synthetic
tgagggaaaaattagcaagcgactctttgcacagataggttttcgtaacactatctgttatcccatcatggaggt

SEQ ID NO: 315112 - DNA, 75 bp, Artificial Sequence
  Synthetic
caacccgtcattaaacaaactactatggaaaactgagtgtcacataaagcgtgttcaggctgtcttacaaccatc

SEQ ID NO: 315113 - DNA, 75 bp, Artificial Sequence
  Synthetic
agtccctgatgactttaggatctataatgacattgttattgatcattctggcaagatcctgagaaagtgattatt

SEQ ID NO: 315114 - DNA, 75 bp, Artificial Sequence
  Synthetic
tatattaaagatcatgttgctcctcagtcagtatatataatttagctgattgacccgaattactacaacccacct

SEQ ID NO: 315115 - DNA, 75 bp, Artificial Sequence
  Synthetic
ttaaagctactagtctttgctcggccaacttttctaattagaataaagtcgctttccttgcagctaataatccta

SEQ ID NO: 315116 - DNA, 75 bp, Artificial Sequence
  Synthetic
aggctacagccaattgcttgactcctggaggttacacatgggtaatcatttgagcttgttcagataattacaagc

SEQ ID NO: 315117 - DNA, 75 bp, Artificial Sequence
  Synthetic
tgagattgagacaaaataataagaggaatttacctgtcctaatttaggtttagaagtgctctaagacagttaatc

SEQ ID NO: 315118 - DNA, 75 bp, Artificial Sequence
  Synthetic
aattaataaaaaacttaggaatcacgtcaaatgaggcacacactgctctagaaccacacccaagcaccccggttt

SEQ ID NO: 315119 - DNA, 75 bp, Artificial Sequence
  Synthetic
cctcttacacacccagcctgcatccccacaaaaacccaaggctttagcaagcccaagccaagcaagacgaaaccc

SEQ ID NO: 315120 - DNA, 75 bp, Artificial Sequence
  Synthetic
aaaaatcacggttcgactcttacctcattctccaccggttgcaattcagcctcagcatagcctaagggaaatatg

SEQ ID NO: 315121 - DNA, 75 bp, Artificial Sequence
  Synthetic
aatcctctcaatcagacccttattgccaaagtattgggtttccttttgctatccagttcatttacagttggtcaa

SEQ ID NO: 315122 - DNA, 75 bp, Artificial Sequence
  Synthetic
attggattcgagaacctcacacgaattggggttcaccaagtcaaacagtacgggtacaagttggcccactataac

SEQ ID NO: 315123 - DNA, 75 bp, Artificial Sequence
  Synthetic
tcccaccagctgttgctaattaggatgattcctactgtaaacggaacccataattgtacccaccaagtgattacg

SEQ ID NO: 315124 - DNA, 75 bp, Artificial Sequence
  Synthetic
cgctatcgagagatggttagggaaattatcacacctattaaaggggctcttgatattatgaagaaagctgtgagt

SEQ ID NO: 315125 - DNA, 75 bp, Artificial Sequence
  Synthetic
cctgacttagtcggtgctaggatatttggcgctattgtagcaggagcggccttagggattgcaacctctgcccag

SEQ ID NO: 315126 - DNA, 75 bp, Artificial Sequence
  Synthetic
ataacagcaggggtggcccttcacaggaccaagttaaatggccaggaaatctcaaaactgaaggaagctgttagc

SEQ ID NO: 315127 - DNA, 75 bp, Artificial Sequence
  Synthetic
ttgacaaatgaggctgtggaacagctccagtactcacagggtaagagtatcttagctatccaagggatccaggat

SEQ ID NO: 315128 - DNA, 75 bp, Artificial Sequence
  Synthetic
tttataaattttaatgtggtgccactgttagaagaacacacatgtgggattgcaaagctgcatttagagatggct

SEQ ID NO: 315129 - DNA, 75 bp, Artificial Sequence
  Synthetic
ctcatggagtatttccaaaagcttatcttggtattcggacctaatttaagagatccaataggttccacgattggc

SEQ ID NO: 315130 - DNA, 75 bp, Artificial Sequence
  Synthetic
atccaggcccttgccaccctatttcagaataatatgtttgaggtaagcttacgattgggttatgcaggagatgat

SEQ ID NO: 315131 - DNA, 75 bp, Artificial Sequence
  Synthetic
ttagaagacgtcttacagagcaactcaattagggctaatattatcgaagctgagccggatagtgggtttattgtt

SEQ ID NO: 315132 - DNA, 75 bp, Artificial Sequence
  Synthetic
ttagcaataaggtaccctaccttaactctggttgaggatcaagtaattacggagttggctcatatcacatttaat

SEQ ID NO: 315133 - DNA, 75 bp, Artificial Sequence
  Synthetic
gacggtcctcaggagtgggttgctaccattcctcagtttgtcacttacagagggttagtcttagctaatattgac

SEQ ID NO: 315134 - DNA, 75 bp, Artificial Sequence
  Synthetic
gtttctacatgtacatttactgaaagaaatgtgatatgtgctagggaccagacctaccccatgattattgatctc

SEQ ID NO: 315135 - DNA, 75 bp, Artificial Sequence
  Synthetic
caattatgcatgagaggtaacattgctaaatgtggccgaacccgggttacagggtctaccgcaagtcgtttcttg

SEQ ID NO: 315136 - DNA, 75 bp, Artificial Sequence
  Synthetic
cttaaggatgggaacatgtatgctaactgcattgctacaatgtgtaggtgtatgtcatcaagctcaattattaat

SEQ ID NO: 315137 - DNA, 75 bp, Artificial Sequence
  Synthetic
caagaaccctctcacttgactactctgattgtgaaagaaacttgctctgaggttatgatcgataccatcaggatt

SEQ ID NO: 315138 - DNA, 75 bp, Artificial Sequence
  Synthetic
acactaggagaaaggaaacatccacccattgactaccaaactacaataacattaggacaaccaatagctttagcc

SEQ ID NO: 315139 - DNA, 75 bp, Artificial Sequence
  Synthetic
ccattagatgttgggactgagttagctaatgcggtgtcttacctaaataagtccaaagtcttgttagaacattct

SEQ ID NO: 315140 - DNA, 75 bp, Artificial Sequence
  Synthetic
aatgaagtattaagttctgtctctactgcacacactagtttgactgctactatagtgctgggaatagtagtgggt

SEQ ID NO: 315141 - DNA, 75 bp, Artificial Sequence
  Synthetic
ggcctagcaattttgatagtggtaatgtttctattcttagaagctcaagtaattaaagttcaaagagcgatgatg

SEQ ID NO: 315142 - DNA, 75 bp, Artificial Sequence
  Synthetic
ctttgtccgattactaaccacggatacttacctaatgaggatctcttaaccagaggacattcaattccaacgatc

SEQ ID NO: 315143 - DNA, 75 bp, Artificial Sequence
  Synthetic
ggttagggcagttcatcgtgcttaggaccagtgctggatcactttctccaccttcgcccagcacccacaggcctc

SEQ ID NO: 315144 - DNA, 75 bp, Artificial Sequence
  Synthetic
accatcctatctctcattctcaaacagcaccagtagaccagtcccctcccacagaatctctccaataaagaccat

SEQ ID NO: 315145 - DNA, 75 bp, Artificial Sequence
  Synthetic
ccaaaatcagtctttccaccacatttgtctagtcctagaatttcaatattccattaagtatagtaattattattt

SEQ ID NO: 315146 - DNA, 75 bp, Artificial Sequence
  Synthetic
taaaaaacgtagacctactaacctcttttaaaacagcactcaggacaagaaagaaaattaggagcaaagaccaaa

SEQ ID NO: 315147 - DNA, 75 bp, Artificial Sequence
  Synthetic
ctcctgcgatctcatagatcaagttctaatttggtatacaatgaaggccatgcattattacaagaatgattttgc

SEQ ID NO: 315148 - DNA, 75 bp, Artificial Sequence
  Synthetic
agaccccggcacaaatgataactcaagtgatctgacgacaaacccattcatatctaatcaaatcaaatcaaacct

SEQ ID NO: 315149 - DNA, 75 bp, Artificial Sequence
  Synthetic
ctcaccacctgtattggccgaaggacatttatcaccaagtcccattccgaaatttcgtaagatccttctaaccat

SEQ ID NO: 315150 - DNA, 75 bp, Artificial Sequence
  Synthetic
ctcctttgtcagcactattgttgtccttaccgtgatcctcttggtattgaccatccggatcctaaccatcataga

SEQ ID NO: 315151 - DNA, 75 bp, Artificial Sequence
  Synthetic
ggcaagtgccggagacgaaaaagatattcacacaatattaagttccttactgaacacctttatgaatgaatacat

SEQ ID NO: 315152 - DNA, 75 bp, Artificial Sequence
  Synthetic
acctgtctttaagaatcttgtttcaataatttcgctccaaatcccccagatgttgatcgatttaaagacgtcaag

SEQ ID NO: 315153 - DNA, 75 bp, Artificial Sequence
  Synthetic
tacgcagatgatgcaatcccttaaaacattccctagggatttagaaacattatccactgttacacaaagtgtagc

SEQ ID NO: 315154 - DNA, 75 bp, Artificial Sequence
  Synthetic
tgttctgttagaaaaagccaaaagcactatcccagacatcaacaaattttacaagaatgttgggaaggttacgtt

SEQ ID NO: 315155 - DNA, 75 bp, Artificial Sequence
  Synthetic
caatgatcccaatattaaggtattaacattggaagttccggcctggcttcctattgtaaggcagtgtttgaaaca

SEQ ID NO: 315156 - DNA, 75 bp, Artificial Sequence
  Synthetic
agattttcgtcaagtaatttctaatagtactggctttgcacttattggtgctttgccatctcaacttttcaatga

SEQ ID NO: 315157 - DNA, 75 bp, Artificial Sequence
  Synthetic
atttgaggggtatccttctttagcaattgtgagtgaagtatatgcgatcacatacctcaaaggggtcatgtttga

SEQ ID NO: 315158 - DNA, 75 bp, Artificial Sequence
  Synthetic
aaaccaggagaatttcttgtatcaatactttgagataggaacaatttcacccgatggctataataaaccttattt

SEQ ID NO: 315159 - DNA, 75 bp, Artificial Sequence
  Synthetic
cttaagacacacatcagttatgttaagtaccttcaagttgagtggaaaatgtactgccgctgtggactatagagg

SEQ ID NO: 315160 - DNA, 75 bp, Artificial Sequence
  Synthetic
aggtatttttttgtgtaccccttctcccaagatcccaaaaatcctccaaaatccaccagatcttccaactctaac

SEQ ID NO: 315161 - DNA, 75 bp, Artificial Sequence
  Synthetic
agtggtatcgatcccatttgatggaagatatacaatccggaatattagcttaatgttgactgatgaagcagatat

SEQ ID NO: 315162 - DNA, 75 bp, Artificial Sequence
  Synthetic
tatttatgacttggacacattacaaggtcggggagtattacaagcaatgagattctatgcacttgtccgggttat

SEQ ID NO: 315163 - DNA, 75 bp, Artificial Sequence
  Synthetic
ttcctcttcatctccgcgtcatttcccattttgtaaaaactcctggtgtccaaccgcggatgataaaatctgtga

SEQ ID NO: 315164 - DNA, 75 bp, Artificial Sequence
  Synthetic
tcaatcccgacgtcttggggctgatgggaattatcctgttatgtatggccttatatcaattccagcacactccag

SEQ ID NO: 315165 - DNA, 75 bp, Artificial Sequence
  Synthetic
ttatcaaggaaatgtcagcttaaagttaatagacccaaaatattatgcttacacaagggacgcctctttatttta

SEQ ID NO: 315166 - DNA, 75 bp, Artificial Sequence
  Synthetic
taattccatgacagacacttaccattactctttcgggacacgaggatgggtatcacgccctatcatcggggaact

SEQ ID NO: 315167 - DNA, 75 bp, Artificial Sequence
  Synthetic
ccttttaggggatgacattgtcctaaccaggtatactgttaggtctgtaagccgggcaaccgcaggtgattgcac

SEQ ID NO: 315168 - DNA, 75 bp, Artificial Sequence
  Synthetic
cactgtctcgatgtgtccacaagcgtgtagcggaggtatgaattctatcttttacccacttaattttgacaaacc

SEQ ID NO: 315169 - DNA, 75 bp, Artificial Sequence
  Synthetic
tcaagtcacaggtgttgcaattcgacaatatgaaaggcaacaggaagggattattgtggtgacaatgaatgatca

SEQ ID NO: 315170 - DNA, 75 bp, Artificial Sequence
  Synthetic
ttactactacagtgtgccaatcataaagaatgggacactgttgatttcatcagttactgattgtttttggttgat

SEQ ID NO: 315171 - DNA, 75 bp, Artificial Sequence
  Synthetic
gggggatttatggtgtatgtccctgatggagaagaacaacctaccgttgggggtgaggtctctagcacatctgac

SEQ ID NO: 315172 - DNA, 75 bp, Artificial Sequence
  Synthetic
atggaacattcactggtcatgttcttagtgcatttactcttaagatggtcctgtagctactgctagtcaggagtg

SEQ ID NO: 315173 - DNA, 75 bp, Artificial Sequence
  Synthetic
tctgtcttgtccaagtgcagagcagataagttgcaactggatatatgaatagcactctaccatcatccaatattc

SEQ ID NO: 315174 - DNA, 75 bp, Artificial Sequence
  Synthetic
ggaggctgactctgaggtgaagatagaggcgaataccggtgtatataagcaataggcaaacttaaatgagctgaa

SEQ ID NO: 315175 - DNA, 75 bp, Artificial Sequence
  Synthetic
agtttcctggattagtctactggtcatcaatgaggctagggggaggaattttctgttattttctaggagcagtaa

SEQ ID NO: 315176 - DNA, 75 bp, Artificial Sequence
  Synthetic
gcatttacctatccggatttgcaggaggacagttgacagtccttttatgttttcttgaagaggattggcgttcgg

SEQ ID NO: 315177 - DNA, 75 bp, Artificial Sequence
  Synthetic
tcttaaatttatacgtataatacaaaaaacttaggattcagaacaatcactgattcctcggctcaaatccatcct

SEQ ID NO: 315178 - DNA, 75 bp, Artificial Sequence
  Synthetic
gggaacacaatatctatcgaacccatccaaacacaccaagtttaatctgatccattggtacaataatgactgatt

SEQ ID NO: 315179 - DNA, 75 bp, Artificial Sequence
  Synthetic
tatcgctcaatgaagtcttatatcctgaagtccacctaaattccccaatcgtcacaggcaaattagtcggattat

SEQ ID NO: 315180 - DNA, 75 bp, Artificial Sequence
  Synthetic
tgaatcgagtagggttgccacacagagtgaacttgagagatcagaccattgtagagaatataaattttagagtgg

SEQ ID NO: 315181 - DNA, 75 bp, Artificial Sequence
  Synthetic
tacaccaacctagtgacccggattggataaaatattcagaattacgagttcatatactaaacctccttgaccaaa

SEQ ID NO: 315182 - DNA, 75 bp, Artificial Sequence
  Synthetic
ataagatagaacactatccgtcataccctgaaggtaatcacttcctctttaggctgcacgatgggaaattagccc

SEQ ID NO: 315183 - DNA, 75 bp, Artificial Sequence
  Synthetic
ctcgcttagagactctactagagagatcatttcggatatatagaaacaattatcttgaccttgctggaatgttgg

SEQ ID NO: 315184 - DNA, 75 bp, Artificial Sequence
  Synthetic
cacaggttaggtcaaagttaggtttgacaaacagtgaaagttatgatttcaagctatactctgaagagctaccat

SEQ ID NO: 315185 - DNA, 75 bp, Artificial Sequence
  Synthetic
tgattatgaaaacttctaagtggtggcacccatttttaaactggttctcaataaaaactctgatgaggtgtgtca

SEQ ID NO: 315186 - DNA, 75 bp, Artificial Sequence
  Synthetic
ttaaaagaacatatggtagatcatctaagagaaagcctataatagagactgcttttggtgaatctctaatagttg

SEQ ID NO: 315187 - DNA, 75 bp, Artificial Sequence
  Synthetic
taataactcatcaattgattgtaattattgataagcaggggaggtctgtacattacctgacacctgagcatgttc

SEQ ID NO: 315188 - DNA, 75 bp, Artificial Sequence
  Synthetic
tactattctgcgatgtcgttgaaggaagactaatgattgataccggctcaaaagttgatcccaaattaagtgtct

SEQ ID NO: 315189 - DNA, 75 bp, Artificial Sequence
  Synthetic
tatcagacaagggaaattctctctgggagctgattgattccctgttctgtcacctgggcaactcgacatacgaga

SEQ ID NO: 315190 - DNA, 75 bp, Artificial Sequence
  Synthetic
ttgttggcctgcttgaaccacttacactcgcaattcttcagacccgagatgtggtgttagacttgagaggggcct

SEQ ID NO: 315191 - DNA, 75 bp, Artificial Sequence
  Synthetic
ttttaaatcactgcctctcggaacttgatgctatattgatcaaagctaatttcactaccctagatgattttgctt

SEQ ID NO: 315192 - DNA, 75 bp, Artificial Sequence
  Synthetic
caattgcagacacactccaacaattactgaacttaagtgacatcaacttagtcgcggaattcttctcatacttcc

SEQ ID NO: 315193 - DNA, 75 bp, Artificial Sequence
  Synthetic
ggacgtttggacatcctacactcgaggcggtgactgcagccgataaagttcgaacatacatggcagatccaaaat

SEQ ID NO: 315194 - DNA, 75 bp, Artificial Sequence
  Synthetic
tgatcaattatgagatcatgatgaaagctcatgctgtatactgtggaattataataaatgggtatcgtgatcggc

SEQ ID NO: 315195 - DNA, 75 bp, Artificial Sequence
  Synthetic
atagcggcatttggccacctgttgagtttccttcccacgctgatcaggcaatcctccgtgctcgaaacaataatg

SEQ ID NO: 315196 - DNA, 75 bp, Artificial Sequence
  Synthetic
atgctctgagtgatgttatgtgtgtgctcaattggaaatcatttatagggtttcacttcaagtgcttcctagatc

SEQ ID NO: 315197 - DNA, 75 bp, Artificial Sequence
  Synthetic
tcaacttagatgaagatttgtctatttacttaaaagacagagctttagcagcagtcaaagaccactgggatgcga

SEQ ID NO: 315198 - DNA, 75 bp, Artificial Sequence
  Synthetic
tttatcctactgagcatatgaaatattcaccagagagaaaccctacttccaggcgtcttgtcgacatctttatcc

SEQ ID NO: 315199 - DNA, 75 bp, Artificial Sequence
  Synthetic
aagatgctaactttgatcctgcacatctaattgaatatgtcctatccggagagtacttaaccgatcctgagttta

SEQ ID NO: 315200 - DNA, 75 bp, Artificial Sequence
  Synthetic
acatttcgtatagtttaaaagaaaaggaaatcaagcaagctgggcggctgtttgctaagatgacctataagatga

SEQ ID NO: 315201 - DNA, 75 bp, Artificial Sequence
  Synthetic
gagcatgccaggttattgcggaaagcctaattgcacacggtgttggtcgctattttaaagataatggaatggtga

SEQ ID NO: 315202 - DNA, 75 bp, Artificial Sequence
  Synthetic
aatcagaagtggaattgagtaagacattgcatagaatgtcagtctcggccgtgccccggagtgatcggtcacaga

SEQ ID NO: 315203 - DNA, 75 bp, Artificial Sequence
  Synthetic
tgtcatcaggagggaatgtaataccccccagcaataattcggaatatactggtcattctaatccggacgggagtc

SEQ ID NO: 315204 - DNA, 75 bp, Artificial Sequence
  Synthetic
agaaggaatcctatattaatgtagggaaatttaataacagtcatcagagggataacaggttcggaggatgtatct

SEQ ID NO: 315205 - DNA, 75 bp, Artificial Sequence
  Synthetic
ccaataagaatgatctcaagacacaccgaaaataccagtctcttcctatccagtcattgaaacacgaggagaact

SEQ ID NO: 315206 - DNA, 75 bp, Artificial Sequence
  Synthetic
atgagacagtaagttcattcattaccacggacctccagaaatattgtctcaattggaggtatgagagcacagccg

SEQ ID NO: 315207 - DNA, 75 bp, Artificial Sequence
  Synthetic
tattcgctgagaggctgaatgaaatttacgggctacctggcttttttaactggcaacacaaacggttagagaggt

SEQ ID NO: 315208 - DNA, 75 bp, Artificial Sequence
  Synthetic
ctattttgtatgtagccgacccttcatgccccccggaccatgaagaattcatacatttagaagatactgataaca

SEQ ID NO: 315209 - DNA, 75 bp, Artificial Sequence
  Synthetic
gtgggatcttcattcattaccctatggggggaatagaggggtatagtcaaaaattgtggacaatcagcacaattc

SEQ ID NO: 315210 - DNA, 75 bp, Artificial Sequence
  Synthetic
cttacctataccttactgcagtggaggtgggtgtcagaattactgcattagttcaaggagacaatacagttatag

SEQ ID NO: 315211 - DNA, 75 bp, Artificial Sequence
  Synthetic
ccgtcactaaaagagtgcccactacttggccttatcatgtaaagaaggaatccgcaatggatgtaacaaggaggt

SEQ ID NO: 315212 - DNA, 75 bp, Artificial Sequence
  Synthetic
attttaagcaactgagatggaatctgagcggaattgggcacaacctgaagatgaacgagactattatctcgtccc

SEQ ID NO: 315213 - DNA, 75 bp, Artificial Sequence
  Synthetic
atttctttgtttattccaaagggatctactatgatggtatgttgctctcacagtcactgaagtcaatctcgagat

SEQ ID NO: 315214 - DNA, 75 bp, Artificial Sequence
  Synthetic
gtgttttttggtctgagaccttggtagatgagacaagagctgcctgtagtaatatagctacgacgatctgcaagg

SEQ ID NO: 315215 - DNA, 75 bp, Artificial Sequence
  Synthetic
cagtagagagaggctatgacaaatatgcaggctatttcctagttttcttaaaaactctccaacaattaatgattt

SEQ ID NO: 315216 - DNA, 75 bp, Artificial Sequence
  Synthetic
cgctcggattttctataaatcaaactttgacagcggatattgtttcacctatcctaaattctgattggtaccttt

SEQ ID NO: 315217 - DNA, 75 bp, Artificial Sequence
  Synthetic
atttgtcagtgatcctcccggcccctcttgggggatttaattacctaaatcttagtcggttgtttgtgcgcaata

SEQ ID NO: 315218 - DNA, 75 bp, Artificial Sequence
  Synthetic
gtgattggttagtatggcttctaagccattctaccctatttcattcaaccgtaaggttgagtattcagtgctcag

SEQ ID NO: 315219 - DNA, 75 bp, Artificial Sequence
  Synthetic
atcggctcacctcagggtgagtggtcgtgagcaaatgtttgagactctagcagaattagatagtcatgttgagac

SEQ ID NO: 315220 - DNA, 75 bp, Artificial Sequence
  Synthetic
agtggttgccggactgtggcgtgataatttgcgccgcagtctggtagcgacccccaccttcactgaggaggggtt

SEQ ID NO: 315221 - DNA, 75 bp, Artificial Sequence
  Synthetic
aatttgcgccgcagtctggtagcgacccccaccttcactgaggaggggttgttagactccttcctatcaaaacca

SEQ ID NO: 315222 - DNA, 75 bp, Artificial Sequence
  Synthetic
ccctcacgaacagttccccttgtccattcatgatctggccaagttacaaggcgagcttgtggaggcggcgcgcaa

SEQ ID NO: 315223 - DNA, 75 bp, Artificial Sequence
  Synthetic
tcctggtcacatattgcggcgtcattactccaccgattcgctcaccgccctaattaacaaaataacaaaatttgt

SEQ ID NO: 315224 - DNA, 75 bp, Artificial Sequence
  Synthetic
atgcaagctcgacgtgcatttgagcgtgaacgagcggaccttttcaaggagctgccacacgtcgaaccagacgtt

SEQ ID NO: 315225 - DNA, 75 bp, Artificial Sequence
  Synthetic
ggtcaccagcagaagtcctacttctatgcaatgtggcggcaggtggtgaagaagggaaaggagttctttataccc

SEQ ID NO: 315226 - DNA, 75 bp, Artificial Sequence
  Synthetic
cttgttaagtgcacctcatggcggaaaaagtttactgaacctgccgaaatcatacgacaagtgctggtccacttt

SEQ ID NO: 315227 - DNA, 75 bp, Artificial Sequence
  Synthetic
tgcgagggaatgcgttcgcaattttccacgaatgcgaactacatcaacttgtcgctcatcgcaaagatgcgaccg

SEQ ID NO: 315228 - DNA, 75 bp, Artificial Sequence
  Synthetic
accgttttgaccatgatcttccaacaacacaagaacacataccgtggctggctagcaacagtcaccgctctgatt

SEQ ID NO: 315229 - DNA, 75 bp, Artificial Sequence
  Synthetic
gctagcaacagtcaccgctctgattgaggtgtactccaacttgttccaggacatgagggacactgcggtgtccgc

SEQ ID NO: 315230 - DNA, 75 bp, Artificial Sequence
  Synthetic
ctttcgagcacaaggcccaacaccatgtgggtgggcggccatagccgctggtgcgctgctcatcttaatgaagct

SEQ ID NO: 315231 - DNA, 75 bp, Artificial Sequence
  Synthetic
ttcaggatgctctaacacagccagctactggcacaggttgcttaaggtgtgtggtggagtcaccactcttgctgc

SEQ ID NO: 315232 - DNA, 75 bp, Artificial Sequence
  Synthetic
ggcggctcgcgctgtggtttgggttcgtgacataatcatggaagctgatggcaagtcccggctcaagaagtacat

SEQ ID NO: 315233 - DNA, 75 bp, Artificial Sequence
  Synthetic
ggcccggaccgcagccttgctggagcttgcagcctccagagatgtcaatggcaccgatgagctaaagcggttact

SEQ ID NO: 315234 - DNA, 75 bp, Artificial Sequence
  Synthetic
gcaccgatgagctaaagcggttactggactgcttcacacagcttatcgaggaagggacagagctgattcaggagt

SEQ ID NO: 315235 - DNA, 75 bp, Artificial Sequence
  Synthetic
gaagggacagagctgattcaggagttcggaacatcaccactggctggccttgcccgctcgtacgtcagtgagctg

SEQ ID NO: 315236 - DNA, 75 bp, Artificial Sequence
  Synthetic
tgcccgctcgtacgtcagtgagctggagtcggctgctaatagcatcagaagcaccattttgcttgacaccccacg

SEQ ID NO: 315237 - DNA, 75 bp, Artificial Sequence
  Synthetic
caagacccccgttgccattatcctcactggccctccaggcataggcaaaactaggttggcacaacacctcgcggc

SEQ ID NO: 315238 - DNA, 75 bp, Artificial Sequence
  Synthetic
tgggtttggcaaggtgtcaaatttttctgtgacgcttgaccatcatgactcgtacactggcaacgaggttgccat

SEQ ID NO: 315239 - DNA, 75 bp, Artificial Sequence
  Synthetic
ttggtattgtcaacacggcaccttacccactcaactgcgaccgggtagagaacaaaggaaaagtgttcacatctg

SEQ ID NO: 315240 - DNA, 75 bp, Artificial Sequence
  Synthetic
cccactcaactgcgaccgggtagagaacaaaggaaaagtgttcacatctgactatgtcatctgcactagcaacta

SEQ ID NO: 315241 - DNA, 75 bp, Artificial Sequence
  Synthetic
ccctacatctgtcctcccggagaacccacgggccggcgccttctaccgtcgtgtgatcacggtggacgtctcatc

SEQ ID NO: 315242 - DNA, 75 bp, Artificial Sequence
  Synthetic
accctcaatagatgactggaagaagaggaaccctggaaagaaacccccagtggacctgtacaagggagacttctc

SEQ ID NO: 315243 - DNA, 75 bp, Artificial Sequence
  Synthetic
gcacctgcgcttgtcagttagaccgtttcttggctacaaccctgaaggagacacattggacggcgtgcgggttaa

SEQ ID NO: 315244 - DNA, 75 bp, Artificial Sequence
  Synthetic
gcccacaaccaccagtgttgatgggttgtcacgcttaatggagaccaagtttaaggaacaaggaaatgagcaacg

SEQ ID NO: 315245 - DNA, 75 bp, Artificial Sequence
  Synthetic
caacatttggatcacctgtccgcgcgatctggtggcccccgccgcatcaggtctgaaatcctacatggcagccaa

SEQ ID NO: 315246 - DNA, 75 bp, Artificial Sequence
  Synthetic
tcgcgcacttgctcaagtgtttcaggagccctcttcccaagacattggggaaacgtgcacgtcgcgcgtgtacgt

SEQ ID NO: 315247 - DNA, 75 bp, Artificial Sequence
  Synthetic
ttcatgcaacaacccaccacccacatttgttggacgcattgtaaaaatcacagccattaacccatgggacgcctc

SEQ ID NO: 315248 - DNA, 75 bp, Artificial Sequence
  Synthetic
gttggccaattcaatgctctcaatgtttgagacttccacacacataccagcatcagtgcagcgtgagattatgta

SEQ ID NO: 315249 - DNA, 75 bp, Artificial Sequence
  Synthetic
cagggtctgggacccgttggtccacctacaatcacgggagcccaacacacagatgttaccttacatcaatcgggt

SEQ ID NO: 315250 - DNA, 75 bp, Artificial Sequence
  Synthetic
ggtgcctgtcgccacggcttttgatttcatacgaggcctccgacaccatctcggtctgtgctcaatcaaagggat

SEQ ID NO: 315251 - DNA, 75 bp, Artificial Sequence
  Synthetic
gtggcgcgcttaccaaggctggacaagctcaaattcaatcctcgagtttttgtcaaaacatatggctgatgtgaa

SEQ ID NO: 315252 - DNA, 75 bp, Artificial Sequence
  Synthetic
tttcccccataaccctgagtgcaccgtgtttcgggcccctgatggggatgtcatcttctacacttttgggtcata

SEQ ID NO: 315253 - DNA, 75 bp, Artificial Sequence
  Synthetic
tcatcttctacacttttgggtcatatgcatgctttgtgtctcccgcccgcgtgccctttgttggcgatcccccca

SEQ ID NO: 315254 - DNA, 75 bp, Artificial Sequence
  Synthetic
cttgctcatgttgcacaacgtgtcctacctcactgcgcggtccagccgcgatgaggaagcaaagggtaaaacaaa

SEQ ID NO: 315255 - DNA, 75 bp, Artificial Sequence
  Synthetic
atgatgagtacgatgagtggcgagatctagtgcgtgactggcgccaagacatgacagtcagcgagttcgtcgagc

SEQ ID NO: 315256 - DNA, 75 bp, Artificial Sequence
  Synthetic
cgtgcctggctcgagttgagagcaatgcgcatgggggcaggggcttaccaacatgccacaatcatcggcaggggt

SEQ ID NO: 315257 - DNA, 75 bp, Artificial Sequence
  Synthetic
tgcgcatgggggcaggggcttaccaacatgccacaatcatcggcaggggtggtgtccaagacacgataatacgca

SEQ ID NO: 315258 - DNA, 75 bp, Artificial Sequence
  Synthetic
ggtgtccaagacacgataatacgcactcaacccatgcgcgcaccacgagcaccacgcagtcagggctatgatgaa

SEQ ID NO: 315259 - DNA, 75 bp, Artificial Sequence
  Synthetic
ctcaacccatgcgcgcaccacgagcaccacgcagtcagggctatgatgaagaagcacccactccaatagttgtgt

SEQ ID NO: 315260 - DNA, 75 bp, Artificial Sequence
  Synthetic
catcagccgcagaccaggtggaaggccaggagttcactattaggaaaactgaaggggaaactacctgggttaaca

SEQ ID NO: 315261 - DNA, 75 bp, Artificial Sequence
  Synthetic
tgacgacaatagcggaaggaacatatgaaacacccaacatcacagtccaggggtaccatctcaggatccttaatg

SEQ ID NO: 315262 - DNA, 75 bp, Artificial Sequence
  Synthetic
gttacccaaccaagcgcggggattgcgggacaccatatttcgacgcctgccgcagactggtgggtttgcacgccg

SEQ ID NO: 315263 - DNA, 75 bp, Artificial Sequence
  Synthetic
cgacttccaccaacggcgagacaaagcttgctcaacgcgtaactaagacatcacgtgttgagaacgcttttgcgt

SEQ ID NO: 315264 - DNA, 75 bp, Artificial Sequence
  Synthetic
ggaaaggtctggcggtcatacgtggtcctgattgcgggggcatgcccactggcactcgttaccaccgctctcctg

SEQ ID NO: 315265 - DNA, 75 bp, Artificial Sequence
  Synthetic
tcctgattgcgggggcatgcccactggcactcgttaccaccgctctcctgcctggcctgagataatcgagggtga

SEQ ID NO: 315266 - DNA, 75 bp, Artificial Sequence
  Synthetic
gacccacgcccctgccccattcgggtctggtgactctcggtattcattctctcaggtggaaatgctcgttaatgg

SEQ ID NO: 315267 - DNA, 75 bp, Artificial Sequence
  Synthetic
actcaagccttactctgaacccacaccaggtatcccacctgccttgctccaaagggcggcaacacacacacgcac

SEQ ID NO: 315268 - DNA, 75 bp, Artificial Sequence
  Synthetic
ctacctggaaactataattggcacccacaggtcacctaatttaacttttggagaagcctgtgccttgttggagcg

SEQ ID NO: 315269 - DNA, 75 bp, Artificial Sequence
  Synthetic
tacaacttcttgtgggccttttgtggccggccagaaaggggactattgggatgaagacaagcagtgctacactgg

SEQ ID NO: 315270 - DNA, 75 bp, Artificial Sequence
  Synthetic
atgaagacaagcagtgctacactggtgtgctggcagaccacctcgctaaggcctgggacgccgccaataggggtg

SEQ ID NO: 315271 - DNA, 75 bp, Artificial Sequence
  Synthetic
tggccccccagaatgcatacaagctggcactcaaggatgaacttcggcccattgacaagaacgcgcagggcaagc

SEQ ID NO: 315272 - DNA, 75 bp, Artificial Sequence
  Synthetic
gccggttgttgtggggttgtgatgccggggccacgctggtcgccactgcagcattcaaaggggtggccacgcgat

SEQ ID NO: 315273 - DNA, 75 bp, Artificial Sequence
  Synthetic
tgcaagcggttgctcccatgacaccagttggggttggcatcaacatggacagctaccaagttgaagtgcttaatg

SEQ ID NO: 315274 - DNA, 75 bp, Artificial Sequence
  Synthetic
agctaccaagttgaagtgcttaatgaatctctcaaaggaggggttctctactgtctggattacagtaagtgggac

SEQ ID NO: 315275 - DNA, 75 bp, Artificial Sequence
  Synthetic
tccacccagcatccagcggtcacggcctcctcattgtcaatcctagaacggctgtctgaggccaccccaatcacc

SEQ ID NO: 315276 - DNA, 75 bp, Artificial Sequence
  Synthetic
acatccgcggtggagttgctatcatccccagcgcgaggccacttaaacgacataatttttgtcaccaagtccggg

SEQ ID NO: 315277 - DNA, 75 bp, Artificial Sequence
  Synthetic
cttccatcaggcatgccattcaccagtgtcatcaattccctcaaccacatgacatattttgccgcggcagtgttg

SEQ ID NO: 315278 - DNA, 75 bp, Artificial Sequence
  Synthetic
gactgtttgtattcagtctgtcctgccacggcctccatcttccactctgttttggccaatctcacctcatttgga

SEQ ID NO: 315279 - DNA, 75 bp, Artificial Sequence
  Synthetic
ctaaagccaaccgctgcagacaagagtgaatgcattgcccccacccacacgccggtatttcttaaaagaaccttg

SEQ ID NO: 315280 - DNA, 75 bp, Artificial Sequence
  Synthetic
aataggacaactgacatcaattccccaccggcatatgaccgggaggcgcgtagtgtccagcttgaaaacgccctt

SEQ ID NO: 315281 - DNA, 75 bp, Artificial Sequence
  Synthetic
tagtgtccagcttgaaaacgcccttgcctatgcttcgcagcacggccacagtgtctttgaggaggttgccaagct

SEQ ID NO: 315282 - DNA, 75 bp, Artificial Sequence
  Synthetic
ggcccgtcatacggccaaagctgaggggcttgtgttgacgaatgtcaactacgaccaggctctcgccacctacga

SEQ ID NO: 315283 - DNA, 75 bp, Artificial Sequence
  Synthetic
atcctggttcataggtggtgcaggcctggtgcaagatggccccagtgaagagaccaccaaattagtgtttgaaat

SEQ ID NO: 315284 - DNA, 75 bp, Artificial Sequence
  Synthetic
agaccaccaaattagtgtttgaaatggagggtaatggcctaccccaggctggacaacagcaagctcttgacgtgc

SEQ ID NO: 315285 - DNA, 75 bp, Artificial Sequence
  Synthetic
caaccttctgcccaggcccaacgcatggagctggctgttgcaaccggtgccgtgtcatcaaatgtcccggatgca

SEQ ID NO: 315286 - DNA, 75 bp, Artificial Sequence
  Synthetic
gtgcgtcagtgctttgcactccttcgcacatttccttggaacactcgacaggccacaggcacttatctgggatct

SEQ ID NO: 315287 - DNA, 75 bp, Artificial Sequence
  Synthetic
ggccacaggcacttatctgggatctgctgcgctgtccccagctctcaacccatacaccgcgcatctttcggcgat

SEQ ID NO: 315288 - DNA, 75 bp, Artificial Sequence
  Synthetic
gtgggcagggtggggtggtagcatggaggcgcgtgtcaccatttctggttctggcacctttgctggtaaaattat

SEQ ID NO: 315289 - DNA, 75 bp, Artificial Sequence
  Synthetic
tgttgccctactgcccccggggttggacccaacgcgtgtgcgtgatcctggagttttgccccacgcccaggttga

SEQ ID NO: 315290 - DNA, 75 bp, Artificial Sequence
  Synthetic
cgctcgcgctgtggatcctatcacatttaacatcaacgatgtgagagctgtggactaccatcgcaccgatggcca

SEQ ID NO: 315291 - DNA, 75 bp, Artificial Sequence
  Synthetic
cattcagccacgatgctttgtccactgcgtgggtatcggtggaaactagaccaggacctgattttgacttctgcc

SEQ ID NO: 315292 - DNA, 75 bp, Artificial Sequence
  Synthetic
tcctgaaacccccacaaatggagatggagaatgggctctcacccagcacgctcttacccagacatcttggccgtt

SEQ ID NO: 315293 - DNA, 75 bp, Artificial Sequence
  Synthetic
ctcttacccagacatcttggccgttcccgcggtaataggtgtggggggttcattgtaggtatggctgtagtggcc

SEQ ID NO: 315294 - DNA, 75 bp, Artificial Sequence
  Synthetic
cattgtaggtatggctgtagtggccatggcacgccaggtcaaccaccatttctccactgcagccacaacctatgg

SEQ ID NO: 315295 - DNA, 75 bp, Artificial Sequence
  Synthetic
gtggtccacacttcccctcggcccgtgtgctgcaaagatcactagttctctccctggggaaataaacaactacac

SEQ ID NO: 315296 - DNA, 75 bp, Artificial Sequence
  Synthetic
tgtgctgcaaagatcactagttctctccctggggaaataaacaactacaccgggtttgcagatgttggtggtgcg

SEQ ID NO: 315297 - DNA, 75 bp, Artificial Sequence
  Synthetic
ggtgagggaccaataatacctaacatcccaaatcattggcccgactcttgtgcctcgtctgtcattgcaacttgg

SEQ ID NO: 315298 - DNA, 75 bp, Artificial Sequence
  Synthetic
tcccaaatcattggcccgactcttgtgcctcgtctgtcattgcaacttgggacggctcacttcaccgcccaaatc

SEQ ID NO: 315299 - DNA, 75 bp, Artificial Sequence
  Synthetic
ttggcattagtggttcaataatgacctttgacaaccatggggatgcggatgaagcccaaataaccggggctatgg

SEQ ID NO: 315300 - DNA, 75 bp, Artificial Sequence
  Synthetic
cagcaactgtggacccatcccccagtcgtagaacccagctgcaaggtagctttactgccaacaccatgcgtataa

SEQ ID NO: 315301 - DNA, 75 bp, Artificial Sequence
  Synthetic
tcgtagaacccagctgcaaggtagctttactgccaacaccatgcgtataatgcgcacgtctggtcttgacaagat

SEQ ID NO: 315302 - DNA, 75 bp, Artificial Sequence
  Synthetic
tggtgaggttaacaagaatgtgtactttattccaatccttcttgacggggccactgggtacatcaatgaaaaagt

SEQ ID NO: 315303 - DNA, 75 bp, Artificial Sequence
  Synthetic
ccactgggtacatcaatgaaaaagttacaaacttggctgatatcaacatttcatatggccctgttggtcccaaca

SEQ ID NO: 315304 - DNA, 75 bp, Artificial Sequence
  Synthetic
atgtcatcctttggcgcgagcgggtcttttccagccaccctcgaccaggcatcttgtacagctcccagcttgaat

SEQ ID NO: 315305 - DNA, 75 bp, Artificial Sequence
  Synthetic
cttttccagccaccctcgaccaggcatcttgtacagctcccagcttgaatccactgcttccatttttcaagatgg

SEQ ID NO: 315306 - DNA, 75 bp, Artificial Sequence
  Synthetic
gccagtaaacatacccaacaactacatggcagttttcaatgtgagtgacacgggtgcagatttccaaattggcat

SEQ ID NO: 315307 - DNA, 75 bp, Artificial Sequence
  Synthetic
ttgccctgacgggtacatgcgcacaggatctccagttggcacagttgttgatctaacacccgagtgcactttcac

SEQ ID NO: 315308 - DNA, 75 bp, Artificial Sequence
  Synthetic
atctaacacccgagtgcactttcacttttgttggccttttccccttcacttcccctctcaatgggccacatggga

SEQ ID NO: 315309 - DNA, 75 bp, Artificial Sequence
  Synthetic
atctaacacccgagtgcactttcacttttgttggccttttccccttcacttcccctctcaatgggcctcatggga

SEQ ID NO: 315310 - DNA, 75 bp, Artificial Sequence
  Synthetic
atctaacacccgagtgcactttcacttttgttggccttttccccttcacttcccctctcaatgggccccatggga

SEQ ID NO: 315311 - DNA, 75 bp, Artificial Sequence
  Synthetic
atctaacacccgagtgcactttcacttttgttggccttttccccttcacttcccctctcaatgggccgcatggga

SEQ ID NO: 315312 - DNA, 75 bp, Artificial Sequence
  Synthetic
agcttggcggtgcgcttgttgacgctgctggcagcgtgtccaacatggtgtaccagcacaaacaacttgaactcc

SEQ ID NO: 315313 - DNA, 75 bp, Artificial Sequence
  Synthetic
ttaaacaacaaaaccaactgtattcaacttggatggccaaaaatgaacagctccaacgtgactccatggcactgt

SEQ ID NO: 315314 - DNA, 75 bp, Artificial Sequence
  Synthetic
ctgaaaagttgacaacggagggccccgctctccgagtcaaggctgcactagacgcgggtttcgaccccgtcagtg

SEQ ID NO: 315315 - DNA, 75 bp, Artificial Sequence
  Synthetic
cgctctccgagtcaaggctgcactagacgcgggtttcgaccccgtcagtgctcgccgtttggccgggtcagggga

SEQ ID NO: 315316 - DNA, 75 bp, Artificial Sequence
  Synthetic
acgccggattcaggggtacatagacatgcctatcatgactcagcagcaatcatctgcacactgggtgaatggcaa

SEQ ID NO: 315317 - DNA, 75 bp, Artificial Sequence
  Synthetic
tttgaccaaagttaattcggcacttaccacattccagcaaggtaccccttttggcaagccccaaccccccaaatt

SEQ ID NO: 315318 - DNA, 75 bp, Artificial Sequence
  Synthetic
gacacaacccaggctcatcatctgcctgacctaccctcttttattccttttctttacttttcttttcttttccga

SEQ ID NO: 315319 - DNA, 75 bp, Artificial Sequence
  Synthetic
ttttcttttccgactggcactcacgcgttcgggagtataatgccaattaagcgattggctccagtttcctcttgg

SEQ ID NO: 315320 - DNA, 75 bp, Artificial Sequence
  Synthetic
gtgatcaccttgggatggcttccaagccactccaagttgagtcttgcgacttcacttttgaagtccacctcctcc

SEQ ID NO: 315321 - DNA, 75 bp, Artificial Sequence
  Synthetic
gacagtgctacctcagggtagcacctagagaggaatttctgtttgacaacacactggaaacgattgcccagtatt

SEQ ID NO: 315322 - DNA, 75 bp, Artificial Sequence
  Synthetic
tgttgaagcacatgcctagatcccacaagtttagcatggggcaagcttgtgaattcgaggctgaggggttgctgt

SEQ ID NO: 315323 - DNA, 75 bp, Artificial Sequence
  Synthetic
cacggttattcgggacagccggttccccctcacttgactcacaaagcgcctacaaagagctctttggttttgaca

SEQ ID NO: 315324 - DNA, 75 bp, Artificial Sequence
  Synthetic
ctagtgagcaaatgcccctctccctagaagaattggcaaagttgcaaggagaaatcgcctcctcgctccaaacca

SEQ ID NO: 315325 - DNA, 75 bp, Artificial Sequence
  Synthetic
ataacaatcaatttgtaaccaaacatggcaaggcaaatgtgcaggcattactggaacagttgaaccagcttgtgc

SEQ ID NO: 315326 - DNA, 75 bp, Artificial Sequence
  Synthetic
cacgggatgtttctgaggccgagcgacggcgacgtgaattctttgaacgtcaaaccgctgcagcttttgcagaac

SEQ ID NO: 315327 - DNA, 75 bp, Artificial Sequence
  Synthetic
tccccaatgatgattcattcacagagcatgactggaagagttattggtatgctatgtggcgacgtgtggtgggag

SEQ ID NO: 315328 - DNA, 75 bp, Artificial Sequence
  Synthetic
gctgccgttcttattaccacagcctccctcgctggagctctttcaaaacacgtcttgcccgagcgacagagccat

SEQ ID NO: 315329 - DNA, 75 bp, Artificial Sequence
  Synthetic
tacgtcaggtcttggctgtagccgctcagacatttgaccaatgcatccaaactgacccccgcatccttgcaatga

SEQ ID NO: 315330 - DNA, 75 bp, Artificial Sequence
  Synthetic
actgtgtcactgctcttaaaccaacagtcctcaccatgatctaccagcaacatcataacaccccaagtgggtggt

SEQ ID NO: 315331 - DNA, 75 bp, Artificial Sequence
  Synthetic
tggcaactctgacagctctttgggaggttttccaaccctccctccctaatctgggcacattgggtgcctccgtgg

SEQ ID NO: 315332 - DNA, 75 bp, Artificial Sequence
  Synthetic
ggttttccaaccctccctccctaatctgggcacattgggtgcctccgtggcaaccactttgggactggttgtaac

SEQ ID NO: 315333 - DNA, 75 bp, Artificial Sequence
  Synthetic
tgcattgtctcggtttttccagaagctgtgttcctatgtgtctgaaacattctttcctgaagctccaactacacc

SEQ ID NO: 315334 - DNA, 75 bp, Artificial Sequence
  Synthetic
aggctgggttgcaattgcggctggggtcctgctgcttttgttaaaactgtcgtgcattccaaaggtcttcaccca

SEQ ID NO: 315335 - DNA, 75 bp, Artificial Sequence
  Synthetic
cgtgcattccaaaggtcttcacccattggcatacgcttttaaaacttgctagtggaattaccacagttgttggag

SEQ ID NO: 315336 - DNA, 75 bp, Artificial Sequence
  Synthetic
ccaccagggccgtggattggatcatgaccaaagtcagggatgcccgccattcttccatgtgtaaacagtttctca

SEQ ID NO: 315337 - DNA, 75 bp, Artificial Sequence
  Synthetic
gtcgtgtctctgcattgttggaacttcactattctaaaacagtcactggtgttgcagagaacactgaattgctca

SEQ ID NO: 315338 - DNA, 75 bp, Artificial Sequence
  Synthetic
gttgcagagaacactgaattgctcaaatgttttgaccaattaattgatgagggtgaggaattggtgtccgaaatt

SEQ ID NO: 315339 - DNA, 75 bp, Artificial Sequence
  Synthetic
ggaggaggttcacttgctgcaataattcgcagtggagtagacacactacagcgggtttccaccgagatcaaggct

SEQ ID NO: 315340 - DNA, 75 bp, Artificial Sequence
  Synthetic
gcgggtttccaccgagatcaaggctacaatacagcttgataacccgcgacctgtccctgtatgtgtggtgttctc

SEQ ID NO: 315341 - DNA, 75 bp, Artificial Sequence
  Synthetic
cggacccccgggcataggcaaaacctctctcgcttatcacatggctaaagggattgggctcacttcaaatttttc

SEQ ID NO: 315342 - DNA, 75 bp, Artificial Sequence
  Synthetic
cttggctaacgatcatcatgatggctacacaggcaatcccgttgcgatctgggatgaatttgacaccgaccgtga

SEQ ID NO: 315343 - DNA, 75 bp, Artificial Sequence
  Synthetic
tggcaagtttgttgagcaaatgattgcacttgtcaacacacagccctgtgtgctcaattgtgatcgccctgagaa

SEQ ID NO: 315344 - DNA, 75 bp, Artificial Sequence
  Synthetic
caaagggaaacttttcacttccaagtttatcttctgcaccacaaattacaccacaagtgttctacctgacaaccc

SEQ ID NO: 315345 - DNA, 75 bp, Artificial Sequence
  Synthetic
tcgggctggagccttttaccgtcgaatcatcacggtggatgtgcgctcccctgaaattgaagattggatgtcagc

SEQ ID NO: 315346 - DNA, 75 bp, Artificial Sequence
  Synthetic
gcacccagggcgatcgccacctaagacactttttaaaaatgactgctcccacctaaaattaatggttcggcctta

SEQ ID NO: 315347 - DNA, 75 bp, Artificial Sequence
  Synthetic
tatgggttacaatccagatggtgacactttatcaggtaagcgagtcaaaccaacacccatttcaattgcaggttt

SEQ ID NO: 315348 - DNA, 75 bp, Artificial Sequence
  Synthetic
acatgatttgatcgacaagaagtttgaagagcagtctggtgaggtgaggggtttgtggatcaccgtgcctagacg

SEQ ID NO: 315349 - DNA, 75 bp, Artificial Sequence
  Synthetic
gagtgttcagccagcactggccgcagtgaagaagttttgcgtggcgcatcaggcactttgccatgtgacctccac

SEQ ID NO: 315350 - DNA, 75 bp, Artificial Sequence
  Synthetic
gcctacaccagaggtgttgcagtgcactaccttctcatgtgtcgtggtttcagacgctcacccacctccaggagt

SEQ ID NO: 315351 - DNA, 75 bp, Artificial Sequence
  Synthetic
actaccttctcatgtgtcgtggtttcagacgctcacccacctccaggagtacctttgatccacatcaaaaatgcc

SEQ ID NO: 315352 - DNA, 75 bp, Artificial Sequence
  Synthetic
catcttgaaagtgacgcaacaggtcaatcattgtccagcattagtgagagtttgcttgggatgttcattaccgag

SEQ ID NO: 315353 - DNA, 75 bp, Artificial Sequence
  Synthetic
tttgcttgggatgttcattaccgagcaacgtgtctcttcaaatgtacaacgggacatcatgtacaaggtgtggtc

SEQ ID NO: 315354 - DNA, 75 bp, Artificial Sequence
  Synthetic
caacgtgtctcttcaaatgtacaacgggacatcatgtacaaggtgtggtcacccttcacactgatgcaaactgag

SEQ ID NO: 315355 - DNA, 75 bp, Artificial Sequence
  Synthetic
ccacttaacacgcaaaacttgccccccatccgccggataatttacgcggacactgccatggatttcattggtggt

SEQ ID NO: 315356 - DNA, 75 bp, Artificial Sequence
  Synthetic
ttgcgtcatcacttggggttcagttcaatccccggcctttggagggctctgaaacatctccctgacacatcctcc

SEQ ID NO: 315357 - DNA, 75 bp, Artificial Sequence
  Synthetic
caatccccggcctttggagggctctgaaacatctccctgacacatcctccatgatagagtggattacggatcatt

SEQ ID NO: 315358 - DNA, 75 bp, Artificial Sequence
  Synthetic
gaaacatctccctgacacatcctccatgatagagtggattacggatcatttgtcccaggtgcaattcccacttaa

SEQ ID NO: 315359 - DNA, 75 bp, Artificial Sequence
  Synthetic
cccggaatccaccctttttcgcactggcaacggtgatgtgattttctacacctacgggtctttctatgcattggg

SEQ ID NO: 315360 - DNA, 75 bp, Artificial Sequence
  Synthetic
gacctgtgctagagtacctgctgtaactggtgacactttaaatccactaccaaacactccacttaagatgacatg

SEQ ID NO: 315361 - DNA, 75 bp, Artificial Sequence
  Synthetic
gtttgagacactaaaagccttgtgttcatcagcccttcgcctcttttcagctgttgccccgtttgcaattgctgt

SEQ ID NO: 315362 - DNA, 75 bp, Artificial Sequence
  Synthetic
ctgttgccccgtttgcaattgctgtggcaaacgtcacttatctcacaacccgtggggcacgtgaagagcaggcaa

SEQ ID NO: 315363 - DNA, 75 bp, Artificial Sequence
  Synthetic
aaggcaaaacaaagcatgggcgtggagctcgtcatgggcggggccgctctactgcattgaatgatgatgagtaca

SEQ ID NO: 315364 - DNA, 75 bp, Artificial Sequence
  Synthetic
atgagtggatggatttacgtcgtgattggcgggaggaaatgactgccgaccagttcttgcagctccgggacgagg

SEQ ID NO: 315365 - DNA, 75 bp, Artificial Sequence
  Synthetic
cttatgagggaatcatcaatgacagaacccaaaggtacaacacctggctcaatattcgtaacatgaggcttgggg

SEQ ID NO: 315366 - DNA, 75 bp, Artificial Sequence
  Synthetic
ctggcgcttaccaacacgctaccattattggcaaaggtggggttagaaatgaaattattcgcacacaagtgatga

SEQ ID NO: 315367 - DNA, 75 bp, Artificial Sequence
  Synthetic
aggcaccaagaaaaggcaagtggtcacacattgactcatctggacctatgaattactttgatgaagcccccacac

SEQ ID NO: 315368 - DNA, 75 bp, Artificial Sequence
  Synthetic
cattggtggaatttgaaagtgatggcagtcacattggttggggtgtgcaccttggtaatgggcgcattgtaactg

SEQ ID NO: 315369 - DNA, 75 bp, Artificial Sequence
  Synthetic
cttggtaatgggcgcattgtaactgtcacccatgttgcaacttcatccaacacagtcaatggagtgcccttcaaa

SEQ ID NO: 315370 - DNA, 75 bp, Artificial Sequence
  Synthetic
attaaggatacagatggtgagacatgtcaagtgtacgctgcacttggtgacttaccacactatcaaattggtgat

SEQ ID NO: 315371 - DNA, 75 bp, Artificial Sequence
  Synthetic
ggccctcctgtttattacacaaccagattccacccagtcttggtaattggagagggacaatatgacacacccacc

SEQ ID NO: 315372 - DNA, 75 bp, Artificial Sequence
  Synthetic
agagggacaatatgacacacccaccacaaccgtcaatggctttcatgtaaagatcaccaattcctacccaacaaa

SEQ ID NO: 315373 - DNA, 75 bp, Artificial Sequence
  Synthetic
gaagggtgattgtggtctgccctacttcaactctctgcgccaagtggttgcattgcacgctgctgggagcactga

SEQ ID NO: 315374 - DNA, 75 bp, Artificial Sequence
  Synthetic
tggcaccactaaactcgcacaacgagttggcaagaccaatgacacttctgaaagctttgtttggaagggactgcc

SEQ ID NO: 315375 - DNA, 75 bp, Artificial Sequence
  Synthetic
tgtgttgcgtggcagtgatgtgggtgggttgccaactggcacccgttaccacagatctcctgcatggccagaaac

SEQ ID NO: 315376 - DNA, 75 bp, Artificial Sequence
  Synthetic
gggttgccaactggcacccgttaccacagatctcctgcatggccagaaacaatgccccacgaaacacattcacct

SEQ ID NO: 315377 - DNA, 75 bp, Artificial Sequence
  Synthetic
gccccctttggatcaggcgacaagaggtatgatttctcccaagttgaaatgcttgttaacaaccttcgcccatac

SEQ ID NO: 315378 - DNA, 75 bp, Artificial Sequence
  Synthetic
cttgatgaagtcccgggcataccaccagttctattgaacagagccattgtccacacccgtaactatttgcaatcc

SEQ ID NO: 315379 - DNA, 75 bp, Artificial Sequence
  Synthetic
atcattggtagtgaacagagtcccagtctgtcatatggagtggcagcaggcatgttggaacgtggcacttcctgt

SEQ ID NO: 315380 - DNA, 75 bp, Artificial Sequence
  Synthetic
ggcccacacgttccaggtttgaaatctgactattgggatgaagaaacatgtcaatacacaggagcattacgggaa

SEQ ID NO: 315381 - DNA, 75 bp, Artificial Sequence
  Synthetic
cacctcgagcaagtgtggaacaaagctttacttggcacacccccgagccacgactacaaattagccttgaaagat

SEQ ID NO: 315382 - DNA, 75 bp, Artificial Sequence
  Synthetic
ctttacttggcacacccccgagccacgactacaaattagccttgaaagatgaattgagaccaaatgagaaaaatg

SEQ ID NO: 315383 - DNA, 75 bp, Artificial Sequence
  Synthetic
cccaagggaaacggcgcctcttgtggggtgcggatgctggcttgacccttgtgtgttgtgctgctttgaaacccg

SEQ ID NO: 315384 - DNA, 75 bp, Artificial Sequence
  Synthetic
cagcagtacgattgcagagtgtcgttcctatgacaccagtggctgtaggtatcaacatggactcggcccacattg

SEQ ID NO: 315385 - DNA, 75 bp, Artificial Sequence
  Synthetic
aggtcatgaacgagtccctcaagggacgagtgttatatgccttagactacagcaaatgggacagtacacagtccg

SEQ ID NO: 315386 - DNA, 75 bp, Artificial Sequence
  Synthetic
agcaaatgggacagtacacagtccgccgctgtcactgctgcatccctggaaattctttcatctttcatggaacca

SEQ ID NO: 315387 - DNA, 75 bp, Artificial Sequence
  Synthetic
tcacctgtggtatcctctgccattgaagctttgaaagcaccagcaaggggcatggtgaatgatgccatatttgtg

SEQ ID NO: 315388 - DNA, 75 bp, Artificial Sequence
  Synthetic
gcgcgctctggtctcccctcgggcatgcctttcactagtgtcatcaattcaatcaaccacatgctgtacatctcc

SEQ ID NO: 315389 - DNA, 75 bp, Artificial Sequence
  Synthetic
tgcctttcactagtgtcatcaattcaatcaaccacatgctgtacatctcctcagccattctgcaagcatatgagt

SEQ ID NO: 315390 - DNA, 75 bp, Artificial Sequence
  Synthetic
aatcaaccacatgctgtacatctcctcagccattctgcaagcatatgagtccatgggactgccatataatgacaa

SEQ ID NO: 315391 - DNA, 75 bp, Artificial Sequence
  Synthetic
tgtgttcaacatagagacagttcacacgtatggtgacgactgcctctatggtttcacaccggcaactgcttctct

SEQ ID NO: 315392 - DNA, 75 bp, Artificial Sequence
  Synthetic
gtttcacaccggcaactgcttctctagcatcaatgatcatagacaaccttcgatcatatggcctcaaaccaacag

SEQ ID NO: 315393 - DNA, 75 bp, Artificial Sequence
  Synthetic
cagctgacaaaggtgatgtcattgcccctgtacaagtgccagtcttcttgaagagaacctttgccacaacaccac

SEQ ID NO: 315394 - DNA, 75 bp, Artificial Sequence
  Synthetic
ccctgtacaagtgccagtcttcttgaagagaacctttgccacaacaccacacggtttgcgcgccctgcttgatac

SEQ ID NO: 315395 - DNA, 75 bp, Artificial Sequence
  Synthetic
tagctctatcctgagacagttccactgggttaaggcgcaacgcacttgtgacattcagtcccctccagcaattga

SEQ ID NO: 315396 - DNA, 75 bp, Artificial Sequence
  Synthetic
tataaagtcacgagcagcccaattggaagtggcactcgcttatgcaagtcagcatggccatgaatttttcgagaa

SEQ ID NO: 315397 - DNA, 75 bp, Artificial Sequence
  Synthetic
gaagtggcactcgcttatgcaagtcagcatggccatgaatttttcgagaaggccagggagattgcggagaagacc

SEQ ID NO: 315398 - DNA, 75 bp, Artificial Sequence
  Synthetic
agcaaagtagaggggtatctcctggttaataccaactttgaacaagctgtggcatgctacaacagctggtacatt

SEQ ID NO: 315399 - DNA, 75 bp, Artificial Sequence
  Synthetic
ggtggcaccacaccagaaatgcccactaccaatgaaggctgtgggctattagtgtttgagatggagggcaatggc

SEQ ID NO: 315400 - DNA, 75 bp, Artificial Sequence
  Synthetic
agtgtttgagatggagggcaatggctcccgacttgggaactcacaaacccaatcccatatggatacttctaacac

SEQ ID NO: 315401 - DNA, 75 bp, Artificial Sequence
  Synthetic
tgtgcagggtgcaccgccgggcacgacaggccctgcggacgcaccccttgtacctgttaatccagaacagcccaa

SEQ ID NO: 315402 - DNA, 75 bp, Artificial Sequence
  Synthetic
tctccctgcccaacgcctggagttggctattgccacaggagcaacatcctccaatgtccctgactgtgtgcggag

SEQ ID NO: 315403 - DNA, 75 bp, Artificial Sequence
  Synthetic
ctgctttgctctccttcgcacgattccttggaacactcgacagccccagggatctttgctcacagctgtgtcttt

SEQ ID NO: 315404 - DNA, 75 bp, Artificial Sequence
  Synthetic
acatcctgacatcaacccgtacacaaaacatcttgctcaaatgtttgccgggtgggggggagcaatggacattag

SEQ ID NO: 315405 - DNA, 75 bp, Artificial Sequence
  Synthetic
agtcacagtctcaggctcgggtctatttgcaggcaagcttgtctgtggcgtactgcctcctggagttaatcccac

SEQ ID NO: 315406 - DNA, 75 bp, Artificial Sequence
  Synthetic
tcttgtcaacgatccgggggtgcttccacacgcactagttgatgcgcgcattactgaaccagcgtgcttcaatgt

SEQ ID NO: 315407 - DNA, 75 bp, Artificial Sequence
  Synthetic
ggctgatgtccgtgccgtggattaccaccgcacggatggggatgaggcaactgccacgcttggaatctgggtact

SEQ ID NO: 315408 - DNA, 75 bp, Artificial Sequence
  Synthetic
acaaccacttatcaaccccttttcaaacgaagcagtatccactgcttggatctctattgaaaccaaacccggagg

SEQ ID NO: 315409 - DNA, 75 bp, Artificial Sequence
  Synthetic
aacgaagcagtatccactgcttggatctctattgaaaccaaacccggaggagattttgatctgtgcttattaaaa

SEQ ID NO: 315410 - DNA, 75 bp, Artificial Sequence
  Synthetic
ccccctggacaagccatggagaatggaggctcaccctcacaccttttgccacgcaaattacaacgggcacgtggc

SEQ ID NO: 315411 - DNA, 75 bp, Artificial Sequence
  Synthetic
aaccgtgcgggaggttatgcagttgggatggtgatagttggctcagcacaccaagttaaccgccatttcaccgcc

SEQ ID NO: 315412 - DNA, 75 bp, Artificial Sequence
  Synthetic
ggatggtgatagttggctcagcacaccaagttaaccgccatttcaccgcccttggcaccactttcgggtggtcca

SEQ ID NO: 315413 - DNA, 75 bp, Artificial Sequence
  Synthetic
ctgcaccatatgaaccaatgaggtgtgcctttggtggtgtccatgtcggggcaacaaccccaaagaaaattggct

SEQ ID NO: 315414 - DNA, 75 bp, Artificial Sequence
  Synthetic
gcaacaaccccaaagaaaattggctattattgggaggttggtgcagatcaacgcggacctctcttccccaacata

SEQ ID NO: 315415 - DNA, 75 bp, Artificial Sequence
  Synthetic
acgcggacctctcttccccaacatagttaaccattggccagattttgctgtcaactccaaatattcatggcccga

SEQ ID NO: 315416 - DNA, 75 bp, Artificial Sequence
  Synthetic
tgcagactacatcccttacaatgctgttgtggggacactggtttcatttgctgataatggtgatgtgtctgaaaa

SEQ ID NO: 315417 - DNA, 75 bp, Artificial Sequence
  Synthetic
tgaagtggctacagccttcgcagtgtctatgaacacgccatccactggcgggcgtggcacgctgcgtgagaactt

SEQ ID NO: 315418 - DNA, 75 bp, Artificial Sequence
  Synthetic
tgacccttcaaccatgcatcttgtgcgtaccaactcaactgcacaacccgctgattggccatcaggctcaaatac

SEQ ID NO: 315419 - DNA, 75 bp, Artificial Sequence
  Synthetic
tggcaatggatacttcacaccaatgtggggccacggtagtggaaacgcaatcaatgacaaagttactaacatgga

SEQ ID NO: 315420 - DNA, 75 bp, Artificial Sequence
  Synthetic
gggtgctaattacacctttggtggttctggtcaaaataacatagtgttgtggattgaaaagatcttctccgacca

SEQ ID NO: 315421 - DNA, 75 bp, Artificial Sequence
  Synthetic
ccctggtcccacaatcctgtattcctcacaattggacagcacagccactatcttccaatctggtccagttaacat

SEQ ID NO: 315422 - DNA, 75 bp, Artificial Sequence
  Synthetic
ccctgaaaacatgatggctgtgtataacgtaacaaccaatggtgcggactttcaagttgggattcgccgtgatgg

SEQ ID NO: 315423 - DNA, 75 bp, Artificial Sequence
  Synthetic
ttatatggtgacatctggcactattggcactcggcaggaacttgatcccgacaccactttcacttatgttggact

SEQ ID NO: 315424 - DNA, 75 bp, Artificial Sequence
  Synthetic
ttttcccctctctgcttcacttgttggcccacatgggaatactggccgggcccaaattgcttggtcatgagttgg

SEQ ID NO: 315425 - DNA, 75 bp, Artificial Sequence
  Synthetic
ctagttggagcacttcaaactcttggtgggcttactgatgtggcttctaccatttctggtgtggtctaccaacag

SEQ ID NO: 315426 - DNA, 75 bp, Artificial Sequence
  Synthetic
aaacacttggaacaattgaggaggcaaaatgatttgcagcaggaatggatggcgcgcaatgaacaactgcagcgc

SEQ ID NO: 315427 - DNA, 75 bp, Artificial Sequence
  Synthetic
gatgccatgcagctttcacgtgacctttccacacacggcccggccctgagagcgcaggccgccattgaggctggg

SEQ ID NO: 315428 - DNA, 75 bp, Artificial Sequence
  Synthetic
tttgatgtggttagtgcgcgtcagcttgctggtgcgggtgaacgcagaattaatggctatctggaacaacccatc

SEQ ID NO: 315429 - DNA, 75 bp, Artificial Sequence
  Synthetic
taatggctatctggaacaacccatccgaaccattggcgaggccatggccgtgcaatcaaggggtaacctcgctac

SEQ ID NO: 315430 - DNA, 75 bp, Artificial Sequence
  Synthetic
cctgtctggcgccatgagcacattccaaagtggtacacaatttggcatgaaacaaccaaagaattggaaacttca

SEQ ID NO: 315431 - DNA, 75 bp, Artificial Sequence
  Synthetic
aagagctgaacaatcacggggacctgttgtgaacctgggacccagacccccatctactgatttatgatttctaaa

SEQ ID NO: 315432 - DNA, 75 bp, Artificial Sequence
  Synthetic
ctatatttcttttcttccctttgtggttgcacacgcgttcgggtgcatgacggtcaattaagcgattgacgccac

SEQ ID NO: 315433 - DNA, 75 bp, Artificial Sequence
  Synthetic
gtgattggttagtatggcttccaagccattctacccaatggagttcaacctaaaggttgagctgcttgtgctccg

SEQ ID NO: 315434 - DNA, 75 bp, Artificial Sequence
  Synthetic
atctgcccacctcagggtgggtggtcgagagcagatttttgagactgttgaagaccttgacattcacgtcaaagg

SEQ ID NO: 315435 - DNA, 75 bp, Artificial Sequence
  Synthetic
ggtggtggccagattgtggcgcgcacatgtgcgccgtagtttggctgccatcccgtcattcacagaggagggtct

SEQ ID NO: 315436 - DNA, 75 bp, Artificial Sequence
  Synthetic
cttggactccttcatgtcaaaaccacctgttgacatcaaccccgacacgacatttcgtgagttgttcggcattga

SEQ ID NO: 315437 - DNA, 75 bp, Artificial Sequence
  Synthetic
cccccacgaacagttccccctgtccattcatgatttggcaaaattgcaaggtgagcttgtggacgcggcacgtaa

SEQ ID NO: 315438 - DNA, 75 bp, Artificial Sequence
  Synthetic
cccaggacacgcgttgcgacgccattactccaccgattcgctcaccgccctaatcaacaaaatcacaaagttcgt

SEQ ID NO: 315439 - DNA, 75 bp, Artificial Sequence
  Synthetic
ccccgtacaggccacgctccaggaaatgcaagcacgcagggctttcgagcgggagcgtgctgaactgttcaagga

SEQ ID NO: 315440 - DNA, 75 bp, Artificial Sequence
  Synthetic
attgccacacactgacctggatgtcaatcgtcagcagaaatcttacttttatgcaatgtggcggcaggtggtcaa

SEQ ID NO: 315441 - DNA, 75 bp, Artificial Sequence
  Synthetic
gaagggaaaggagttcttcattcctctggtgaagtgtacatcttggcgccgaaagttcacagagcccgccgaaat

SEQ ID NO: 315442 - DNA, 75 bp, Artificial Sequence
  Synthetic
tatcaggcaggttttggtccacttttgtgaagggatgaggtcacaatttgcaacaaacgccaattacatcaacct

SEQ ID NO: 315443 - DNA, 75 bp, Artificial Sequence
  Synthetic
gtcccttatagctaagttgcggccaacggttctcaccatgatctttcaacaacacaaaaacacctacagagggtg

SEQ ID NO: 315444 - DNA, 75 bp, Artificial Sequence
  Synthetic
gttggccacagttaccgctcttgttgaggtttattccagcttgtttcaggacatgagagacactgcagtgtcagc

SEQ ID NO: 315445 - DNA, 75 bp, Artificial Sequence
  Synthetic
aatatcggctatcaccttggtgtttgagaccatcaaagactttatagtcaatgtgatagatctagtcaagagcac

SEQ ID NO: 315446 - DNA, 75 bp, Artificial Sequence
  Synthetic
gtttcagtcccaaggcccgacttcctgtggttgggccgccattgctgccggtgccctcctcatactcatgaaact

SEQ ID NO: 315447 - DNA, 75 bp, Artificial Sequence
  Synthetic
gtccgggtgttcaaacaccaccagttattggcatcgcctcttgaaagtgtgtggtggtgtcacaaccattgcggc

SEQ ID NO: 315448 - DNA, 75 bp, Artificial Sequence
  Synthetic
agctgcccgagccgttgtgtgggtgcgtgacatcattgccgaagccgacggcaaagccaggctcaaaaagtatat

SEQ ID NO: 315449 - DNA, 75 bp, Artificial Sequence
  Synthetic
ggcgcgcaccgccgcactcctagagttggcggcttcccgagatgtgaccggcaccgatgagctcaagcgcttgct

SEQ ID NO: 315450 - DNA, 75 bp, Artificial Sequence
  Synthetic
ggactgtttcacacaactcattgaggagggcacagaactggtacaagaatttggcacatcaccactagcgggtct

SEQ ID NO: 315451 - DNA, 75 bp, Artificial Sequence
  Synthetic
gactaggtcgtatgtgagtgagctagagtcaactgcaaacagcattaggagcaccatcctacttgacacacctag

SEQ ID NO: 315452 - DNA, 75 bp, Artificial Sequence
  Synthetic
gaaaactccagttgctattatcctcactggccctccaggaattggtaaaactaagttagcccaacatctcgcagc

SEQ ID NO: 315453 - DNA, 75 bp, Artificial Sequence
  Synthetic
gggctttggtaaggtgtcgaatttctctgtcacactggaccaccatgattcatacactggaaatgaggtcgccat

SEQ ID NO: 315454 - DNA, 75 bp, Artificial Sequence
  Synthetic
ttgggacgaatttgacgtggacacgcagggcaagtatgtcgagactatgattggagttgtcaacactgcccccta

SEQ ID NO: 315455 - DNA, 75 bp, Artificial Sequence
  Synthetic
ccctctcaattgcgaccgagtggagaataagggtaaggtttttacatctgactacatcatttgcacaagcaacta

SEQ ID NO: 315456 - DNA, 75 bp, Artificial Sequence
  Synthetic
cccaacatctgtgcttcctgacaacccgcgtgccggtgctttctaccgacgtgttacgacggtggatgtctcgtc

SEQ ID NO: 315457 - DNA, 75 bp, Artificial Sequence
  Synthetic
acccgccattgaggattggaagaagaagaaccccgggaagaagcctccaccagatttatacaagagtgatttcac

SEQ ID NO: 315458 - DNA, 75 bp, Artificial Sequence
  Synthetic
acaccttcggctgtctattcgaccattccttggttacaaccctgaaggagacactcttgatggggttcgggtgaa

SEQ ID NO: 315459 - DNA, 75 bp, Artificial Sequence
  Synthetic
acccgtcctgactagcgttgatggcctgtctcgcttgatggagaccaagtttaaagaacaaggcaacgagcaacg

SEQ ID NO: 315460 - DNA, 75 bp, Artificial Sequence
  Synthetic
caacctttggatcacgtgccctcgggacttggtgtcaccagcagcgtcaggcctgaaagcttatatggctgcaaa

SEQ ID NO: 315461 - DNA, 75 bp, Artificial Sequence
  Synthetic
ccgagctcttgcacaagtgtttcaggaaccatcttcacaggacattggtgagacctgcacgtctaggatctatgt

SEQ ID NO: 315462 - DNA, 75 bp, Artificial Sequence
  Synthetic
ttcctgtaacaatcctccacccacatttgttgggcgcgtggtgaagatcacggccatcaacccgtgggatgcgtc

SEQ ID NO: 315463 - DNA, 75 bp, Artificial Sequence
  Synthetic
attggccaactccatgctgtctatgtttgagaccactagtcacatcccggcctcggtgcaacgtgagatcatgta

SEQ ID NO: 315464 - DNA, 75 bp, Artificial Sequence
  Synthetic
tcgtgtgtgggatccactagttcacttgcagactcgggagcccaacacacagatgctcccctatataaacagggt

SEQ ID NO: 315465 - DNA, 75 bp, Artificial Sequence
  Synthetic
ggtgccggtcaccacagcttttgacttcatcagaggcctgagacaccatcttgggctttgttcggttaagggcat

SEQ ID NO: 315466 - DNA, 75 bp, Artificial Sequence
  Synthetic
gtggcgggcctaccaaggctggagtagctctagctctatcctggaattcctctcaaagcatatggcagatgtgtc

SEQ ID NO: 315467 - DNA, 75 bp, Artificial Sequence
  Synthetic
ttttccccacaaccctgaatgcaccgtctttcgggcgccagacggcgatgtcatcttctacacctttgggtccta

SEQ ID NO: 315468 - DNA, 75 bp, Artificial Sequence
  Synthetic
tgcgtgctttgtgtcaccagcacgtgttccatttgttggcgacccccccaaaaatgtgcactcaaacataacacg

SEQ ID NO: 315469 - DNA, 75 bp, Artificial Sequence
  Synthetic
caacatgacctgggctgaaactttacgcctactcgccgagactgtggcggagagtctagcacactttggaccatt

SEQ ID NO: 315470 - DNA, 75 bp, Artificial Sequence
  Synthetic
cctgctcatgatgcacaacgtgtcctaccttgcaactcgctctagccgggacgaggaggcgaaaggtaagaccaa

SEQ ID NO: 315471 - DNA, 75 bp, Artificial Sequence
  Synthetic
acatgggcgcggcgccaaacattccaggaggggaggggtcagcttgtctgacgatgagtacgatgagtggcgaga

SEQ ID NO: 315472 - DNA, 75 bp, Artificial Sequence
  Synthetic
ccttgtgcgcgactggaggcaagacatgaccgttggggaatttgtggagctacgcgagaggtacgcactcggaat

SEQ ID NO: 315473 - DNA, 75 bp, Artificial Sequence
  Synthetic
ggactctgaggatgtacagcgctgccgcgcttggttggaattgcgggcgatgcgcatgggggctggggcctacca

SEQ ID NO: 315474 - DNA, 75 bp, Artificial Sequence
  Synthetic
acatgcaaccataattggcaggggcggggtccaggataccattatccgaacccagccaatgcgagccccacgcat

SEQ ID NO: 315475 - DNA, 75 bp, Artificial Sequence
  Synthetic
gcctcgcaatcaaggttatgacgaggaagccccgacaccagtcgtcacattcacatccggtggcgagcacgttgg

SEQ ID NO: 315476 - DNA, 75 bp, Artificial Sequence
  Synthetic
gtacggctgtcacatggggaatggggtggttgtcacggtcacacacgttgcctccgcatctgaccaagtagaagg

SEQ ID NO: 315477 - DNA, 75 bp, Artificial Sequence
  Synthetic
ggaagatttcaccatacggaaaaccgagggcgaaaccacctgggttaacaccaaccttagccatctacctcacta

SEQ ID NO: 315478 - DNA, 75 bp, Artificial Sequence
  Synthetic
ccaggtgggtgagggagcaccagtgtactactctgcccgcttgcaccccgtcacaacacttgctgaaggcaccta

SEQ ID NO: 315479 - DNA, 75 bp, Artificial Sequence
  Synthetic
cgagactcccaacatcaccgtccagggttatcacctccgcattctcaatgggtaccccacgaaacgtggtgattg

SEQ ID NO: 315480 - DNA, 75 bp, Artificial Sequence
  Synthetic
tggcactccatatttcgattcgtgccgccgtttggtagggctgcacgcagccacatcaacgaatggcgagaccaa

SEQ ID NO: 315481 - DNA, 75 bp, Artificial Sequence
  Synthetic
acttgcccagcgcgtctcgaaaacatctaaagtggagaatgcttttgcctggaagggacttgcagttgtccgtgg

SEQ ID NO: 315482 - DNA, 75 bp, Artificial Sequence
  Synthetic
acctgactgcgggggcatgcccactggcacacggttccaccgctcacccgcctggcccgaaccagtggagggaga

SEQ ID NO: 315483 - DNA, 75 bp, Artificial Sequence
  Synthetic
gacacacgcccctgctccatttggttcaggggatagccgatacaagttttcccaagttgagatgcttgtcaatgg

SEQ ID NO: 315484 - DNA, 75 bp, Artificial Sequence
  Synthetic
cctaaagccctactctgagccgaccccggggatcccaccagccctgttacaacgggccgccactcatacgcgcac

SEQ ID NO: 315485 - DNA, 75 bp, Artificial Sequence
  Synthetic
gtacctggagacaataataggcacccacagatcgccaaatttgtctttcggtgaagcgtgctcacttttggaaaa

SEQ ID NO: 315486 - DNA, 75 bp, Artificial Sequence
  Synthetic
gtccacttcctgtgggcctttcattgctggccaaaagggtgattactgggatgaggacaagcagtgttacactgg

SEQ ID NO: 315487 - DNA, 75 bp, Artificial Sequence
  Synthetic
agtgttggccgagcaccttgctaaggcctgggacgcggccaacaggggggtggccccacaaaatgcatataagct

SEQ ID NO: 315488 - DNA, 75 bp, Artificial Sequence
  Synthetic
ggcactcaaagatgagctcagacccattgagaaaaatgcccagggcaagcggcggctcctatggggctgtgacgc

SEQ ID NO: 315489 - DNA, 75 bp, Artificial Sequence
  Synthetic
aggggccactttggtggccactgccgcattcaagggtgtagctacccggctgcaaactgtcgccccaatgacccc

SEQ ID NO: 315490 - DNA, 75 bp, Artificial Sequence
  Synthetic
ggtgggcgttgggataaacatggacagttatcaggttgaagtgttgaatgaatcacttaaaggtggggtcttgta

SEQ ID NO: 315491 - DNA, 75 bp, Artificial Sequence
  Synthetic
ctgcttggactatagcaaatgggactcaacacagcaccctgcggtcacagccgcctcgctcggaattttggagag

SEQ ID NO: 315492 - DNA, 75 bp, Artificial Sequence
  Synthetic
gctatcagaggccaccccaatcaccacatcagcagttgagttgttatcctcgcctgcgaggggacacctgaatga

SEQ ID NO: 315493 - DNA, 75 bp, Artificial Sequence
  Synthetic
catagttttcattacgaagtctggtttaccatctggaatgccattcaccagtgtcatcaactccctcaaccacat

SEQ ID NO: 315494 - DNA, 75 bp, Artificial Sequence
  Synthetic
gacctacttcgcagcagctgtgctcaaggcatatgaacagcatggtgctccttacacaggcaacgtgttccaggt

SEQ ID NO: 315495 - DNA, 75 bp, Artificial Sequence
  Synthetic
tgagaccgttcacacctatggtgacgattgcctatattcagtgtgcccagcaactgcctcaatcttccaaacagt

SEQ ID NO: 315496 - DNA, 75 bp, Artificial Sequence
  Synthetic
gttggccaatttggcatcctttggtctaaaaccaactgctgctgacaagagtgaaaccattgtgcccacccatac

SEQ ID NO: 315497 - DNA, 75 bp, Artificial Sequence
  Synthetic
tcctgttttcttaaaaaggactctaacttgcactccacgtggtgtacggggtttgcttgatatcacatccataaa

SEQ ID NO: 315498 - DNA, 75 bp, Artificial Sequence
  Synthetic
gagacaattcatgtggatcaaggccaacagaactgtggacattcattccccaccagcttacgaccgtggggctcg

SEQ ID NO: 315499 - DNA, 75 bp, Artificial Sequence
  Synthetic
gagcatccagttggagaacgccctggcttatgcttcacagcacggccatgcagtcttcgaggaagttgccgagtt

SEQ ID NO: 315500 - DNA, 75 bp, Artificial Sequence
  Synthetic
ggcccgccacacggccaaggccgaaggccttgttttgaccaatgtcaattatgaccaggctctcgccacctacga

SEQ ID NO: 315501 - DNA, 75 bp, Artificial Sequence
  Synthetic
gtcatggttcataggtggtgcaggcctcagtcaaggcaaccccagtgaagaggttaccaaattagtgtttgaaat

SEQ ID NO: 315502 - DNA, 75 bp, Artificial Sequence
  Synthetic
ggagggtaacgcccgccacgatgagcctaaggctcagagcagcaacaatgttccgcttgcatcacctcaggacac

SEQ ID NO: 315503 - DNA, 75 bp, Artificial Sequence
  Synthetic
cattggcccgagcgcagcattacttctcccaactcaaattgaaaccccaaacgctaccgcccagcgcgtggaatt

SEQ ID NO: 315504 - DNA, 75 bp, Artificial Sequence
  Synthetic
ggctgctgccactggagcaatctcaagcaacataccaaactgtgtccgtgagtgttttgctagtgtcaccacttt

SEQ ID NO: 315505 - DNA, 75 bp, Artificial Sequence
  Synthetic
gccatggaccactcgcatggcagctaacacttttctgggggccatccaccttggtcctcgaatcaacccctacac

SEQ ID NO: 315506 - DNA, 75 bp, Artificial Sequence
  Synthetic
tgcacacatgagtgccatgtttgctggatggggtggcagtttccaagtgcgtgtcaccatttcaggttctggcct

SEQ ID NO: 315507 - DNA, 75 bp, Artificial Sequence
  Synthetic
gtttgctggtagggctatcaccgccgtcctacctcctggggtcaacccagctaacgtgcaaaaccccggtgtctt

SEQ ID NO: 315508 - DNA, 75 bp, Artificial Sequence
  Synthetic
cccacatgctttcattgatgcacgcactgtggatcccattctgatcaacctgcctgacatcagggccgttgacta

SEQ ID NO: 315509 - DNA, 75 bp, Artificial Sequence
  Synthetic
ccaccgagtggatggggaagagcaaactgcaacagttgggttatgggtagcacaacctctcatcaacccgtttca

SEQ ID NO: 315510 - DNA, 75 bp, Artificial Sequence
  Synthetic
agcggggtcagtgtccacttgctggctgagttttgaaactcgtccagggcccgactttgatttttgtcttcttaa

SEQ ID NO: 315511 - DNA, 75 bp, Artificial Sequence
  Synthetic
ggcccctgaacagcagatggacaatgggatttcaccagcaaacctcttaccccggaggcttgggcggtcacgtgg

SEQ ID NO: 315512 - DNA, 75 bp, Artificial Sequence
  Synthetic
caaccgacttgggggtcgaattgtcgggttggccgtcgtggcggttgctgaacaggttaatcaccattttatggc

SEQ ID NO: 315513 - DNA, 75 bp, Artificial Sequence
  Synthetic
caattccacaactctgggctggtccaccttgccaattgaaccaattgctggtgctgtttcatggtaccaaacccc

SEQ ID NO: 315514 - DNA, 75 bp, Artificial Sequence
  Synthetic
aagtcaaaccatcacaacacgtggtttgttgagtgctgaaggcaaaggcatcatcttcccaaacattgtcaacca

SEQ ID NO: 315515 - DNA, 75 bp, Artificial Sequence
  Synthetic
ttggaccgatgtggcactttccagcaaaacggccggtcaaacagccgtcccaagtacccaggagattctcaatcg

SEQ ID NO: 315516 - DNA, 75 bp, Artificial Sequence
  Synthetic
ctcaccaggtgcttctgggcctgtggtgatgttccaaaacaatggtgatgttaatgagagcagtgcaaataattg

SEQ ID NO: 315517 - DNA, 75 bp, Artificial Sequence
  Synthetic
tgttctgacggcggcatcccaagacttcactacgttgtcttccaactttgatgctgctggcacgtgggtgtggct

SEQ ID NO: 315518 - DNA, 75 bp, Artificial Sequence
  Synthetic
cccatggacatcaagtacccctaacggtgccaccaaccaaaacgtgtatgtcacacctacttggatcaatggtga

SEQ ID NO: 315519 - DNA, 75 bp, Artificial Sequence
  Synthetic
tccttccaaacccattcatggtaaatgcaccaacatgattggcaccaatttccaatttggtggcacgggcacaaa

SEQ ID NO: 315520 - DNA, 75 bp, Artificial Sequence
  Synthetic
caacatcatgttgtggcaagagcagcacttcacatcgttccctggagcggcggaagtgtattgctcccagttgga

SEQ ID NO: 315521 - DNA, 75 bp, Artificial Sequence
  Synthetic
aagcacggctgagatgtttcaaaacaatgtggtgaatattccatctaatcaaatggccgtgtttaatgtggaaac

SEQ ID NO: 315522 - DNA, 75 bp, Artificial Sequence
  Synthetic
cgctggcaacacctttcaaattggcattcttccaaatgggtactgtgtgacaaatgccactgttggcactcatca

SEQ ID NO: 315523 - DNA, 75 bp, Artificial Sequence
  Synthetic
attgttggattttgagactggatttcggtttgttggacttttcccccagagcacaagtcttcaagggcccaatgg

SEQ ID NO: 315524 - DNA, 75 bp, Artificial Sequence
  Synthetic
gaacgcagggcgggccgtgcgtttccttgaataatgtcttggttcacaggagctgccctcgccgctggatcctta

SEQ ID NO: 315525 - DNA, 75 bp, Artificial Sequence
  Synthetic
gtggatatggctggcacagtctcatccatagttgcacaacaccggcaaattgatttaatggcacaggcaaatcaa

SEQ ID NO: 315526 - DNA, 75 bp, Artificial Sequence
  Synthetic
attcaacgagattgggtcaataaacaggaggcattgataaagagaggacaagatatgtcacaggatttggcaatc

SEQ ID NO: 315527 - DNA, 75 bp, Artificial Sequence
  Synthetic
aatggcactgctcggcgtgttcagtccttagttgaggctggcttcacccccaccgacgctcgacgtctcgcaggt

SEQ ID NO: 315528 - DNA, 75 bp, Artificial Sequence
  Synthetic
agtggtgagactgtccaatatggcatcttggaccgccctatcctgcaacggggagtcttgactggcatttcagag

SEQ ID NO: 315529 - DNA, 75 bp, Artificial Sequence
  Synthetic
acgcaccacctacagacaatgcagggtgcgcttagtgccttcaagaagggctccagttatggggctccaccagcc

SEQ ID NO: 315530 - DNA, 75 bp, Artificial Sequence
  Synthetic
cccgctggctttgtcaatccaaattatcaattggcacccccaaaagtaaatttgggctatcggcctccatcaacc

SEQ ID NO: 315531 - DNA, 75 bp, Artificial Sequence
  Synthetic
aatgtgtaaattttccattcctctttcttcttttcttttcttttctacatggttcctcacgcgtccgggtggata

SEQ ID NO: 315532 - DNA, 75 bp, Artificial Sequence
  Synthetic
cttttcttttctacatggttcctcacgcgtccgggtggataattgtgattaagcgatcacagccatgctttctgg

SEQ ID NO: 315533 - DNA, 75 bp, Artificial Sequence
  Synthetic
gtgattggttagtatggcttctaagccattctaccctattttattcaaccgtaaggttgagtactcagtgctcag

SEQ ID NO: 315534 - DNA, 75 bp, Artificial Sequence
  Synthetic
ccattctaccctattttattcaaccgtaaggttgagtactcagtgctcagatcagctcacctcagggtgagtggt

SEQ ID NO: 315535 - DNA, 75 bp, Artificial Sequence
  Synthetic
cgtgagcaaatgtttgagactatagcagaactagatagtcatgttgaaacagtggttgccagactgtggcgtgat

SEQ ID NO: 315536 - DNA, 75 bp, Artificial Sequence
  Synthetic
aatttgcgccgcagtctggtagcgacccctaccttcactgaggagggattgttagactcattcctatcaaaacca

SEQ ID NO: 315537 - DNA, 75 bp, Artificial Sequence
  Synthetic
gttagactcattcctatcaaaaccacccgtggacatcaacccagatacgacgtttcgtgagttatttggagttga

SEQ ID NO: 315538 - DNA, 75 bp, Artificial Sequence
  Synthetic
tactccaccgattcgctcaccgccctaattaacaaaataacaaaatttgtccccgtccaggcaaccctacaagaa

SEQ ID NO: 315539 - DNA, 75 bp, Artificial Sequence
  Synthetic
cttgtcaagtgcacctcatggcggaaaaagttcactgaacctgccgaaatcgtgcgacaagtgctggtccacttt

SEQ ID NO: 315540 - DNA, 75 bp, Artificial Sequence
  Synthetic
tgtgaggggatgcgttcgcaattttccacaaatgcgaactacatcaacttgtcgctcatcgcaaagatgcgaccg

SEQ ID NO: 315541 - DNA, 75 bp, Artificial Sequence
  Synthetic
accgtcttgactatgattttccaacaacacaagaacacataccgtggctggctagcaacggtcaccgctctgatt

SEQ ID NO: 315542 - DNA, 75 bp, Artificial Sequence
  Synthetic
gctagcaacggtcaccgctctgattgaggtgtactccaacttattccaggacatgagggacacagcggtgtccgc

SEQ ID NO: 315543 - DNA, 75 bp, Artificial Sequence
  Synthetic
agtatctgcggtcaccctcgtgtttgaaacaatcaaggatttcatcaacaacgtcattgacttggttaagtccac

SEQ ID NO: 315544 - DNA, 75 bp, Artificial Sequence
  Synthetic
ctttcgagcgcaaggtccaacaccatgtgggtgggcggccatagccgctggtgcgttgctcatcttaatgaagct

SEQ ID NO: 315545 - DNA, 75 bp, Artificial Sequence
  Synthetic
ttcaggatgctccaacacagccagctactggcacaggttgcttaaggtgtgtggaggagttaccactcttgctgc

SEQ ID NO: 315546 - DNA, 75 bp, Artificial Sequence
  Synthetic
tgcccgctcgtacgtcagtgagctggagtcggctgctaatagcatcaggagcaccattttgctcgacaccccacg

SEQ ID NO: 315547 - DNA, 75 bp, Artificial Sequence
  Synthetic
tgggtttggtaaggtgtcaaatttttccgtgacgcttgatcatcatgactcgtacactggcaatgaggttgccat

SEQ ID NO: 315548 - DNA, 75 bp, Artificial Sequence
  Synthetic
cccactcaactgcgaccgggtagagaacaaaggaaaagtgttcacatctgactatgtcatctgcaccagcaatta

SEQ ID NO: 315549 - DNA, 75 bp, Artificial Sequence
  Synthetic
caacatttggatcacctgtccgcgcgatctggtggcccctgccgcgtcaggtttgaaatcctacatggcagccaa

SEQ ID NO: 315550 - DNA, 75 bp, Artificial Sequence
  Synthetic
tcgcgcacttgctcaagtatttcaggagccctcttcccaggacattggggaaacgtgcacctcgcgcgtgtacgt

SEQ ID NO: 315551 - DNA, 75 bp, Artificial Sequence
  Synthetic
ttcatgcaacaatccaccacccacatttattggacgcgttgtaaaaatcacagctattaacccatgggacgcctc

SEQ ID NO: 315552 - DNA, 75 bp, Artificial Sequence
  Synthetic
cagggtgtgggacccgttggtccacctacagtcacgagagcccaacacacagatgttaccatacatcaatcgggt

SEQ ID NO: 315553 - DNA, 75 bp, Artificial Sequence
  Synthetic
ggtacctgtcgccacggcttttgatttcatacgaggcctccgacaccatctcggtctgtgctcagtcaaggggat

SEQ ID NO: 315554 - DNA, 75 bp, Artificial Sequence
  Synthetic
tcatcttctacacttttgggtcatatgcgtgctttgtgtcccccgcccgcgtgccctttgttggcgaccccccca

SEQ ID NO: 315555 - DNA, 75 bp, Artificial Sequence
  Synthetic
aaaacgttcactcaaacatcacccgcaacatgacatgggttgaaaccttacgcttgcttgctgagacggtgacgg

SEQ ID NO: 315556 - DNA, 75 bp, Artificial Sequence
  Synthetic
atgaggaagcaaagggtaaaacaaaacatggccgcggtgcaaagcactcacgtagggggggggtcagcctgtctg

SEQ ID NO: 315557 - DNA, 75 bp, Artificial Sequence
  Synthetic
atgacagtcagcgagttcgtcgagcttcgagagaggttcgcactcggcatggactctgaggatgtgcagcgatac

SEQ ID NO: 315558 - DNA, 75 bp, Artificial Sequence
  Synthetic
ctcaacccatgcgtgcaccacgagcaccacgcagtcagggctatgatgaagaagcacccactccaatagtcgtgt

SEQ ID NO: 315559 - DNA, 75 bp, Artificial Sequence
  Synthetic
catcagctgcagatcaggtggacggccaggagttcactattaggaaaactgagggggagaccacctgggttaaca

SEQ ID NO: 315560 - DNA, 75 bp, Artificial Sequence
  Synthetic
tcctgattgcgggggcatgcccactggcactcgttaccaccgctctcctgcctggcctgagacaattgagggtga

SEQ ID NO: 315561 - DNA, 75 bp, Artificial Sequence
  Synthetic
atgaagacaagcagtgctatactggcgtgctggcagaccacctcgctaaggcctgggacgccgccaacaggggtg

SEQ ID NO: 315562 - DNA, 75 bp, Artificial Sequence
  Synthetic
agctaccaagttgaagtgcttaatgaatctctcaagggaggggttctctactgcttggattacagtaagtgggac

SEQ ID NO: 315563 - DNA, 75 bp, Artificial Sequence
  Synthetic
gactgtctgtattcagtctgtcctgccacggcctccatcttccaatctgtattggccaatctcacctcattcgga

SEQ ID NO: 315564 - DNA, 75 bp, Artificial Sequence
  Synthetic
ctaaagcctaccgctgcagacaagagtgaatgcattgcccccacccacacgccagtatttcttaaaagaaccctg

SEQ ID NO: 315565 - DNA, 75 bp, Artificial Sequence
  Synthetic
aatagaacaactgacatcaattccccaccggcttatgaccgggaggcacgtagtgtccagctcgaaaacgccctt

SEQ ID NO: 315566 - DNA, 75 bp, Artificial Sequence
  Synthetic
tagtgtccagctcgaaaacgcccttgcctatgcttcacagcacggccacagcgtctttgaggaggttgccaagtt

SEQ ID NO: 315567 - DNA, 75 bp, Artificial Sequence
  Synthetic
agaccaccaaattagtgtttgaaatggagggcaatggcctaccccaggctggagaacagcatgctcttgacgtgc

SEQ ID NO: 315568 - DNA, 75 bp, Artificial Sequence
  Synthetic
ggccacaggcacttatctgggatctgctacgctgtccccagctctcaacccatataccgcacatctttcggcgat

SEQ ID NO: 315569 - DNA, 75 bp, Artificial Sequence
  Synthetic
gtggtccacacttcccctgggcccgtgtgctgcaaagatcactagtgctctccctggggaaataaacaactacac

SEQ ID NO: 315570 - DNA, 75 bp, Artificial Sequence
  Synthetic
tgtgctgcaaagatcactagtgctctccctggggaaataaacaactacaccgggtttgcagatgttgatggtgcg

SEQ ID NO: 315571 - DNA, 75 bp, Artificial Sequence
  Synthetic
cagcaacggtggatccatcccccagtcgtagaacccaactacaaggtagctttactgccaacaccatgcgcatac

SEQ ID NO: 315572 - DNA, 75 bp, Artificial Sequence
  Synthetic
tcgtagaacccaactacaaggtagctttactgccaacaccatgcgcatactgcgcacgtctgggcttgacaagat

SEQ ID NO: 315573 - DNA, 75 bp, Artificial Sequence
  Synthetic
ccactgggtacatcaatgaaaaagttacaaacttggctgatatcaacatctcatatggccctgttggttccaata

SEQ ID NO: 315574 - DNA, 75 bp, Artificial Sequence
  Synthetic
cttttccagccaccctcgaccaggcatcttgtacagctcccagcttgaatccactgcctctatctttcaagatgg

SEQ ID NO: 315575 - DNA, 75 bp, Artificial Sequence
  Synthetic
tcccctctcaatgggcctcatgggactgggcgaggcagaagcgtttaccaatgagttggttggtgggagcactcc

SEQ ID NO: 315576 - DNA, 75 bp, Artificial Sequence
  Synthetic
tcaaacaggtgggcccaacattgggaataacagaccggcagtcaacattggacacaacccaggctcatcatctgc

SEQ ID NO: 315577 - DNA, 75 bp, Artificial Sequence
  Synthetic
ctgattcaccctctttcatttcttttcttttcttttccgactggcactcacgcgttcgggagtataatgccaatt

SEQ ID NO: 315578 - DNA, 75 bp, Artificial Sequence
  Synthetic
tttcttttccgactggcactcacgcgttcgggagtataatgccaattaagcgattggctccagtttcctctaggg

SEQ ID NO: 315579 - DNA, 75 bp, Artificial Sequence
  Synthetic
gtgattggttggatggcttccaagccattcaagccaatagttctcaatgccactttcgagtggcagatcttcaag

SEQ ID NO: 315580 - DNA, 75 bp, Artificial Sequence
  Synthetic
cactttcgagtggcagatcttcaagcggtgctacctcagggtagcgccgcgtgaagcattttgcgagaacttgag

SEQ ID NO: 315581 - DNA, 75 bp, Artificial Sequence
  Synthetic
tgaacttcaccactactttgccaggcgtatgaacgcctggctcaagcatgccacaaggaccctcccaaacgaata

SEQ ID NO: 315582 - DNA, 75 bp, Artificial Sequence
  Synthetic
tacattcgttgaggagggtctccttgacatgtttggtacaaaggcccccgacagtgttcaagaaggcacactgtt

SEQ ID NO: 315583 - DNA, 75 bp, Artificial Sequence
  Synthetic
tcgggagctgttcggggttgaccaaactgagcaattccctttgtccctcgcagacctggccaggttgcaagggga

SEQ ID NO: 315584 - DNA, 75 bp, Artificial Sequence
  Synthetic
acttgttgacgcaactcgcactccaggacacgtgctgcgtcaaaagtatacaatgaccaccatacaggacttgat

SEQ ID NO: 315585 - DNA, 75 bp, Artificial Sequence
  Synthetic
taacaagattaccaaggttgttccagtgcaggccacgctcactgagatgcacgcgcgtaggcaattcgagcgtga

SEQ ID NO: 315586 - DNA, 75 bp, Artificial Sequence
  Synthetic
gcgagccgacctgtttcacgagctcccattggtagatgaggatgctgtttcacaacccaaaacctatttttacac

SEQ ID NO: 315587 - DNA, 75 bp, Artificial Sequence
  Synthetic
catgtggcgccaagttgtgaagaaaggcaaagcgtatttctgtcctctcgttaagacgagtgcatggcgcactaa

SEQ ID NO: 315588 - DNA, 75 bp, Artificial Sequence
  Synthetic
aatcagtgccataacggaacccattaaggacttcttgattgcgttttgccaggcagtgcaacaagaaatgggtgt

SEQ ID NO: 315589 - DNA, 75 bp, Artificial Sequence
  Synthetic
taatccgcagtacctacaacttgcctggttgcaaaaactcaaacccaccactttaaccatcattctgcaacaaca

SEQ ID NO: 315590 - DNA, 75 bp, Artificial Sequence
  Synthetic
caagcataccgtctcaggatggctggccaccatgacagcacttgtggaagtgtactcaaatctgtttgacgactt

SEQ ID NO: 315591 - DNA, 75 bp, Artificial Sequence
  Synthetic
gcgcaaatcatcagttgccatcgtgtcaagcattggagctttctttgacatctgtaaagactttgtgtcacaagt

SEQ ID NO: 315592 - DNA, 75 bp, Artificial Sequence
  Synthetic
tgtggagctggtcaaaacaacgttcactgctcaaggtccgacagacttggggtgggcggcagtgctggcaggggc

SEQ ID NO: 315593 - DNA, 75 bp, Artificial Sequence
  Synthetic
tgcaatgattttgctaaaaatgtctgggtgtccaggcgtcattggcatgtggacaaaagtgcttaaaatttgtgg

SEQ ID NO: 315594 - DNA, 75 bp, Artificial Sequence
  Synthetic
gggcatcaccaccatcacagcagcagcgcgtggagtgcgttggttaaaggatctctatgaggaggctgaaggacg

SEQ ID NO: 315595 - DNA, 75 bp, Artificial Sequence
  Synthetic
caggctggcaaaaatgtatatggcacgtggtgccgcccttattgaacttgctgccagtcgtgaggtgacaggtat

SEQ ID NO: 315596 - DNA, 75 bp, Artificial Sequence
  Synthetic
tgacgagctcaagggcctccttgattgtttcaccatattgatcgaggagggcactgaacttatccacaagttcgg

SEQ ID NO: 315597 - DNA, 75 bp, Artificial Sequence
  Synthetic
cactagcccactggcaggtttggtgcgcacttatgtgtccgaactagaaactcaagcaaacaacattagatccac

SEQ ID NO: 315598 - DNA, 75 bp, Artificial Sequence
  Synthetic
cattaagcttgacacccccagacgggtgcccgttgttattatcctcactggggcacctggcattggaaaaactcg

SEQ ID NO: 315599 - DNA, 75 bp, Artificial Sequence
  Synthetic
tttagcacaatatgtcggccagcgctttggtaaaacgtccaatttttcagtagctgtggaccaccatgacggcta

SEQ ID NO: 315600 - DNA, 75 bp, Artificial Sequence
  Synthetic
cacagggaacactgtgtgcatatgggatgagtttgatgtcgattccaaaggtgcgtttgtggagacaatgatcgg

SEQ ID NO: 315601 - DNA, 75 bp, Artificial Sequence
  Synthetic
gattgcaaacacggcacccttcccgctaaattgtgacagggttgaaaataaagggcgtgtgttcacgtccgacta

SEQ ID NO: 315602 - DNA, 75 bp, Artificial Sequence
  Synthetic
tgtcatttgtacatccaactatcccacatctgtcatcccagacaatccaagggctgcggccttttaccgcagggt

SEQ ID NO: 315603 - DNA, 75 bp, Artificial Sequence
  Synthetic
cctaactgttgatgtcagcgcaccagatttggaggaatggaaaaagaggaatcctggcaagcgtcccactccaga

SEQ ID NO: 315604 - DNA, 75 bp, Artificial Sequence
  Synthetic
atcctggcaagcgtcccactccagatttgtaccaagatgatttctctcacctcaaattgatgcttagaccatatt

SEQ ID NO: 315605 - DNA, 75 bp, Artificial Sequence
  Synthetic
tgggttacaatccagacggagacacacttgaaggccccagagttgcccccacccaaataagtatagcaggactga

SEQ ID NO: 315606 - DNA, 75 bp, Artificial Sequence
  Synthetic
acccaaataagtatagcaggactgataaccctaatggaaagaaggtttaaggaacaagctgggcccctgcagaac

SEQ ID NO: 315607 - DNA, 75 bp, Artificial Sequence
  Synthetic
ttatggttacaagtccccaagccacttgtagaacagtccacaaacatggtcaaagcatttatgtacgccaaccgc

SEQ ID NO: 315608 - DNA, 75 bp, Artificial Sequence
  Synthetic
gcagtgtgtgacgttatacctaaccccgccacccgtgatatcactgagactgcgttgtcaaaaatcttcgtgtgt

SEQ ID NO: 315609 - DNA, 75 bp, Artificial Sequence
  Synthetic
ggcaccgcgccaccacctgagtttgttggcaagcatatagttatcactggcatagaggttggtgatgcgtccatt

SEQ ID NO: 315610 - DNA, 75 bp, Artificial Sequence
  Synthetic
gccaattcattattgtcaatgttcaccaccactacacgactgtctgccgcagctcaaagggagtatatgtacaga

SEQ ID NO: 315611 - DNA, 75 bp, Artificial Sequence
  Synthetic
gtgtggagcccactgatccacatccaagaccgaagcataaacactcagaatctcccatacatcaacagagtgatc

SEQ ID NO: 315612 - DNA, 75 bp, Artificial Sequence
  Synthetic
ccagtaacatcccactgggactttttgaggggtttgcggcaccatcttggcttcacatctattccaggcatgtgg

SEQ ID NO: 315613 - DNA, 75 bp, Artificial Sequence
  Synthetic
aaagcattccaaggttggcgcacatcacagggcatagttgattttgtagcacaccatatggcagatgtcacattt

SEQ ID NO: 315614 - DNA, 75 bp, Artificial Sequence
  Synthetic
ccaagcaacccagaatgcaccatcttccgcacgccagatgcggacgtggttttctacacttttggctcttatgtg

SEQ ID NO: 315615 - DNA, 75 bp, Artificial Sequence
  Synthetic
tgctttgctaccccagcacgagtgccgtacgttggtacaccacccaccaccatccattccaacacaccacggtgc

SEQ ID NO: 315616 - DNA, 75 bp, Artificial Sequence
  Synthetic
atgacttggggcgagaccatagcactgttgtgtgaggtggttgccgagtttgtccttcatttcggtcctgtgatt

SEQ ID NO: 315617 - DNA, 75 bp, Artificial Sequence
  Synthetic
ctgtctgcagccaacattgcctatcttatgactcggggctcaaggactgaggaagccaagggtaagaccaagcat

SEQ ID NO: 315618 - DNA, 75 bp, Artificial Sequence
  Synthetic
ggacgtggtatgcgtcatggccacagggccggagtgagcctctcagacgatgagtatgacgagtggcgagatctg

SEQ ID NO: 315619 - DNA, 75 bp, Artificial Sequence
  Synthetic
atgcgggattggaggcgtgacatgagtgtcaatgacttcctaatgctcagggagaggtctgcacttgggatggac

SEQ ID NO: 315620 - DNA, 75 bp, Artificial Sequence
  Synthetic
gatgaggacgtggccaggtatagagcatggcttgagatccgcgccatgcgaatggcagggggtgcgtacacacat

SEQ ID NO: 315621 - DNA, 75 bp, Artificial Sequence
  Synthetic
gccactatcattggtcgtggtggtgtgcgagatgagatcatacgcacggcaccacgcagagctccaacacgaccc

SEQ ID NO: 315622 - DNA, 75 bp, Artificial Sequence
  Synthetic
cagcaacattatgaggaagaggccccgacagcgattgtggagttcacccagggtggtgaccacattggatacgga

SEQ ID NO: 315623 - DNA, 75 bp, Artificial Sequence
  Synthetic
gtgcacattggcaatggcaatgtgataactgtcacccatgtggcatcaacgtccgatgaggtcaacggcagtact

SEQ ID NO: 315624 - DNA, 75 bp, Artificial Sequence
  Synthetic
ttcaaaataacacgtactgttggagagacaacgtgggtacaaggaccattctcacaactaccacacatgcaaata

SEQ ID NO: 315625 - DNA, 75 bp, Artificial Sequence
  Synthetic
ggcagtggttccccggtttacttcaccacacggttgcacccagtcttcacaatatcagaaggaacatttgaaact

SEQ ID NO: 315626 - DNA, 75 bp, Artificial Sequence
  Synthetic
ccaaacatcaccgtgaatggttttcatgtcagaataatgaacggttacccaaccaagaaaggtgactgtggtcta

SEQ ID NO: 315627 - DNA, 75 bp, Artificial Sequence
  Synthetic
ccctattttaattccaaccgccagttggtggcgttgcatgccggcacggacacacaaggtgaaacaaaagtggct

SEQ ID NO: 315628 - DNA, 75 bp, Artificial Sequence
  Synthetic
caacgtgttgtcaaggaggtcaccactcaagatgaatttcaatggaagggtttgcccgtggtgaagtctggactc

SEQ ID NO: 315629 - DNA, 75 bp, Artificial Sequence
  Synthetic
gacgttgggggtatgcccactgggacccgataccacagatcccctgcgtggcccgaagaacagcctggtgagaca

SEQ ID NO: 315630 - DNA, 75 bp, Artificial Sequence
  Synthetic
catgcgccagcaccctttggtgcaggagacaagaggtacacattttcacagacagaaatgctagtaaacgggttg

SEQ ID NO: 315631 - DNA, 75 bp, Artificial Sequence
  Synthetic
aagccttacacggaacccactgctggggtgccaccacagcttttgtctcgtgcggtcacacacgtacgatcatac

SEQ ID NO: 315632 - DNA, 75 bp, Artificial Sequence
  Synthetic
atagaaacaatcattggtacacaccggtctcctgtactaacataccatcaagcatgtgagctacttgaacggacc

SEQ ID NO: 315633 - DNA, 75 bp, Artificial Sequence
  Synthetic
acttcatgtggtccattcgtacagggccttaagggtgactactgggatgaagagcaacagcagtatactggtgtg

SEQ ID NO: 315634 - DNA, 75 bp, Artificial Sequence
  Synthetic
ctggcaaaccaccttgaacaggcatgggacaaggctaacaaagggatagcaccaaggaatgcctacaagttggca

SEQ ID NO: 315635 - DNA, 75 bp, Artificial Sequence
  Synthetic
cttaaagatgagctcaggccaattgagaagaacaaggctggcaaacgcaggttgttatggggctgtgatgctgcc

SEQ ID NO: 315636 - DNA, 75 bp, Artificial Sequence
  Synthetic
actacactcatagccaccgcggcttttaaggccgtggctaccaggctacaggtagtgacgccaatgacaccggtc

SEQ ID NO: 315637 - DNA, 75 bp, Artificial Sequence
  Synthetic
gctgttggcatcaatatggattctgtccagatgcaagtgatgaacgactccttgaagggaggtgtcctttactgc

SEQ ID NO: 315638 - DNA, 75 bp, Artificial Sequence
  Synthetic
ctggattattccaaatgggattccacacagaaccccgcagtaacagcagcatcactgtcgatattggaaagattt

SEQ ID NO: 315639 - DNA, 75 bp, Artificial Sequence
  Synthetic
gctgaaccccacccaatcgtgtcttgtgccattgaagctctctcctcccctgcagaaggctacgttaatgacatc

SEQ ID NO: 315640 - DNA, 75 bp, Artificial Sequence
  Synthetic
aagtttgtgacacgcggcggtctaccatctgggatgccattcacatctgttgtcaattctatcaaccatatgata

SEQ ID NO: 315641 - DNA, 75 bp, Artificial Sequence
  Synthetic
tacgtggccgcagccattttacaggcatatgaaagtcacaatgttccgtacactggaaatgtcttccaagtggaa

SEQ ID NO: 315642 - DNA, 75 bp, Artificial Sequence
  Synthetic
actgtccacacgtacggtgatgattgcatgtacagtgtgtgccctgccactgcatcaatattccacactgtgctt

SEQ ID NO: 315643 - DNA, 75 bp, Artificial Sequence
  Synthetic
gcgaatctgacatcatatggacttaaacctactgcagcagacaagagtgaagcaatcaaaccaaccaacacacca

SEQ ID NO: 315644 - DNA, 75 bp, Artificial Sequence
  Synthetic
gtgtttttgaagaggacattcacacaaaccccacatggagttcgtgcactactagacatcacttctataactaga

SEQ ID NO: 315645 - DNA, 75 bp, Artificial Sequence
  Synthetic
cagttttactggctgaaagctaataggacatcagacctatctagcccacctgctttcgaccgacaggcacgcggt

SEQ ID NO: 315646 - DNA, 75 bp, Artificial Sequence
  Synthetic
gcgcaactggagaacgcactggcctatgcttcacaacacgggcctgttgtgtttgacaccgtgcgccaaattgcc

SEQ ID NO: 315647 - DNA, 75 bp, Artificial Sequence
  Synthetic
ataaagactgcccaaggggaaggactggtgcttgtcaacaccaactatgaccaggctctcgccacctacaatgcc

SEQ ID NO: 315648 - DNA, 75 bp, Artificial Sequence
  Synthetic
tggttcataggtggtacagtacctgacccagtgggtcacactgaaggaacccacaaaatagtgtttgagatggag

SEQ ID NO: 315649 - DNA, 75 bp, Artificial Sequence
  Synthetic
acccagtgggtcacactgaaggaacccacaaaatagtgtttgagatggagggcaatggctccaacccagagccaa

SEQ ID NO: 315650 - DNA, 75 bp, Artificial Sequence
  Synthetic
ccacaaaatagtgtttgagatggagggcaatggctccaacccagagccaaagcaaagcaacaacccgatggtcgt

SEQ ID NO: 315651 - DNA, 75 bp, Artificial Sequence
  Synthetic
ggcaatggctccaacccagagccaaagcaaagcaacaacccgatggtcgttgacccgcctggcacaacaggtccg

SEQ ID NO: 315652 - DNA, 75 bp, Artificial Sequence
  Synthetic
accacatcccacgttgttgttgctaatccggagcaacccaatggggccgcacagcgcctggagttggctgttgcc

SEQ ID NO: 315653 - DNA, 75 bp, Artificial Sequence
  Synthetic
actggtgcaatccaatccaatgtccctgaggcaatacgcaactgctttgcagtctttcgtacttttgcttggaac

SEQ ID NO: 315654 - DNA, 75 bp, Artificial Sequence
  Synthetic
gacaggatgcccacgggaacttttcttggatctatatcgcttcatcccaacattaacccgtacactgctcacctc

SEQ ID NO: 315655 - DNA, 75 bp, Artificial Sequence
  Synthetic
ctctggttctggcgtgttcgctgggcgcatcattgcttctgtcataccaccaggggttgatccctcgtccatcag

SEQ ID NO: 315656 - DNA, 75 bp, Artificial Sequence
  Synthetic
ggacccaggcgtgttgcctcacgctttcgttgatgctcgcatcactgagccagtttctttcatgatccctgatgt

SEQ ID NO: 315657 - DNA, 75 bp, Artificial Sequence
  Synthetic
ttcgttgatgctcgcatcactgagccagtttctttcatgatccctgatgtcagagcagtggactaccacaggatg

SEQ ID NO: 315658 - DNA, 75 bp, Artificial Sequence
  Synthetic
gatggtgctgagcccacttgctcgttagggttctgggtttaccaaccattgctcaacccattttccaccaccgcc

SEQ ID NO: 315659 - DNA, 75 bp, Artificial Sequence
  Synthetic
gtttcaacatgttgggtgtcagtagagactaagccaggtggtgattttgatttctgcctactaagaccaccgggt

SEQ ID NO: 315660 - DNA, 75 bp, Artificial Sequence
  Synthetic
caacagatggaaaatggggtctcaccagaaggcctattgcccagacgcctaggttactcgcgtggtaatcgtgtt

SEQ ID NO: 315661 - DNA, 75 bp, Artificial Sequence
  Synthetic
ggtggcttggtggttggtatgatcttggtggctgaacataagcaggtcaatagacacttcaactccaattcagtc

SEQ ID NO: 315662 - DNA, 75 bp, Artificial Sequence
  Synthetic
acttttggttggtccacggcacctgtcaacccaatggcagcagaaattgtgacaaaccaggcacattcaacatca

SEQ ID NO: 315663 - DNA, 75 bp, Artificial Sequence
  Synthetic
cgacatgcttggctttccattggtgctcaaaacaagggtccattgtttcctggaatacctaaccacttccccgac

SEQ ID NO: 315664 - DNA, 75 bp, Artificial Sequence
  Synthetic
tcgtgtgcatcaacaatcgttggggccatggacacctcccttggaggccggccgtccactggggtgtgtggacct

SEQ ID NO: 315665 - DNA, 75 bp, Artificial Sequence
  Synthetic
gccgtccactggggtgtgtggacctgccataagctttcaaaataatggtgatgtgtacgagaatgacacaccctc

SEQ ID NO: 315666 - DNA, 75 bp, Artificial Sequence
  Synthetic
agtcatgtttgccacttatgacccactcacgtcaggcacgggggttgctcttaccaacagcatcaaccccgcatc

SEQ ID NO: 315667 - DNA, 75 bp, Artificial Sequence
  Synthetic
cctggcgttggtgcgcatatccaataatgactttgacactagtggctttgccaacgataagaacgtggtggttca

SEQ ID NO: 315668 - DNA, 75 bp, Artificial Sequence
  Synthetic
aatgtcatgggagatgtatacaggcaccaatcaaattagaggtcaggttacaccaatgtctggcaccaactacac

SEQ ID NO: 315669 - DNA, 75 bp, Artificial Sequence
  Synthetic
cttcacatcaacaggtgcaaacactcttgtgttgtggcaggagcgtatgctcagctatgatggacaccaagcaat

SEQ ID NO: 315670 - DNA, 75 bp, Artificial Sequence
  Synthetic
actgtactcgtcacaattggaaaggacggctgagtactttcagaatgacatagttaacatacctgaaaactccat

SEQ ID NO: 315671 - DNA, 75 bp, Artificial Sequence
  Synthetic
ggcagtgttcaatgtggaaaccaactctgcatctttccaaattggcattagacctgatggttacatggtgacagg

SEQ ID NO: 315672 - DNA, 75 bp, Artificial Sequence
  Synthetic
gacctgatggttacatggtgacaggtggctccattggtattaatgtgccgcttgagcctgaaacccgattccaat

SEQ ID NO: 315673 - DNA, 75 bp, Artificial Sequence
  Synthetic
acgttggaattctccctttgtccgcagctttgtctgggcccagtgggaacatgggaagggccagacgggtgttcc

SEQ ID NO: 315674 - DNA, 75 bp, Artificial Sequence
  Synthetic
aatgagttggttggtaggtgctctgcaaacttttgggtctttggctgatgttgctggcactgtttccaacatagt

SEQ ID NO: 315675 - DNA, 75 bp, Artificial Sequence
  Synthetic
gtaccagcagcgccaggccgctcagttggaaaaacaaaatgaacttatggagacatggatgaacaaacaagaggc

SEQ ID NO: 315676 - DNA, 75 bp, Artificial Sequence
  Synthetic
actgcagaagtctcaaatggaattaacccgagacctctccatcaatggtccagccgcccgggtacaatcagcact

SEQ ID NO: 315677 - DNA, 75 bp, Artificial Sequence
  Synthetic
acccgagacctctccatcaatggtccagccgcccgggtacaatcagcacttgatgcaggttttgatgaggtaagt

SEQ ID NO: 315678 - DNA, 75 bp, Artificial Sequence
  Synthetic
gcacggcgcattgctggttcaggtgagcgcgtgatttgggggaacttggatcgacccatcatgcacgctggcact

SEQ ID NO: 315679 - DNA, 75 bp, Artificial Sequence
  Synthetic
atggacagcatacgccagactaaacatttggactctctgagtcattcattggccacatttaaaaatggaactcca

SEQ ID NO: 315680 - DNA, 75 bp, Artificial Sequence
  Synthetic
ttcggaaaacctgcacccccaacagcaaaatctggaaggccccaggccacaactgcaaaaatcaccattggtcac

SEQ ID NO: 315681 - DNA, 75 bp, Artificial Sequence
  Synthetic
aactgcaaaaatcaccattggtcacaaccctggtagcaccagtgtttaaatttaaattttcttttctttgaaacg

SEQ ID NO: 315682 - DNA, 75 bp, Artificial Sequence
  Synthetic
aattttcttttctttgaaacggtcccacacgcgttcgggtgggttttggacaattaagcgattgtcgccgtcccc

SEQ ID NO: 315683 - DNA, 75 bp, Artificial Sequence
  Synthetic
gtgattggttagatggtttccaagccattcaagccaatagttctcaatgccacttttgagtggcaagtctttaag

SEQ ID NO: 315684 - DNA, 75 bp, Artificial Sequence
  Synthetic
cggtgctacctcagggtagcgccgcgtgaggcattttgtgagaacctaagtgaactacatcactattttgccagg

SEQ ID NO: 315685 - DNA, 75 bp, Artificial Sequence
  Synthetic
cgtgtaaacgcctggctcaagcatgccacaaggaccctcccagacgaatacacgttcgttgaggagggtctcctt

SEQ ID NO: 315686 - DNA, 75 bp, Artificial Sequence
  Synthetic
cacgttcgttgaggagggtctccttgacatgtttggtacaaaagctcctgacagtgttcaagaaggtacattgtt

SEQ ID NO: 315687 - DNA, 75 bp, Artificial Sequence
  Synthetic
cagacttggccaggttgcaaggggaacttgttgacgcaactcgcaccccaggacacgcattgcgacaaaaataca

SEQ ID NO: 315688 - DNA, 75 bp, Artificial Sequence
  Synthetic
caatgaccactatacaggacttgattaacaagatcaccaaagttgtgccagtgcaggccacgctcaatgagatgc

SEQ ID NO: 315689 - DNA, 75 bp, Artificial Sequence
  Synthetic
acgcacgcaggcaatttgagcgtgaacgagctgacttgttccatgagcttccactggtagacgaagacgccgttg

SEQ ID NO: 315690 - DNA, 75 bp, Artificial Sequence
  Synthetic
cacaacccaagacttatttttacaccatgtggcgtcaagttgtgaagaagggtaaggcgtacttctgtcccctag

SEQ ID NO: 315691 - DNA, 75 bp, Artificial Sequence
  Synthetic
ttaagacgagtgcatggcgcactaagatcagtgccataacagaacctatcaaagatttcttgattgcgttttggc

SEQ ID NO: 315692 - DNA, 75 bp, Artificial Sequence
  Synthetic
aggcagtacaacaagaaatgggtgtcaatccgcaatacttgcagcttgcttggttgcaaaaacttaaacccacca

SEQ ID NO: 315693 - DNA, 75 bp, Artificial Sequence
  Synthetic
ccttaactatcattcttcaacaacacaagcacaccgtttcagggtggctggccaccatgacagcactagtggaag

SEQ ID NO: 315694 - DNA, 75 bp, Artificial Sequence
  Synthetic
gccaccatgacagcactagtggaagtgtactcaaatctgtttgacgacttgcgtaaatcatcagtaaccatcgtg

SEQ ID NO: 315695 - DNA, 75 bp, Artificial Sequence
  Synthetic
cgttgagctggtcaaaacaacgttcaccgcccaaggcccaacagaccttgggtgggcggcggtgctggcaggggc

SEQ ID NO: 315696 - DNA, 75 bp, Artificial Sequence
  Synthetic
gggcatcaccaccatcacagcagcagcacgtggggtgcgttggctgaaagacctctatgaggaggctgaaggacg

SEQ ID NO: 315697 - DNA, 75 bp, Artificial Sequence
  Synthetic
aagactgccaaaaatgtacatggcacgtggtgctgctctaattgaactagccgccagccgtgaggtgacaggtgt

SEQ ID NO: 315698 - DNA, 75 bp, Artificial Sequence
  Synthetic
tgatgagcttaagggcctccttgattgttttaccatattgattgaggagggcactgagctcatccacaagtttgg

SEQ ID NO: 315699 - DNA, 75 bp, Artificial Sequence
  Synthetic
cactagcccactagcaggcctagtgcgcacgtatgtgtccgaacttgagacccaagcaaacaacatcaggtccac

SEQ ID NO: 315700 - DNA, 75 bp, Artificial Sequence
  Synthetic
catcaaacttgacacccctagacgagtgcccgttgtcatcatcctcactggggcacctggcattggaaaaactcg

SEQ ID NO: 315701 - DNA, 75 bp, Artificial Sequence
  Synthetic
cttggcacaatatattggccagcgctttgggaaaacgtccaatttctcagtagctgtggatcaccacgacggcta

SEQ ID NO: 315702 - DNA, 75 bp, Artificial Sequence
  Synthetic
tagctgtggatcaccacgacggctacacgggaaacactgtttgcatatgggatgaatttgatgtcgattccaagg

SEQ ID NO: 315703 - DNA, 75 bp, Artificial Sequence
  Synthetic
tgtcatctgcacgtccaactatccaacatctgttatcccagacaatccaagagctgccgccttttatcgcagggt

SEQ ID NO: 315704 - DNA, 75 bp, Artificial Sequence
  Synthetic
cctaactgttgacgtcagcgcacctgacttggaggaatggaagaagaggaatcctggtaagcgacccacccctga

SEQ ID NO: 315705 - DNA, 75 bp, Artificial Sequence
  Synthetic
cttgtaccaagatgatttttcccacctcaaactgatgcttaggccttatttaggttacaacccagatggggacac

SEQ ID NO: 315706 - DNA, 75 bp, Artificial Sequence
  Synthetic
ctcaaactgatgcttaggccttatttaggttacaacccagatggggacacacttgaaggtcccagagtcgccccc

SEQ ID NO: 315707 - DNA, 75 bp, Artificial Sequence
  Synthetic
actcaaataagcatagccggactgataaccctaatggaaagaaggtttaaggaacaagctgggcctctacagaac

SEQ ID NO: 315708 - DNA, 75 bp, Artificial Sequence
  Synthetic
ggaacaagctgggcctctacagaacttgtggttgcaggttcccaagacactcgtggaacagtccacaaatatggt

SEQ ID NO: 315709 - DNA, 75 bp, Artificial Sequence
  Synthetic
caaggcatttatgtacgccaaccgtgcagtgtgtgacgtgatacctaatcctgccacccgtgacatcactgaaac

SEQ ID NO: 315710 - DNA, 75 bp, Artificial Sequence
  Synthetic
ctgccacccgtgacatcactgaaactgcattgtcaaaagtctttgtatgtggcaccgcgcccccacctgagtttg

SEQ ID NO: 315711 - DNA, 75 bp, Artificial Sequence
  Synthetic
ttggcaagcatatagtcattacaggcatagaggtcggtgatgcctccatcgccaactcactactgtccatgttta

SEQ ID NO: 315712 - DNA, 75 bp, Artificial Sequence
  Synthetic
ccaccaccacacgactgtctgccgcggcccagagggagtacatgtacagagtgtggagcccactgatccacatac

SEQ ID NO: 315713 - DNA, 75 bp, Artificial Sequence
  Synthetic
aagaccgaagcatgaatactcagaacctcccatacatcaatagagtgataccagtgacatcccactgggacttct

SEQ ID NO: 315714 - DNA, 75 bp, Artificial Sequence
  Synthetic
tgaggggtttgcggcaccatttgggtttcacttctatcccaggtatgtggaaggcatttcaaggctggcgtacat

SEQ ID NO: 315715 - DNA, 75 bp, Artificial Sequence
  Synthetic
cacaggggatagttgattttgtggctcatcacatggcagatgttacattcccaagtaacccagaatgcaccatct

SEQ ID NO: 315716 - DNA, 75 bp, Artificial Sequence
  Synthetic
cgtatgttggcacaccacccaccactatccactctaacacgccacggtgcatgacttggggcgaaactttagcac

SEQ ID NO: 315717 - DNA, 75 bp, Artificial Sequence
  Synthetic
atgacttggggcgaaactttagcactgttgtgtgaggtagttgctgagtttgtacttcactttggtcctgtgatt

SEQ ID NO: 315718 - DNA, 75 bp, Artificial Sequence
  Synthetic
ggaggccaagggtaagaccaagcatgggcgtggtatgcgccatggccacagggctggagtaagcctctcagacga

SEQ ID NO: 315719 - DNA, 75 bp, Artificial Sequence
  Synthetic
tgagtacgacgagtggcgtgacctgatgcgtgattggaggcgtgacatgagtgtcaatgacttcctaatgcttag

SEQ ID NO: 315720 - DNA, 75 bp, Artificial Sequence
  Synthetic
aatggccgggggtgcatacacacatgccactatcatcggtcgtggtggtgtgcgagatgagatcatacgcacatc

SEQ ID NO: 315721 - DNA, 75 bp, Artificial Sequence
  Synthetic
accacgtagagcccccactcgaccccaacaacactatgaggaagagggcccaacagcaatcgtggagttcacgca

SEQ ID NO: 315722 - DNA, 75 bp, Artificial Sequence
  Synthetic
caacagcaatcgtggagttcacgcaaggtggtgaccacattggatatggagtacatattggcaatggtaatgtga

SEQ ID NO: 315723 - DNA, 75 bp, Artificial Sequence
  Synthetic
taaccgtcacccatgtggcgtcaacatccgatgaggtcaatggcagtgccttcaagataacacgcactgtgggtg

SEQ ID NO: 315724 - DNA, 75 bp, Artificial Sequence
  Synthetic
aaacaacctgggtgcaaggcccattttcgcaactaccacacatgcaaataggcagtggttccccagtctacttta

SEQ ID NO: 315725 - DNA, 75 bp, Artificial Sequence
  Synthetic
ggcagtggttccccagtctactttaccacacggttgcacccagtcttcacaatatcagaggggacatttgaaact

SEQ ID NO: 315726 - DNA, 75 bp, Artificial Sequence
  Synthetic
atgtcagaatcatgaatggatacccaaccaagaaaggtgactgtggactgccctatttcaactccaaccgccagt

SEQ ID NO: 315727 - DNA, 75 bp, Artificial Sequence
  Synthetic
tagtggcgttgcatgccggcacggatacacagggtgaaacaaaagtggctcaacgagttgtcaaagaagttacca

SEQ ID NO: 315728 - DNA, 75 bp, Artificial Sequence
  Synthetic
cccaagacgagtttcaatggaagggtttgcccgtggtgaagtctggattggatgttggaggcatgcccactggga

SEQ ID NO: 315729 - DNA, 75 bp, Artificial Sequence
  Synthetic
cccggtaccacaggtcccccgcatggccagaggaacagcctggtgagacacatgccccagcaccctttggttcag

SEQ ID NO: 315730 - DNA, 75 bp, Artificial Sequence
  Synthetic
gagacaagaggtacacattctcacaaacagaaatgctagtgaatggattgaagccctacacagaacccactgctg

SEQ ID NO: 315731 - DNA, 75 bp, Artificial Sequence
  Synthetic
aagccctacacagaacccactgctggagtaccaccacagctcttgtctcgcgcagtcacacatgtgcgatcatac

SEQ ID NO: 315732 - DNA, 75 bp, Artificial Sequence
  Synthetic
cgcagtcacacatgtgcgatcatacatagaaacaatcattggcacgcaccggtcccctgtactaacataccacca

SEQ ID NO: 315733 - DNA, 75 bp, Artificial Sequence
  Synthetic
ggtcccctgtactaacataccaccaagcatgtgagctgcttgagcgaaccacttcgtgtggacccttcgtgcagg

SEQ ID NO: 315734 - DNA, 75 bp, Artificial Sequence
  Synthetic
gcctcaagggtgattattgggatgaggagcaacagcagtacactggtgtgctggcaaaccaccttgaacaggcat

SEQ ID NO: 315735 - DNA, 75 bp, Artificial Sequence
  Synthetic
gggacaaagctaataaagggatagcacctagaaacgcctacaaattggcacttaaggatgagctcagaccaattg

SEQ ID NO: 315736 - DNA, 75 bp, Artificial Sequence
  Synthetic
aaaagaacaaggctggcaaacgtaggttgttgtggggctgtgacgccgccactacgctcatagccaccgcggctt

SEQ ID NO: 315737 - DNA, 75 bp, Artificial Sequence
  Synthetic
ttaaggccgtggccaccaggctgcaggtggtgacgccaatgacaccagttgctgttggtatcaacatggactctg

SEQ ID NO: 315738 - DNA, 75 bp, Artificial Sequence
  Synthetic
tccaaatgcaagtgatgaatgactccttgaaagggggcgtcctctactgtctggactactccaaatgggattcca

SEQ ID NO: 315739 - DNA, 75 bp, Artificial Sequence
  Synthetic
cacaaaaccccgcggtaacagcggcatccctggcaatattggagagatttgctgaaccccatccaattgtgtctt

SEQ ID NO: 315740 - DNA, 75 bp, Artificial Sequence
  Synthetic
gcgccattgaggctctttcttcccctgcagagggttacgtcaatgatatcaaatttgtaacacgtggtggtctac

SEQ ID NO: 315741 - DNA, 75 bp, Artificial Sequence
  Synthetic
tgcagagggttacgtcaatgatatcaaatttgtaacacgtggtggtctaccatctgggatgccattcacatctgt

SEQ ID NO: 315742 - DNA, 75 bp, Artificial Sequence
  Synthetic
tgtcaattccatcaatcacatgatatatgtggcggcagccatcttgcaggcatacgaaagccacaatgttccata

SEQ ID NO: 315743 - DNA, 75 bp, Artificial Sequence
  Synthetic
cactgggaatgtcttccaggtggagaccattcacacgtacggtgatgactgcatgtacagtgtgtgccctgccac

SEQ ID NO: 315744 - DNA, 75 bp, Artificial Sequence
  Synthetic
tgcatcaatctttcacaccgtgctcgccaacctgacatcgtatggactgaagcctacagcagctgacaagagtga

SEQ ID NO: 315745 - DNA, 75 bp, Artificial Sequence
  Synthetic
tgcaatcaaaccaactaacacaccagtgtttctgaagaggacattcacacaaaccccacatggaatccgtgcact

SEQ ID NO: 315746 - DNA, 75 bp, Artificial Sequence
  Synthetic
aaaccccacatggaatccgtgcactactagatatcacttccataactagacagttttactggcttaaagcaaaca

SEQ ID NO: 315747 - DNA, 75 bp, Artificial Sequence
  Synthetic
gaacatctgacccctctagcccacctgctttcgatcgtcaggcacgcagtgcacaactggagaatgcactagcct

SEQ ID NO: 315748 - DNA, 75 bp, Artificial Sequence
  Synthetic
acgcctcacaacacgggcctgtcatgtttgacaccgtgcgccaaattgccataaaaactgcccaaggggaggggc

SEQ ID NO: 315749 - DNA, 75 bp, Artificial Sequence
  Synthetic
tggtgcttgttaacaccaactatgaccaggctctcgccacctacaatgcttggttcataggtggtacagtacctg

SEQ ID NO: 315750 - DNA, 75 bp, Artificial Sequence
  Synthetic
ccaggctctcgccacctacaatgcttggttcataggtggtacagtacctgatccagtgggccacactgaaggaac

SEQ ID NO: 315751 - DNA, 75 bp, Artificial Sequence
  Synthetic
cattaacccgtacacttctcacctctctgggatgtgggccgggtggggcggtagttttgaggtccggctatcgat

SEQ ID NO: 315752 - DNA, 75 bp, Artificial Sequence
  Synthetic
cagagcagtggactaccataggatggatggtgctgaacccacgtgttccttggggttctgggtctatcaaccatt

SEQ ID NO: 315753 - DNA, 75 bp, Artificial Sequence
  Synthetic
actcaaccccttctccaccaccgccgtttcaacatgttgggtgtcagtggaaactaaaccaggtggtgattttga

SEQ ID NO: 315754 - DNA, 75 bp, Artificial Sequence
  Synthetic
cagaaggcctgttgcccaggcgcttgggttactcgcgtggtaaccgtgttggtggcttggtggttggcatgattt

SEQ ID NO: 315755 - DNA, 75 bp, Artificial Sequence
  Synthetic
gggttactcgcgtggtaaccgtgttggtggcttggtggttggcatgattttggtggctgagcataagcaggtcaa

SEQ ID NO: 315756 - DNA, 75 bp, Artificial Sequence
  Synthetic
tggtggctgagcataagcaggtcaacagacactttaactccaattcagtcacttttggttggtcaacggcacctg

SEQ ID NO: 315757 - DNA, 75 bp, Artificial Sequence
  Synthetic
ttaatccaatggcagcagagattgtaactaaccaggcacattcaacatcacgccatgcttggctttccattggtg

SEQ ID NO: 315758 - DNA, 75 bp, Artificial Sequence
  Synthetic
ctcagaataagggtccactgtttcccgggatacccaaccatttccccgactcttgtgcatcaacagtcgtggggg

SEQ ID NO: 315759 - DNA, 75 bp, Artificial Sequence
  Synthetic
atgtgtacgaaaatgacacaccctcagttatgtttgccacttatgaccctctcacgtcaggcacgggggttgccc

SEQ ID NO: 315760 - DNA, 75 bp, Artificial Sequence
  Synthetic
ttaccaacagcattaaccctgcatccctggcattggtgcgcatatccaacaatgactttgacaccagtggctttg

SEQ ID NO: 315761 - DNA, 75 bp, Artificial Sequence
  Synthetic
cctggcattggtgcgcatatccaacaatgactttgacaccagtggctttgccaacgataagaatgtagtggtgca

SEQ ID NO: 315762 - DNA, 75 bp, Artificial Sequence
  Synthetic
cttgtgctatggcaggagcgcatgctcagctatgatggacaccaagcaatactgtactcgtcacaattggagaga

SEQ ID NO: 315763 - DNA, 75 bp, Artificial Sequence
  Synthetic
actgtactcgtcacaattggagagaacggctgagtactttcagaatgacatagtcaacataccagaaaattccat

SEQ ID NO: 315764 - DNA, 75 bp, Artificial Sequence
  Synthetic
acggctgagtactttcagaatgacatagtcaacataccagaaaattccatggcggtgttcaatgtggaaaccaac

SEQ ID NO: 315765 - DNA, 75 bp, Artificial Sequence
  Synthetic
ggcggtgttcaatgtggaaaccaactccgcatctttccaaattggcattagacctgatggttacatggtgacagg

SEQ ID NO: 315766 - DNA, 75 bp, Artificial Sequence
  Synthetic
tccgcatctttccaaattggcattagacctgatggttacatggtgacaggtggatccatcggcgtcaacgtgccg

SEQ ID NO: 315767 - DNA, 75 bp, Artificial Sequence
  Synthetic
cttgaacctgaaaccagattccaatacgttggaattctccctttgtctgcagctttatctgggcccagtgggaac

SEQ ID NO: 315768 - DNA, 75 bp, Artificial Sequence
  Synthetic
atgggaagggctagacgggtgttccaatgagttggttggtaggagccctccagaccttcgggtcattggctgacg

SEQ ID NO: 315769 - DNA, 75 bp, Artificial Sequence
  Synthetic
ttgctggcactgtatctaatatagtataccagcagcgtcaggctgctcagttggaaaaacaaaatgaactgatgg

SEQ ID NO: 315770 - DNA, 75 bp, Artificial Sequence
  Synthetic
ataccagcagcgtcaggctgctcagttggaaaaacaaaatgaactgatggagacatggatgaacaagcaagaagc

SEQ ID NO: 315771 - DNA, 75 bp, Artificial Sequence
  Synthetic
acccgagacctctccattaatggtccagctgcccgggtgcaatcagcacttgacgcaggttttgatgaagtgagt

SEQ ID NO: 315772 - DNA, 75 bp, Artificial Sequence
  Synthetic
acttggactctctgagtcactcattggccacatttaaaaatgggactccattcgggaaacctgcgcccccaacaa

SEQ ID NO: 315773 - DNA, 75 bp, Artificial Sequence
  Synthetic
caaaatttggcaagccccaggccacaactgcacaaatcaacattggccacaatcctggcagctccagtgtctaaa

SEQ ID NO: 315774 - DNA, 75 bp, Artificial Sequence
  Synthetic
aactgcacaaatcaacattggccacaatcctggcagctccagtgtctaaatttaaattttcttttctttgaaacg

SEQ ID NO: 315775 - DNA, 75 bp, Artificial Sequence
  Synthetic
ttttcttttctttgaaacggtcccacacgcgttcgggtgggtatcagacaattaagcgattgtcgccgtccccgc

SEQ ID NO: 315776 - DNA, 75 bp, Artificial Sequence
  Synthetic
gtgattggttagatggcttccaagccattcaagccaatagttctcaatgccacttttgagtggcaagtcttcaag

SEQ ID NO: 315777 - DNA, 75 bp, Artificial Sequence
  Synthetic
cggtgctacctcagggtagtgccgcgtgaggcattttgtgagaacttaagtgaactacatcactattttgccagg

SEQ ID NO: 315778 - DNA, 75 bp, Artificial Sequence
  Synthetic
tgaactacatcactattttgccaggcgtgtgaacgcctggctcaagcatgccacaaggaccctcccacacgaata

SEQ ID NO: 315779 - DNA, 75 bp, Artificial Sequence
  Synthetic
cgtgtgaacgcctggctcaagcatgccacaaggaccctcccacacgaatacacattcgttgaggagggtctcctt

SEQ ID NO: 315780 - DNA, 75 bp, Artificial Sequence
  Synthetic
gacatgtttggtacaaaagctcctgacagtgtccaagaaggtgcattgttccgggagctgttcggggttgaccaa

SEQ ID NO: 315781 - DNA, 75 bp, Artificial Sequence
  Synthetic
accgaacagttcccattgtcacttgcagacttggccaggttgcaaggggaacttgttgacgcaactcgtactcca

SEQ ID NO: 315782 - DNA, 75 bp, Artificial Sequence
  Synthetic
ggacatgcattgcgacaaaaatacacaatgaccaccatacaggacttgattaacaagatcaccaaagttgtgcca

SEQ ID NO: 315783 - DNA, 75 bp, Artificial Sequence
  Synthetic
gtgcaggccacgctcaatgagatgcacgcacgcaggcaattcgagcgtgaacgggctgacctgtttcatgagctt

SEQ ID NO: 315784 - DNA, 75 bp, Artificial Sequence
  Synthetic
acgcacgcaggcaattcgagcgtgaacgggctgacctgtttcatgagcttccactggtagatgaagacgccgctg

SEQ ID NO: 315785 - DNA, 75 bp, Artificial Sequence
  Synthetic
cacaacccaagacttatttttacaccatgtggcgtcaagttgtgaagaagggtaaagcatacttttgccctcttg

SEQ ID NO: 315786 - DNA, 75 bp, Artificial Sequence
  Synthetic
ggtaaagcatacttttgccctcttgttaagacaagtgcatggcgcactaagatcagtgccataacggaacccatt

SEQ ID NO: 315787 - DNA, 75 bp, Artificial Sequence
  Synthetic
aaggatttcttaattgcattttgccaggcagtacaacaagaaatgggtgtcaatcctcaatacttgcaacttgct

SEQ ID NO: 315788 - DNA, 75 bp, Artificial Sequence
  Synthetic
tggttgcaaaaactcaaacccaccactttaactatcattcttcaacagcacaagcataccgtctcagggtggctg

SEQ ID NO: 315789 - DNA, 75 bp, Artificial Sequence
  Synthetic
gccaccatgacagcacttgtagaagtgtactcaaatttgtttgacgacttgcgcaaatcatcagtagccatagtg

SEQ ID NO: 315790 - DNA, 75 bp, Artificial Sequence
  Synthetic
tcaagtattggagctttctttgacatttgtaaagactttgtgtcacaagtcgttgagctggtcaaaacaacattc

SEQ ID NO: 315791 - DNA, 75 bp, Artificial Sequence
  Synthetic
cgttgagctggtcaaaacaacattcactgcccaaggcccaacggaccttgggtgggcggcggtactggcaggggt

SEQ ID NO: 315792 - DNA, 75 bp, Artificial Sequence
  Synthetic
gggcattaccaccatcacagcagctgcacgtggagtgcgctggttgaaggacctctatgaggaggctgaaggacg

SEQ ID NO: 315793 - DNA, 75 bp, Artificial Sequence
  Synthetic
tagactggcaaaaatgtacatggcacgtggtgctgctctgatcgaactagccgccagccgtgaggtgacaggcgt

SEQ ID NO: 315794 - DNA, 75 bp, Artificial Sequence
  Synthetic
tgatgagctcaagggcctccttgattgtttcaccgtattgattgaagagggcactgaactcatccacaagtttgg

SEQ ID NO: 315795 - DNA, 75 bp, Artificial Sequence
  Synthetic
cactagcccactagcaggcctggtgcgcacgtatgtgtccgaacttgagacccaagccaacaacatcaggtccac

SEQ ID NO: 315796 - DNA, 75 bp, Artificial Sequence
  Synthetic
cattaagcttgacacccccagacgagtgcccgttgtcatcatcctcactggggcacctggcattggaaaaactcg

SEQ ID NO: 315797 - DNA, 75 bp, Artificial Sequence
  Synthetic
gtgcccgttgtcatcatcctcactggggcacctggcattggaaaaactcgcttagcacaatacattggccagcgc

SEQ ID NO: 315798 - DNA, 75 bp, Artificial Sequence
  Synthetic
tttgggaaaacgtccaatttctcagtggctgtggatcaccacgatggctacacgggaaacactgtttgtatatgg

SEQ ID NO: 315799 - DNA, 75 bp, Artificial Sequence
  Synthetic
tggctgtggatcaccacgatggctacacgggaaacactgtttgtatatgggatgaatttgatgtcgactccaagg

SEQ ID NO: 315800 - DNA, 75 bp, Artificial Sequence
  Synthetic
tgtcatctgcacgtccaactatccaacatctgttatcccagataatccaagagctgcggctttttaccgcagggt

SEQ ID NO: 315801 - DNA, 75 bp, Artificial Sequence
  Synthetic
cctaactgttgacgtcagcgcgcctgacttggaggaatggaagaagaggaatcctggcaagcgacccacccctga

SEQ ID NO: 315802 - DNA, 75 bp, Artificial Sequence
  Synthetic
cctgtatcaagacgatttttcccacctcaaactgatgcttaggccttatttaggttataacccagatggggacac

SEQ ID NO: 315803 - DNA, 75 bp, Artificial Sequence
  Synthetic
acttgaaggtcccagagttgcccccactcaaataagcatagctggactgataaccctaatggaaagaaggtttaa

SEQ ID NO: 315804 - DNA, 75 bp, Artificial Sequence
  Synthetic
ggaacaagctgggcccttacagaacttgtggttgcaagtccccaagacactcgtagaacagtctacaaacatggt

SEQ ID NO: 315805 - DNA, 75 bp, Artificial Sequence
  Synthetic
ctgccacccgtgacatcactgaaactgcattgtcaaaagtttttgtgtgtggcactgcacccccacctgaatttg

SEQ ID NO: 315806 - DNA, 75 bp, Artificial Sequence
  Synthetic
ccaccaccacacgactgtctgccgcggcccagagggagtatatgtatagagtttggagcccactgattcacatac

SEQ ID NO: 315807 - DNA, 75 bp, Artificial Sequence
  Synthetic
aagacagaagcatcaacactcagaacctcccatacatcaatagagtgatcccagtgacatcccactgggacttct

SEQ ID NO: 315808 - DNA, 75 bp, Artificial Sequence
  Synthetic
tgaggggcttgcgacaccatcttggtttcacttctatcccaggcatgtggaaggcatttcaaggttggcgcacat

SEQ ID NO: 315809 - DNA, 75 bp, Artificial Sequence
  Synthetic
cacagggtatagttgattttgtggctcaccacatggcagatgtcacattcccaagtaacccagaatgcaccattt

SEQ ID NO: 315810 - DNA, 75 bp, Artificial Sequence
  Synthetic
cgtatgttggcacaccacccaccactattcactctaatacgcctcggtgcatgacttggggcgaaactatagcac

SEQ ID NO: 315811 - DNA, 75 bp, Artificial Sequence
  Synthetic
atgacttggggcgaaactatagcactgttgtgtgaggtggttgcagagtttgtacttcactttggccctgtgatt

SEQ ID NO: 315812 - DNA, 75 bp, Artificial Sequence
  Synthetic
ctatctgcagccaacatagcctaccttatgactaggggctcaaggaccgaggaggccaagggtaagaccaagcat

SEQ ID NO: 315813 - DNA, 75 bp, Artificial Sequence
  Synthetic
gggctggggtaagcctctcagacgatgagtatgacgagtggcgtgacctcatgcgtgattggcggcgtgacatga

SEQ ID NO: 315814 - DNA, 75 bp, Artificial Sequence
  Synthetic
tgagtatgacgagtggcgtgacctcatgcgtgattggcggcgtgacatgagtgtcaacgacttcctgatgcttag

SEQ ID NO: 315815 - DNA, 75 bp, Artificial Sequence
  Synthetic
ggaaaggtctgcacttggaatggatgatgaggatgtggccaggtatagggcatggcttgagattcgtgccatgcg

SEQ ID NO: 315816 - DNA, 75 bp, Artificial Sequence
  Synthetic
gatgaggatgtggccaggtatagggcatggcttgagattcgtgccatgcgaatggctgggggcgcgtacacacat

SEQ ID NO: 315817 - DNA, 75 bp, Artificial Sequence
  Synthetic
catggcttgagattcgtgccatgcgaatggctgggggcgcgtacacacatgccactatcatcggtcgtggtggtg

SEQ ID NO: 315818 - DNA, 75 bp, Artificial Sequence
  Synthetic
tgcgagatgagatcatacgcacatcaccacgtagggccccgacccgaccccaacaacactatgaggaagagggcc

SEQ ID NO: 315819 - DNA, 75 bp, Artificial Sequence
  Synthetic
caacagcgatcgtggagttcacacagggtggtgatcacattggatatggagtacacattggcaatggcaacgtaa

SEQ ID NO: 315820 - DNA, 75 bp, Artificial Sequence
  Synthetic
ttcaagataacacgcactgtgggtgaaacaacctgggtgcaagggccattttcacaactgccacacatgcaaata

SEQ ID NO: 315821 - DNA, 75 bp, Artificial Sequence
  Synthetic
ccacacggttgcacccagtcttcacaatatcagagggaacatttgaaactccaaacatcactgtgaatgggttcc

SEQ ID NO: 315822 - DNA, 75 bp, Artificial Sequence
  Synthetic
ccaaacatcactgtgaatgggttccatgttagaattgtgaatggttacccaactaagaagggtgactgtgggctg

SEQ ID NO: 315823 - DNA, 75 bp, Artificial Sequence
  Synthetic
ccctatttcaactccaaccgccagttggtggcgttgcatgccggcacggacacacaaggtgaaacaaaagtggct

SEQ ID NO: 315824 - DNA, 75 bp, Artificial Sequence
  Synthetic
caacgagttgttaaagaagttaccacccaagatgaattccagtggaagggtttgcccgtggtgaagtccgggttg

SEQ ID NO: 315825 - DNA, 75 bp, Artificial Sequence
  Synthetic
gatgttggaggtatgcctactgggacgcggtaccacaggtcccccgcgtggccagaggaacagcctggtgagaca

SEQ ID NO: 315826 - DNA, 75 bp, Artificial Sequence
  Synthetic
cgcggtaccacaggtcccccgcgtggccagaggaacagcctggtgagacacatgccccagcaccctttggtgcgg

SEQ ID NO: 315827 - DNA, 75 bp, Artificial Sequence
  Synthetic
aagccctacacagaacccactgccggagtaccgccacagctcttgtctcgcgcagtcacacacgtgcgatcatac

SEQ ID NO: 315828 - DNA, 75 bp, Artificial Sequence
  Synthetic
gagtaccgccacagctcttgtctcgcgcagtcacacacgtgcgatcatacatagagacaattattggcacgcacc

SEQ ID NO: 315829 - DNA, 75 bp, Artificial Sequence
  Synthetic
acttcgtgtggacccttcgtgcagggccttaagggtgattattgggatgaggagcagcagcagtacactggtgtg

SEQ ID NO: 315830 - DNA, 75 bp, Artificial Sequence
  Synthetic
ctggcaaaccaccttgaacaggcatgggataaggctaacaaagggatagcacccagaaacgcctacaaattggca

SEQ ID NO: 315831 - DNA, 75 bp, Artificial Sequence
  Synthetic
acccagaaacgcctacaaattggcacttaaggatgagctcaggccaattgaaaagaacaaggttggcaaacgtag

SEQ ID NO: 315832 - DNA, 75 bp, Artificial Sequence
  Synthetic
ttaaggccgtggctaccaggctacaggtggtgacgccaatgacaccagttgctgttggcattaacatggactctg

SEQ ID NO: 315833 - DNA, 75 bp, Artificial Sequence
  Synthetic
gctgttggcattaacatggactctgtccaaatgcaagtgatgaatgactccttgaaaggaggtgttctctactgc

SEQ ID NO: 315834 - DNA, 75 bp, Artificial Sequence
  Synthetic
ctggactactccaaatgggactccacacaaaatcccgcagtgacagcagcatccctggcaatattggagagattt

SEQ ID NO: 315835 - DNA, 75 bp, Artificial Sequence
  Synthetic
gctgaaccccatccaattgtgtcttgcgccattgaggccctttcctcccctgcagagggctacgtcaacgacatt

SEQ ID NO: 315836 - DNA, 75 bp, Artificial Sequence
  Synthetic
tgcagagggctacgtcaacgacattaagtttgtgacacgtggtggtctgccgtctgggatgccatttacatctgt

SEQ ID NO: 315837 - DNA, 75 bp, Artificial Sequence
  Synthetic
tgtcaattccatcaatcacatgttatacgtggcggcagccatcttgcaggcatacgaaagccacaatgtcccata

SEQ ID NO: 315838 - DNA, 75 bp, Artificial Sequence
  Synthetic
cgcgtcaatcttccacactgtgctcgccaatctgacatcatatggactgaagcccacagcagctgacaagagtga

SEQ ID NO: 315839 - DNA, 75 bp, Artificial Sequence
  Synthetic
tgcaatcaaaccaaccaacacaccagtgtttctgaagaggacattcacgcagaccccacatggagtccgtgcact

SEQ ID NO: 315840 - DNA, 75 bp, Artificial Sequence
  Synthetic
agaccccacatggagtccgtgcactgctagacatcacttccataactaggcagttttactggttgaaagcaaata

SEQ ID NO: 315841 - DNA, 75 bp, Artificial Sequence
  Synthetic
atgcttcacaacacgggcctgttatgtttgacaccgttcgtcaaattgccataaagactgcccaaggagagggac

SEQ ID NO: 315842 - DNA, 75 bp, Artificial Sequence
  Synthetic
aagggcagtggactaccataggatggatggtgctgaacccacatgctccttggggttttgggtttatcaaccatt

SEQ ID NO: 315843 - DNA, 75 bp, Artificial Sequence
  Synthetic
aaactaaaccaggtggtgattttgacttctgtctgctaaggccaccaggtcaacagatggaaaatggggtttcac

SEQ ID NO: 315844 - DNA, 75 bp, Artificial Sequence
  Synthetic
cttctgtctgctaaggccaccaggtcaacagatggaaaatggggtttcaccggaaggtctattgcctaggcgctt

SEQ ID NO: 315845 - DNA, 75 bp, Artificial Sequence
  Synthetic
tggtagctgagcataagcaggtcaatagacactttaattccaattcagtcacctttggttggtcaacggcacctg

SEQ ID NO: 315846 - DNA, 75 bp, Artificial Sequence
  Synthetic
ctcagaataagggtccattgtttcccgggatacccaaccacttccccgactcgtgtgtatcaacagtcgtggggg

SEQ ID NO: 315847 - DNA, 75 bp, Artificial Sequence
  Synthetic
atgtgtacgaaaatgatacaccctcagtcatgtttgccacttacgaccctctcacgccaggcacgggggttgctc

SEQ ID NO: 315848 - DNA, 75 bp, Artificial Sequence
  Synthetic
agtcatgtttgccacttacgaccctctcacgccaggcacgggggttgctctcaccaacagcattaaccctgcatc

SEQ ID NO: 315849 - DNA, 75 bp, Artificial Sequence
  Synthetic
cctggcgttggtacgcatatccaacaatgactttgacaccagtggctttgccaacgacaagaatgtagtggtgca

SEQ ID NO: 315850 - DNA, 75 bp, Artificial Sequence
  Synthetic
aatgtcatgggagatgtacacaggcaccaaccaaattagaggtcaagtcacaccaatgtctggcaccaactacac

SEQ ID NO: 315851 - DNA, 75 bp, Artificial Sequence
  Synthetic
accaaccaaattagaggtcaagtcacaccaatgtctggcaccaactacacctttacttccacaggtgcgaacact

SEQ ID NO: 315852 - DNA, 75 bp, Artificial Sequence
  Synthetic
tccgcatccttccaaattggcattagacctgatggttacatggtgacaggtggatctattggcattaacgtaccg

SEQ ID NO: 315853 - DNA, 75 bp, Artificial Sequence
  Synthetic
atgggaagggccaaacgggtgttccaatgagttggttagtgggtgccctccaaaccttcgggtcattggctgacg

SEQ ID NO: 315854 - DNA, 75 bp, Artificial Sequence
  Synthetic
aatgagttggttagtgggtgccctccaaaccttcgggtcattggctgacgttgctggcactgtatccaatatagt

SEQ ID NO: 315855 - DNA, 75 bp, Artificial Sequence
  Synthetic
gtaccagcagcgccaggctgctcagttggaaaaacaaaatgaactgatggaaacatggataaacaagcaagaagc

SEQ ID NO: 315856 - DNA, 75 bp, Artificial Sequence
  Synthetic
actgcagaaatcccaaatggaattaacccgagacctctccattaatggtccagctgcccgggtgcaatcagcact

SEQ ID NO: 315857 - DNA, 75 bp, Artificial Sequence
  Synthetic
cagctgcccgggtgcaatcagcactcgacgcgggttttgatgaagtgagtgcacggcgaatagctggttcaggtg

SEQ ID NO: 315858 - DNA, 75 bp, Artificial Sequence
  Synthetic
tcgacccatcatgcacgctggcactatggatagcatacgccaaaccaaacatttggactctttgagtcactcatt

SEQ ID NO: 315859 - DNA, 75 bp, Artificial Sequence
  Synthetic
atggatagcatacgccaaaccaaacatttggactctttgagtcactcattggctacattcaaaaatgggactcca

SEQ ID NO: 315860 - DNA, 75 bp, Artificial Sequence
  Synthetic
tttgggaaacctgcgcccccaacagcaaaatttggcaagccccaggccacaactgcacaagttaacattggtcac

SEQ ID NO: 315861 - DNA, 75 bp, Artificial Sequence
  Synthetic
aactgcacaagttaacattggtcacaaccctggcagctccaatgtctaaattcaaattttcttttctttgaaacg

SEQ ID NO: 315862 - DNA, 75 bp, Artificial Sequence
  Synthetic
cggtgctacctcagggtagctccgcgcgaggcattttgtgagaacttaagtgaattacatcactattttgccagg

SEQ ID NO: 315863 - DNA, 75 bp, Artificial Sequence
  Synthetic
cgtttgaacgcctggctcaagcatgccacaaggaccctccctaacgaatatacgttcgtcgaggagggtctcctt

SEQ ID NO: 315864 - DNA, 75 bp, Artificial Sequence
  Synthetic
gacatgtttggtacaaaagctcctgacagtgtccaagaaggtgcattgtttcgggagctgttcggtgttgaccaa

SEQ ID NO: 315865 - DNA, 75 bp, Artificial Sequence
  Synthetic
accgagcagttccctctgtcccttgcagacttggccaggttgcaaggggaacttgttgacgcgacccgcactcca

SEQ ID NO: 315866 - DNA, 75 bp, Artificial Sequence
  Synthetic
ggacacgcattgcgacaaaaatacacaatgaccaccatacaggacttgatcaacaaaatcaccaaagttgtgcca

SEQ ID NO: 315867 - DNA, 75 bp, Artificial Sequence
  Synthetic
gtgcaggccacgctcagtgaaatgcatgcacgcaggcaattcgagcgtgagcgggctgacctattccatgagctt

SEQ ID NO: 315868 - DNA, 75 bp, Artificial Sequence
  Synthetic
ccattggtagatgaagacgccgttgcacaacccaaaacctatttttacaccatgtggcgtcaagttgtgaagaag

SEQ ID NO: 315869 - DNA, 75 bp, Artificial Sequence
  Synthetic
ggtaaggcatacttttgtcccctcgtcaagacaagtgcgtggcgcaccaagatcagtgccattacagaacccatt

SEQ ID NO: 315870 - DNA, 75 bp, Artificial Sequence
  Synthetic
aaggatttcttgattgcgttttgccaggcagtacaacaagaaatgggtgtcaacccgcaatacctgcaacttgct

SEQ ID NO: 315871 - DNA, 75 bp, Artificial Sequence
  Synthetic
tggctacaaaaactcaaacctaccaccttaaccatcatccttcaacaacacaagcacacagtctcagggtggctg

SEQ ID NO: 315872 - DNA, 75 bp, Artificial Sequence
  Synthetic
gccaccatgacagcactagtggaggtgtattcaaatctgtttgacgacttgcgtaagtcatcagtgaccattgtg

SEQ ID NO: 315873 - DNA, 75 bp, Artificial Sequence
  Synthetic
gcgtaagtcatcagtgaccattgtgtcaagtattggagctttctttgacatttgcaaagactttgtgtcacaggt

SEQ ID NO: 315874 - DNA, 75 bp, Artificial Sequence
  Synthetic
tgcaatgatcctactaaaaatgtctgggtgcccaggcgtacttggtatgtggacaaaagtgctcaaaatctgcgg

SEQ ID NO: 315875 - DNA, 75 bp, Artificial Sequence
  Synthetic
gggcatcaccaccatcacagcagcagcacgtggggtgcgttggttgaaggacctctatgaggaggctgaaggacg

SEQ ID NO: 315876 - DNA, 75 bp, Artificial Sequence
  Synthetic
tagactggcaaaaatgtatatggcacgtggtgctgctctgattgaactagctgccagccgtgaggtgacaggtgt

SEQ ID NO: 315877 - DNA, 75 bp, Artificial Sequence
  Synthetic
cgacgagcttaaaggtctcctagattgtttcaccatattgattgaggagggcactgagctcatccacaagtttgg

SEQ ID NO: 315878 - DNA, 75 bp, Artificial Sequence
  Synthetic
cactagcccacttgcaggcctagtacgcacgtatgtgtccgaacttgagacccaggcaaacaacatcaggtccac

SEQ ID NO: 315879 - DNA, 75 bp, Artificial Sequence
  Synthetic
cattaaacttgacaccccaagacgtgtgcccgttgtcatcatcctcactggtgcacctggcattggaaaaacccg

SEQ ID NO: 315880 - DNA, 75 bp, Artificial Sequence
  Synthetic
cttagcacaatacattggccagcgctttggaaaaacctccaatttctcagtagctgtggaccaccacgacggcta

SEQ ID NO: 315881 - DNA, 75 bp, Artificial Sequence
  Synthetic
tagctgtggaccaccacgacggctacacaggaaacactgtttgcatatgggatgaatttgatgtcgactccaaag

SEQ ID NO: 315882 - DNA, 75 bp, Artificial Sequence
  Synthetic
gtgcgtttgtggagacgatgattgggattgcaaacacggcacccttcccattaaattgtgacagggttgaaaata

SEQ ID NO: 315883 - DNA, 75 bp, Artificial Sequence
  Synthetic
gattgcaaacacggcacccttcccattaaattgtgacagggttgaaaataagggacgtgtattcacatccgacta

SEQ ID NO: 315884 - DNA, 75 bp, Artificial Sequence
  Synthetic
tgtcatctgcacgtccaattacccaacatctgttatcccagacaacccaagagctgcggccttttaccgcagggt

SEQ ID NO: 315885 - DNA, 75 bp, Artificial Sequence
  Synthetic
cttaacagttgatgtcagcgcgcccgacttggaggaatggaagaagaggaatcccggcaagcgacctacccctga

SEQ ID NO: 315886 - DNA, 75 bp, Artificial Sequence
  Synthetic
cctgtaccaagatgatttttcccacctcaaactgatgcttaggccctatttgggttacaacccagatggggacac

SEQ ID NO: 315887 - DNA, 75 bp, Artificial Sequence
  Synthetic
ctcaaactgatgcttaggccctatttgggttacaacccagatggggacacacttgaaggccccagggttgccccc

SEQ ID NO: 315888 - DNA, 75 bp, Artificial Sequence
  Synthetic
taaccctaatggaaagaaggtttaaggaacaagctgggcccctacagaacttgtggttgcaagttcccaagacac

SEQ ID NO: 315889 - DNA, 75 bp, Artificial Sequence
  Synthetic
tcgtggaacagtctacaaatatggttaaggcgtttatgtacgccaaccgtgcagtgtgtgacgttatacccaatc

SEQ ID NO: 315890 - DNA, 75 bp, Artificial Sequence
  Synthetic
ctgccacccgtgacattactgaaactgcattgtcaaaggtctttgtatgtggcactgcgcccccaccagagtttg

SEQ ID NO: 315891 - DNA, 75 bp, Artificial Sequence
  Synthetic
ttggcaaacatatagtcgttacgggcatagaggttggggacgcctccatcgccaactcactattgtccatgttca

SEQ ID NO: 315892 - DNA, 75 bp, Artificial Sequence
  Synthetic
ccaccaccacacgactctccgccgcagcccagagggagtacatgtacagagtgtggagtccgctgatccatatac

SEQ ID NO: 315893 - DNA, 75 bp, Artificial Sequence
  Synthetic
aagaccgaagcataaacacccagaacctcccatacatcaacagagtgatcccagtgacatcccattgggacttct

SEQ ID NO: 315894 - DNA, 75 bp, Artificial Sequence
  Synthetic
tgaggggtttgcggcaccatctgggtttcacttccatcccaggtatgtggaaggcatttcaaggttggcgcacat

SEQ ID NO: 315895 - DNA, 75 bp, Artificial Sequence
  Synthetic
cacagggtatagttgattttgtggctcatcacatggcagatgttacattcccaagtaatccagaatgcaccattt

SEQ ID NO: 315896 - DNA, 75 bp, Artificial Sequence
  Synthetic
tccgcacgccagatgcggatgtggtcttttacacttttggctcatacgtgtgtttcgccaccccagcacgagtgc

SEQ ID NO: 315897 - DNA, 75 bp, Artificial Sequence
  Synthetic
catatgttggcacaccgcccaccaccatccactccaacacgcctcgttgcatgacttggggcgaaactatagcac

SEQ ID NO: 315898 - DNA, 75 bp, Artificial Sequence
  Synthetic
tgttgtgtgaggtggttgccgagtttgtacttcattttggtcctgtgattctatctgcagccaacatagcctacc

SEQ ID NO: 315899 - DNA, 75 bp, Artificial Sequence
  Synthetic
ttatgactagaggctcaaggactgaggaggctaagggtaagaccaagcatggacgtggtatgcgccatggccacc

SEQ ID NO: 315900 - DNA, 75 bp, Artificial Sequence
  Synthetic
gggctggagtgagtctctcagacgatgagtatgacgagtggcgtgacctaatgcgcgattggaggcgtgacatga

SEQ ID NO: 315901 - DNA, 75 bp, Artificial Sequence
  Synthetic
gtgtcaatgacttcctaatgcttagggaaaggtccgcacttggaatggatgatgaggacgtagccaggtatcgag

SEQ ID NO: 315902 - DNA, 75 bp, Artificial Sequence
  Synthetic
cgtggcttgaaatccgtgccatgcgaatggctgggggtgcgtacacacatgctactatcattggtcgtggtggcg

SEQ ID NO: 315903 - DNA, 75 bp, Artificial Sequence
  Synthetic
tgcgggatgagatcatacgcacatcaccgcgtagagccccgacccgaccccaacaacactatgaggaagagagcc

SEQ ID NO: 315904 - DNA, 75 bp, Artificial Sequence
  Synthetic
caaccgcaatcgtggaatttacacagggtggtgaacacattgggtatggagtacacattggcaatggcaacgtaa

SEQ ID NO: 315905 - DNA, 75 bp, Artificial Sequence
  Synthetic
aaacaacctgggtgcaggggccattcgcacaactgccacatatgcaaataggtaatggttctccagtctacttca

SEQ ID NO: 315906 - DNA, 75 bp, Artificial Sequence
  Synthetic
ccacacggttacatccagtcttcacaatatcagaggggacatttgaaactccaaacattactgtgaatggattcc

SEQ ID NO: 315907 - DNA, 75 bp, Artificial Sequence
  Synthetic
atgtcaggatcatgaacggttacccaaccaagaagggtgactgtggactgccctatttcaactccaaccgccagt

SEQ ID NO: 315908 - DNA, 75 bp, Artificial Sequence
  Synthetic
tggtggcgttgcatgccggcacggacacacagggtgaaacaaaagtggcccaacgagttgtgaaggaagtcacca

SEQ ID NO: 315909 - DNA, 75 bp, Artificial Sequence
  Synthetic
ctcaagacgagttccaatggaagggtttgcccgtggtgaagtctgggttggatgttggaggcatgcccactggaa

SEQ ID NO: 315910 - DNA, 75 bp, Artificial Sequence
  Synthetic
ctcgttatcacaggtctcccgcatggccagaggaacagcctggtgagacacatgccccagcaccctttggtgcag

SEQ ID NO: 315911 - DNA, 75 bp, Artificial Sequence
  Synthetic
catgccccagcaccctttggtgcaggggacaagaggtacacattctcacaaacagaaatgctagtcaatggattg

SEQ ID NO: 315912 - DNA, 75 bp, Artificial Sequence
  Synthetic
atagaaacaatcattggcacgcatcggtcccctgtactaacataccatcaggcatgtgagttgcttgagcggacc

SEQ ID NO: 315913 - DNA, 75 bp, Artificial Sequence
  Synthetic
acttcgtgtggacccttcgtgcagggtctcaagggtgattattgggacgaggagcaacagcagtacactggtgtg

SEQ ID NO: 315914 - DNA, 75 bp, Artificial Sequence
  Synthetic
ctggctaatcaccttgaacaggcatgggacaaagctaacaaagggatagcacctaggaacgcctacaagctggca

SEQ ID NO: 315915 - DNA, 75 bp, Artificial Sequence
  Synthetic
cttaaggatgagctcaggccaattgaaaagaacaaagttggcaaacgtaggttgctgtggggctgtgacgccgcc

SEQ ID NO: 315916 - DNA, 75 bp, Artificial Sequence
  Synthetic
accacacttatagccactgcggcttttaaggccgtggctactaggctgcaggtggtgacgccaatgacaccagtt

SEQ ID NO: 315917 - DNA, 75 bp, Artificial Sequence
  Synthetic
gctgttggcatcaacatggactctgtccaaatgcaagtgatgaacgactccttgaaagggggcgtcctctactgc

SEQ ID NO: 315918 - DNA, 75 bp, Artificial Sequence
  Synthetic
gctgaaccccatccaattgtgtcctgtgctattgaggccctttcttcccctgcagagggctatgtcaacgacatt

SEQ ID NO: 315919 - DNA, 75 bp, Artificial Sequence
  Synthetic
aagtttgtgacgcgtggtggtctaccctctgggatgccattcacatctgtcgtcaattccatcaaccacatgata

SEQ ID NO: 315920 - DNA, 75 bp, Artificial Sequence
  Synthetic
tatgtggcggcagccattctgcaggcatatgaaagccacaatgtcccatacactggaaatgttttccaggtggag

SEQ ID NO: 315921 - DNA, 75 bp, Artificial Sequence
  Synthetic
accattcacacgtacggtgatgactgtatgtacagtgtgtgccctgccaccgcatcaattttccacactgtgctc

SEQ ID NO: 315922 - DNA, 75 bp, Artificial Sequence
  Synthetic
gccaacctgacatcgtatggactgaagcccacagcagctgacaagagtgatgcaattaaaccaaccaacatacca

SEQ ID NO: 315923 - DNA, 75 bp, Artificial Sequence
  Synthetic
gtgtttctaaagaggacattcacacaaaccccacatggagtccgtgcactactagacatcacttccataactaga

SEQ ID NO: 315924 - DNA, 75 bp, Artificial Sequence
  Synthetic
cagttttactggctgaaagcaaatagaacatctgacccctctagtccacctgcttttgatcgccaggcacgcagt

SEQ ID NO: 315925 - DNA, 75 bp, Artificial Sequence
  Synthetic
gcgcaactggagaacgcactagcctatgcctcacaacacgggcctgtcacgtttgacaccgtgcgccaaattgcc

SEQ ID NO: 315926 - DNA, 75 bp, Artificial Sequence
  Synthetic
atgcctcacaacacgggcctgtcacgtttgacaccgtgcgccaaattgccattaagactgcccaaggagagggac

SEQ ID NO: 315927 - DNA, 75 bp, Artificial Sequence
  Synthetic
acccagtgggtcacactgaaggaacccacaaaatagtgtttgagatggagggcaatggctccaactcagagccaa

SEQ ID NO: 315928 - DNA, 75 bp, Artificial Sequence
  Synthetic
cattaacccgtacacttctcacctctctgggatgtgggccgggtggggcggtagctttgaggtccggctatcgat

SEQ ID NO: 315929 - DNA, 75 bp, Artificial Sequence
  Synthetic
cagagcagtggactaccatagaatggatggtgctgaacccacatgttccttggggttctgggtctaccaaccatt

SEQ ID NO: 315930 - DNA, 75 bp, Artificial Sequence
  Synthetic
cagaaggcctgctgcccaggcgtttgggttactcacgtggtaatcgtgttggtggtctggtggttggcatgattt

SEQ ID NO: 315931 - DNA, 75 bp, Artificial Sequence
  Synthetic
tggtggctgaacacaagcaggtcaacaggcattttaactccaattctgtcacatttggttggtcaaccgcacctg

SEQ ID NO: 315932 - DNA, 75 bp, Artificial Sequence
  Synthetic
ttaacccaatggcagcagagatcgtgaccaaccaggcacattcgacatcacgtcatgcttggctctccattggtg

SEQ ID NO: 315933 - DNA, 75 bp, Artificial Sequence
  Synthetic
ctcagaataagggtccattgttccccgggatacccaaccatttccccgactcgtgtgcatcaacagtcgtggggg

SEQ ID NO: 315934 - DNA, 75 bp, Artificial Sequence
  Synthetic
acgtttacgaaaatgacacaccctcagtcatgtttgccacctacgaccctctcacgtccggcacgggggttgctc

SEQ ID NO: 315935 - DNA, 75 bp, Artificial Sequence
  Synthetic
ttaccaatagcatcaaccctgcatctctggcattggtgcgcatatccaacaacgactttgacaccagtggttttg

SEQ ID NO: 315936 - DNA, 75 bp, Artificial Sequence
  Synthetic
tctggcattggtgcgcatatccaacaacgactttgacaccagtggttttgccaacgataaaaatgtggtggtgca

SEQ ID NO: 315937 - DNA, 75 bp, Artificial Sequence
  Synthetic
cttgtgttgtggcaggagcgtatgctcagctacgatggacaccaagcaatattgtactcgtcacaattggagagg

SEQ ID NO: 315938 - DNA, 75 bp, Artificial Sequence
  Synthetic
acggctgagtacttccagaatgacatagttaacatacctgaaaattccatggcagtgttcaatgtggaaaccaat

SEQ ID NO: 315939 - DNA, 75 bp, Artificial Sequence
  Synthetic
tctgcatcttttcaaattggcattagacctgatggttatatggtgacaggtggatctattggcgtcaatgtgccg

SEQ ID NO: 315940 - DNA, 75 bp, Artificial Sequence
  Synthetic
cttgaacctgaaactagattccaatacgttggtatcctccctttgtctgcagctttatctgggcccagtgggaac

SEQ ID NO: 315941 - DNA, 75 bp, Artificial Sequence
  Synthetic
atgggaagggccagacgggtgttccaatgagttggttggtaggcgccctccagaccttcgggtcattggctgacg

SEQ ID NO: 315942 - DNA, 75 bp, Artificial Sequence
  Synthetic
ttgctggcactgtgtctaacatagtgtaccagcagcgtcaggctgctcagttggaaaaacagaatgaactaatgg

SEQ ID NO: 315943 - DNA, 75 bp, Artificial Sequence
  Synthetic
ttggaaaaacagaatgaactaatggagacatggatgaacaagcaagaagcattgcaaaagtcccaaatggaatta

SEQ ID NO: 315944 - DNA, 75 bp, Artificial Sequence
  Synthetic
gcacggcgtattgctggttcaggtgagcgcgtgatatggggcaatcttgatcggcccatcatgcacgctggcact

SEQ ID NO: 315945 - DNA, 75 bp, Artificial Sequence
  Synthetic
atggacagcatacgccaaactaaacacttggactttttgagtcactcattggccacattcaaaaatggaactcca

SEQ ID NO: 315946 - DNA, 75 bp, Artificial Sequence
  Synthetic
tttggtaaacctgcacccccaacagcaaaatttggcaaacctcaggccacaattgcaaaaatcaacattggtcac

SEQ ID NO: 315947 - DNA, 75 bp, Artificial Sequence
  Synthetic
aaccctggtagctccagtgtctaaatccaaatttttttttctttgaaacggtcccacaggggttggggggggtat

SEQ ID NO: 315948 - DNA, 75 bp, Artificial Sequence
  Synthetic
aatttttttttctttgaaacggtcccacaggggttggggggggtatcagacaattaagggattgtcgccgtcccc

SEQ ID NO: 315949 - DNA, 75 bp, Artificial Sequence
  Synthetic
ttgccctgacgggtacatgcgtacaggatccccagttggcacagttgttgatttaacacccgagtgcacttttac

SEQ ID NO: 315950 - DNA, 75 bp, Artificial Sequence
  Synthetic
atttaacacccgagtgcacttttacttttgttggtcttttcccttttacttcccctctcaatgggcctcatggga

SEQ ID NO: 315951 - DNA, 75 bp, Artificial Sequence
  Synthetic
ctgaaaagttatccacagagggccccgctctccgagtcaaggctgcactagacgcgggttttgaccccgtcagcg

SEQ ID NO: 315952 - DNA, 75 bp, Artificial Sequence
  Synthetic
cgctctccgagtcaaggctgcactagacgcgggttttgaccccgtcagcgcccgccgtttggccgggtcagggga

SEQ ID NO: 315953 - DNA, 75 bp, Artificial Sequence
  Synthetic
gtgatcgtgatggctaattgccgtccgttacctattgggcatctgcccaacaggattttcagcaccccacgactc

SEQ ID NO: 315954 - DNA, 75 bp, Artificial Sequence
  Synthetic
accccagggtgggtgtgggcgtgcacaaataaagctatgttcaaattagagtggcttcaagacccggtggttatc

SEQ ID NO: 315955 - DNA, 75 bp, Artificial Sequence
  Synthetic
cgacctccggaggtgttcgtagcgcaaggggtggtggacgatttcttccgccccaagcgcgttttgcagggtgac

SEQ ID NO: 315956 - DNA, 75 bp, Artificial Sequence
  Synthetic
ccacaacttatcgcacaagtcttgcttggtgatgctagtgggccactggttggccccgtgtccatgcagcaatta

SEQ ID NO: 315957 - DNA, 75 bp, Artificial Sequence
  Synthetic
acatcactgctgcatgaggtgtcacaggcgttaaatgaccataaacacccattggccaacaggtacaccagggcc

SEQ ID NO: 315958 - DNA, 75 bp, Artificial Sequence
  Synthetic
tctctgcaaaggtatgctgacactttatccaactacataccccttgtggacattttgacaggaccaaaggatctc

SEQ ID NO: 315959 - DNA, 75 bp, Artificial Sequence
  Synthetic
acaccacgggacgttctagaacagctcgccgcaggacgtgagtgggagtgtgtaccagacagcgccctaaagaag

SEQ ID NO: 315960 - DNA, 75 bp, Artificial Sequence
  Synthetic
gttttcagggacatgtggcagtacgtctgtgaggggtgtgacagtgtgtacataaagctccaggatgtaaagcgc

SEQ ID NO: 315961 - DNA, 75 bp, Artificial Sequence
  Synthetic
aagatgccgcacatcgacacaacagtgttgaaacagtttatcatcacactgacagataccatctccatggcaaca

SEQ ID NO: 315962 - DNA, 75 bp, Artificial Sequence
  Synthetic
gccttggacaccaaaacgtggctcgcacacattttgggctggctaaaacccacctgtttagtcatgattatgcaa

SEQ ID NO: 315963 - DNA, 75 bp, Artificial Sequence
  Synthetic
caacacgtcaactctccccagggatgggctgccacattgactgccctggcagaactctattatggcatcatgcca

SEQ ID NO: 315964 - DNA, 75 bp, Artificial Sequence
  Synthetic
ctcactgagacacttggctctgttgccagttgggtgactgacaagtttgctgacatggcgactggcacttggggc

SEQ ID NO: 315965 - DNA, 75 bp, Artificial Sequence
  Synthetic
aagtttaaatcttggtgggacagcctttacacaccacaggcaggtaatgaccttatcatattggggggcgttgtc

SEQ ID NO: 315966 - DNA, 75 bp, Artificial Sequence
  Synthetic
ggactggtgtactttatggtgtttggtgacgcacccacccaaatgttcaccaagaaattgatgaaggtgtgtggt

SEQ ID NO: 315967 - DNA, 75 bp, Artificial Sequence
  Synthetic
ttcatcacctccacggtggctgctattaaggcagccatgtggatagtggactacttcaaacaacgcgagcacgag

SEQ ID NO: 315968 - DNA, 75 bp, Artificial Sequence
  Synthetic
caccaggttcgcgtcaccttggcaaggtgggccgcacttcaagaagtgataaaacaaaacaggtgtgctggcctc

SEQ ID NO: 315969 - DNA, 75 bp, Artificial Sequence
  Synthetic
agtgaagttaccaagctaaaagagtgttgtgaagtgttgctaaatgaagtcactgagctcatgtacaaactgggt

SEQ ID NO: 315970 - DNA, 75 bp, Artificial Sequence
  Synthetic
gcctcacccctggcagggttgatacgtagcacctctgatgtcatccaaaccaccatcaatgaactggcccagcta

SEQ ID NO: 315971 - DNA, 75 bp, Artificial Sequence
  Synthetic
atggcctacgacacccagcgcaagccgccagccatgatagtgtttggagggcctccgggcattggtaaaacacgg

SEQ ID NO: 315972 - DNA, 75 bp, Artificial Sequence
  Synthetic
ctggtggaagccttagctaaacagctgggagaagtcagccatttcaccatggctgttgaccactatgacacttac

SEQ ID NO: 315973 - DNA, 75 bp, Artificial Sequence
  Synthetic
actggcaatacggttgcgatttgggacgaattcgatgtggactcaaaacaggccttcattgaggccaccattggc

SEQ ID NO: 315974 - DNA, 75 bp, Artificial Sequence
  Synthetic
attgtgaattgcgccccttaccccttgaattgtgaccggccagaagcaaagggcagggttttcacgtcacagtac

SEQ ID NO: 315975 - DNA, 75 bp, Artificial Sequence
  Synthetic
gtgctggccaccaccaattgccccacaccggtcttgcccgaccacccgagggccatggccttttggcgtcgcata

SEQ ID NO: 315976 - DNA, 75 bp, Artificial Sequence
  Synthetic
acattcattgacgtgacagcccccacaattgaacagtggctagtggacaacccagggcgcaaagccccagcaagc

SEQ ID NO: 315977 - DNA, 75 bp, Artificial Sequence
  Synthetic
ctttttaaagatgacttttcccatttgcagtgctcagtgcgcggctacactgcctatgatgagaagggcaacacg

SEQ ID NO: 315978 - DNA, 75 bp, Artificial Sequence
  Synthetic
ctcagtggtaaggtggccagggccaggtacgtgtcagttaacaatctccttgacttgatcaaggagaaatacgac

SEQ ID NO: 315979 - DNA, 75 bp, Artificial Sequence
  Synthetic
agtgaggcctctgacatcaaacatctgtggtttactgtccctcaggccatccacaagcaagcacgcgacatcata

SEQ ID NO: 315980 - DNA, 75 bp, Artificial Sequence
  Synthetic
ctgggctggctgcggttccactcttacccgaacacagttgcagataacatacccctctctgaggtcagggaccct

SEQ ID NO: 315981 - DNA, 75 bp, Artificial Sequence
  Synthetic
acgtgttttgggtatgtggtgatttctgatgtggacccaccacgacatgtggctgagcatgttgcccacatagaa

SEQ ID NO: 315982 - DNA, 75 bp, Artificial Sequence
  Synthetic
gtagaatcagtgttgcgcactgacattatggatctgttgagggaaggtggtggcggcttgttcagagccctcaag

SEQ ID NO: 315983 - DNA, 75 bp, Artificial Sequence
  Synthetic
gtcaagagtgccccgcgcagttgtgtcattaataaggtcatgatgcaagcacaccacaccaccttgcaagtgctc

SEQ ID NO: 315984 - DNA, 75 bp, Artificial Sequence
  Synthetic
accaaccaggaaccacacccaccaaatttgcctcgacccaggcgtctggtgtttgttgagtcgccaattgacatc

SEQ ID NO: 315985 - DNA, 75 bp, Artificial Sequence
  Synthetic
attagtgccctacgacaccatgtcggcttctgcactatccctggcatcgtcaaattaatcacctctggagtaggg

SEQ ID NO: 315986 - DNA, 75 bp, Artificial Sequence
  Synthetic
ttgggcgttgagaacttgggtaacttccttcaatctattgctggcaacgtcaggtttcctttgcagtctgaatgc

SEQ ID NO: 315987 - DNA, 75 bp, Artificial Sequence
  Synthetic
tcattgctcaggaccccaggtggcgacgtcctcttctacacctcaggacaggctgccgtgtgggctacacctgcg

SEQ ID NO: 315988 - DNA, 75 bp, Artificial Sequence
  Synthetic
cgctttccaataatcacaccgggagaggcatcagttggtaaggaggtgtgctcagagtcctcttggtgggacatt

SEQ ID NO: 315989 - DNA, 75 bp, Artificial Sequence
  Synthetic
cttaaagcacttttcagcacacttgtggtggcatttggacccattgccacgctggtgttgacagcccacaatttg

SEQ ID NO: 315990 - DNA, 75 bp, Artificial Sequence
  Synthetic
gcctatctgaacacccgtgagggcacgctcagcgaggcgaaagggaaaaacaaacgcgggcgtggcgcgcgcaag

SEQ ID NO: 315991 - DNA, 75 bp, Artificial Sequence
  Synthetic
gccattgctctcagggacgatgagtatgatgagtggcaggacatcatccgcgactggcgcaaggaaatgactgtc

SEQ ID NO: 315992 - DNA, 75 bp, Artificial Sequence
  Synthetic
cagcagtttctggacttgaaagaacgcgcactgtcgggcgcctcagaccctgattcccaaaggtacaacgcctgg

SEQ ID NO: 315993 - DNA, 75 bp, Artificial Sequence
  Synthetic
ctcgagctacgcgcaaagaggttgagcgctggggcctaccaacatgcggtcgtggacatcatcggtaaatcaggt

SEQ ID NO: 315994 - DNA, 75 bp, Artificial Sequence
  Synthetic
cacaggcgtgaggtgattcgcactcaggtgatgcgtgcgccacgcgaaccaagggatgacacctatgacagtgag

SEQ ID NO: 315995 - DNA, 75 bp, Artificial Sequence
  Synthetic
gggcgtgggtatgtggtgcccatgaccgcccaagacaagcacacagggtgggcggtccacattgggaatgggcgc

SEQ ID NO: 315996 - DNA, 75 bp, Artificial Sequence
  Synthetic
ttggtcacttgcacacacgtggccaacatgtgtgatcgtgtggccgaggtggagttcaagattgcagagacagat

SEQ ID NO: 315997 - DNA, 75 bp, Artificial Sequence
  Synthetic
cgtgacacctgcatcatcactgcccctcttggtcatttgcctagtgttgcacttggtgatgggccaccagcattt

SEQ ID NO: 315998 - DNA, 75 bp, Artificial Sequence
  Synthetic
tacacgaccaactttcaccccatccgggtgctggatgagggcagctgggacaccaccaccacccgagtaacaggg

SEQ ID NO: 315999 - DNA, 75 bp, Artificial Sequence
  Synthetic
tggcgtgtgatcatcaataatggcacaacaacagccccaggagactgcggtcaaccctacttaaatgcgcggcgg

SEQ ID NO: 316000 - DNA, 75 bp, Artificial Sequence
  Synthetic
caattggttggagtgcacgccgcaaccagtacatgtggggtgaagaagctcgtgtcaagggtgcaaaccaagagg

SEQ ID NO: 316001 - DNA, 75 bp, Artificial Sequence
  Synthetic
gctgcaaagaccacctttccctggaagggcctgccagtaacaaccatgtctgacgctggcgggctgcccactgga

SEQ ID NO: 316002 - DNA, 75 bp, Artificial Sequence
  Synthetic
acccggtatcaccgatccactgcatggccaaaactgctcccagaagaaacccacgcgcccgcaccttatggtgtg

SEQ ID NO: 316003 - DNA, 75 bp, Artificial Sequence
  Synthetic
aatgacccaaggtaccccttttcacaacatcaaatgattgccaacaacctgcaaccttacaccaacacgccggtg

SEQ ID NO: 316004 - DNA, 75 bp, Artificial Sequence
  Synthetic
gttttggatcaaaccctgttgcagcgtgcagtcaagcacactaagggctaccttgaccaaattattggaacccat

SEQ ID NO: 316005 - DNA, 75 bp, Artificial Sequence
  Synthetic
agatcaccaaacctgacttacgccgctgcagtcgagtcaatggcccacgacacggcgtgtggaccaaatttgccc

SEQ ID NO: 316006 - DNA, 75 bp, Artificial Sequence
  Synthetic
ggccggaaaaaggactacatgacagaccaaggggagccaatcgggcctttgaaacagatgttggaggaagcttgg

SEQ ID NO: 316007 - DNA, 75 bp, Artificial Sequence
  Synthetic
gacatggcacaccgcggcattccacgcaggcatgaatacaaacttgcactgaaggacgagcttcgccccatagaa

SEQ ID NO: 316008 - DNA, 75 bp, Artificial Sequence
  Synthetic
aagaacgatcaaggcaaaagacgcctgctgtggggttgtgacgctggtgtgtcactgatagccaacgctgtcttc

SEQ ID NO: 316009 - DNA, 75 bp, Artificial Sequence
  Synthetic
aaacctgtcgccgagcgcctcgtggacactgtgcctatgcatcctgtggctgtcggtatatgcatggatagcccc

SEQ ID NO: 316010 - DNA, 75 bp, Artificial Sequence
  Synthetic
cagatagagcaaatgaaccaagccttaaccggtagggtgctttactgcctggattacagcaagtgggactccacg

SEQ ID NO: 316011 - DNA, 75 bp, Artificial Sequence
  Synthetic
caaaacccagctgtcacgtgtgccagtgttgacatcttggcctcttatgctgaggatacaccactcacctcagca

SEQ ID NO: 316012 - DNA, 75 bp, Artificial Sequence
  Synthetic
gccatagccacactgtgttcaccagccatcggtcggctggatgacattggcttgaccgtcacaacgggactccca

SEQ ID NO: 316013 - DNA, 75 bp, Artificial Sequence
  Synthetic
tctggcatgccgttcaccagtgtcataaactctgttaaccacatgatatactttgccatggctgtgctcgaggcc

SEQ ID NO: 316014 - DNA, 75 bp, Artificial Sequence
  Synthetic
tatgaggagttcaaagtgccctacatggggaacatttttgacaatgagaccgtctacacctatggtgatgattgc

SEQ ID NO: 316015 - DNA, 75 bp, Artificial Sequence
  Synthetic
gtgtacggcttgacaccagccacagcctcaatcatgcccgtggtggtcaaaaacctgaccagttacgggttggtt

SEQ ID NO: 316016 - DNA, 75 bp, Artificial Sequence
  Synthetic
ccaactgctgcagacaagtcccaaaacattgaacccactgacactcctgtgttcctcaaacgcaccttttcccaa

SEQ ID NO: 316017 - DNA, 75 bp, Artificial Sequence
  Synthetic
acaccttttggtttgcgggccctgcttgacgaaacaagcctggcgcggcaatgttactgggtcaaagccaatcgt

SEQ ID NO: 316018 - DNA, 75 bp, Artificial Sequence
  Synthetic
accacagacctctttgagccagcggctgttgatgtggaaatcaggaagaaccagttggaggtcatgctcgcatat

SEQ ID NO: 316019 - DNA, 75 bp, Artificial Sequence
  Synthetic
gccagccagcacccaagggcagtgtttgacaaacttgcaaatatggttgaggtaactgcacaagctgagggttac

SEQ ID NO: 316020 - DNA, 75 bp, Artificial Sequence
  Synthetic
caagtggtgaatgttgattgggccaacgcagtggcaacgtacaatgcgtggtacggtggcactgacggtggccgc

SEQ ID NO: 316021 - DNA, 75 bp, Artificial Sequence
  Synthetic
gctcccaccaatgaagatgaagagccagaagtgttcgtgatggaggcgcccgccccaacccgtccggttgcgagc

SEQ ID NO: 316022 - DNA, 75 bp, Artificial Sequence
  Synthetic
aacccagagggtactcagaccagtaatgagtccagaccagttcagccagctgggcccatgcccgtggccacggcc

SEQ ID NO: 316023 - DNA, 75 bp, Artificial Sequence
  Synthetic
caggccttggaaatggctgttgccacagggcaaatcaatgacactatccccagtgtggtcagggaaacttttagc

SEQ ID NO: 316024 - DNA, 75 bp, Artificial Sequence
  Synthetic
acttataccaacgtcacctggaccacacgccagcccacggggactctgcttgcccgaatgtccctcgggccaagt

SEQ ID NO: 316025 - DNA, 75 bp, Artificial Sequence
  Synthetic
ctgaacccttacacgcttcacttgtccgccatgtgggctggctggggtgggtcatttgaaatcaaagtggtaata

SEQ ID NO: 316026 - DNA, 75 bp, Artificial Sequence
  Synthetic
tcagggtctggcatgtatgcaggcaaattgctgtgcgcactcataccgcctggggttgaccccagcggtgttgac

SEQ ID NO: 316027 - DNA, 75 bp, Artificial Sequence
  Synthetic
caacccggagccttcccacacgcgcttgtggatgcgcgcatcactgaaggtgttaccttcaccttgggggatgtt

SEQ ID NO: 316028 - DNA, 75 bp, Artificial Sequence
  Synthetic
agggcggtggattaccacgaaacaggtactggtgggaacgtggcatgcctggcactttatgtgtaccaaccactc

SEQ ID NO: 316029 - DNA, 75 bp, Artificial Sequence
  Synthetic
atcaacccttttgaaaccgccatctcggctgccatggtgacaattgaaacccgccctggcccagactttggattc

SEQ ID NO: 316030 - DNA, 75 bp, Artificial Sequence
  Synthetic
accctgctcaagcccccaaaccaaaccatggaggtgggatttgatcccaggtcgctcctgccccgtacggcaaga

SEQ ID NO: 316031 - DNA, 75 bp, Artificial Sequence
  Synthetic
acgcttcgggggaacaggtttggcagaccaatcacagctgtggtcatagtgggtttggcacaacaaatcaacagg

SEQ ID NO: 316032 - DNA, 75 bp, Artificial Sequence
  Synthetic
catttttcagctgatggcaccacacttggctggtccacggccccagttgccccatgtgtggcacgtgtcaatgga

SEQ ID NO: 316033 - DNA, 75 bp, Artificial Sequence
  Synthetic
aagtacaccggcaccaacggcatggcagtgtttcaacttcaacccttgagcaatgggcccctttaccctaacatc

SEQ ID NO: 316034 - DNA, 75 bp, Artificial Sequence
  Synthetic
gtcaatcactacccagatgtggccgcatcaacaatactcagtgacaggaccaccattgctgacaccatgacgtgt

SEQ ID NO: 316035 - DNA, 75 bp, Artificial Sequence
  Synthetic
ggtggggggcctatggtggtttttgatgatcaaggtgatgtgaccgagactgtggcttaccaaatgagattcata

SEQ ID NO: 316036 - DNA, 75 bp, Artificial Sequence
  Synthetic
gcctcacatgctacttcccaaaatcccacacttgttgacaaaatcaatgcaacaacaatggcactgtgcagcttt

SEQ ID NO: 316037 - DNA, 75 bp, Artificial Sequence
  Synthetic
ggcaattcccgaggagactttggcacaggccaacttaatgtgggtgttgagttgacctacacctgtggcaccaca

SEQ ID NO: 316038 - DNA, 75 bp, Artificial Sequence
  Synthetic
caggccaacttaatgtgggtgttgagttgacctacacctgtggcaccacagcgatcaatgaaaaggtcaccacgt

SEQ ID NO: 316039 - DNA, 75 bp, Artificial Sequence
  Synthetic
tcatggatcgccaatacacatttggtgcacaggggcccaataacatcatgctctgggtggaaactgtactcggca

SEQ ID NO: 316040 - DNA, 75 bp, Artificial Sequence
  Synthetic
cgcacacgggcaacaacactgtgtacagttcgcaacccgacaccgtggccgccgcattacagggccaaccctaca

SEQ ID NO: 316041 - DNA, 75 bp, Artificial Sequence
  Synthetic
acataccagatgggtacatggctgtgtggaatgtcaatgcagacagtgctgactttcagataggcctaaggcgcg

SEQ ID NO: 316042 - DNA, 75 bp, Artificial Sequence
  Synthetic
gactttcagataggcctaaggcgcgatggcttcttcgtcaccagtggggccattggtacgcgcatggtcatttca

SEQ ID NO: 316043 - DNA, 75 bp, Artificial Sequence
  Synthetic
gaagacaccactttcacctacgctggcattttcaccctcaccacccccctcattggaccaagtgggatgacagga

SEQ ID NO: 316044 - DNA, 75 bp, Artificial Sequence
  Synthetic
aggtcccttcacagctcacgatgagttgggttgcaggcgcaatgcagggtgctggcctgctaggtgatcttgcag

SEQ ID NO: 316045 - DNA, 75 bp, Artificial Sequence
  Synthetic
gcacaattggacaaatagtgttatacaacaagcagttgaatattcagaaatcttttaatcaggcccagatggagt

SEQ ID NO: 316046 - DNA, 75 bp, Artificial Sequence
  Synthetic
tggctaaagaacaattgaagcaaaatcaacaaatggccaaccagttttatgaatttaattcaaatttacctgcca

SEQ ID NO: 316047 - DNA, 75 bp, Artificial Sequence
  Synthetic
atcagtacaacagtgctgtgagtgccggctttgactcggtctctgcacgtcaattggctgggtcacgtgaagtgc

SEQ ID NO: 316048 - DNA, 75 bp, Artificial Sequence
  Synthetic
gttaccttggtgggcaacaaacaccactgcttcaccaaggacagatacaacaaatgatgttttcaccaagacacc

SEQ ID NO: 316049 - DNA, 75 bp, Artificial Sequence
  Synthetic
tgatgcaagcacaacacgtggtcggcaccttttcccgcgggatacctggtgtcactcccagcaaggggttgccaa

SEQ ID NO: 316050 - DNA, 75 bp, Artificial Sequence
  Synthetic
ggccacagggcattacacctagaccacagggtgttacagccagtgtgcccgtggccggcgctaccaccactcaca

SEQ ID NO: 316051 - DNA, 75 bp, Artificial Sequence
  Synthetic
gcagagtgtgattttctttccctggttacgcgtaccggaccttacacagtgtggcggcctgtggggcgtgcttgg

SEQ ID NO: 316052 - DNA, 75 bp, Artificial Sequence
  Synthetic
cactttttcccgtggaacgcctggtgtgacccctagcaaggggttgcccaaaccgcagggcatcactcccaggcc

SEQ ID NO: 316053 - DNA, 75 bp, Artificial Sequence
  Synthetic
gtgacccctagcaaggggttgcccaaaccgcagggcatcactcccaggccacagagtgtcacagccactgtgccg

SEQ ID NO: 316054 - DNA, 75 bp, Artificial Sequence
  Synthetic
gtggctggagccaccaccactcacagcaaagtgtgattttctttccctggttacgcgtaccgaaccttacacagt

SEQ ID NO: 316055 - DNA, 75 bp, Artificial Sequence
  Synthetic
tgattttctttccctggttacgcgtaccgaaccttacacagtgtggcggctgtgggggaaaaaaaaaaaaaaaaa

SEQ ID NO: 316056 - DNA, 75 bp, Artificial Sequence
  Synthetic
gtgattggttggtatggcttctaagccattctacccaattgagttcaaccgtaaggttgaaacaacagtcctctt

SEQ ID NO: 316057 - DNA, 75 bp, Artificial Sequence
  Synthetic
ccattctacccaattgagttcaaccgtaaggttgaaacaacagtcctcttctctgctcacctcagggtgagcggg

SEQ ID NO: 316058 - DNA, 75 bp, Artificial Sequence
  Synthetic
agagaggaaatttttgaaaccaaacaggacatgtacgcccatgtttgccaagtggtcgccggggtgcggcgcgag

SEQ ID NO: 316059 - DNA, 75 bp, Artificial Sequence
  Synthetic
ataatgcgtcgcaccccggtggtcaaccccgctttcagtgcggaggggctcctagatgcctttgcatccaaaccc

SEQ ID NO: 316060 - DNA, 75 bp, Artificial Sequence
  Synthetic
ccagtggacattaaccctgacaccacatttcgtgagttgtttggaatagatccacatgaacaattcccattgtcc

SEQ ID NO: 316061 - DNA, 75 bp, Artificial Sequence
  Synthetic
catttcgtgagttgtttggaatagatccacatgaacaattcccattgtccatcactgatttggccaagttacagg

SEQ ID NO: 316062 - DNA, 75 bp, Artificial Sequence
  Synthetic
atcactgatttggccaagttacagggtgagcttgtggatgcagcgcacaacccaggtcacatcctgcgtcgtcac

SEQ ID NO: 316063 - DNA, 75 bp, Artificial Sequence
  Synthetic
gtgagcttgtggatgcagcgcacaacccaggtcacatcctgcgtcgtcactactccaccgattcgctcaccaaac

SEQ ID NO: 316064 - DNA, 75 bp, Artificial Sequence
  Synthetic
taataaacaaaatcaccaagtacgtccccgttcaagctactttaactgagatgcaagcacgaagggcgcatgaga

SEQ ID NO: 316065 - DNA, 75 bp, Artificial Sequence
  Synthetic
gggaacgagcggacctatttaaggaactgccgttagtcgatcctgaagtgacccagcaacagaagtcctactttt

SEQ ID NO: 316066 - DNA, 75 bp, Artificial Sequence
  Synthetic
acgccatgtggcgacaagtggtaaagaagggcaaggagtttttcatacccctggtaaagtgtacatcatggagga

SEQ ID NO: 316067 - DNA, 75 bp, Artificial Sequence
  Synthetic
aaaagttctcagaaccagctgagattgtgcgccaactccttgtgcacttttgtgaaggcatgcgcacacaattta

SEQ ID NO: 316068 - DNA, 75 bp, Artificial Sequence
  Synthetic
tgtgcgccaactccttgtgcacttttgtgaaggcatgcgcacacaatttaacacaaatgccaactacatcaattt

SEQ ID NO: 316069 - DNA, 75 bp, Artificial Sequence
  Synthetic
gtccctcctggcaaaattgcgacccacggttttgacaatgattttccaacagcataaaaacacttaccgtggttg

SEQ ID NO: 316070 - DNA, 75 bp, Artificial Sequence
  Synthetic
agcataaaaacacttaccgtggttggctcgccaccatcacagcccttgttgaggtctattcaaatttgttccagg

SEQ ID NO: 316071 - DNA, 75 bp, Artificial Sequence
  Synthetic
gctcgccaccatcacagcccttgttgaggtctattcaaatttgttccaggacatgcgtgaaaccgcagtatctgc

SEQ ID NO: 316072 - DNA, 75 bp, Artificial Sequence
  Synthetic
ggtgtccgcaatcacgctcctttttgagtcattgaagcagtttgtggaaggagtcattgatcttgtcagaggcac

SEQ ID NO: 316073 - DNA, 75 bp, Artificial Sequence
  Synthetic
tttccaggcgcagggccccacgaactgtgggtgggccgccattgccgctggtgttattctaatcctcctcaagat

SEQ ID NO: 316074 - DNA, 75 bp, Artificial Sequence
  Synthetic
tgtgggtgggccgccattgccgctggtgttattctaatcctcctcaagatctctggctgccctagtgttatggga

SEQ ID NO: 316075 - DNA, 75 bp, Artificial Sequence
  Synthetic
tattggcagcgcttgttaaaagtgtgtgccggtgtcacgaccatagctgcagctgcgagagcgttcacctgggtt

SEQ ID NO: 316076 - DNA, 75 bp, Artificial Sequence
  Synthetic
gaaaggctcgcctcaagaaatacatggcccgcaccgctgccctgttggaacttgctgcatcgcgagatgtcactg

SEQ ID NO: 316077 - DNA, 75 bp, Artificial Sequence
  Synthetic
cttgctgcatcgcgagatgtcactggcacggaagaactaaaacggttgctagaatgttttacccagctcattgag

SEQ ID NO: 316078 - DNA, 75 bp, Artificial Sequence
  Synthetic
gagggcacggagctgattcaggagtttgggacatcaccgatggcagggcttgcacgatcttatgtcagtgagctt

SEQ ID NO: 316079 - DNA, 75 bp, Artificial Sequence
  Synthetic
gaaactgccgccaatggcatcagaagtacaatcctcttagacaccccaaggaaggtcccagtggcaataatctta

SEQ ID NO: 316080 - DNA, 75 bp, Artificial Sequence
  Synthetic
actggtccaccgggtataggaaaaacacaccttgcacagcacttagccgctggttttggcaaaacatcaaacttc

SEQ ID NO: 316081 - DNA, 75 bp, Artificial Sequence
  Synthetic
cacaccttgcacagcacttagccgctggttttggcaaaacatcaaacttctctgtcacgcttgatcaccatgact

SEQ ID NO: 316082 - DNA, 75 bp, Artificial Sequence
  Synthetic
cctacacaggcaatgacgtggccatctgggacgagttcgatgtggacgcccagggtaagtttgtggagacaatga

SEQ ID NO: 316083 - DNA, 75 bp, Artificial Sequence
  Synthetic
cagggtaagtttgtggagacaatgattggtgtggtaaacaccgcaccataccccttaaattgtgacagagtggaa

SEQ ID NO: 316084 - DNA, 75 bp, Artificial Sequence
  Synthetic
ttggtgtggtaaacaccgcaccataccccttaaattgtgacagagtggaaaataaaggcaaagtcttcacatcca

SEQ ID NO: 316085 - DNA, 75 bp, Artificial Sequence
  Synthetic
gcgtcacgacggtcgatgtgtcatcccctgttattgatgattggaaaaagaaaaaccctggtaagaaacctccat

SEQ ID NO: 316086 - DNA, 75 bp, Artificial Sequence
  Synthetic
tggacttgtacaagaaagatttctcacatttgcgcctttccgtccggccataccttggttacaatcccgaggggg

SEQ ID NO: 316087 - DNA, 75 bp, Artificial Sequence
  Synthetic
acactctggagggcgttcgtgtgaaacctatcctaaccagtgtggacggcctgtctcggctcatggaaactaagt

SEQ ID NO: 316088 - DNA, 75 bp, Artificial Sequence
  Synthetic
acctatcctaaccagtgtggacggcctgtctcggctcatggaaactaagttcaaagaacagggcaatgagttgcg

SEQ ID NO: 316089 - DNA, 75 bp, Artificial Sequence
  Synthetic
caacctttggatcacgtgcccccgtgacctagtgacacctgcagcatctgggctgaaatcatacatggctgctaa

SEQ ID NO: 316090 - DNA, 75 bp, Artificial Sequence
  Synthetic
gacctagtgacacctgcagcatctgggctgaaatcatacatggctgctaacagggcgctggcacaagttttcgca

SEQ ID NO: 316091 - DNA, 75 bp, Artificial Sequence
  Synthetic
gaaccttcttccaacgaaattgcggaaacgtgcacgtctagaattttcgtgtctgccaataaccctccccccacc

SEQ ID NO: 316092 - DNA, 75 bp, Artificial Sequence
  Synthetic
tttgtgggcagacacgtgaaaataacagccatcaatccctgggacgcatcccttgctaactcaatgttgtcaatg

SEQ ID NO: 316093 - DNA, 75 bp, Artificial Sequence
  Synthetic
tttgagaccaacactcacataccagcagttacccaaagggagatcatgtaccgtgtttggacgcccctaatacac

SEQ ID NO: 316094 - DNA, 75 bp, Artificial Sequence
  Synthetic
cagttacccaaagggagatcatgtaccgtgtttggacgcccctaatacacatgcaaacacgggaaccaaataccc

SEQ ID NO: 316095 - DNA, 75 bp, Artificial Sequence
  Synthetic
agatgctcccctacatcaatcgggtggtgccagtcacctcttcatttgactttgttcgtgggttgcgccaccacc

SEQ ID NO: 316096 - DNA, 75 bp, Artificial Sequence
  Synthetic
ggtgccagtcacctcttcatttgactttgttcgtgggttgcgccaccaccttggattgtgttctatcaaaggcat

SEQ ID NO: 316097 - DNA, 75 bp, Artificial Sequence
  Synthetic
tttgttcgtgggttgcgccaccaccttggattgtgttctatcaaaggcatgtggaaagcgtaccagggatggcac

SEQ ID NO: 316098 - DNA, 75 bp, Artificial Sequence
  Synthetic
agctccgcgacaatcctggagttcctgtccaagcacatggaagatgttacattcccctccaatccggaatgtact

SEQ ID NO: 316099 - DNA, 75 bp, Artificial Sequence
  Synthetic
tgtccaagcacatggaagatgttacattcccctccaatccggaatgtactgtgtttcgagctgcggacggagatg

SEQ ID NO: 316100 - DNA, 75 bp, Artificial Sequence
  Synthetic
tcatcttttacacatttgggtcctatgcctgctttgtctccccagcacgggttccatttgtcggggacccaccaa

SEQ ID NO: 316101 - DNA, 75 bp, Artificial Sequence
  Synthetic
aaaccgtccactccaacatcacacgcaacatgacgtggattgaaaccttgcgactgcttgttgaaacaatcacgg

SEQ ID NO: 316102 - DNA, 75 bp, Artificial Sequence
  Synthetic
agagtttggcccactttggcccgctgctgttgatggttcataacgtggcatacttgacaactaggtcacaacgtg

SEQ ID NO: 316103 - DNA, 75 bp, Artificial Sequence
  Synthetic
acgaggaggccaaaggcaaaactaaacatggtaggggagccagacacgcacgacgtggtggagtgagcttgtcgg

SEQ ID NO: 316104 - DNA, 75 bp, Artificial Sequence
  Synthetic
cgacgtggtggagtgagcttgtcggatgacgagtatgatgagtggcgtgaccttgtgcgtgactggagacaggac

SEQ ID NO: 316105 - DNA, 75 bp, Artificial Sequence
  Synthetic
atgacgagtatgatgagtggcgtgaccttgtgcgtgactggagacaggacatgaccgttggggagtttgtcgagt

SEQ ID NO: 316106 - DNA, 75 bp, Artificial Sequence
  Synthetic
tgcgcgagcgctacgcccttgggatggactcagaggacgtgcaacggtaccgggcatggctgcaacttcgtgcca

SEQ ID NO: 316107 - DNA, 75 bp, Artificial Sequence
  Synthetic
tgcggctaggcgcaggtgcctaccagcatgcaaccatcattgggcgcggacgtgttgaggataccatcatccgca

SEQ ID NO: 316108 - DNA, 75 bp, Artificial Sequence
  Synthetic
cgtgttgaggataccatcatccgcacacaacccatgcgtgctccacgtgcccctcgttccaccggatatgatgag

SEQ ID NO: 316109 - DNA, 75 bp, Artificial Sequence
  Synthetic
gaagccccaacaccgattgtcacctttaccagcaacggggaccatgtgggttacggttgccacattggcaacggt

SEQ ID NO: 316110 - DNA, 75 bp, Artificial Sequence
  Synthetic
gtggtggtgacagtaactcatgtggctgccgctgcggacgccgtggagggtctggaattctcggttaggaaaacc

SEQ ID NO: 316111 - DNA, 75 bp, Artificial Sequence
  Synthetic
gagggtgaaaccacatgggtgaacaccccccttggccacctgccacactaccaactgggtgatggggcaccagtt

SEQ ID NO: 316112 - DNA, 75 bp, Artificial Sequence
  Synthetic
tactattcaactcgattgcaccccgtcaccacaattgcagaaggtacatatgaaactcctaacatcacagttcat

SEQ ID NO: 316113 - DNA, 75 bp, Artificial Sequence
  Synthetic
tgaaactcctaacatcacagttcatgggttccatctacgcatcatcaatggttaccccacaaaacgtggagactg

SEQ ID NO: 316114 - DNA, 75 bp, Artificial Sequence
  Synthetic
cggcacgccgtacttcgactcatgtcgaaggctggtgggcctacatgccgccacgtcaaccaatggggagaccaa

SEQ ID NO: 316115 - DNA, 75 bp, Artificial Sequence
  Synthetic
cgaaggctggtgggcctacatgccgccacgtcaaccaatggggagaccaagttggcacagaaagtaagtcgagtt

SEQ ID NO: 316116 - DNA, 75 bp, Artificial Sequence
  Synthetic
tcaaaggtggaaaatgcttttgcctggaagggcttgcccgtcttacgaggccctgattgtggtggtatgcccaca

SEQ ID NO: 316117 - DNA, 75 bp, Artificial Sequence
  Synthetic
ccctgattgtggtggtatgcccacaggaacaaggtatcatcggtccccagcctggccagaacagctctcaagtga

SEQ ID NO: 316118 - DNA, 75 bp, Artificial Sequence
  Synthetic
aacccatgccccagccccatttggtgccggtgacccccgttacaatttctcccaagtagaaatgttggtcacagg

SEQ ID NO: 316119 - DNA, 75 bp, Artificial Sequence
  Synthetic
gttgaaacctttttcagaacccacccctgggataccccctgccctcctgcagcgggcagccacacacacccgtac

SEQ ID NO: 316120 - DNA, 75 bp, Artificial Sequence
  Synthetic
agcgggcagccacacacacccgtacatacctggagtcaatagtcggcacacaccgatcccctaatttaacttaca

SEQ ID NO: 316121 - DNA, 75 bp, Artificial Sequence
  Synthetic
acgaagcatgtgccttattggatcgcagcacatcttgtggtccgttcattgcaggccaaaagggggattactggg

SEQ ID NO: 316122 - DNA, 75 bp, Artificial Sequence
  Synthetic
cagcacatcttgtggtccgttcattgcaggccaaaagggggattactgggatgaagatcgccagtgttacacagg

SEQ ID NO: 316123 - DNA, 75 bp, Artificial Sequence
  Synthetic
agtgttggctgagcacctcggtaaggcctgggatgccgccaaccgaggcattgctccacaaaatgcctacaaact

SEQ ID NO: 316124 - DNA, 75 bp, Artificial Sequence
  Synthetic
ggcccttaaagatgagcttcgaccaattgaaaagaaccaacaaggcaagcgccgactgttgtggggttgtgacgc

SEQ ID NO: 316125 - DNA, 75 bp, Artificial Sequence
  Synthetic
gccgactgttgtggggttgtgacgctggggcaactttggttgccacagcagctttcaaagggattgctacgcgcc

SEQ ID NO: 316126 - DNA, 75 bp, Artificial Sequence
  Synthetic
tgcaggcagttgcacccatgacacctgttggcgttggcattaacatggacagttaccaggtagaggtgcttaatg

SEQ ID NO: 316127 - DNA, 75 bp, Artificial Sequence
  Synthetic
tgttggcgttggcattaacatggacagttaccaggtagaggtgcttaatgaatcccttaagggcggtgtcgtgta

SEQ ID NO: 316128 - DNA, 75 bp, Artificial Sequence
  Synthetic
ctgcctagactacagcaagtgggattccactcaacacccggccgttacagctgcgtccttggcaatccttgagcg

SEQ ID NO: 316129 - DNA, 75 bp, Artificial Sequence
  Synthetic
ctgcgtccttggcaatccttgagcggctgtctgaagcaacaccaataacaacatcggccgtagagttgctctcat

SEQ ID NO: 316130 - DNA, 75 bp, Artificial Sequence
  Synthetic
gctgtctgaagcaacaccaataacaacatcggccgtagagttgctctcatcaccagcacgtggccacttgagtga

SEQ ID NO: 316131 - DNA, 75 bp, Artificial Sequence
  Synthetic
catcatctttgtgacaaagtctggactcccctcgggcatgccattcaccagtgttgtcaactctcttaaccatat

SEQ ID NO: 316132 - DNA, 75 bp, Artificial Sequence
  Synthetic
gtgttgtcaactctcttaaccatatgacatactttgctgctgcagtgttgaaagcctatgaacaacatggggcgc

SEQ ID NO: 316133 - DNA, 75 bp, Artificial Sequence
  Synthetic
gacatactttgctgctgcagtgttgaaagcctatgaacaacatggggcgccttacactggtaatgtgtttcaggt

SEQ ID NO: 316134 - DNA, 75 bp, Artificial Sequence
  Synthetic
ggaaactgttcacacttatggtgatgattgcatttactccttgtgcccggcaaccgcttccatctttgaaactgt

SEQ ID NO: 316135 - DNA, 75 bp, Artificial Sequence
  Synthetic
tttggccaacctcagtgcctttggtctacggcccaccgctgccgataaaacagacaaaatagcccccacccacac

SEQ ID NO: 316136 - DNA, 75 bp, Artificial Sequence
  Synthetic
accagtctttttaaagcgaactcttacctgtacaccaagaggtatccgtgggctactcgacatcacgtcaatcag

SEQ ID NO: 316137 - DNA, 75 bp, Artificial Sequence
  Synthetic
gcggcaattcttctggattaaggctaaccgcaccacagacatatcatccccacccgcctacgacagggaagcccg

SEQ ID NO: 316138 - DNA, 75 bp, Artificial Sequence
  Synthetic
gagtgtgcagcttgaaaatgccctggcttatgcttcacaacatggccacgcaatctttgaggagattgccgaaat

SEQ ID NO: 316139 - DNA, 75 bp, Artificial Sequence
  Synthetic
tgccaagaggacggcacagtcagaagggttagtgctcaccaatgtgaactatgaccaggctctcgccacctacga

SEQ ID NO: 316140 - DNA, 75 bp, Artificial Sequence
  Synthetic
agcatggtttataggtggtacaggcaccggccaagatagccccagtgaagagactaccaaattagtgtttgaaat

SEQ ID NO: 316141 - DNA, 75 bp, Artificial Sequence
  Synthetic
agactaccaaattagtgtttgaaatggagggcctgggccagccacagtcccaaagggaccaacaggttatggaac

SEQ ID NO: 316142 - DNA, 75 bp, Artificial Sequence
  Synthetic
caaagggaccaacaggttatggaacaggttgttaccccccaggacaccattggaccaacgagtgcacttctattg

SEQ ID NO: 316143 - DNA, 75 bp, Artificial Sequence
  Synthetic
cccactcaagttgagacaccaaatgctagtgctcagcgtgtggaacttgcaatggccacaggggcagtgaccagc

SEQ ID NO: 316144 - DNA, 75 bp, Artificial Sequence
  Synthetic
aatgtgcccaactgcatccgggagtgttttgctgcggtcaccacaataccatggaccacccggcaagcagcaaac

SEQ ID NO: 316145 - DNA, 75 bp, Artificial Sequence
  Synthetic
acctttctcggtgccatacatctgggcccacgcattaacccctacactgcacacctgagtgcaatgtttgctggt

SEQ ID NO: 316146 - DNA, 75 bp, Artificial Sequence
  Synthetic
tggggggggggctttcaggtgcgggtcacaatctcaggttccgggctctttgctggtcgggccattactgctatc

SEQ ID NO: 316147 - DNA, 75 bp, Artificial Sequence
  Synthetic
ctgccaccaggtgtcaacccggctgctgtccagaacccgggtgtcttcccccatgcgttcattgacgctcgcaca

SEQ ID NO: 316148 - DNA, 75 bp, Artificial Sequence
  Synthetic
accgaccccatactgatcaatttgcccgacatccggcccattgattttcaccgtgtagatggggacgacgcgaca

SEQ ID NO: 316149 - DNA, 75 bp, Artificial Sequence
  Synthetic
ccgacatccggcccattgattttcaccgtgtagatggggacgacgcgacagcgtccgtggggttatgggtcgcgc

SEQ ID NO: 316150 - DNA, 75 bp, Artificial Sequence
  Synthetic
agcccttgatcaacccgtttcaaactggctccgtttccacatgttggctcagtttcgaaacacggcctggccctg

SEQ ID NO: 316151 - DNA, 75 bp, Artificial Sequence
  Synthetic
actttgacttttgtctcctcaaggcccccgagcaggaaatggacaatgggatatcacctgccaacctgttgccac

SEQ ID NO: 316152 - DNA, 75 bp, Artificial Sequence
  Synthetic
gccgcctcgggcgttcccggggcaaccgcctcggcggtcgtgtcgtggggctggttgtggtggctgcggccgagc

SEQ ID NO: 316153 - DNA, 75 bp, Artificial Sequence
  Synthetic
ccgcctcggcggtcgtgtcgtggggctggttgtggtggctgcggccgagcaagttaaccaccacttcggcgcaaa

SEQ ID NO: 316154 - DNA, 75 bp, Artificial Sequence
  Synthetic
ctccaccacacttggttggtcaacactgcctattgagccaattgcgggagcagtttcttggtacgatgataacaa

SEQ ID NO: 316155 - DNA, 75 bp, Artificial Sequence
  Synthetic
tgaacataccaaaatacgggggctcttgagcgcacaaggaaagggtatcatcttcccaaacattgtcaaccattg

SEQ ID NO: 316156 - DNA, 75 bp, Artificial Sequence
  Synthetic
gacagatgtgtcattgtccgccaagacctcggggcagaccaccatccccacagctgctgacaacctcaacaacag

SEQ ID NO: 316157 - DNA, 75 bp, Artificial Sequence
  Synthetic
ccctggagcagcaggcccggtggttatgtttgaaaacaatggagatgtcaatgagtccactgcaaaccatggcat

SEQ ID NO: 316158 - DNA, 75 bp, Artificial Sequence
  Synthetic
atgagtccactgcaaaccatggcatactgaccgctgcgtcgcatgacttcacatcactgtcccaaactttcgacg

SEQ ID NO: 316159 - DNA, 75 bp, Artificial Sequence
  Synthetic
cagcagggctatgggtttggatgccatggacccgaaacaaaccagacgggcgcacgaacacaaatgtctacatca

SEQ ID NO: 316160 - DNA, 75 bp, Artificial Sequence
  Synthetic
ctccaacttggattaatggcaaccctgcccgccccatacacgagaaatgtaccaacatggtcgggaccaatttcc

SEQ ID NO: 316161 - DNA, 75 bp, Artificial Sequence
  Synthetic
aattcggtggtactgggacaaacaacatcatgttatggcaggagcaacacttcacatcttttccaggtgctgcag

SEQ ID NO: 316162 - DNA, 75 bp, Artificial Sequence
  Synthetic
aggtgtactgttcacaactggagagcacagcagaaatgtttcaaaacaatgtggtcaacatccccgcaaaccaaa

SEQ ID NO: 316163 - DNA, 75 bp, Artificial Sequence
  Synthetic
tggcagtcttcaatgtggaaactgcaggtaacacatttcagattgggatcttgccaaatggctattcagtcacca

SEQ ID NO: 316164 - DNA, 75 bp, Artificial Sequence
  Synthetic
acgcggcaattggcacacaccaactccttgactacgagaccagttttagatttgttggacttttcccccaaagca

SEQ ID NO: 316165 - DNA, 75 bp, Artificial Sequence
  Synthetic
cttcacttcaggggcccaatgggaacgctggacgggccgtcaggttcttagaataatgtcttggtttactggagc

SEQ ID NO: 316166 - DNA, 75 bp, Artificial Sequence
  Synthetic
agccttagccgccggctctgtcgtggacatggccggcacaatatcttcaattgttgcacaacacagacaacttga

SEQ ID NO: 316167 - DNA, 75 bp, Artificial Sequence
  Synthetic
tttgatggcacaggcaaatcgcatacaacaggattgggtaaacagacaagaggcactcatcacacgaggacagga

SEQ ID NO: 316168 - DNA, 75 bp, Artificial Sequence
  Synthetic
tatctcccgcgaccttgctgtcaatggaacggcgcaacgcgtcgactcgctggtcaaggcggggttcacccctgt

SEQ ID NO: 316169 - DNA, 75 bp, Artificial Sequence
  Synthetic
tgatgctcgcagactggcgggcggcacggaaagcgtgcagtacggcctgctggacagacctatactgcaacgttc

SEQ ID NO: 316170 - DNA, 75 bp, Artificial Sequence
  Synthetic
agtgctgtcgggcatctcagagactcggcacttacaatctgtgcaaggtgccttgagtgcttttaaaaatggatc

SEQ ID NO: 316171 - DNA, 75 bp, Artificial Sequence
  Synthetic
cagctacgggagcccctcccgcccccgcgggcttcgtcaacccaaattatcaggcttcaccaccaaagttaacac

SEQ ID NO: 316172 - DNA, 75 bp, Artificial Sequence
  Synthetic
caggcttcaccaccaaagttaacactaggccccagacccccagtgactaatgtgtagtgatgattaggtttcctc

SEQ ID NO: 316173 - DNA, 75 bp, Artificial Sequence
  Synthetic
agataatcaaatttccatttatttagttttctttgcttttcttttcttttcccatggtaccacacgcgttcgggt

SEQ ID NO: 316174 - DNA, 75 bp, Artificial Sequence
  Synthetic
cttttcttttcccatggtaccacacgcgttcgggtggacaattgtggttaagcgaccacagccatgaccctctgg

SEQ ID NO: 316175 - DNA, 75 bp, Artificial Sequence
  Synthetic
gtgattggttagatggtttccaagccatacaggccaatatccctcgaccccactttcgagtgggtcgttttccgt

SEQ ID NO: 316176 - DNA, 75 bp, Artificial Sequence
  Synthetic
cgctgctacctcagggtagcacctcgggaaacatttgtagaggatttcaaagaattagaatattatttcaccacg

SEQ ID NO: 316177 - DNA, 75 bp, Artificial Sequence
  Synthetic
cgcttgtgcgcgtggttaaagcgtgtcactaggaccctccctaggagggagtttgtggaggagggtctccttgac

SEQ ID NO: 316178 - DNA, 75 bp, Artificial Sequence
  Synthetic
gcgtttaacagcaagccagtggttgaacctaatgaggacattctctttagagaactctttggggtggacttgcag

SEQ ID NO: 316179 - DNA, 75 bp, Artificial Sequence
  Synthetic
gaacagttcccaatgtcaattcacgacctcgccaaattacaaggtgaggcggtggatgccttgcgtaatcctgga

SEQ ID NO: 316180 - DNA, 75 bp, Artificial Sequence
  Synthetic
catcaattacgtaggaagtatacaacacaaaccctaaagaaactggttaccaaaatcacaagggtggtacctgtc

SEQ ID NO: 316181 - DNA, 75 bp, Artificial Sequence
  Synthetic
caggccaccctacaagacatgcatgagcggcgcgattttgaaagggaacgtgccgacttgtttaaagaactaccc

SEQ ID NO: 316182 - DNA, 75 bp, Artificial Sequence
  Synthetic
ctgttagatgaagagataacacaaaaacccaagacatatttttattcaatgtggcgtcaagttgtgaagaaaggt

SEQ ID NO: 316183 - DNA, 75 bp, Artificial Sequence
  Synthetic
aagacctacttcatgccactcgtaaagacaaatggatgggttagtaaaatcacaaaaatcactgaccccatcaaa

SEQ ID NO: 316184 - DNA, 75 bp, Artificial Sequence
  Synthetic
gatttcatcatagctttttgccaggcagtccaacaagagatggggacggatccacggtatttgcagctggcttgg

SEQ ID NO: 316185 - DNA, 75 bp, Artificial Sequence
  Synthetic
attcaaaagctaaagccaaccgtgctcaccatcatcctacaacaacacaaaaacaccgtgtcagggtggttggcg

SEQ ID NO: 316186 - DNA, 75 bp, Artificial Sequence
  Synthetic
acactaacagctctagtggaagtttactccaacctttttgatgatttgcgcaagtctgccgttaccatcatatcg

SEQ ID NO: 316187 - DNA, 75 bp, Artificial Sequence
  Synthetic
gcactaagtgctttcttcgatgtgtgtaaagacttcattgctagtgttgttgacttgattaaaaccacattcaca

SEQ ID NO: 316188 - DNA, 75 bp, Artificial Sequence
  Synthetic
cctcagggccccactgatcttggatggaccgcagttgcggctggagcagtcatgattctactaaaggcttctggt

SEQ ID NO: 316189 - DNA, 75 bp, Artificial Sequence
  Synthetic
tgccctggtgtgtcgggcatgtggggtaaaatactcaaggtgtgcgggggcattacaaccataaccgctgccata

SEQ ID NO: 316190 - DNA, 75 bp, Artificial Sequence
  Synthetic
cggggtatcaagtggctcagagaactgtatgaagaggctgaaagtaaaaggctcgccaagatgtacatggctagg

SEQ ID NO: 316191 - DNA, 75 bp, Artificial Sequence
  Synthetic
gcagcagccctaattgagttggcagcaagcagggaagtgactggggttaaggaactgaaggagctcctcagttgc

SEQ ID NO: 316192 - DNA, 75 bp, Artificial Sequence
  Synthetic
ttcaccgtcctcatagaggagggtgctgaacttctacaaaagtttggcacaagccccctttctggcctcatacgc

SEQ ID NO: 316193 - DNA, 75 bp, Artificial Sequence
  Synthetic
acatatgtgtcagaattggaaacccaagcaaacaacatcagatctaccatcatgctagacacacctcgtgaggtt

SEQ ID NO: 316194 - DNA, 75 bp, Artificial Sequence
  Synthetic
ccagtagtcatcatcttgactggaccaccaggtattggtaagacacggttggctcagtttataggggaaaaattt

SEQ ID NO: 316195 - DNA, 75 bp, Artificial Sequence
  Synthetic
ggtaaagtgttcaacttcagtgttgcagtagatcaccatgatggttacacaggcaacccagtgtgcatatgggat

SEQ ID NO: 316196 - DNA, 75 bp, Artificial Sequence
  Synthetic
gagtttgatgtggacgcaaaaggtagtttcgtggaaacaatgattggtattgccaatacagcaccgttcccactt

SEQ ID NO: 316197 - DNA, 75 bp, Artificial Sequence
  Synthetic
aattgtgaccgtgtggagaacaaaggtagggtgtttacttcaaattatgttatttgcacatcaaactaccccacg

SEQ ID NO: 316198 - DNA, 75 bp, Artificial Sequence
  Synthetic
tctgtcattccagagaacccacgtgccccagccttttaccgtcgagtcatcatcttggatgtttcatctccagaa

SEQ ID NO: 316199 - DNA, 75 bp, Artificial Sequence
  Synthetic
cttgatgagtggaagaagaagaaccctggaaagaagcccccatctgacttgtataaacaagacttttcacacctg

SEQ ID NO: 316200 - DNA, 75 bp, Artificial Sequence
  Synthetic
aagttgatgctccgcccctaccttgggtacaatcccgaaggggacacacttgacggcactagagtcaaacccacc

SEQ ID NO: 316201 - DNA, 75 bp, Artificial Sequence
  Synthetic
cagatatccatcccaagtttgatctcactcatgcaaaagaggtttaaggagcaatcaggggaaaaccagaaccta

SEQ ID NO: 316202 - DNA, 75 bp, Artificial Sequence
  Synthetic
tggatgcaagtccctaggggagctgttgatcaagcatctaatatgataaagacctttgtctatgctaaccgtggt

SEQ ID NO: 316203 - DNA, 75 bp, Artificial Sequence
  Synthetic
gtgtgtgacgttctcccaaaccctgcctcccgtgacatcacagagacatctgtatcaaaaatctttgtctcctca

SEQ ID NO: 316204 - DNA, 75 bp, Artificial Sequence
  Synthetic
acagccccaccaccagagttcttaggccgccatgtgatcatcactgggtttgaacttggggatgcatccatagca

SEQ ID NO: 316205 - DNA, 75 bp, Artificial Sequence
  Synthetic
aactctttgttatccatgttttccacaagcacacgtctcactgctggtgcacagcgagagtatatgtatagaatt

SEQ ID NO: 316206 - DNA, 75 bp, Artificial Sequence
  Synthetic
tggaatcccatcatccacatccaagagaggtccatcaacacacaaaatctgccatatgttaaccgcgtgatccca

SEQ ID NO: 316207 - DNA, 75 bp, Artificial Sequence
  Synthetic
gtcacatctcactgggatttcttacgtggtttaagacaccaccttggtttggtgtccatccctggaatgtggcgg

SEQ ID NO: 316208 - DNA, 75 bp, Artificial Sequence
  Synthetic
gctttccaggggtggcgatcgtcccaaggtatcattgactttgttgcaaatcacatgaatgaagtcacattcccc

SEQ ID NO: 316209 - DNA, 75 bp, Artificial Sequence
  Synthetic
agtaacccagaatgcactgtcttccgcactggggatggggacgttgtcttttacacgtatgggtcatacgcgtgc

SEQ ID NO: 316210 - DNA, 75 bp, Artificial Sequence
  Synthetic
cttgcgtcccctgcccgcgtgccctatgttggaaatccaccatccaccatccattcaaatgtcccgagatgcatg

SEQ ID NO: 316211 - DNA, 75 bp, Artificial Sequence
  Synthetic
acgtggggtgaaaccattgggtatctttgtgaggtggtggcagaatttgccctacattttggtccattaatcttg

SEQ ID NO: 316212 - DNA, 75 bp, Artificial Sequence
  Synthetic
gcagcaaccaacatagcttacctgtgctcaagaggcaatcgggatgaggaagccaaagggaagtcaaaacatggc

SEQ ID NO: 316213 - DNA, 75 bp, Artificial Sequence
  Synthetic
agaggagccaaacacgcacatcgtggcggaaccagcctgtcggacgatgagtatgatgagtggcgagatcttgtc

SEQ ID NO: 316214 - DNA, 75 bp, Artificial Sequence
  Synthetic
cgcgactggcgtaaagacatgacagtcaatgacttcctcatgctacgggagcgcagcgctctcggtacggatgac

SEQ ID NO: 316215 - DNA, 75 bp, Artificial Sequence
  Synthetic
gaagacgtggcacgctatagagcatggctagaaatccgtgccatgcggttagcaggtggtgcttacacccacgcc

SEQ ID NO: 316216 - DNA, 75 bp, Artificial Sequence
  Synthetic
acagtaatcggcaaaggtggtgtgcgagaagagatcattagaacagcccctcgccgtgcccccatgagtgcacgg

SEQ ID NO: 316217 - DNA, 75 bp, Artificial Sequence
  Synthetic
cgcgccaattatgaagaggaagcccccactgccattgttgagttcacccatgaaggcgaccacatagggtatgga

SEQ ID NO: 316218 - DNA, 75 bp, Artificial Sequence
  Synthetic
gtccatcttggcaatggtagagtggtcaccgtcacccatgtagcatcatcatcagatagtgttgagggagcacct

SEQ ID NO: 316219 - DNA, 75 bp, Artificial Sequence
  Synthetic
tttaaggtacaaagaactgttggtgaaaccacttgggttgaaacacagcttcccaactacccccatttgcaaatt

SEQ ID NO: 316220 - DNA, 75 bp, Artificial Sequence
  Synthetic
ggctcaggaaggcccgtgtattacacgatgcgattgcatccagtggtgactatcacggaaggcacttttgagacc

SEQ ID NO: 316221 - DNA, 75 bp, Artificial Sequence
  Synthetic
ccaaatatcactgttcatggtttccatgttcgcatcacaaatgggtaccaaaccaggaaaggtgattgtggattg

SEQ ID NO: 316222 - DNA, 75 bp, Artificial Sequence
  Synthetic
ccttacttgaatgccaacaggcaggtggtgggattgcatgctggtaccgatgttcaaggggaaaccaaattggca

SEQ ID NO: 316223 - DNA, 75 bp, Artificial Sequence
  Synthetic
cagaaggtagttaaagagctgcctgtggagagtgaatttcactggaagggcctcccagttatcaaatctgacctg

SEQ ID NO: 316224 - DNA, 75 bp, Artificial Sequence
  Synthetic
gatgttggggggatgccaaccggcacacggtaccatcgatcacctgcatggccagagcaactccccgaggaaact

SEQ ID NO: 316225 - DNA, 75 bp, Artificial Sequence
  Synthetic
tatgcccccgccccctttggtgccggtgacaaacgctatcacttcacccagactgagatgttagtgaacgccctt

SEQ ID NO: 316226 - DNA, 75 bp, Artificial Sequence
  Synthetic
aagccctacactgagactacacctggcatccccccttccttgctatcacgggctacaactcacgtgcgtgcttac

SEQ ID NO: 316227 - DNA, 75 bp, Artificial Sequence
  Synthetic
cttgaaacaattattggtacacaccgttctcctgtgctcactttcacccaggcagttgagttgcttgaaaaatcc

SEQ ID NO: 316228 - DNA, 75 bp, Artificial Sequence
  Synthetic
acctcatgtggcccgttcatacaaggactaaaaggagactattgggatgatgaaacacaacaatacactggggcc

SEQ ID NO: 316229 - DNA, 75 bp, Artificial Sequence
  Synthetic
ctacgtgaacatttagacagagcatgggatcatgctgtcaggggcattgcaccagggaactcctacaaattggca

SEQ ID NO: 316230 - DNA, 75 bp, Artificial Sequence
  Synthetic
cttaaggatgaactccgtcctgaggaaaagaataaagaagggaagaggcggctgctgtggggctgtgacgccgca

SEQ ID NO: 316231 - DNA, 75 bp, Artificial Sequence
  Synthetic
acaactctaattgcagtggcggcgtttaagccagtggccgcacgcttacaagtagtgacaccaatgactccaatt

SEQ ID NO: 316232 - DNA, 75 bp, Artificial Sequence
  Synthetic
tccgttggtatcaacatggactcaatgcaaatgcaagtgatgaatgattctttgaggggtggtgtactttactgc

SEQ ID NO: 316233 - DNA, 75 bp, Artificial Sequence
  Synthetic
ctagactactccaaatgggactccacacaaaacccagctgtcactgcagctagcctgtccattttagagagattt

SEQ ID NO: 316234 - DNA, 75 bp, Artificial Sequence
  Synthetic
atggaaagcagcccattggtgtcctgtgcaatagagtccctgtcctcaccagcaattggctatctcaatgacatt

SEQ ID NO: 316235 - DNA, 75 bp, Artificial Sequence
  Synthetic
aaatttgtaaccaaagggggtctcccatcaggaatgcccttcacctcagtcatcaactcggtgaaccacatgata

SEQ ID NO: 316236 - DNA, 75 bp, Artificial Sequence
  Synthetic
tactttgcagcgggtgtgctcaaagcttatgaggaccaccacgtcccatacactggcaatgtatttcagatagag

SEQ ID NO: 316237 - DNA, 75 bp, Artificial Sequence
  Synthetic
actgtccacacctatggtgatgactgtatttatagtgtttgtcctgccaccgcttctatctttggttctgttctc

SEQ ID NO: 316238 - DNA, 75 bp, Artificial Sequence
  Synthetic
gccaacctgtcctccttcggtctcaggcccactgccgctgacaaaactgcagaaatcaagcccacccaaacacca

SEQ ID NO: 316239 - DNA, 75 bp, Artificial Sequence
  Synthetic
gtttttctgaaaagaacattcacacagacgccctatggggtgagggcactattggacatcaattccatcattcgg

SEQ ID NO: 316240 - DNA, 75 bp, Artificial Sequence
  Synthetic
cagttctactgggttaaggcgaaccgcactagtgacccatctagcccccctgcatttgatcgcactgcccgcagt

SEQ ID NO: 316241 - DNA, 75 bp, Artificial Sequence
  Synthetic
gcccagttggaagcagccctagcctatgcatcacaacatggacctttagtgtttgacaaggtgcgtgacattgcc

SEQ ID NO: 316242 - DNA, 75 bp, Artificial Sequence
  Synthetic
atcaaaacggccgaaggagagggtgtggtgcttgtgaatacaaactttgatttggccctcgccacctacaatgcc

SEQ ID NO: 316243 - DNA, 75 bp, Artificial Sequence
  Synthetic
tggttcataggtggtacagctccagatccagagcgccccactgaaggtgcacccaaattagtgtttgagatggag

SEQ ID NO: 316244 - DNA, 75 bp, Artificial Sequence
  Synthetic
ggcaatggctcccagttgccaaccaatcaaaatggtggccatgttggccaggatgttgacccgcctggcgcgact

SEQ ID NO: 316245 - DNA, 75 bp, Artificial Sequence
  Synthetic
ggtccgaccacatcccatgttgttgtgtctaatccagaacaacccaatgggcccgcacaacgcctggaaatggct

SEQ ID NO: 316246 - DNA, 75 bp, Artificial Sequence
  Synthetic
gttgctactggttccatccaatcaaatgtccctgaagcgatacgcaactgctttgcagtctgtcgtacttttgct

SEQ ID NO: 316247 - DNA, 75 bp, Artificial Sequence
  Synthetic
tggaatgacagaatgcccactggaactttcctgggatctttatcgcttcatcccaacattaatccatacacatcc

SEQ ID NO: 316248 - DNA, 75 bp, Artificial Sequence
  Synthetic
catctttcaggcatgtgggcagggtggggaggtagctttgaggcccgcatctcaatttctgggtctggcatgttt

SEQ ID NO: 316249 - DNA, 75 bp, Artificial Sequence
  Synthetic
gctgggaggatcattgcttctgtcataccacctggggttgaccccacgtcgatcagggatccgggcgtgctccct

SEQ ID NO: 316250 - DNA, 75 bp, Artificial Sequence
  Synthetic
cacgctttcgttgatgctcgtatcactgatccagtatcatttatgatccctgatgtgagaaacgttgattaccat

SEQ ID NO: 316251 - DNA, 75 bp, Artificial Sequence
  Synthetic
aggatggacatcactgaacccacttgctcccttggattctgggtctatcaaccactgctaaatccattttccacc

SEQ ID NO: 316252 - DNA, 75 bp, Artificial Sequence
  Synthetic
acagcagtcacaacatgctgggtatccatagaaaccaagcctggtggtgattttgatttttgcctcttgaggccc

SEQ ID NO: 316253 - DNA, 75 bp, Artificial Sequence
  Synthetic
cctggtcaacagatggagaatggtgtgtcacctgagggtctcctcccacgccgcttgggctacacccggggtaac

SEQ ID NO: 316254 - DNA, 75 bp, Artificial Sequence
  Synthetic
cgggttggggggttagtagttggtatggttttggttgctgaccaccgccaggtgaacaggcactttaatgcacag

SEQ ID NO: 316255 - DNA, 75 bp, Artificial Sequence
  Synthetic
tctatcacttatggatggtctactgcaccagtcaacccaatggcagcggcaattcaaacaaatcatgtccacact

SEQ ID NO: 316256 - DNA, 75 bp, Artificial Sequence
  Synthetic
ggaaacaacaattccaacaaaaggaacgcttggttatcacttagtgcagaaaacaagggtccactgttcccaggc

SEQ ID NO: 316257 - DNA, 75 bp, Artificial Sequence
  Synthetic
atcccaaaccacttccccgactcctgtgcttccacggtaatgggcgctatggacacagaccgccacatgccatcc

SEQ ID NO: 316258 - DNA, 75 bp, Artificial Sequence
  Synthetic
acaggaatctgtggcccagcaattggcttccaaaacaatggagatgcctatgaaaatgagactcctgcagtcatg

SEQ ID NO: 316259 - DNA, 75 bp, Artificial Sequence
  Synthetic
tttgccactctaaaccccctgactggtggtactaatgagaatcctgtagccctctttggttcaatcaatctggcc

SEQ ID NO: 316260 - DNA, 75 bp, Artificial Sequence
  Synthetic
tctttagctgtggttcgcactcaacaggatgtggacttcacaaccaccggttttgccaacaacatgaacgtggtt

SEQ ID NO: 316261 - DNA, 75 bp, Artificial Sequence
  Synthetic
gtggaaatgtcctgggaaatgtactcaggatcacaacagatacaggggcgtgtgacacctatggatggcactaac

SEQ ID NO: 316262 - DNA, 75 bp, Artificial Sequence
  Synthetic
tttgttttcacttcttcaggcgccaacaccctggtgctctgggaggagcaattactcagttatgatggaacccca

SEQ ID NO: 316263 - DNA, 75 bp, Artificial Sequence
  Synthetic
gcaatcttgtactcatctcagttggagcgcactgcggagtacttccaaaatgacaatgtcaacatacccccaggt

SEQ ID NO: 316264 - DNA, 75 bp, Artificial Sequence
  Synthetic
tcaatggctgtttttaatgttgaaacaaattctgcctctttccaagttggcattcggcatgatggatacgtggtg

SEQ ID NO: 316265 - DNA, 75 bp, Artificial Sequence
  Synthetic
actggtggtacggttggaactcatgttgctctggatgcggaaacacgatttcaatttgttggtattctccccctc

SEQ ID NO: 316266 - DNA, 75 bp, Artificial Sequence
  Synthetic
acagccacactggctgggcccaatgggaactcaggaagggccaggcgtctgttccaatgagttggttagttggcg

SEQ ID NO: 316267 - DNA, 75 bp, Artificial Sequence
  Synthetic
ccttgcagacaactgggtcactcgttgaccttgcaggaactgtttcagatatagtttacaaacaaaggcaagtgg

SEQ ID NO: 316268 - DNA, 75 bp, Artificial Sequence
  Synthetic
cacaactggagaaacaaaaccagctcatggagcaatggatgtacaaacaggaagccttgcaaaagtcccaaatgg

SEQ ID NO: 316269 - DNA, 75 bp, Artificial Sequence
  Synthetic
atctcacacgtgacttggcagtgaacacccctgtgtatcgtgtccaggctgcactagatgctgggtttgacccaa

SEQ ID NO: 316270 - DNA, 75 bp, Artificial Sequence
  Synthetic
tcagcgcgcgacgcttggctggttccagcgagcgcgttatctatggcaacttggatagaccaataatgcatgcag

SEQ ID NO: 316271 - DNA, 75 bp, Artificial Sequence
  Synthetic
gcaccatggaagggattaggcaaactaaccacttgaatgccatcagttcagcaatggctacatttaagaacggta

SEQ ID NO: 316272 - DNA, 75 bp, Artificial Sequence
  Synthetic
cacaatttggaaaaccagctcctccaaaaattcaaactgggacaccaaccaaaccctcaatcaatcttaatcacc

SEQ ID NO: 316273 - DNA, 75 bp, Artificial Sequence
  Synthetic
aacctggatcatccagtgcttgattctaaattttctttcaattttaaattttcttttcttttgaagtgatgccac

SEQ ID NO: 316274 - DNA, 75 bp, Artificial Sequence
  Synthetic
tcttttcttttgaagtgatgccacacgcgttcgggtggttaaatgtgattaagcgatcacagtcactaagctttc

SEQ ID NO: 316275 - DNA, 75 bp, Artificial Sequence
  Synthetic
atggctaattgccgtccgttacctattgggcagctgcccaacagggtttttggcaccccacgactcaccccaggg

SEQ ID NO: 316276 - DNA, 75 bp, Artificial Sequence
  Synthetic
tgggtgtgggcgtgcacgagtgaagccatgttcaagttggaatggcttcaggatccggtggtcattcgatccccg

SEQ ID NO: 316277 - DNA, 75 bp, Artificial Sequence
  Synthetic
gacgtatttgtggcgcagggggtggtggatgatttctttcgccccaagcgcgttttgcagggtgacccgcaactc

SEQ ID NO: 316278 - DNA, 75 bp, Artificial Sequence
  Synthetic
atcgcacaggtcctgcttggtgacgccactggaccactggttggccctgtgtccatgcagcaactgacatcactg

SEQ ID NO: 316279 - DNA, 75 bp, Artificial Sequence
  Synthetic
ttgcatgaggtgtcgcaggccctgaatgaccataagcacccactggccaacagatacactagggcctctttgcaa

SEQ ID NO: 316280 - DNA, 75 bp, Artificial Sequence
  Synthetic
aggtatgctgacactttgtccaattacatacctcttgtggacattctaacaggaccaaaggacctcaccccacgt

SEQ ID NO: 316281 - DNA, 75 bp, Artificial Sequence
  Synthetic
gacgttcttgaacagctcgcagcaggacgtgagtgggagtgtgtgccagacagtgctctgaagaaggttttcagg

SEQ ID NO: 316282 - DNA, 75 bp, Artificial Sequence
  Synthetic
gacatgtggcagtacatttgtgaggggtgcgacagtgtgtatataaagcttcaggacgtggagcgcaaaatgcca

SEQ ID NO: 316283 - DNA, 75 bp, Artificial Sequence
  Synthetic
cacattgataccactgtgctgaaacaattcatcatcacactgacagataccatctccatggcaacagctttagac

SEQ ID NO: 316284 - DNA, 75 bp, Artificial Sequence
  Synthetic
accaaaacgtggcttgcgcacattttgggttggctcaaacccacctgtttggtgatgatcatgcaacaacatgtc

SEQ ID NO: 316285 - DNA, 75 bp, Artificial Sequence
  Synthetic
aactccccccaggggtgggctgccacgttaactcgtttggcagagctgtattatggcatcatgccattaacagaa

SEQ ID NO: 316286 - DNA, 75 bp, Artificial Sequence
  Synthetic
acacttggctcagttgccagctgggtgactgataaatttgctgacatggcgactagcacctggggcaagttcaaa

SEQ ID NO: 316287 - DNA, 75 bp, Artificial Sequence
  Synthetic
acctggtgggacagcctctacacgccgcaggcaggcaatgatctcatcatactggggggcgttgttgggctggtg

SEQ ID NO: 316288 - DNA, 75 bp, Artificial Sequence
  Synthetic
tacttcatggtgtttggcgatgcgcccacccaaatgttcaccaagaagctgatgaaggtgtgtggttttatcacc

SEQ ID NO: 316289 - DNA, 75 bp, Artificial Sequence
  Synthetic
tcgacggtggctgccattaaagctgccatgtggatagtggactactttaagcagcgtgagcatgagcaccaggtc

SEQ ID NO: 316290 - DNA, 75 bp, Artificial Sequence
  Synthetic
cgcatcaccctagcgagatgggccgcactccaggaggtgataaagcagaacaggtgtgctggccttagtgaagtg

SEQ ID NO: 316291 - DNA, 75 bp, Artificial Sequence
  Synthetic
actaagttaaaagagtgttgtgaagtgctgctaaacgaggtcaccgagttgatgtacaaactgggggcttcacct

SEQ ID NO: 316292 - DNA, 75 bp, Artificial Sequence
  Synthetic
ctggctgggttgatacgcaccacctctgatgtgatacaaaccaccatcaatgagctggcccagttgatggcttat

SEQ ID NO: 316293 - DNA, 75 bp, Artificial Sequence
  Synthetic
gacacccagcgtaaaccacccgccatggtggtgttcgggggtccaccgggcattggtaaaactcggctggtggag

SEQ ID NO: 316294 - DNA, 75 bp, Artificial Sequence
  Synthetic
gccctagccaagcaactgggagaggtcagccacttcaccatgactgttgatcactatgacacgtacacaggcaac

SEQ ID NO: 316295 - DNA, 75 bp, Artificial Sequence
  Synthetic
acagtagcaatttgggacgagtttgatgtggactcaaaacaggctttcatcgaagccactattggcatcgtgaat

SEQ ID NO: 316296 - DNA, 75 bp, Artificial Sequence
  Synthetic
tgtgccccttaccccttgaactgtgaccgcccagaagcaaagggcagggtttttacatccaaatacgtgttggct

SEQ ID NO: 316297 - DNA, 75 bp, Artificial Sequence
  Synthetic
accaccaattgccccaccccagtcatgcccgaccacccaagggctatggctttttggcgtcgcataactttcatt

SEQ ID NO: 316298 - DNA, 75 bp, Artificial Sequence
  Synthetic
gacgtgacagcccccacaattgaacagtggctggtggacaacccagggcgcaaagctcctacaagtctctttaag

SEQ ID NO: 316299 - DNA, 75 bp, Artificial Sequence
  Synthetic
gaagacttttcccatctgcagtgctcagtacgcggctacactgcctatgatgagaagggcaacacactcagtggt

SEQ ID NO: 316300 - DNA, 75 bp, Artificial Sequence
  Synthetic
aaggtggccagggccagatatgtgtcagtcaacaatctccttgatctgattaaggagaagtacaacagtgaggcc

SEQ ID NO: 316301 - DNA, 75 bp, Artificial Sequence
  Synthetic
gctgatatcaaacatctatggttcaccgtcccacaggccatccacaagcaagcgcgtgacatcatacttggctgg

SEQ ID NO: 316302 - DNA, 75 bp, Artificial Sequence
  Synthetic
ttgcggttccactcctacccgaacacagtcgcagacaacatacccctttctgaggtcagagaccccacgtgtttt

SEQ ID NO: 316303 - DNA, 75 bp, Artificial Sequence
  Synthetic
gggtacgtggtgatttctgatgtggacccaccacgacatgtggctgagcatgttgcccatgtggaagtggagtca

SEQ ID NO: 316304 - DNA, 75 bp, Artificial Sequence
  Synthetic
atactgcgcactgatattatggacttgttgagggagggtggtggaggcctgtttagagctctcaaagtcaaaagt

SEQ ID NO: 316305 - DNA, 75 bp, Artificial Sequence
  Synthetic
gccccgcgcagctgtgttatcaacaaggtcatgatgcaagcacaccacaccaccttgcaagtgctcaccagtcaa

SEQ ID NO: 316306 - DNA, 75 bp, Artificial Sequence
  Synthetic
gaaccacacccaccaaacttgccacggcccagacggttggtgtttgttgagtcgccaattgacatcatcagcgcc

SEQ ID NO: 316307 - DNA, 75 bp, Artificial Sequence
  Synthetic
ttacggcaccacgtcggcttttgcaccattcctggcatcgtcaaattgatcacctctggggtggggttgggcgtt

SEQ ID NO: 316308 - DNA, 75 bp, Artificial Sequence
  Synthetic
gaaaacttgggcaactttctccaatccattgctggtaatgttaggttccctttgcagtctgagtgctcattgctc

SEQ ID NO: 316309 - DNA, 75 bp, Artificial Sequence
  Synthetic
agaacgccaagtggtgacgtcctcttttacacctcaggacaggctgccgtctgggccacacctgcgcgctttcca

SEQ ID NO: 316310 - DNA, 75 bp, Artificial Sequence
  Synthetic
atagttacgccaggagaggcgtcagttggcaaggaggtttgttcagagtcctcctggtgggacattctcaaagca

SEQ ID NO: 316311 - DNA, 75 bp, Artificial Sequence
  Synthetic
ctcttcagcacactggtggtggcgtttggacctattgccacgctagtgttgacagcccacaacttggcctacttg

SEQ ID NO: 316312 - DNA, 75 bp, Artificial Sequence
  Synthetic
aacacccgtgaaaacacacttagcgaggcgaaagggaaaaacaaacgcgggcgtggtgctcgcaaggctattgcc

SEQ ID NO: 316313 - DNA, 75 bp, Artificial Sequence
  Synthetic
ctaagggatgatgagtttgatgagtggcaggacatcatccgtgactggcgcaaggaaatgactgttcaacagttc

SEQ ID NO: 316314 - DNA, 75 bp, Artificial Sequence
  Synthetic
ctggacctcaaggaacgcgcattgtcaggcgcatcagaccctgactcccaaagatacaacgcttggcttgaactg

SEQ ID NO: 316315 - DNA, 75 bp, Artificial Sequence
  Synthetic
cgcgcaaaaaggctgagcgctggagcctaccaacatgcggttgtggacatcatcggcaagtcaggtcacaggcgt

SEQ ID NO: 316316 - DNA, 75 bp, Artificial Sequence
  Synthetic
gaggtgattcgcacacaggtcatgcgtgcgccacgtgagccaagaggtgatacctatgacagtgaggggcgtggg

SEQ ID NO: 316317 - DNA, 75 bp, Artificial Sequence
  Synthetic
tacgtggtacccatgactgcccaagagaagcacacaggttgggcagtccacattgggaatgggcgcctggtcact

SEQ ID NO: 316318 - DNA, 75 bp, Artificial Sequence
  Synthetic
tgtacgcatgtggccaacatgtgtgaccgtgtagccgaggtggaattcaaggtcgcagaaacagaccgcgacacc

SEQ ID NO: 316319 - DNA, 75 bp, Artificial Sequence
  Synthetic
tgcatcatcactgcccccctcggccacctgcctagcgttgcgcttggtaatgggccaccagcattttacacaacc

SEQ ID NO: 316320 - DNA, 75 bp, Artificial Sequence
  Synthetic
aactttcaccccatccgggtgctggatgagggcagctgggacaccacaaccacccgtgtgagagggtggcgcgtg

SEQ ID NO: 316321 - DNA, 75 bp, Artificial Sequence
  Synthetic
gtcatcaacaatggcacaacaacggccccaggcgactgcggtcaaccctatctcaatgcgcggcgacaactggtt

SEQ ID NO: 316322 - DNA, 75 bp, Artificial Sequence
  Synthetic
ggagtgtacgccgcaactagcacgtgtggggtgaagaagcttgtgtcaagggtgcaaaccaagaaggccgcaaaa

SEQ ID NO: 316323 - DNA, 75 bp, Artificial Sequence
  Synthetic
gctaccttcccatggaagggcctgccagtaacaaccatgcctgatgctggcggattacccactgggacccggtac

SEQ ID NO: 316324 - DNA, 75 bp, Artificial Sequence
  Synthetic
caccggtccatcgcatggccaaagctgctcccagaagaaacacacgcacctgcaccctatggcgtgaatgaccca

SEQ ID NO: 316325 - DNA, 75 bp, Artificial Sequence
  Synthetic
aggtaccccttctcacaacaccaaatgattgccaacaatctacaaccttacaccaacacaccagttgctttggat

SEQ ID NO: 316326 - DNA, 75 bp, Artificial Sequence
  Synthetic
caaaccctgttgcagcgtgcagtcaaacataccaaaggctaccttgaccaaatcattgggacccatagatcacca

SEQ ID NO: 316327 - DNA, 75 bp, Artificial Sequence
  Synthetic
aacttgacctatgctgctgcggtcgaatcaatggcccatgatacagcgtgcgggccaaacttgcctggccggaaa

SEQ ID NO: 316328 - DNA, 75 bp, Artificial Sequence
  Synthetic
aaggattacatgacagaccaaggggagccaattggacctttgaaacaaatgttagaagaagcctgggatatggcg

SEQ ID NO: 316329 - DNA, 75 bp, Artificial Sequence
  Synthetic
caccgtggcactccacgcagacacgagtacaagctcgcgctcaaggatgagcttcgccccatagaaaagaacgac

SEQ ID NO: 316330 - DNA, 75 bp, Artificial Sequence
  Synthetic
caaggcaaaagacgcctgctgtggggctgcgatgctggcgtgtcaatgatagccaacgctgttttcaaacctgtt

SEQ ID NO: 316331 - DNA, 75 bp, Artificial Sequence
  Synthetic
gctgagcgcctcgtggataccgtgcccatgcaccccgtggctgttggcatatgtatggacagccctcagattgaa

SEQ ID NO: 316332 - DNA, 75 bp, Artificial Sequence
  Synthetic
caaatggaccaagccttaactggtagggtgctctactgcctggactacagcaagtgggattccacacaaaatccg

SEQ ID NO: 316333 - DNA, 75 bp, Artificial Sequence
  Synthetic
gccgtcacctgtgccagtgttgacatcctggcctcctatgctgaggacacacctttgtcctcggcagccatagcc

SEQ ID NO: 316334 - DNA, 75 bp, Artificial Sequence
  Synthetic
accctgtgctcaccagccgtgggcaggttggatgacatcggcttgactgtgacatcggggctcccctctggcatg

SEQ ID NO: 316335 - DNA, 75 bp, Artificial Sequence
  Synthetic
cccttcaccagtgtcataaactctgtgaatcacatgatctattttgccatggctgtgctcgaggcctatgaggaa

SEQ ID NO: 316336 - DNA, 75 bp, Artificial Sequence
  Synthetic
ttcaaggtgccttatatgggaaatatctttgataatgagactgtttacacctacggggatgattgtgtgtatggc

SEQ ID NO: 316337 - DNA, 75 bp, Artificial Sequence
  Synthetic
ttgacaccagccacagcctccatcatgcctgtggtagtcaagaacctgactagctatgggttggcccccactgct

SEQ ID NO: 316338 - DNA, 75 bp, Artificial Sequence
  Synthetic
gcagacaaatcccaaagcatcgagccaacagacactcctgtgttcctcaagcgcaccttttcccaaacccctttt

SEQ ID NO: 316339 - DNA, 75 bp, Artificial Sequence
  Synthetic
ggtctgcgtgcgctactagatgagaccagcttggcacggcagtgttactgggttaaggccaaccgcaccacaaac

SEQ ID NO: 316340 - DNA, 75 bp, Artificial Sequence
  Synthetic
ctcttcgagccggcggccgttgatgtggacatcaggaaaaaccaactggaagtgatgcttgcatatgcaagtcaa

SEQ ID NO: 316341 - DNA, 75 bp, Artificial Sequence
  Synthetic
cacccaagatcggtgtttgacaagctggcaggtatggctgaggtcaccgcaagtgcagagggctaccagcttgtg

SEQ ID NO: 316342 - DNA, 75 bp, Artificial Sequence
  Synthetic
aatgttgagtgggccaacgcagtggcaacgtacaacgcatggtacggtggcactgacggtggccgtgctcccacc

SEQ ID NO: 316343 - DNA, 75 bp, Artificial Sequence
  Synthetic
gatgaagatgaagagccagaagtgttcgtgatggaggcgcctgccccagcccgttcggttgcgagcaacccagag

SEQ ID NO: 316344 - DNA, 75 bp, Artificial Sequence
  Synthetic
ggcactcagaatagcaatgagaccagaccagtccaaccagctgggcctatgcccgtggccgcggcccaggccctg

SEQ ID NO: 316345 - DNA, 75 bp, Artificial Sequence
  Synthetic
gaaatggctgttgccacagggcaaatcagtgacaccatccccagtgtggtcagagaaaccttcagcacctacacc

SEQ ID NO: 316346 - DNA, 75 bp, Artificial Sequence
  Synthetic
aatgtcacctggactacacgccagcctacagggactcttcttgcccgaatgtccctagggccaggcttgaacccc

SEQ ID NO: 316347 - DNA, 75 bp, Artificial Sequence
  Synthetic
tatacactccacttgtccgccatgtgggccggctggggtgggtcgtttgagatcaaggtgataatatcagggtct

SEQ ID NO: 316348 - DNA, 75 bp, Artificial Sequence
  Synthetic
ggcatgtatgcgggcaaattgttgtgtgcactcataccacccggagttgatcccagtgctgtggaccagcctggt

SEQ ID NO: 316349 - DNA, 75 bp, Artificial Sequence
  Synthetic
gccttcccgcacgcacttgtggacgcgcgcataactgaaggcgtcaccttcaccttgggggacgtcagggcggtg

SEQ ID NO: 316350 - DNA, 75 bp, Artificial Sequence
  Synthetic
gactatcatgagacaggagttggagggactgtagcgtgtttggcactttacgtgtaccaaccgcttatcaaccct

SEQ ID NO: 316351 - DNA, 75 bp, Artificial Sequence
  Synthetic
tttgaagccgccgtgtcagctgcgatggtgacaattgagacccgccctggccaagactttggatttaccctgctc

SEQ ID NO: 316352 - DNA, 75 bp, Artificial Sequence
  Synthetic
aagcctccaaaccaagccatggaagtagggttcgaccccaggtcactcctgccccgcacggcaagaacactacgg

SEQ ID NO: 316353 - DNA, 75 bp, Artificial Sequence
  Synthetic
gggaacaggtttggcagacccatcacagctgtggtcatagtaggtgtggcacgacaaatcaacaggcacttttca

SEQ ID NO: 316354 - DNA, 75 bp, Artificial Sequence
  Synthetic
gctgagggcaccacacttggctggtccacggccccaattggcccttgtgtggcccgtgtcaatggaaagtacacc

SEQ ID NO: 316355 - DNA, 75 bp, Artificial Sequence
  Synthetic
aacaatacgggcaaggcagtgtttcagttgggacccttgagcaatgggcccctctaccccaacatcatcaaccat

SEQ ID NO: 316356 - DNA, 75 bp, Artificial Sequence
  Synthetic
tacccagatgtggctgcatcaacaatgttcaatacagcaactgccgtggatgacgacacgacgggtgggggaggg

SEQ ID NO: 316357 - DNA, 75 bp, Artificial Sequence
  Synthetic
cctatggtgatcttcaacgatgttggtgatgtggtagagggtgtggcctatcaaatgagattcatagcctcacat

SEQ ID NO: 316358 - DNA, 75 bp, Artificial Sequence
  Synthetic
gccacttcccaaagtcccacactcattgatcaaatcaatgcaacatcaatggcaatatgcagctttggcaattcc

SEQ ID NO: 316359 - DNA, 75 bp, Artificial Sequence
  Synthetic
cgggcagacctcaaccaaagcccactcaatgtgggcattgaattgacctacacctgtggcaccaaggcgatcgat

SEQ ID NO: 316360 - DNA, 75 bp, Artificial Sequence
  Synthetic
gggattgtcacctcatttatggaccgccaatacacatttggcccacaggggcccaacaacatcatgctttgggtg

SEQ ID NO: 316361 - DNA, 75 bp, Artificial Sequence
  Synthetic
gagtctgtgctcggcacacacacaggtaacaacgccgtgtacagttcacagccagacactgtttctgctgcactg

SEQ ID NO: 316362 - DNA, 75 bp, Artificial Sequence
  Synthetic
cagggccagcccttcaacataccagatgggtacatggccgtgtggaacgtcaatgcggacagtgccgatttccaa

SEQ ID NO: 316363 - DNA, 75 bp, Artificial Sequence
  Synthetic
atagggctgagacgcgatggctacttcgtcaccaacggggccattggcacgcgcatggttatttcagaagatacc

SEQ ID NO: 316364 - DNA, 75 bp, Artificial Sequence
  Synthetic
accttcagtttcaacggcatgtacaccctaaccactcccctcattggaccaagtgggacatcaggaaggtccatt

SEQ ID NO: 316365 - DNA, 75 bp, Artificial Sequence
  Synthetic
cacagctcacgatgagttggattgcaggagcaatgcagggtgctggcctgctgggtgaccttgcaggcacaattg

SEQ ID NO: 316366 - DNA, 75 bp, Artificial Sequence
  Synthetic
gacaaatagtgttacataacaagcaattgaatatcatgaattcttttaatcaggcccagatacagttggctaaag

SEQ ID NO: 316367 - DNA, 75 bp, Artificial Sequence
  Synthetic
atcaattaaaacaaaatcgggaattagccaaccagtattatgaatttaatgcaaatttacctgtcaatcagtaca

SEQ ID NO: 316368 - DNA, 75 bp, Artificial Sequence
  Synthetic
acagtgctgtgggtgctggttttgactcagtttccgcgcgtcaattggctgggtcacgtgaagtgcgctatcttg

SEQ ID NO: 316369 - DNA, 75 bp, Artificial Sequence
  Synthetic
gtgggcagcaaacacctttggtccaccaagggcagatacatcaaatgatgttttcacccaagcacttgatgcaag

SEQ ID NO: 316370 - DNA, 75 bp, Artificial Sequence
  Synthetic
cacaacacgcggtcggcactttttcccgtgggatgcctggtgtcacccccagtaaggggttgcccagaccacagg

SEQ ID NO: 316371 - DNA, 75 bp, Artificial Sequence
  Synthetic
gcgtcacagctaaagtgcctgcggctggagccaccaccactcacagcagaatgtgattttctttccctggttacg

SEQ ID NO: 316372 - DNA, 75 bp, Artificial Sequence
  Synthetic
gcctgcggctggagccaccaccactcacagcagaatgtgattttctttccctggttacgcgtaccgaaccttaca

SEQ ID NO: 316373 - DNA, 75 bp, Artificial Sequence
  Synthetic
gtgattggttagatggtttccaagccattcaagccaatagttctcaatgccaccttcgagtggcagatcttcaag

SEQ ID NO: 316374 - DNA, 75 bp, Artificial Sequence
  Synthetic
cgttgctacctcagggtagcaccgcgtgaagcattttgtgagaacttgagtgaactatatcactactttgccagg

SEQ ID NO: 316375 - DNA, 75 bp, Artificial Sequence
  Synthetic
cgtgtgaacgcctggctcaagcatgccacaaggaccctcccaaacgaatacacgttcgtcgaggagggtctcctt

SEQ ID NO: 316376 - DNA, 75 bp, Artificial Sequence
  Synthetic
gacatgtttggtacaaaagcccctgacagtgttcaagaaggtacactgttccgggaactgttcggagttgaccaa

SEQ ID NO: 316377 - DNA, 75 bp, Artificial Sequence
  Synthetic
actgaacagttccctttgtccctcgcggacttggctaggttgcaaggggaacttgttgacgcgactcgcacccca

SEQ ID NO: 316378 - DNA, 75 bp, Artificial Sequence
  Synthetic
ggacacgcgctgcgtcaaaagtacacaatggccactatacaggagttgatcaacaagatcaccaaggttgtgcca

SEQ ID NO: 316379 - DNA, 75 bp, Artificial Sequence
  Synthetic
gtgcaggccacactcaatgaaatgcacgcacgcaggcaattcgagcgtgagcgggctgacctgtttcacgaactc

SEQ ID NO: 316380 - DNA, 75 bp, Artificial Sequence
  Synthetic
ccactggtagatgaagacgccgttgcacaacccaaaacttatttttacaccatgtggcgtcaggttgtgaagaaa

SEQ ID NO: 316381 - DNA, 75 bp, Artificial Sequence
  Synthetic
ggcaaagcatacttctgtccccttgttaagacaagtgcatggcgcactaagatcagtgccataacagaacctatc

SEQ ID NO: 316382 - DNA, 75 bp, Artificial Sequence
  Synthetic
aaggatttcttaattgcattttgccaggcagtgcaacaagaaatgggtgtcaacccacaatacttgcaactcgcc

SEQ ID NO: 316383 - DNA, 75 bp, Artificial Sequence
  Synthetic
tggttgcaaaaactcaaacctaccactttaaccattatccttcaacaacataaacacaccgtctcagggtggctg

SEQ ID NO: 316384 - DNA, 75 bp, Artificial Sequence
  Synthetic
gccaccatgacagcactcgtggaagtgtactcaaatctgtttgacgacttgcgcaaatcatcggttgccatcgtg

SEQ ID NO: 316385 - DNA, 75 bp, Artificial Sequence
  Synthetic
tcgagcattggagctttctttgacatttgtaaagactttgtgacacaggtcgtggagttggttaaaacaacgttc

SEQ ID NO: 316386 - DNA, 75 bp, Artificial Sequence
  Synthetic
accgcccaaggtccaacagacttggggtgggcggcagtactggcgggggctgcgatgattctactaaaaatgtct

SEQ ID NO: 316387 - DNA, 75 bp, Artificial Sequence
  Synthetic
gggtgcccaggcgttattggcatgtggacaaaagtgctcaaaatctgtgggggcatcaccaccatcacggcagca

SEQ ID NO: 316388 - DNA, 75 bp, Artificial Sequence
  Synthetic
gcgcgtggagtgcgctggttgaaggatctctatgaggaggctgaaggacgcagactggcaaaaatgtacatggca

SEQ ID NO: 316389 - DNA, 75 bp, Artificial Sequence
  Synthetic
cgcggtgccgccctgattgaacttgccgccagccgagaggtgacaggcattgatgaacttaagggccttcttgat

SEQ ID NO: 316390 - DNA, 75 bp, Artificial Sequence
  Synthetic
tgttttaccatattgattgaggagggcactgagcttatccacaagtttggcactagcccactagcaggtctggtg

SEQ ID NO: 316391 - DNA, 75 bp, Artificial Sequence
  Synthetic
cgcacgtatgtgtctgaacttgaaacccaagcaaacaacatcagatccactattaagcttgacacccctagacgg

SEQ ID NO: 316392 - DNA, 75 bp, Artificial Sequence
  Synthetic
gtgcccgttgttatcatccttactggggcacctggcattggaaaaactcgcctagcacaatatgttggccagcgc

SEQ ID NO: 316393 - DNA, 75 bp, Artificial Sequence
  Synthetic
tttgggaaaacgtccaatttctcagtggctgtggatcaccatgtcggctacacagggaacactgtttgtatatgg

SEQ ID NO: 316394 - DNA, 75 bp, Artificial Sequence
  Synthetic
gatgaatttgatgtcgattccaagggtgcgtttgtagagacgatgattgggatcgcaaatacagcaccctttcca

SEQ ID NO: 316395 - DNA, 75 bp, Artificial Sequence
  Synthetic
ttaaactgtgacagggttgaaaacaaagggcgtgtgtttacgtcagactatgtcatttgcacgtccaactatcca

SEQ ID NO: 316396 - DNA, 75 bp, Artificial Sequence
  Synthetic
acatctgttatcccagataatccaagggccgcggcattttaccgcagggtcctaactgttgacgtcagcgcgccc

SEQ ID NO: 316397 - DNA, 75 bp, Artificial Sequence
  Synthetic
gacttggaggagtggaagaagaggaatcctggtaagcgacctactccagacctgtaccaagatgatttctcccac

SEQ ID NO: 316398 - DNA, 75 bp, Artificial Sequence
  Synthetic
ctcaagctgatgctaaggccatacttgggctacaacccagatggggacacacttgaaggccccagagttgccccc

SEQ ID NO: 316399 - DNA, 75 bp, Artificial Sequence
  Synthetic
ttgtggttgcaagtccccaagacactcgtggaacaatctacaaacatggtcaaagcatttatgtatgccaaccgt

SEQ ID NO: 316400 - DNA, 75 bp, Artificial Sequence
  Synthetic
gcagtgtgtgatgtgatacctaacccttccacccgtgacatcaccgagaccgcgttgtcgaaaatctttgtgtgt

SEQ ID NO: 316401 - DNA, 75 bp, Artificial Sequence
  Synthetic
ggcactgcacctccacctgagtttgttggcaaacatatagtcattactggcatagaggtaggtgatgcgtccatc

SEQ ID NO: 316402 - DNA, 75 bp, Artificial Sequence
  Synthetic
gctaactcgttactatccatgttcaccaccaccacacggctgtctgccgcagctcagagggagtacatgtacaga

SEQ ID NO: 316403 - DNA, 75 bp, Artificial Sequence
  Synthetic
gtgtggagcccattgatccacatccaagaccgaagcataaacactcaaaatctcccctacatcaacagagtgatc

SEQ ID NO: 316404 - DNA, 75 bp, Artificial Sequence
  Synthetic
ccagtaacatctcactgggactttttgaggggtttgcggcaccatcttggtttcacctctatcccaggtatgtgg

SEQ ID NO: 316405 - DNA, 75 bp, Artificial Sequence
  Synthetic
aaggcatttcaaggttggcgtacatcacagggcatagttgatttcgtggcccaccacatggcagatgtcacattc

SEQ ID NO: 316406 - DNA, 75 bp, Artificial Sequence
  Synthetic
ccaagcaacccagaatgtaccatcttccgcacgccagatgcggatgtggtcttctatacttttggctcatatgtg

SEQ ID NO: 316407 - DNA, 75 bp, Artificial Sequence
  Synthetic
tgctttgccaccccagcacgagtgccatatgttggtacgccacccaccactatccactctaacacaccccggtgc

SEQ ID NO: 316408 - DNA, 75 bp, Artificial Sequence
  Synthetic
atgacctggggcgaaaccatagcactgttgtgtgaagtggttgccgagtttgtccttcattttggtcctgtgatc

SEQ ID NO: 316409 - DNA, 75 bp, Artificial Sequence
  Synthetic
ctatctgcagccaacattgcctacctcatgactaggggctcaaggactgaggaagctaagggcaagaccaagcat

SEQ ID NO: 316410 - DNA, 75 bp, Artificial Sequence
  Synthetic
ggacgcggcatgcgccatggccatagagctggagtaagcctctcagacgatgagtatgatgagtggcgtgatctg

SEQ ID NO: 316411 - DNA, 75 bp, Artificial Sequence
  Synthetic
atgcgtgattggaggcgtgacatgagcgttaatgacttcctaatgctcagggaaaggtccgcgctagggatggac

SEQ ID NO: 316412 - DNA, 75 bp, Artificial Sequence
  Synthetic
gatgaggacgtggccagatacagagcatggcttgagatccgtgccatgcgcatggcagggggtgcgtacacacat

SEQ ID NO: 316413 - DNA, 75 bp, Artificial Sequence
  Synthetic
gccactattattggtcgtggtggtgtgcgagatgagatcatacgcacgtcaccacgcagagccccaacacgaccc

SEQ ID NO: 316414 - DNA, 75 bp, Artificial Sequence
  Synthetic
caacaacactacgaagaagaggggccaacagcaattgtggagttcacgcaaggtggtgaccacattggatatgga

SEQ ID NO: 316415 - DNA, 75 bp, Artificial Sequence
  Synthetic
gtacatattggcaatggcaatgtgataactgtcacccacgtggcgtcgacgtccgacgaggtcaatggctgtgct

SEQ ID NO: 316416 - DNA, 75 bp, Artificial Sequence
  Synthetic
ttcaagataacacgcactgttggtgaaacaacctgggtgcaagggccattttcacaattgccacacatgcagata

SEQ ID NO: 316417 - DNA, 75 bp, Artificial Sequence
  Synthetic
ggcagtggttccccggtctatttcaccacacggttgcacccagttttcacaatatcagaggggacatttgaaact

SEQ ID NO: 316418 - DNA, 75 bp, Artificial Sequence
  Synthetic
ccaaacatcaccgtaaacgggttccatgtcagaatcatgaatggttacccaaccaagaaaggtgactgtgggctg

SEQ ID NO: 316419 - DNA, 75 bp, Artificial Sequence
  Synthetic
ccgtatttcaattccaaccgccagttggtggcgttgcatgccggcacggacacacaaggtgaaacaaaagtggct

SEQ ID NO: 316420 - DNA, 75 bp, Artificial Sequence
  Synthetic
caacgagttgtgaaggaggtcaccacccaagatgaatttcaatggaagggtttgcccgtggtgaagtccggattg

SEQ ID NO: 316421 - DNA, 75 bp, Artificial Sequence
  Synthetic
gacgttggaggcatgcccactgggacccggtaccacaggtctcctgcgtggcccgaagaacaacctggtgagaca

SEQ ID NO: 316422 - DNA, 75 bp, Artificial Sequence
  Synthetic
catgccccagcaccttttggtgcaggggacaagaggtacacattttcacagacagaaatgttggtaaatggattg

SEQ ID NO: 316423 - DNA, 75 bp, Artificial Sequence
  Synthetic
aagccctacacagaacccaccgccggggtaccaccacagctcttgtctcgcgcagtcacgcatgtgagatcatac

SEQ ID NO: 316424 - DNA, 75 bp, Artificial Sequence
  Synthetic
atagaaacaattattggcacacaccggtcccctgtgttaacatatcaccaagcatgtgagctgcttgaacggacc

SEQ ID NO: 316425 - DNA, 75 bp, Artificial Sequence
  Synthetic
acatcatgcggaccgttcgtacagggcctcaagggtgattattgggatgaggaacaacagcagtacactggtgtg

SEQ ID NO: 316426 - DNA, 75 bp, Artificial Sequence
  Synthetic
ttggccagccaccttgaacaggcgtgggataaggctaacaaagggatagcaccaaggaacgcctataaattggca

SEQ ID NO: 316427 - DNA, 75 bp, Artificial Sequence
  Synthetic
cttaaagatgagctcaggccaattgagaagaacaaggttggtaaacgcaggttgttgtggggctgtgatgctgcc

SEQ ID NO: 316428 - DNA, 75 bp, Artificial Sequence
  Synthetic
agaagaacaaggttggtaaacgcaggttgttgtggggctgtgatgctgccaccacgcttatagccaccgcggctt

SEQ ID NO: 316429 - DNA, 75 bp, Artificial Sequence
  Synthetic
ttcagatgcaagtgatgaatgactctttaaaggggggtgttctttactgtttggattattccaaatgggattcca

SEQ ID NO: 316430 - DNA, 75 bp, Artificial Sequence
  Synthetic
cacaaaaccctgcagtgacagcagcctccctggcaatattggagagatttgctgagccccatccaattgtgtctt

SEQ ID NO: 316431 - DNA, 75 bp, Artificial Sequence
  Synthetic
gtgccattgaggctctttcctcccctgcagagggctatgtcaatgatatcaaatttgtgacacgcggcggcctac

SEQ ID NO: 316432 - DNA, 75 bp, Artificial Sequence
  Synthetic
catctgggatgccatttacatctgtcgtcaattctatcaaccatatgatatacgtggcggcagccatcctgcagg

SEQ ID NO: 316433 - DNA, 75 bp, Artificial Sequence
  Synthetic
catacgaaagccacaatgtcccatatactggaaacgtcttccaagtggagaccgttcacacgtatggtgatgatt

SEQ ID NO: 316434 - DNA, 75 bp, Artificial Sequence
  Synthetic
gcatgtacagcgtgtgccctgccactgcatcaattttccacactgtgcttgcaaacctaacgtcgtatggactca

SEQ ID NO: 316435 - DNA, 75 bp, Artificial Sequence
  Synthetic
aacccactgcggcagataagagtgatgcaattaaaccaaccaacacaccagtgtttttgaagaggacatttacac

SEQ ID NO: 316436 - DNA, 75 bp, Artificial Sequence
  Synthetic
aaaccccgcatggagttcgtgcactgctagacatcacttccataactagacagttctactggctgaaagctaata

SEQ ID NO: 316437 - DNA, 75 bp, Artificial Sequence
  Synthetic
ggacatctgacccttccagcccgcctgcttttgatcgtgctagagcacgcagtgcgcaactggagaatgcattgg

SEQ ID NO: 316438 - DNA, 75 bp, Artificial Sequence
  Synthetic
cctatgcttcacaacacggtcctgttgtgtttgacaccgtgcgccaaattgccataaagactgctcaaggagagg

SEQ ID NO: 316439 - DNA, 75 bp, Artificial Sequence
  Synthetic
ggctggtgcttgttaacaccaactatgaccaggctctcgccacctacaacgcttggtttataggtggtacagtgc

SEQ ID NO: 316440 - DNA, 75 bp, Artificial Sequence
  Synthetic
tgaccaggctctcgccacctacaacgcttggtttataggtggtacagtgcctgacccagtgggtcacactgaagg

SEQ ID NO: 316441 - DNA, 75 bp, Artificial Sequence
  Synthetic
caaagcagagcaacaacccaatggtcgttgacccgcctggcacaacgggtccgaccacatcccatgttgttgttg

SEQ ID NO: 316442 - DNA, 75 bp, Artificial Sequence
  Synthetic
gccactggtgcaatccaatccaatgtccctgaggcaatacgcaactgctttgcagtctttcgcacttttgcttgg

SEQ ID NO: 316443 - DNA, 75 bp, Artificial Sequence
  Synthetic
tccctgaggcaatacgcaactgctttgcagtctttcgcacttttgcttggaatgacaggatgcccacgggaactt

SEQ ID NO: 316444 - DNA, 75 bp, Artificial Sequence
  Synthetic
agccagtttctttcatgatccctgatgttagagcagtggactaccacaggatggatggtgctgaacctacatgct

SEQ ID NO: 316445 - DNA, 75 bp, Artificial Sequence
  Synthetic
ccttagggttctgggtttaccagccattgctgaacccgttttccaccaccgccgtttcaacatgttgggtatcag

SEQ ID NO: 316446 - DNA, 75 bp, Artificial Sequence
  Synthetic
tggaaactaaaccaggcggcgactttgacttctgtctgctaaggccaccaggtcaacaaatggaaaatggggttt

SEQ ID NO: 316447 - DNA, 75 bp, Artificial Sequence
  Synthetic
tgacttctgtctgctaaggccaccaggtcaacaaatggaaaatggggtttcaccagaaggcctgttgcccaggcg

SEQ ID NO: 316448 - DNA, 75 bp, Artificial Sequence
  Synthetic
cttaggttactcgcgtggtaaccgtgttggtggcttggtggttggcatgattttggtggctgagcataaacaggt

SEQ ID NO: 316449 - DNA, 75 bp, Artificial Sequence
  Synthetic
caacagacactttaattccaactcagtcacttttggttggtcaacggcacctgtcaacccaatggcagcagaaat

SEQ ID NO: 316450 - DNA, 75 bp, Artificial Sequence
  Synthetic
cgtgacaaaccaggcacactcaacatcacgccacgcttggctctccattggtgctcaaaataagggtccactgtt

SEQ ID NO: 316451 - DNA, 75 bp, Artificial Sequence
  Synthetic
tcctggaatacccaaccattttcccgactcgtgtgcatcaacagttgtaggggccatggatacctcccttggtgg

SEQ ID NO: 316452 - DNA, 75 bp, Artificial Sequence
  Synthetic
ccggccatccactggggtgtgtgggcctgccataagctttcaaaacaatggtgatgtgtatgagaatgacacacc

SEQ ID NO: 316453 - DNA, 75 bp, Artificial Sequence
  Synthetic
ctcagtcatgtttgccacttatgacccactcacgtcaggtacgggggttgctctcaccaacagcattaaccccgc

SEQ ID NO: 316454 - DNA, 75 bp, Artificial Sequence
  Synthetic
atccctggcgttggtgcgcatttccaacaatgactttgacaccagtggctttgccaacgataaaaacgtagtggt

SEQ ID NO: 316455 - DNA, 75 bp, Artificial Sequence
  Synthetic
tcaaatgtcgtgggagatgtacacaggtaccaaccaaattaggggtcaggtcacaccaatgtctggtaccaacta

SEQ ID NO: 316456 - DNA, 75 bp, Artificial Sequence
  Synthetic
caccttcacttctacaggtgcaaacacacttgtgttgtggcaggagcgcatgcttagctatgatggtcaccaagc

SEQ ID NO: 316457 - DNA, 75 bp, Artificial Sequence
  Synthetic
acacttgtgttgtggcaggagcgcatgcttagctatgatggtcaccaagcaatactgtactcgtcacaattggag

SEQ ID NO: 316458 - DNA, 75 bp, Artificial Sequence
  Synthetic
aactctgcagctttccaaattggcattagacctgacggttacatggtgacgggtggatccattggtgttaatgtg

SEQ ID NO: 316459 - DNA, 75 bp, Artificial Sequence
  Synthetic
ccgcttgaacctgaaacccgattccaatacgttggaatcctccctttgtccgcagctttatctgggcccagtggg

SEQ ID NO: 316460 - DNA, 75 bp, Artificial Sequence
  Synthetic
aacatgggaagggccaaacgggtgttccaatgagttggttggtgggtgcccttcaaacttttgggtctttggctg

SEQ ID NO: 316461 - DNA, 75 bp, Artificial Sequence
  Synthetic
acgttgctggcactgtttctaacatagtgtaccagcagcgccaggccgctcaattggagaaacaaaatgaactaa

SEQ ID NO: 316462 - DNA, 75 bp, Artificial Sequence
  Synthetic
tggagacatggatgaacaaacaagaggcattgcaaaaatcccaaatggaattgacccgagacctctccatcaatg

SEQ ID NO: 316463 - DNA, 75 bp, Artificial Sequence
  Synthetic
gtccagctgcccgggtgcaatcagcactcgacgcaggtttcgatgcagtgagtgctcggcgcattgctggttcag

SEQ ID NO: 316464 - DNA, 75 bp, Artificial Sequence
  Synthetic
gtgagcgcgtgatatgggggaacttggatcgccccatcatgcacgctggcaccatggacagcatacgccaaacca

SEQ ID NO: 316465 - DNA, 75 bp, Artificial Sequence
  Synthetic
aacatttggactctctgagtcactcattggccacatttaaaaatggaaccccattcggaaaacctgcgcccccaa

SEQ ID NO: 316466 - DNA, 75 bp, Artificial Sequence
  Synthetic
cagcaaaatttggtaagccccaagccacaaccgcacaaatcactattggccataaccctggtagctccagtgtct

SEQ ID NO: 316467 - DNA, 75 bp, Artificial Sequence
  Synthetic
aaatttaaattttcttttctttgaaacggtcccacacgcgttcgggtgggttttagacaattaagcgattgtcac

SEQ ID NO: 316468 - DNA, 75 bp, Artificial Sequence
  Synthetic
attttcttttctttgaaacggtcccacacgcgttcgggtgggttttagacaattaagcgattgtcaccgttcccc

SEQ ID NO: 316469 - DNA, 75 bp, Artificial Sequence
  Synthetic
tgaacttcatcactactttgccaggcgtatgaacgcctggctcaagcatgccacaaggaccctcccagatgaata

SEQ ID NO: 316470 - DNA, 75 bp, Artificial Sequence
  Synthetic
tacgttcgttgaggagggtctccttgacatgtttggtacaaaggcccctgacagtgttcaagaaggtacactatt

SEQ ID NO: 316471 - DNA, 75 bp, Artificial Sequence
  Synthetic
ccgggagctgtttggggttgaccaaaccgaacagtttccgttgtcccttgcagacttggccaggctgcaggggga

SEQ ID NO: 316472 - DNA, 75 bp, Artificial Sequence
  Synthetic
acttgttgacgcaacccgcaccccaggacacgcattgcgtcaaaagtacacaatgaccactatacaggacttaat

SEQ ID NO: 316473 - DNA, 75 bp, Artificial Sequence
  Synthetic
taacaagatcaccaaggtcgtgccagtgcaggccacgctcacagagatgcacgcgcgtaggcaatttgagcgtga

SEQ ID NO: 316474 - DNA, 75 bp, Artificial Sequence
  Synthetic
gcgagctgacctgtttcacgaactcccactggtagatgaggatgctgtttcacaacccaaaacttatttttacac

SEQ ID NO: 316475 - DNA, 75 bp, Artificial Sequence
  Synthetic
catgtggcgccaagttgtgaagaaaggcaaagcgtacttctgcccccttgtcaagacgagtgcatggcgcaccaa

SEQ ID NO: 316476 - DNA, 75 bp, Artificial Sequence
  Synthetic
gatcagtgccataacagaacccattaaggatttcttaattgcgttttgccaggcagtgcaacaagaaatgggtgt

SEQ ID NO: 316477 - DNA, 75 bp, Artificial Sequence
  Synthetic
caacccgcagtatttacaacttgcctggctgcagaaactcaaacccaccacattgaccatcattcttcaacaaca

SEQ ID NO: 316478 - DNA, 75 bp, Artificial Sequence
  Synthetic
caagcacaccgtctcagggtggctggccaccatgacagcacttgtggaagtgtactcaaatttgtttgacgactt

SEQ ID NO: 316479 - DNA, 75 bp, Artificial Sequence
  Synthetic
gcgcaaatcatcagttgcaatcgtgtcaagcattggagctttctttgacatttgtaaagattttgtgtcgcaagt

SEQ ID NO: 316480 - DNA, 75 bp, Artificial Sequence
  Synthetic
cgtggagctggtcaaaacaacattcaccgctcaaggtccgacagacttggggtgggcagcagtgctggcaggggc

SEQ ID NO: 316481 - DNA, 75 bp, Artificial Sequence
  Synthetic
cgcaatgattttgctcaaaatgtctgggtgcccaggcgtcatcggcatgtggacaaaagtgcttaaaatctgtgg

SEQ ID NO: 316482 - DNA, 75 bp, Artificial Sequence
  Synthetic
aggcatcaccaccattacagcagcggcacgtggagtgcgctggctaaaggatctttatgaggaggctgaaggacg

SEQ ID NO: 316483 - DNA, 75 bp, Artificial Sequence
  Synthetic
taggctggcaaaaatgtacatggcacgcggtgccgcccttattgaacttgccgccagtcgtgaggtgacaggcat

SEQ ID NO: 316484 - DNA, 75 bp, Artificial Sequence
  Synthetic
tgacgagctcaagggtctccttgattgttttaccatattaattgaggagggtactgaacttatccacaagttcgg

SEQ ID NO: 316485 - DNA, 75 bp, Artificial Sequence
  Synthetic
cactagcccactggcaggcctggtgcgcacatatgtgtccgaactagaaacccaagcaaacaacattagatccac

SEQ ID NO: 316486 - DNA, 75 bp, Artificial Sequence
  Synthetic
cattaagcttgacacccctagacgggtgcccgttgtcatcatccttactggggcacctggcattggaaaaacccg

SEQ ID NO: 316487 - DNA, 75 bp, Artificial Sequence
  Synthetic
cttagcacaatatgttggccagcgctttgggaaaacgtccaatttttcagtagctgtggaccaccatgacggcta

SEQ ID NO: 316488 - DNA, 75 bp, Artificial Sequence
  Synthetic
cacagggaatactgtgtgcatatgggatgaatttgatgtcgattctaagggtgcgtttgtggagacaatgattgg

SEQ ID NO: 316489 - DNA, 75 bp, Artificial Sequence
  Synthetic
gatcgcaaacacggcacccttcccactaaattgtgacagggttgaaaataaagggcgtgtgttcacgtccgacta

SEQ ID NO: 316490 - DNA, 75 bp, Artificial Sequence
  Synthetic
tgtcatttgtacatctaactaccccacgtctgtcatcccagacaatccaagggctgcggccttttaccgcagggt

SEQ ID NO: 316491 - DNA, 75 bp, Artificial Sequence
  Synthetic
cctaactgttgatgtcagcgcgccagatttagaggaatggaaaaagaggaatcctggaaaacgtcccactccaga

SEQ ID NO: 316492 - DNA, 75 bp, Artificial Sequence
  Synthetic
atcctggaaaacgtcccactccagacctataccaagatgatttctctcatttaaagttgatgctcagaccatatt

SEQ ID NO: 316493 - DNA, 75 bp, Artificial Sequence
  Synthetic
tagccctaatggaaagaaggtttaaggaacaggctgggcctctgcagaacttgtggttacaggtccctagaccac

SEQ ID NO: 316494 - DNA, 75 bp, Artificial Sequence
  Synthetic
ttgtggagcagtctacaaacatggtcaaagcatttatgtatgccaaccgcgcagtgtgtgacgtgatacctaatc

SEQ ID NO: 316495 - DNA, 75 bp, Artificial Sequence
  Synthetic
ccgccacccgtgacatcaccgagactgcgttgtcaaaaatcttcgtgtgtggcactgccccaccacctgagtttg

SEQ ID NO: 316496 - DNA, 75 bp, Artificial Sequence
  Synthetic
ttggcaagcatatagtcatcactggcatagaggtaggtgacgcgtccattgccaactcattactgtccatgttta

SEQ ID NO: 316497 - DNA, 75 bp, Artificial Sequence
  Synthetic
ccaccaccacacgactgtctgccgcagctcagagagagtatatgtacagagtgtggagcccactcatccacatcc

SEQ ID NO: 316498 - DNA, 75 bp, Artificial Sequence
  Synthetic
aagaccgaagcataaacactcaaaacctcccatacatcaatagagtgatcccagtgacatcccactgggacttct

SEQ ID NO: 316499 - DNA, 75 bp, Artificial Sequence
  Synthetic
tgaggggtttgcggcaccaccttggtttcacatctattccaggcatgtggaaggcatttcaaggttggcgcacat

SEQ ID NO: 316500 - DNA, 75 bp, Artificial Sequence
  Synthetic
aaggcatttcaaggttggcgcacatcacagggcatagttgattttgtggcacatcatatggcagatgtcacattc

SEQ ID NO: 316501 - DNA, 75 bp, Artificial Sequence
  Synthetic
tgctttgccaccccagcacgagtgccgtatgttggtacaccacccaccacaatccactccaacacaccccgatgc

SEQ ID NO: 316502 - DNA, 75 bp, Artificial Sequence
  Synthetic
atgacttggggtgaaaccatagcactattgtgtgaggtggttgccgagtttgtcctccattttggtcctgtgatt

SEQ ID NO: 316503 - DNA, 75 bp, Artificial Sequence
  Synthetic
ttatctgcagccaacattgcctaccttatgaccaggggttcaaggactgaggaggccaagggtaaaaccaaacat

SEQ ID NO: 316504 - DNA, 75 bp, Artificial Sequence
  Synthetic
ggacgtggcatgcgccacggccatagggccggagtgagcctctcagacgatgagtatgatgagtggcgtgacttg

SEQ ID NO: 316505 - DNA, 75 bp, Artificial Sequence
  Synthetic
gatgaggatgtggccaggtacagagcatggcttgagatccgcgccatgcgaatggcaggtggtgcgtatacacat

SEQ ID NO: 316506 - DNA, 75 bp, Artificial Sequence
  Synthetic
gccactatcattggtcgtggtggtgtgcgagatgagatcatacgcacggcaccacgcagagccccaactcgaccc

SEQ ID NO: 316507 - DNA, 75 bp, Artificial Sequence
  Synthetic
caacaacactatgaggaagaggccccgacagcaatcgtggagttcacgcagggtggcgaccacattggatacggg

SEQ ID NO: 316508 - DNA, 75 bp, Artificial Sequence
  Synthetic
gtgcacattggcaatggcaatgtgataaccgttacccatgtggcatcaacgtccgacgaggtcaacggcagtgct

SEQ ID NO: 316509 - DNA, 75 bp, Artificial Sequence
  Synthetic
tttaaaataacacgtactgttggagagacaacgtgggtccaagggccattctcacaattaccacacatgcaaata

SEQ ID NO: 316510 - DNA, 75 bp, Artificial Sequence
  Synthetic
agacaacgtgggtccaagggccattctcacaattaccacacatgcaaataggcagtggctccccggtttacttca

SEQ ID NO: 316511 - DNA, 75 bp, Artificial Sequence
  Synthetic
atgtcagaataatgaatggttacccaaccaagaaaggtgattgtgggctgccctactttaattccagccgccagt

SEQ ID NO: 316512 - DNA, 75 bp, Artificial Sequence
  Synthetic
tggtggcgttgcacgccggtacggacacgcaaggtgaaacaaaagtggctcaacgtgttgtcaaggaggtcacca

SEQ ID NO: 316513 - DNA, 75 bp, Artificial Sequence
  Synthetic
cccaagatgaattccaatggaagggtttgccagtggtgaagtctggacttgacgttgggggcatgcccactggga

SEQ ID NO: 316514 - DNA, 75 bp, Artificial Sequence
  Synthetic
ctcggtaccataggtcccctgcgtggcccgaagaacagcctggtgagacacacgccccagcaccctttggtgcag

SEQ ID NO: 316515 - DNA, 75 bp, Artificial Sequence
  Synthetic
gagacaagaggtacacattttcacaaacagaaatgctagtgaatgggctaaagccctacacggaacccactgctg

SEQ ID NO: 316516 - DNA, 75 bp, Artificial Sequence
  Synthetic
gggtgccaccacagctcctgtcccgcgcggtcacacatgtacgatcgtacatagaaacaatcattggcacacatc

SEQ ID NO: 316517 - DNA, 75 bp, Artificial Sequence
  Synthetic
ggtctcctgtactgacatatcaccaagcatgtgagctgcttgaacggaccacttcatgtggtccgttcgtgcagg

SEQ ID NO: 316518 - DNA, 75 bp, Artificial Sequence
  Synthetic
gtcttaagggcgattactgggatgaagagcaacagcagtacaccggtgtgttagcaaaccacctcgaacaggcat

SEQ ID NO: 316519 - DNA, 75 bp, Artificial Sequence
  Synthetic
gggacaaggctaacaaagggatagcaccaaggaatgcctataaattggcacttaaagatgagcttaggccaattg

SEQ ID NO: 316520 - DNA, 75 bp, Artificial Sequence
  Synthetic
agaagaataaggctggtaaacgcaggttgttgtggggctgtgatgctgccaccacactcgtagccaccgcggcct

SEQ ID NO: 316521 - DNA, 75 bp, Artificial Sequence
  Synthetic
ttaaggctgtggctaccaggctacaggtggtaacgccaatgacaccggtcgctgttggcatcaacatggactctg

SEQ ID NO: 316522 - DNA, 75 bp, Artificial Sequence
  Synthetic
ttcaaatgcaagtgatgaatgactcattgaagggaggtgtcctttactgcctggactactctaaatgggattcca

SEQ ID NO: 316523 - DNA, 75 bp, Artificial Sequence
  Synthetic
cacaaaatcctgcagtaacagcagcatcactggccatattggagagattcgctgaaccccacccaatcgtgtctt

SEQ ID NO: 316524 - DNA, 75 bp, Artificial Sequence
  Synthetic
gtgccgttgaggcgctctcctcccctgcagagggctacgtcaatgatatcaagttcgtgacacgcggcggtctac

SEQ ID NO: 316525 - DNA, 75 bp, Artificial Sequence
  Synthetic
catctgggatgccattcacatctgttgttaattccatcaaccatatgatatatgtggcggcagccattctgcagg

SEQ ID NO: 316526 - DNA, 75 bp, Artificial Sequence
  Synthetic
catatgaaagtcacaatgtcccgtacactggtaatgttttccaagtggaaactgtccacacgtacggcgatgatt

SEQ ID NO: 316527 - DNA, 75 bp, Artificial Sequence
  Synthetic
gcatgtacagtgtgtgtcctgccactgcatcaatcttccacactgtgcttgcgaatctgacatcgtatggactta

SEQ ID NO: 316528 - DNA, 75 bp, Artificial Sequence
  Synthetic
aacccactgcagcagacaaaagtgatgcaatcaaaccaactaacacaccagtgtttttgaagaggacattcacac

SEQ ID NO: 316529 - DNA, 75 bp, Artificial Sequence
  Synthetic
aaaccccgcatggagttcgagcactgctagacatcacttccataactagacagttttactggctgaaagctaata

SEQ ID NO: 316530 - DNA, 75 bp, Artificial Sequence
  Synthetic
ggacatcagacccttctagcccgcccgcttttgatcgacaagcacgcagtgcgcaactggagaacgcgctagcct

SEQ ID NO: 316531 - DNA, 75 bp, Artificial Sequence
  Synthetic
atgcttcacaacatgggcctgtagtgtttgacaccgtgcgccaaattgccataaaaaccgcccaaggagagggac

SEQ ID NO: 316532 - DNA, 75 bp, Artificial Sequence
  Synthetic
gatggtgctgagcccacttgctcgttaggattttgggtttaccaaccattgctcaacccgttttccaccaccgcc

SEQ ID NO: 316533 - DNA, 75 bp, Artificial Sequence
  Synthetic
gtttcaacatgctgggtgtcagtggagaccaaaccaggtggtgattttgatttttgcctactaaggccaccaggt

SEQ ID NO: 316534 - DNA, 75 bp, Artificial Sequence
  Synthetic
cagcagatggaaaatggggtttcaccagaaggcctgttgcccaggcgcctaggttactcacgcggtaaccgtgtt

SEQ ID NO: 316535 - DNA, 75 bp, Artificial Sequence
  Synthetic
ggtggcttggtggttggtatgatcttggtggctgagcacaagcaggtcaacaggcattttaactccaattcagtc

SEQ ID NO: 316536 - DNA, 75 bp, Artificial Sequence
  Synthetic
acttttggttggtccacggcacctgtcaacccaatggcggcagaaattgtgacaaaccaagcacattcaacatcg

SEQ ID NO: 316537 - DNA, 75 bp, Artificial Sequence
  Synthetic
cgccatgcttggctttctattggtgctcaaaacaagggtccattgtttcccgggatacctaaccatttccccgac

SEQ ID NO: 316538 - DNA, 75 bp, Artificial Sequence
  Synthetic
tcgtgtgcatcaacaatcgtgggggccatggacacctcccttggtggccggccgtctactggggtatgtggacct

SEQ ID NO: 316539 - DNA, 75 bp, Artificial Sequence
  Synthetic
gccgtctactggggtatgtggacctgccataagttttcaaaacaatggtgatgtgtacgagaacgacacaccctc

SEQ ID NO: 316540 - DNA, 75 bp, Artificial Sequence
  Synthetic
aatgtcatgggaaatgtatacaggcaccaatcaaattagaggtcaggtcacaccaatgtctggcactaactacac

SEQ ID NO: 316541 - DNA, 75 bp, Artificial Sequence
  Synthetic
cttcacatccacaggtgcaaacacccttgtattgtggcaagagcgcatgctcagctatgatggacaccaagcaat

SEQ ID NO: 316542 - DNA, 75 bp, Artificial Sequence
  Synthetic
actgtactcgtcacaattggagaggacggccgagtactttcagaatgatatagtcaacatacctgaaaactctat

SEQ ID NO: 316543 - DNA, 75 bp, Artificial Sequence
  Synthetic
ggcagtgttcaatgtggaaaccaactctgcatctttccaaattggcatcagacctgatggttatatggtgacagg

SEQ ID NO: 316544 - DNA, 75 bp, Artificial Sequence
  Synthetic
gacctgatggttatatggtgacaggtggctccattggtatcaatgtgccgctcgaacccgaaacccgattccaat

SEQ ID NO: 316545 - DNA, 75 bp, Artificial Sequence
  Synthetic
aatgagttggttggtgggtgctctgcagacttttgggtctttggcagacgttgctggcactgtttccaacatagt

SEQ ID NO: 316546 - DNA, 75 bp, Artificial Sequence
  Synthetic
gtaccagcagcgccaggctgctcagttggaaaaacaaaatgaactaatggagacatggatgaataaacaagaggc

SEQ ID NO: 316547 - DNA, 75 bp, Artificial Sequence
  Synthetic
actgcagaaatctcaaatggaattaactcgggacctctccatcaatggtccagccgcccgggtgcaatcagcact

SEQ ID NO: 316548 - DNA, 75 bp, Artificial Sequence
  Synthetic
cgatgcaggttttgatgaagtgagtgcacggcgcattgctggttcaggtgaacgcgtgatatgggggaatttgga

SEQ ID NO: 316549 - DNA, 75 bp, Artificial Sequence
  Synthetic
tcgacccattatgcacgctggcactatggatagcatacgccaaactaaacatttggactctctgagtcattcttt

SEQ ID NO: 316550 - DNA, 75 bp, Artificial Sequence
  Synthetic
ggccacattcaaaaatggaactccatttggaaaacctgcacccccaacagcaaagtctggaaggcctcaggccac

SEQ ID NO: 316551 - DNA, 75 bp, Artificial Sequence
  Synthetic
aactgcacaaatcaatattggccacaaccctggtagtaccagtgtttaaatctaaattttcttttctttgaaacg

SEQ ID NO: 316552 - DNA, 75 bp, Artificial Sequence
  Synthetic
gtgatcgtgatgcctaattgccgtccgttgcctattgggcatttgcccaacaggattttcagcaccccacgactc

SEQ ID NO: 316553 - DNA, 75 bp, Artificial Sequence
  Synthetic
accccagggtgggtgtgggcgtgtgctaaagaagccatgtttaaactagagtggcttcaagatccggtggtcatt

SEQ ID NO: 316554 - DNA, 75 bp, Artificial Sequence
  Synthetic
cgaccgccggatgtttatgtcgcgcaaggggtggtggatgacttcttccgccccaagcgcgtcttacagggtgat

SEQ ID NO: 316555 - DNA, 75 bp, Artificial Sequence
  Synthetic
ccacagctcatagcccaggtattgcttggtgatgccagtggtccgctggttggccccgtttccatgcagcaactg

SEQ ID NO: 316556 - DNA, 75 bp, Artificial Sequence
  Synthetic
acatcattgctgcatgaagtctcgcaggcactgaatgaccacaaacaccccttggccaacagatacaccagagcc

SEQ ID NO: 316557 - DNA, 75 bp, Artificial Sequence
  Synthetic
tctttgcaaagatatgcagacaccttgtcaaattacatacccctagtggagatactcactgggccaaaagacctc

SEQ ID NO: 316558 - DNA, 75 bp, Artificial Sequence
  Synthetic
accccacgtgacgtgctcgagcaacttgcagctgggcgtgagtgggagtgcgtcccagatagtgccctcaaaaag

SEQ ID NO: 316559 - DNA, 75 bp, Artificial Sequence
  Synthetic
gttttccgggacatgtggcaatacatttgtgaggggtgtgacagtgtgtacatcaagttgcaagacgtgaagcgg

SEQ ID NO: 316560 - DNA, 75 bp, Artificial Sequence
  Synthetic
aagataccccacatcgacaccacagtgttaaagcagttcttcattacactcacagataccatatcaatggcaaca

SEQ ID NO: 316561 - DNA, 75 bp, Artificial Sequence
  Synthetic
gccctggacaccaagacctggcttgcacacatcttgggttggctcaaacccacttgtttggtgatgatcatgcaa

SEQ ID NO: 316562 - DNA, 75 bp, Artificial Sequence
  Synthetic
caacacatcaactccccccaggggtgggcagccacactaactgctcttgccgagctgtactacggcatcatgccg

SEQ ID NO: 316563 - DNA, 75 bp, Artificial Sequence
  Synthetic
ctgaccgaggtactcggttccattgccggctgggtcacagataaatttgctgatgtaaccactaatacctggggc

SEQ ID NO: 316564 - DNA, 75 bp, Artificial Sequence
  Synthetic
aagttcaaggcatggtgggacaatctttacacaccacaagccggcaatgacctgatcatattggggggtgttgtc

SEQ ID NO: 316565 - DNA, 75 bp, Artificial Sequence
  Synthetic
ggactggtgtactttatggtgtttggagacgcccccactcagatgttcaccaagaaattgatgaaggtgtgtggt

SEQ ID NO: 316566 - DNA, 75 bp, Artificial Sequence
  Synthetic
ttcatcacatccacagtggcagcgatcaaggctgccatgtggatagtggattattttaagcagcgtgagcatgaa

SEQ ID NO: 316567 - DNA, 75 bp, Artificial Sequence
  Synthetic
caccaggttcgcgttactctggcaaggtgggccgcactccaagaggtcatcaagcaaaacaggtgtgctggtctt

SEQ ID NO: 316568 - DNA, 75 bp, Artificial Sequence
  Synthetic
agcgaggtcaccaagttgaaagagtgctgtgaagtcttgttgaacgaagtcactgagctgatgtacaagccgggt

SEQ ID NO: 316569 - DNA, 75 bp, Artificial Sequence
  Synthetic
gcctcgcctttggcaggactgatacgcagcacctctgatgtcatacaaaccaccatcaatgatttggctcaactg

SEQ ID NO: 316570 - DNA, 75 bp, Artificial Sequence
  Synthetic
atggcgtacgacacccaacgtaagccccctgctatgattgtgtttggtgggcctccgggcataggcaaaacacgg

SEQ ID NO: 316571 - DNA, 75 bp, Artificial Sequence
  Synthetic
ctggttgaagctctggccaaacaacttggggaggtcagccacttcaccatgaccgttgaccactatgacacctac

SEQ ID NO: 316572 - DNA, 75 bp, Artificial Sequence
  Synthetic
acaggcaataccgtggcaatctgggacgagtttgatgtggattcaaagcaagctttcattgaggccaccattggc

SEQ ID NO: 316573 - DNA, 75 bp, Artificial Sequence
  Synthetic
attgtcaactgtgccccctaccccttaaactgtgaccggccagaggcaaagggcagagtgttcacatcaaaatac

SEQ ID NO: 316574 - DNA, 75 bp, Artificial Sequence
  Synthetic
gtgttggccactaccaactgtcccacaccagtcatgcccgaccacccgagagccatggcattctggcgtcgcata

SEQ ID NO: 316575 - DNA, 75 bp, Artificial Sequence
  Synthetic
actttcatcgacgttactgccccaacaatcgagcagtggttggttgacaaccccgggcgcaaggcaccttccagc

SEQ ID NO: 316576 - DNA, 75 bp, Artificial Sequence
  Synthetic
cttttcaaagaagacttttctcacctgcagtgttctgtgcgtgggtacactgcctacgatgaaaagggcaacacg

SEQ ID NO: 316577 - DNA, 75 bp, Artificial Sequence
  Synthetic
ctcaacggtaaggtggctcgagctagatatgtgtcagtcaacaacctgctcgatttaatcaaggagaaatacaac

SEQ ID NO: 316578 - DNA, 75 bp, Artificial Sequence
  Synthetic
agtgaagccactgacgtcaaacacttgtggttcaccgtaccacagggcatccacaagcaggctcgagacattata

SEQ ID NO: 316579 - DNA, 75 bp, Artificial Sequence
  Synthetic
ctgggttggctgcggttccactcctaccccaacacagtggccgacaacatacccctctctgaagttagggacccc

SEQ ID NO: 316580 - DNA, 75 bp, Artificial Sequence
  Synthetic
acttgttttgggtatgtggtgatttctgatgtggatccaccacgacatgtgagcgaccatgtggcacacattgaa

SEQ ID NO: 316581 - DNA, 75 bp, Artificial Sequence
  Synthetic
gtggagtcgatactgcgcactgacatcatggatctcctgagagagggaggtgggggcttgttcagggcgttgaag

SEQ ID NO: 316582 - DNA, 75 bp, Artificial Sequence
  Synthetic
gtgaagagcgccccccggagctgtgtgatcaataaagtcatgatgcaggcgcaccacaccactttacaggtgctt

SEQ ID NO: 316583 - DNA, 75 bp, Artificial Sequence
  Synthetic
acaagccaggaaccaaatccaccaaacctaccccgacccaggcgtttggtctttgttgagtcaccaattgacatc

SEQ ID NO: 316584 - DNA, 75 bp, Artificial Sequence
  Synthetic
attagcgccttgcgacatcatgtggggttctgcaccattccaggcatagtcaagttgatcacatctggagtgggt

SEQ ID NO: 316585 - DNA, 75 bp, Artificial Sequence
  Synthetic
ctgggtgtagagaatctgggcaatttcctgcagtccatcgctggtaatgtcaggtttcctttgcagtctgagtgc

SEQ ID NO: 316586 - DNA, 75 bp, Artificial Sequence
  Synthetic
tcactgctcaggacacccggtggtgatgtgctattttacacctctgggcaggctgcggtgtgggcaacacccgca

SEQ ID NO: 316587 - DNA, 75 bp, Artificial Sequence
  Synthetic
cgttttccaatcgtcactccaggagaggcgtccgttggcaaagatgtgtgttctgaatcctcctggtgggacatt

SEQ ID NO: 316588 - DNA, 75 bp, Artificial Sequence
  Synthetic
cttaaggccttgtttagcacgctagtggtggcctttggccccatagccacattggtgctcaccgcacacaacttg

SEQ ID NO: 316589 - DNA, 75 bp, Artificial Sequence
  Synthetic
gcctacctgaacacccgtgacaacaccctgagcgaggctaaagggaaaaacaaacgtggccgtggtgcccgcaag

SEQ ID NO: 316590 - DNA, 75 bp, Artificial Sequence
  Synthetic
gccatcgctctcagggatgatgagtatgatgagtggcaggacatcatccgtgactggcgcaaagagatgactgtc

SEQ ID NO: 316591 - DNA, 75 bp, Artificial Sequence
  Synthetic
cagcaattcctggaccttaaggagcgagccctgtcaggtgcttccgaccctgactcacaacgatacaatgcttgg

SEQ ID NO: 316592 - DNA, 75 bp, Artificial Sequence
  Synthetic
cttgaattgcgtgcaaagagacttagtgctggggcctaccaacacgcagttgtggacatcatcggaaaatcaggt

SEQ ID NO: 316593 - DNA, 75 bp, Artificial Sequence
  Synthetic
cacaggcgcgaagtgattcgcacacagatgatgcgtgcccctcgcgaaccaaaagcagacacctacgacagtgag

SEQ ID NO: 316594 - DNA, 75 bp, Artificial Sequence
  Synthetic
gggcgtggttacgtggtgcccatgactgcccaggaaaaacacacaggctgggcagtgcacattgggaatggcaga

SEQ ID NO: 316595 - DNA, 75 bp, Artificial Sequence
  Synthetic
ctggtcacctgcacgcacgtggccaacatgtgtgatcgcgtggccgatgtggagttcaagatcgctgaaacagat

SEQ ID NO: 316596 - DNA, 75 bp, Artificial Sequence
  Synthetic
cgtgacacatgcatcatcaccgccccgctcggccacctgcccagtgtcgcccttggggatggaccacctgccttc

SEQ ID NO: 316597 - DNA, 75 bp, Artificial Sequence
  Synthetic
tacaccaccaatttccaccctatccgcgtgctggacgagggtagctgggacaccacaaccacccgtgtcaccggt

SEQ ID NO: 316598 - DNA, 75 bp, Artificial Sequence
  Synthetic
tggcgtgtcattatcaacaatggcaccacaacagctcctggtgattgcggccaaccgtacttgaatgcacgccga

SEQ ID NO: 316599 - DNA, 75 bp, Artificial Sequence
  Synthetic
caacttgttggggtgcacgcagcaacaagcacatgtggggtgaagaagctcgtgtccagagtgcaatccaaaagg

SEQ ID NO: 316600 - DNA, 75 bp, Artificial Sequence
  Synthetic
gcgtcaaaaaccacattcccctggaaaggtctacctgttaccaacatgcccgacgctggtggtttgccaactggc

SEQ ID NO: 316601 - DNA, 75 bp, Artificial Sequence
  Synthetic
acacgttaccaccgctccaccgcatggcccaagcagttaccagaggaaacgcatgcccctgcaccttatggcgtg

SEQ ID NO: 316602 - DNA, 75 bp, Artificial Sequence
  Synthetic
aatgacccccggtaccccttctcccaacaccagatgattgccaacaacttgcagccatataccaaaactccagtt

SEQ ID NO: 316603 - DNA, 75 bp, Artificial Sequence
  Synthetic
gcattggaccaaacgctgttgcaacgcgctgtcaaacacacaaagggctacctagaccaggttattgggacacac

SEQ ID NO: 316604 - DNA, 75 bp, Artificial Sequence
  Synthetic
aggtctccaaatctcacctatgcagctgcagtggattcaatggcccacgacacggcatgtgggcccaacctgcct

SEQ ID NO: 316605 - DNA, 75 bp, Artificial Sequence
  Synthetic
ggccgcaagaaagattacatgacagaccaaggggagcccatcgggccactcaaacagatgttggaggaagcctgg

SEQ ID NO: 316606 - DNA, 75 bp, Artificial Sequence
  Synthetic
gacatggcacaccggggtgtccctcgcaggcacgagtacaagctcgcactcaaggacgaactccgacccatagaa

SEQ ID NO: 316607 - DNA, 75 bp, Artificial Sequence
  Synthetic
aagaatgaccagggcaaaagacgcctgctgtggggctgtgacgctggggtgtcattgatagccaattctgtgttc

SEQ ID NO: 316608 - DNA, 75 bp, Artificial Sequence
  Synthetic
aaacccgtggccgaacgactggtggacaccgtacccatgcaccccgtggctgttggcatatgcatggacagcccc

SEQ ID NO: 316609 - DNA, 75 bp, Artificial Sequence
  Synthetic
caaattgagcaaatgaaccaagctttgactggtagggtactgtactgcttggactacagcaagtgggactccaca

SEQ ID NO: 316610 - DNA, 75 bp, Artificial Sequence
  Synthetic
cagaacccagccgtcacgtgtgccagtgtcgacatcttggcctcctacgctgaggacacaccactcacctcagca

SEQ ID NO: 316611 - DNA, 75 bp, Artificial Sequence
  Synthetic
gccatagctacactgtgctcaccagccatcggccggctggatgacattggcttgactgtcaccacggggcttccc

SEQ ID NO: 316612 - DNA, 75 bp, Artificial Sequence
  Synthetic
tccggcatgccgttcaccagtgtcataaattctgtcaaccacatgatatattttgccatggctgtgctcgaggcc

SEQ ID NO: 316613 - DNA, 75 bp, Artificial Sequence
  Synthetic
tatgaggagtttaaggtgccctacatggggaacatctttgacaatgagaccgtctacacctatggggatgactgt

SEQ ID NO: 316614 - DNA, 75 bp, Artificial Sequence
  Synthetic
gtatacggcttgacaccagccacagcctcaatcatgcccgtggtggtcaagaatctgaccagttacggattggtc

SEQ ID NO: 316615 - DNA, 75 bp, Artificial Sequence
  Synthetic
acaccttttggtttgcgggccctgcttgatggggcaagcctggcgcggcagtgctactgggtcaaagccaaccgc

SEQ ID NO: 316616 - DNA, 75 bp, Artificial Sequence
  Synthetic
accacagacctttttgagccagcggccgttgatgtggagatcaggaagaaccagttggaggtcatgctcgcgtat

SEQ ID NO: 316617 - DNA, 75 bp, Artificial Sequence
  Synthetic
gccagccagcacccaagggcagtgtttgacaaacttgcaaacatggttgaggcgactgcacatgctgagggttat

SEQ ID NO: 316618 - DNA, 75 bp, Artificial Sequence
  Synthetic
caagtggtgaatgttgattgggccaacgcggtggcaacgtacaacgcatggtacggtggcactgacggtggccat

SEQ ID NO: 316619 - DNA, 75 bp, Artificial Sequence
  Synthetic
gctcccaccaatgaagatgaagagccagaagtgttcgtgatggaggcgcctgccccaacccgttcggtggcgagc

SEQ ID NO: 316620 - DNA, 75 bp, Artificial Sequence
  Synthetic
aacccagagggtactcaaactagtaatgaatccaggccagtccagccagccgggcctatgcccgtggccactgcc

SEQ ID NO: 316621 - DNA, 75 bp, Artificial Sequence
  Synthetic
caagcccttgagatggctgttgctactgggcaagtcaatgacaccatccccagtgtggttagagaaaccttcagc

SEQ ID NO: 316622 - DNA, 75 bp, Artificial Sequence
  Synthetic
acctacaccaatgttacttggaccacacgtcagccagcagggaccctgcttgcccggatgtccctagggccaggc

SEQ ID NO: 316623 - DNA, 75 bp, Artificial Sequence
  Synthetic
ctgaatccttacacactccacctatctgctatgtgggctggctggggagggtcatttgaaattaaggtgataata

SEQ ID NO: 316624 - DNA, 75 bp, Artificial Sequence
  Synthetic
tcagggtctggcttgtatgcgggcaaattactgtgtgcactcataccacctggggtggaccccagtgctgtagat

SEQ ID NO: 316625 - DNA, 75 bp, Artificial Sequence
  Synthetic
cagcctggggccttcccccatgcacttgtggatgcacgcatcactgagggcgtcaccttcacccttggggacgtc

SEQ ID NO: 316626 - DNA, 75 bp, Artificial Sequence
  Synthetic
agggcagtggattaccacgaaacaggagctggtgggaccatcgcatgcttggcactctacgtgtatcaaccactc

SEQ ID NO: 316627 - DNA, 75 bp, Artificial Sequence
  Synthetic
atcaacccgtttgaaactgccttgtcagccgccatggtgacaatcgagacccgccctggcccagactttgggttc

SEQ ID NO: 316628 - DNA, 75 bp, Artificial Sequence
  Synthetic
accctgctcaagcctccaaaccaaaccatggaagcagggcttgaccctaggtcgctcctgccccgcacggcaaga

SEQ ID NO: 316629 - DNA, 75 bp, Artificial Sequence
  Synthetic
acactgcggggaaataggtttggtagacccatcacagctgtggtcatagttggcatggcacaccaaattaatagg

SEQ ID NO: 316630 - DNA, 75 bp, Artificial Sequence
  Synthetic
cacttctcagccgagggcaccacgcttggctggtctacagccccaattggtccatgtgtgggccgcatcaattcc

SEQ ID NO: 316631 - DNA, 75 bp, Artificial Sequence
  Synthetic
aagtacactaacaccaccggtgccgctgtgctctccctgcaacccctgagcaatgggcccctttaccccaacatc

SEQ ID NO: 316632 - DNA, 75 bp, Artificial Sequence
  Synthetic
atcaaccactacccagatgtggccgcatcaagagcattcaacacaagcactagcctgagtgacagcaccacgtgt

SEQ ID NO: 316633 - DNA, 75 bp, Artificial Sequence
  Synthetic
gggggggggcccatggtggtcttcaatgatgtgggtgatgtggttgagaacgtgtcttaccaaatgagattcata

SEQ ID NO: 316634 - DNA, 75 bp, Artificial Sequence
  Synthetic
gcctcacaagccacctcccaaacacccacacttgttgattacatcaatgcaacatcaatggcagtgtgcagtttt

SEQ ID NO: 316635 - DNA, 75 bp, Artificial Sequence
  Synthetic
ggcaattctcgaggggactttggctcaggccagctcaacgtgggcgttgagttgacctacacctgtggcaacaca

SEQ ID NO: 316636 - DNA, 75 bp, Artificial Sequence
  Synthetic
caggccagctcaacgtgggcgttgagttgacctacacctgtggcaacacagcgatcaacgaaaaagtcaccacgt

SEQ ID NO: 316637 - DNA, 75 bp, Artificial Sequence
  Synthetic
cgcacacgggtaacaacactgtgtacagctcgcaacccgacactgtgtctgccgcattgcagggtcagccctaca

SEQ ID NO: 316638 - DNA, 75 bp, Artificial Sequence
  Synthetic
acataccagatgggtacatggccgtgtggaatgtcaacgcggacagtgccgattttcagataggcctgaggcgcg

SEQ ID NO: 316639 - DNA, 75 bp, Artificial Sequence
  Synthetic
gattttcagataggcctgaggcgcgacggcttctttgtcaccagtggggccatcggcacgcgcatggtcatttca

SEQ ID NO: 316640 - DNA, 75 bp, Artificial Sequence
  Synthetic
gcacgattggacaaatagtgttacacaacaagcagttgaatattcagaaatcttttaatcaggcacagatagagt

SEQ ID NO: 316641 - DNA, 75 bp, Artificial Sequence
  Synthetic
tggctaaagaacaattgaaacaaaaccaacaaatggccaaccagttttatgaatttaattcaaatttacctgcta

SEQ ID NO: 316642 - DNA, 75 bp, Artificial Sequence
  Synthetic
atcagtacaacagtgctgtgagtgccggttttgactcagtctctgcacgtcaactggctgggtcacacgaagtgc

SEQ ID NO: 316643 - DNA, 75 bp, Artificial Sequence
  Synthetic
gttactttggtgggcaacaaacacctttgctccaccaagggcagatgcaccaaatgatgttctcatcaaaacact

SEQ ID NO: 316644 - DNA, 75 bp, Artificial Sequence
  Synthetic
tgatgcaagcacaaaatgtgctcggcactttttcccgtgggacgcctggtgtgacccctagcaaggggttgccca

SEQ ID NO: 316645 - DNA, 75 bp, Artificial Sequence
  Synthetic
gtgacccctagcaaggggttgcccaaaccgcagggcatcacccccaggccgcagagcatcacagccaccgtacct

SEQ ID NO: 316646 - DNA, 75 bp, Artificial Sequence
  Synthetic
ctggttacgcgtaccgaaccttacacagtgtggcggctgtgggggaaaaaaaaaaaaaaaaaaaaaaaaaaaaaa

SEQ ID NO: 316647 - DNA, 75 bp, Artificial Sequence
  Synthetic
gtgattggttggtatggcttccaagccattctacccaattgagttcaaccgcaaggttgaaacaacagtcctctt

SEQ ID NO: 316648 - DNA, 75 bp, Artificial Sequence
  Synthetic
agagaggaaatttttgaaaccaagcaggacatgtacgcccatgtttgtcgagtggttgccggggtgtggcgcgaa

SEQ ID NO: 316649 - DNA, 75 bp, Artificial Sequence
  Synthetic
atattgcgtcgcatcccggtggtcagccccgttttcagtgcggaggggctcctagatgcttttgcatccaaaccc

SEQ ID NO: 316650 - DNA, 75 bp, Artificial Sequence
  Synthetic
ccagtggacattaaccctgacaccacatttcgtgagttgtttgggatagatccacatgaacaattcccattgtct

SEQ ID NO: 316651 - DNA, 75 bp, Artificial Sequence
  Synthetic
taataaacaaaattaccaagtacgtccccgttcaagccactctgactgagatgcaagcacgaagggcgcatgaga

SEQ ID NO: 316652 - DNA, 75 bp, Artificial Sequence
  Synthetic
gggaacgagcagacctattcaaggagctgccattggttgaccctgaggtaacccagcaacagaagtcctactttt

SEQ ID NO: 316653 - DNA, 75 bp, Artificial Sequence
  Synthetic
atgccatgtggcgacaggtggtaaagaaaggcaaggagtttttcatccccctggtgaagtgtacgtcatggagga

SEQ ID NO: 316654 - DNA, 75 bp, Artificial Sequence
  Synthetic
aaaagttctcagaaccagctgagattgtgcgccaaatcctcgtgcacttttgtgaaggtatgcgcgcacaattta

SEQ ID NO: 316655 - DNA, 75 bp, Artificial Sequence
  Synthetic
acacaaacgccaattacatcaatttgtcccttttggcgaaattgcgacccacagttttgactatgattttccaac

SEQ ID NO: 316656 - DNA, 75 bp, Artificial Sequence
  Synthetic
aacataaaaacacttaccgtggttggctcgccaccatcacagcccttgtcgaggtctattcaaatttgtttcagg

SEQ ID NO: 316657 - DNA, 75 bp, Artificial Sequence
  Synthetic
atatgcgtgagaccgcagtatctgcggtgtccgcaatcacactcctttttgagtccctgaagcagtttgtggaag

SEQ ID NO: 316658 - DNA, 75 bp, Artificial Sequence
  Synthetic
gagttattgaccttgtcaagggcaccttccaggcgcagggccctacgaactgtgggtgggccgccattgccgctg

SEQ ID NO: 316659 - DNA, 75 bp, Artificial Sequence
  Synthetic
gcgtcctcctaatccttctcaagatctctggctgccccaatgtcatgggatattggcagcgattattgaaagtgt

SEQ ID NO: 316660 - DNA, 75 bp, Artificial Sequence
  Synthetic
ctctggctgccccaatgtcatgggatattggcagcgattattgaaagtgtgtgctggtgtcacgaccgttgctgc

SEQ ID NO: 316661 - DNA, 75 bp, Artificial Sequence
  Synthetic
ggcccgcaccgctgccctgttggaacttgctgcgtcgcgagatgtcactggcacggaagaactaaaacggttgtt

SEQ ID NO: 316662 - DNA, 75 bp, Artificial Sequence
  Synthetic
agaatgtttcacccagctcattgaggagggcacggagctgattcaagagtttgggacatcacctatggcagggct

SEQ ID NO: 316663 - DNA, 75 bp, Artificial Sequence
  Synthetic
tgcacgatcttatgtcagtgagcttgaaactgccgctaatggcatcaggagcacaatccttttggacactccaag

SEQ ID NO: 316664 - DNA, 75 bp, Artificial Sequence
  Synthetic
aaaagtcccagtggcaataattctaactggtccaccgggtataggaaagacacaccttgcacagcacctagccgc

SEQ ID NO: 316665 - DNA, 75 bp, Artificial Sequence
  Synthetic
tggatttggcaagacatcaaacttttctgtcacgcttgaccaccatgactcctacacaggcaatgatgtggccat

SEQ ID NO: 316666 - DNA, 75 bp, Artificial Sequence
  Synthetic
ctgggacgagttcgatgtggacgcccagggcaagtttgtggagacaatgattggtgtggtaaacaccgctccata

SEQ ID NO: 316667 - DNA, 75 bp, Artificial Sequence
  Synthetic
ttggtgtggtaaacaccgctccatatcccttaaactgtgacagagtggaaaacaaaggtaaggtgtttacatcta

SEQ ID NO: 316668 - DNA, 75 bp, Artificial Sequence
  Synthetic
attacattatatgtactagcaattaccccacctctgttttgccagaaaacccgagggctggagccttttaccgcc

SEQ ID NO: 316669 - DNA, 75 bp, Artificial Sequence
  Synthetic
gtgtcaccacggtagatgtgtcatcccctatcattgatgattggaaaaagaagaaccctggtaagaaacctccat

SEQ ID NO: 316670 - DNA, 75 bp, Artificial Sequence
  Synthetic
tggacttgtacaagaaagatttctcgcatttgcgcctttccgtccgaccataccttggttacaatcccgaggggg

SEQ ID NO: 316671 - DNA, 75 bp, Artificial Sequence
  Synthetic
acactctggagggtgtccgtgtgaaacctatcctaaccagtgtcgacggcctgtcccgactcatggaaactaagt

SEQ ID NO: 316672 - DNA, 75 bp, Artificial Sequence
  Synthetic
tcaaagaacagggcaatgagatgcgcaacctttgggttacgtgtccccgtgacttggtgacacccgcagcatctg

SEQ ID NO: 316673 - DNA, 75 bp, Artificial Sequence
  Synthetic
gacttggtgacacccgcagcatctgggctgaaatcatacatggctgctaatagggcgttggcgcaagtcttcgca

SEQ ID NO: 316674 - DNA, 75 bp, Artificial Sequence
  Synthetic
tttgtgggcagacacgtgaaaataacagccattaatccttgggacgcatccctcgccaactcaatgttgtcaatg

SEQ ID NO: 316675 - DNA, 75 bp, Artificial Sequence
  Synthetic
tttgagactaacacacacataccagcagtcacccaaagggagatcatgtaccgtgtctggtcgcccctgatacac

SEQ ID NO: 316676 - DNA, 75 bp, Artificial Sequence
  Synthetic
cagtcacccaaagggagatcatgtaccgtgtctggtcgcccctgatacacatgcaaacccgggaaccgaacaccc

SEQ ID NO: 316677 - DNA, 75 bp, Artificial Sequence
  Synthetic
ttggactgtgttctatcaaaggcatgtggaaagcataccaggggtggcacagctccgcgacaatcctggagttcc

SEQ ID NO: 316678 - DNA, 75 bp, Artificial Sequence
  Synthetic
tgtctaaacatatggaagatgtcacattcccctccaacccggagtgtactgtgtttcgagctgcggatggggatg

SEQ ID NO: 316679 - DNA, 75 bp, Artificial Sequence
  Synthetic
tcatcttctacacatttggctcctatgcctgttttgtctccccagcacgggttccatttgttggggacccaccaa

SEQ ID NO: 316680 - DNA, 75 bp, Artificial Sequence
  Synthetic
aaaccgtccactccaacatcacacgcaacatgacgtggattgaaaccctgcgtttgcttgttgaaacaatcacgg

SEQ ID NO: 316681 - DNA, 75 bp, Artificial Sequence
  Synthetic
agagtttggcccactttggaccactgctgttgatggttcacaatgtggcatatttgacaactaggtcacaacgtg

SEQ ID NO: 316682 - DNA, 75 bp, Artificial Sequence
  Synthetic
acgaggaggccaaaggtaaaaccaaacacggcaggggggccagacacgcacgtcgcggtggagtgagcttgtcgg

SEQ ID NO: 316683 - DNA, 75 bp, Artificial Sequence
  Synthetic
atgacgagtatgatgagtggcgcgacctcgtgcgtgactggagacaggatatgactgttggggagttcgtcgagt

SEQ ID NO: 316684 - DNA, 75 bp, Artificial Sequence
  Synthetic
tgcgcgagcgctacgccctcggaatggactcagaagacgtgcaacggtaccgcgcttggttgcaacttcgtgcca

SEQ ID NO: 316685 - DNA, 75 bp, Artificial Sequence
  Synthetic
tgcggctaggtgcaggtgcctatcagcatgcaaccatcattgggcgcgggcgtgttgaggacaccatcatccgca

SEQ ID NO: 316686 - DNA, 75 bp, Artificial Sequence
  Synthetic
cacaacccatgcgcgctccacgtgcccctcgttccaccgggtatgatgaagaagccccaacaccgattgttacct

SEQ ID NO: 316687 - DNA, 75 bp, Artificial Sequence
  Synthetic
tcaccagcaatggggaccatgtgggttacggttgccacgttggcaacggtgtggtagtgacagtcactcatgtgg

SEQ ID NO: 316688 - DNA, 75 bp, Artificial Sequence
  Synthetic
gtggtagtgacagtcactcatgtggctgccgctgcggatgccgtggagggtttggaattctcggttaggaaaaca

SEQ ID NO: 316689 - DNA, 75 bp, Artificial Sequence
  Synthetic
tactactcaactcgattgcaccctgtcaccacaattgcagaaggtacgtatgaaacccccaacatcacagtccat

SEQ ID NO: 316690 - DNA, 75 bp, Artificial Sequence
  Synthetic
gggttccatctacgcatcatcaatggttaccccacaaaacgaggagattgcggcacaccgtacttcgactcgtgt

SEQ ID NO: 316691 - DNA, 75 bp, Artificial Sequence
  Synthetic
cgaaggctggtgggcctacatgccgccacatcaaccaatggggagactaagttggctcagaaagtgagtcgagtt

SEQ ID NO: 316692 - DNA, 75 bp, Artificial Sequence
  Synthetic
gttggctcagaaagtgagtcgagtttcaaaggtggaaaatgcttttgcctggaaggggttgcccgttttgcgagg

SEQ ID NO: 316693 - DNA, 75 bp, Artificial Sequence
  Synthetic
aacccatgctccggccccatttggtgctggtgactcccgttacaatttctcccaagtagaaatgttggtcacagg

SEQ ID NO: 316694 - DNA, 75 bp, Artificial Sequence
  Synthetic
gttgaaaccttattccgagcccacccctgggataccccctgcgctcctgcagcgggcagccactcacacccgcac

SEQ ID NO: 316695 - DNA, 75 bp, Artificial Sequence
  Synthetic
atacttggagtcaatagtcggcacacaccgatcccccaatctgacttacaacgaagcatgtgccttattggatcg

SEQ ID NO: 316696 - DNA, 75 bp, Artificial Sequence
  Synthetic
cagcacatcttgtggcccattcattgcaggccaaaagggggattactgggatgaagatcgccagtgttacacagg

SEQ ID NO: 316697 - DNA, 75 bp, Artificial Sequence
  Synthetic
ggtactggccgagcacctcggtaaggcctgggatgccgctaaccgcggcattgctccacaaaatgcctacaaact

SEQ ID NO: 316698 - DNA, 75 bp, Artificial Sequence
  Synthetic
ggccctcaaagatgaacttcggccaattgaaaagaaccagcaaggcaagcgtcgactgttgtggggttgcgacgc

SEQ ID NO: 316699 - DNA, 75 bp, Artificial Sequence
  Synthetic
tggggctactttggttgccacagcagccttcaaaggagttgctacgcgcctacaggcagttgcacccatgacacc

SEQ ID NO: 316700 - DNA, 75 bp, Artificial Sequence
  Synthetic
tgttggcgttggtattaacatggatagttgccaggtggaggtgctcaacgaatccctcaagggcggcgtcgtgta

SEQ ID NO: 316701 - DNA, 75 bp, Artificial Sequence
  Synthetic
ctgcctagactacagcaagtgggactccactcaacatcccgccgtaacagccgcgtccttagcaatcctcgagcg

SEQ ID NO: 316702 - DNA, 75 bp, Artificial Sequence
  Synthetic
gctgtctgaagcaacaccagtaacaacatcggccgtagagttactatcatcaccagcacgtggccacctgaatga

SEQ ID NO: 316703 - DNA, 75 bp, Artificial Sequence
  Synthetic
cataatctttgtgacaaagtctggactcccctcgggtatgccattcaccagcgttgttaattctcttaaccacat

SEQ ID NO: 316704 - DNA, 75 bp, Artificial Sequence
  Synthetic
gacatactttgcagctgcagtgctgaaggcctatgaacaacatggggcaccttacactggtaatgtgtttcaggt

SEQ ID NO: 316705 - DNA, 75 bp, Artificial Sequence
  Synthetic
agaaactgttcacacatatggtgatgattgcatttactccttatgcccggcgactgcttccatctttgaaactgt

SEQ ID NO: 316706 - DNA, 75 bp, Artificial Sequence
  Synthetic
tttggccaacctcagtgcctttggtctacggcccaccgctgccgacaagacagacaagatagtccccacccacac

SEQ ID NO: 316707 - DNA, 75 bp, Artificial Sequence
  Synthetic
accagtctttctaaagcgaactctcacctgtacaccaagaggtattcgtgggctcctcgacatctcgtcaattaa

SEQ ID NO: 316708 - DNA, 75 bp, Artificial Sequence
  Synthetic
gcggcaattcttctggattaaggccaaccgcactacagatatatcatccccgcccgcctacgacagggaggcccg

SEQ ID NO: 316709 - DNA, 75 bp, Artificial Sequence
  Synthetic
gagtgtgcagcttgaaaatgccctagcctacgcttcacaacatggccatgcaatttttgaggagattgctgaaat

SEQ ID NO: 316710 - DNA, 75 bp, Artificial Sequence
  Synthetic
agcgtggtttataggtggtgcaggcaccggccaggatagccccagtgaagagactaccaaattagtgtttgaaat

SEQ ID NO: 316711 - DNA, 75 bp, Artificial Sequence
  Synthetic
ggagggcaatgctcgccccgaggggcaaaaccccgagcgctcgaatgtgccactggcttccccacaggacaccat

SEQ ID NO: 316712 - DNA, 75 bp, Artificial Sequence
  Synthetic
tggcccaagtgctgcgctcttgctcccaactcaaattgaaactccaaacgccactgcacagcgcgtggagctggc

SEQ ID NO: 316713 - DNA, 75 bp, Artificial Sequence
  Synthetic
agctgcaaccggagcaatcaccagcaatgttcctagttgcattagggagtgctttgccagcgtcaccacgctccc

SEQ ID NO: 316714 - DNA, 75 bp, Artificial Sequence
  Synthetic
ctggaccactcgccaagcagccaacacgttcttgggtgcaatccatcttggtccgaggatcaatccctacaccgc

SEQ ID NO: 316715 - DNA, 75 bp, Artificial Sequence
  Synthetic
gcacatgagcgccatgtttgcaggatggggaggtagtttccaggttcgtgtcacactctctggctcaggactctt

SEQ ID NO: 316716 - DNA, 75 bp, Artificial Sequence
  Synthetic
tgcgggacgtgctgtcgtggctgttttaccaccaggggtcaacccggcaaatgtgcaaaatccaggggtttttcc

SEQ ID NO: 316717 - DNA, 75 bp, Artificial Sequence
  Synthetic
gcatgcgttcatcgacgcgcgcaccgtggatcccatcctgatcaacctgccagacattcgagcagttgattatca

SEQ ID NO: 316718 - DNA, 75 bp, Artificial Sequence
  Synthetic
tcgggtcgacggtgacgaacctactgccaccgttggcctctgggttgcacaaccactcatcaacccttttcagac

SEQ ID NO: 316719 - DNA, 75 bp, Artificial Sequence
  Synthetic
tggctcgatatccacgtgttggctgagttttgagacgcgccccggtccagactttgatttctgtctcctcaaggc

SEQ ID NO: 316720 - DNA, 75 bp, Artificial Sequence
  Synthetic
acccgagcaggagatggacaatggcgtctcccccgcaaatctgcttccgcggcgccttgggcgatctcgaggcaa

SEQ ID NO: 316721 - DNA, 75 bp, Artificial Sequence
  Synthetic
ccgccttggtggtcgtataacaggtttggtggtggtggccgtggcggaacaagtaaaccaccactttgcagccaa

SEQ ID NO: 316722 - DNA, 75 bp, Artificial Sequence
  Synthetic
ctcaacaactcttggctggtcaacgctcccaattgaaccaatcgcgggagccgtgtcctggtacaagtccactgc

SEQ ID NO: 316723 - DNA, 75 bp, Artificial Sequence
  Synthetic
ctccaacagtgtccgggggttaattggggctgcaggcaagggcatcatcttcccaaacattgtcaaccactggac

SEQ ID NO: 316724 - DNA, 75 bp, Artificial Sequence
  Synthetic
agatgtagcactctctgccaaaaactcgggccaaaccagtctacccgcccccaatgctgacatgagcggctaccc

SEQ ID NO: 316725 - DNA, 75 bp, Artificial Sequence
  Synthetic
gggggcttccggccccgtggtgatgttccagaacaatggagatgtcaatgagagctcagctaaccatggcatact

SEQ ID NO: 316726 - DNA, 75 bp, Artificial Sequence
  Synthetic
tactgcagccaatcatgactttaccacattgacacagacttttgatgctgctggcacgtggatttggatgccttg

SEQ ID NO: 316727 - DNA, 75 bp, Artificial Sequence
  Synthetic
gacttcaacccaacctgatggtacacagaacaacaacgtgtacatcaatccaatctggatcaatggcaactcttc

SEQ ID NO: 316728 - DNA, 75 bp, Artificial Sequence
  Synthetic
ccaccccatacacggcaagtgcacaaacatgaccggcaccaactttcaatttggtggcactggtaccaacaatat

SEQ ID NO: 316729 - DNA, 75 bp, Artificial Sequence
  Synthetic
catgttgtggcaggaacagcactttacttcgtggccaggggcagcagaggtctactgttcccagcttgagagcac

SEQ ID NO: 316730 - DNA, 75 bp, Artificial Sequence
  Synthetic
tgcagagatgtttcaaaacaatatagtcaacattcctgctaatcaaatggcagtgttcaatgtggagactgctgg

SEQ ID NO: 316731 - DNA, 75 bp, Artificial Sequence
  Synthetic
gaacacattccaaattggcatcttgccaaatggctactgtgtcacaaatgctgctgttggtacacaccaactcct

SEQ ID NO: 316732 - DNA, 75 bp, Artificial Sequence
  Synthetic
tgactttgaaactgcatttaggtttgttggtcttttcccccaaagtacaacacttcaagggcccaatgggaacgc

SEQ ID NO: 316733 - DNA, 75 bp, Artificial Sequence
  Synthetic
tggtcgggccgtcagatttcttgaataatgtcttggttcacaggtgcagctcttgccgctggttctgtcgtaaac

SEQ ID NO: 316734 - DNA, 75 bp, Artificial Sequence
  Synthetic
atggccggcaccatttcatctattgtggcacagcacaggcaattggatctaatggcgcaagctaacaaaattcaa

SEQ ID NO: 316735 - DNA, 75 bp, Artificial Sequence
  Synthetic
caggagtgggtgacaaagcaggaggcattggctcgacggggtcaagatatttctcaggatttggccatcaatggc

SEQ ID NO: 316736 - DNA, 75 bp, Artificial Sequence
  Synthetic
actgccaagcgggttgagtccctcattaattctggattcaccccagtagatgcccgccgccttgccggtggtact

SEQ ID NO: 316737 - DNA, 75 bp, Artificial Sequence
  Synthetic
gaaaccgtgcagtatggactgctggacagacccattctgcaccgagaggttctcacaggcatctctgaaacacac

SEQ ID NO: 316738 - DNA, 75 bp, Artificial Sequence
  Synthetic
cacctccagtcaatgcaaggggttctcagtgctttcaaacaggggtccaagtatggtgctcctccggcacctgct

SEQ ID NO: 316739 - DNA, 75 bp, Artificial Sequence
  Synthetic
ggtttcatcaatccaaattaccaatctgcacccccccgagtgaatttgggtttccgacccccatctaccaatgtg

SEQ ID NO: 316740 - DNA, 75 bp, Artificial Sequence
  Synthetic
taaatattcttttaattcttttctgtcttttctttcttccattccgtggttcctcacgcgtccgggtggacaatt

SEQ ID NO: 316741 - DNA, 75 bp, Artificial Sequence
  Synthetic
cttccattccgtggttcctcacgcgtccgggtggacaattgcgattaagcgatcgcagccacgtctctcttatgg

SEQ ID NO: 316742 - DNA, 75 bp, Artificial Sequence
  Synthetic
gtgattggttagtatggcttctaagccattctaccctattctattcaactgtaaggttgagtattcagtgctcag

SEQ ID NO: 316743 - DNA, 75 bp, Artificial Sequence
  Synthetic
ccattctaccctattctattcaactgtaaggttgagtattcagtgctcagatcggctcacctcagggtgagtggt

SEQ ID NO: 316744 - DNA, 75 bp, Artificial Sequence
  Synthetic
cccgtggacatcaacccagacacgacgtttcgtgagttatttggagttgaccctcacgaacagttccccttgtcc

SEQ ID NO: 316745 - DNA, 75 bp, Artificial Sequence
  Synthetic
ctgggacgagtttgatgttgacacacaaggcaagttcgttgagaccatgattggtattgtcaacacggcaccata

SEQ ID NO: 316746 - DNA, 75 bp, Artificial Sequence
  Synthetic
ttcatgcaacaacccaccacccacattcattggacgcgttgtaaaaatcacagctattaacccatgggacgcctc

SEQ ID NO: 316747 - DNA, 75 bp, Artificial Sequence
  Synthetic
cgcttgcttgctgagacggtgacggagtgcctagcgcatttcggcccgttcttgctcatgttgcacaacgtgtcc

SEQ ID NO: 316748 - DNA, 75 bp, Artificial Sequence
  Synthetic
cgggcctacgagcaacacggggccccctacaccggaaatgttttccaagttgaaacagtccacacttatggagat

SEQ ID NO: 316749 - DNA, 75 bp, Artificial Sequence
  Synthetic
acctgcacgcctcgtggcgtacgggggctcttggacatctcctccatcaagaggcaattcctttggatcaaggcc

SEQ ID NO: 316750 - DNA, 75 bp, Artificial Sequence
  Synthetic
tggactaccatcgcaccgatggccaggaagccaccagcaccctgggtttctgggtgttgcaacccctcatcaatc

SEQ ID NO: 316751 - DNA, 75 bp, Artificial Sequence
  Synthetic
atctaacacccgagtgcactttcacttttgttggtcttttccccttcacttcccccctcaatgggcctcatggga

SEQ ID NO: 316752 - DNA, 75 bp, Artificial Sequence
  Synthetic
ctgggcgaggcagaagtgtttaccaatgagttggttggtgggagcactccagcttggcggtgcgcttgttgacgc

SEQ ID NO: 316753 - DNA, 75 bp, Artificial Sequence
  Synthetic
aataacagaccggcagtcaacattggacacaacccaggctcatcatctgcctgatttaccctctttcatttcttt

SEQ ID NO: 316754 - DNA, 75 bp, Artificial Sequence
  Synthetic
tcttttcttttccgactggcactcacgcgttcgggagtataatgccaattaagcgattggctctcgctacctacc

SEQ ID NO: 316755 - DNA, 75 bp, Artificial Sequence
  Synthetic
atgaggaagcaaagggtaaaacaaaacatggccgcggtgcaaagcactcacgcagggggggagtcagcctgtctg

SEQ ID NO: 316756 - DNA, 75 bp, Artificial Sequence
  Synthetic
tcacttccggtgatgagcacattggttatggttgccacttgggcaatggcgtggttgtgactgtcacgcatgttg

SEQ ID NO: 316757 - DNA, 75 bp, Artificial Sequence
  Synthetic
caaatctcggccacctgccccattaccaacttggggagggtgccccggtctattactcagcccgcctccacccag

SEQ ID NO: 316758 - DNA, 75 bp, Artificial Sequence
  Synthetic
acctgcacgcctcgtggcgtacgggggctcttggacatatcctccatcaaaaggcaattcctttggatcaaggcc

SEQ ID NO: 316759 - DNA, 75 bp, Artificial Sequence
  Synthetic
caggaacaactggcccgacttcgtcggcagtggtggtggcaaatcctgaccaaccttctacccaggcccaacgca

SEQ ID NO: 316760 - DNA, 75 bp, Artificial Sequence
  Synthetic
tcccaaatcattggcccgactcttgtgcctcgtctgtcattgcaacttgggacggctcacttcaccgcccagacc

SEQ ID NO: 316761 - DNA, 75 bp, Artificial Sequence
  Synthetic
gacagtgctacctcagggtagcacctagggaggaattcctatttgacaacacactggaaacaattgcccagtatt

SEQ ID NO: 316762 - DNA, 75 bp, Artificial Sequence
  Synthetic
tgttgaagcacatgcctagatcccacaagtttaacatggggcaagcttgtgagtttgaggctgaggggttgctgt

SEQ ID NO: 316763 - DNA, 75 bp, Artificial Sequence
  Synthetic
ataacaaccaatttgtaaccaaacatggtaaggcaaatgtgcaggcattactggaacagttgaaccagcttgtgc

SEQ ID NO: 316764 - DNA, 75 bp, Artificial Sequence
  Synthetic
cacgggatgtttctgaggccgaacggcggcgacgtgaattctttgaacgtcaaaccgctgcagcatttgcagaac

SEQ ID NO: 316765 - DNA, 75 bp, Artificial Sequence
  Synthetic
tccccaatgatgattctttcacagagcatgactggaagagttattggtatgctatgtggcgacgtgtggttgggg

SEQ ID NO: 316766 - DNA, 75 bp, Artificial Sequence
  Synthetic
attgtgtcactgccctcaaaccaacagtcctcaccatgatctaccagcaacatcataacaccccgagcgggtggt

SEQ ID NO: 316767 - DNA, 75 bp, Artificial Sequence
  Synthetic
ggttttccaaccctcccttcctaatctgggcacattgggtgcctccgtggcaaccactttgggattggttgtgac

SEQ ID NO: 316768 - DNA, 75 bp, Artificial Sequence
  Synthetic
aggctgggttgcaattgtggctggggtcttgctgcttttgttaaaactgtcgtgcattccaaaagtcttcactca

SEQ ID NO: 316769 - DNA, 75 bp, Artificial Sequence
  Synthetic
cgtgcattccaaaagtcttcactcattggcacacacttctaaaacttgctagtggaatcaccacagttgttggag

SEQ ID NO: 316770 - DNA, 75 bp, Artificial Sequence
  Synthetic
gtcgtgtttctgcattgttggaactccactattctaaaacagtcactggtgttgcagagaacactgaattgctca

SEQ ID NO: 316771 - DNA, 75 bp, Artificial Sequence
  Synthetic
gttgcagagaacactgaattgctcaaatgttttgaccaactgattgatgagggcgaggaattggtgtccgaaatt

SEQ ID NO: 316772 - DNA, 75 bp, Artificial Sequence
  Synthetic
ccgtgctggagccttttaccgtcgaatcattacggtggatgtgcgttcccctgaaattgaagattggatgtcagc

SEQ ID NO: 316773 - DNA, 75 bp, Artificial Sequence
  Synthetic
acacccagggcgttccccacctaagacactttttaaaaatgactgctcccatttgaaattaatggttcggcctta

SEQ ID NO: 316774 - DNA, 75 bp, Artificial Sequence
  Synthetic
acatgatttgattgataagaagtttgaagagcagtctggtgaggtcaggggtttgtggatcaccgtgcccagaag

SEQ ID NO: 316775 - DNA, 75 bp, Artificial Sequence
  Synthetic
gagtgttcagccagcactggccgcagtgaagaagttttgcgtggcgcaccaggcactttgccatgtcacctccac

SEQ ID NO: 316776 - DNA, 75 bp, Artificial Sequence
  Synthetic
acccacaccagaggtgttgcagtgcaccactttctcatgtgtcgtggtttcagacgctcacccacctccaggagt

SEQ ID NO: 316777 - DNA, 75 bp, Artificial Sequence
  Synthetic
accactttctcatgtgtcgtggtttcagacgctcacccacctccaggagtgcctttgattcacatcaaaaatgcc

SEQ ID NO: 316778 - DNA, 75 bp, Artificial Sequence
  Synthetic
caacgtgtctcttcaaatgtacaacgggatatcatgtacaaggtgtggtcgcccttcacactgatgcaaactgag

SEQ ID NO: 316779 - DNA, 75 bp, Artificial Sequence
  Synthetic
gaaacatctccctgacacatcctccatgatagagtggattacggaccatttgtcccaggtgcagttcccacttaa

SEQ ID NO: 316780 - DNA, 75 bp, Artificial Sequence
  Synthetic
ctgttgccccgtttgcaattgctgtggcaaatgttacttatctcacaacccgcggggcacgtgaagagcaggcaa

SEQ ID NO: 316781 - DNA, 75 bp, Artificial Sequence
  Synthetic
atgagtggatggatttacgtcgtgactggcgggaggaaatgactgccgatcagttcttgcagctccgggatgagg

SEQ ID NO: 316782 - DNA, 75 bp, Artificial Sequence
  Synthetic
ctggtgcttaccaacacgctactattattggcaaaggtggggttagaaatgaaattatccgcacacaagtaatga

SEQ ID NO: 316783 - DNA, 75 bp, Artificial Sequence
  Synthetic
aggcaccaagaaaaggtaagtggtcacatattgactcatctggacccatgaattattttgatgaagcccccacac

SEQ ID NO: 316784 - DNA, 75 bp, Artificial Sequence
  Synthetic
cattggtggagtttgaaagcgatggcagccacattggttggggtgtacaccttggtaatgggcgcattgtaactg

SEQ ID NO: 316785 - DNA, 75 bp, Artificial Sequence
  Synthetic
cttggtaatgggcgcattgtaactgtcacccatgttgcaacttcatccaacacagttaatggggtgcccttcaaa

SEQ ID NO: 316786 - DNA, 75 bp, Artificial Sequence
  Synthetic
ggccctcctgtttattacacaaccagattccacccggtcttggtgattggagagggacaatatgacacacccacc

SEQ ID NO: 316787 - DNA, 75 bp, Artificial Sequence
  Synthetic
agagggacaatatgacacacccaccacaaccgtcaatggcttccatgtaaagattaccaattcttacccaacaaa

SEQ ID NO: 316788 - DNA, 75 bp, Artificial Sequence
  Synthetic
attattggtagtgaacagagtcccagtctgtcatatggagtggcagcaagtatgttggaacgtggcacttcctgt

SEQ ID NO: 316789 - DNA, 75 bp, Artificial Sequence
  Synthetic
ggcccacacgttccaggtttgaaatctgactattgggatgaggaaacatgccaattcacaggagcattacgggaa

SEQ ID NO: 316790 - DNA, 75 bp, Artificial Sequence
  Synthetic
cacctcgagcaagtgtggaacaaagctttacttggcacacccccaagccacgattacaagttagctttgaaagat

SEQ ID NO: 316791 - DNA, 75 bp, Artificial Sequence
  Synthetic
ctttacttggcacacccccaagccacgattacaagttagctttgaaagatgaattgagaccaaacgagaaaaatg

SEQ ID NO: 316792 - DNA, 75 bp, Artificial Sequence
  Synthetic
cagcagtacggttgcagagtgtcgtccctatgacaccagtggctgtaggtatcaatatggactcagcccacattg

SEQ ID NO: 316793 - DNA, 75 bp, Artificial Sequence
  Synthetic
aggtcatgaacgagtccctcaagggacgagtgttgtatgccctggactacagcaaatgggacagcacacagtccg

SEQ ID NO: 316794 - DNA, 75 bp, Artificial Sequence
  Synthetic
agcaaatgggacagcacacagtccgccgctgtcactgctgcatccctggagattctttcatccttcatggagcca

SEQ ID NO: 316795 - DNA, 75 bp, Artificial Sequence
  Synthetic
aatcaaccacatgctgtacatctcctcagccatcctgcaagcatatgagtccatgggcctgccatacaatgacaa

SEQ ID NO: 316796 - DNA, 75 bp, Artificial Sequence
  Synthetic
gaagtggcactcgcttatgcaagtcagcatggccatgaatttttcgagaaggccagggagatcgcggagaggacc

SEQ ID NO: 316797 - DNA, 75 bp, Artificial Sequence
  Synthetic
acaaccacttatcaaccccttttcaaatgaagcagtgtccactgcttggatctctattgaaaccaaacccggagg

SEQ ID NO: 316798 - DNA, 75 bp, Artificial Sequence
  Synthetic
aatgaagcagtgtccactgcttggatctctattgaaaccaaacccggaggagattttgatttgtgcttactaaaa

SEQ ID NO: 316799 - DNA, 75 bp, Artificial Sequence
  Synthetic
ggatggtgatagttggctcagcacaccaagttaaccgccatttcaccgcccttggtaccaccttcgggtggtcca

SEQ ID NO: 316800 - DNA, 75 bp, Artificial Sequence
  Synthetic
tgcggactacattccttacaatgctattgtgggaacactggtttcatttgctgacaatggtgatgtgtctgaaaa

SEQ ID NO: 316801 - DNA, 75 bp, Artificial Sequence
  Synthetic
tgaggtggccacagccttcgcagtgtctatgaacacgccatccactggcgggcgtggcacgctgcgtgaaaactt

SEQ ID NO: 316802 - DNA, 75 bp, Artificial Sequence
  Synthetic
tgacccttcgaccatgcatcttgtgcgtaccaactcaactgcacaacccgctgactggccatcaggctcaaatac

SEQ ID NO: 316803 - DNA, 75 bp, Artificial Sequence
  Synthetic
tggcaatggatatttcacaccaatgtggggccacggtagtggaaatgcaatcaatgacaaagttaccaacatgga

SEQ ID NO: 316804 - DNA, 75 bp, Artificial Sequence
  Synthetic
tttccccctctctgcttcacttgtcggcccacatgggaatactggccgggcccaaattgcttggtcatgagctgg

SEQ ID NO: 316805 - DNA, 75 bp, Artificial Sequence
  Synthetic
ctagttggggcacttcaaactcttggtgggcttactgatgtggcttctaccatttccggtgtagtctaccaacag

SEQ ID NO: 316806 - DNA, 75 bp, Artificial Sequence
  Synthetic
tttgatgtggttagtgcacgccagcttgctggttcgggtgaacgcagaattaatggctatctggaacaacccatc

SEQ ID NO: 316807 - DNA, 75 bp, Artificial Sequence
  Synthetic
taatggctatctggaacaacccatccggaccattggcgaggccatggccgtgcaatcaaggggtaacctcaccac

SEQ ID NO: 316808 - DNA, 75 bp, Artificial Sequence
  Synthetic
gtgattggttagtatggcttccaagccattctacccaatagagttcaacccgagtgttgagcttcaagtgctccg

SEQ ID NO: 316809 - DNA, 75 bp, Artificial Sequence
  Synthetic
atcggcccacctcagggtgggtggtcgtgagcaaatgtttgaaaccattaatgacctcaatgatcatgtcagggg

SEQ ID NO: 316810 - DNA, 75 bp, Artificial Sequence
  Synthetic
tgtggtggccaaactgtggtgcaagcatttgcaccgtagtttggctgccgcccccacattcacggaggagggctt

SEQ ID NO: 316811 - DNA, 75 bp, Artificial Sequence
  Synthetic
gttagactctttcctttcaaaaccaccggttgacatcaatcctgacacaacgttccgtgagctgtttggtattaa

SEQ ID NO: 316812 - DNA, 75 bp, Artificial Sequence
  Synthetic
tccccacgagcagttcccgctgtccattcatgatttggcaaaattacagggtgagcttgtggatgcggcacgcaa

SEQ ID NO: 316813 - DNA, 75 bp, Artificial Sequence
  Synthetic
cccaggccatgtgttgcggcgtcattattccaccgattcgctcaccgccctaattaacaaaatcacgaaatttgt

SEQ ID NO: 316814 - DNA, 75 bp, Artificial Sequence
  Synthetic
ccctgtgcatgccacacttcaagaaatgcaagcacgccgtgctttcgagcgagagcgcgcggagctgtttaggga

SEQ ID NO: 316815 - DNA, 75 bp, Artificial Sequence
  Synthetic
actgccacatgctgatttggatgtaagtcgccaacaaaagtcgtacttttatgccatgtggcgtcaggtggttaa

SEQ ID NO: 316816 - DNA, 75 bp, Artificial Sequence
  Synthetic
gaagagcaaagagtttttcatccccctggtcaaatgtacatcttggcggaagaagtttacagagcctgcggaaat

SEQ ID NO: 316817 - DNA, 75 bp, Artificial Sequence
  Synthetic
tgttagacaggttctggtccacttttgtgaagggatgaggtcgcagttttccaccaatgcaaattacatcaattt

SEQ ID NO: 316818 - DNA, 75 bp, Artificial Sequence
  Synthetic
gtccctcattgccaaactccggccaacagtcctcacaatgattctccagcaacacaagaacacctacagagggtg

SEQ ID NO: 316819 - DNA, 75 bp, Artificial Sequence
  Synthetic
gttggcaacagtcactgctttggttgaagtgtactccaacctgtttcaagacatgcgggacaccgctgtctcagc

SEQ ID NO: 316820 - DNA, 75 bp, Artificial Sequence
  Synthetic
agtgtcagccattacactggtgtttgaaaccattaaggactttgtagtcaatgtgatagaccttgttaagagcac

SEQ ID NO: 316821 - DNA, 75 bp, Artificial Sequence
  Synthetic
gttccagtcacaaggcccaacatcttgcggctgggctgctatcattgctggtgcactgctcatcttaatgaaatt

SEQ ID NO: 316822 - DNA, 75 bp, Artificial Sequence
  Synthetic
gtcagggtgctccaacaccacaagttattggcaccgactcctcaaggtgtgtgggggtgtcactaccattgctgc

SEQ ID NO: 316823 - DNA, 75 bp, Artificial Sequence
  Synthetic
ggcggcccgtgctgtcgtgtgggtgcgagacatcatagcagaagctgatggcaaggctagactgaaaaagtacat

SEQ ID NO: 316824 - DNA, 75 bp, Artificial Sequence
  Synthetic
ggcccgcacagcagctctacttgagcttgcagcatctcgagacgtgacgggcactgatgaactcaagcgcctatt

SEQ ID NO: 316825 - DNA, 75 bp, Artificial Sequence
  Synthetic
agattgtttcacacagctcatcgaggagggtactgagttgatacaggaatttggtacatcaccacttgctggtct

SEQ ID NO: 316826 - DNA, 75 bp, Artificial Sequence
  Synthetic
gactaggtcatatgtgagtgagcttgagtcaactgcaaacagtatcaggagcaccatcctcctagacacaccccg

SEQ ID NO: 316827 - DNA, 75 bp, Artificial Sequence
  Synthetic
aaagactccagttgcaatcatcctcactggtcctcctggtataggcaaaacaaggcttgcacagcaccttgctgc

SEQ ID NO: 316828 - DNA, 75 bp, Artificial Sequence
  Synthetic
aggttttggcaaagtgtcaaacttttccgtcacgttggaccaccacgactcttacaccggaaatgaagtcgcaat

SEQ ID NO: 316829 - DNA, 75 bp, Artificial Sequence
  Synthetic
ttgggatgagtttgacgttgacacacagggtaaatttgtggagaccatgattggtgtagttaataccgcccccta

SEQ ID NO: 316830 - DNA, 75 bp, Artificial Sequence
  Synthetic
cccactcaattgcgaccgagtggagaacaaaggcaaagtgttcacatctgattatatcatatgcaccagcaatta

SEQ ID NO: 316831 - DNA, 75 bp, Artificial Sequence
  Synthetic
cccaacctctgtgttacctgacaacccacgagcgggggctttctatcgccgagtcacaacgatagatgtgtcatc

SEQ ID NO: 316832 - DNA, 75 bp, Artificial Sequence
  Synthetic
tcctaccattgaagattggaagaagaagaacccagggaagaaacccccacccgacttgtacaagaacgatttcac

SEQ ID NO: 316833 - DNA, 75 bp, Artificial Sequence
  Synthetic
acaccttcgcctatctgttagaccgttcttggggtacaaccccgagggggacaccttggatggtgtccgagtgaa

SEQ ID NO: 316834 - DNA, 75 bp, Artificial Sequence
  Synthetic
acctgtgctcactagtgtggatggtctgtcacgcttgatggaaaccaagtttaaggagcagggcaatgaacatcg

SEQ ID NO: 316835 - DNA, 75 bp, Artificial Sequence
  Synthetic
gaacctgtggataacatgcccgcgtgacctggtggcccccgccgcatctggtttaaaagcatacatggccgccaa

SEQ ID NO: 316836 - DNA, 75 bp, Artificial Sequence
  Synthetic
ccgagcgctcgcacaagtgttccaggaaccatcttcacaggacattggtgaaacctgcacgtcccgtgtgtacgt

SEQ ID NO: 316837 - DNA, 75 bp, Artificial Sequence
  Synthetic
gtcatgtaacaatccacctcccacatacagtggacgggtggtgaaaatcacagccatcaatccatgggatgcatc

SEQ ID NO: 316838 - DNA, 75 bp, Artificial Sequence
  Synthetic
actcgccaattccatgttatcaatgtttgaaaccaccagtcacatccctgcctcgattcagcgtgaaatcatgta

SEQ ID NO: 316839 - DNA, 75 bp, Artificial Sequence
  Synthetic
tagagtttgggacccactggttcacctgcagacacgtgagccaaatacgcagatgctcccctacatcaacagagt

SEQ ID NO: 316840 - DNA, 75 bp, Artificial Sequence
  Synthetic
ggtcccggtgtcttctgcatttgacttcatccgaggcctcaggcaccatcttggtctgtgttcagtcaaaggcat

SEQ ID NO: 316841 - DNA, 75 bp, Artificial Sequence
  Synthetic
gtggagagcttatcagggttggaacagttccagctcgatcttggaattcctgtcaaagcacatggctgatgttgc

SEQ ID NO: 316842 - DNA, 75 bp, Artificial Sequence
  Synthetic
tttcccacacaaccccgagtgcaccgttttccgggccccggacggtgatgtgatcttttacacgttcgggtcata

SEQ ID NO: 316843 - DNA, 75 bp, Artificial Sequence
  Synthetic
tgcttgctttgtgtccccagcccgtgtcccatttgttggagagcccccgaagaacgtgcattcaaatataacacg

SEQ ID NO: 316844 - DNA, 75 bp, Artificial Sequence
  Synthetic
caacatgacgtgggctgagacactccgcctgttggcagaaactataactgaaagtctggtgcactttggcccctt

SEQ ID NO: 316845 - DNA, 75 bp, Artificial Sequence
  Synthetic
cctactcatgatgcacaatgtttcatacctcgccacccggtctggtcgggaggaggaggccaaaggaaagaccaa

SEQ ID NO: 316846 - DNA, 75 bp, Artificial Sequence
  Synthetic
gcatggccgtggtgccaaacacgctaggaggggaggtgtcagcttgtctgatgatgagtatgatgagtggcgtga

SEQ ID NO: 316847 - DNA, 75 bp, Artificial Sequence
  Synthetic
cctggtacgggactggcggcaagacatgactgttggggagtttgtggagcttcgtgagcgatacgcgctcggaat

SEQ ID NO: 316848 - DNA, 75 bp, Artificial Sequence
  Synthetic
ggactctgaggatgtgcaacgttatcgtgcttggcttgagctacgagcgatgcgcatgggtgcaggtgcctacca

SEQ ID NO: 316849 - DNA, 75 bp, Artificial Sequence
  Synthetic
acatgccaccattattggtaggggaggagtacaagacaccatcatccgcacccaaccaatgcgtgctccacgtgc

SEQ ID NO: 316850 - DNA, 75 bp, Artificial Sequence
  Synthetic
gccccgtaatcaaggttatgatgaagaagctcccacaccaattgttacattcacatctgggggtgatcacattgg

SEQ ID NO: 316851 - DNA, 75 bp, Artificial Sequence
  Synthetic
gtatggttgtcacatgggtaatggggtggttgtcacagttacacacgtggcctctgcgtctgaccaagtagaagg

SEQ ID NO: 316852 - DNA, 75 bp, Artificial Sequence
  Synthetic
gcaggacttcgcaatcaggaagaccgagggtgaaaccacctgggtgaacaccaaccttggtcacttgccccacta

SEQ ID NO: 316853 - DNA, 75 bp, Artificial Sequence
  Synthetic
ccagatcggtgatggcgcccctgtctactactcggcgcgcctacaccctgtcaccacgcttgcggaggggacgta

SEQ ID NO: 316854 - DNA, 75 bp, Artificial Sequence
  Synthetic
tgagacacccaatatcacggtccaggggtatcacctgcgcatcataaatggatacccaacaaagcgtggggactg

SEQ ID NO: 316855 - DNA, 75 bp, Artificial Sequence
  Synthetic
tggcacaccctattttgactcatgccgtcgtttggtcggactgcacgcagccacatcaacaaatggagaaaccaa

SEQ ID NO: 316856 - DNA, 75 bp, Artificial Sequence
  Synthetic
gcttgctcagcgagtgactaaaacatccaaggtggagaatgcttttgcttggaagggtctaccagtggttcgagg

SEQ ID NO: 316857 - DNA, 75 bp, Artificial Sequence
  Synthetic
ccccgactgtggcggcatgcccacggggactcgttaccaccgctcacctgcatggcccaaccctgtggaaggaga

SEQ ID NO: 316858 - DNA, 75 bp, Artificial Sequence
  Synthetic
aacacacgcccctgcgccgtttggttccggtgatgagcggtacaaattttcccaggtggagatgttggtcaacgg

SEQ ID NO: 316859 - DNA, 75 bp, Artificial Sequence
  Synthetic
cttaaagccttactcagagcccacccctggcataccccccgctttgttacaacgtgcagccacacacacacgcac

SEQ ID NO: 316860 - DNA, 75 bp, Artificial Sequence
  Synthetic
gtatctggaaacaataattggcacccaccgatcaccaaatttgtcattcagtgaggcatgttcactcttggaaaa

SEQ ID NO: 316861 - DNA, 75 bp, Artificial Sequence
  Synthetic
atcaacatcgtgtggtccgttcgtggctggccaaaagggggactactgggacgaggacaaacagtgttacacagg

SEQ ID NO: 316862 - DNA, 75 bp, Artificial Sequence
  Synthetic
tgtgttggcagaacatcttgccaaagcatgggatgcagccaacaggggcgttgcaccccaaaacgcctacaaatt

SEQ ID NO: 316863 - DNA, 75 bp, Artificial Sequence
  Synthetic
ggctttgaaagatgaactgagaccaattgaaaagaatgcacaaggaaaaagacgcctcctgtggggttgtgatgc

SEQ ID NO: 316864 - DNA, 75 bp, Artificial Sequence
  Synthetic
gggtgccacattggtggctactgcggccttcaagggtgttgccacccgcctccaagcagttgctccaatgacacc

SEQ ID NO: 316865 - DNA, 75 bp, Artificial Sequence
  Synthetic
agttagcgttggcataaacatggacagttaccaggttgaggtgctgaatgagtcactcaagggtggggtgcttta

SEQ ID NO: 316866 - DNA, 75 bp, Artificial Sequence
  Synthetic
ctgtctcgattatagcaagtgggattcaacacagcaccctgccgtcacggccgcctcacttgggattttggagag

SEQ ID NO: 316867 - DNA, 75 bp, Artificial Sequence
  Synthetic
attgtctgaagccactcccattacaacgtcagctgtcgagttgctatcctcccctgctagaggccatttaaacga

SEQ ID NO: 316868 - DNA, 75 bp, Artificial Sequence
  Synthetic
cattgtatttatcacaaaatctggtctcccatctggcatgccgtttaccagtgtcatcaactcactcaaccacat

SEQ ID NO: 316869 - DNA, 75 bp, Artificial Sequence
  Synthetic
gacttactttgcagctgcagtgcttaaggcgtatgaacaacacggagcaccatacacaggtaacgtgtttcaggt

SEQ ID NO: 316870 - DNA, 75 bp, Artificial Sequence
  Synthetic
tgaaactgttcacacctacggggatgactgtttatactcagtgtgccctgcaacagcctccattttccagacagt

SEQ ID NO: 316871 - DNA, 75 bp, Artificial Sequence
  Synthetic
tctagccaacttgacctcgttcggtctcaaaccaacagctgcagataagagtgagacgatagccccgacccacac

SEQ ID NO: 316872 - DNA, 75 bp, Artificial Sequence
  Synthetic
tcctgtcttccttaagagaactctaacatgcacaccacgtggtgtgcgtggcctattagacatcacatccataaa

SEQ ID NO: 316873 - DNA, 75 bp, Artificial Sequence
  Synthetic
gaggcaattcttgtggatcaaggctaacaggacagttgacatcaattcaccaccagcatacgatcgcgacgcgcg

SEQ ID NO: 316874 - DNA, 75 bp, Artificial Sequence
  Synthetic
tggcatccagttagaaaacgccctcgcgtacgcatcgcagcatggccatgcagtttttgaggaagttgctgaatt

SEQ ID NO: 316875 - DNA, 75 bp, Artificial Sequence
  Synthetic
ggctcgacacacagccaaggctgagggactggtgctaaccaatgtcaactatgaccaggctctcgccacctacga

SEQ ID NO: 316876 - DNA, 75 bp, Artificial Sequence
  Synthetic
atcttggttcataggtggtacaggcctggtacaaggtagccccagtgaagagaccaccaaattagtgtttgaaat

SEQ ID NO: 316877 - DNA, 75 bp, Artificial Sequence
  Synthetic
ggagggcctaggccaaccacagccacagggtggcgaaaagaccagcccacagcctgtgacaccacaggacaccat

SEQ ID NO: 316878 - DNA, 75 bp, Artificial Sequence
  Synthetic
tggccctacagcggccctcttacttccaactcagattgaaacaccaaacgcaagtgcacagcgcttggagttggc

SEQ ID NO: 316879 - DNA, 75 bp, Artificial Sequence
  Synthetic
catggccacaggggcagtcacgagtaatgtaccaaactgtattcgtgagtgttttgcctctgttaccacaatccc

SEQ ID NO: 316880 - DNA, 75 bp, Artificial Sequence
  Synthetic
ctggacaactcgacaggccgctaacactttccttggggctatccaccttggcccacgcatcaacccatacaccgc

SEQ ID NO: 316881 - DNA, 75 bp, Artificial Sequence
  Synthetic
tcacctgagcgcaatgtttgctgggtggggtggtggttttcaagtgagagtgactatatctggttctggcctgtt

SEQ ID NO: 316882 - DNA, 75 bp, Artificial Sequence
  Synthetic
tgctggtcgggcggtaactgccatcttgccacccggagtgaaccccgcgagtgtccaaaaccctggggttttccc

SEQ ID NO: 316883 - DNA, 75 bp, Artificial Sequence
  Synthetic
tcatgccttcattgatgcacgtaccactgagccaatcttgattaatctgccagacattcgtcctgttgacttcca

SEQ ID NO: 316884 - DNA, 75 bp, Artificial Sequence
  Synthetic
ccgtgtagacggagacgatgccacggcatctgttggactgtgggtagctcaacccctcatcaacccatttcagac

SEQ ID NO: 316885 - DNA, 75 bp, Artificial Sequence
  Synthetic
aggccctgtgtccacttgttggttgagttttgaaacaagacccggccctgactttgacttttgtctgttgaaggc

SEQ ID NO: 316886 - DNA, 75 bp, Artificial Sequence
  Synthetic
cccagagcagcagatggacaatggaatttcgcccgcctctttgttgccccgtaggctcggacgttcccgaggcaa

SEQ ID NO: 316887 - DNA, 75 bp, Artificial Sequence
  Synthetic
cagaatgggtgggcgaattgtgggactggttgtggtggcggctgcggaacaggtgaaccatcactttgatgcccg

SEQ ID NO: 316888 - DNA, 75 bp, Artificial Sequence
  Synthetic
gtcaacaacattagggtggtccacattgcctgttgaacctattgcaggggatatatcctggtatggtgatgctgg

SEQ ID NO: 316889 - DNA, 75 bp, Artificial Sequence
  Synthetic
gaacaagtcaatccgagggcttgttagtgctcagggcaaaggtataatatttccaaacatagtcaaccactggac

SEQ ID NO: 316890 - DNA, 75 bp, Artificial Sequence
  Synthetic
tgacgttgcactgtcctccaagacatctaacaccacaaccataccaactgacacatctactcttggcaatttacc

SEQ ID NO: 316891 - DNA, 75 bp, Artificial Sequence
  Synthetic
aggtgcctctggaccacttgtcacttttgctgacaatggggatgttaatgagagttccgcccaaaatgccatatt

SEQ ID NO: 316892 - DNA, 75 bp, Artificial Sequence
  Synthetic
gacagctgcaaatcagaacttcacatcattctctccaacttttgatgcggcagggatatgggtgtggatgccttg

SEQ ID NO: 316893 - DNA, 75 bp, Artificial Sequence
  Synthetic
ggccacggatcgtccaggtgcgtcagacagcaacatctacattagccccacctgggtaaatggcaatccctccca

SEQ ID NO: 316894 - DNA, 75 bp, Artificial Sequence
  Synthetic
cccaatccatgaaaaatgcactaacatgattggcacaaactttcagtttggagggaccggcaccaacaacatcat

SEQ ID NO: 316895 - DNA, 75 bp, Artificial Sequence
  Synthetic
gttgtggcaggaacagcacttcacatcctggcccggtgcagcagaggtgtactgctcgcaactggaaagcactgc

SEQ ID NO: 316896 - DNA, 75 bp, Artificial Sequence
  Synthetic
cgagattttccagaacaacattgttaacatcccaatgaaccaaatggcagtgtttaatgttgagactgcaggtaa

SEQ ID NO: 316897 - DNA, 75 bp, Artificial Sequence
  Synthetic
ttcattccaaatagccatcttgcccaatggttattgtgtcaccaacgcaccagtgggaacacaccaacttcttga

SEQ ID NO: 316898 - DNA, 75 bp, Artificial Sequence
  Synthetic
ctatgagactagcttcaaatttgtaggactcttcccccaaagcacttcacttcaggggccccatgggaacagtgg

SEQ ID NO: 316899 - DNA, 75 bp, Artificial Sequence
  Synthetic
ccgggccgttaggttcttagaataatgtcttggtttactggagcatctctggctgccggttcactcgtggacatg

SEQ ID NO: 316900 - DNA, 75 bp, Artificial Sequence
  Synthetic
gcaggcaccatttcatcaattgtggcacaacaaagacaaattgatctgatggcagaagcaaatagaatccaggca

SEQ ID NO: 316901 - DNA, 75 bp, Artificial Sequence
  Synthetic
gattgggtgcgccgtcaagaggcactacaaatccgtggccaggacatctcacgggatcttgctgttaacggcact

SEQ ID NO: 316902 - DNA, 75 bp, Artificial Sequence
  Synthetic
gcccagcgtgttgagtctttagtcaatgcaggcttcacacccgtggacgcacgtcggctggccggcggaacggaa

SEQ ID NO: 316903 - DNA, 75 bp, Artificial Sequence
  Synthetic
acggtgagttacggcctactggatcgccctatcctacaacggggcatcctttctggcatcactgagacacgacac

SEQ ID NO: 316904 - DNA, 75 bp, Artificial Sequence
  Synthetic
ctccaggccatgcagggcgctctaagtgcattcaaaaatggtgcctcttacggagccccgccagccccatcaggc

SEQ ID NO: 316905 - DNA, 75 bp, Artificial Sequence
  Synthetic
tttgtgaatccaaattatcaaccttcacctccgagattgaaactaggccctaggccccctagcaccaatgtttga

SEQ ID NO: 316906 - DNA, 75 bp, Artificial Sequence
  Synthetic
aatcctatctcttatacaaattttctatcttttcttttctttctacacggtacctcacgcgttcgggtggtcaaa

SEQ ID NO: 316907 - DNA, 75 bp, Artificial Sequence
  Synthetic
cttttctttctacacggtacctcacgcgttcgggtggtcaaatgcaattaagcgattgcagccgtgctttcttgg

SEQ ID NO: 316908 - DNA, 75 bp, Artificial Sequence
  Synthetic
cgtgtgaacgcctggctcaagcatgccacaaggaccctcccaaacgaatacacattcgttgaggagggcctcctt

SEQ ID NO: 316909 - DNA, 75 bp, Artificial Sequence
  Synthetic
ccgggagctgttcggggttgaccaaaccgaacagttcccattgtcccttgcagacttggccaggttgcaagggga

SEQ ID NO: 316910 - DNA, 75 bp, Artificial Sequence
  Synthetic
aaggatttcttgattgcattctgccaggcagtacaacaagaaatgggtgtcaaccctcaatacttgcaacttgct

SEQ ID NO: 316911 - DNA, 75 bp, Artificial Sequence
  Synthetic
tgcaatgattctgctaaaaatgtctgggtgcccaggcgtcattggcatgtggacaaaagtgctcaaaatctgcgg

SEQ ID NO: 316912 - DNA, 75 bp, Artificial Sequence
  Synthetic
tgatgagctcaagggcctccttgattgtttcaccatactgattgaggagggcaccgagctcatccacaagtttgg

SEQ ID NO: 316913 - DNA, 75 bp, Artificial Sequence
  Synthetic
cactagcccactagcaggcctggtacgcacgtatgtgtccgaacttgagacccaagctaacaacatcaggtctac

SEQ ID NO: 316914 - DNA, 75 bp, Artificial Sequence
  Synthetic
cattaagcttgacacccctagaagagtgcccgttgtcatcatcctcactggggcacctggcattggaaaaactcg

SEQ ID NO: 316915 - DNA, 75 bp, Artificial Sequence
  Synthetic
gtgcccgttgtcatcatcctcactggggcacctggcattggaaaaactcgcttggcacaatacgttggccagcgc

SEQ ID NO: 316916 - DNA, 75 bp, Artificial Sequence
  Synthetic
cctgtaccaagacgatttttcccacctcaaattgatgcttaggccttatttaggttataacccagatggggacac

SEQ ID NO: 316917 - DNA, 75 bp, Artificial Sequence
  Synthetic
taggttataacccagatggggacacacttgaaggccccagagttgcccccactcaaataagcatagctggattaa

SEQ ID NO: 316918 - DNA, 75 bp, Artificial Sequence
  Synthetic
ggaacaagctgggcccctacagaacttgtggttgcaagttcccaagacactcgtggaacagtccacaaacatgat

SEQ ID NO: 316919 - DNA, 75 bp, Artificial Sequence
  Synthetic
tccgcacgccagatgcggatgtggtcttttacacttttggctcatatgtgtgttttgccaccccagcacgagtgc

SEQ ID NO: 316920 - DNA, 75 bp, Artificial Sequence
  Synthetic
cgtatgttggcacaccacctaccactatccactctaacacgcctcggtgcatgacttggggcgagactatagcac

SEQ ID NO: 316921 - DNA, 75 bp, Artificial Sequence
  Synthetic
tgagtatgacgagtggcgtgacctcatgcgtgattggaggcgtgacatgagtgtcaacgacttcctaatgcttag

SEQ ID NO: 316922 - DNA, 75 bp, Artificial Sequence
  Synthetic
catggcttgagattcgtgccatgcgaatggctgggggtgcgtacacacatgccactatcatcggtcgtggtggcg

SEQ ID NO: 316923 - DNA, 75 bp, Artificial Sequence
  Synthetic
caacagcaatcgtggagttcacacagggtggtgaccacattggatatggagtacacattggcaatggtaacgtaa

SEQ ID NO: 316924 - DNA, 75 bp, Artificial Sequence
  Synthetic
aaacaacctgggtgcaagggccattttcacaactgccacacatgcaaataggcagtggctccccagtctatttta

SEQ ID NO: 316925 - DNA, 75 bp, Artificial Sequence
  Synthetic
ccaaacatcactgtgaatgggttccatgtcagaattgtgaatggttacccaactaagaagggagactgtggactg

SEQ ID NO: 316926 - DNA, 75 bp, Artificial Sequence
  Synthetic
aaaagaacaaggttggcaaacgtaggttattgtggggctgtgacgccgccactacactcatagctaccgcggctt

SEQ ID NO: 316927 - DNA, 75 bp, Artificial Sequence
  Synthetic
gctgttggcattaacatggactctgtccaaatgcaagtaatgaatgactccttgaaaggaggcgttctctactgt

SEQ ID NO: 316928 - DNA, 75 bp, Artificial Sequence
  Synthetic
atgcttcacaacacgggcctgtcatatttgacaccgtgcgccaaattgccataaagactgcccaaggagagggac

SEQ ID NO: 316929 - DNA, 75 bp, Artificial Sequence
  Synthetic
agcagagcaacaacccaatggtcgttgacccgcctggcacaacaggtccgaccacatcccacgttgttgttgcta

SEQ ID NO: 316930 - DNA, 75 bp, Artificial Sequence
  Synthetic
tggggttttgggtttatcaaccattactcaaccccttttccaccaccgccgtctcaacatgttgggtgtcagtgg

SEQ ID NO: 316931 - DNA, 75 bp, Artificial Sequence
  Synthetic
cttctgtttgctaaggccaccaggtcaacagatggaaaatggggtttcaccagaaggcttattgcctaggcgctt

SEQ ID NO: 316932 - DNA, 75 bp, Artificial Sequence
  Synthetic
ccatggacacctctcttggcggccggccatccactggggtgtgtgggcctgccataagcttccaaaacaatggtg

SEQ ID NO: 316933 - DNA, 75 bp, Artificial Sequence
  Synthetic
atgtgtacgaaaatgatacaccctcagtcatgtttgccacttacgaccccctcacgtcaggcacgggggttgctc

SEQ ID NO: 316934 - DNA, 75 bp, Artificial Sequence
  Synthetic
ctttacttccacaggtgcgaacactcttgtgctgtggcaggagcgcatgcttagctatgatgggcaccaagcaat

SEQ ID NO: 316935 - DNA, 75 bp, Artificial Sequence
  Synthetic
ggcggtgttcaatgtggaaaccaactccgcatccttccaaattggcatcaggcctgatggttacatggtgacagg

SEQ ID NO: 316936 - DNA, 75 bp, Artificial Sequence
  Synthetic
tccgcatccttccaaattggcatcaggcctgatggttacatggtgacaggtggatctattggcatcaacgtgccg

SEQ ID NO: 316937 - DNA, 75 bp, Artificial Sequence
  Synthetic
aatgagttggttagtgggtgccctccagaccttcgggtcattggctgacgttgctggcactgtgtctaatatagt

SEQ ID NO: 316938 - DNA, 75 bp, Artificial Sequence
  Synthetic
agcgtgtgatatgggggaacttggatcgacccatcatgcacgctggcactatggatagcatacgccaaaccaaac

SEQ ID NO: 316939 - DNA, 75 bp, Artificial Sequence
  Synthetic
atggatagcatacgccaaaccaaacatttggactctttgagtcactcattggctacgttcaaaaatggaactcca

SEQ ID NO: 316940 - DNA, 75 bp, Artificial Sequence
  Synthetic
aattttcttttctttgaaacggtcccacacgcgttcgggtgggtttcagacaattaagcgattgtcgccgtcccc

SEQ ID NO: 316941 - DNA, 75 bp, Artificial Sequence
  Synthetic
gtgaacgttatggcggctacttgccgtcatagtgtttgtgcgcgctttcagcgtgaatcacgcttgtgcgcagaa

SEQ ID NO: 316942 - DNA, 75 bp, Artificial Sequence
  Synthetic
gtaggcgtgctgccacctgacaatacaggttggcattcacgcctacaccaaacccctcgcggccctacagttgga

SEQ ID NO: 316943 - DNA, 75 bp, Artificial Sequence
  Synthetic
taccgcttgcaggggatgtttgattgtgctcccgttgactgtggcaacgggaagaacaactacaacttacccacc

SEQ ID NO: 316944 - DNA, 75 bp, Artificial Sequence
  Synthetic
acgaacgatccaattgggttcgtgacacaacttttgagtgaccacaccagggaggtgtgcggtcccattacaacc

SEQ ID NO: 316945 - DNA, 75 bp, Artificial Sequence
  Synthetic
gggaccatacacgcacttaggcaagttgtggtcgatgcccttttaaggcagactggcccgctctatggaaagctg

SEQ ID NO: 316946 - DNA, 75 bp, Artificial Sequence
  Synthetic
gaaacaacccagctaaacggcctgatggctgctttgaccgttctcacccccacaccaaccaacatccttgatagt

SEQ ID NO: 316947 - DNA, 75 bp, Artificial Sequence
  Synthetic
agactggaacttgaggccgctctgcggtctcagacatgtactagtttgcgcgcagcgatcaccgctggcatcctc

SEQ ID NO: 316948 - DNA, 75 bp, Artificial Sequence
  Synthetic
aagggtaatgatgtcatgcgagaaactggtcactgggtcaagcagttcttccatgctggcgtgggcgggttcacc

SEQ ID NO: 316949 - DNA, 75 bp, Artificial Sequence
  Synthetic
aaggtcttcaagttgtggtgccatggcgttgcggcctatttcgacaacgccaccaatggggcgataaccatcacc

SEQ ID NO: 316950 - DNA, 75 bp, Artificial Sequence
  Synthetic
tcactcttgtccactataaagcccgtggtactcagcatgatcactcggtcacaccaagacaccccacatgggtgg

SEQ ID NO: 316951 - DNA, 75 bp, Artificial Sequence
  Synthetic
attgtaaccctcacagcattgcgtgagttgtatgggtttgacacgagtgacatcggggcgctcattacacagatc

SEQ ID NO: 316952 - DNA, 75 bp, Artificial Sequence
  Synthetic
attgacgccctcacctcgctcgctcacacagcttggaacaagatcctcagcgccgctggttacaccatgcagggc

SEQ ID NO: 316953 - DNA, 75 bp, Artificial Sequence
  Synthetic
gttgacacaactgcatttgcctgcgtgatccttggcgcaatttactatctctgtactggtaatgtctggaagaaa

SEQ ID NO: 316954 - DNA, 75 bp, Artificial Sequence
  Synthetic
gacgttatgtcgcgcctccgtaatatcatgggggtcacagtttctatcatcgggtttgttagagcaatccagtac

SEQ ID NO: 316955 - DNA, 75 bp, Artificial Sequence
  Synthetic
atgcatgagtgcatccaacgtgatgtcaacaaccggaacgtcactaagttccttgttcgagttggcgccttcatc

SEQ ID NO: 316956 - DNA, 75 bp, Artificial Sequence
  Synthetic
gacgccactaaagttaaagaccttaaagcatccgaggcagagaacattatggactttgctgacacactcatggtg

SEQ ID NO: 316957 - DNA, 75 bp, Artificial Sequence
  Synthetic
gaggggcaagagttacttgtcagcaacatcggtccccttgtctcagtaatacagaccacccttagggacatagca

SEQ ID NO: 316958 - DNA, 75 bp, Artificial Sequence
  Synthetic
aaccacaaagttgccctccaatcactggttgcttccgcgcagagggttcaaccacccgttatgtacgtgttttgt

SEQ ID NO: 316959 - DNA, 75 bp, Artificial Sequence
  Synthetic
ggtccgccaggcattggtaaaacaacactgataaatggccttgtcaaggccttgggtcaaaagtccactaacttc

SEQ ID NO: 316960 - DNA, 75 bp, Artificial Sequence
  Synthetic
accttgatgctcgaccaccacgattattacactggtgaacctattgcactctgggatgagtacgacaccgaccca

SEQ ID NO: 316961 - DNA, 75 bp, Artificial Sequence
  Synthetic
aagggcgcatacgtctccactgtcattgggatgataaacactgtccccttaccactgaattgtgacaggattgaa

SEQ ID NO: 316962 - DNA, 75 bp, Artificial Sequence
  Synthetic
aacaaagggcgagtgttttcctcgcacgtcgtcctcgcaacaaccaacaatgaaactcccatacaacccaatgac

SEQ ID NO: 316963 - DNA, 75 bp, Artificial Sequence
  Synthetic
cccaggtacagtgccttcatgcgccgcatcaccatcatagacgtttcatgtcccagggtcactgagtgcatagaa

SEQ ID NO: 316964 - DNA, 75 bp, Artificial Sequence
  Synthetic
ggtggcaggaggcccaaccctggcatgtttaagccggacttttcccacctggatttgcgtaggcgttgtcacatg

SEQ ID NO: 316965 - DNA, 75 bp, Artificial Sequence
  Synthetic
gcttacacgaaggaagggcacctcccaaatgggaagcaatttgggtcaacaccgatcacgttctctaaactggtg

SEQ ID NO: 316966 - DNA, 75 bp, Artificial Sequence
  Synthetic
gcggacttgcaggcagagctagcagggtttgcactacaaggccccgagtgggagggcctgtgggtgcggtgtgtc

SEQ ID NO: 316967 - DNA, 75 bp, Artificial Sequence
  Synthetic
aagtcgcaccatgtccctgaagtcacggattacttcaatgcgatgtttaagtggattggagtcccaacacgcgtc

SEQ ID NO: 316968 - DNA, 75 bp, Artificial Sequence
  Synthetic
ataaccgaccgcaccaaatctgaggttgggttttatgattgcatcgtgacagataggcagccaccccatgggtcc

SEQ ID NO: 316969 - DNA, 75 bp, Artificial Sequence
  Synthetic
aaataccatgagattgtgatcgacggctttcgtgtccgaccagactgcgtgcgggacccgtacgaaagaccattg

SEQ ID NO: 316970 - DNA, 75 bp, Artificial Sequence
  Synthetic
tccatctttgactttgttggcacaccatcacagaacttgatcaacatggcgacaaggcaaacacgtggccacgtt

SEQ ID NO: 316971 - DNA, 75 bp, Artificial Sequence
  Synthetic
gttgtcacttccaccggtccagttgactgttccagacttccacggccccgccgcgttgttgacgcgagcaactgg

SEQ ID NO: 316972 - DNA, 75 bp, Artificial Sequence
  Synthetic
tttcaactcattaaagccgcgttcgcccactcttcactgtttaccccattcaccctttggcgaatggttaagaat

SEQ ID NO: 316973 - DNA, 75 bp, Artificial Sequence
  Synthetic
ggcgccacgctcacccaggacaacattgaggaatttttcaagaatgtcacaaaggatgtcaagttcggcccgaac

SEQ ID NO: 316974 - DNA, 75 bp, Artificial Sequence
  Synthetic
cctgagtgcaccttgatacgtctcccgctgttggacgtgctgttttacacatgttcaggcagctacacgcggatc

SEQ ID NO: 316975 - DNA, 75 bp, Artificial Sequence
  Synthetic
ctgccaggcaggatgccacttgtgcacctaggcccaatacaggagcttttggtccccagttccagcgtagtcaag

SEQ ID NO: 316976 - DNA, 75 bp, Artificial Sequence
  Synthetic
tgcaccctgccgcaagctatacatcttgctgtcacttcttttatcaactacgtcaaaccatacattggtgtggtt

SEQ ID NO: 316977 - DNA, 75 bp, Artificial Sequence
  Synthetic
atgaccacagtgtcgctctcacatatctggtcagacagccttcaaaagaagaagggtaagaacaagcggggtggt

SEQ ID NO: 316978 - DNA, 75 bp, Artificial Sequence
  Synthetic
tttcgggcacttggtgacgaagagtaccaggaataccttgacctgcaacgtgactggaggctcaagatgactgtt

SEQ ID NO: 316979 - DNA, 75 bp, Artificial Sequence
  Synthetic
gacgagtacatcgatattgtcagtaatccagagagcgactatgtggagcggtacaatgcgtgggccaacctccga

SEQ ID NO: 316980 - DNA, 75 bp, Artificial Sequence
  Synthetic
caactgaggatggccaatggtgcgtatgaccatgctcgtgtcgtgattggcaagtctggccctaagtgggagata

SEQ ID NO: 316981 - DNA, 75 bp, Artificial Sequence
  Synthetic
caagggccgaccccaacagtcacactaaatgacacctcaggtcaaagtgtgggctttgcaaacaggattggtgag

SEQ ID NO: 316982 - DNA, 75 bp, Artificial Sequence
  Synthetic
gggctctatgtcacgtgcactcacctcctcgaacatgctagcagtgtggatggggtcccttttgaacaggtgact

SEQ ID NO: 316983 - DNA, 75 bp, Artificial Sequence
  Synthetic
gcggttgctgactgtgcaatcatcaaacaaaccataccaacgagtggcccgtgttacaaggtttcaacaacaaca

SEQ ID NO: 316984 - DNA, 75 bp, Artificial Sequence
  Synthetic
gacccggccacctttgacaccaacaaggttccaatcacttgcctccacaaggtacaacaaactgtgagtggcagt

SEQ ID NO: 316985 - DNA, 75 bp, Artificial Sequence
  Synthetic
gtgatcagtggttggcgtgtgtcatcgcaggtgcaaaccaagagtggagactgtggcaaaccctaccttgacgcc

SEQ ID NO: 316986 - DNA, 75 bp, Artificial Sequence
  Synthetic
tccggatgtttggttggtgtacacagcgcctcggcgaacattggtccatataagctggtttccagggtctgcacc

SEQ ID NO: 316987 - DNA, 75 bp, Artificial Sequence
  Synthetic
accgtcacagcaaaaacacaaccagacttaaaatggaaggggttagacgctgaccacacagcgactaacatgggg

SEQ ID NO: 316988 - DNA, 75 bp, Artificial Sequence
  Synthetic
ccactcaccggttctaccaagtaccacaaatccttggcccattacgactgtggttatgagccagcaaacttcggg

SEQ ID NO: 316989 - DNA, 75 bp, Artificial Sequence
  Synthetic
cctaacgaccagaggtgcccaatacccctccctgatgtcattgccactcaggttcgcccgtaccaagacccacca

SEQ ID NO: 316990 - DNA, 75 bp, Artificial Sequence
  Synthetic
gttgcaataaatggggaattgctgcataggggtaagagacacgtccaagcattcttgcgccacattcttggcact

SEQ ID NO: 316991 - DNA, 75 bp, Artificial Sequence
  Synthetic
cacaggcgcaagcccttgccactggtcgaggcgttcaagtccctgaatatgaagagttctaacggcccatggttc

SEQ ID NO: 316992 - DNA, 75 bp, Artificial Sequence
  Synthetic
cctggtgtcaaaaaggactacaccacggaagatggcggccccaaccccattcttgaaaattacataatatcaaag

SEQ ID NO: 316993 - DNA, 75 bp, Artificial Sequence
  Synthetic
tttaatgatatgacccacggcaggtataagcactgttaccgccttgccctcaaggatgaacttagaccaactcag

SEQ ID NO: 316994 - DNA, 75 bp, Artificial Sequence
  Synthetic
aaggtccgggatggcaagcgccggctcttgtggggttgtgatgtcgcattggcgacaggagctgcaatggtgtac

SEQ ID NO: 316995 - DNA, 75 bp, Artificial Sequence
  Synthetic
aaaaacctgtttgatgacattgctagagcggccccatgcgctggcagctgcgtgggcatcgacatggacaacgtc

SEQ ID NO: 316996 - DNA, 75 bp, Artificial Sequence
  Synthetic
gagaccatcaagctgctcaaccaaatgttcacaggttttcacaccgtgtgtgctgattactccaagtgggactcc

SEQ ID NO: 316997 - DNA, 75 bp, Artificial Sequence
  Synthetic
acactgcacccagaggtgatctcaacagcaattgacattctgggtgagtttgttgagccaaatgattttgccaac

SEQ ID NO: 316998 - DNA, 75 bp, Artificial Sequence
  Synthetic
acgatacagtccgtgctcaagcagcggcccgctggacttgtgtttgacatctcgctacccacacagaagggcctc

SEQ ID NO: 316999 - DNA, 75 bp, Artificial Sequence
  Synthetic
ccgtcgggcatgccgggcaccagtgtgttcaattcagtttgccaccttgtgttgtttgcatgttgtgtgctccag

SEQ ID NO: 317000 - DNA, 75 bp, Artificial Sequence
  Synthetic
tgttacgcggagcgtggtgtgccgtaccaaggcaatgttttcgccaacgaacgtatcgttgtctatggtgatgac

SEQ ID NO: 317001 - DNA, 75 bp, Artificial Sequence
  Synthetic
tgcatttatgggtggacccctggcacagcatcaatggcgcccagattttgggaccacatgcgtgcctttggcatg

SEQ ID NO: 317002 - DNA, 75 bp, Artificial Sequence
  Synthetic
cgacccaccaatactgacaagaccggtgaccccgcgttcaccagcacgctgcagtttttgaaacgcaccatcgtg

SEQ ID NO: 317003 - DNA, 75 bp, Artificial Sequence
  Synthetic
ggcgggccaaatggcactttgttgggggctttagacaagtcctcccttgaaagacagttgtgctggataaagggt

SEQ ID NO: 317004 - DNA, 75 bp, Artificial Sequence
  Synthetic
ccacagacaacaaccatggaaccaatctaccctcctgacccagtagcccgcctggcccaaatacagaacgccgtg

SEQ ID NO: 317005 - DNA, 75 bp, Artificial Sequence
  Synthetic
tggaggagtgctgcgtggggtcctgagtacttccaacactttgaacaccttgctgcaaaccttgcaaggtgcgag

SEQ ID NO: 317006 - DNA, 75 bp, Artificial Sequence
  Synthetic
aagttgccctacactggcacagaatactctgaggccatcgaggtgataaccaacatttcatcaggcacgcccgag

SEQ ID NO: 317007 - DNA, 75 bp, Artificial Sequence
  Synthetic
ggcgaggcaattgtgtataaaatggagggtcctgaggggccaaagcccacagagggccccattgaacttggagat

SEQ ID NO: 317008 - DNA, 75 bp, Artificial Sequence
  Synthetic
ggtgtgcagtcttccaccgctgggcctcctgtcttggtcaacccgacgccgccaaatcaagtggccatggcagcc

SEQ ID NO: 317009 - DNA, 75 bp, Artificial Sequence
  Synthetic
tcatcagcggacgccagtgggggaagcttggtcacctttggtgacgatgtgcgctcaacctactgtgtgtacaag

SEQ ID NO: 317010 - DNA, 75 bp, Artificial Sequence
  Synthetic
aacttcacatggaacacgcgcgcggcgcagggcacactcattggtgttgtcaggctcggaccagagtgcaaccca

SEQ ID NO: 317011 - DNA, 75 bp, Artificial Sequence
  Synthetic
tacacactgcacatcagccgcatgtacggcggttggtcagggagcatcagtgtccgcatctcaatttccgggtca

SEQ ID NO: 317012 - DNA, 75 bp, Artificial Sequence
  Synthetic
ggaatttatgctggtaagatcatgtgctgtgtgctgccacccggcattaatccagaggatgctggtcaaccaggc

SEQ ID NO: 317013 - DNA, 75 bp, Artificial Sequence
  Synthetic
gcgtacccccatgccctcatcgacgctaagaccaacctggcgttcgctgtggacatgtatgacgtgcgcaacatc

SEQ ID NO: 317014 - DNA, 75 bp, Artificial Sequence
  Synthetic
gacttccactacatgggtgacgaaaggacacctacattgggcctatgggtttaccagccactcatcaacccattc

SEQ ID NO: 317015 - DNA, 75 bp, Artificial Sequence
  Synthetic
aacccagcagatgctagtgccatgatcactgtggaaacccgcccgggagctgacttcaacttttgcatgctgaag

SEQ ID NO: 317016 - DNA, 75 bp, Artificial Sequence
  Synthetic
tcacccgagagtgtcacccagagcaccggccctgagaaggccctcccaactgtgctcatgggttcaattgaaaac

SEQ ID NO: 317017 - DNA, 75 bp, Artificial Sequence
  Synthetic
cggtttgggcgcacccccacaggctttgttggcgccaacatagccaaccaggtgaatcaccactttgatggcacc

SEQ ID NO: 317018 - DNA, 75 bp, Artificial Sequence
  Synthetic
ggtgtcacttatgggtggtcgactgtaccctttgacactccaaacctccacgtgggtcaacaaatcaattttgac

SEQ ID NO: 317019 - DNA, 75 bp, Artificial Sequence
  Synthetic
aacaacaacattgggtacatggtcgacccccctgccggtaccgacccagtggtggctggcgtccccaatcattgg

SEQ ID NO: 317020 - DNA, 75 bp, Artificial Sequence
  Synthetic
ccagattcatgttctagcaccacaataaactcgggtgccaacagccttgctggtaggggtgctgccggcgcagtc

SEQ ID NO: 317021 - DNA, 75 bp, Artificial Sequence
  Synthetic
ctcacaatgaatcaacttgatgtgggggagcaagcgccgtactccgtgcagtacatgatattcaaccagactggt

SEQ ID NO: 317022 - DNA, 75 bp, Artificial Sequence
  Synthetic
gcacctcttgggcctgcagtgcaacctggtaagctggccctgcggcgcataaacggaaccagtggctctgtcccg

SEQ ID NO: 317023 - DNA, 75 bp, Artificial Sequence
  Synthetic
acaaatgacagcagcatgtgcactgtgtcttatatcatgaccaacaatgacaacaatgccaacatcggtgctgcg

SEQ ID NO: 317024 - DNA, 75 bp, Artificial Sequence
  Synthetic
gtcactccccttgccggcgtggctcgctcttttgggcctcttggtggcaacaacctgtgcctttggtacgccgac

SEQ ID NO: 317025 - DNA, 75 bp, Artificial Sequence
  Synthetic
accccggcttcacacagacccgggggtgttgttcacagctcccagcttgatatcacctcagttgcgctagcgaac

SEQ ID NO: 317026 - DNA, 75 bp, Artificial Sequence
  Synthetic
ggcgccaccatccccgtggggtcaatggccgtcttcacggtcacatcagcaggcaatgtcttccagataggcttg

SEQ ID NO: 317027 - DNA, 75 bp, Artificial Sequence
  Synthetic
tgttgggatgggtatttacgtactgggatatccgaaggcacaataatttacttggatgctgacacaaggttcgtg

SEQ ID NO: 317028 - DNA, 75 bp, Artificial Sequence
  Synthetic
tacaacggtctgtactcgatcaacaccccccttgctggcccagatgggaactctggacgggccttttcaatgaca

SEQ ID NO: 317029 - DNA, 75 bp, Artificial Sequence
  Synthetic
agatgagttggactgctggtgtgcttggtggactgggcctgctctctgacattgcaggcaacgtcgggaacatag

SEQ ID NO: 317030 - DNA, 75 bp, Artificial Sequence
  Synthetic
ttgctcaacaacagatggtgagaaaccaacgtaagcagcttgaaatacaacaacaggcactaaatgagcaggtta

SEQ ID NO: 317031 - DNA, 75 bp, Artificial Sequence
  Synthetic
ggcttgcagagaggggtcagaacttgagcgcctacctgaccgtgaaggggccccagcttgcatattccagcgccc

SEQ ID NO: 317032 - DNA, 75 bp, Artificial Sequence
  Synthetic
ggtcactcgggtacacgcatgctgaggctctgcagatgggtggtggcgctcgcgtgtcttatggtggggtcaatg

SEQ ID NO: 317033 - DNA, 75 bp, Artificial Sequence
  Synthetic
ttgacccgcgaccactccccacaatgcccttttacaacgtggggcagaattctttggccaaatctgttggcgtgg

SEQ ID NO: 317034 - DNA, 75 bp, Artificial Sequence
  Synthetic
ttgcccagtttaagcaaggtactacagggttcacactcccacagcctagtggttttgccaatccaaattatgggg

SEQ ID NO: 317035 - DNA, 75 bp, Artificial Sequence
  Synthetic
ttaaattgactgcagccagggtcaacattggcaacaaccctggtcaaagtgttgtttgaattggctttaatttga

SEQ ID NO: 317036 - DNA, 75 bp, Artificial Sequence
  Synthetic
ggtcaacattggcaacaaccctggtcaaagtgttgtttgaattggctttaatttgattttcttttctgtttcagg

SEQ ID NO: 317037 - DNA, 75 bp, Artificial Sequence
  Synthetic
tgtgcgccaactccttgtgcacttttgtgaaggcatgcgcacacaatttaacacaaatgccaattacatcaatct

SEQ ID NO: 317038 - DNA, 75 bp, Artificial Sequence
  Synthetic
gctcgccaccatcacagcccttgttgaggtctattcaaatttgttccaggacatgcgtgaaaccgcagtgtccgc

SEQ ID NO: 317039 - DNA, 75 bp, Artificial Sequence
  Synthetic
tgtgggtgggccgccattgccgctggtgttattctaatcctcctcaagatctccggctgccctagtgttatgggg

SEQ ID NO: 317040 - DNA, 75 bp, Artificial Sequence
  Synthetic
agctgcgagagcgttcacctgggttcgtgacatcattgtggaggcggaaagaaaggctcgcctcaagaaatacat

SEQ ID NO: 317041 - DNA, 75 bp, Artificial Sequence
  Synthetic
ttggtgtggtgaacaccgcaccataccccttaaattgtgacagagtggaaaataaaggcaaagtctttacatcta

SEQ ID NO: 317042 - DNA, 75 bp, Artificial Sequence
  Synthetic
acctatcctaaccagtgtggacggcctgtcccggctcatggaaactaagtttaaggaacagggcaatgagttgcg

SEQ ID NO: 317043 - DNA, 75 bp, Artificial Sequence
  Synthetic
tttgttcgtgggttgcgccaccaccttggattgtgttctatcaaaggcatgtggaaggcgtaccagggatggcat

SEQ ID NO: 317044 - DNA, 75 bp, Artificial Sequence
  Synthetic
tgtccaagcacatggaggatgttacattcccctccaatccggaatgtactgtgtttcgagctgcggatggagatg

SEQ ID NO: 317045 - DNA, 75 bp, Artificial Sequence
  Synthetic
atgacgagtatgatgagtggcgtgaccttgtgcgtgactggagacaggacatgactgttggggagtttgttgagt

SEQ ID NO: 317046 - DNA, 75 bp, Artificial Sequence
  Synthetic
cgtgttgaggataccatcatccgcacacagcccatgcgtgccccacgtgctcctcgttccaccggatatgatgag

SEQ ID NO: 317047 - DNA, 75 bp, Artificial Sequence
  Synthetic
tactactcaactcgattgcaccccgttaccacaattgcagaaggtacatatgaaactcctaacatcacagttcat

SEQ ID NO: 317048 - DNA, 75 bp, Artificial Sequence
  Synthetic
tgaaactcctaacatcacagttcatgggttccatcttcgcatcatcaatggttaccccacaaagcgtggagactg

SEQ ID NO: 317049 - DNA, 75 bp, Artificial Sequence
  Synthetic
ccctgattgtggtggtatgcccacaggaacaaggtatcatcggtccccagcctggccagaacaactctccagtga

SEQ ID NO: 317050 - DNA, 75 bp, Artificial Sequence
  Synthetic
acgaagcatgtgccttgttggaccgcagcacatcttgtggtccgttcattgcaggccaaaagggggattactggg

SEQ ID NO: 317051 - DNA, 75 bp, Artificial Sequence
  Synthetic
cagcacatcttgtggtccgttcattgcaggccaaaagggggattactgggatgaagatcgccaatgttatatagg

SEQ ID NO: 317052 - DNA, 75 bp, Artificial Sequence
  Synthetic
tgcaggcagttgcacctatgacacctgttggcgttggcatcaacatggacagttaccaggtggaggtgctcaatg

SEQ ID NO: 317053 - DNA, 75 bp, Artificial Sequence
  Synthetic
tgttggcgttggcatcaacatggacagttaccaggtggaggtgctcaatgaatcccttaagggcggtgtcgtata

SEQ ID NO: 317054 - DNA, 75 bp, Artificial Sequence
  Synthetic
gctgtctgaagcaacaccaataacaacatcggccgtagagttgctctcatcaccggcacgtggccatttgaatga

SEQ ID NO: 317055 - DNA, 75 bp, Artificial Sequence
  Synthetic
gacatactttgctgctgcagtgttgaaggcctatgaacaacatggggcgccttacactggcaatgtgtttcaggt

SEQ ID NO: 317056 - DNA, 75 bp, Artificial Sequence
  Synthetic
tgccaagaggacggcacagtcagaagggctggtgctcaccaatgtgaactatgaccaggctctcgccacctacga

SEQ ID NO: 317057 - DNA, 75 bp, Artificial Sequence
  Synthetic
ccgatatccggcccattgattttcaccgtgtagatggggacgacgcgacagcgtctgtggggttatgggtcgcgc

SEQ ID NO: 317058 - DNA, 75 bp, Artificial Sequence
  Synthetic
ccgcctcggcggtcgtgtcgtggggctggttgtggtggctgcggccgagcaagtcaatcaccactttggcgcaaa

SEQ ID NO: 317059 - DNA, 75 bp, Artificial Sequence
  Synthetic
cgaacataccaaaatacgggggctcttgagcgcacaaggaaaaggtatcatcttcccaaacattgtcaatcactg

SEQ ID NO: 317060 - DNA, 75 bp, Artificial Sequence
  Synthetic
ccctggggcagcaggcccggtggttatgtttgaaaacaatggggatgtcaatgagtccactgcaaaccatggcat

SEQ ID NO: 317061 - DNA, 75 bp, Artificial Sequence
  Synthetic
atgagtccactgcaaaccatggcatactaaccgctgcgtcgcatgacttcacatctctgtcccaaactttcgatg

SEQ ID NO: 317062 - DNA, 75 bp, Artificial Sequence
  Synthetic
agtgttgtcgggcatctcagagactcggcacttacaatctgtacaaggtgccttgagtgctttcaaacatggatc

SEQ ID NO: 317063 - DNA, 75 bp, Artificial Sequence
  Synthetic
cagctacgggagctcctcccgcccccgcgggcctcgtcaacccaaattatcaggcttcaccaccaaagttaacac

SEQ ID NO: 317064 - DNA, 75 bp, Artificial Sequence
  Synthetic
caggcttcaccaccaaagttaacactaggccccagacccccagtgacaaatgtgtagtgatgattaggtttccta

SEQ ID NO: 317065 - DNA, 75 bp, Artificial Sequence
  Synthetic
gtgtatagttatggcggctacttgccgtcatagcgcttgtcaacgctaccaagcgttgaattctctgtacaatga

SEQ ID NO: 317066 - DNA, 75 bp, Artificial Sequence
  Synthetic
ggttggggttttgaccccagaccacttgtatggttataaggcactggcctcggacccaaaagggccagaggccag

SEQ ID NO: 317067 - DNA, 75 bp, Artificial Sequence
  Synthetic
tgtgagctttgagctccaaggcttgtttgacatactgaagcctgaacctgttgtcgttggggagcgcaacaacta

SEQ ID NO: 317068 - DNA, 75 bp, Artificial Sequence
  Synthetic
tggcctcccaacgaccaacgaccctgtctcgtttattacacagctactttctgacagcactcgggaggtggtcgg

SEQ ID NO: 317069 - DNA, 75 bp, Artificial Sequence
  Synthetic
acccatcaacaggtcaaccattgagtcactgaggcactttgtcgttcaggccactctttataaggacgggccctt

SEQ ID NO: 317070 - DNA, 75 bp, Artificial Sequence
  Synthetic
gtatgggcgtctcgaggagacccaattggcggaactttccgctgctcttgctttgttgaggcccacacaccccag

SEQ ID NO: 317071 - DNA, 75 bp, Artificial Sequence
  Synthetic
tgaccttgcaaaccggcagtttgttgaaagctgtatcaccaagctttctgggccctttggactgaggccgttggt

SEQ ID NO: 317072 - DNA, 75 bp, Artificial Sequence
  Synthetic
ggcctcattattactcaaggggcgtggctttgttgagaccacttgccagggtgtcagggcggcatactcatggct

SEQ ID NO: 317073 - DNA, 75 bp, Artificial Sequence
  Synthetic
ctttgataatggaccccaacttgttaaggacactctggtggcagtggcggcctacttccaagaggctggcactgg

SEQ ID NO: 317074 - DNA, 75 bp, Artificial Sequence
  Synthetic
ccttgggactatgaatgaccttatacggctgttcaaaccagttgcacttagcattatagtgaaaagtcacaccaa

SEQ ID NO: 317075 - DNA, 75 bp, Artificial Sequence
  Synthetic
cactcccgccgggtggttagtcacactaacagcgatgaaggaactgtacggtgttgatgctgctggtgcagttag

SEQ ID NO: 317076 - DNA, 75 bp, Artificial Sequence
  Synthetic
taaagtggcaggcctagtggtggatttgctatgtacactcacttctgatgcatggcagaaaatcataagttgcat

SEQ ID NO: 317077 - DNA, 75 bp, Artificial Sequence
  Synthetic
gggttttcaactgcagggtcccttggaagtgtgcgggtttgtgacaacactcctcgttgccgtgtattatttgtg

SEQ ID NO: 317078 - DNA, 75 bp, Artificial Sequence
  Synthetic
tactggcagtgtgcccgcaggtaagcatgtgaaccgagttaagactatcattggtggtgctgtaacgcttactgc

SEQ ID NO: 317079 - DNA, 75 bp, Artificial Sequence
  Synthetic
agcaataaaagccgtgcagtatgttgttgatctcgttaaggcgagtgagatgcgccagcgcgtgttgttgttcct

SEQ ID NO: 317080 - DNA, 75 bp, Artificial Sequence
  Synthetic
aacaaggtgtgcagggttcacggacgccacagctgcatgtgccacgtcagctagtgaggccaaagacctacttga

SEQ ID NO: 317081 - DNA, 75 bp, Artificial Sequence
  Synthetic
acccttggaacagctggtttctgaggggtctgagatcctgttaaccccagggatagggtccctagggcccatggt

SEQ ID NO: 317082 - DNA, 75 bp, Artificial Sequence
  Synthetic
gcacacggccctgcgagaacttgcaacccataaatcctatctacagggcttgattgacaacgcggcaagacgaca

SEQ ID NO: 317083 - DNA, 75 bp, Artificial Sequence
  Synthetic
accaccgctgatgttagttttgtgtggacctccagggataggaaaaaccacccttgcccagaagttgtgtgaggc

SEQ ID NO: 317084 - DNA, 75 bp, Artificial Sequence
  Synthetic
acttggcgcacccttcagccacttcacattgggcatggaccaccatgattattacactggtgaagacatcgtcat

SEQ ID NO: 317085 - DNA, 75 bp, Artificial Sequence
  Synthetic
atgggatgagtacgacacggacaagaacggggattttgtccaagctgttataaacatggtcaacacagctcccta

SEQ ID NO: 317086 - DNA, 75 bp, Artificial Sequence
  Synthetic
cccattgaattgtgatttgatccagaataagggcaggcaattcacatctaaggtgattatagcaacaacgaattg

SEQ ID NO: 317087 - DNA, 75 bp, Artificial Sequence
  Synthetic
tgagacaccaattcagcccaacgacccaaggtttggcgctttcatgcgtagggtgacttatttagatataaccgc

SEQ ID NO: 317088 - DNA, 75 bp, Artificial Sequence
  Synthetic
cccaaacataacagcatgctatgagagtgggcggcgaccacaacagaacatgtttaaccctgacatgtctcacct

SEQ ID NO: 317089 - DNA, 75 bp, Artificial Sequence
  Synthetic
gaccattatgaggcgctgtgcaatggcttatgatgcgaaaggcactctgcaaaatggaaaggtgtttggccccac

SEQ ID NO: 317090 - DNA, 75 bp, Artificial Sequence
  Synthetic
caaggtcaccttccaatcgctagtggacctggtgaaggcgcacttggaatcctacgtgttgcagggcccagactg

SEQ ID NO: 317091 - DNA, 75 bp, Artificial Sequence
  Synthetic
ggagggtttgtggtttagatgcacacacgcacaccacgtgcccacagtcacacaatttctgaatgggtatttacg

SEQ ID NO: 317092 - DNA, 75 bp, Artificial Sequence
  Synthetic
acaccttgggttgccgaaccgtgtcacaaccgtgagatcaaacagccagaacggcttttatgacatcatcgtgag

SEQ ID NO: 317093 - DNA, 75 bp, Artificial Sequence
  Synthetic
tgaccagagcccccctccaggttccacgttccatgaaatcgtggttgatgggttcagaaccatgccagacgcaac

SEQ ID NO: 317094 - DNA, 75 bp, Artificial Sequence
  Synthetic
cagtgacatctatgatcgaccacttaaggccatggattttgtcggcactccctcccaaaccttgattaacgttgc

SEQ ID NO: 317095 - DNA, 75 bp, Artificial Sequence
  Synthetic
cacacaccaggtacgcgggcacgttgtgaagatttccaacgggcccgtcgatgttagcacgataccaagaccccg

SEQ ID NO: 317096 - DNA, 75 bp, Artificial Sequence
  Synthetic
aagagtgtgtaatgccacgaactggtatgacatgttgaagtgtgttttccaccactcaaacatctggaccccctt

SEQ ID NO: 317097 - DNA, 75 bp, Artificial Sequence
  Synthetic
aggattgtacaggatggtcaagaatggcagcaacctgaatgaggctaacgttgaagagttcttccgtggcctgac

SEQ ID NO: 317098 - DNA, 75 bp, Artificial Sequence
  Synthetic
aaatggtgtcaagttctcagtcaaccccgagtgctccctgatcagactgccaatgtttgacattgtgttcttcac

SEQ ID NO: 317099 - DNA, 75 bp, Artificial Sequence
  Synthetic
cagtgttggcagctatgtctggatcttgcctggtcgtgttccactcctagagacgggcgagatgggtcaggtggt

SEQ ID NO: 317100 - DNA, 75 bp, Artificial Sequence
  Synthetic
agtcccagccaacttgacatacactggtagtctctctggggcgttgattatggcattagaatcagtgctgaattt

SEQ ID NO: 317101 - DNA, 75 bp, Artificial Sequence
  Synthetic
tctgaaaccatacctcggtgtgatcgccactaccatgtcactgtcacttgtgtggtccaccgaactccagaagaa

SEQ ID NO: 317102 - DNA, 75 bp, Artificial Sequence
  Synthetic
gaaaggtaagaacaagggaggtcggtcttttcgagcccttggcgatgacgaataccaagagttcttggacctgaa

SEQ ID NO: 317103 - DNA, 75 bp, Artificial Sequence
  Synthetic
ccgtgattggaagacgagattcacagttgagcagtacctagatgtggtcagtaaccccgacagcgattacgccca

SEQ ID NO: 317104 - DNA, 75 bp, Artificial Sequence
  Synthetic
gagatataaggcctggagtgaactcaggagcctccggatcgcaaacaacgcgtacgatcacgtcgtgattgggcg

SEQ ID NO: 317105 - DNA, 75 bp, Artificial Sequence
  Synthetic
tgagggggtcaggtgggagtcgcaggggccagcccccaaccccgtggtggaattgaagaactccaccggtgacca

SEQ ID NO: 317106 - DNA, 75 bp, Artificial Sequence
  Synthetic
tgtggggttcgcaactcgtattggacctggaatttttgccactgcagcccacctgctttcgttggccacaacagt

SEQ ID NO: 317107 - DNA, 75 bp, Artificial Sequence
  Synthetic
ggatggtgtcccatttgaggtcatcggccagcgacacgactatgcccaaattaaacaaagtgtcgctacacctgg

SEQ ID NO: 317108 - DNA, 75 bp, Artificial Sequence
  Synthetic
gccgcaggtgaagatttcaacatccacacaaccacatagctttggagtggacagaaacccagtgcaatgccttgg

SEQ ID NO: 317109 - DNA, 75 bp, Artificial Sequence
  Synthetic
ggcgtcagacacgaaggttggtgagactcgcatagttggctggaaggtcaacacaacaacgcaaaccagtggtgg

SEQ ID NO: 317110 - DNA, 75 bp, Artificial Sequence
  Synthetic
tgactgtggactcccatattacgactctgtgggttgtttggtgggcgtacatagtgctgcggcaacaactggcct

SEQ ID NO: 317111 - DNA, 75 bp, Artificial Sequence
  Synthetic
aggcaagttgtgctctgcggctcagaagatgttgaggagacctgaaccacccccagacatcacctggaaggggtt

SEQ ID NO: 317112 - DNA, 75 bp, Artificial Sequence
  Synthetic
acaggcaacccggaagagcctcaacatgggccctctaccaggccacaccaagtaccatcgctcctttgtgcataa

SEQ ID NO: 317113 - DNA, 75 bp, Artificial Sequence
  Synthetic
gccctgtgggtatgaacctgccaactttggcccccttgacaccaggtgcccacgcccactcctggatgttgttgc

SEQ ID NO: 317114 - DNA, 75 bp, Artificial Sequence
  Synthetic
tgagcaattggccccttaccaacaggaaccggtgccaattgattcagtgctgatccagcgcggtgcaaaacacgt

SEQ ID NO: 317115 - DNA, 75 bp, Artificial Sequence
  Synthetic
cctagcgtttctgaggcacatcatcggagcccataggcgcccaccaatcactctggacgaggcatttaggagttt

SEQ ID NO: 317116 - DNA, 75 bp, Artificial Sequence
  Synthetic
aaaccacaagagttcgaacgggcccttcttccctggggtgaaacgggattacactgacccagacactgggttgcc

SEQ ID NO: 317117 - DNA, 75 bp, Artificial Sequence
  Synthetic
aaataacatgctccgggcttacattgaatctgcggttcagaaaataaggcgtgaacaacacccacacgcctacaa

SEQ ID NO: 317118 - DNA, 75 bp, Artificial Sequence
  Synthetic
ggtatctctgaaggacgagttgcgccccactgagaaggtcgttgctgggaagcgtaggctgttgtgggggtgtga

SEQ ID NO: 317119 - DNA, 75 bp, Artificial Sequence
  Synthetic
cgttggcaccgctaccgctgcagcaatggtgttcaagacactgtttgatgacatagctgctgctgctccatttac

SEQ ID NO: 317120 - DNA, 75 bp, Artificial Sequence
  Synthetic
aggcattgcagttggaatagacatggatcgtgcaagcaccatcgccactctgaaccaaatgttcactggcacgca

SEQ ID NO: 317121 - DNA, 75 bp, Artificial Sequence
  Synthetic
catggtctgcgcggactactccaaatgggacagcacactgcaccccgaggtcatcgaaaccgctataaatttgtt

SEQ ID NO: 317122 - DNA, 75 bp, Artificial Sequence
  Synthetic
gggtgagtttgtggccccaacggaccttgccgaaggtgtcatgaggctgcttgggtcacgcccagtggcacttgt

SEQ ID NO: 317123 - DNA, 75 bp, Artificial Sequence
  Synthetic
attggacattggaattcccaccactaaagggttaccatctggaatgccaggcaccagtgtgatcaactcagtttg

SEQ ID NO: 317124 - DNA, 75 bp, Artificial Sequence
  Synthetic
ccacatgatcctctttgcagcgtgtgtgcttgggtcttaccaaaaatataaggtcccgtaccagggcaatgtatt

SEQ ID NO: 317125 - DNA, 75 bp, Artificial Sequence
  Synthetic
ttccaacgagaaaatagtcacctatggtgatgactgtgtttatgggtactgcaccgccacagcatctgttagtgg

SEQ ID NO: 317126 - DNA, 75 bp, Artificial Sequence
  Synthetic
cgcattctgggacatgatgagagcatttggcatgcaccccaccaatgctgacaaaactggtgacccctcttttgg

SEQ ID NO: 317127 - DNA, 75 bp, Artificial Sequence
  Synthetic
tgataccatccatttcttgaagaggaccattcgtgtgcaggatggtgccctagttggggcgctagaccaattgtc

SEQ ID NO: 317128 - DNA, 75 bp, Artificial Sequence
  Synthetic
catagaaaggcagttctactggataaagggtccacccacgaccacgatggaaccagtgcgcccggctgatccaac

SEQ ID NO: 317129 - DNA, 75 bp, Artificial Sequence
  Synthetic
cataagacttgttcaactacagaatgcagtttaccgatcaactgcctggggcccagactttttccagcacattga

SEQ ID NO: 317130 - DNA, 75 bp, Artificial Sequence
  Synthetic
aaatttggccgctgactgcgcggcgaaagaaggattgccatacactaggatagattacacagaggcatttgacgt

SEQ ID NO: 317131 - DNA, 75 bp, Artificial Sequence
  Synthetic
gatgcgcaacttgtcatctacccagcccgatggcggggctgttgtgtacacaatggaggggccaaagccctctcg

SEQ ID NO: 317132 - DNA, 75 bp, Artificial Sequence
  Synthetic
tgtgtcgagtggatcacccactccaatggaggtggttgatggggcgcagtcctccacggctgggccgcccatcct

SEQ ID NO: 317133 - DNA, 75 bp, Artificial Sequence
  Synthetic
ggtgaaccccacccccccaaacaccacggcccaactggcggcagcagtggacgccactggcggttctgtggacaa

SEQ ID NO: 317134 - DNA, 75 bp, Artificial Sequence
  Synthetic
cgtcccagctgaagttcgcgactcattcgtggtgatgaacaactacacctggaacaccagggctgctcagaacac

SEQ ID NO: 317135 - DNA, 75 bp, Artificial Sequence
  Synthetic
cttgctgggcgcaatggcactgggccctgactgcaacccctaccttcgtcacctgggccgcatgtttgggggctg

SEQ ID NO: 317136 - DNA, 75 bp, Artificial Sequence
  Synthetic
gagtggctcagttgagttccgcatcagcgtgtcgggctctgggatttacgcaggaaagctgttggctgtcgtctt

SEQ ID NO: 317137 - DNA, 75 bp, Artificial Sequence
  Synthetic
gccaccacgcgttcagccaaatgacgtcacaaacccaggacaatacccacacgccatcatagatgccaaaacgtc

SEQ ID NO: 317138 - DNA, 75 bp, Artificial Sequence
  Synthetic
tgtggccttttccatcccggtttttgacatacgcaacaaccagttccattacaatggtgacagcgatgtctgcac

SEQ ID NO: 317139 - DNA, 75 bp, Artificial Sequence
  Synthetic
ctttgggatatgggtttaccaaccactaatcaacccctttaatgttggcggagagtccgctgccattgtcactgt

SEQ ID NO: 317140 - DNA, 75 bp, Artificial Sequence
  Synthetic
agagaccagaccgagccttgactttcgcttctgtctcctcaagtctcctgatgacatcacctccactgctgaccc

SEQ ID NO: 317141 - DNA, 75 bp, Artificial Sequence
  Synthetic
aagtgacctcctacctcggaacttagtaggtgccacagagaatagaatggggttgccagtgcagaccatagagat

SEQ ID NO: 317142 - DNA, 75 bp, Artificial Sequence
  Synthetic
tgtcaatgctgcgcaccaggtcaaccaccactactcccccaatggtgaaacttttgggtggtctacagtcccagt

SEQ ID NO: 317143 - DNA, 75 bp, Artificial Sequence
  Synthetic
tggcaatccagaactggtcatcaacacagcacgtgtcaacatggtatccaatccatcaggtcctctatctatagg

SEQ ID NO: 317144 - DNA, 75 bp, Artificial Sequence
  Synthetic
ttaccgtgttacacctgcacctggggcagacccaattgtacccggcattcccaatcactggcctgatgggtgtgc

SEQ ID NO: 317145 - DNA, 75 bp, Artificial Sequence
  Synthetic
cagcactgtgaccagcgggggggggaattcggctactggcgttggtgcctctgggaccatcctgcccatgtacaa

SEQ ID NO: 317146 - DNA, 75 bp, Artificial Sequence
  Synthetic
ctctgatgtggaggaggaaaacccctacacagtcaagtatgctgtctttaacaccacgggggcccccctcgctgc

SEQ ID NO: 317147 - DNA, 75 bp, Artificial Sequence
  Synthetic
tgccatcgatcgtggcaacttgatggtcatcaggtacaacggcactactggcaacccggggaacaacaacaacgc

SEQ ID NO: 317148 - DNA, 75 bp, Artificial Sequence
  Synthetic
cctgtgctcggttaattttgttggcagacctgacaatgcttcacctgggttgcgagagctggtgacccccctcgc

SEQ ID NO: 317149 - DNA, 75 bp, Artificial Sequence
  Synthetic
aaactcgcagtccatctatggtcctgtcggtggtaacaacatagcactgtggggtgccactgccccttcctcaca

SEQ ID NO: 317150 - DNA, 75 bp, Artificial Sequence
  Synthetic
ccagaacgggtcgcctgtgtacagctcccagttgcaagagacctctgttgcctgtgcggcaaccaggaatgtgcc

SEQ ID NO: 317151 - DNA, 75 bp, Artificial Sequence
  Synthetic
ccctggggctgttgccatctacaccgtcaacacagccggcatggtgtttcaggtgggaatctactcggatggcta

SEQ ID NO: 317152 - DNA, 75 bp, Artificial Sequence
  Synthetic
catgagaactggggctcccacgggcacctcagttgtcgtaggacccaatactacaatcacatacaatgggctgta

SEQ ID NO: 317153 - DNA, 75 bp, Artificial Sequence
  Synthetic
ctcatctagcactcctctcaatgggcctcatgggacaagtgggctgtctgggtggtcaagaacatgagttggttt

SEQ ID NO: 317154 - DNA, 75 bp, Artificial Sequence
  Synthetic
tcgggggcacttgggactgcaggcttctttggcgacctagcaggcacaattggcaacattgttgctcagcaacag

SEQ ID NO: 317155 - DNA, 75 bp, Artificial Sequence
  Synthetic
atggttagaaaccaggctaagcaattggaaatttaccagcaagctgttaacaagtcccttgatctgcagcagagg

SEQ ID NO: 317156 - DNA, 75 bp, Artificial Sequence
  Synthetic
gcacaagatgtgtcagtctacctttctacccaggcaccagttttacaatatggtagtgcccgcgctctggggttg

SEQ ID NO: 317157 - DNA, 75 bp, Artificial Sequence
  Synthetic
acccaccaggaagcgcaaaaggttgtctctggacatcggatcctcgtgggtggggtggatgttgagcctaggcag

SEQ ID NO: 317158 - DNA, 75 bp, Artificial Sequence
  Synthetic
ttgccgactttaccattcttcatccaaccaactggtcatcaaggtgccgggcatgcaacatcagctcggttcctc

SEQ ID NO: 317159 - DNA, 75 bp, Artificial Sequence
  Synthetic
actggcacgccgggggccaccgagcctgctcctcctgggttttcaaacccgaactatggggttaaattgacttct

SEQ ID NO: 317160 - DNA, 75 bp, Artificial Sequence
  Synthetic
cttatcgccaacaattggaccactctgttggtgaatcaaatgcatgagttcttttctttttccccttttcagtgt

SEQ ID NO: 317161 - DNA, 75 bp, Artificial Sequence
  Synthetic
gtgattggttagatggcttctaagccatattatccaattactctcaaccccacctttgagtgggaagtcttcctt

SEQ ID NO: 317162 - DNA, 75 bp, Artificial Sequence
  Synthetic
aggtgctacctcagggtagaaccacgggaagaattttgcgagagcttacaagaactaaaattttattttcacagg

SEQ ID NO: 317163 - DNA, 75 bp, Artificial Sequence
  Synthetic
cgcttaagcgcctttgtcaagcacgccaccagggccctccaaaggaactacacctttgaagaggagggcctcctt

SEQ ID NO: 317164 - DNA, 75 bp, Artificial Sequence
  Synthetic
gacgtgtttggaactaaaccaccagatgatgtccaggaaagcacactatttcgggagttgtttggagtagaccca

SEQ ID NO: 317165 - DNA, 75 bp, Artificial Sequence
  Synthetic
accgaacagttcccgttgtcattgacagaccttgcacgcctccaaggcgagcttgttgatgccacacgaacacct

SEQ ID NO: 317166 - DNA, 75 bp, Artificial Sequence
  Synthetic
gggcacaagcttcgccagaggtacgatctcaatacaattggcaggctagtggataagatcaccaagttggtccct

SEQ ID NO: 317167 - DNA, 75 bp, Artificial Sequence
  Synthetic
gttcaagccaccctcaatgagatgcatgcacgtagacagtacgagcgtgatcgtgctgaactgtttcatgaactg

SEQ ID NO: 317168 - DNA, 75 bp, Artificial Sequence
  Synthetic
cctttggtggatgatgagattgttaggaaaccaaaaccatacttttatactatgtggagacaggtggtcaagaag

SEQ ID NO: 317169 - DNA, 75 bp, Artificial Sequence
  Synthetic
agcaaagcatatttttgcccactagtaaagacaagcgcttggcgcacccgcgtcagtgccataactgaacccatt

SEQ ID NO: 317170 - DNA, 75 bp, Artificial Sequence
  Synthetic
aaggattttgtgatagcattttgccaggcagtccaaaaagagatgggtcttaacccacagtatttgcaattggca

SEQ ID NO: 317171 - DNA, 75 bp, Artificial Sequence
  Synthetic
tggttgcaaaaattgaaacctactacactgaccattatactacagcaacacaagcacactgtatctggctggcta

SEQ ID NO: 317172 - DNA, 75 bp, Artificial Sequence
  Synthetic
gccacaatgacatcccttgttgaggtttactcaaacctctttgatgacctgagaaagtcctctgtaaccatcatt

SEQ ID NO: 317173 - DNA, 75 bp, Artificial Sequence
  Synthetic
gcaagtataggggctttctttgacatgtgtaaagactttattagtgaagtgatcagtttagtaaaaaccactttc

SEQ ID NO: 317174 - DNA, 75 bp, Artificial Sequence
  Synthetic
accccgcaagggccaactgacttggggtgggcagccgtgcttgcaggagccactatgatcttgcttaaaatggcg

SEQ ID NO: 317175 - DNA, 75 bp, Artificial Sequence
  Synthetic
gggtgtccaggggttgctggcatgtggtcaaaggttttgaagatttgtggtagcataacaaccatcactgccgca

SEQ ID NO: 317176 - DNA, 75 bp, Artificial Sequence
  Synthetic
gcacgaggcattcggtggttaaaggagctctatgaagaggctgagggccgacgactgacgaaaatgtacatggca

SEQ ID NO: 317177 - DNA, 75 bp, Artificial Sequence
  Synthetic
cggggggctgctctcatagaactggcagccagcaaagaggttactggtgtcgatgaactgaaaggtttgcttgag

SEQ ID NO: 317178 - DNA, 75 bp, Artificial Sequence
  Synthetic
tgttttactatactgattgaagaaggcacagagctcatgcacaagttcggcacgagtccactggctggtctaatc

SEQ ID NO: 317179 - DNA, 75 bp, Artificial Sequence
  Synthetic
cgaacatatgtgtccgagcttgaggcacaagccaacaacataaggtcaactatcaaattagacaccccaagacag

SEQ ID NO: 317180 - DNA, 75 bp, Artificial Sequence
  Synthetic
gttcccaccgtggtcatcttaactggaccccccggtataggcaagactaagttggcacaatacattggccagcga

SEQ ID NO: 317181 - DNA, 75 bp, Artificial Sequence
  Synthetic
tttggcaagacatccaacttctctgttgctgtcgatcaccacgatggttacaccggaaacaaagtctgcatctgg

SEQ ID NO: 317182 - DNA, 75 bp, Artificial Sequence
  Synthetic
gacgagttcgatgttgattctaaaggagtgtttgtggaaacaatgattggcattgctaacacggccccgttcccg

SEQ ID NO: 317183 - DNA, 75 bp, Artificial Sequence
  Synthetic
ttaaactgtgacagggtagaaaacaagggtcgtgtgttcacatcggactatgtcatctgcacatccaactacccc

SEQ ID NO: 317184 - DNA, 75 bp, Artificial Sequence
  Synthetic
acttcagtgatacccgaaaacccacgtgcagcagccttctatcgtagggtaattattgtggatgtatcggcccct

SEQ ID NO: 317185 - DNA, 75 bp, Artificial Sequence
  Synthetic
gatttggaagaatggaagaagaggaaccccggcaagcgccccacacccgatctataccaggatgacttttctcat

SEQ ID NO: 317186 - DNA, 75 bp, Artificial Sequence
  Synthetic
ttgaaattgatgttgcgaccatacctcgggtacaaccccgaaggggacactctggaggggactagagttcggcca

SEQ ID NO: 317187 - DNA, 75 bp, Artificial Sequence
  Synthetic
acacagatcagcatcgggaaccttgtaaaccttatggagaaaaggtttaaggaacagtcaggagatttacaaaat

SEQ ID NO: 317188 - DNA, 75 bp, Artificial Sequence
  Synthetic
ctatggctacaggtacccaaagcaatggttgaccaggctaccaacatggtaaaaactttcatgtatgcaaaccgg

SEQ ID NO: 317189 - DNA, 75 bp, Artificial Sequence
  Synthetic
gccgtttgtagtgtcatcccaaaccccgcttctagagacattactgagacagcactttcaaaaatattcatatgt

SEQ ID NO: 317190 - DNA, 75 bp, Artificial Sequence
  Synthetic
ggcacagccccccccccagagtttgagggcaagcacattgtgattactggcctcgaacctggcgaggcctctttg

SEQ ID NO: 317191 - DNA, 75 bp, Artificial Sequence
  Synthetic
gcaaattcacttttgtctatgttttccaccaccacacgattatctgcttccgcccagcgtgagtacatgtaccgt

SEQ ID NO: 317192 - DNA, 75 bp, Artificial Sequence
  Synthetic
gtgtggagtccaatgattcacattcaagaccgatccatcaacacacaaaacctcccttacatcaatagagttatc

SEQ ID NO: 317193 - DNA, 75 bp, Artificial Sequence
  Synthetic
cctgtcacatcacactgggatttccttaggggcttacgccaccatttgggttttacatcaatacctggcatgtgg

SEQ ID NO: 317194 - DNA, 75 bp, Artificial Sequence
  Synthetic
cgtgccttccagggttggaggacctcccaaggtataattgattttgtggctaaccacatggcagacgtgacgttc

SEQ ID NO: 317195 - DNA, 75 bp, Artificial Sequence
  Synthetic
ccaagtaatcccgagtgtacaatatttagaacccctgatgcagatgtggtgttctatacctttggatcctatgtg

SEQ ID NO: 317196 - DNA, 75 bp, Artificial Sequence
  Synthetic
tgttttgcttcaccagctagggtcccgtttgttggggtgcccccaccaaatgtacattccaatgccccccactgt

SEQ ID NO: 317197 - DNA, 75 bp, Artificial Sequence
  Synthetic
atgacatggggtgaaacccttgccctgctttgtgaggtcgccgttgagttcatgctacactttggaccggtcata

SEQ ID NO: 317198 - DNA, 75 bp, Artificial Sequence
  Synthetic
ctctcagcaacgaacattgcttacttgttggcacgtggctcaagatccgaggaggccaaagggaaaactaaacac

SEQ ID NO: 317199 - DNA, 75 bp, Artificial Sequence
  Synthetic
ggccgaggaatgagacacggtcaccgggcaggcgtgagcctgtctgacgatgagtacgatgagtggcgtgacctc

SEQ ID NO: 317200 - DNA, 75 bp, Artificial Sequence
  Synthetic
atgagggactggcgcagagacatgagtgttagtgatttcctcatgctaagagaaagatcagcacttggcatggac

SEQ ID NO: 317201 - DNA, 75 bp, Artificial Sequence
  Synthetic
gacgaggacgtcgcgcgctaccgggcttggctcgaagtgcgcgcgatgcgccttgctggcggggcgtacactcat

SEQ ID NO: 317202 - DNA, 75 bp, Artificial Sequence
  Synthetic
gcaacaatcattggccgtggtggggtgcgcgatgagatcatacgcacagcaccgcgtagggcgccaaccaaacca

SEQ ID NO: 317203 - DNA, 75 bp, Artificial Sequence
  Synthetic
cattccagctatgaggaggaagggccgaccgctgtagtggagttcaccatggatggagatcacattggttatggt

SEQ ID NO: 317204 - DNA, 75 bp, Artificial Sequence
  Synthetic
gtgcatgttggcaatggtagcgttgtgactgtgacacatgttgcctcctcgtccaacctggtagacggtcaaccc

SEQ ID NO: 317205 - DNA, 75 bp, Artificial Sequence
  Synthetic
tttaaagtgcaccgaacacttggagagaccacctgggtgcacacatcattgtctgggctaccccacatgcaaatt

SEQ ID NO: 317206 - DNA, 75 bp, Artificial Sequence
  Synthetic
ggccaaggcacaccagtttattttaccaataggctccacccggtacttactatatctgaggggacatttgaaaca

SEQ ID NO: 317207 - DNA, 75 bp, Artificial Sequence
  Synthetic
cctaacatcacagttaagggttaccatgttcgcatcaccaatggttaccccacaaagaagggtgattgtggcctc

SEQ ID NO: 317208 - DNA, 75 bp, Artificial Sequence
  Synthetic
ccttactttaatgctcatcgccagcttgtggcattgcatgcaggaactgatacacagggtgaaacaaaagtggca

SEQ ID NO: 317209 - DNA, 75 bp, Artificial Sequence
  Synthetic
cagcgggtcccaaaggacgccactgtggaggatgagttccaatggaaagggctacctgtggtgaagtcagacatt

SEQ ID NO: 317210 - DNA, 75 bp, Artificial Sequence
  Synthetic
gatgtcgggggaatgccaactggcacacggtaccaccgttccccagcttggcccgaagagcagcctggtgaaaca

SEQ ID NO: 317211 - DNA, 75 bp, Artificial Sequence
  Synthetic
catgcacctgcaccatttggtgcaggagacaagaggtacacgttttcacaaactgaaatgctagtcaatggtttg

SEQ ID NO: 317212 - DNA, 75 bp, Artificial Sequence
  Synthetic
aaaccatacacagagacgacaccaggtattcccccccaactgcttgcacgtgccgtttcccatgttcgcagctat

SEQ ID NO: 317213 - DNA, 75 bp, Artificial Sequence
  Synthetic
ctggaaaccattattgggacccacaggtcacccgtcctgacattccaccaagccagcgagctcctggaacgtgca

SEQ ID NO: 317214 - DNA, 75 bp, Artificial Sequence
  Synthetic
acttcttgtggcccattcatacagggtctcaaaggtgattattgggacgaagaagaacaggtttacaaaggtata

SEQ ID NO: 317215 - DNA, 75 bp, Artificial Sequence
  Synthetic
cttggtgaccatcttagagaggcttgggacaaagcgtgcaaaggtgttgcccccaagaacgcctacaagctggct

SEQ ID NO: 317216 - DNA, 75 bp, Artificial Sequence
  Synthetic
ttgaaggatgagctccgcccaatagagaagaataagttggggaagaggcggttactctggggatgtgacgctgcc

SEQ ID NO: 317217 - DNA, 75 bp, Artificial Sequence
  Synthetic
accacgctaatcgctacagcagccttcaaagcggttgccacgagattacaagcagtcactcccatgacaccagtc

SEQ ID NO: 317218 - DNA, 75 bp, Artificial Sequence
  Synthetic
gctgtaggtattaacatggactcaatgcagatgcaagtgatgaatgactcactcactggtggcgtgttgtattgc

SEQ ID NO: 317219 - DNA, 75 bp, Artificial Sequence
  Synthetic
ttggactactcaaagtgggactccacacaaaaccccgcggtcacagcagcctctttggcaattcttgaaagattt

SEQ ID NO: 317220 - DNA, 75 bp, Artificial Sequence
  Synthetic
gctgaacctcacccaattgtctcatgcgccattgagtcgttgtcatccccagctgttggttacatcaatgatatc

SEQ ID NO: 317221 - DNA, 75 bp, Artificial Sequence
  Synthetic
aagtttacaaccagagggggcttaccttcaggcatgccattcacatcagttgtcaactcactcaaccatatgata

SEQ ID NO: 317222 - DNA, 75 bp, Artificial Sequence
  Synthetic
tacattgctgcagcggttttacaggcgtatgaggaacaccacgccccctacactggcaatgttttccaaattgaa

SEQ ID NO: 317223 - DNA, 75 bp, Artificial Sequence
  Synthetic
accattcacacatatggtgatgactgtatgtacagtttctgccccgccacggcatcagtgttccaaacagttttg

SEQ ID NO: 317224 - DNA, 75 bp, Artificial Sequence
  Synthetic
gccagtttgattcggttcggattgaagcccactgcggcagacaaaagtgaagcaatcaaacccacaacaacacca

SEQ ID NO: 317225 - DNA, 75 bp, Artificial Sequence
  Synthetic
gtgtttttgaaaagaacattcacacagacaccacaaggagttagggcattgctggatttgtcttcaatcacaagg

SEQ ID NO: 317226 - DNA, 75 bp, Artificial Sequence
  Synthetic
caattctactggttgaaagccaacagaacttcagacccatctagcccaccagcatttgaccgccaggcacggggt

SEQ ID NO: 317227 - DNA, 75 bp, Artificial Sequence
  Synthetic
gctcaattggaaaacgcactagcatttgcctcccaacacggaccactagcctttgacaaggtccgtgagatagcc

SEQ ID NO: 317228 - DNA, 75 bp, Artificial Sequence
  Synthetic
atcaaaacggcacagggtgaaggtttggtgttagtgaacaccaattatgatcacgctctcgccacctacaacgca

SEQ ID NO: 317229 - DNA, 75 bp, Artificial Sequence
  Synthetic
tggttcataggtggtacagtgcctgacccagaacgccccactgaaggcgcgtccaaaatagtgtttgagatggag

SEQ ID NO: 317230 - DNA, 75 bp, Artificial Sequence
  Synthetic
ggcaatggctcccaacaaggggcacgaccaaaaagtccacctcaaagtgttgaccttcctggcacggttggcccg

SEQ ID NO: 317231 - DNA, 75 bp, Artificial Sequence
  Synthetic
gccacatccaatgttgttgtggctaatccggaacaacccaatggggccgcacaacgcttggagatggctgttgcc

SEQ ID NO: 317232 - DNA, 75 bp, Artificial Sequence
  Synthetic
actggcacaatccaatccaatgtccctgaggcaatacggaactgctttgcagtctttcgtacttttgcttggaat

SEQ ID NO: 317233 - DNA, 75 bp, Artificial Sequence
  Synthetic
gacaggatgcccgcgggaacttaccttggatctgtatcgcttcatcccaacattaatccatacactcagcacttg

SEQ ID NO: 317234 - DNA, 75 bp, Artificial Sequence
  Synthetic
tcagcaatgtgggctgggtggggtggcagttttgaggcccgtctatcggtctctgggtctggtgtctacgctggc

SEQ ID NO: 317235 - DNA, 75 bp, Artificial Sequence
  Synthetic
cgtatcattgcttctgtcgtaccaccaggggttgatccaacgaccatccgtgacccaggggtgctgcctcatgct

SEQ ID NO: 317236 - DNA, 75 bp, Artificial Sequence
  Synthetic
ttcgttgatgctcgcatcactgagccagtttcttttatagtgcctgatgtacgtgcagttgactaccaccgcatg

SEQ ID NO: 317237 - DNA, 75 bp, Artificial Sequence
  Synthetic
gacggcacagaacccacatgttcattgggtctttgggtttaccaaccactgattaacccattcgccactgcagcg

SEQ ID NO: 317238 - DNA, 75 bp, Artificial Sequence
  Synthetic
gtatctacatgttgggtgtcaattgagaccaaaccagggggcgattttgacttttgccttttgaaaccaccaggg

SEQ ID NO: 317239 - DNA, 75 bp, Artificial Sequence
  Synthetic
cagcagatgcaaaatggtatatcacctgagggcctgttgccacgccgactgggttatgcaagaggcaatagggtt

SEQ ID NO: 317240 - DNA, 75 bp, Artificial Sequence
  Synthetic
ggtggccttgctgttggtatggttttggtgtctgagcacaagcaagtcaaccgccacttcaactcccaatcaata

SEQ ID NO: 317241 - DNA, 75 bp, Artificial Sequence
  Synthetic
acatatggctggtcaaccgcacccgtcaacccaatggcagccgaaattgtcaacaagtatgatcacactggcaca

SEQ ID NO: 317242 - DNA, 75 bp, Artificial Sequence
  Synthetic
ggtaataccaaaaggaatgcatggctatcaattggggcacaaaataagggtccactgttccctggtctacctaac

SEQ ID NO: 317243 - DNA, 75 bp, Artificial Sequence
  Synthetic
cactttccagactcctgcgcatcaactattgtgggtgccatggacacaaaccgtgggatgccatccactggggtt

SEQ ID NO: 317244 - DNA, 75 bp, Artificial Sequence
  Synthetic
tgtggtcctgcaattggtttccaaaacaatggtgatgtgtatgaaaatcacaccccctctgtgatgtttgctaca

SEQ ID NO: 317245 - DNA, 75 bp, Artificial Sequence
  Synthetic
tacaatccactcactggaggtggtaacaacccagttgcactttctgattcaattaatttggcatcattggcagtt

SEQ ID NO: 317246 - DNA, 75 bp, Artificial Sequence
  Synthetic
gtacgcattcagtctgaccaaaattttgactcaacaggtttcagcaatgataaaaatgtggttgtgcagacttca

SEQ ID NO: 317247 - DNA, 75 bp, Artificial Sequence
  Synthetic
tgggagatgtttgacaatgtgcagcagatttatgggagggtcaccccaatgcagggcaccaattttgtctttact

SEQ ID NO: 317248 - DNA, 75 bp, Artificial Sequence
  Synthetic
tcatctggggcaaatacgctcgtgttgtgggaggagcgcttgctcagttacgatggtcacgctgctattttacac

SEQ ID NO: 317249 - DNA, 75 bp, Artificial Sequence
  Synthetic
tcatcccaacttgaacgcaccgctgaagtcttccaaaatgacaacgtgaacataccccaaggtgccatggcagtt

SEQ ID NO: 317250 - DNA, 75 bp, Artificial Sequence
  Synthetic
ttcaatgttgacaccaattcggcttcatttcaagtcggcatcagggctgatggatacatggtcacaggaggcacc

SEQ ID NO: 317251 - DNA, 75 bp, Artificial Sequence
  Synthetic
gttgggacccatgtggcacttgacccagaaaccagattccaatttgttggggtgctccccttaaccgctgctctc

SEQ ID NO: 317252 - DNA, 75 bp, Artificial Sequence
  Synthetic
tcagggcccaatgggaacaatggtcgggccaggcgtgtgttccaatgagttggttggtaggcgccttacaaaccg

SEQ ID NO: 317253 - DNA, 75 bp, Artificial Sequence
  Synthetic
ccgggtccctcgtggacatggctggaaccatctctggcattgtgtatcaacagagacaagctgcccaactagaaa

SEQ ID NO: 317254 - DNA, 75 bp, Artificial Sequence
  Synthetic
agcaaaacaagctaatggaggaatggatgggcaaacaagaggcactccaacgatcacagatggagttgactagag

SEQ ID NO: 317255 - DNA, 75 bp, Artificial Sequence
  Synthetic
agttggcagtcaatgcacctgtggctagagttcaagcagcacttgatgcagggtttgatcaaataagtgccaggc

SEQ ID NO: 317256 - DNA, 75 bp, Artificial Sequence
  Synthetic
gtatggcggggtccaatgagagggtgatctatggcaatcttgaccgccccataatgcatgctggcacaatggaag

SEQ ID NO: 317257 - DNA, 75 bp, Artificial Sequence
  Synthetic
ggattcggaacaccaggcatcttgagtcaatcagtagctccctagccactttcaaaaatggcactcaatttggaa

SEQ ID NO: 317258 - DNA, 75 bp, Artificial Sequence
  Synthetic
aaccttctccacctaaatttatgactggtccacccaaaatacaacaagctaccattaacattggccacaaccctg

SEQ ID NO: 317259 - DNA, 75 bp, Artificial Sequence
  Synthetic
gtagctcacaggcctaaattttattttggatgtgtatgattcctcacgcgttcgggaggagttagtgtagttaag

SEQ ID NO: 317260 - DNA, 75 bp, Artificial Sequence
  Synthetic
attttggatgtgtatgattcctcacgcgttcgggaggagttagtgtagttaagcgactgcagtcatactacaacc

SEQ ID NO: 317261 - DNA, 75 bp, Artificial Sequence
  Synthetic
gtttttacctacccaggaaaagccaaccaacctcgatctcttgtagatctgttctctaaacgaactttaaaatct

SEQ ID NO: 317262 - DNA, 75 bp, Artificial Sequence
  Synthetic
accaacctcgatctcttgtagatctgttctctaaacgaactttaaaatctgtgtagctgtcgctcggctgcatgc

SEQ ID NO: 317263 - DNA, 75 bp, Artificial Sequence
  Synthetic
gtataagacacctgccataaaagattttggcggtttcaatttctcacaaatattgcctgacccttcaaagccaac

SEQ ID NO: 317264 - DNA, 75 bp, Artificial Sequence
  Synthetic
tgtgatgatgattatttcaataagaaggattggtatgacttcgtagagaatcctgacatcttacgcgtatatgct

SEQ ID NO: 317265 - DNA, 75 bp, Artificial Sequence
  Synthetic
ctagtgcacctacgcagtataaacaataataaattttactgtcgttgacaagaaacgagtaactcgtccctcttc

SEQ ID NO: 317266 - DNA, 75 bp, Artificial Sequence
  Synthetic
tattgcctgacccttcaaagccaacaaagagatcatttattgaagatttactcttcaacaaagtgactcttgctg

SEQ ID NO: 317267 - DNA, 75 bp, Artificial Sequence
  Synthetic
tgcagactgcttacggtttcgtccgtgttgcagtcgatcatcagcatacctaggtttcgtccgggtgtgaccgaa

SEQ ID NO: 317268 - DNA, 75 bp, Artificial Sequence
  Synthetic
agaagatgagtttacgcctttcgatgttgttagacaatgttctggtgtgacttttcaaggtaagttcaagaaaat

SEQ ID NO: 317269 - DNA, 75 bp, Artificial Sequence
  Synthetic
tgttgcagtcgatcatcagcatacctaggtttcgtccgggtgtgaccgaaaggtaagatggagagccttgttctt

SEQ ID NO: 317270 - DNA, 75 bp, Artificial Sequence
  Synthetic
attgctcacagatgaaatgattgctgcgtacaccgctgcccttgtcagtggtactgctactgctggctggacgtt

SEQ ID NO: 317271 - DNA, 75 bp, Artificial Sequence
  Synthetic
gtcactgtttttctttgtttatgagaatgctttcttgccatttacttttggtattatggctattgctgcttgtgc

SEQ ID NO: 317272 - DNA, 75 bp, Artificial Sequence
  Synthetic
tagagacgtgctagtgcgtggcttcggggactctgtggaagaggccctatcggaggcacgtgaacacctcaaaaa

SEQ ID NO: 317273 - DNA, 75 bp, Artificial Sequence
  Synthetic
gctgctgagtcccatatggatgctgatctcgcaaaaccacttattaagtgggatttgctgaaatatgattttacg

SEQ ID NO: 317274 - DNA, 75 bp, Artificial Sequence
  Synthetic
gaaaaaggcgtactgccccagcttgaacagccctatgtgttcattaaacgttctgatgccttaagcaccaatcac

SEQ ID NO: 317275 - DNA, 75 bp, Artificial Sequence
  Synthetic
ttctgatgccttaagcaccaatcacggccacaaggtcgttgagctggttgcagaaatggacggcattcagtacgg

SEQ ID NO: 317276 - DNA, 75 bp, Artificial Sequence
  Synthetic
caatcagtcaaattcaagaatcacttacgacaacatcaactgcattgggcaagctgcaagacgttgttaatgata

SEQ ID NO: 317277 - DNA, 75 bp, Artificial Sequence
  Synthetic
tcaccctcatgactgctcgtactgtctatgatgatgctgctaggcgtgtatggacattgatgaatgtcattacac

SEQ ID NO: 317278 - DNA, 75 bp, Artificial Sequence
  Synthetic
taaacaacttagctccaattttggtgcaatttcaagtgtgctaaatgacatcctttcacgactagacaaagtcga

SEQ ID NO: 317279 - DNA, 75 bp, Artificial Sequence
  Synthetic
tggacattgatgaatgtcattacacttgtttataaagtctattatggtaattccttagatcaagctatttccatg

SEQ ID NO: 317280 - DNA, 75 bp, Artificial Sequence
  Synthetic
taaagtcttatgacttaggtgacgagcttggcactgatcccattgaagattatgaacaaaactggaacactaagc

SEQ ID NO: 317281 - DNA, 75 bp, Artificial Sequence
  Synthetic
atggcagtggtgcactccgtgaactcactcgtgagctcaatggaggtgcagtcactcgctatgtcgacaacaatt

SEQ ID NO: 317282 - DNA, 75 bp, Artificial Sequence
  Synthetic
acaaacaatgttgcttttcaaactgtcaaacccggtaattttaataaagacttttatgactttgctgtgtctaaa

SEQ ID NO: 317283 - DNA, 75 bp, Artificial Sequence
  Synthetic
tatcacctgatgtctttcccccaagctgctccacatggtgtggtcttcctacatgtcacttatgtgccatcgcag

SEQ ID NO: 317284 - DNA, 75 bp, Artificial Sequence
  Synthetic
cttacagtgtattatgcttgtctattgtttcttaggctattgttgctgttgctactttggcctcttttgtttact

SEQ ID NO: 317285 - DNA, 75 bp, Artificial Sequence
  Synthetic
caatttgtcatgaaggcaaagcatacttccctcgtgaaggtgtttttgtatctaatggcacttcttggttcatca

SEQ ID NO: 317286 - DNA, 75 bp, Artificial Sequence
  Synthetic
ggtgtttatgactatttggtctccacacaggagtttagatatatgaactcacaagggcttttgccacctaagagt

SEQ ID NO: 317287 - DNA, 75 bp, Artificial Sequence
  Synthetic
cacaggagtttagatatatgaactcacaagggcttttgccacctaagagtagtattgatgcattcaagcttaaca

SEQ ID NO: 317288 - DNA, 75 bp, Artificial Sequence
  Synthetic
cacagaggaatttttactcaccacagataattacaacagacaatacatttgtcgctggaaattgtgatgtcgtaa

SEQ ID NO: 317289 - DNA, 75 bp, Artificial Sequence
  Synthetic
ctttcaaaggggaatgcccaaagtttgtgtttcctcttaactcaaaagtcaaagtcattcaaccacgtgttgaaa

SEQ ID NO: 317290 - DNA, 75 bp, Artificial Sequence
  Synthetic
accatgcataaaagttgctactgttcagtctaaaatgtctgacgtgaagtgcacttctgttgtactactttctgt

SEQ ID NO: 317291 - DNA, 75 bp, Artificial Sequence
  Synthetic
cagtctaaaatgtctgacgtgaagtgcacttctgttgtactactttctgttcttcaacaacttagagtagaatca

SEQ ID NO: 317292 - DNA, 75 bp, Artificial Sequence
  Synthetic
tgatcctctgcaacctgagcttgactcatttaaagaagagctggacaagtacttcaaaaatcatacatcaccaga

SEQ ID NO: 317293 - DNA, 75 bp, Artificial Sequence
  Synthetic
tgcaattgcacaatgacattttattggctaaagacacaactgaagcctttgaaaagatggtttctcttctgtctg

SEQ ID NO: 317294 - DNA, 75 bp, Artificial Sequence
  Synthetic
cgtagtgaagcttttgagtactaccacactcttgatgagagtttccttggtagatacatgtctgctttaaaccac

SEQ ID NO: 317295 - DNA, 75 bp, Artificial Sequence
  Synthetic
tgttgatctcggcgacatttcaggcattaatgcttctgtcgtcaatattcaaaaagaaattgaccgcctcaatga

SEQ ID NO: 317296 - DNA, 75 bp, Artificial Sequence
  Synthetic
ggctaaagacacaactgaagcctttgaaaagatggtttctcttctgtctgttctgctatctatgcaaggtgctgt

SEQ ID NO: 317297 - DNA, 75 bp, Artificial Sequence
  Synthetic
ctcattgacctccaagaacttggaaaatatgagcaatacatcaaatggccttggtatgtttggctcggcttcatc

SEQ ID NO: 317298 - DNA, 75 bp, Artificial Sequence
  Synthetic
ttggtggtttgacttcgattaagtgggctgataacaattgttatttgtctagtgttttattagcacttcaacaaa

SEQ ID NO: 317299 - DNA, 75 bp, Artificial Sequence
  Synthetic
actacaagaagcttactatagagctcgtgctggtgatgctgctaatttttgtgcacttatactcgcttacagtaa

SEQ ID NO: 317300 - DNA, 75 bp, Artificial Sequence
  Synthetic
gtcagagaaactatggcccatcttttacagcatgctaatttggaatctgcaaagcgagttcttaatgtggtgtgt

SEQ ID NO: 317301 - DNA, 75 bp, Artificial Sequence
  Synthetic
cgacgagtctgccgccaagtctgcatctgtttattacagtcagcttatgtgccaacctattctgttacttgacca

SEQ ID NO: 317302 - DNA, 75 bp, Artificial Sequence
  Synthetic
gtgacaatgtggagaccttgaatgaggatctccttgagatactgagtcgtgaacgtgttaacattaacattgttg

SEQ ID NO: 317303 - DNA, 75 bp, Artificial Sequence
  Synthetic
ggatctccttgagatactgagtcgtgaacgtgttaacattaacattgttggcgattttcatttgaatgaagaggt

SEQ ID NO: 317304 - DNA, 75 bp, Artificial Sequence
  Synthetic
gcttctacaagtgcctttattgacactataaagagtcttgattacaagtctttcaaaaccattgttgagtcctgc

SEQ ID NO: 317305 - DNA, 75 bp, Artificial Sequence
  Synthetic
ttgctgtttttcaaagcgcttccaaagtgattgcgcttcataagaggtggcagcttgccttgtataaaggcattc

SEQ ID NO: 317306 - DNA, 75 bp, Artificial Sequence
  Synthetic
tgtgatggtaacacttttacatatgcatctgctctctgggaaattcagcaagttgttgatgcagatagtaaaatt

SEQ ID NO: 317307 - DNA, 75 bp, Artificial Sequence
  Synthetic
tggacaacagagatcagttttaacaccactgtgtggttttccctcacaggctgctggtgttatcagatcaatttt

SEQ ID NO: 317308 - DNA, 75 bp, Artificial Sequence
  Synthetic
ctactgttagctgctggcatggaggcacaatttttgtacatctatgccctgatttacattctgcaaatcgtaagc

SEQ ID NO: 317309 - DNA, 75 bp, Artificial Sequence
  Synthetic
gctcacctataacaaagttgaaaacatgacgcccagagatcttggtgcatgtattgattgtaatgcaaggcatat

SEQ ID NO: 317310 - DNA, 75 bp, Artificial Sequence
  Synthetic
aaatccattactctatgatgctaactatttcgtatgttggcacaccaattgctttgactactgtataccatacaa

SEQ ID NO: 317311 - DNA, 75 bp, Artificial Sequence
  Synthetic
atgaactgagtccagtagcactacgacagatgtcttgtgcagctggtactacacaaacagcttgtactgatgaca

SEQ ID NO: 317312 - DNA, 75 bp, Artificial Sequence
  Synthetic
tgctcaccaacagtgtcattattatggcatatgtaactggtggtcttgtacaacagacttctcagtggttgtcta

SEQ ID NO: 317313 - DNA, 75 bp, Artificial Sequence
  Synthetic
acgtcaggtgacggaactactcagccaaaacttaaagaagactaccaaattggtggttattccgaggattggcat

SEQ ID NO: 317314 - DNA, 75 bp, Artificial Sequence
  Synthetic
taagggaggtaggtttgtgcttgcattactatcagaccatcaagatctcaagtgggctagattccctaagagtga

SEQ ID NO: 317315 - DNA, 75 bp, Artificial Sequence
  Synthetic
ggcatatgtaactggtggtcttgtacaacagacttctcagtggttgtctaatcttttgggcactactgttgaaaa

SEQ ID NO: 317316 - DNA, 75 bp, Artificial Sequence
  Synthetic
ttactatcagaccatcaagatctcaagtgggctagattccctaagagtgacggaacaggtactatttatacagaa

SEQ ID NO: 317317 - DNA, 75 bp, Artificial Sequence
  Synthetic
gaggcgaaacttagtgcaggagttgaatttctcaaggatgcttgggagattctcaaatttctcattacaggtgtt

SEQ ID NO: 317318 - DNA, 75 bp, Artificial Sequence
  Synthetic
cagacaccccaaaaggacctaaagtgaaatacttgtatttcattaagggcttaaacaacctaaatagaggtatgg

SEQ ID NO: 317319 - DNA, 75 bp, Artificial Sequence
  Synthetic
gaaatacttgtatttcattaagggcttaaacaacctaaatagaggtatggtattgggcagtttagctgctacagt

SEQ ID NO: 317320 - DNA, 75 bp, Artificial Sequence
  Synthetic
cagacttgaatggcgatgtagtggctattgactatagacactactcagcgagtttcaagaaaggtgctaaattac

SEQ ID NO: 317321 - DNA, 75 bp, Artificial Sequence
  Synthetic
tttgacatcgtcaagggtcaaatacaggttgcttcagataacatcaaggattgtgtaaaatgcttcattgatgtt

SEQ ID NO: 317322 - DNA, 75 bp, Artificial Sequence
  Synthetic
gaagtgccagccaactcaactgtgctttctttctgcgcctttgctgttgatccagctaaagcatacaaagattac

SEQ ID NO: 317323 - DNA, 75 bp, Artificial Sequence
  Synthetic
gaagtcttcatcgctcaaagcaagggactttaccgtcagtgtatacgtggcaaggagcagctgcaactactcatg

SEQ ID NO: 317324 - DNA, 75 bp, Artificial Sequence
  Synthetic
ccaattgcgtgaagatgctgtgcacacacactggtacaggacaggcaattaccgtaacacccgaagccaatatgg

SEQ ID NO: 317325 - DNA, 75 bp, Artificial Sequence
  Synthetic
attcctaggacgaacagcaatcacaacatcaaactgtgctaagagattagtacagcgtgtatttaacaactacat

SEQ ID NO: 317326 - DNA, 75 bp, Artificial Sequence
  Synthetic
ccagtctgtgtaaatggcctcatgctcttagagattaaggacaaagaacaatactgcgcattgtctcctggttta

SEQ ID NO: 317327 - DNA, 75 bp, Artificial Sequence
  Synthetic
atactgcgcattgtctcctggtttactggctacaaacaatgtctttcgcttaaaagggggtgcaccaattaaagg

SEQ ID NO: 317328 - DNA, 75 bp, Artificial Sequence
  Synthetic
gccctatgtgcttacattattgttccaattgtgtacttttaccaaaagtacaaattctagaattagagcttcact

SEQ ID NO: 317329 - DNA, 75 bp, Artificial Sequence
  Synthetic
tgggaagttcaaggttacaagaatgtgagaatcacatttgagcttgatgaacgtgttgacaaagtgcttaatgaa

SEQ ID NO: 317330 - DNA, 75 bp, Artificial Sequence
  Synthetic
cactagcactgatgtcgtttacagggcttttgacatctacaacgaaaaggttgctggttttgcaaagttcctaaa

SEQ ID NO: 317331 - DNA, 75 bp, Artificial Sequence
  Synthetic
atgtgttgtagcagaggctgttgtgaagactttacaaccagtttctgatctccttaccaacatgggtattgatct

SEQ ID NO: 317332 - DNA, 75 bp, Artificial Sequence
  Synthetic
gctacttcgttgcttctttcaggctgtttgctcgcacccgctcaatgtggtcattcaacccagaaacaaacattc

SEQ ID NO: 317333 - DNA, 75 bp, Artificial Sequence
  Synthetic
aaaacttttcatcacgtatgtattgttccttttaccctccagatgaggaagaagaggacgatgcagagtgtgagg

SEQ ID NO: 317334 - DNA, 75 bp, Artificial Sequence
  Synthetic
aattttgaccagaccgctcttggaaagtgaacttgtcattggtgctgtgatcattcgtggtcacttacgaatggc

SEQ ID NO: 317335 - DNA, 75 bp, Artificial Sequence
  Synthetic
aagaagaaattgatgaaacctgtgaacatgagtacggtacagaggatgattatcaaggtctccctctggaatttg

SEQ ID NO: 317336 - DNA, 75 bp, Artificial Sequence
  Synthetic
aacgtctaactaagtacacaatggcagacttagtctatgctctacgtcattttgacgagggcaattgtgacacat

SEQ ID NO: 317337 - DNA, 75 bp, Artificial Sequence
  Synthetic
attagactcgcttgattcctatccagctcttgaaaccatccaggtaacgatttcatcgtataagctagacttgac

SEQ ID NO: 317338 - DNA, 75 bp, Artificial Sequence
  Synthetic
tgaggaagaagaagaggaagactggctggatgatactactgagcaatcagagattgagccagaaccagaacctac

SEQ ID NO: 317339 - DNA, 75 bp, Artificial Sequence
  Synthetic
aaaatcctgacatcctgcgcgtatatgcaaaccttggtgagcgtgtacgtcaagctttattaaagactgtgcaat

SEQ ID NO: 317340 - DNA, 75 bp, Artificial Sequence
  Synthetic
ttactaatgatgtttcatttttagctcaccttcaatggtttgctatgttttctcccattgtgcctttctggataa

SEQ ID NO: 317341 - DNA, 75 bp, Artificial Sequence
  Synthetic
ctgcatacaaccgctaccgaattgggaactataaattaaatacagaccactcaggtagcaacgacaatattgctt

SEQ ID NO: 317342 - DNA, 75 bp, Artificial Sequence
  Synthetic
agcaccaggctgcggagttcctattgtggattcatactattctttgctgatgcctattctcacactaacgagggc

SEQ ID NO: 317343 - DNA, 75 bp, Artificial Sequence
  Synthetic
tttagctgctgagtcccatatggacgctgatctcacaaaaccactcattaagtgggatttgttgaaatatgactt

SEQ ID NO: 317344 - DNA, 75 bp, Artificial Sequence
  Synthetic
agtgggatttgttgaaatatgactttacggaagagagactctgtctcttcgaccgttactttaaatattgggatc

SEQ ID NO: 317345 - DNA, 75 bp, Artificial Sequence
  Synthetic
ctgtttggatgataggtgtatcctccattgtgcaaactttaatgtattgttttctactgtgttcccacctacaag

SEQ ID NO: 317346 - DNA, 75 bp, Artificial Sequence
  Synthetic
atcactatcaggagtgtgttagaggtaccactgtactactaaaagaaccttgcccgtcagggacctacgagggca

SEQ ID NO: 317347 - DNA, 75 bp, Artificial Sequence
  Synthetic
cattgtgcaaactttaatgtattgttttctactgtgttcccacctacaagctttggaccattagtaaggaaaata

SEQ ID NO: 317348 - DNA, 75 bp, Artificial Sequence
  Synthetic
atttcaattcacaggacatcttacttgcaccattgttgtcagcaggcatatttggtgctaaaccacttcagtctt

SEQ ID NO: 317349 - DNA, 75 bp, Artificial Sequence
  Synthetic
gacaaagctctttatgagcaggttgtcatggattatcttgataacctgaagcctagagtggaagcacctaaacaa

SEQ ID NO: 317350 - DNA, 75 bp, Artificial Sequence
  Synthetic
tttctgttaagatgtttgatgcttatgtcgacaccttttcagcaacttttagtgttcctatggaaaaacttaagg

SEQ ID NO: 317351 - DNA, 75 bp, Artificial Sequence
  Synthetic
ttcaccaagagctctattcaccactttttctcattgttgctgctctagtatttataatactttgcttcaccatta

SEQ ID NO: 317352 - DNA, 75 bp, Artificial Sequence
  Synthetic
aaaattaaggcctgcattgatgaggttaccacaacactggaagaaactaagtttcttaccaataagttactcttg

SEQ ID NO: 317353 - DNA, 75 bp, Artificial Sequence
  Synthetic
ttaccacaacactggaagaaactaagtttcttaccaataagttactcttgtttgctgatatcaatggtaagcttt

SEQ ID NO: 317354 - DNA, 75 bp, Artificial Sequence
  Synthetic
attggcaaagggtgtagctttagatggtgtcctatctacatttgtgtctgcagctcgtcaaggtgttgttgacac

SEQ ID NO: 317355 - DNA, 75 bp, Artificial Sequence
  Synthetic
tgatgttgatacaaaggatgtcattgaatgtctcaaaatttcacatcactcagacttggaagtgacaggtgacag

SEQ ID NO: 317356 - DNA, 75 bp, Artificial Sequence
  Synthetic
aggtgaagatatgtctttccttgagaaggatgcaccttacatggtaggtgatgttatcactagtggtgatatcac

SEQ ID NO: 317357 - DNA, 75 bp, Artificial Sequence
  Synthetic
aagaaccctgtaacaaagtctaaacgaacatgaaacttctcattgtttttggactcttaacatcagtatactgca

SEQ ID NO: 317358 - DNA, 75 bp, Artificial Sequence
  Synthetic
caagagctttgaagaaagtgccagttgatgagtatataaccacgtaccctggacaaggatgtgctggttatacac

SEQ ID NO: 317359 - DNA, 75 bp, Artificial Sequence
  Synthetic
tgatgagtatataaccacgtaccctggacaaggatgtgctggttatacacttgaggaagctaagactgctcttaa

SEQ ID NO: 317360 - DNA, 75 bp, Artificial Sequence
  Synthetic
gtctttgtcagagcagttgcgtaaacaaattcgtagtgctgctaagaagaacaacataccttttagattaacttg

SEQ ID NO: 317361 - DNA, 75 bp, Artificial Sequence
  Synthetic
caaattcgtagtgctgctaagaagaacaacataccttttagattaacttgtgccacgactaggcaagttgtcaat

SEQ ID NO: 317362 - DNA, 75 bp, Artificial Sequence
  Synthetic
gaaatgcaaatctgcattttatgtactaccttcagaagcacctaatgctaaggaagagattctaggaactgtatc

SEQ ID NO: 317363 - DNA, 75 bp, Artificial Sequence
  Synthetic
gcaaaagaattccgattcattatgaaatgtttggcaattacactatctcttgtgaaccccttgagataaactgtc

SEQ ID NO: 317364 - DNA, 75 bp, Artificial Sequence
  Synthetic
aggaagagattctaggaactgtatcctggaatttgagagaaatgcttgctcatgctgaagagacaagaaaattaa

SEQ ID NO: 317365 - DNA, 75 bp, Artificial Sequence
  Synthetic
agggtggtaagattattagtacttggtttaaactcatgctgaaagccacattattgtgtgtccttgctgcgttgt

SEQ ID NO: 317366 - DNA, 75 bp, Artificial Sequence
  Synthetic
gtttaaactcatgctgaaagccacattattgtgtgtccttgctgcgttgttttgttatgtcatcatgccggtaca

SEQ ID NO: 317367 - DNA, 75 bp, Artificial Sequence
  Synthetic
tgcctatatgcatggatgttagagccataatggcaaccatccaacgtaagtataaaggaattaaaattcaagagg

SEQ ID NO: 317368 - DNA, 75 bp, Artificial Sequence
  Synthetic
acaaatgagatcattggttacaaagctatccaagatggtgtcactcgtgacattgttcccactgatgattgtttt

SEQ ID NO: 317369 - DNA, 75 bp, Artificial Sequence
  Synthetic
cattgttcccactgatgattgttttgcaaacaaacatgctggttttgacacatggtttagtcagcgtggtggctc

SEQ ID NO: 317370 - DNA, 75 bp, Artificial Sequence
  Synthetic
aatgccaattggttatgtgacacatggttttaatcttgaagaggctgcgcgctgtatgcgttctcttaaagctcc

SEQ ID NO: 317371 - DNA, 75 bp, Artificial Sequence
  Synthetic
gggactacccaaaatgtgacagagccatgcctaacatgcttagaattatggcttctcttgttcttgctcgcaaac

SEQ ID NO: 317372 - DNA, 75 bp, Artificial Sequence
  Synthetic
gctgtatgcgttctcttaaagctcctgccgtagtgtcagtatcatcaccagatgctgttactacatataatggat

SEQ ID NO: 317373 - DNA, 75 bp, Artificial Sequence
  Synthetic
tgccgtagtgtcagtatcatcaccagatgctgttactacatataatggatacctcacttcgtcatcaaagacatc

SEQ ID NO: 317374 - DNA, 75 bp, Artificial Sequence
  Synthetic
gtgtgtttaacatttgtcaagcggtgacagctaatgtaaatgcacttctctcaactgatggtaacaagattgctg

SEQ ID NO: 317375 - DNA, 75 bp, Artificial Sequence
  Synthetic
cacaatctttaaggacgctatgggcaagcctgtgccatattgttatgatactaacttgcttgaaggttctatttc

SEQ ID NO: 317376 - DNA, 75 bp, Artificial Sequence
  Synthetic
acaagtacgttcgcaacctccaacacaggctatatgagtgtctctatagaaatagagacgttgatcatgaatttg

SEQ ID NO: 317377 - DNA, 75 bp, Artificial Sequence
  Synthetic
ggaaggttctgttagagtggttacaacttttgatgctgagtactgtagacatggtacatgcgaaagatcagaagc

SEQ ID NO: 317378 - DNA, 75 bp, Artificial Sequence
  Synthetic
tgacatatggacagcagtttggtccaacatacttggatggtgctgatgttacaaaaattaaacctcatgtaaatc

SEQ ID NO: 317379 - DNA, 75 bp, Artificial Sequence
  Synthetic
acttttgatgctgagtactgtagacatggtacatgcgaaagatcagaagctggtatttgcttatctactagtggt

SEQ ID NO: 317380 - DNA, 75 bp, Artificial Sequence
  Synthetic
acagagcgctacctggagttttctgtggagtcgatgctatgaatcttatagctaacatctttacccctcttgttc

SEQ ID NO: 317381 - DNA, 75 bp, Artificial Sequence
  Synthetic
tggagtcgatgctatgaatcttatagctaacatctttacccctcttgttcaacctgtaggtgctttagatgtttc

SEQ ID NO: 317382 - DNA, 75 bp, Artificial Sequence
  Synthetic
cctctaactattctggtgtcgttacgactatcatgttcttagctagagctatagtttttgtgtgtgttgagtatt

SEQ ID NO: 317383 - DNA, 75 bp, Artificial Sequence
  Synthetic
catgtctgctttaaaccacacaaagaaatggaaatttcctcaagttggtggtttaacttcaattaaatgggctga

SEQ ID NO: 317384 - DNA, 75 bp, Artificial Sequence
  Synthetic
gactgagactgatcttaccaaaggacctcatgaattttgctctcagcatacaatgctagttaaacaaggagatga

SEQ ID NO: 317385 - DNA, 75 bp, Artificial Sequence
  Synthetic
attgccatattggtgacttgtgccgcttactatttcatgaaattcaggcgtgcttttggtgaatacaaccatgtt

SEQ ID NO: 317386 - DNA, 75 bp, Artificial Sequence
  Synthetic
taacaattgttatttgtctagtgttttattagcacttcaacagcttgaagtcaaattcaatgcaccagcacttca

SEQ ID NO: 317387 - DNA, 75 bp, Artificial Sequence
  Synthetic
aaccaagtcgtacaacgtcactcaagcatttgggagacgcggtccagaacaaacccaaggaaactttggggacca

SEQ ID NO: 317388 - DNA, 75 bp, Artificial Sequence
  Synthetic
gttttgttgatgacatcgtcaaaacagatggtacacttatgattgaaaggtttgtgtcacttgcgattgatgctt

SEQ ID NO: 317389 - DNA, 75 bp, Artificial Sequence
  Synthetic
aaatggaaatttcctcaagttggtggtttaacttcaattaaatgggctgataacaattgttatttgtctagtgtt

SEQ ID NO: 317390 - DNA, 75 bp, Artificial Sequence
  Synthetic
ggtgatgctgctaacttttgtgcactcatactcgcttacagtaataaaactgttggcgagcttggtgatgtcaga

SEQ ID NO: 317391 - DNA, 75 bp, Artificial Sequence
  Synthetic
ggaatatgctgatgttttccacttgtatttgcaatacattaggaaattacatgatgagcttactggtcacatgtt

SEQ ID NO: 317392 - DNA, 75 bp, Artificial Sequence
  Synthetic
tatttgcaatacattaggaaattacatgatgagcttactggtcacatgttggacatgtactctgtaatgctaact

SEQ ID NO: 317393 - DNA, 75 bp, Artificial Sequence
  Synthetic
tcatactcgcttacagtaataaaactgttggcgagcttggtgatgtcagagaaactatgacccatcttctacagc

SEQ ID NO: 317394 - DNA, 75 bp, Artificial Sequence
  Synthetic
aacctgagttttacgaagccatgtacacaccacatacaatcttgcaggctgtaggtgcatgtgtgttgtgtaatt

SEQ ID NO: 317395 - DNA, 75 bp, Artificial Sequence
  Synthetic
cacaccacatacaatcttgcaggctgtaggtgcatgtgtgttgtgtaattcacagacttcacttcgttgcggcgc

SEQ ID NO: 317396 - DNA, 75 bp, Artificial Sequence
  Synthetic
gctgctttgtgtacctttttgcttaataaggaaatgtacctaaaattacgtagtgagacgctgttgccacttaca

SEQ ID NO: 317397 - DNA, 75 bp, Artificial Sequence
  Synthetic
tgcaagtgctgctatgaccatgttatttcaacatctcataaattagtactgtctgttaatccctatgtttgcaat

SEQ ID NO: 317398 - DNA, 75 bp, Artificial Sequence
  Synthetic
tttcaacatctcataaattagtactgtctgttaatccctatgtttgcaatgccccaggttgtggcgttactgatg

SEQ ID NO: 317399 - DNA, 75 bp, Artificial Sequence
  Synthetic
gaaatgctcgacaaccgcgctaccctgcaggctattgcttcagaatttagttctttaccatcatatgctgcctat

SEQ ID NO: 317400 - DNA, 75 bp, Artificial Sequence
  Synthetic
gaagcagcttgctgccacttagcaaaggctctaaatgacttcagtaattctggttctgatgttctttaccaacca

SEQ ID NO: 317401 - DNA, 75 bp, Artificial Sequence
  Synthetic
cctcccattagtttcccattgtgtgctaatggtcaggtttttggtctatataagaacacatgtgtaggcagtgac

SEQ ID NO: 317402 - DNA, 75 bp, Artificial Sequence
  Synthetic
agttgttcttaaaaagttaaagaaatctttgaatgtggctaaatctgagtttgaccgtgatgctgccatgcaacg

SEQ ID NO: 317403 - DNA, 75 bp, Artificial Sequence
  Synthetic
ggcattcccatcgggtaaagttgaagggtgcatggtacaagtaacctgtggaactacaactcttaacggattgtg

SEQ ID NO: 317404 - DNA, 75 bp, Artificial Sequence
  Synthetic
cttacacagagattgaaccaaaattggatgggtattataaaaaggataatgcttactatacagagcagcctatag

SEQ ID NO: 317405 - DNA, 75 bp, Artificial Sequence
  Synthetic
agacatgtcatttgcacagcggaagacatgcttaatcctaactatgaagacctgctcattcgcaaatctaatcat

SEQ ID NO: 317406 - DNA, 75 bp, Artificial Sequence
  Synthetic
gctactgtacgtgaagtactgtctgatagagaacttcatctttcatgggaggtaggaaaaccaagaccaccattg

SEQ ID NO: 317407 - DNA, 75 bp, Artificial Sequence
  Synthetic
aaagttgacacctctaaccctaagacacccaagtacaaatttgtccgcatccaacctggtcagacattttcagtt

SEQ ID NO: 317408 - DNA, 75 bp, Artificial Sequence
  Synthetic
acaaattggagagtacacatttgaaaaaggtgactatggtgatgctgttgtgtacagaggtactacaacatacaa

SEQ ID NO: 317409 - DNA, 75 bp, Artificial Sequence
  Synthetic
ggctacaaccaagacaacgttcaaaccaaacacttggtgtttacgttgtctttggagtacaaagccagtagatac

SEQ ID NO: 317410 - DNA, 75 bp, Artificial Sequence
  Synthetic
ctggtgtttatcagtgtgccatgagacctaaccacaccatcaagggttctttccttaatggatcatgtggtagtg

SEQ ID NO: 317411 - DNA, 75 bp, Artificial Sequence
  Synthetic
ttatacccaactctcaacatttcagaagagttttctagcaatgttgcaaactaccagaaggtcggtatgcaaaaa

SEQ ID NO: 317412 - DNA, 75 bp, Artificial Sequence
  Synthetic
aagagttttctagcaatgttgcaaactaccagaaggtcggtatgcaaaaatattcaacactccagggaccaccag

SEQ ID NO: 317413 - DNA, 75 bp, Artificial Sequence
  Synthetic
ggtgatagatggttccttaataggtttaccactacactaaatgatttcaatcttgtggcaatgaagtacaattat

SEQ ID NO: 317414 - DNA, 75 bp, Artificial Sequence
  Synthetic
ttaccactacactaaatgatttcaatcttgtggcaatgaagtacaattatgaaccactgacacaggaccatgttg

SEQ ID NO: 317415 - DNA, 75 bp, Artificial Sequence
  Synthetic
ctgcacgtgcgcgtgtggagtgctttgacaaattcaaagtgaattcaacattagaacagtacgttttctgcactg

SEQ ID NO: 317416 - DNA, 75 bp, Artificial Sequence
  Synthetic
tgacaaattcaaagtgaattcaacattagaacagtacgttttctgcactgtaaatgcactgcctgaaactactgc

SEQ ID NO: 317417 - DNA, 75 bp, Artificial Sequence
  Synthetic
aattgccactcatggtattgctgcaattaatagtgttccttggagtaaaattttggcttatgtcaaaccattctt

SEQ ID NO: 317418 - DNA, 75 bp, Artificial Sequence
  Synthetic
tcaatggcaactaattatgacttgagtgtcgtcaatgctagactacgtgcaaaacactacgtttacattggtgac

SEQ ID NO: 317419 - DNA, 75 bp, Artificial Sequence
  Synthetic
gagtttacaccattcgacgttgttagacaatgttctggtgttacatttcagggtaaattcaagaaaatagttaag

SEQ ID NO: 317420 - DNA, 75 bp, Artificial Sequence
  Synthetic
gacaatgttctggtgttacatttcagggtaaattcaagaaaatagttaagggtactcatcactgggtgcttttga

SEQ ID NO: 317421 - DNA, 75 bp, Artificial Sequence
  Synthetic
tggaggtgcagtcactcgctatgtcgacaacaatttctgtggcccagatgggtaccctcttgattgcatcaaaga

SEQ ID NO: 317422 - DNA, 75 bp, Artificial Sequence
  Synthetic
aactattgctaaaaatagtgttaagagtgttgctaaattatgtttggatgccggcattaattatgtgaagtcacc

SEQ ID NO: 317423 - DNA, 75 bp, Artificial Sequence
  Synthetic
tgttcaaagtacgcagtggtcactgtttttctttgtttacgagaatgccttcttgccatttactcttggtattat

SEQ ID NO: 317424 - DNA, 75 bp, Artificial Sequence
  Synthetic
ccggcattaattatgtgaagtcacccaaattttctaaattgttcacaatcgctatgtggctattgttgttaagta

SEQ ID NO: 317425 - DNA, 75 bp, Artificial Sequence
  Synthetic
tttttctttgtttacgagaatgccttcttgccatttactcttggtattatggctattgctgcatgcgctatgctt

SEQ ID NO: 317426 - DNA, 75 bp, Artificial Sequence
  Synthetic
agctaaaagcacacaaagaaaagtcagctcaatgctttaagatgttttacaagggtgtgatcacacatgatgttt

SEQ ID NO: 317427 - DNA, 75 bp, Artificial Sequence
  Synthetic
aactgctgcttttggtgtactcttatctaattttggtgctccttcttattgtaatggcgttagagaattgtatct

SEQ ID NO: 317428 - DNA, 75 bp, Artificial Sequence
  Synthetic
tgtgcttgtttctgttaccttctcttgcaacggttgcttatttcaatatggtctacatgcctgctagttgggtga

SEQ ID NO: 317429 - DNA, 75 bp, Artificial Sequence
  Synthetic
tgcaacggttgcttatttcaatatggtctacatgcctgctagttgggtgatgcgtatcatgacatggcttgaatt

SEQ ID NO: 317430 - DNA, 75 bp, Artificial Sequence
  Synthetic
gcagcatttgtttaagtggattagactcccttgattcttatccagctcttgaaaccattcaggtgacgatttcat

SEQ ID NO: 317431 - DNA, 75 bp, Artificial Sequence
  Synthetic
gaaaccattcaggtgacgatttcatcgtacaagctagacttgacaattttaggtctggccgctgagtgggttttg

SEQ ID NO: 317432 - DNA, 75 bp, Artificial Sequence
  Synthetic
catgacagctcgcactgtttatgatgatgctgctagacgtgtgtggacattgatgaatgtcatcacacttgttta

SEQ ID NO: 317433 - DNA, 75 bp, Artificial Sequence
  Synthetic
gagaaggatgaggaaggcaatttaatagactcttatttcgtagttaagagacatactatgtccaactaccagcat

SEQ ID NO: 317434 - DNA, 75 bp, Artificial Sequence
  Synthetic
tgcaatttacgagtctggaagtaccacgtcgcaatgtggctacgttacaagcagaaaatgtaactggactcttta

SEQ ID NO: 317435 - DNA, 75 bp, Artificial Sequence
  Synthetic
tttttagctagagccgtagtgtttgtgtgtgttgagtattacccattgctgttcattactggtaacactttacag

SEQ ID NO: 317436 - DNA, 75 bp, Artificial Sequence
  Synthetic
tgtacaaatggcacccgtttctgcaatggttaggatgtacatcttctttgcttctttctactacatatggaagag

SEQ ID NO: 317437 - DNA, 75 bp, Artificial Sequence
  Synthetic
aggactgtagtaaaatcattactggtcttcaccctacacaggcaccgacacacctcagtgttgatactaaattca

SEQ ID NO: 317438 - DNA, 75 bp, Artificial Sequence
  Synthetic
cttctttctactacatatggaagagctatgttcatatcatggatggttgcacctcttcgacttgcatgatgtgct

SEQ ID NO: 317439 - DNA, 75 bp, Artificial Sequence
  Synthetic
tgggctattgttgctgttgctactttggtcttttctgtttactcaaccgctactttagacttactcttggtgttt

SEQ ID NO: 317440 - DNA, 75 bp, Artificial Sequence
  Synthetic
tcttcaccctacacaggcaccgacacacctcagtgttgatactaaattcaagactgaaggcctctgtgttgacat

SEQ ID NO: 317441 - DNA, 75 bp, Artificial Sequence
  Synthetic
tactttagacttactcttggtgtttatgattacttggtctctacacaagagtttagatatatgaactctcagggg

SEQ ID NO: 317442 - DNA, 75 bp, Artificial Sequence
  Synthetic
tgagtgtacaactattgttaatggcatgaagagatctttctatgtctatgcaaatggaggccgtggcttctgcaa

SEQ ID NO: 317443 - DNA, 75 bp, Artificial Sequence
  Synthetic
tatcgcagactcatctctatgatgggcttcaaaatgaactatcaagtcaatggttaccctaatatgtttatcacc

SEQ ID NO: 317444 - DNA, 75 bp, Artificial Sequence
  Synthetic
caattgttgtggtgacgattatttcaataagaaggattggtatgactttgtagaaaatcctgacatcctgcgcgt

SEQ ID NO: 317445 - DNA, 75 bp, Artificial Sequence
  Synthetic
acgccttcaaacttaacattaagttgctaggtattggaggtaaaccatgcattaaagttgctactgtacagtcta

SEQ ID NO: 317446 - DNA, 75 bp, Artificial Sequence
  Synthetic
gctaggtattggaggtaaaccatgcattaaagttgctactgtacagtctaaaatgtctgatgtaaagtgcacatc

SEQ ID NO: 317447 - DNA, 75 bp, Artificial Sequence
  Synthetic
cattcattagtgatgaagttgctcgtgatttgtcactccagtttaaaagaccaatcaaccctactgaccagtcat

SEQ ID NO: 317448 - DNA, 75 bp, Artificial Sequence
  Synthetic
gggttgtcatgcaacaagggatgctgtgggaactaacctaccactccaattaggattttcgacaggtgttaactt

SEQ ID NO: 317449 - DNA, 75 bp, Artificial Sequence
  Synthetic
tgatttgtcactccagtttaaaagaccaatcaaccctactgaccagtcatcgtatattgttgatagtgttgctgt

SEQ ID NO: 317450 - DNA, 75 bp, Artificial Sequence
  Synthetic
caactcagagtagaatcatcttctaaattgtgggcgcaatgcgtgcaacttcataatgatattcttttggctaaa

SEQ ID NO: 317451 - DNA, 75 bp, Artificial Sequence
  Synthetic
gcttcaaaatgaactatcaagtcaatggttaccctaatatgtttatcacccgtgaagaagccattcgtcacgttc

SEQ ID NO: 317452 - DNA, 75 bp, Artificial Sequence
  Synthetic
ctagagtcaatgcaaaacctcctccaggtgaccaattcaaacatcttataccactcatgtataagggcttgccct

SEQ ID NO: 317453 - DNA, 75 bp, Artificial Sequence
  Synthetic
gtgggaactaacctaccactccaattaggattttcgacaggtgttaacttagtagctgtacccactggctatgtt

SEQ ID NO: 317454 - DNA, 75 bp, Artificial Sequence
  Synthetic
cttggaacattggacaacagagatcagttttaacaccactgtgtggttttccctcacaggctgctggtgttatca

SEQ ID NO: 317455 - DNA, 75 bp, Artificial Sequence
  Synthetic
atccatgcagggtgctgtagacattaacaagttgtgcgaggaaatgcttgacaaccgtgcaactcttcaggcaat

SEQ ID NO: 317456 - DNA, 75 bp, Artificial Sequence
  Synthetic
tcatatgctgcgtatgccacagcccaagaggcttatgagcaagctgtagctaacggtgattctgaagttgtactt

SEQ ID NO: 317457 - DNA, 75 bp, Artificial Sequence
  Synthetic
ttgcaaagagcagctgtcaccatacttgatggtatttctgaacagtcattacgtcttgtcgacgccatggtttat

SEQ ID NO: 317458 - DNA, 75 bp, Artificial Sequence
  Synthetic
tgctgccatgcaacgtaagttggaaaagatggcagatcaggctatgacccaaatgtacaaacaggcaagatctga

SEQ ID NO: 317459 - DNA, 75 bp, Artificial Sequence
  Synthetic
ttgctacagctcacagcgagttagcaaagggtgtagctttagatggtgtcctttctacattcgtgtcagctgccc

SEQ ID NO: 317460 - DNA, 75 bp, Artificial Sequence
  Synthetic
tgacacaaaggatgttattgaatgtctcaaactttcacatcactctgacttagaagtgacaggtgacagttgtaa

SEQ ID NO: 317461 - DNA, 75 bp, Artificial Sequence
  Synthetic
caatttcatgctcacctataataaggttgaaaacatgacgcccagagatcttggcgcatgtattgactgtaatgc

SEQ ID NO: 317462 - DNA, 75 bp, Artificial Sequence
  Synthetic
gacgcagatagtaaaattgtccaacttagtgaaatcaacatggacaattcgccaaatttggcttggcctcttatt

SEQ ID NO: 317463 - DNA, 75 bp, Artificial Sequence
  Synthetic
tttggaattgtaacgttgatcgttacccggccaatgctattgtttgtaggtttgacactagagttttatctaact

SEQ ID NO: 317464 - DNA, 75 bp, Artificial Sequence
  Synthetic
taaatcagctggatttccatttaataaatggggtaaggctaggctttattatgattcaatgagttatgaggacca

SEQ ID NO: 317465 - DNA, 75 bp, Artificial Sequence
  Synthetic
aggatggtgtcactcgtgacatcatttctactgatgattgttttgcaaataaacatgctggttttgacgcatggt

SEQ ID NO: 317466 - DNA, 75 bp, Artificial Sequence
  Synthetic
caccttgtaggtttgttacagacacaccaaaaggacctaaagtgaagtatttgtacttcattaagggactaaaca

SEQ ID NO: 317467 - DNA, 75 bp, Artificial Sequence
  Synthetic
aaatgacaaaagctgccctgtagtagctgctatcattacaagagagattggtttcatagtgcctggcttaccggg

SEQ ID NO: 317468 - DNA, 75 bp, Artificial Sequence
  Synthetic
gcgttcttgctgctgagtgtacaatttttaaggatgctatgggcaaacctgtgccatattgttatgacactaatt

SEQ ID NO: 317469 - DNA, 75 bp, Artificial Sequence
  Synthetic
cgatggacagattggcgaagcgcccgtgtctatcattaataatgctgtttacaccaaagtagatggcaatgatgt

SEQ ID NO: 317470 - DNA, 75 bp, Artificial Sequence
  Synthetic
gtgccatattgttatgacactaatttgctagagggttctatttcttatagtgagcttcgtccagacactcgttat

SEQ ID NO: 317471 - DNA, 75 bp, Artificial Sequence
  Synthetic
atcatttggtggtgcttcatgctgcctgtattgtagatgccacattgaccatccaaatcctaaaggattttgtga

SEQ ID NO: 317472 - DNA, 75 bp, Artificial Sequence
  Synthetic
gagtgtgcacaagtattaagtgagatggtcatgtgcggaggctcactatatgtaaaaccaggtggaacatcatca

SEQ ID NO: 317473 - DNA, 75 bp, Artificial Sequence
  Synthetic
ctgtattgtagatgccacattgaccatccaaatcctaaaggattttgtgatttgaaaggtaagtatgttcaaata

SEQ ID NO: 317474 - DNA, 75 bp, Artificial Sequence
  Synthetic
tgaagatctcctagagatactgcgtcgtgaacgtgttaacattaacattgttggcgattttcagttgaatgaaga

SEQ ID NO: 317475 - DNA, 75 bp, Artificial Sequence
  Synthetic
tttgcggtgtaagtgcagcccgtcttacaccgtgcggcacaggcactagtactgatgtcgtttacagggcttttg

SEQ ID NO: 317476 - DNA, 75 bp, Artificial Sequence
  Synthetic
gttcttaataatgagcattacagagctctatcaggagttttctgtggtgttgatgcgatgaatctcatagctaac

SEQ ID NO: 317477 - DNA, 75 bp, Artificial Sequence
  Synthetic
accttttcagaaatgcccgaaacggtgttttaataacagaaggttcagtcaagggtttaacaccatctaaaggac

SEQ ID NO: 317478 - DNA, 75 bp, Artificial Sequence
  Synthetic
tgtgttaactccttcttcaaagagatttcaaccatttcaacaatttggccgtgatgtttctgatttcactgattc

SEQ ID NO: 317479 - DNA, 75 bp, Artificial Sequence
  Synthetic
tccaactaccaacatgaagagactatttataacttggttaaagaatgtccagcagttgccgttcatgactttttc

SEQ ID NO: 317480 - DNA, 75 bp, Artificial Sequence
  Synthetic
acacagtttaattatttcaagaaagtagatggcatcatccaacaattgcctgaaacctactttacacagagtaga

SEQ ID NO: 317481 - DNA, 75 bp, Artificial Sequence
  Synthetic
tagatggcatcatccaacaattgcctgaaacctactttacacagagtagagacttagaggattttaagcccagat

SEQ ID NO: 317482 - DNA, 75 bp, Artificial Sequence
  Synthetic
gctcgcaatggatggattcatacagcgatacaagctagaaggctatgccttcgagcataccgtttatggagattt

SEQ ID NO: 317483 - DNA, 75 bp, Artificial Sequence
  Synthetic
aatactcgtcacatataattgttgtgatgataattatttcaataagaaggattggtatgattttgtagagaatcc

SEQ ID NO: 317484 - DNA, 75 bp, Artificial Sequence
  Synthetic
ttaggtgagcgtgtacgccaagcattattaaaaactgtgcaattctgcgatgctatgcgcgatgcaggcatcgta

SEQ ID NO: 317485 - DNA, 75 bp, Artificial Sequence
  Synthetic
atcttaatgggaactggtatgatttcggagattttgtacaagtagcacaaggctgcggagttcctattgtggatt

SEQ ID NO: 317486 - DNA, 75 bp, Artificial Sequence
  Synthetic
aacaggtatcttgctctatataacaagtacaagtatttcagtggagccttagatactaccagctatcgtgaagca

SEQ ID NO: 317487 - DNA, 75 bp, Artificial Sequence
  Synthetic
agtacaagtatttcagtggagccttagatactaccagctatcgtgaagcagcttgctgccacttagcaaaggctc

SEQ ID NO: 317488 - DNA, 75 bp, Artificial Sequence
  Synthetic
tatgctgaaatatcatttatgctttggtgtaaagatggacatgctgaaaccttttacccaaaattacaagcgagt

SEQ ID NO: 317489 - DNA, 75 bp, Artificial Sequence
  Synthetic
gcttgctgccacttagcaaaggctctaaatgactttagcaactcaggtgctgatgttctctaccaaccaccacag

SEQ ID NO: 317490 - DNA, 75 bp, Artificial Sequence
  Synthetic
cggagattttgtacaagtagcacaaggctgcggagttcctattgtggattcatattattcattgctgatgcctat

SEQ ID NO: 317491 - DNA, 75 bp, Artificial Sequence
  Synthetic
gacactgttgccacttacacagtataacaggtatcttgctctatataacaagtacaagtatttcagtggagcctt

SEQ ID NO: 317492 - DNA, 75 bp, Artificial Sequence
  Synthetic
agagtggttttaggaaaatggcattcccgtcaggcaaagttgaagggtgcatggtacaagtaacctgtggaacta

SEQ ID NO: 317493 - DNA, 75 bp, Artificial Sequence
  Synthetic
ccatcctaattgtattaactgtttggacgataggtgtattctccattgtgcaaactttaatgtgctattttctac

SEQ ID NO: 317494 - DNA, 75 bp, Artificial Sequence
  Synthetic
tacttaaacacacttacattagctgtgccttacaacatgagagtcatacactttggcgctggctctgacaaagga

SEQ ID NO: 317495 - DNA, 75 bp, Artificial Sequence
  Synthetic
gtcatttgcacagcagaagacatgcttaatcctaactatgaagatctgctcattcgcaaatccaaccatagcttt

SEQ ID NO: 317496 - DNA, 75 bp, Artificial Sequence
  Synthetic
ccattagtaaggaaaatatttgtagatggtgtgccttttgttgtctcaacaggataccattttcatgagctagga

SEQ ID NO: 317497 - DNA, 75 bp, Artificial Sequence
  Synthetic
gacagtggttgccaattggcacactacttgtcgattctgaccttaatgattttgtctctgacgctgattctacat

SEQ ID NO: 317498 - DNA, 75 bp, Artificial Sequence
  Synthetic
acttgtcgattctgaccttaatgattttgtctctgacgctgattctacattaattggagactgtgctactgtaca

SEQ ID NO: 317499 - DNA, 75 bp, Artificial Sequence
  Synthetic
cttgttcaggctggcaatgttcaacttcgtgttattggccattctatgcaaaattgtctgcttaggcttaaagtt

SEQ ID NO: 317500 - DNA, 75 bp, Artificial Sequence
  Synthetic
ccagctatgcatgctgcctctggcaatttattgctagacaagcgcactacatgcttttcagtagctgcactaaca

SEQ ID NO: 317501 - DNA, 75 bp, Artificial Sequence
  Synthetic
gttagcgatatgtatgaccctaaaactaagcatgtgacagaggagaatgactcaaaagaagggtttttcacctat

SEQ ID NO: 317502 - DNA, 75 bp, Artificial Sequence
  Synthetic
ctaagcatgtgacagaggagaatgactcaaaagaagggtttttcacctatctgtgtggatttataaaacaaaaac

SEQ ID NO: 317503 - DNA, 75 bp, Artificial Sequence
  Synthetic
gttaccgtgtaactaaaaatagtaaagtacaaattggagagtacacatttgaaaaaggtgactatggtgatgctg

SEQ ID NO: 317504 - DNA, 75 bp, Artificial Sequence
  Synthetic
aaagataacagagcattcttggaatgctgatctctacaagcttatgggatatttctcatggtggacagcttttgt

SEQ ID NO: 317505 - DNA, 75 bp, Artificial Sequence
  Synthetic
gctgatctctacaagcttatgggatatttctcatggtggacagcttttgtcacaaatgtcaatgcgtcatcctct

SEQ ID NO: 317506 - DNA, 75 bp, Artificial Sequence
  Synthetic
tccatttgttgacagacaaactgcacaggctgcaggtacagacacaaccataacattaaatgttttggcatggct

SEQ ID NO: 317507 - DNA, 75 bp, Artificial Sequence
  Synthetic
accttggtaagccgaaagagcaaattgatggctataccatgcatgctaactacgtcttctggaggaatacaaatc

SEQ ID NO: 317508 - DNA, 75 bp, Artificial Sequence
  Synthetic
gtgctaacatcacacacagtaatgccactaagtgcaccaacactagtgcctcaagagcactatgtgagaataact

SEQ ID NO: 317509 - DNA, 75 bp, Artificial Sequence
  Synthetic
tgatggctataccatgcatgctaactacgtcttctggaggaatacaaatcctattcaattgtcttcttattcatt

SEQ ID NO: 317510 - DNA, 75 bp, Artificial Sequence
  Synthetic
gggctgccagtgtcattagatcaatcttttctcgcacactcgatgcagcaaatcattcaataccagacctgcaga

SEQ ID NO: 317511 - DNA, 75 bp, Artificial Sequence
  Synthetic
aaattaagggggactgctgttatgtctttaaaagagaatcaaatcaatgacatgatttattccctgttggaaaag

SEQ ID NO: 317512 - DNA, 75 bp, Artificial Sequence
  Synthetic
ctttaaaagagaatcaaatcaatgacatgatttattccctgttggaaaagggtagacttatcattagagaaaaca

SEQ ID NO: 317513 - DNA, 75 bp, Artificial Sequence
  Synthetic
tcttgttaatcattaaacgaacatgaaaattttaatttttgctttcctagttaccctagttaaagcacaagaagg

SEQ ID NO: 317514 - DNA, 75 bp, Artificial Sequence
  Synthetic
aaaattttaatttttgctttcctagttaccctagttaaagcacaagaaggttgtggcgtgatcaacctcaggaca

SEQ ID NO: 317515 - DNA, 75 bp, Artificial Sequence
  Synthetic
cctcgcgtagaggtgtttattataatgatgatatattccgttctgatgttttacatctcacgcaggattatttct

SEQ ID NO: 317516 - DNA, 75 bp, Artificial Sequence
  Synthetic
tgatgatatattccgttctgatgttttacatctcacgcaggattatttcttaccattccattctaacctaacaca

SEQ ID NO: 317517 - DNA, 75 bp, Artificial Sequence
  Synthetic
cccaaagtgtgacagggccatgcctaacatgcttaggataatggcttctcttgttcttgctcgcaaacatagcac

SEQ ID NO: 317518 - DNA, 75 bp, Artificial Sequence
  Synthetic
gataaaattgtttattttgacaatcccatattgaaatttggtgacggtgtttacttcgcagccaccgaaaagtct

SEQ ID NO: 317519 - DNA, 75 bp, Artificial Sequence
  Synthetic
gcacattgcttactaagggcacacttgaacctgaatactttaactcggtgtgcagactcatgaaaacaataggtc

SEQ ID NO: 317520 - DNA, 75 bp, Artificial Sequence
  Synthetic
tgtttctgttaccttctcttgcaacagttgcttactttaatatggtctacatgcctgctagctgggtgatgcgta

SEQ ID NO: 317521 - DNA, 75 bp, Artificial Sequence
  Synthetic
ccatattgaaatttggtgacggtgtttacttcgcagccaccgaaaagtctaatgtaataagaggctgggtgtttg

SEQ ID NO: 317522 - DNA, 75 bp, Artificial Sequence
  Synthetic
ctgacatgtttcttggaacatgtcgccgttgtcctgctgaaattgtcgacacagtgagtgctttagtttatgata

SEQ ID NO: 317523 - DNA, 75 bp, Artificial Sequence
  Synthetic
gtctgctattatagtcaataattccacacacattattatacgtgtgtgctattttaacctctgtaaagaccccat

SEQ ID NO: 317524 - DNA, 75 bp, Artificial Sequence
  Synthetic
acacacattattatacgtgtgtgctattttaacctctgtaaagaccccatgtatactgtgtctgctggcacccaa

SEQ ID NO: 317525 - DNA, 75 bp, Artificial Sequence
  Synthetic
agcccgtgctggtgatgctgctaacttttgtgcactcatactcgcttacagtaataaaactgttggcgagcttgg

SEQ ID NO: 317526 - DNA, 75 bp, Artificial Sequence
  Synthetic
ctttcaattgcacatacgatagagtggaaaaaagcttccaactagacacatcccctaagactggtaattttactg

SEQ ID NO: 317527 - DNA, 75 bp, Artificial Sequence
  Synthetic
tgttcgcaatcttcagcacaggctctatgagtgtctctatagaaatagggacgttgatcatgaattcgtggatga

SEQ ID NO: 317528 - DNA, 75 bp, Artificial Sequence
  Synthetic
gctagacgtgtttggacactgatgaatgtcattacacttgtttacaaagtctactatggtaatgctttagatcaa

SEQ ID NO: 317529 - DNA, 75 bp, Artificial Sequence
  Synthetic
ggaaaaaagcttccaactagacacatcccctaagactggtaattttactgacttacgtgagtttgtctttaaaaa

SEQ ID NO: 317530 - DNA, 75 bp, Artificial Sequence
  Synthetic
ttaggattacccactcaaactgttgattcttcacagggctcagagtatgactatgtcatattcacacaaaccact

SEQ ID NO: 317531 - DNA, 75 bp, Artificial Sequence
  Synthetic
cagacttataccccagttaacctccttagaggtttgccatcaggtctttcagttttaaaacccattcttaaatta

SEQ ID NO: 317532 - DNA, 75 bp, Artificial Sequence
  Synthetic
ttagaggtttgccatcaggtctttcagttttaaaacccattcttaaattaccatttggaattaatattacttctt

SEQ ID NO: 317533 - DNA, 75 bp, Artificial Sequence
  Synthetic
accgctttaatgtggctatcacaagagcaaaaattggcattttgtgcataatgtctgacagagatctttatgata

SEQ ID NO: 317534 - DNA, 75 bp, Artificial Sequence
  Synthetic
taaaaccacttctaattatgtgccagaaagtgctgcttattatgtgggtaatcttaaacagtccacctttatgct

SEQ ID NO: 317535 - DNA, 75 bp, Artificial Sequence
  Synthetic
gaaagtgctgcttattatgtgggtaatcttaaacagtccacctttatgctcagttttaatcagaatggaactatt

SEQ ID NO: 317536 - DNA, 75 bp, Artificial Sequence
  Synthetic
atccacttgcagagttaaagtgtactacaaaaagttttaatgtctccaaaggcatttatcaaacttccaatttca

SEQ ID NO: 317537 - DNA, 75 bp, Artificial Sequence
  Synthetic
cctcctaagagtagtattgatgctttcaagcttaacattaagttgttgggtattggaggtaaaccatgtatcaag

SEQ ID NO: 317538 - DNA, 75 bp, Artificial Sequence
  Synthetic
tacaaaaagttttaatgtctccaaaggcatttatcaaacttccaatttcagagtatcaccagttactgaggttgt

SEQ ID NO: 317539 - DNA, 75 bp, Artificial Sequence
  Synthetic
tattccgtaatgctaactaatgataacacctcacggtattgggaacctgagttttatgaagctatgtacacacca

SEQ ID NO: 317540 - DNA, 75 bp, Artificial Sequence
  Synthetic
tgtccttttgacaaggtttttaatgccacacgctttcctagtgtctatgcctgggaaagaacaaagatttctgat

SEQ ID NO: 317541 - DNA, 75 bp, Artificial Sequence
  Synthetic
ccacacgctttcctagtgtctatgcctgggaaagaacaaagatttctgattgtgttgcagattacactgttttct

SEQ ID NO: 317542 - DNA, 75 bp, Artificial Sequence
  Synthetic
actgaagctttcgagaagatggtttctcttttgtctgttttgctatccatgcagggtgctgtagacattaatagg

SEQ ID NO: 317543 - DNA, 75 bp, Artificial Sequence
  Synthetic
caactgttacggagtctctccttctaagttgattgatttgtgttttacaagtgtgtatgcagacacatttttgat

SEQ ID NO: 317544 - DNA, 75 bp, Artificial Sequence
  Synthetic
ttcacttcgttgtggtgcttgcattaggagaccattcctctgttgtaagtgctgctatgatcatgttatttcaac

SEQ ID NO: 317545 - DNA, 75 bp, Artificial Sequence
  Synthetic
gctgctatgatcatgttatttcaacatcacataaattagtgctgtctgttaatccctatgtttgcaatgcttcag

SEQ ID NO: 317546 - DNA, 75 bp, Artificial Sequence
  Synthetic
gtgctactcttcaggctattgcttcagaatttagttctttaccatcatatgccgcttatgccactgcccaagagg

SEQ ID NO: 317547 - DNA, 75 bp, Artificial Sequence
  Synthetic
aagttgattgatttgtgttttacaagtgtgtatgcagacacatttttgataagattttccgaagtcagacaagta

SEQ ID NO: 317548 - DNA, 75 bp, Artificial Sequence
  Synthetic
cagactacaattataaactacctgacgactttacaggctgtgttatagcttggaacactgctaagcaagacgtcg

SEQ ID NO: 317549 - DNA, 75 bp, Artificial Sequence
  Synthetic
tggaacactgctaagcaagacgtcggtagctatttttataggtctcatcgctctagcaaattaaaaccctttgaa

SEQ ID NO: 317550 - DNA, 75 bp, Artificial Sequence
  Synthetic
cgtacaaatgctcagtgacacgctgaagggattgtctgacagagtcgtgtttgtcctttgggctcatggctttga

SEQ ID NO: 317551 - DNA, 75 bp, Artificial Sequence
  Synthetic
gtgtccgtacactcagtacgtatgattttaaccaaaatgtacctcttgagtaccaagccactagagttgttgttc

SEQ ID NO: 317552 - DNA, 75 bp, Artificial Sequence
  Synthetic
ttttaaccaaaatgtacctcttgagtaccaagccactagagttgttgttctttcatttgaactccttaatgcacc

SEQ ID NO: 317553 - DNA, 75 bp, Artificial Sequence
  Synthetic
aagattggaccagaaagaacgtgttgtctgtgtgacaagcgtgcaacttgcttctctacttcatctgacacttat

SEQ ID NO: 317554 - DNA, 75 bp, Artificial Sequence
  Synthetic
aaactgtcatacggtattgccactgtacgtgaagtgctttctgacagggaattgcatctttcatgggaggttgga

SEQ ID NO: 317555 - DNA, 75 bp, Artificial Sequence
  Synthetic
tccacttcattggttaagaaccagtgcgtcaacttcaactttaatggatttaaaggtactggtgtgttgaccgac

SEQ ID NO: 317556 - DNA, 75 bp, Artificial Sequence
  Synthetic
gcgtcaacttcaactttaatggatttaaaggtactggtgtgttgaccgactcgtctaaaacgtttcagtcttttc

SEQ ID NO: 317557 - DNA, 75 bp, Artificial Sequence
  Synthetic
gattgatgtccagcaatggggctttacaggtaaccttcagagcaaccatgaccaacactgtcaagtgcatggtaa

SEQ ID NO: 317558 - DNA, 75 bp, Artificial Sequence
  Synthetic
aaacctagaccacctttgaatagaaattatgtctttactggttatcgcgtaactaaaaatagtaaagtacaaata

SEQ ID NO: 317559 - DNA, 75 bp, Artificial Sequence
  Synthetic
ttttactgattcagtgcgtgacccgcaaactttacggatacttgacatttcaccgtgctcttttggtggtgtgag

SEQ ID NO: 317560 - DNA, 75 bp, Artificial Sequence
  Synthetic
caaactttacggatacttgacatttcaccgtgctcttttggtggtgtgagtgtcataacaccaggaactaacact

SEQ ID NO: 317561 - DNA, 75 bp, Artificial Sequence
  Synthetic
aagatgtaaactgcactgatgttcccagaacaatacaagcagatcaattagcaccctcttggcgtgtttatacca

SEQ ID NO: 317562 - DNA, 75 bp, Artificial Sequence
  Synthetic
cagaacaatacaagcagatcaattagcaccctcttggcgtgtttataccactggaccctatgttttccaaacaca

SEQ ID NO: 317563 - DNA, 75 bp, Artificial Sequence
  Synthetic
aaagccggtatgcaaaaatactctacacttcaaggaccacctggtactggtaagagccattttgctatcggactt

SEQ ID NO: 317564 - DNA, 75 bp, Artificial Sequence
  Synthetic
catgtcaacgcatcctatcagtgtgacattccaattggtgctggcatttgtgctagctatcatacagcctcacac

SEQ ID NO: 317565 - DNA, 75 bp, Artificial Sequence
  Synthetic
acaaggcttataagatagaagaactcttctactcctatgccacccaccatgacaaattcactgatggtgtttgct

SEQ ID NO: 317566 - DNA, 75 bp, Artificial Sequence
  Synthetic
gctctctactacccatctgctcgtatagtgtatacagcttgctctcatgcagctgttgatgccctgtgcgaaaag

SEQ ID NO: 317567 - DNA, 75 bp, Artificial Sequence
  Synthetic
aggtttttgtacataataaagcttgttttcctctggctcttgtggccagtaacacttgcttgctttgtgcttgct

SEQ ID NO: 317568 - DNA, 75 bp, Artificial Sequence
  Synthetic
acattccaattggtgctggcatttgtgctagctatcatacagcctcacacttacggagtacaggtcaaaaatcca

SEQ ID NO: 317569 - DNA, 75 bp, Artificial Sequence
  Synthetic
tgctgaaaattctgtggcatatgctaataattccattgccatacctactaatttttctattagtgtcactactga

SEQ ID NO: 317570 - DNA, 75 bp, Artificial Sequence
  Synthetic
ttatccagccaatgctatcgtttgtaggtttgatacacgagttctctccaatctaaacctacctggttgtgatgg

SEQ ID NO: 317571 - DNA, 75 bp, Artificial Sequence
  Synthetic
aataattccattgccatacctactaatttttctattagtgtcactactgaagtgatgcctgtttctatggctaaa

SEQ ID NO: 317572 - DNA, 75 bp, Artificial Sequence
  Synthetic
atagaggtatggtgctgggcagtttagctgctacagtacgtcttcaggctggaaatgctacagaagtacctgcca

SEQ ID NO: 317573 - DNA, 75 bp, Artificial Sequence
  Synthetic
gcattccacactccagcttttgataagagtgcatttactcatttgaaacaactgccattcttttattactctgat

SEQ ID NO: 317574 - DNA, 75 bp, Artificial Sequence
  Synthetic
tctgtggtgattctttagagtgcagtaacctactgcttcagtatggtagcttctgtacccaacttaatcgtgccc

SEQ ID NO: 317575 - DNA, 75 bp, Artificial Sequence
  Synthetic
actgccattcttttattactctgatagtccttgcgagtcgcatggcaagcaggttgtgtcagacattgattatgt

SEQ ID NO: 317576 - DNA, 75 bp, Artificial Sequence
  Synthetic
taacctactgcttcagtatggtagcttctgtacccaacttaatcgtgccctttctggcattgctgtagaacagga

SEQ ID NO: 317577 - DNA, 75 bp, Artificial Sequence
  Synthetic
ttttgcagtagaccctgctaaagcatataaggattacctagcaagtggaggacaaccaatcaccaactgtgtgaa

SEQ ID NO: 317578 - DNA, 75 bp, Artificial Sequence
  Synthetic
caggttaaacagatgtataaaacaccaaccataagagattttggtggttttaatttctctcagatattaccagac

SEQ ID NO: 317579 - DNA, 75 bp, Artificial Sequence
  Synthetic
aattaccagctcctcgcacattgctaactaaaggcacactggaacctgagcactttaattcagtgtgcagactta

SEQ ID NO: 317580 - DNA, 75 bp, Artificial Sequence
  Synthetic
caaccataagagattttggtggttttaatttctctcagatattaccagaccctttgaagcctactaagcgttctt

SEQ ID NO: 317581 - DNA, 75 bp, Artificial Sequence
  Synthetic
tttgcagacatcatgcaaatgagtatagacagtacttagatgcatacaacatgatgatttcagctggttttagcc

SEQ ID NO: 317582 - DNA, 75 bp, Artificial Sequence
  Synthetic
tcttggaacatgtcgccgctgtcctgctgagattgtcgacactgtgagtgctttagtttatgacaataagctcag

SEQ ID NO: 317583 - DNA, 75 bp, Artificial Sequence
  Synthetic
agtaacactcgcggatgcaggtttcatgaaacagtatgcagactgtctgggtggtattaacgcaagagatctcat

SEQ ID NO: 317584 - DNA, 75 bp, Artificial Sequence
  Synthetic
aggtaagtacgtccaaatacctaccacttgtgctaatgacccagtgggttttacacttagaaacacagtctgtac

SEQ ID NO: 317585 - DNA, 75 bp, Artificial Sequence
  Synthetic
atacaacctgtggaacacctttaccaggttacagagtctagaaaatgtggcttacaatgttattaataaaggaca

SEQ ID NO: 317586 - DNA, 75 bp, Artificial Sequence
  Synthetic
tgcttcaaaatgttttacaagggtgtgattacacatgatgtttcatctgcaatcaacaggccccaaataggtgtt

SEQ ID NO: 317587 - DNA, 75 bp, Artificial Sequence
  Synthetic
acagtcttaccacctttgctcactgatgacatgattgctgcctatactgcagcgctcattagtggcactgccact

SEQ ID NO: 317588 - DNA, 75 bp, Artificial Sequence
  Synthetic
tttacactaaagtagacggcgttgatgtggagatcttcgagaacaagacaacacttcctgtgaatgtagcgtttg

SEQ ID NO: 317589 - DNA, 75 bp, Artificial Sequence
  Synthetic
tgattacacatgatgtttcatctgcaatcaacaggccccaaataggtgttgtaagagaatttcttacacgtaacc

SEQ ID NO: 317590 - DNA, 75 bp, Artificial Sequence
  Synthetic
aggttacagagtctagaaaatgtggcttacaatgttattaataaaggacactttgatggacagattggcgaagca

SEQ ID NO: 317591 - DNA, 75 bp, Artificial Sequence
  Synthetic
tgtggagatcttcgagaacaagacaacacttcctgtgaatgtagcgtttgagctttgggctaagcgtaacatcaa

SEQ ID NO: 317592 - DNA, 75 bp, Artificial Sequence
  Synthetic
gtagctgcaaaaatcttaggcttgcctacacaaactgtagattcttcacagggttctgagtatgactacgtcata

SEQ ID NO: 317593 - DNA, 75 bp, Artificial Sequence
  Synthetic
aacaatttgggtgtcgacatcgctgccaatactgttatctgggactacaaaagagaagcgccagcacatgtctca

SEQ ID NO: 317594 - DNA, 75 bp, Artificial Sequence
  Synthetic
ccaatactgttatctgggactacaaaagagaagcgccagcacatgtctcaacaataggtatctgcacaatgactg

SEQ ID NO: 317595 - DNA, 75 bp, Artificial Sequence
  Synthetic
gcaaatggcttataggtttaatggcattggagttactcaaaatgttctctacgagaaccaaaaacaaattgccaa

SEQ ID NO: 317596 - DNA, 75 bp, Artificial Sequence
  Synthetic
attcaagaatcactcacaactacatcgacagcattgggcaagctgcaagacgtagtcaaccagaatgctcaagca

SEQ ID NO: 317597 - DNA, 75 bp, Artificial Sequence
  Synthetic
aatcaacaggccccaaataggtgttgtaagagaatttcttacacgtaaccctgcatggagaaaaactgttttcat

SEQ ID NO: 317598 - DNA, 75 bp, Artificial Sequence
  Synthetic
cgcttgttcgtcgcttaccgtcttattcgatggtagagttgaaggacaggttgacttattcagaaatgcacgtaa

SEQ ID NO: 317599 - DNA, 75 bp, Artificial Sequence
  Synthetic
gtacgactgtactactaaaagaaccttgcccatcaggaacatacgagggcaattcaccatttcaccctcttgctg

SEQ ID NO: 317600 - DNA, 75 bp, Artificial Sequence
  Synthetic
ttaaatacacttgtcaaacaacttagctccaattttggtgctatttcaagtgctttgaatgacatcctctcacga

SEQ ID NO: 317601 - DNA, 75 bp, Artificial Sequence
  Synthetic
tggtgttttaataacggaaggttcagtcaagggtttaacaccatcaaaaggacctgtgcaagcaagtgtcaatgg

SEQ ID NO: 317602 - DNA, 75 bp, Artificial Sequence
  Synthetic
gagatctttatgacaagctgcaattcacaagtctagaagtaccgcgtcgtaacgtggctacattacaagcagaaa

SEQ ID NO: 317603 - DNA, 75 bp, Artificial Sequence
  Synthetic
aaattgacaggttgattacaggcagattacaaagcctccaaacctatgtaacacaacaactaatcagagctgctg

SEQ ID NO: 317604 - DNA, 75 bp, Artificial Sequence
  Synthetic
tagtaagatcataactggtcttcatcctacacaagcacctacacaccttagtgttgatacaaaattcaagactga

SEQ ID NO: 317605 - DNA, 75 bp, Artificial Sequence
  Synthetic
tgctaccaaaatgtctgagtgtgttcttggacaatcgaaaagagttgatttttgtggaaaaggctaccaccttat

SEQ ID NO: 317606 - DNA, 75 bp, Artificial Sequence
  Synthetic
ggtgttgtgttcttacatgtcacttatgtgccatcacaagaaaagaacttcaccactgccccagcaatttgtcat

SEQ ID NO: 317607 - DNA, 75 bp, Artificial Sequence
  Synthetic
atgtgccatcacaagaaaagaacttcaccactgccccagcaatttgtcatgaaggtaaggcatacttccctcgtg

SEQ ID NO: 317608 - DNA, 75 bp, Artificial Sequence
  Synthetic
cttcatctaatgataggtcttgccaagagatcacaagactcaccgttaaaattagaggattttatccctatggac

SEQ ID NO: 317609 - DNA, 75 bp, Artificial Sequence
  Synthetic
atgggaactggtacgatttcggtgatttcgtacaagtagcaccaggctgcggagttcctattgtggattcatatt

SEQ ID NO: 317610 - DNA, 75 bp, Artificial Sequence
  Synthetic
ttcttggtttattacacagaggaatttttattcaccacagataatcacaacagacaatacatttgtcgccggaag

SEQ ID NO: 317611 - DNA, 75 bp, Artificial Sequence
  Synthetic
ttctacaggtgttaacttagtagctgtaccaactggctatgttgacactgaaaacaatacagaattcaccagagt

SEQ ID NO: 317612 - DNA, 75 bp, Artificial Sequence
  Synthetic
caatttaaacatcttataccacttatgtacaaaggtttaccctggaacatagtgcgtatcaagatagtacaaatg

SEQ ID NO: 317613 - DNA, 75 bp, Artificial Sequence
  Synthetic
aacaatacagtttatgatcctctgcaacctgagcttgactcatttaaacaagagctagacaagtacttcaaaaat

SEQ ID NO: 317614 - DNA, 75 bp, Artificial Sequence
  Synthetic
aacctgagcttgactcatttaaacaagagctagacaagtacttcaaaaatcatacatcacctgatgttgatcttg

SEQ ID NO: 317615 - DNA, 75 bp, Artificial Sequence
  Synthetic
caattgtattaactgtttggatgataggtgtatccttcattgtgcaaactttaatgtgttattttctactgtgtt

SEQ ID NO: 317616 - DNA, 75 bp, Artificial Sequence
  Synthetic
gaccgcctcaatgaggttgccaaaaatttaaatgaatcactcattgaccttcaagaacttggcaaatatgagcaa

SEQ ID NO: 317617 - DNA, 75 bp, Artificial Sequence
  Synthetic
accattctgtgggttttgactatgtctataatccatttatgattgatgtccagcagtggggttttacaggtaacc

SEQ ID NO: 317618 - DNA, 75 bp, Artificial Sequence
  Synthetic
ggcttggctttatagcagggttagtaggattattcatggccatcattcttctttgttactttactagctgctgca

SEQ ID NO: 317619 - DNA, 75 bp, Artificial Sequence
  Synthetic
aggattattcatggccatcattcttctttgttactttactagctgctgcagctgctgtaaaggcatgtgctcctg

SEQ ID NO: 317620 - DNA, 75 bp, Artificial Sequence
  Synthetic
ctataatccatttatgattgatgtccagcagtggggttttacaggtaaccttcagagtaatcatgatcagcattg

SEQ ID NO: 317621 - DNA, 75 bp, Artificial Sequence
  Synthetic
gacgactctgagccagtgctcaaaggagtcaaattacattacacataaacgaacttatggatttgtttatgagta

SEQ ID NO: 317622 - DNA, 75 bp, Artificial Sequence
  Synthetic
atgcatgcagcttctggcaatttattgctagataaacgcactacatgcttttcagtagctgcactaacaaacaat

SEQ ID NO: 317623 - DNA, 75 bp, Artificial Sequence
  Synthetic
gatgtttagcagtccatgagtgctttgttaagcgcgttgactggtctgttgagtacccaattataggtgatgaac

SEQ ID NO: 317624 - DNA, 75 bp, Artificial Sequence
  Synthetic
ttttcacacttggatcaatcacacgtcaaccaagtaagattgaaaatgcttttcttgcaagtactgttcatgcta

SEQ ID NO: 317625 - DNA, 75 bp, Artificial Sequence
  Synthetic
agtgcaacatatggttgtaaagtctgcattgcttgctgacaaattcccagttcttcatgacattggaaacccaaa

SEQ ID NO: 317626 - DNA, 75 bp, Artificial Sequence
  Synthetic
tttcttgcaagtactgttcatgctactgcaacgataccgctacaagcctcattctctttccgatggcttgttatt

SEQ ID NO: 317627 - DNA, 75 bp, Artificial Sequence
  Synthetic
ctgcaacgataccgctacaagcctcattctctttccgatggcttgttattggcgttgcacttcttgctgtttttc

SEQ ID NO: 317628 - DNA, 75 bp, Artificial Sequence
  Synthetic
ggctatcaaatgtgtcccacaggctgaagtggattggaagttctatgatgctcagccctgcagtgacaaagctta

SEQ ID NO: 317629 - DNA, 75 bp, Artificial Sequence
  Synthetic
caacgctgctatcagtgattatgactattatcgttataatctgccaacaatgtgtgatatcagacaactcctatt

SEQ ID NO: 317630 - DNA, 75 bp, Artificial Sequence
  Synthetic
tcataagaagtggcagcttgccttatacaaaggcatccaattagtttgtaacttgctgctactttttgtgacaat

SEQ ID NO: 317631 - DNA, 75 bp, Artificial Sequence
  Synthetic
tacaaaggcatccaattagtttgtaacttgctgctactttttgtgacaatttattcacattttctacttttagct

SEQ ID NO: 317632 - DNA, 75 bp, Artificial Sequence
  Synthetic
caatctggataaatcagctggtttcccatttaataaatggggtaaggctagactttattatgactcaatgagtta

SEQ ID NO: 317633 - DNA, 75 bp, Artificial Sequence
  Synthetic
acatctatgctttgatttatattctgcaaattttaagcttttgcagatttgtcatgagatgctggctttgttgga

SEQ ID NO: 317634 - DNA, 75 bp, Artificial Sequence
  Synthetic
cgagagtcttgtcaaatttgaacttgccaggttgtgatggtggtagtttgtatgtaaataagcatgcattccaca

SEQ ID NO: 317635 - DNA, 75 bp, Artificial Sequence
  Synthetic
gttgttgaagttcagggctataagaatgtgaagattacattcgagcttgatgagcgtgtggacaaagtgcttaat

SEQ ID NO: 317636 - DNA, 75 bp, Artificial Sequence
  Synthetic
gccaggttgtgatggtggtagtttgtatgtaaataagcatgcattccacactccagcttttgataaaagtgcatt

SEQ ID NO: 317637 - DNA, 75 bp, Artificial Sequence
  Synthetic
atatgatgccaactactttgtttgctggcatacatataattatgactactgtataccatacaacagtgtcacaga

SEQ ID NO: 317638 - DNA, 75 bp, Artificial Sequence
  Synthetic
ggcagcagtaggggaaattctcctgctcgaatggctagcggaggtggtgaaactgccctcgcgctattgctgcta

SEQ ID NO: 317639 - DNA, 75 bp, Artificial Sequence
  Synthetic
agtcatatggcaagcaggttgtttctgacattgattatgtaccactcaaatctgctacatgtataacacgatgca

SEQ ID NO: 317640 - DNA, 75 bp, Artificial Sequence
  Synthetic
tcatgcaaatgagtaccgacagtacttggatgcatacaatatgatgatttctgctggctttagcctctggattta

SEQ ID NO: 317641 - DNA, 75 bp, Artificial Sequence
  Synthetic
ttggatgcatacaatatgatgatttctgctggctttagcctctggatttacaaacagtttgacacttataacctg

SEQ ID NO: 317642 - DNA, 75 bp, Artificial Sequence
  Synthetic
taattggaacaagcaagttttacggtggctggcataatatgttaaaaactgtttacagtgatgtagaaactccac

SEQ ID NO: 317643 - DNA, 75 bp, Artificial Sequence
  Synthetic
ccagcacatatgtcaacaataggtgtctgcacaatgactgacattgccaagaaacctactgagagtgcttgttcc

SEQ ID NO: 317644 - DNA, 75 bp, Artificial Sequence
  Synthetic
atcatgaattcgtggatgagttttacgcttacctgcgtaaacatttctccatgatgattctttctgatgatgccg

SEQ ID NO: 317645 - DNA, 75 bp, Artificial Sequence
  Synthetic
attttctgtttggaactttaacattgcttatcatggctgagaacggaaccatttctgttgaggagcttaaaagac

SEQ ID NO: 317646 - DNA, 75 bp, Artificial Sequence
  Synthetic
tgcatgtgttgtagctgaggcggttgtgaaaacattacaacctgtctctgatctacttaccaatatgggtattga

SEQ ID NO: 317647 - DNA, 75 bp, Artificial Sequence
  Synthetic
atttctgttgaggagcttaaaagactcctggaacaatggaacctagtaataggcttcctcttcctcgcctggatt

SEQ ID NO: 317648 - DNA, 75 bp, Artificial Sequence
  Synthetic
taacaccttcaaagggaccagcacaagctagtgtcaatggagtcacattaattggagaatcagtaaaaacacagt

SEQ ID NO: 317649 - DNA, 75 bp, Artificial Sequence
  Synthetic
agctagtgtcaatggagtcacattaattggagaatcagtaaaaacacagtttaattattttaagaaagtagatgg

SEQ ID NO: 317650 - DNA, 75 bp, Artificial Sequence
  Synthetic
ggcaaaatgttggactgagactgaccttactaaaggacctcacgaattttgctcacagcatacaatgctagttaa

SEQ ID NO: 317651 - DNA, 75 bp, Artificial Sequence
  Synthetic
acatcctaatcaggagtatgctgatgtctttcacttgtatttacaatacattagaaagttacatgatgagcttac

SEQ ID NO: 317652 - DNA, 75 bp, Artificial Sequence
  Synthetic
aacaggttcatccaaatgcgtgtgctctgttattgatcttctgcttgatgactttgttgagataataaagtcaca

SEQ ID NO: 317653 - DNA, 75 bp, Artificial Sequence
  Synthetic
atgaccatgtcatttcaacatcacacaaattagtgttgtctgttaatccctatgtttgcaatgccccaggttgtg

SEQ ID NO: 317654 - DNA, 75 bp, Artificial Sequence
  Synthetic
atacacttacattagctgtgccatacaatatgagagttatccattttggtgctggctcggacaaaggagttgcac

SEQ ID NO: 317655 - DNA, 75 bp, Artificial Sequence
  Synthetic
cacgctggtactgacttagaaggtaaattctatggtccatttgttgacagacaaactgcacaggctgcaggtaca

SEQ ID NO: 317656 - DNA, 75 bp, Artificial Sequence
  Synthetic
gcgagttatatcactatcaggagtgtgttagaggtaccactgtactattagaagaaccttgcccatcaggaacat

SEQ ID NO: 317657 - DNA, 75 bp, Artificial Sequence
  Synthetic
gctggctcggacaaaggagttgcacccggcacagctgttctcagacagtggttgccaattggcacactacttgtt

SEQ ID NO: 317658 - DNA, 75 bp, Artificial Sequence
  Synthetic
ctgacgctgattctactctaattggagactgtgcaactgtacatacagctaacaaatgggatctcattgttagcg

SEQ ID NO: 317659 - DNA, 75 bp, Artificial Sequence
  Synthetic
tacctatcagcttcgtgcaagatcagtttcacctaaacttttcaccagacaagagaaagtttaccaagagctcta

SEQ ID NO: 317660 - DNA, 75 bp, Artificial Sequence
  Synthetic
cgtgacaagggaaaatgattcaaaagaaggatttttcacttacctgtgtggatttattaaacaaaaattagccct

SEQ ID NO: 317661 - DNA, 75 bp, Artificial Sequence
  Synthetic
gctttagtatttataatactttgcttcaccattaagagaaagacagaatgagtgagctcactttaattgacttct

SEQ ID NO: 317662 - DNA, 75 bp, Artificial Sequence
  Synthetic
atggtggacagcttttgttacaaatgttaatgcatcttcatcagaagcatttttaattggagttaactatcttgg

SEQ ID NO: 317663 - DNA, 75 bp, Artificial Sequence
  Synthetic
agaattactggcttgtacccaacactcaacatctcagatgagttttctagcaatgttgcaaattatcaaaaggtc

SEQ ID NO: 317664 - DNA, 75 bp, Artificial Sequence
  Synthetic
agtttaaacaaacatgaaatttctcattgttatgacttgtatatctctttgctgctgtatacgcactgtggtaca

SEQ ID NO: 317665 - DNA, 75 bp, Artificial Sequence
  Synthetic
tctggaggaatacaaacccgattcaattgtcttcctattcactttttgacatgagtaagttccctcttaaattaa

SEQ ID NO: 317666 - DNA, 75 bp, Artificial Sequence
  Synthetic
attgttatgacttgtatatctctttgctgctgtatacgcactgtggtacagcgctgtgcatctaatacaccttat

SEQ ID NO: 317667 - DNA, 75 bp, Artificial Sequence
  Synthetic
attgtcttcctattcactttttgacatgagtaagttccctcttaaattaaggggaacagctgtcatgtctttaaa

SEQ ID NO: 317668 - DNA, 75 bp, Artificial Sequence
  Synthetic
ggcatgcaaaagtactctacactccaaggaccacctggtactggtaagagtcattttgccatcggacttgctctc

SEQ ID NO: 317669 - DNA, 75 bp, Artificial Sequence
  Synthetic
gttatcagccagagtggaacattaggtataacactaggggtaatacttataacagtgctagactgtgtgctttag

SEQ ID NO: 317670 - DNA, 75 bp, Artificial Sequence
  Synthetic
tattctctacttgaaaaaggcagacttatcattagggaaaacaacagagttgttgtctcaagtgatgttcttgtt

SEQ ID NO: 317671 - DNA, 75 bp, Artificial Sequence
  Synthetic
gtataacactaggggtaatacttataacagtgctagactgtgtgctttaggaaaagttttatcttttcataggtg

SEQ ID NO: 317672 - DNA, 75 bp, Artificial Sequence
  Synthetic
atacggcatgctctcatgcagctgttgatgccctatgtgaaaaggcattaaaatatttgcccatagataaatgta

SEQ ID NO: 317673 - DNA, 75 bp, Artificial Sequence
  Synthetic
gtagaatcatacctgcgcgtgcgcgcgtagagtgttttgataaattcaaagtgaattcaacactagaacagtatg

SEQ ID NO: 317674 - DNA, 75 bp, Artificial Sequence
  Synthetic
cctaatgtcaccatcaattgtcaagatccagtaggtggtgcacttgtagcgagatgttggtacttttaccaaggt

SEQ ID NO: 317675 - DNA, 75 bp, Artificial Sequence
  Synthetic
tgctttagcccaggaaggttgtggcttattgagtttcaaaccacaacctaagctggcacaattttcatcttccaa

SEQ ID NO: 317676 - DNA, 75 bp, Artificial Sequence
  Synthetic
gagatgttggtacttttaccaaggtccccagaccgctacatttagagacatacatgtagatctgttctttaaacg

SEQ ID NO: 317677 - DNA, 75 bp, Artificial Sequence
  Synthetic
ttatcattagggaaaacaacagagttgttgtctcaagtgatgttcttgttaataactaaacgaacatgaaaattt

SEQ ID NO: 317678 - DNA, 75 bp, Artificial Sequence
  Synthetic
tttgatgaaatctctatggctactaattatgacttgagtgttgtcaatgctagacttcgtgcaaaacactacgtc

SEQ ID NO: 317679 - DNA, 75 bp, Artificial Sequence
  Synthetic
ttattgagtttcaaaccacaacctaagctggcacaattttcatcttccaagagaggtgtttattataatgatgat

SEQ ID NO: 317680 - DNA, 75 bp, Artificial Sequence
  Synthetic
tcactcaggattatttcttaccatttcactctaatttaacgcagtacttttcattaaatgtcgattcggatcgtc

SEQ ID NO: 317681 - DNA, 75 bp, Artificial Sequence
  Synthetic
tcactctaatttaacgcagtacttttcattaaatgtcgattcggatcgtcaagtctattttgacaatccaacctt

SEQ ID NO: 317682 - DNA, 75 bp, Artificial Sequence
  Synthetic
gccttagttatttctgtaacctctaactattctggtgtcgttacgactatcatgtttttagctagagctatagtg

SEQ ID NO: 317683 - DNA, 75 bp, Artificial Sequence
  Synthetic
aggcacactagaaccagaatattttaattcagtgtgcagacttatgaaaacaataggtccagacatgttccttgg

SEQ ID NO: 317684 - DNA, 75 bp, Artificial Sequence
  Synthetic
gctgcaactgaaaagtctaatgttattagaggttggatttttggctctactatggacaatagtacgcagtcagct

SEQ ID NO: 317685 - DNA, 75 bp, Artificial Sequence
  Synthetic
atactgcgtcttggttcacagctctcactcagcatggtaaggaaggactcaaattccctcaaggccagggagttc

SEQ ID NO: 317686 - DNA, 75 bp, Artificial Sequence
  Synthetic
ttagaggttggatttttggctctactatggacaatagtacgcagtcagctatcattgttaacaattccacacaca

SEQ ID NO: 317687 - DNA, 75 bp, Artificial Sequence
  Synthetic
cctttgtaaagaacccatgtttacagtctctcgaggcgtccattttagttcttgggtttatcaaagtgcattcaa

SEQ ID NO: 317688 - DNA, 75 bp, Artificial Sequence
  Synthetic
gtctctcgaggcgtccattttagttcttgggtttatcaaagtgcattcaattgcacatatgacagagtcgagaaa

SEQ ID NO: 317689 - DNA, 75 bp, Artificial Sequence
  Synthetic
cagacctcaaataggcgttgtaagagaatttcttacacgcaatcctgcttggagaaaagctgtttttatctcacc

SEQ ID NO: 317690 - DNA, 75 bp, Artificial Sequence
  Synthetic
actggcccagaagcttcacttccctatggtgccaataaagaaggcatcgtatgggttgcaactgagggtgccttg

SEQ ID NO: 317691 - DNA, 75 bp, Artificial Sequence
  Synthetic
aaactggaaattttaaggacctacgtgagtatgtctttaaaaatcgtgatggttttcttagtgtctaccattctt

SEQ ID NO: 317692 - DNA, 75 bp, Artificial Sequence
  Synthetic
tgagtatgtctttaaaaatcgtgatggttttcttagtgtctaccattcttatactcctgttgatattattagagg

SEQ ID NO: 317693 - DNA, 75 bp, Artificial Sequence
  Synthetic
acaacattgccaaaaggcttctacgcagaagggagcaggaatggtagtcaagcctcttctcgctcctcatcacgt

SEQ ID NO: 317694 - DNA, 75 bp, Artificial Sequence
  Synthetic
aagcctattcttaagcttcctattggtatcaacattacttcttttaaggttgttatgaccatgtatagtcaaacc

SEQ ID NO: 317695 - DNA, 75 bp, Artificial Sequence
  Synthetic
gtatcaacattacttcttttaaggttgttatgaccatgtatagtcaaaccacatctaattttctttccgaaagtg

SEQ ID NO: 317696 - DNA, 75 bp, Artificial Sequence
  Synthetic
atacgttaccttcatgtttcagtttaatgagaatggcactattgcagatgcagtagattgttctcaaaatcctct

SEQ ID NO: 317697 - DNA, 75 bp, Artificial Sequence
  Synthetic
aatgagaatggcactattgcagatgcagtagattgttctcaaaatcctctcgctgagttaaaatgcacccttaaa

SEQ ID NO: 317698 - DNA, 75 bp, Artificial Sequence
  Synthetic
atcagacttctaacttcagggtttcaccatccacagaggttattagatttcctaacattacaaaccgctgccctt

SEQ ID NO: 317699 - DNA, 75 bp, Artificial Sequence
  Synthetic
aaggacatgacctaccgtagactcatctctatgatgggtttcaaaatgaattaccaagtcaatggttaccctaat

SEQ ID NO: 317700 - DNA, 75 bp, Artificial Sequence
  Synthetic
accaaacagtacaatgtcacccaagcctttgggcgacgtggtccagatcaaactcaaggaaactttggagaccag

SEQ ID NO: 317701 - DNA, 75 bp, Artificial Sequence
  Synthetic
atgtgttgacataccaggcataccaaaggacatgacctaccgtagactcatctctatgatgggtttcaaaatgaa

SEQ ID NO: 317702 - DNA, 75 bp, Artificial Sequence
  Synthetic
cctttgggcgacgtggtccagatcaaactcaaggaaactttggagaccaggagttaatcagacaaggaactgatt

SEQ ID NO: 317703 - DNA, 75 bp, Artificial Sequence
  Synthetic
aggactaaaatttctgattgtgttgctgattacactgttctctacaactcaacttcattttcaactttcaaatgt

SEQ ID NO: 317704 - DNA, 75 bp, Artificial Sequence
  Synthetic
accatccacagaggttattagatttcctaacattacaaaccgctgccctttcgacagagtttttaatgcgtctcg

SEQ ID NO: 317705 - DNA, 75 bp, Artificial Sequence
  Synthetic
ctgattacactgttctctacaactcaacttcattttcaactttcaaatgttatggagtttccccatctaagttga

SEQ ID NO: 317706 - DNA, 75 bp, Artificial Sequence
  Synthetic
aggtgttaacttagtagctgtaccgactggttatgttgacactgaaaataacacagaattcaccagagttaatgc

SEQ ID NO: 317707 - DNA, 75 bp, Artificial Sequence
  Synthetic
tgctgatacattcctgataagattttcagaagttaggcaaatagcgcctggtgaaactggcgttattgcagacta

SEQ ID NO: 317708 - DNA, 75 bp, Artificial Sequence
  Synthetic
tcagaagttaggcaaatagcgcctggtgaaactggcgttattgcagactataattataagctgcctgatgagttt

SEQ ID NO: 317709 - DNA, 75 bp, Artificial Sequence
  Synthetic
aaacatcttataccactcatgtataaaggcttgccctggaatgtagtgcgtattaagatagtacaaatgctcagt

SEQ ID NO: 317710 - DNA, 75 bp, Artificial Sequence
  Synthetic
cggctaaccaagaccggggtcagtattattacagatcatctagaaagactaagcttaaaccttttgagagagacc

SEQ ID NO: 317711 - DNA, 75 bp, Artificial Sequence
  Synthetic
ttattacagatcatctagaaagactaagcttaaaccttttgagagagacctgtcttctgatgaaaatggtgtacg

SEQ ID NO: 317712 - DNA, 75 bp, Artificial Sequence
  Synthetic
ccttcagtaccacttgaataccaagctactagagtagtggtactttcatttgagcttctaaatgcacctgccaca

SEQ ID NO: 317713 - DNA, 75 bp, Artificial Sequence
  Synthetic
ttctgtcgtcgatattcaaaaagaaattgaccgcctcaatgaggtcgccaaaaatttaaatgaatcactcattga

SEQ ID NO: 317714 - DNA, 75 bp, Artificial Sequence
  Synthetic
tgcaacttgcttttctacttcatcagatacttatgcctgctggaatcattctgtgggttttgactatgtctataa

SEQ ID NO: 317715 - DNA, 75 bp, Artificial Sequence
  Synthetic
ctactagagtagtggtactttcatttgagcttctaaatgcacctgccacagtgtgtggaccaaaattgtccacat

SEQ ID NO: 317716 - DNA, 75 bp, Artificial Sequence
  Synthetic
ttttaatttcaatggactcaagggtactggtgtgttgactgactcgtccaaaaagtttcagtcttttcaacaatt

SEQ ID NO: 317717 - DNA, 75 bp, Artificial Sequence
  Synthetic
actggtgtgttgactgactcgtccaaaaagtttcagtcttttcaacaatttggaagggatgcatctgattttact

SEQ ID NO: 317718 - DNA, 75 bp, Artificial Sequence
  Synthetic
ttcaaatacttgacatttcaccatgctcatttggtggtgtgagtgtaataacaccaggaacaaatgcttcatctg

SEQ ID NO: 317719 - DNA, 75 bp, Artificial Sequence
  Synthetic
ctcatttggtggtgtgagtgtaataacaccaggaacaaatgcttcatctgaagtagccgttctataccaagatgt

SEQ ID NO: 317720 - DNA, 75 bp, Artificial Sequence
  Synthetic
atacgtgctgaccaactcacacctgcttggcgtgtttactctgctggagtaaatgtgtttcaaactcaggctggc

SEQ ID NO: 317721 - DNA, 75 bp, Artificial Sequence
  Synthetic
tgctaaagcatataaggattacctagcaagtggaggacaaccaatcaccaactgtgtgaagatgttgtgtacaca

SEQ ID NO: 317722 - DNA, 75 bp, Artificial Sequence
  Synthetic
cttggcgtgtttactctgctggagtaaatgtgtttcaaactcaggctggctgtttaataggagcggaacatgtca

SEQ ID NO: 317723 - DNA, 75 bp, Artificial Sequence
  Synthetic
cattggtgcaggcatttgtgctagttaccatacagcttcccttttacgtaatacaggccagaaatcaattgtggc

SEQ ID NO: 317724 - DNA, 75 bp, Artificial Sequence
  Synthetic
atacaggccagaaatcaattgtggcctatactatgtcacttggtgctgaaaactcaattgcttatgctaataact

SEQ ID NO: 317725 - DNA, 75 bp, Artificial Sequence
  Synthetic
aatacctaccacttgtgctaatgacccagtgggttttacacttagaaacacagtctgtaccgtctgcggaatgtg

SEQ ID NO: 317726 - DNA, 75 bp, Artificial Sequence
  Synthetic
cctgtttcaatggctaagacatcagtagattgtacaatgtacatctgtggtgactcccaggagtgcagcaactta

SEQ ID NO: 317727 - DNA, 75 bp, Artificial Sequence
  Synthetic
tattctgatagtccttgtgagtctcatggcaaacaagtagtgtcggatattgattatgttccactcaaatctgct

SEQ ID NO: 317728 - DNA, 75 bp, Artificial Sequence
  Synthetic
cacaattaaatcgtgccctttcaggcattgctgttgaacaggacaaaaacactcaagaggtttttgcccaagtta

SEQ ID NO: 317729 - DNA, 75 bp, Artificial Sequence
  Synthetic
gtggtgctgtttgcagacaccatgcaaatgagtaccgacagtacttggatgcatataatatgatgatttctgctg

SEQ ID NO: 317730 - DNA, 75 bp, Artificial Sequence
  Synthetic
aaaagattttggtggctttaatttctcacaaatattgcctgacccttctaagccaacaaaaagatcatttattga

SEQ ID NO: 317731 - DNA, 75 bp, Artificial Sequence
  Synthetic
tcacaaatattgcctgacccttctaagccaacaaaaagatcatttattgaggatttactcttcaacaaagtgact

SEQ ID NO: 317732 - DNA, 75 bp, Artificial Sequence
  Synthetic
ctcgctgatgctggctttatgaagcaatacggcgaatgcctaggcgatattagtgctagagatctcatttgtgcg

SEQ ID NO: 317733 - DNA, 75 bp, Artificial Sequence
  Synthetic
ggcgaagcacctgtttccatcattaataatgctgtttacacaaaggtagatggtattgatgtggagatctttgaa

SEQ ID NO: 317734 - DNA, 75 bp, Artificial Sequence
  Synthetic
ttccacctctactcacggatgaaatgattgctgcttacaccgccgctcttgtcagcggtactgctactgctggtt

SEQ ID NO: 317735 - DNA, 75 bp, Artificial Sequence
  Synthetic
gtctaactaaatacacaatggctgatttagtctatgctctacgtcattttgatgagggtaattgtgatacattaa

SEQ ID NO: 317736 - DNA, 75 bp, Artificial Sequence
  Synthetic
gcttataggttcaatggcattggagttactcaaaatgttctctatgagaaccagaagcagatcgctaaccaattt

SEQ ID NO: 317737 - DNA, 75 bp, Artificial Sequence
  Synthetic
aatcacttactactacttcaactgcattgggcaagctgcaagacgtcgtcaaccagaatgctcaagcattgaaca

SEQ ID NO: 317738 - DNA, 75 bp, Artificial Sequence
  Synthetic
attgggcaagctgcaagacgtcgtcaaccagaatgctcaagcattgaacacacttgttaaacaactaagttctaa

SEQ ID NO: 317739 - DNA, 75 bp, Artificial Sequence
  Synthetic
aatgacattctgtctcgacttgacaaagttgaggctgaagtgcaaattgataggttgattactggcagattacaa

SEQ ID NO: 317740 - DNA, 75 bp, Artificial Sequence
  Synthetic
aagttgaggctgaagtgcaaattgataggttgattactggcagattacaaagccttcagacctatgtaacacaac

SEQ ID NO: 317741 - DNA, 75 bp, Artificial Sequence
  Synthetic
tcaacagttgcctgaaacctactttactcagagcagagacttagaggattttaagcccagatcacaaatggaaac

SEQ ID NO: 317742 - DNA, 75 bp, Artificial Sequence
  Synthetic
agcttctgccaatcttgctgccactaagatgtccgagtgtgttcttggacaatcaaaaagagttgacttttgtgg

SEQ ID NO: 317743 - DNA, 75 bp, Artificial Sequence
  Synthetic
aaaaggctatcatcttatgtctttccctcaagcagccccacatggtgtcgtcttcttacatgtcacatacgtgcc

SEQ ID NO: 317744 - DNA, 75 bp, Artificial Sequence
  Synthetic
cttggcggtcttcatttaatgataggcttagccaagcgctcacaagattcaccacttaaattagaggattttatc

SEQ ID NO: 317745 - DNA, 75 bp, Artificial Sequence
  Synthetic
tttatcacacagaggaatttcttttcaccacaaataattacaacagacaatacatttgtctctggaaattgtgat

SEQ ID NO: 317746 - DNA, 75 bp, Artificial Sequence
  Synthetic
caactgtgtcaatacttaaatacacttactttagctgtaccctacaacatgagagttattcactttggtgctggc

SEQ ID NO: 317747 - DNA, 75 bp, Artificial Sequence
  Synthetic
ttactttagctgtaccctacaacatgagagttattcactttggtgctggctctgataaaggagttgcaccaggta

SEQ ID NO: 317748 - DNA, 75 bp, Artificial Sequence
  Synthetic
ctgagcccgtgctcaaaggagtcaaattacactacacataaacgaacttaatggatttgtttatgagtattttca

SEQ ID NO: 317749 - DNA, 75 bp, Artificial Sequence
  Synthetic
cattcttggaatgctgacctttacaagcttatgggccatttctcatggtggacagcttttgttacaaatgtaaat

SEQ ID NO: 317750 - DNA, 75 bp, Artificial Sequence
  Synthetic
agcttatgggccatttctcatggtggacagcttttgttacaaatgtaaatgcatcatcatcggaagcatttttaa

SEQ ID NO: 317751 - DNA, 75 bp, Artificial Sequence
  Synthetic
tgctactctttgtaacaatttactcacaccttctactcttagctgctggcatggaggcacaattttcgtacatct

SEQ ID NO: 317752 - DNA, 75 bp, Artificial Sequence
  Synthetic
agtcaatggttaccctaatatgtttatcacccgcgaagaagctattcgtcacgttcgtgcgtggattggctttga

SEQ ID NO: 317753 - DNA, 75 bp, Artificial Sequence
  Synthetic
tcgtgagcgtgttaatattaacattgttggtgattttcagcttaatgacgagattgccattattttggcgtcttt

SEQ ID NO: 317754 - DNA, 75 bp, Artificial Sequence
  Synthetic
gaaggaacaaattgatggctataccatgcatgctaactacattttctggaggaacacaaatcctatccagttgtc

SEQ ID NO: 317755 - DNA, 75 bp, Artificial Sequence
  Synthetic
tgtcagcttctgcagatttattatgagatgctggctttgctggaagtgcaaatccaaaaacccattactttatga

SEQ ID NO: 317756 - DNA, 75 bp, Artificial Sequence
  Synthetic
agattgccattattttggcgtctttttcggcttctgctagtgcttttatcgagactgtaaggggtcttgattaca

SEQ ID NO: 317757 - DNA, 75 bp, Artificial Sequence
  Synthetic
ttcctattcactctttgacatgagcaaatttcctcttaaattaagaggaactgctgtaatgtctcttaaggagaa

SEQ ID NO: 317758 - DNA, 75 bp, Artificial Sequence
  Synthetic
actgggttcctcgtgctagtgccgatattggtgcgaaccatactggcattactggtgaaaatgttgagactctta

SEQ ID NO: 317759 - DNA, 75 bp, Artificial Sequence
  Synthetic
actaggaacattgatgctacttcaactggtaattataattataaatataggtatcttagacatggcaagcttagg

SEQ ID NO: 317760 - DNA, 75 bp, Artificial Sequence
  Synthetic
ttagagaaaacaacagagttgtggtttcaagtgatattcttgttaacaactaaacgaacatgtttattttcttat

SEQ ID NO: 317761 - DNA, 75 bp, Artificial Sequence
  Synthetic
tgaccttgaccggtgcaccacttttgatgatgttcaagctcctaattacactcaacatacttcatctatgagggg

SEQ ID NO: 317762 - DNA, 75 bp, Artificial Sequence
  Synthetic
agatcagacactctttatttaactcaggatttatttcttccattttattctaatgttacagggtttcatactatt

SEQ ID NO: 317763 - DNA, 75 bp, Artificial Sequence
  Synthetic
taccttttaaggatggtatttattttgctgccacagagaaatcaaatgttgtccgtggttgggtttttggttcta

SEQ ID NO: 317764 - DNA, 75 bp, Artificial Sequence
  Synthetic
tgctgccacagagaaatcaaatgttgtccgtggttgggtttttggttctaccatgaacaacaagtcacagtcggt

SEQ ID NO: 317765 - DNA, 75 bp, Artificial Sequence
  Synthetic
tcaagaatattaggcgcaggctgttttgtcgatgatattgtcaaaacagatggtacacttatgattgaaaggttc

SEQ ID NO: 317766 - DNA, 75 bp, Artificial Sequence
  Synthetic
gttgttatacgagcatgtaactttgaattgtgtgacaaccctttctttgctgtttctaaacccatgggtacacag

SEQ ID NO: 317767 - DNA, 75 bp, Artificial Sequence
  Synthetic
tgctgcaatattgttaacgtgagtttagtaaaaccaacagtttacgtctactcgcgtgttaaaaatctgaactct

SEQ ID NO: 317768 - DNA, 75 bp, Artificial Sequence
  Synthetic
tgtttctaaacccatgggtacacagacacatactatgatattcgataatgcatttaattgcactttcgagtacat

SEQ ID NO: 317769 - DNA, 75 bp, Artificial Sequence
  Synthetic
atctgatgccttttcgcttgatgtttcagaaaagtcaggtaattttaaacacttacgagagtttgtgtttaaaaa

SEQ ID NO: 317770 - DNA, 75 bp, Artificial Sequence
  Synthetic
tcagaaaagtcaggtaattttaaacacttacgagagtttgtgtttaaaaataaagatgggtttctctatgtttat

SEQ ID NO: 317771 - DNA, 75 bp, Artificial Sequence
  Synthetic
tactgttgaagagcttaagcagctcttggaacaatggaacctagtaataggattccttttccttgcctggattat

SEQ ID NO: 317772 - DNA, 75 bp, Artificial Sequence
  Synthetic
ccaaccaccacaaacttcaatcacatctgcagttttgcagagtggttttagaaaaatggcattcccgtctggtaa

SEQ ID NO: 317773 - DNA, 75 bp, Artificial Sequence
  Synthetic
ttcgtgatctaccttctggttttaacactttgaaacctatttttaagttgcctcttggtattaacattacaaatt

SEQ ID NO: 317774 - DNA, 75 bp, Artificial Sequence
  Synthetic
aggaataggtttttgtacataataaagcttgtttttctctggctcttgtggccagtaacacttgcttgctttgtg

SEQ ID NO: 317775 - DNA, 75 bp, Artificial Sequence
  Synthetic
cctgtgaacatgaatatggcacagaggatgactataaaggtctccctcttgaatttggtgcatcaactgaaacac

SEQ ID NO: 317776 - DNA, 75 bp, Artificial Sequence
  Synthetic
tggcttagctacttcattgcttctttcaggctgtttgcacgcacccgttctatgtggtcattcaatccagaaact

SEQ ID NO: 317777 - DNA, 75 bp, Artificial Sequence
  Synthetic
caagtatgatgaaaatggtacaatcacagatgctgttgattgttctcaaaatccacttgctgaactcaaatgctc

SEQ ID NO: 317778 - DNA, 75 bp, Artificial Sequence
  Synthetic
acagatgctgttgattgttctcaaaatccacttgctgaactcaaatgctctgttaagagctttgagattgacaaa

SEQ ID NO: 317779 - DNA, 75 bp, Artificial Sequence
  Synthetic
gggttgttccctcaggagatgttgtgagattccctaatattacaaacttgtgtccttttggagaggtttttaatg

SEQ ID NO: 317780 - DNA, 75 bp, Artificial Sequence
  Synthetic
ctgtgacatcaaggacctgccaaaagagattactgtggctacatcacgaacgctttcttattacaaattaggagc

SEQ ID NO: 317781 - DNA, 75 bp, Artificial Sequence
  Synthetic
aagttgaatgatctttgcttctccaatgtctatgcagattcttttgtagtcaagggagatgatgtaagacaaata

SEQ ID NO: 317782 - DNA, 75 bp, Artificial Sequence
  Synthetic
caacagatgtttcatctagttgacttccaggttacaatagcagagatattgattatcattatgaggactttcagg

SEQ ID NO: 317783 - DNA, 75 bp, Artificial Sequence
  Synthetic
ctgattataattataaattgccagatgatttcatgggttgtgtccttgcttggaatactaggaacattgatgcta

SEQ ID NO: 317784 - DNA, 75 bp, Artificial Sequence
  Synthetic
taataagttcaatagtgagacaattatttaagcctctaactaagaagaattattctgagttagatgatgaagaac

SEQ ID NO: 317785 - DNA, 75 bp, Artificial Sequence
  Synthetic
tattctgagttagatgatgaagaacctatggagattgattatccataaaacgaacatgaaaattatcctcttcct

SEQ ID NO: 317786 - DNA, 75 bp, Artificial Sequence
  Synthetic
atggtttttacaccactactggcattggctaccaaccttacagagttgtagtactttcttttgaacttttaaatg

SEQ ID NO: 317787 - DNA, 75 bp, Artificial Sequence
  Synthetic
tggctaccaaccttacagagttgtagtactttcttttgaacttttaaatgcaccggccacggtttgtggaccaaa

SEQ ID NO: 317788 - DNA, 75 bp, Artificial Sequence
  Synthetic
ttgctgacaacaaatttgcactaacttgcattagcacacattttgcttttgcttgtgctgacggtactcgacata

SEQ ID NO: 317789 - DNA, 75 bp, Artificial Sequence
  Synthetic
ttgcattagcacacattttgcttttgcttgtgctgacggtactcgacatacctatcagcttcgtgcaagatcagt

SEQ ID NO: 317790 - DNA, 75 bp, Artificial Sequence
  Synthetic
cagtgtgtcaattttaattttaatggactcactggtactggtgtgttaactccttcttcaaagagatttcaacca

SEQ ID NO: 317791 - DNA, 75 bp, Artificial Sequence
  Synthetic
tcctaaaacatctgaaatattagacatttcaccttgctcttttgggggtgtaagtgtaattacacctggaacaaa

SEQ ID NO: 317792 - DNA, 75 bp, Artificial Sequence
  Synthetic
ttgtgctttttagcctttctgctattccttgttttaataatgctcatcatattttggttctccttggagattcaa

SEQ ID NO: 317793 - DNA, 75 bp, Artificial Sequence
  Synthetic
tatcaagatgttaactgcactgatgtttctacagcaattcatgcagatcaactcacaccagcttggcgcatatat

SEQ ID NO: 317794 - DNA, 75 bp, Artificial Sequence
  Synthetic
tctaaacgaacatgaaacttctcattgtttttggactcttaacaatagtgtatggtatgcataaggaatgcacca

SEQ ID NO: 317795 - DNA, 75 bp, Artificial Sequence
  Synthetic
ctcaagcaggctgtcttataggagctgagcatgtcgacacttcttatgagtgcgacattcctattggagctggca

SEQ ID NO: 317796 - DNA, 75 bp, Artificial Sequence
  Synthetic
tgtttttggactcttaacaatagtgtatggtatgcataaggaatgcaccatacaagagtgttgtgaaaatcaacc

SEQ ID NO: 317797 - DNA, 75 bp, Artificial Sequence
  Synthetic
tgagcatgtcgacacttcttatgagtgcgacattcctattggagctggcatttgtgctagttaccatacagtttc

SEQ ID NO: 317798 - DNA, 75 bp, Artificial Sequence
  Synthetic
atacactactattcggactggtatttaaagattggaccaagaaagtcggcccgcttacttcagctttgtgctggt

SEQ ID NO: 317799 - DNA, 75 bp, Artificial Sequence
  Synthetic
tctattgtggcttatactatgtctttaggtgctgatagttcaattgcttactctaataacaccattgctatacct

SEQ ID NO: 317800 - DNA, 75 bp, Artificial Sequence
  Synthetic
agtatgagaagcttggcaactatactatcaactgtgaaccatttgaaattaattgccaaacaccacctgtaggca

SEQ ID NO: 317801 - DNA, 75 bp, Artificial Sequence
  Synthetic
taaaacctccgtagattgtaatatgtacatctgcggagattctactgaatgtgctaatttgcttctccaatatgg

SEQ ID NO: 317802 - DNA, 75 bp, Artificial Sequence
  Synthetic
gtgctaatttgcttctccaatatggtagcttttgcacacaactaaatcgtgcactctcaggtattgctgctgaac

SEQ ID NO: 317803 - DNA, 75 bp, Artificial Sequence
  Synthetic
cgctcaagtcaaacaaatgtacaaaaccccaactttgaaatattttggtggttttaatttttcacaaatattacc

SEQ ID NO: 317804 - DNA, 75 bp, Artificial Sequence
  Synthetic
gttttaatttttcacaaatattacctgaccctctaaagccaactaagaggtcttttattgaggacttgctcttta

SEQ ID NO: 317805 - DNA, 75 bp, Artificial Sequence
  Synthetic
ataaggtgacactcgctgatgctggcttcatgaagcaatatggcgaatgcctaggtgatattaatgctagagatc

SEQ ID NO: 317806 - DNA, 75 bp, Artificial Sequence
  Synthetic
taaaatcaagccacatgttaatcatgagggtaagacattttttgtactacctagtgatgatacactgcgtagtga

SEQ ID NO: 317807 - DNA, 75 bp, Artificial Sequence
  Synthetic
tcaaattcaagaatcacttacaacaacatcaactgcattgggcaagctgcaagacgttgttaaccagaatgctca

SEQ ID NO: 317808 - DNA, 75 bp, Artificial Sequence
  Synthetic
gcagacttcaaagccttcaaacctatgtaacacaacaactaatcagggctgctgaaatcagggcttctgctaatc

SEQ ID NO: 317809 - DNA, 75 bp, Artificial Sequence
  Synthetic
gctgaaatcagggcttctgctaatcttgctgctactaaaatgtctgagtgtgttcttggacaatcaaaaagagtt

SEQ ID NO: 317810 - DNA, 75 bp, Artificial Sequence
  Synthetic
acttcaccacagcgccagcaatttgtcatgaaggcaaagcatacttccctcgtgaaggtgtttttgtgtttaatg

SEQ ID NO: 317811 - DNA, 75 bp, Artificial Sequence
  Synthetic
cttctgtcgtcaacattcaaaaagaaattgaccgcctcaatgaggtcgctaaaaatttaaatgaatcactcattg

SEQ ID NO: 317812 - DNA, 75 bp, Artificial Sequence
  Synthetic
aattgaccgcctcaatgaggtcgctaaaaatttaaatgaatcactcattgaccttcaagaattgggaaaatatga

SEQ ID NO: 317813 - DNA, 75 bp, Artificial Sequence
  Synthetic
acacaaggcagatgggctatgtaaacgttttcgcaattccgtttacgatacatagtctactcttgtgcagaatga

SEQ ID NO: 317814 - DNA, 75 bp, Artificial Sequence
  Synthetic
ttttgggcactactgttgaaaaactcaggcctatctttgaatggattgaggcgaaacttagtgcaggagttgaat

SEQ ID NO: 317815 - DNA, 75 bp, Artificial Sequence
  Synthetic
tgcttctcctgcaagtactgttcatgctacagcaacgataccgctacaagcctcactccctttcggatggcttgt

SEQ ID NO: 317816 - DNA, 75 bp, Artificial Sequence
  Synthetic
cctctgaagaagtagtggaaaatcctaccgtacagaaggaaataatagagtgtgacgtgaaaactaccgaagttg

SEQ ID NO: 317817 - DNA, 75 bp, Artificial Sequence
  Synthetic
cgctgcaggtatggaggcgcaatttttgtacctctatgccttgatatattttctacaatgcatcaacgcatgtag

SEQ ID NO: 317818 - DNA, 75 bp, Artificial Sequence
  Synthetic
ttgtacctctatgccttgatatattttctacaatgcatcaacgcatgtagaattattatgagatgttggctttgt

SEQ ID NO: 317819 - DNA, 75 bp, Artificial Sequence
  Synthetic
ggtgcgcttatagctaggtgttggtaccttcatgaaggtcaccaaactgctgcatttagagacgtacttgttgtt

SEQ ID NO: 317820 - DNA, 75 bp, Artificial Sequence
  Synthetic
tactttatgatgccaactactttgtttgctggcacacacataactatgactactgtataccatataacagtgtca

SEQ ID NO: 317821 - DNA, 75 bp, Artificial Sequence
  Synthetic
tgacggcatttcaacaccaaaactcaaagaagactaccaaattggtggttattctgaggataggcactcaggtgt

SEQ ID NO: 317822 - DNA, 75 bp, Artificial Sequence
  Synthetic
aaagaagactaccaaattggtggttattctgaggataggcactcaggtgttaaagactatgtcgttgtacatggc

SEQ ID NO: 317823 - DNA, 75 bp, Artificial Sequence
  Synthetic
aatccagcaatggatccaatttatgatgagccgacgacgactactagcgtgcctttgtaagcacaagaaagtgag

SEQ ID NO: 317824 - DNA, 75 bp, Artificial Sequence
  Synthetic
gcctttgtaagcacaagaaagtgagtacgaacttatgtactcattcgtttcggaagaaacaggtacgttaatagt

SEQ ID NO: 317825 - DNA, 75 bp, Artificial Sequence
  Synthetic
ttcgtggtattcttgctagtcacactagccatccttactgcgcttcgattgtgtgcgtactgctgcaatattgtt

SEQ ID NO: 317826 - DNA, 75 bp, Artificial Sequence
  Synthetic
tctgaactcttctgaaggagttcctgatcttctggtctaaacgaactaactattattattattctgtttggaact

SEQ ID NO: 317827 - DNA, 75 bp, Artificial Sequence
  Synthetic
gatcttctggtctaaacgaactaactattattattattctgtttggaactttaacattgcttatcatggcagaca

SEQ ID NO: 317828 - DNA, 75 bp, Artificial Sequence
  Synthetic
taaacaactcctggaacaatggaacctagtaataggtttcctattcctagcctggattatgttactacaatttgc

SEQ ID NO: 317829 - DNA, 75 bp, Artificial Sequence
  Synthetic
gtgcctctccgggggacaattgtgaccagaccgctcatggaaagtgaacttgtcattggtgctgtgatcattcgt

SEQ ID NO: 317830 - DNA, 75 bp, Artificial Sequence
  Synthetic
acatcacgaacgctttcttattacaaattaggagcgtcgcagcgtgtaggcactgattcaggttttgctgcatac

SEQ ID NO: 317831 - DNA, 75 bp, Artificial Sequence
  Synthetic
aattaggagcgtcgcagcgtgtaggcactgattcaggttttgctgcatacaaccgctaccgtattggaaactata

SEQ ID NO: 317832 - DNA, 75 bp, Artificial Sequence
  Synthetic
cactgattcaggttttgctgcatacaaccgctaccgtattggaaactataaattaaatacagaccacgccggtag

SEQ ID NO: 317833 - DNA, 75 bp, Artificial Sequence
  Synthetic
caacgacaatattgctttgctagtacagtaagtgacaacagatgtttcatcttgttgacttccaggttacaatag

SEQ ID NO: 317834 - DNA, 75 bp, Artificial Sequence
  Synthetic
acgatacatagtctactcttgtgcagaatgaattctcgtaactaaacagcacaagtaggtttagttaactttaat

SEQ ID NO: 317835 - DNA, 75 bp, Artificial Sequence
  Synthetic
gctgtatgctgctgttatcaatggtgataggtggtttcttaatagattcaccactactttgaatgactttaacct

SEQ ID NO: 317836 - DNA, 75 bp, Artificial Sequence
  Synthetic
gactttcaggattgctatttggaatcttgacgttataataagttcaatagtgagacaattatttaagcctctaac

SEQ ID NO: 317837 - DNA, 75 bp, Artificial Sequence
  Synthetic
ttttacgcttacctgcgtaaacatttctccatgatgattctttctgatgatgccgttgtgtgctataacagtaac

SEQ ID NO: 317838 - DNA, 75 bp, Artificial Sequence
  Synthetic
agaccattcctatgttgcaagtgctgctatgaccatgtcatttcaacatcacacaaattagtgttgtctgttaat

SEQ ID NO: 317839 - DNA, 75 bp, Artificial Sequence
  Synthetic
gtgttccttttgttgtttcaactggataccattttcgtgagttaggagtcgtacataatcaggatgtaaacttac

SEQ ID NO: 317840 - DNA, 75 bp, Artificial Sequence
  Synthetic
gaggtgacaggtgacagttgtaacaactttatgctcacctataacaaagttgaaaacatgacgcctagagatctt

SEQ ID NO: 317841 - DNA, 75 bp, Artificial Sequence
  Synthetic
tactactaaaagaaccttgcccatcaggaacatacgagggcaattcaccatttcaccctcttgctgacaataaat

SEQ ID NO: 317842 - DNA, 75 bp, Artificial Sequence
  Synthetic
acagaatgaatgagctcactttaattgacttctatttgtgctttttagcctttctgctattccttgttttaataa

SEQ ID NO: 317843 - DNA, 75 bp, Artificial Sequence
  Synthetic
gtagtacagcgctgtgcatctaataaacctcatgtgcttgaagatccttgtaaggtacaacactaggggtaatac

SEQ ID NO: 317844 - DNA, 75 bp, Artificial Sequence
  Synthetic
ttatagcactgcttggctttgtgctctaggaaaggttttaccttttcatagatggcacactatggttcaaacatg

SEQ ID NO: 317845 - DNA, 75 bp, Artificial Sequence
  Synthetic
cacacctaatgttactatcaactgtcaagatccagctggtggtgcgcttatagctaggtgttggtaccttcatga

SEQ ID NO: 317846 - DNA, 75 bp, Artificial Sequence
  Synthetic
tagctaggtgttggtaccttcatgaaggtcaccaaactgctgcatttagagacgtacttgttgttttaaataaac

SEQ ID NO: 317847 - DNA, 75 bp, Artificial Sequence
  Synthetic
gaacaaattaaaatgtctgataatggaccccaatcaaaccaacgtagtgccccccgcattacatttggtggaccc

SEQ ID NO: 317848 - DNA, 75 bp, Artificial Sequence
  Synthetic
caaacattcttctcaatgtgcctcttcgggggacaattgtgaccagaccgctcatggaaagtgaacttgtcattg

SEQ ID NO: 317849 - DNA, 75 bp, Artificial Sequence
  Synthetic
cccaataatactgcgtcttggttcacagctctcactcagcatggcaaggaggaacttagattccctcgaggccag

SEQ ID NO: 317850 - DNA, 75 bp, Artificial Sequence
  Synthetic
ccgaagagctacccgacgagttcgtggtggtgacggcaaaatgaaagagctcagccccagatggtacttctatta

SEQ ID NO: 317851 - DNA, 75 bp, Artificial Sequence
  Synthetic
cttccctacggcgctaacaaagaaggcatcgtatgggttgcaactgagggagccttgaatacacccaaagaccac

SEQ ID NO: 317852 - DNA, 75 bp, Artificial Sequence
  Synthetic
tcaaggaacaacattgccaaaaggcttctacgcagagggaagcagaggcggcagtcaagcctcttctcgctcctc

SEQ ID NO: 317853 - DNA, 75 bp, Artificial Sequence
  Synthetic
agtggttttaggaaaatggcatttccctctggtaaagttgaaggatgcatggtacaagtcacctgtggaactaca

SEQ ID NO: 317854 - DNA, 75 bp, Artificial Sequence
  Synthetic
gaagcagcccactgtgactcttcttcctgcggctgacatggatgatttctccagacaacttcaaaattccatgag

SEQ ID NO: 317855 - DNA, 75 bp, Artificial Sequence
  Synthetic
ccagacaacttcaaaattccatgagtggagcttctgctgattcaactcaggcataaacactcatgatgaccacac

SEQ ID NO: 317856 - DNA, 75 bp, Artificial Sequence
  Synthetic
ttcgcaattccgtttacgatacatagtctactcttgtgcagaatgaattctcgtaactaaacagcacaagtaggt

SEQ ID NO: 317857 - DNA, 75 bp, Artificial Sequence
  Synthetic
ctctgaagaagtagtggaaaatcctaccatacagaaggaagtcatagagtgtgacgtgaaaactaccgaagttgt

SEQ ID NO: 317858 - DNA, 75 bp, Artificial Sequence
  Synthetic
ttagttaactttaatctcacatagcaatctttaatcaatgtgtaacattagggaggacttgaaagagccaccaca

SEQ ID NO: 317859 - DNA, 75 bp, Artificial Sequence
  Synthetic
ttttcatcgaggccacgcggagtacgatcgagggtacagtgaataatgctagggagagctgcctatatggaagag

SEQ ID NO: 317860 - DNA, 75 bp, Artificial Sequence
  Synthetic
gatcgagggtacagtgaataatgctagggagagctgcctatatggaagagccctaatgtgtaaaattaattttag

SEQ ID NO: 317861 - DNA, 75 bp, Artificial Sequence
  Synthetic
agggagagctgcctatatggaagagccctaatgtgtaaaattaattttagtagtgctatccccatgtgattttaa

SEQ ID NO: 317862 - DNA, 75 bp, Artificial Sequence
  Synthetic
aacgaactttaaaatctgtgtagctgtcgctcggctgcatgcctagtgcacctacgcagtataaacaataataaa

SEQ ID NO: 317863 - DNA, 75 bp, Artificial Sequence
  Synthetic
ctgctgccgtgaccatgagcatgaaattgcctggttcactgagcgctctgataagagctatgagcatcagacacc

SEQ ID NO: 317864 - DNA, 75 bp, Artificial Sequence
  Synthetic
agaatgctcaagcattaaacacacttgttaaacaacttagctctaattttggtgcaatttcaagtgtgctaaatg

SEQ ID NO: 317865 - DNA, 75 bp, Artificial Sequence
  Synthetic
atgttttggaggctgtgtgtttgcctatgttggctgctataacaagcgtgcctactgggttcctcgtgctagtgc

SEQ ID NO: 317866 - DNA, 75 bp, Artificial Sequence
  Synthetic
acaaataattactacagacaatacatttgtctcaggaaattgtgatgtcgttattggcatcattaacaacacagt

SEQ ID NO: 317867 - DNA, 75 bp, Artificial Sequence
  Synthetic
gactcattcaaagaagagctggacaagtacttcaaaaatcatacatcaccagatgttgatcttggcgacatttca

SEQ ID NO: 317868 - DNA, 75 bp, Artificial Sequence
  Synthetic
acatgaactctcaggggctcctgccacctaagagtagtattgacgctttcaagcttaacattaaattgttgggca

SEQ ID NO: 317869 - DNA, 75 bp, Artificial Sequence
  Synthetic
tcaaggattgtgtaaaatgcttcattgatgttgttaacaaggcacttgaaatgtgcattgaccaagtcactatcg

SEQ ID NO: 317870 - DNA, 75 bp, Artificial Sequence
  Synthetic
atgtgcattgaccaagtcactatcgctggcgcaaagttgcgatcactcaacttaggtgaagtcttcatcgctcaa

SEQ ID NO: 317871 - DNA, 75 bp, Artificial Sequence
  Synthetic
tgcttatgccactgcccaagaggcttatgagcaagctgtatcaaatggtgattctgaagttgttcttaagaagtt

SEQ ID NO: 317872 - DNA, 75 bp, Artificial Sequence
  Synthetic
aatcctgtgcgcatgaatacggtacagaagaagactaccaaggtcttccactggaatttggtgcctcaactgaaa

SEQ ID NO: 317873 - DNA, 75 bp, Artificial Sequence
  Synthetic
cacttgatgcagcaaaccactcaattcctgatttgcaaagagcagctgtcaccatacttgatggtatttctgaac

SEQ ID NO: 317874 - DNA, 75 bp, Artificial Sequence
  Synthetic
aaccaacacctgaggaaccagttaaccagtttactggttatttaaaacttactgacaatgttgccattaagtgtg

SEQ ID NO: 317875 - DNA, 75 bp, Artificial Sequence
  Synthetic
tggcttggcctcttattgttactgcactaagagccaactcagctgtcaaactacagaataatgaactgagtccag

SEQ ID NO: 317876 - DNA, 75 bp, Artificial Sequence
  Synthetic
ctatctttgaatggattgaggcgaaacttagtgcaggagttgaatttctcaaggatgcttgggagattctcaaat

SEQ ID NO: 317877 - DNA, 75 bp, Artificial Sequence
  Synthetic
cgtcaagggtcaaatacaggttgcttcagataacatcaaggattgtgtaaaatgcttcattgatgttgttaacaa

SEQ ID NO: 317878 - DNA, 75 bp, Artificial Sequence
  Synthetic
agtgaataatgctagggagagctgcctatatggaagagccctaatgtgtaaaaattaattttagtagtgctatcc

SEQ ID NO: 317879 - DNA, 75 bp, Artificial Sequence
  Synthetic
ttacctctgaggaggttgttctcaagaacggtgaactcgaagcactcgagacgcccgttgatagcttcacaaatg

SEQ ID NO: 317880 - DNA, 75 bp, Artificial Sequence
  Synthetic
acaggcaatcacggtaacaccagaagccaatatggatcaagagtcctttggtggtgcttcatgctgtctgtattg

SEQ ID NO: 317881 - DNA, 75 bp, Artificial Sequence
  Synthetic
acttgacaaactaaagagtctcttatccctacgggaggttaagactataaaagtgttcacaactgtggacaacac

SEQ ID NO: 317882 - DNA, 75 bp, Artificial Sequence
  Synthetic
tagatgccacattgatcatccaaatcctaagggattttgtgacttgaaaggtaagtatgtccaaatacctaccac

SEQ ID NO: 317883 - DNA, 75 bp, Artificial Sequence
  Synthetic
caaagcgagttcttaatgtggtgtgtaaacattgcggtcagaaaactactaccttaacgggtgtagaagctgtga

SEQ ID NO: 317884 - DNA, 75 bp, Artificial Sequence
  Synthetic
agttgtaggcaatgtcatacttaaaccatcagatgaaggtgttaaagtaacacaagagttaggtcatgaggatct

SEQ ID NO: 317885 - DNA, 75 bp, Artificial Sequence
  Synthetic
aaccagttaatcagtttactggttatttaaaacttactgacaatgttgccattaaatgtgttgacatcgttaagg

SEQ ID NO: 317886 - DNA, 75 bp, Artificial Sequence
  Synthetic
ctatttcaataagaaggattggtatgattttgtagaaaatcctgatgttctacgcgtatacgcgaacctaggtga

SEQ ID NO: 317887 - DNA, 75 bp, Artificial Sequence
  Synthetic
gattgtaaatgctgctaacatacacctgaaacatggtggtggtgtagcaggtgcactcaacaaggcaaccaatgg

SEQ ID NO: 317888 - DNA, 75 bp, Artificial Sequence
  Synthetic
cacaagcattaccattaagaaacctaatgagctttcattagccctaggtttaaaaacaattgctactcatggtat

SEQ ID NO: 317889 - DNA, 75 bp, Artificial Sequence
  Synthetic
gaggagaaatctgtcgtacagaagcctgtcgatgtgaagccaaaaattaaggcctgcattgatgaggttaccaca

SEQ ID NO: 317890 - DNA, 75 bp, Artificial Sequence
  Synthetic
atctcatcgtacaagctagacttgacaattttaggtctggctgctgagtgggttttggcatatatgttgttcaca

SEQ ID NO: 317891 - DNA, 75 bp, Artificial Sequence
  Synthetic
tagttgaggttgtcgataaatactttgattgttacgatggtggctgtatcaatgccaaccaagttatcgttaaca

SEQ ID NO: 317892 - DNA, 75 bp, Artificial Sequence
  Synthetic
ttgctgtgaaaaacggtgcacttcacctctactttgacaaggctggtcaaaagacttatgagagacacccactct

SEQ ID NO: 317893 - DNA, 75 bp, Artificial Sequence
  Synthetic
ttacagtgatgtagaaagtccccaccttatgggttgggactacccaaaatgtgacagagccatgcctaatatgct

SEQ ID NO: 317894 - DNA, 75 bp, Artificial Sequence
  Synthetic
tggctcttacagagattggtcctattcaggacagcgtacagagttaggtgttgaatttcttaagcgtggtgacaa

SEQ ID NO: 317895 - DNA, 75 bp, Artificial Sequence
  Synthetic
tcaggacagcgtacagagttaggtgttgaatttcttaagcgtggtgacaaaattgtgtaccacactctggagagc

SEQ ID NO: 317896 - DNA, 75 bp, Artificial Sequence
  Synthetic
ttcaaaggggaatgcccaaagtttgtgtttcctcttaactcaaaagtcaaagtcattcaaccacgtgttgaaaag

SEQ ID NO: 317897 - DNA, 75 bp, Artificial Sequence
  Synthetic
tctcagcatactatgctagttaaacaaggagatgattacgtgtacctgccttacccagatccatctagaatatta

SEQ ID NO: 317898 - DNA, 75 bp, Artificial Sequence
  Synthetic
attatagagcccgtgctggtgatgctgctaacttttgtgcactcatactcgcttacagtaataaaactgttggcg

SEQ ID NO: 317899 - DNA, 75 bp, Artificial Sequence
  Synthetic
aacaagagtcttcttttgttatgatgtctgcaccacctgctgagtataaattacagcaaggtacattcttatgtg

SEQ ID NO: 317900 - DNA, 75 bp, Artificial Sequence
  Synthetic
atgtggctatcacaagagcaaaaattggcattttgtgcataatgtctgatagagatctttatgacaaactgcaat

SEQ ID NO: 317901 - DNA, 75 bp, Artificial Sequence
  Synthetic
gctggtgttatcagatcaatttttgcgcgcacacttgatgcagcaaaccactcaattcctgatttgcaaagagca

SEQ ID NO: 317902 - DNA, 75 bp, Artificial Sequence
  Synthetic
taggaggtatgagctattactgcaagtcacataaaccacccattagttttcctttgtgtgctaatggtcaggttt

SEQ ID NO: 317903 - DNA, 75 bp, Artificial Sequence
  Synthetic
agccagcttcacgagagctatctgtcacattcttcccagacttgaatggcgatgtagtggctattgactatagac

SEQ ID NO: 317904 - DNA, 75 bp, Artificial Sequence
  Synthetic
actattcagcgagtttcaagaaaggtgctaaattactgcataagccaattgtttggcacattaaccaggctacaa

SEQ ID NO: 317905 - DNA, 75 bp, Artificial Sequence
  Synthetic
accagcttacagctttctgccgggagtctactcagtcttttacttgtacttgacattctatttcaccaatgatgt

SEQ ID NO: 317906 - DNA, 75 bp, Artificial Sequence
  Synthetic
tctgtactctacaactcaacatctttttcaacttttaagtgttatggcgtttctgccactaagctgaatgacctt

SEQ ID NO: 317907 - DNA, 75 bp, Artificial Sequence
  Synthetic
cacacaaggaatggacaatcttgcttgtgaaagtcaacaacccacctctgaagaagtagtggaaaatcctaccat

SEQ ID NO: 317908 - DNA, 75 bp, Artificial Sequence
  Synthetic
aaggcaaatagcaccaggacagaccggtgttattgctgattataattacaaattaccagatgacttcttgggttg

SEQ ID NO: 317909 - DNA, 75 bp, Artificial Sequence
  Synthetic
aaagattcttccacttccggtaattataattatttatatagatgggttagaaggtctaagcttaacccttatgag

SEQ ID NO: 317910 - DNA, 75 bp, Artificial Sequence
  Synthetic
ataattatttatatagatgggttagaaggtctaagcttaacccttatgagcgcgacttatctaacgacatctatt

SEQ ID NO: 317911 - DNA, 75 bp, Artificial Sequence
  Synthetic
atgtggaaaacacaagcattaccattaagaaacctaatgagctttcactagccttaggtttaaaaacaattgcca

SEQ ID NO: 317912 - DNA, 75 bp, Artificial Sequence
  Synthetic
tgtaggtcctaattgttataaccccttacgtccatatggcttttttacaacagctggtgttggacaccaacctta

SEQ ID NO: 317913 - DNA, 75 bp, Artificial Sequence
  Synthetic
cagctggtgttggacaccaaccttatagagttgtagtactttcttttgaacttttaaatgcacccgctacagtct

SEQ ID NO: 317914 - DNA, 75 bp, Artificial Sequence
  Synthetic
taagagattagcacaacgtgtgtttaacaattatatgccttatgtgtttacattattgttccaattgtgtacttt

SEQ ID NO: 317915 - DNA, 75 bp, Artificial Sequence
  Synthetic
aacttcgtgttattggccattctatgcaaaattgtctgcttaggcttaaagttgatacttctaaccctaagacac

SEQ ID NO: 317916 - DNA, 75 bp, Artificial Sequence
  Synthetic
tatgacaataagctaaaagcacacaaagagaagtcagcgcaatgcttcaaaatgtattacaagggtgtgattacg

SEQ ID NO: 317917 - DNA, 75 bp, Artificial Sequence
  Synthetic
gcatgctacaatggttcaccatctggtgtttatcagtgtgccatgagacctaatcataccattaaaggttctttc

SEQ ID NO: 317918 - DNA, 75 bp, Artificial Sequence
  Synthetic
tgctgacggtactagacatacctatcagcttcgtgcaagatcagtttcaccaaaacttttcatcagacaagagga

SEQ ID NO: 317919 - DNA, 75 bp, Artificial Sequence
  Synthetic
tggtttatcattagtattgtacaaatggcacccgtttctgcaatggttaggatgtacatcttctttgcttctttc

SEQ ID NO: 317920 - DNA, 75 bp, Artificial Sequence
  Synthetic
aatgtaaaccgctttaatgtggccatcacaagagcaaagattggcatcttatgcataatgtctgatagagacctt

SEQ ID NO: 317921 - DNA, 75 bp, Artificial Sequence
  Synthetic
taggactcttaacatcagtgtattgcatgcataaagaatgcagtatacaagaatgttgtgaaaatcaaccattcc

SEQ ID NO: 317922 - DNA, 75 bp, Artificial Sequence
  Synthetic
gcttcttaaggcagcatatgaaaatttcaattcacaggacaccttacttgcaccattgttgtcagcaggcatatt

SEQ ID NO: 317923 - DNA, 75 bp, Artificial Sequence
  Synthetic
tagacaatttgagagctaacaacactaaaggttcactgcctattaatgtcatagtttttgatggcaagtccaaat

SEQ ID NO: 317924 - DNA, 75 bp, Artificial Sequence
  Synthetic
agtctactatggtaatgctttagatcaagctatttccatgtgggccttagttatttctgcaacctctaactattc

SEQ ID NO: 317925 - DNA, 75 bp, Artificial Sequence
  Synthetic
acgtgttgtctgtgtgacaaacgcgcgacttgcttctctacttcatctgatacttatgcctgttggaatcactct

SEQ ID NO: 317926 - DNA, 75 bp, Artificial Sequence
  Synthetic
acaaaaagaaaaagactgatgaagctcagcctttaccgcagagacaaaagaagcagcccactgtgactcttcttc

SEQ ID NO: 317927 - DNA, 75 bp, Artificial Sequence
  Synthetic
catttatgattgacgtccagcagtggggttttacaggtaaccttcaaagtaaccatgatcaacactgccaagtgc

SEQ ID NO: 317928 - DNA, 75 bp, Artificial Sequence
  Synthetic
caatgtttcactcatctggaatgtaaaagactacatgtctttatctgaacagctgcgtaaacaaattcgtagtgc

SEQ ID NO: 317929 - DNA, 75 bp, Artificial Sequence
  Synthetic
atatggttgttaaatctgcattgcttgctgataaatttccagttcttcatgacataggaaacccaaaggctatta

SEQ ID NO: 317930 - DNA, 75 bp, Artificial Sequence
  Synthetic
ctggaaattctacgacgctcagccttgcattgacaaagcttacaaaatagaagaactcttctactcatatgccac

SEQ ID NO: 317931 - DNA, 75 bp, Artificial Sequence
  Synthetic
gatggttgtgttccactcaacatcataccattgactacagcagccaaactcatggttgttgtccctgattatggt

SEQ ID NO: 317932 - DNA, 75 bp, Artificial Sequence
  Synthetic
ttagatgtgtctgcttcagtagtggctggtggtattattgccatattggtgacttgtgctgcctactactttatg

SEQ ID NO: 317933 - DNA, 75 bp, Artificial Sequence
  Synthetic
cgtcttgtttgatggtagagttgagggacaggtagatcttttcagaaatgcccgcaatggtgttttaataacaga

SEQ ID NO: 317934 - DNA, 75 bp, Artificial Sequence
  Synthetic
cttttacttgtacttgacattctatttcaccaatgatgtttcattcttggctcaccttcaatggtttgccatgtt

SEQ ID NO: 317935 - DNA, 75 bp, Artificial Sequence
  Synthetic
agcaattgcccgaaacctactttactcaaagcagagacttagaggatttcaagcccaggtcacaaatggagactg

SEQ ID NO: 317936 - DNA, 75 bp, Artificial Sequence
  Synthetic
cttgtaccaactcaaccattaccaaatgcgagttttgataatttcaaactcacatgttctaacacaaaatttgct

SEQ ID NO: 317937 - DNA, 75 bp, Artificial Sequence
  Synthetic
catcaaaatgtgtatgctctgttattgatcttttacttgatgactttgtcgaaataataaaggctcaagatttat

SEQ ID NO: 317938 - DNA, 75 bp, Artificial Sequence
  Synthetic
taatgctggcgattacatacttgccaacacttgtactgagagactcaagcttttcgcagcagaaacgctcaaagc

SEQ ID NO: 317939 - DNA, 75 bp, Artificial Sequence
  Synthetic
tacaattgactatgctgaaatttcatttatgctttggtgtaagaacggacatgttgaaaccttctatccaaaatt

SEQ ID NO: 317940 - DNA, 75 bp, Artificial Sequence
  Synthetic
agatgcaaagaatgcttcttgaaaaatgtgaccttcagaattatggtgaaaatgctgttataccaaaaggaataa

SEQ ID NO: 317941 - DNA, 75 bp, Artificial Sequence
  Synthetic
acattagctgtgccttataacatgagagttatacattttggtgcaggctcagacaaaggagtagcacctggtacg

SEQ ID NO: 317942 - DNA, 75 bp, Artificial Sequence
  Synthetic
ccggcacactacttgttgattctgatcttaatgacttcgtctctgacgctgattctacattgattggagactgtg

SEQ ID NO: 317943 - DNA, 75 bp, Artificial Sequence
  Synthetic
tcttaatgacttcgtctctgacgctgattctacattgattggagactgtgctactgtacatacagctaataagtg

SEQ ID NO: 317944 - DNA, 75 bp, Artificial Sequence
  Synthetic
ttaaaggttctttccttaatggatcatgtggtagtgttggttttaacattgattatgattgcgtgtctttctgct

SEQ ID NO: 317945 - DNA, 75 bp, Artificial Sequence
  Synthetic
gatcctaagaccaaacatgtgacaaaagagaatgactcaaaagaagggtttttcacttatctttgtggatttatt

SEQ ID NO: 317946 - DNA, 75 bp, Artificial Sequence
  Synthetic
cagcttttgttacaaatgtaaatgcatcatcttcagaggcatttttaattggagttaactatcttggaaagccaa

SEQ ID NO: 317947 - DNA, 75 bp, Artificial Sequence
  Synthetic
caaaaccacttattaagtgggatttgctgaaatatgattttacggaagagagactttgtctcttcgaccgttatt

SEQ ID NO: 317948 - DNA, 75 bp, Artificial Sequence
  Synthetic
tgatgttgttagacaatgctctggtgttaccttccaaggtaagttcaagaaaattgttaagggcactcatcattg

SEQ ID NO: 317949 - DNA, 75 bp, Artificial Sequence
  Synthetic
aacgaacatgaaaattttaatttttgctttcctagctagtctagctaaagcacaagaaggatgtggcattatcag

SEQ ID NO: 317950 - DNA, 75 bp, Artificial Sequence
  Synthetic
gctttcctagctagtctagctaaagcacaagaaggatgtggcattatcagtcgaaagccgcagccaaaaatggca

SEQ ID NO: 317951 - DNA, 75 bp, Artificial Sequence
  Synthetic
cacaagaaggatgtggcattatcagtcgaaagccgcagccaaaaatggcacaagtctcttcttctcgtcgaggtg

SEQ ID NO: 317952 - DNA, 75 bp, Artificial Sequence
  Synthetic
ctctgatgtgctacacctcacacaggattatttcctgccattcgattccaatctaacacagtacttttctcttaa

SEQ ID NO: 317953 - DNA, 75 bp, Artificial Sequence
  Synthetic
gattatttcctgccattcgattccaatctaacacagtacttttctcttaatgttgactcagataggtatacctat

SEQ ID NO: 317954 - DNA, 75 bp, Artificial Sequence
  Synthetic
tgtctggttataggcttaaggattgtgttatgtatgcttcagctttagttttgcttattctcatgacagctcgca

SEQ ID NO: 317955 - DNA, 75 bp, Artificial Sequence
  Synthetic
tgttatgtatgcttcagctttagttttgcttattctcatgacagctcgcactgtttatgatgatgctgctagacg

SEQ ID NO: 317956 - DNA, 75 bp, Artificial Sequence
  Synthetic
gtgatggcgtttattttgctgccaccgaaaagtctaatgtaataagaggctggatttttggttcgtcttttgata

SEQ ID NO: 317957 - DNA, 75 bp, Artificial Sequence
  Synthetic
cgaaaagtctaatgtaataagaggctggatttttggttcgtcttttgataataccacccagtcagctgtcatagt

SEQ ID NO: 317958 - DNA, 75 bp, Artificial Sequence
  Synthetic
cgtgtgtgtaatttcaacttgtgtaaagaacccatgtacactgttagtatgggtacacaacagaattcttgggtt

SEQ ID NO: 317959 - DNA, 75 bp, Artificial Sequence
  Synthetic
aagaacccatgtacactgttagtatgggtacacaacagaattcttgggtttatcaaagtgcatttaattgcacct

SEQ ID NO: 317960 - DNA, 75 bp, Artificial Sequence
  Synthetic
tatagtgtttgtgtgtgttgagtattacccattgttatttattactggcaacaccttacagtgtatcatgcttgt

SEQ ID NO: 317961 - DNA, 75 bp, Artificial Sequence
  Synthetic
gctcgatacagttcctaaaactggaaattttaaggacttacgtgagtacgtcttcaagaatagggatggtttcct

SEQ ID NO: 317962 - DNA, 75 bp, Artificial Sequence
  Synthetic
tcttcaagaatagggatggtttccttagtgtttatcaaacctatactgctgttaatttacccagaggtttgcctg

SEQ ID NO: 317963 - DNA, 75 bp, Artificial Sequence
  Synthetic
ccttcatgctgcgatttaatgaaaatgggaccatcacggatgctgtggattgttcccaaaacccacttgctgaat

SEQ ID NO: 317964 - DNA, 75 bp, Artificial Sequence
  Synthetic
taagcgtaatgtcatccctactataactcaaatgaatcttaagtatgccattagtgcaaagaatagagctcgcac

SEQ ID NO: 317965 - DNA, 75 bp, Artificial Sequence
  Synthetic
gtcatcttctaaattgtgggcacaatgtgtacaactccacaatgatattcttcttgcaaaagacacaactgaagc

SEQ ID NO: 317966 - DNA, 75 bp, Artificial Sequence
  Synthetic
tgttgacaaaggaatctaccaaacatccaactttagagtttcacccacccaagaggttattagattccctaacat

SEQ ID NO: 317967 - DNA, 75 bp, Artificial Sequence
  Synthetic
tccaactttagagtttcacccacccaagaggttattagattccctaacattacaaaccgctgtccttttgacagg

SEQ ID NO: 317968 - DNA, 75 bp, Artificial Sequence
  Synthetic
gtgtttatgcatgggagcggacgaaaatttctgagtgtgttgcagactacacagttctctacaactcaacctctt

SEQ ID NO: 317969 - DNA, 75 bp, Artificial Sequence
  Synthetic
tattaagtgagatggtcatgtgtggcggctcactatatgttaaaccaggtggaacatcatccggtgatgctacaa

SEQ ID NO: 317970 - DNA, 75 bp, Artificial Sequence
  Synthetic
ctagacaggttgtcaatgtcataactactaaaatctcactcaagggtggtaagattgttagtacttggtttaaac

SEQ ID NO: 317971 - DNA, 75 bp, Artificial Sequence
  Synthetic
ttacgcttacctgcgtaaacatttctccatgatgattctttctgatgatgccgttgtgtgctataacagtaacta

SEQ ID NO: 317972 - DNA, 75 bp, Artificial Sequence
  Synthetic
gattgttcaacttagtgaaattaacatggacaattcaccaaatttggcttggcctcttattgttacagctctaag

SEQ ID NO: 317973 - DNA, 75 bp, Artificial Sequence
  Synthetic
aataatgaactgagtccagtagcactacgacagatgtcctgtgcggctggtaccacacaaacagcttgtactgat

SEQ ID NO: 317974 - DNA, 75 bp, Artificial Sequence
  Synthetic
ctcaaatgggctagattccctaagagtgatggtacaggtacaatttacacagaactggaaccaccttgtaggttt

SEQ ID NO: 317975 - DNA, 75 bp, Artificial Sequence
  Synthetic
tgcaagtcacataagcctcccattagttttccattatgtgctaatggtcaggtttttggtttatacaaaaacaca

SEQ ID NO: 317976 - DNA, 75 bp, Artificial Sequence
  Synthetic
ttcaatggctaaaacatccgtggattgtacaatgtacatctgtggtgactctttggagtgcagcaacctactatt

SEQ ID NO: 317977 - DNA, 75 bp, Artificial Sequence
  Synthetic
gttcaatggacttactgtgctaccaccactgctcacagatgagatgattgctgcatatacagctgcgctagttag

SEQ ID NO: 317978 - DNA, 75 bp, Artificial Sequence
  Synthetic
ttcggtgcaggggcagctctccaaataccgttcgctatgcaaatggcctataggtttaatggcattggagttact

SEQ ID NO: 317979 - DNA, 75 bp, Artificial Sequence
  Synthetic
taccgttcgctatgcaaatggcctataggtttaatggcattggagttactcaaaacgttctctatgagaaccaga

SEQ ID NO: 317980 - DNA, 75 bp, Artificial Sequence
  Synthetic
tgctataggcaaaattcaagactcattatcatctactgcgagtgcacttggaaaacttcaggatgttgttaacca

SEQ ID NO: 317981 - DNA, 75 bp, Artificial Sequence
  Synthetic
gttaaacagcttagctctaattttggagctatttcgagtgtgttaaatgatattctttctcgacttgataaagtt

SEQ ID NO: 317982 - DNA, 75 bp, Artificial Sequence
  Synthetic
caggcattgtaggcgtactgacattagataatcaggatcttaatgggaactggtacgatttcggtgatttcgtac

SEQ ID NO: 317983 - DNA, 75 bp, Artificial Sequence
  Synthetic
gctaccatcttatgtcttttcctcaatcagcaccacacggtgtcgtttttctacacgttacatacgtgccttcac

SEQ ID NO: 317984 - DNA, 75 bp, Artificial Sequence
  Synthetic
ctacacgttacatacgtgccttcacaagagagaaacttcaccacagctccagccatttgtcatgaaggcaaagct

SEQ ID NO: 317985 - DNA, 75 bp, Artificial Sequence
  Synthetic
actcatttaaagaagagctggacaagtacttcaaaaatcatacatcaccagatgttgatcttggcgacatttcag

SEQ ID NO: 317986 - DNA, 75 bp, Artificial Sequence
  Synthetic
aaacgcactacatgcttttcagtagctgcactaacaaacaatgttgcttttcaaactgtcaaacccggtaatttt

SEQ ID NO: 317987 - DNA, 75 bp, Artificial Sequence
  Synthetic
ggagcaatcacgcgcaatattgaaaatgcttctcctgcaagtactgttcatgctactgcaacgataccgctgcaa

SEQ ID NO: 317988 - DNA, 75 bp, Artificial Sequence
  Synthetic
gtgcaaagaatagagctcgcaccgtagctggtgtctctatctgtagtactatgacaaatagacagtttcatcaga

SEQ ID NO: 317989 - DNA, 75 bp, Artificial Sequence
  Synthetic
aagtactttgtcaagattggacctgaaagaacgtgttgtctgtgtgacaaacgtgcaacttgcttttctacttca

SEQ ID NO: 317990 - DNA, 75 bp, Artificial Sequence
  Synthetic
gagccatgcctaacatgcttaggataatggcctctcttgttcttgctcgcaaacataacacttgctgtaacttat

SEQ ID NO: 317991 - DNA, 75 bp, Artificial Sequence
  Synthetic
gctgacaagtatgtccgcaatctacaacacaggctctatgagtgtctctatagaaatagggatgttgatcatgaa

SEQ ID NO: 317992 - DNA, 75 bp, Artificial Sequence
  Synthetic
aatgtgttcatgtctgaggcaaaatgttggactgagactgaccttactaaaggacctcacgaattttgctcacag

SEQ ID NO: 317993 - DNA, 75 bp, Artificial Sequence
  Synthetic
aggacctcacgaattttgctcacagcatacaatgctagttaaacaaggagatgattacgtgtacctgccttaccc

SEQ ID NO: 317994 - DNA, 75 bp, Artificial Sequence
  Synthetic
tggctcttgtggccagtaacacttgcttgctttgtgcttgctgctgtttacagaattaattgggtgactggcgga

SEQ ID NO: 317995 - DNA, 75 bp, Artificial Sequence
  Synthetic
tgggaacctgagttttatgaggctatgtacacaccacatacagtcttgcaggctgtaggtgcttgtgtattgtgc

SEQ ID NO: 317996 - DNA, 75 bp, Artificial Sequence
  Synthetic
aagcttgataatgatgcacttaacaacattatcaacaatgcgcgtgatggttgtgttccactcaacatcatacca

SEQ ID NO: 317997 - DNA, 75 bp, Artificial Sequence
  Synthetic
tgacaatgtcactgacttcaatgcgatagcaacatgtgattggactaatgctggcgattacatacttgccaacac

SEQ ID NO: 317998 - DNA, 75 bp, Artificial Sequence
  Synthetic
atagcaacatgtgattggactaatgctggcgattacatacttgccaacacttgtactgagagactcaagcttttc

SEQ ID NO: 317999 - DNA, 75 bp, Artificial Sequence
  Synthetic
tttgagctttgggctaagcgtaacattaaaccagtgccagagattaagatactcaataatttgggtgttgatatc

SEQ ID NO: 318000 - DNA, 75 bp, Artificial Sequence
  Synthetic
tcaggagtgtgttagaggtacaactgtactactaaaagaaccttgcccatcaggaacatacgagggcaattcacc

SEQ ID NO: 318001 - DNA, 75 bp, Artificial Sequence
  Synthetic
tcagatgagttttctagcaatgttgcaaattatcaaaaggtcggcatgcaaaagtactctacactccaaggacca

SEQ ID NO: 318002 - DNA, 75 bp, Artificial Sequence
  Synthetic
caacgtttttaaacgggtttgcggtgtaagtgcagcccgtcttacaccgtgcggcacaggcactagtactgatgt

SEQ ID NO: 318003 - DNA, 75 bp, Artificial Sequence
  Synthetic
caacgtagtgctccccgcattacatttggtggacccacagattcaactgacaataaccaggatggaggacgcagt

SEQ ID NO: 318004 - DNA, 75 bp, Artificial Sequence
  Synthetic
gtttcatctgcaatcaacagacctcaaataggcgttgtaagagaatttcttacacgcaatcctgcttggagaaaa

SEQ ID NO: 318005 - DNA, 75 bp, Artificial Sequence
  Synthetic
taatgacttcgtctccgacgcagattctactttaattggagactgtgcaacagtacatacggctaataaatggga

SEQ ID NO: 318006 - DNA, 75 bp, Artificial Sequence
  Synthetic
cttaggattgcctacgcagactgttgattcatcacagggttctgaatatgactatgtcatattcacacaaactac

SEQ ID NO: 318007 - DNA, 75 bp, Artificial Sequence
  Synthetic
acaagcagaaaatgtaactggactttttaaggactgtagtaagatcattactggtcttcatcctacacaggcacc

SEQ ID NO: 318008 - DNA, 75 bp, Artificial Sequence
  Synthetic
ccctggaatgtagtgcgtattaagatagtacaaatgctcagtgatacactgaaaggattgtcagacagagtcgtg

SEQ ID NO: 318009 - DNA, 75 bp, Artificial Sequence
  Synthetic
taagtttccagttcttcatgacattggaaatccaaaggctatcaagtgtgtgcctcaggctgaagtagaatggaa

SEQ ID NO: 318010 - DNA, 75 bp, Artificial Sequence
  Synthetic
aggacaaactggtgttattgctgattataattataaattgccagatgatttcatgggttgtgtccttgcttggaa

SEQ ID NO: 318011 - DNA, 75 bp, Artificial Sequence
  Synthetic
gagtcacattaattggagaatcagtaaaaacacagtttaactactttaagaaagtagacggcattattcaacagt

SEQ ID NO: 318012 - DNA, 75 bp, Artificial Sequence
  Synthetic
aatgcgatagcaacatgtgattggactaatgctggcgattacatacttgccaacacttgtactgagagactcaag

SEQ ID NO: 318013 - DNA, 75 bp, Artificial Sequence
  Synthetic
gcgatgcctaacttgtacaagatgcaaagaatgcttcttgaaaagtgtgaccttcagaattatggtgaaaatgct

SEQ ID NO: 318014 - DNA, 75 bp, Artificial Sequence
  Synthetic
aaagaatgcttcttgaaaagtgtgaccttcagaattatggtgaaaatgctgttataccaaaaggaataatgatga

SEQ ID NO: 318015 - DNA, 75 bp, Artificial Sequence
  Synthetic
gagtgtgttagaggtacgactgtactactaaaagaaccttgcccatcaggaacatacgagggcaattcaccattt

SEQ ID NO: 318016 - DNA, 75 bp, Artificial Sequence
  Synthetic
accaaagtctaaacgaacatgaaacttctcattgttttgacttgtatttctctatgcagttgcatatgcactgta

SEQ ID NO: 318017 - DNA, 75 bp, Artificial Sequence
  Synthetic
aattgacaggttaattacaggcagacttcaaagccttcaaacctatgtaacacaacaactaatcagggctgctga

SEQ ID NO: 318018 - DNA, 75 bp, Artificial Sequence
  Synthetic
gttaacgtgagtttagtaaaaccaacggtttacgtctactcgcgtgttaaaaatctgaactcttctgaaggagtt

SEQ ID NO: 318019 - DNA, 75 bp, Artificial Sequence
  Synthetic
tggtttattacacagaggaacttcttttctccacaaataattactacagacaatacatttgtctcaggaaattgt

SEQ ID NO: 318020 - DNA, 75 bp, Artificial Sequence
  Synthetic
tcttgctgcaagtttgatgaggatgactctgagccagttctcaagggtgtcaaattacattacacataaacgaac

SEQ ID NO: 318021 - DNA, 75 bp, Artificial Sequence
  Synthetic
caaattacattacacataaacgaacttatggatttgtttatgagattttttactcttggatcaattactgcacag

SEQ ID NO: 318022 - DNA, 75 bp, Artificial Sequence
  Synthetic
gacttgaaagagccaccacattttcatcgaggccacgcggagtacgatcgagggtacagtgaataatgctaggga

SEQ ID NO: 318023 - DNA, 75 bp, Artificial Sequence
  Synthetic
tgtggcttagctacttcgttgcttccttcaggctgtttgctcgtacccgctcaatgtggtcattcaacccagaaa

SEQ ID NO: 318024 - DNA, 75 bp, Artificial Sequence
  Synthetic
tcaagatgttaactgcactgatgtttctacattaattcatgcagaacaactcacaccagcttggcgcatatattc

SEQ ID NO: 318025 - DNA, 75 bp, Artificial Sequence
  Synthetic
aagaacggtaataagggagccggtggtcatagctatggcatcgatctaaagtcttatgacttaggtgacgagctt

SEQ ID NO: 318026 - DNA, 75 bp, Artificial Sequence
  Synthetic
gcaatcctaataacaatgctgctaccgtgctacaacttcctcaaggaacaacattgccaaaaggcttctacgcag

SEQ ID NO: 318027 - DNA, 75 bp, Artificial Sequence
  Synthetic
atctattcacatcttttgcttgtcgctgcaggtatggaggcgcaatttttgtacctctatgccttgatatatttt

SEQ ID NO: 318028 - DNA, 75 bp, Artificial Sequence
  Synthetic
tcaagaacggtgaactcgaagcactcgagacgcccgttgatagcttcacaaatggagctatcgttggcacaccag

SEQ ID NO: 318029 - DNA, 75 bp, Artificial Sequence
  Synthetic
ttgtgcagaatgaattctcgtaactaaacagcacaagtaggtttagttaactttaatctcacatagcaatcttta

SEQ ID NO: 318030 - DNA, 75 bp, Artificial Sequence
  Synthetic
taccaacatgggtattgatcttgatgagtggagtgtagctacattctacttatttgatgatgctggtgaagaaaa

SEQ ID NO: 318031 - DNA, 75 bp, Artificial Sequence
  Synthetic
ctttctcccctgatggcaaaccttgcaccccacctgcttttaattgttattggccattaaatgattatggttttt

SEQ ID NO: 318032 - DNA, 75 bp, Artificial Sequence
  Synthetic
tgtttccattccatgtgtgtgtggtcgtgatgctacacaatatctagtacaacaagagtcttcttttgttatgat

SEQ ID NO: 318033 - DNA, 75 bp, Artificial Sequence
  Synthetic
tcaccctcttgctgataataaatttgcactaacttgcactagcacacactttgcttttgcttgtgctgacggtac

SEQ ID NO: 318034 - DNA, 75 bp, Artificial Sequence
  Synthetic
ctgcctatatggaagagccctaatgtgtaaaattaattttagtagtgctatccccatgtgattttacacattagg

SEQ ID NO: 318035 - DNA, 75 bp, Artificial Sequence
  Synthetic
tcgctcctcatcacgtagtcgcggtaattcaagaaattcaactcctggcagcagtaggggaaattctcctgctcg

SEQ ID NO: 318036 - DNA, 75 bp, Artificial Sequence
  Synthetic
catccgctctcccattttgtcaatttagacaatttgagagctaacaaacactaaaggttcactgcctattaatgc

SEQ ID NO: 318037 - DNA, 75 bp, Artificial Sequence
  Synthetic
tgaagctttcgagaagatggtttctcttttgtactgttttgctatccatgcagggtgctgtagacattaataggt

SEQ ID NO: 318038 - DNA, 75 bp, Artificial Sequence
  Synthetic
tgtagaagctgtgatgtatatgggtactctatcttatgataatcttaagacaggtgtttccattccatgtgtgtg

SEQ ID NO: 318039 - DNA, 75 bp, Artificial Sequence
  Synthetic
tattgccactgtacgcgaagtactctctgacagagaattgcatctttcatgggaggttggaaaacctagaccacc

SEQ ID NO: 318040 - DNA, 75 bp, Artificial Sequence
  Synthetic
gctattgctgctagacagattgaaccagcttgagagcaaagtttctggtaaaggccaacaacaacaaggccaaac

SEQ ID NO: 318041 - DNA, 75 bp, Artificial Sequence
  Synthetic
aaggccaacaacaacaaggccaaactgtcactaagaaatctgctgctgaggcatctaaaaagcctcgccaaaaac

SEQ ID NO: 318042 - DNA, 75 bp, Artificial Sequence
  Synthetic
tgatgttttctacaaggaaacatcttacactacaaccatcaagcctgtgtcgtataaactcgatggagttactta

SEQ ID NO: 318043 - DNA, 75 bp, Artificial Sequence
  Synthetic
gagtagtattgatgctttcaagcttaaccattaagttgttgggtattggaggtaaaccatgtatcaaggttgcta

SEQ ID NO: 318044 - DNA, 75 bp, Artificial Sequence
  Synthetic
gcgagttttgataatttcaaactcacatgttctaacacaaaatttgctgatgatttaaatcaaatgacaggcttc

SEQ ID NO: 318045 - DNA, 75 bp, Artificial Sequence
  Synthetic
gacaaagcttacaaaatagaggaactcttctattcttatgctacacatcacgataaattcactgatggtgtttgt

SEQ ID NO: 318046 - DNA, 75 bp, Artificial Sequence
  Synthetic
tttcaaaagtggtcaaggttacaattgactatgctgaaatttcattcatgctttggtgtaaggatggacatgttg

SEQ ID NO: 318047 - DNA, 75 bp, Artificial Sequence
  Synthetic
actggtacgatttcggagatttcgtacgagtagcacccaggctgcggagttcctattgtggattcatattactca

SEQ ID NO: 318048 - DNA, 75 bp, Artificial Sequence
  Synthetic
tgttgccacctctgctcactgatgatatgattgctgcctacactgctgctctagttagtggtactgccactgctg

SEQ ID NO: 318049 - DNA, 75 bp, Artificial Sequence
  Synthetic
tcctattgtggattcatattactcattgctgatgccccatcctcactttgactagggccattggctgctgagtcc

SEQ ID NO: 318050 - DNA, 75 bp, Artificial Sequence
  Synthetic
tggcgttagagaattgtatcttaattcgtctaacgttactactatggatttctgtgaaggttcttttccttgcag

SEQ ID NO: 318051 - DNA, 75 bp, Artificial Sequence
  Synthetic
aaaccaacgtagtgccccccgcattacatttggtggacccacagattcaactgacaataaccagaatggaggacg

SEQ ID NO: 318052 - DNA, 75 bp, Artificial Sequence
  Synthetic
aaatgcgacgagtctgcttctaagtctgcttctgtgtactacagtcagctgatgtgccaacctattctgttgctt

SEQ ID NO: 318053 - DNA, 75 bp, Artificial Sequence
  Synthetic
aggaaaagccaaccaacctcgatctcttgtagatctgttctctaaacgaactttaaaatctgtgtagctgtcgct

SEQ ID NO: 318054 - DNA, 75 bp, Artificial Sequence
  Synthetic
ttgggagacgtggtccagaacaaacccaaggaaatttcggggaccaagacctaatcagacaaggaactgattaca

SEQ ID NO: 318055 - DNA, 75 bp, Artificial Sequence
  Synthetic
ggccacgcggagtacgatcgagggtacagtgaataatgctagggagagctgcctatatggaagagccctaatgtg

SEQ ID NO: 318056 - DNA, 75 bp, Artificial Sequence
  Synthetic
gcctatatggaagagccctaatgtgtaaaattaattttagtagtgctatccccatgtgattttaatagcttctta

SEQ ID NO: 318057 - DNA, 75 bp, Artificial Sequence
  Synthetic
atgcacttttgtttttgatgtctttcactatactctgtctggtaccagcttacagctttctgccgggagtctact

SEQ ID NO: 318058 - DNA, 75 bp, Artificial Sequence
  Synthetic
tgttttctcctattgtgcctttttggataacagcaatctatgtattctgtatttctctgaagcactgccattggt

SEQ ID NO: 318059 - DNA, 75 bp, Artificial Sequence
  Synthetic
gtccaactcagtttgcctgttcttcaggttagagacgtgctagtgcgtggcttcggggactctgtggaagaggcc

SEQ ID NO: 318060 - DNA, 75 bp, Artificial Sequence
  Synthetic
cttgaacagccctatgtgttcattaaacgatctgatgctctaagcaccaatcacggccacaaggttgtggaattg

SEQ ID NO: 318061 - DNA, 75 bp, Artificial Sequence
  Synthetic
aacgatctgatgctctaagcaccaatcacggccacaaggttgtggaattggttgcagaattagatggcattcagt

SEQ ID NO: 318062 - DNA, 75 bp, Artificial Sequence
  Synthetic
cgagattaagagtgccaagaaatttgacacctttaaaggggaatgcccgaagttcgtatttcctcttaactctaa

SEQ ID NO: 318063 - DNA, 75 bp, Artificial Sequence
  Synthetic
agttcgtatttcctcttaactctaaagtcaaagtcattcaaccacgtgttgaaaagaaaaagactgaaggtttca

SEQ ID NO: 318064 - DNA, 75 bp, Artificial Sequence
  Synthetic
agtcaaagtcattcaaccacgtgttgaaaagaaaaagactgaaggtttcatggggcgcattcgctctgtgtaccc

SEQ ID NO: 318065 - DNA, 75 bp, Artificial Sequence
  Synthetic
gaaaagaaaaagactgaaggtttcatggggcgcattcgctctgtgtaccctgttgccactcctcaagagtgcaat

SEQ ID NO: 318066 - DNA, 75 bp, Artificial Sequence
  Synthetic
aatgtaatcattgcgatgaagtttcatggcagacgtgcgactttctaaaagccacttgtgaacaatgtggcactg

SEQ ID NO: 318067 - DNA, 75 bp, Artificial Sequence
  Synthetic
gccacttgtgaacaatgtggcactgaaaatttagtttgtgaaggacccactacatgtggatacctacctactaat

SEQ ID NO: 318068 - DNA, 75 bp, Artificial Sequence
  Synthetic
tcacctgctcaagacatttggggcacgtcagctgcagcctattttgttggctatttaaagccaactacatttatg

SEQ ID NO: 318069 - DNA, 75 bp, Artificial Sequence
  Synthetic
agagcatagtgttgctgactaccacaaccattcaaacattgaaactcgactccgcaagggaggtaggactaagtg

SEQ ID NO: 318070 - DNA, 75 bp, Artificial Sequence
  Synthetic
aaccattcaaacattgaaactcgactccgcaagggaggtaggactaagtgttttggcggctgtgtattttcctat

SEQ ID NO: 318071 - DNA, 75 bp, Artificial Sequence
  Synthetic
actgggtccctcgtgctagtgctaatatcggtgcgaaccatactggcattactggtgaaaatgttgagactctta

SEQ ID NO: 318072 - DNA, 75 bp, Artificial Sequence
  Synthetic
tatcggtgcgaaccatactggcattactggtgaaaatgttgagactcttaatgaggatcttctggagatactgaa

SEQ ID NO: 318073 - DNA, 75 bp, Artificial Sequence
  Synthetic
gttggtgattttcggtttaatgaggaggttgccatcattttggcatctttttcagcttctcctagcgcttttatc

SEQ ID NO: 318074 - DNA, 75 bp, Artificial Sequence
  Synthetic
aggttgccatcattttggcatctttttcagcttctcctagcgcttttatcgagactgtaaagggtcttgattaca

SEQ ID NO: 318075 - DNA, 75 bp, Artificial Sequence
  Synthetic
ctgcggtaactacaaagttactaatggaaagcccgtaacaggagcttggaacattggacaacagagatccatcct

SEQ ID NO: 318076 - DNA, 75 bp, Artificial Sequence
  Synthetic
ggaaagcccgtaacaggagcttggaacattggacaacagagatccatcctaacaccactgtgtggtttcccctca

SEQ ID NO: 318077 - DNA, 75 bp, Artificial Sequence
  Synthetic
tgctgattataattataaattgcccagatgatttcatgggttgtgtccttgcttggaatactaggaacattgatg

SEQ ID NO: 318078 - DNA, 75 bp, Artificial Sequence
  Synthetic
ttttctctcgcacactggatgcagcaaaccattctattcttgaccttcaaagagcagctgtcaccactcttgatg

SEQ ID NO: 318079 - DNA, 75 bp, Artificial Sequence
  Synthetic
aaaccattctattcttgaccttcaaagagcagctgtcaccactcttgatggtatttctgaacaatcattgcgtct

SEQ ID NO: 318080 - DNA, 75 bp, Artificial Sequence
  Synthetic
gatttgttaaccaacagtgttgtcgttatggcatatgtgactggtggtcttgtacaacaaacgatgcagtggttg

SEQ ID NO: 318081 - DNA, 75 bp, Artificial Sequence
  Synthetic
ttatggcatatgtgactggtggtcttgtacaacaaacgatgcagtggttgtctaacatgctaggcactgctgttg

SEQ ID NO: 318082 - DNA, 75 bp, Artificial Sequence
  Synthetic
ggttgaggctaaacttagtgcaggagttgaatttcttagagatgcttgggaaattcttaaattcttgatcacagg

SEQ ID NO: 318083 - DNA, 75 bp, Artificial Sequence
  Synthetic
gttgaatttcttagagatgcttgggaaattcttaaattcttgatcacaggagtatttgatgtcattaagggtcaa

SEQ ID NO: 318084 - DNA, 75 bp, Artificial Sequence
  Synthetic
aggaatgtgtaaaaatttttcttggtgttgttaacaaagcacttgaaatgtgtttagaccaggtcacgattgctg

SEQ ID NO: 318085 - DNA, 75 bp, Artificial Sequence
  Synthetic
tgtttagaccaggtcacgattgctggcactaagttgagagcgctcaatttaggtgaagtcttcattgcacaaagc

SEQ ID NO: 318086 - DNA, 75 bp, Artificial Sequence
  Synthetic
agaggactctaccgccagtgtattcgtggcaaagaacagctgcaattactcatgcctcttaaggcaccaaaagaa

SEQ ID NO: 318087 - DNA, 75 bp, Artificial Sequence
  Synthetic
gtcaccttccttgaaggagatgcacatgatacagtactaacctctgaagaggtcgtccttaagagtggtgagctc

SEQ ID NO: 318088 - DNA, 75 bp, Artificial Sequence
  Synthetic
gcttcactagtggagctgttgtaggtacacctgtttgtatcaatggcctcatgctcttagagctcgagaataagg

SEQ ID NO: 318089 - DNA, 75 bp, Artificial Sequence
  Synthetic
atgctcttagagctcgagaataaggaacagtattgtgccttgtctcctggcttgttagcaacaaacaatgtcttt

SEQ ID NO: 318090 - DNA, 75 bp, Artificial Sequence
  Synthetic
aaggtgtgacttttggagaggacactgttttagaagttcaaggctacaagaatgtgaagattacttttgaacttg

SEQ ID NO: 318091 - DNA, 75 bp, Artificial Sequence
  Synthetic
tgttttagaagttcaaggctacaagaatgtgaagattacttttgaacttgatgagcgtgtggataaggtgcttaa

SEQ ID NO: 318092 - DNA, 75 bp, Artificial Sequence
  Synthetic
gagtctggtactgaggttactgaattcgcatgtgttgtagcggaagctgttgtaaaaactttgcaaccagtttct

SEQ ID NO: 318093 - DNA, 75 bp, Artificial Sequence
  Synthetic
tcgcatgtgttgtagcggaagctgttgtaaaaactttgcaaccagtttctgaccttcttacccccatgggtattg

SEQ ID NO: 318094 - DNA, 75 bp, Artificial Sequence
  Synthetic
attttacttgttcgacgacgctggtgaagaaaaactttcatcacgcatgtattgctctttctaccctcctgatga

SEQ ID NO: 318095 - DNA, 75 bp, Artificial Sequence
  Synthetic
gaagaaaaactttcatcacgcatgtattgctctttctaccctcctgatgaggaagaagactgtgaagagtgtgag

SEQ ID NO: 318096 - DNA, 75 bp, Artificial Sequence
  Synthetic
aggtctccctcttgaatttggtgcatcaactgaaacaccacatgttgaagaagaggaagaagaggaagattggct

SEQ ID NO: 318097 - DNA, 75 bp, Artificial Sequence
  Synthetic
tcaactgaaacaccacatgttgaagaagaggaagaagaggaagattggcttgatgacgctatagaagcagaacct

SEQ ID NO: 318098 - DNA, 75 bp, Artificial Sequence
  Synthetic
cagtcaatcagtttgttggttatttaaagcttactgacaatgttgccattaagtgtattgacattgttaaagagg

SEQ ID NO: 318099 - DNA, 75 bp, Artificial Sequence
  Synthetic
tgttaatgctgctaacacccacttgaaacatggtggtggtgtagctggtgctctaaataaggccactaatggtgc

SEQ ID NO: 318100 - DNA, 75 bp, Artificial Sequence
  Synthetic
aaacatggtggtggtgtagctggtgctctaaataaggccactaatggtgctatgcagaatgagagtgatgaatac

SEQ ID NO: 318101 - DNA, 75 bp, Artificial Sequence
  Synthetic
ctctaaataaggccactaatggtgctatgcagaatgagagtgatgaatacatcaggcaaaatggacctcttacag

SEQ ID NO: 318102 - DNA, 75 bp, Artificial Sequence
  Synthetic
acaagagtcttcttttgttatgatgtctgcaccacctgctgagtataaattacagcaaggtacattcttatgtgc

SEQ ID NO: 318103 - DNA, 75 bp, Artificial Sequence
  Synthetic
acacaatcttgcagagaagtgtctgcatgttgttggacctaacttaaatgccggtgaggatgttcaactccttaa

SEQ ID NO: 318104 - DNA, 75 bp, Artificial Sequence
  Synthetic
catgttgttggacctaacttaaatgccggtgaggatgttcaactccttaaaagggcatatgagaatttcaattca

SEQ ID NO: 318105 - DNA, 75 bp, Artificial Sequence
  Synthetic
tgtcagctggcatatttggtgccaaaccacttcagtcattaaaaatgtgtgttgagatagttcgcacacaagttt

SEQ ID NO: 318106 - DNA, 75 bp, Artificial Sequence
  Synthetic
ttatgatcagattgtcttagattatctagatagtctgaaacctaaagtggagtcccccaacaaggaggaagagcc

SEQ ID NO: 318107 - DNA, 75 bp, Artificial Sequence
  Synthetic
ctagatagtctgaaacctaaagtggagtcccccaacaaggaggaagagccaaaattggaggagcctaaagcggtg

SEQ ID NO: 318108 - DNA, 75 bp, Artificial Sequence
  Synthetic
agtcccccaacaaggaggaagagccaaaattggaggagcctaaagcggtgcagccagttgctgagaaacctgttg

SEQ ID NO: 318109 - DNA, 75 bp, Artificial Sequence
  Synthetic
tatcgacgaggtcactacaacactggaggaaactaagtttcttaccaataaattgcttctttttgctgacatcaa

SEQ ID NO: 318110 - DNA, 75 bp, Artificial Sequence
  Synthetic
gaggaaactaagtttcttaccaataaattgcttctttttgctgacatcaatggtaaactttaccaagattcacag

SEQ ID NO: 318111 - DNA, 75 bp, Artificial Sequence
  Synthetic
ctttcttagagaaagatgcaccatatattgttggtgatgtcatcactagtggtgacatcacttgtgtcataatac

SEQ ID NO: 318112 - DNA, 75 bp, Artificial Sequence
  Synthetic
tattgttggtgatgtcatcactagtggtgacatcacttgtgtcataatacctgctaagaagtcgggtgggactac

SEQ ID NO: 318113 - DNA, 75 bp, Artificial Sequence
  Synthetic
tcgtggtcacttgcgaatggccggacactccctagggcgctgtgacattaaggacctgccaaaagagatcactgt

SEQ ID NO: 318114 - DNA, 75 bp, Artificial Sequence
  Synthetic
gaagtcccagttgctgagtatataacaacctatcctggacaagggtgtgctggttatacacttgaagaagcaaag

SEQ ID NO: 318115 - DNA, 75 bp, Artificial Sequence
  Synthetic
caacctatcctggacaagggtgtgctggttatacacttgaagaagcaaagactgcacttaaaaaatgcaaatctg

SEQ ID NO: 318116 - DNA, 75 bp, Artificial Sequence
  Synthetic
acctaatgagaaggaagaggttcttggcacagtatcatggaacctacgtgaaatgcttgctcatgcagaggagac

SEQ ID NO: 318117 - DNA, 75 bp, Artificial Sequence
  Synthetic
ggcacagtatcatggaacctacgtgaaatgcttgctcatgcagaggagacaagaaaattaatgcctatttgcctg

SEQ ID NO: 318118 - DNA, 75 bp, Artificial Sequence
  Synthetic
tccagcgcaagtataagggtattaaagttcaggaaggaatcgtggattacggtgtccggttcttcttctatacta

SEQ ID NO: 318119 - DNA, 75 bp, Artificial Sequence
  Synthetic
agttcaggaaggaatcgtggattacggtgtccggttcttcttctatactagcaaggagcctgtagcttctattat

SEQ ID NO: 318120 - DNA, 75 bp, Artificial Sequence
  Synthetic
ccacttgttactatgcccataggttatgtgacacatggtcttaacctagaagaggccgcgcgctgtatgcgctcc

SEQ ID NO: 318121 - DNA, 75 bp, Artificial Sequence
  Synthetic
atgtgacacatggtcttaacctagaagaggccgcgcgctgtatgcgctccctcaaggcacctgctgtggtgtcag

SEQ ID NO: 318122 - DNA, 75 bp, Artificial Sequence
  Synthetic
atataatggttacctcacttcgtcttccaagacacctgaggagtattttgtggagactacttctcttgcgggatc

SEQ ID NO: 318123 - DNA, 75 bp, Artificial Sequence
  Synthetic
tccaagacacctgaggagtattttgtggagactacttctcttgcgggatcgtatagagattggtcttattcagga

SEQ ID NO: 318124 - DNA, 75 bp, Artificial Sequence
  Synthetic
ttcttaagcgtggggacaagattgtctatcacactacagggagccccattgagtttcaccttgatggtgaggttc

SEQ ID NO: 318125 - DNA, 75 bp, Artificial Sequence
  Synthetic
ctatcacactacagggagccccattgagtttcaccttgatggtgaggttcttccacttgacaaactaaagagtct

SEQ ID NO: 318126 - DNA, 75 bp, Artificial Sequence
  Synthetic
tggttttaggaaaatggcattcccgtcaggcaaagttgaagggtgcatggtacaagtaacctgtggaactacaac

SEQ ID NO: 318127 - DNA, 75 bp, Artificial Sequence
  Synthetic
attaaggtgtttacaactgtagacaacactaacctccacacgcatattgtggacatgtctatgacttatggacaa

SEQ ID NO: 318128 - DNA, 75 bp, Artificial Sequence
  Synthetic
cttggtagatatatgtcagcattaaaccatacaaagaagtggaagtttcctcaggttggtggtttaacttcaatc

SEQ ID NO: 318129 - DNA, 75 bp, Artificial Sequence
  Synthetic
accatacaaagaagtggaagtttcctcaggttggtggtttaacttcaatcaaatgggcagacaacaattgttact

SEQ ID NO: 318130 - DNA, 75 bp, Artificial Sequence
  Synthetic
gcaagttgaagtgaaatttaatgcacccgcgcttcaggaagcctattatagggctcgcgccggtgatgctgccaa

SEQ ID NO: 318131 - DNA, 75 bp, Artificial Sequence
  Synthetic
cccgcgcttcaggaagcctattatagggctcgcgccggtgatgctgccaacttttgtgcactcatactggcttac

SEQ ID NO: 318132 - DNA, 75 bp, Artificial Sequence
  Synthetic
gtgatgtcagagaaactatgacccatcttttacagcatgctaatttagagtcagctaaaagagttcttaatgtag

SEQ ID NO: 318133 - DNA, 75 bp, Artificial Sequence
  Synthetic
tcttttacagcatgctaatttagagtcagctaaaagagttcttaatgtagtatgcaaacactgcggccagaaaac

SEQ ID NO: 318134 - DNA, 75 bp, Artificial Sequence
  Synthetic
gtgatgtacatggggactctgtcttatgatgagcttaagacaggtgtttcaattccttgtgtatgtgggcgtaat

SEQ ID NO: 318135 - DNA, 75 bp, Artificial Sequence
  Synthetic
atgatgagcttaagacaggtgtttcaattccttgtgtatgtgggcgtaatgctacacaatatttagtacaacaag

SEQ ID NO: 318136 - DNA, 75 bp, Artificial Sequence
  Synthetic
accacctgctgagtacaaattacaacagggggcctttttgtgtgctaatgaatacactggcaattatcagtgtgg

SEQ ID NO: 318137 - DNA, 75 bp, Artificial Sequence
  Synthetic
cagggggcctttttgtgtgctaatgaatacactggcaattatcagtgtggacattacactcacataactgctaaa

SEQ ID NO: 318138 - DNA, 75 bp, Artificial Sequence
  Synthetic
cacatcttactaagatgtcagaatataaaggaccagtgactgatgttttctacaaggaaacctcctacactacag

SEQ ID NO: 318139 - DNA, 75 bp, Artificial Sequence
  Synthetic
taaaggaccagtgactgatgttttctacaaggaaacctcctacactacagctatcaaacctgtgtcttataaact

SEQ ID NO: 318140 - DNA, 75 bp, Artificial Sequence
  Synthetic
gtactgggaacctgagttttatgaggctatgtacacaccacacacagtcttgcaggctgtaggtgcttgtgtatt

SEQ ID NO: 318141 - DNA, 75 bp, Artificial Sequence
  Synthetic
gctatgtacacaccacacacagtcttgcaggctgtaggtgcttgtgtattgtgcaattcacagacttcacttcgt

SEQ ID NO: 318142 - DNA, 75 bp, Artificial Sequence
  Synthetic
gaaccgaaattagatgggtactataagaagggtaatgcttactacactgagcagcctattgaccttgtcccaacc

SEQ ID NO: 318143 - DNA, 75 bp, Artificial Sequence
  Synthetic
gcagcctattgaccttgtcccaacccaaccaatgccaaatgcaagttttgataattttaaacttacatgctctaa

SEQ ID NO: 318144 - DNA, 75 bp, Artificial Sequence
  Synthetic
cattaataatgctgtttacacaaaggtagatggtgttgatgtggagatctttgaaaataagacaacacttcctgt

SEQ ID NO: 318145 - DNA, 75 bp, Artificial Sequence
  Synthetic
cactaaatttgctgatgaccttaatcaaatgacaggctttaaaaagccagcctcgcgtgagctaaccgtcacatt

SEQ ID NO: 318146 - DNA, 75 bp, Artificial Sequence
  Synthetic
caaatgacaggctttaaaaagccagcctcgcgtgagctaaccgtcacattcttcccagacttgaatggcgatgta

SEQ ID NO: 318147 - DNA, 75 bp, Artificial Sequence
  Synthetic
ccacgagtttcaagaaaggtgcaaaactggtacataagccaattctttggcatattaaccagactacaaacaaga

SEQ ID NO: 318148 - DNA, 75 bp, Artificial Sequence
  Synthetic
actggtacataagccaattctttggcatattaaccagactacaaacaagacaacgtacaaaccaaacatctggtg

SEQ ID NO: 318149 - DNA, 75 bp, Artificial Sequence
  Synthetic
ggaaataatagagtgtgacgtgaaaactaccgaagttgtaggcaatgtcatactaaaaccatcagaagaaggtgt

SEQ ID NO: 318150 - DNA, 75 bp, Artificial Sequence
  Synthetic
gaagatctaatggctgcttatgttgaagaaacaagcattaccattaagaagcctaacgagctttcgttagcctta

SEQ ID NO: 318151 - DNA, 75 bp, Artificial Sequence
  Synthetic
aagaaacaagcattaccattaagaagcctaacgagctttcgttagccttaggcttgaaaacacttgccacccatg

SEQ ID NO: 318152 - DNA, 75 bp, Artificial Sequence
  Synthetic
atggagtaagattttggcgtatgtcaaacccttccttggacagacagcggttataacttcaaactgcatcaagaa

SEQ ID NO: 318153 - DNA, 75 bp, Artificial Sequence
  Synthetic
aaacccttccttggacagacagcggttataacttcaaactgcatcaagaaatgtgtgcagcgagtttttagcaac

SEQ ID NO: 318154 - DNA, 75 bp, Artificial Sequence
  Synthetic
tatttcaattgtgcacttttacaaagagcaccaattccagaataaaagcttcacttcctacgactattgctaaaa

SEQ ID NO: 318155 - DNA, 75 bp, Artificial Sequence
  Synthetic
atagtgttaagagtgttgctaaattgtgtttggacgtttgcattaattatgtgaaatctcctaagttttctaaat

SEQ ID NO: 318156 - DNA, 75 bp, Artificial Sequence
  Synthetic
gttgttaagtatttgcctaggttctttaacctatgtaactgctgttcttggtgtatgcctatctagtttaggtgt

SEQ ID NO: 318157 - DNA, 75 bp, Artificial Sequence
  Synthetic
ttaacctatgtaactgctgttcttggtgtatgcctatctagtttaggtgttccttcttattgtgatggcgttaga

SEQ ID NO: 318158 - DNA, 75 bp, Artificial Sequence
  Synthetic
tcactactatggacttttgtcagggttattttccctgcagtgtctgtttaagtggattagattctcttgattctt

SEQ ID NO: 318159 - DNA, 75 bp, Artificial Sequence
  Synthetic
ttattttccctgcagtgtctgtttaagtggattagattctcttgattcttacccagctcttgaaaccatccaggt

SEQ ID NO: 318160 - DNA, 75 bp, Artificial Sequence
  Synthetic
ctgacatttttgggtttggcagctgaatggttattggcatatatgttgtttacaaagttcttctacttacttggt

SEQ ID NO: 318161 - DNA, 75 bp, Artificial Sequence
  Synthetic
aatggttattggcatatatgttgtttacaaagttcttctacttacttggtctctccgccataatgcaagcgttct

SEQ ID NO: 318162 - DNA, 75 bp, Artificial Sequence
  Synthetic
tagcaattcttggcttatgtggtttatcattagtattgtacagatggcacctgtttcagcaatggttaggatgta

SEQ ID NO: 318163 - DNA, 75 bp, Artificial Sequence
  Synthetic
atcattagtattgtacagatggcacctgtttcagcaatggttaggatgtacattttctttgcttctttctattat

SEQ ID NO: 318164 - DNA, 75 bp, Artificial Sequence
  Synthetic
tggatggctgtacttcatcaacttgcatgatgtgctacaaacgcaatcgtgcgacacgtgttgagtgtacaacta

SEQ ID NO: 318165 - DNA, 75 bp, Artificial Sequence
  Synthetic
catgatgtgctacaaacgcaatcgtgcgacacgtgttgagtgtacaactattgtcaatggcgtgaagagatcttt

SEQ ID NO: 318166 - DNA, 75 bp, Artificial Sequence
  Synthetic
ggcttctgtaaggctcacaattggaattgtctcaactgtgacactttttgtgctggtagtactttcattagcgat

SEQ ID NO: 318167 - DNA, 75 bp, Artificial Sequence
  Synthetic
attgtctcaactgtgacactttttgtgctggtagtactttcattagcgatgaggttgctcgtgatttgtcactcc

SEQ ID NO: 318168 - DNA, 75 bp, Artificial Sequence
  Synthetic
tgaccagtctgcatatgtcgtggatagcgttactgtgaaaaacggcgcactccacctctattttgataaggctgg

SEQ ID NO: 318169 - DNA, 75 bp, Artificial Sequence
  Synthetic
agcgttactgtgaaaaacggcgcactccacctctattttgataaggctggtcaaaagacttatgagaggcaccca

SEQ ID NO: 318170 - DNA, 75 bp, Artificial Sequence
  Synthetic
atttgagggctaacaacactaaaggttcattacctattaatgtcatagtttttgacggcaagtccaaatgtgagg

SEQ ID NO: 318171 - DNA, 75 bp, Artificial Sequence
  Synthetic
ttcattacctattaatgtcatagtttttgacggcaagtccaaatgtgaggagtctgccgctaaatctgcatctgt

SEQ ID NO: 318172 - DNA, 75 bp, Artificial Sequence
  Synthetic
taagacaccaaagtataaatttgtccgtatccaaccaggtcagacattttcagtcctagcttgttacaatggttc

SEQ ID NO: 318173 - DNA, 75 bp, Artificial Sequence
  Synthetic
cccattctgttacttgaccaagctcttgtgtcagatgttggagatagtactgaagtttctgttaagatgttcgat

SEQ ID NO: 318174 - DNA, 75 bp, Artificial Sequence
  Synthetic
ttgtgtcagatgttggagatagtactgaagtttctgttaagatgttcgatgcttatgtagacactttttcagcaa

SEQ ID NO: 318175 - DNA, 75 bp, Artificial Sequence
  Synthetic
taaagcacttgttgctacagcacatagtgagttggcaaagggtgtagctttagatggtgtcctttctacattcgt

SEQ ID NO: 318176 - DNA, 75 bp, Artificial Sequence
  Synthetic
gatactgatgttgatacaaaggatgtcattgagtgtctcaaactttctcaccattctgatatagaggtgacaggt

SEQ ID NO: 318177 - DNA, 75 bp, Artificial Sequence
  Synthetic
gcctagagatcttggtgcatgtattgattgtaatgcaaggcatataaatgcccaagtagcaaaaagccacaatgt

SEQ ID NO: 318178 - DNA, 75 bp, Artificial Sequence
  Synthetic
tacatgtctctgtccgaacagctgcgcaagcaaattcgcagtgctgccaaaaagaacaacataccttttagactt

SEQ ID NO: 318179 - DNA, 75 bp, Artificial Sequence
  Synthetic
gcaagcaaattcgcagtgctgccaaaaagaacaacataccttttagacttacctgtgctactactagacaggttg

SEQ ID NO: 318180 - DNA, 75 bp, Artificial Sequence
  Synthetic
actcaaaggtggtaaggttgttagtacgtggttcaaacttttgctgaaagtcacacttttgtgtgttcttgctgc

SEQ ID NO: 318181 - DNA, 75 bp, Artificial Sequence
  Synthetic
cttaatagattcaccactactttgaatgactttaaccttgtggcaatgaagtacaactatgaacctttgacacaa

SEQ ID NO: 318182 - DNA, 75 bp, Artificial Sequence
  Synthetic
caaagccattcaggatggtgtcactcgtgacattgtttctactgatgattgttttgctaacaaacatgctggatt

SEQ ID NO: 318183 - DNA, 75 bp, Artificial Sequence
  Synthetic
ggttcttacaggaatgacaaaaactgccctgtagtagcagctatcattactagagaaattggtttcatagtgcct

SEQ ID NO: 318184 - DNA, 75 bp, Artificial Sequence
  Synthetic
gccctgtagtagcagctatcattactagagaaattggtttcatagtgcctggtttacctggtactgttttgagag

SEQ ID NO: 318185 - DNA, 75 bp, Artificial Sequence
  Synthetic
aactcattgagtatagtgattttgctacttctgcttgcgttttggctgctgaatgtactattttcaaggatgcta

SEQ ID NO: 318186 - DNA, 75 bp, Artificial Sequence
  Synthetic
cgacactaacttacttgagggttctatttcttatagtgaactccgtcctgacacccgttatgtgctcatggatgg

SEQ ID NO: 318187 - DNA, 75 bp, Artificial Sequence
  Synthetic
atttcttatagtgaactccgtcctgacacccgttatgtgctcatggatggttctatcatacaattccctaacact

SEQ ID NO: 318188 - DNA, 75 bp, Artificial Sequence
  Synthetic
ttacaacttttgatgctgagtattgcagacatggtacttgtgaaaggtcagaagttggtgtgtgcttatctacta

SEQ ID NO: 318189 - DNA, 75 bp, Artificial Sequence
  Synthetic
cagacatggtacttgtgaaaggtcagaagttggtgtgtgcttatctactagcggtagatgggttcttaataatga

SEQ ID NO: 318190 - DNA, 75 bp, Artificial Sequence
  Synthetic
ttctgtggtgtcgatgctatgaacctcatagctaatatcttcacacctcttgttcaacctgtcggtgctctagat

SEQ ID NO: 318191 - DNA, 75 bp, Artificial Sequence
  Synthetic
tcatagctaatatcttcacacctcttgttcaacctgtcggtgctctagatgtgtctgcttcagtagtagcaggtg

SEQ ID NO: 318192 - DNA, 75 bp, Artificial Sequence
  Synthetic
tgctgcttactactttatgaaattcagacgtgcgtttggtgagtacaaccatgttgttgccgctaatgcattgct

SEQ ID NO: 318193 - DNA, 75 bp, Artificial Sequence
  Synthetic
gtttctaatgtctttcactatactctgtctggcacctgcttatagctttttgccgggggtttactctatctttta

SEQ ID NO: 318194 - DNA, 75 bp, Artificial Sequence
  Synthetic
tgaccatccaaatcctaagggattttgtgacttgaaaggtaagtatgtccaaatacctaccacttgtgctaatga

SEQ ID NO: 318195 - DNA, 75 bp, Artificial Sequence
  Synthetic
agccttttcacctgctcaagacacttggggcacgtcagctgcagcctattttgttggctatttaaagccaactac

SEQ ID NO: 318196 - DNA, 75 bp, Artificial Sequence
  Synthetic
tgcaatggtttgccatgttttctcctattgtgcctttctggataacagcaatctatgtgttctgtatttccctaa

SEQ ID NO: 318197 - DNA, 75 bp, Artificial Sequence
  Synthetic
ctatcttaagaaaagagtcatgtttaatggggttacattcagcacctttgaagaggcagctttatgtaccttttt

SEQ ID NO: 318198 - DNA, 75 bp, Artificial Sequence
  Synthetic
aatggggttacattcagcacctttgaagaggcagctttatgtacctttttacttaacaaagaaatgtatctgaga

SEQ ID NO: 318199 - DNA, 75 bp, Artificial Sequence
  Synthetic
ttacacagtataacagataccttgctctttacaacaagtacaagtattttagcggggccttggatactactagtt

SEQ ID NO: 318200 - DNA, 75 bp, Artificial Sequence
  Synthetic
atcgtgaagcagcttgctgccacttagctaaggctctaaatgacttcagtaactcaggtgctgacgtactctacc

SEQ ID NO: 318201 - DNA, 75 bp, Artificial Sequence
  Synthetic
cggaagagagactttgtcttttcgaccgctattttaaatattgggaccagatataccatcccaattgtattaatt

SEQ ID NO: 318202 - DNA, 75 bp, Artificial Sequence
  Synthetic
gtttggatgacaggtgtatcctccattgtgcaaactttaatgtattattttctactgtgtttccacctacgagtt

SEQ ID NO: 318203 - DNA, 75 bp, Artificial Sequence
  Synthetic
gacgacctgctcatccgcaaatctaaccatagtttccttgttcaagctggtaatgtccaacttcgtgttattggc

SEQ ID NO: 318204 - DNA, 75 bp, Artificial Sequence
  Synthetic
caagaatttaggtatatgaactcccaggggcttttgcctcctaagagtagtattgatgctttcaagcttaacatt

SEQ ID NO: 318205 - DNA, 75 bp, Artificial Sequence
  Synthetic
cagtcctagcttgttacaatggctcaccatcaggtgtttatcagtgtgccatgagacctaatcacaccattaagg

SEQ ID NO: 318206 - DNA, 75 bp, Artificial Sequence
  Synthetic
tagtgttggttttaacattgattatgattgcgtgtctttctgctacatgcatcatatggagcttccaactggagt

SEQ ID NO: 318207 - DNA, 75 bp, Artificial Sequence
  Synthetic
gacagactgcacaggctgctggcacagatacaactattacactgaatgttttagcttggctctatgctgctgtta

SEQ ID NO: 318208 - DNA, 75 bp, Artificial Sequence
  Synthetic
taggtttaccactactctcaatgactttaatcttgtggcaatgaagtacaattatgaacccctgacacaagatca

SEQ ID NO: 318209 - DNA, 75 bp, Artificial Sequence
  Synthetic
tttaatcttgtggcaatgaagtacaattatgaacccctgacacaagatcatgttgacatactaggacccctttct

SEQ ID NO: 318210 - DNA, 75 bp, Artificial Sequence
  Synthetic
atatgtgtgctgctctgaaagagcttctacagaatggtatgaatggtcgtactattcttggtagcactattttag

SEQ ID NO: 318211 - DNA, 75 bp, Artificial Sequence
  Synthetic
tctacagaatggtatgaatggtcgtactattcttggtagcactattttagaggatgagttcacgccctttgacgt

SEQ ID NO: 318212 - DNA, 75 bp, Artificial Sequence
  Synthetic
ttccaaggtaagttcaagaaaattgttaaaggtactcatcattggatgcttttgactttcttgacatcactttta

SEQ ID NO: 318213 - DNA, 75 bp, Artificial Sequence
  Synthetic
ttaaaggtactcatcattggatgcttttgactttcttgacatcacttttaattcttgtccagagtacacagtggt

SEQ ID NO: 318214 - DNA, 75 bp, Artificial Sequence
  Synthetic
tggaccaagagtcctttggtggtgcttcatgttgtctgtattgtagatgccacattgaccatccaaatcctaaag

SEQ ID NO: 318215 - DNA, 75 bp, Artificial Sequence
  Synthetic
tgctttcttgccatttgctttaggtattatggctgttgctgcttgcgcaatgcttcttgttaagcataaacatgc

SEQ ID NO: 318216 - DNA, 75 bp, Artificial Sequence
  Synthetic
attatggctgttgctgcttgcgcaatgcttcttgttaagcataaacatgcattcctgtgcttatttctattacct

SEQ ID NO: 318217 - DNA, 75 bp, Artificial Sequence
  Synthetic
atatggtctacatgcctgctagttgggtgatgcgtataatgacatggcttgaattggccgacactagcctgtctg

SEQ ID NO: 318218 - DNA, 75 bp, Artificial Sequence
  Synthetic
ggtgatgcgtataatgacatggcttgaattggccgacactagcctgtctggttatcggcttaaggactgtgttat

SEQ ID NO: 318219 - DNA, 75 bp, Artificial Sequence
  Synthetic
atcctcatgactgcccgtactgtttatgatgatgctgctagacgtgtgtggacattgatgaatgtcattacactc

SEQ ID NO: 318220 - DNA, 75 bp, Artificial Sequence
  Synthetic
tagactcttactttgtagttaagaggcatactatgtctaactaccaacatgaagagactatttataacttggtta

SEQ ID NO: 318221 - DNA, 75 bp, Artificial Sequence
  Synthetic
caagtactgttcgtgctacagcaacgataccgctacaagcctcactccctttcggagggcttgttattggcgttg

SEQ ID NO: 318222 - DNA, 75 bp, Artificial Sequence
  Synthetic
tttcttaggctattgttgttgttgctactttggcttattttgtttactcaaccgctattttagacttactcttgg

SEQ ID NO: 318223 - DNA, 75 bp, Artificial Sequence
  Synthetic
cttgtatcaaggttgctactgtacagtctaaaatgtctgacgtaaagtgcacatcagtagtgctgctctcagttc

SEQ ID NO: 318224 - DNA, 75 bp, Artificial Sequence
  Synthetic
ggcattggctgctgagtcccatatggatgctgatctcgcaaaaccacttattaagtgggatttgctgaaatatga

SEQ ID NO: 318225 - DNA, 75 bp, Artificial Sequence
  Synthetic
tggaaaagatggcagatcaagctatgacccaaatgtacaagcaggcaagatctgaagacaagcgggcaaaagtaa

SEQ ID NO: 318226 - DNA, 75 bp, Artificial Sequence
  Synthetic
gatgcacttaacaacattatcaacaatgcacgtgatggttgtgtaccactcaacatcataccacttacaacagca

SEQ ID NO: 318227 - DNA, 75 bp, Artificial Sequence
  Synthetic
tgatggtaacactttcacatatgcgtcagcactctgggaaattcagcaagttgttgatgcagatagtaaaattgt

SEQ ID NO: 318228 - DNA, 75 bp, Artificial Sequence
  Synthetic
gtcctgccgaaattgttgacacagtgagtgctttagtttatgacaataagctaaaagcacacaaagagaagtcag

SEQ ID NO: 318229 - DNA, 75 bp, Artificial Sequence
  Synthetic
gaactgagtccagtagcattacgacagatgtcttgtgcggctggtactacgcaaacagcttgtactgatgacaat

SEQ ID NO: 318230 - DNA, 75 bp, Artificial Sequence
  Synthetic
agggaggtaggtttgtgcttgcattactatcagaccaccaggacctcaagtgggctagattccctaagagtgatg

SEQ ID NO: 318231 - DNA, 75 bp, Artificial Sequence
  Synthetic
tgggctagattccctaagagtgatggtacaggtactatctatacagaactggaaccaccttgcaggtttgttaca

SEQ ID NO: 318232 - DNA, 75 bp, Artificial Sequence
  Synthetic
ccgttattttaaatattgggaccagacataccatcccaattgtattaactgtttggatgataggtgtatccttca

SEQ ID NO: 318233 - DNA, 75 bp, Artificial Sequence
  Synthetic
tttaaaatgaattaccaagttaatggttaccctaatatgtttattacccgtgaagaagctattcgtcacgttcgt

SEQ ID NO: 318234 - DNA, 75 bp, Artificial Sequence
  Synthetic
taacaacctaaatagaggtatggtactgggtagtttagctgccacagtacgtcttcaggccggtaatgcgacaga

SEQ ID NO: 318235 - DNA, 75 bp, Artificial Sequence
  Synthetic
tgcaaagaatagagctcgcaccgtagctggtgtctctatctgtagtactatgacaaatagacagtttcatcagaa

SEQ ID NO: 318236 - DNA, 75 bp, Artificial Sequence
  Synthetic
tctttctgtgctttcgctgtagacccagctaaagcttacaaagattacttagcaagtggtggacaaccaatcacg

SEQ ID NO: 318237 - DNA, 75 bp, Artificial Sequence
  Synthetic
acagtctgtaccgtctgcggaatgtggaaaggttatggctgtagttgtgatcaactccgcgaacccatgatgcag

SEQ ID NO: 318238 - DNA, 75 bp, Artificial Sequence
  Synthetic
cgtcttacaccgtgcggcacaggcactagcactgatgtcgtttatagggcttttgatatttacaacgagaaagtt

SEQ ID NO: 318239 - DNA, 75 bp, Artificial Sequence
  Synthetic
ctaattgctgccgcttccaagaaaaggatgaggaaggcaatttattagactcttatttcgtagttaagaggcaca

SEQ ID NO: 318240 - DNA, 75 bp, Artificial Sequence
  Synthetic
ggatgaggaaggcaatttattagactcttatttcgtagttaagaggcacacaatgtccaactaccaacatgaaga

SEQ ID NO: 318241 - DNA, 75 bp, Artificial Sequence
  Synthetic
tcgtaggtgtactgacactagataatcaggatctgaatgggaattggtacgattttggagacttcgtacaggtag

SEQ ID NO: 318242 - DNA, 75 bp, Artificial Sequence
  Synthetic
ggattcatactattctttgctgatgcctatcttgacactcacaaaggccttagctgctgagtcccatatggacgc

SEQ ID NO: 318243 - DNA, 75 bp, Artificial Sequence
  Synthetic
tgccagagattaagatactcaataatttgggtgttgacatcgctgctaacactgtcatctgggactataaaagag

SEQ ID NO: 318244 - DNA, 75 bp, Artificial Sequence
  Synthetic
actgtcatctgggactataaaagagaagccccggctcatgtttctacaataggtgtctgtactatgactgacata

SEQ ID NO: 318245 - DNA, 75 bp, Artificial Sequence
  Synthetic
tctactgtgtttccacctacgagttttggaccactagtaagaaagatatttgtagatggtgtaccttttgttgtt

SEQ ID NO: 318246 - DNA, 75 bp, Artificial Sequence
  Synthetic
taggggttgtacataatcaggatgtaaacttacatagctcacgcctcagttttaaggaacttttagtgtacgctg

SEQ ID NO: 318247 - DNA, 75 bp, Artificial Sequence
  Synthetic
gatggcataattcagcaattgcctgaaacctactttactcaaagcagagacttagaggatttcaagcccaggtca

SEQ ID NO: 318248 - DNA, 75 bp, Artificial Sequence
  Synthetic
aaacttacatagctcacgcctcagttttaaggaacttttagtgtacgctgctgatccagccatgcatgctgcctc

SEQ ID NO: 318249 - DNA, 75 bp, Artificial Sequence
  Synthetic
atcaagaatattaggcgcaggctgttttgtcgatgatattgtcaaaacagatggtacacttatgattgaaaggtt

SEQ ID NO: 318250 - DNA, 75 bp, Artificial Sequence
  Synthetic
atataaacttgaaggctatgcttttgagcatatcgtttatggagactttagtcatggacaacttggcggacttca

SEQ ID NO: 318251 - DNA, 75 bp, Artificial Sequence
  Synthetic
tgtcaaacccggtaattttaataaagacttttatgactttgctgtgtctaaaggcttctttaaggaaggaagttc

SEQ ID NO: 318252 - DNA, 75 bp, Artificial Sequence
  Synthetic
tcacaagattcaccgcttaaactagaggattttatccctatggatagcacagtgaaaaattatttcataacagat

SEQ ID NO: 318253 - DNA, 75 bp, Artificial Sequence
  Synthetic
gggtaaggctagactttattatgactcaatgagttatgaggaccaagatgcattgttcgcatacactaagcgtaa

SEQ ID NO: 318254 - DNA, 75 bp, Artificial Sequence
  Synthetic
tgtctctatctgtagtactatgaccaatagacagtttcatcagaaattattaaagtcaatagccgctactagagg

SEQ ID NO: 318255 - DNA, 75 bp, Artificial Sequence
  Synthetic
aatagacagtttcatcagaaattattaaagtcaatagccgctactagaggagctactgtggtaattggaacaagc

SEQ ID NO: 318256 - DNA, 75 bp, Artificial Sequence
  Synthetic
ctcactggcattgctatagaacaggacaaaaacactcaggaagtctttgcccaggttaaacaaatgtacaagaca

SEQ ID NO: 318257 - DNA, 75 bp, Artificial Sequence
  Synthetic
agcacttgttgtaacttgtcacaccgtttctatagattagctaatgagtgtgcacaggtattaagtgagatggtc

SEQ ID NO: 318258 - DNA, 75 bp, Artificial Sequence
  Synthetic
aaccaggtgggacatcatccggtgatgccacaactgcatatgctaatagtgtgtttaacatctgtcaagcagtaa

SEQ ID NO: 318259 - DNA, 75 bp, Artificial Sequence
  Synthetic
gtgtttaacatctgtcaagcagtaacagctaacgtaaatgcacttctttcaactgatggtaataagattgctgat

SEQ ID NO: 318260 - DNA, 75 bp, Artificial Sequence
  Synthetic
aactgatggtaataagattgctgataagtacgtccgcaatcttcaacatagactttatgagtgtctctatagaaa

SEQ ID NO: 318261 - DNA, 75 bp, Artificial Sequence
  Synthetic
cagagatgtggatcatgagttcgtggatgaattttatgcatatttgcgtaagcacttctccatgatgattctttc

SEQ ID NO: 318262 - DNA, 75 bp, Artificial Sequence
  Synthetic
gatgaattttatgcatatttgcgtaagcacttctccatgatgattctttctgacgatgccgttgtgtgctataat

SEQ ID NO: 318263 - DNA, 75 bp, Artificial Sequence
  Synthetic
tagctagcattaagaacttcaaagcagttctttactaccaaaataatgtgtttatgtctgaggcgaaatgctgga

SEQ ID NO: 318264 - DNA, 75 bp, Artificial Sequence
  Synthetic
gattgcaaagccttcaaacctatgtaacacaacaacttatcagagctgctgaaatcagagcttctgctaatcttg

SEQ ID NO: 318265 - DNA, 75 bp, Artificial Sequence
  Synthetic
acgtgtacctgccttacccagatccatctagaatattaggcgcaggctgttttgtcgacgacattgtcaaaacag

SEQ ID NO: 318266 - DNA, 75 bp, Artificial Sequence
  Synthetic
tgtgtcattagcaattgacgcctacccacttacaaagcaccctaatcaagagtatgctgatgttttccatttata

SEQ ID NO: 318267 - DNA, 75 bp, Artificial Sequence
  Synthetic
cttacagtatattaggaaactacatgatgagcttactggtcacatgttggacatgtactctgtaatgctaactaa

SEQ ID NO: 318268 - DNA, 75 bp, Artificial Sequence
  Synthetic
cctgaattttatgaagctatgtacacaccacacacagttttacaagctgtaggtgcttgtgtgttatgtaattca

SEQ ID NO: 318269 - DNA, 75 bp, Artificial Sequence
  Synthetic
gagtgctttagtttatgacaataagctaaaagcacacaaggagaagtcagctcaatgcttcaaaatgttctacaa

SEQ ID NO: 318270 - DNA, 75 bp, Artificial Sequence
  Synthetic
caccacacacagttttacaagctgtaggtgcttgtgtgttatgtaattcacagacttcgcttcgttgcggcgctt

SEQ ID NO: 318271 - DNA, 75 bp, Artificial Sequence
  Synthetic
caagtgctgctatgaccatgtcatttcaacatcacataaattagtgttgtctgttaatccctatgtttgcaatgc

SEQ ID NO: 318272 - DNA, 75 bp, Artificial Sequence
  Synthetic
acccattagttttcctttgtgtgctaatggtcaggtttttggtttatacaaaaacacatgtgtgggcagtgacaa

SEQ ID NO: 318273 - DNA, 75 bp, Artificial Sequence
  Synthetic
acatgtgattggactaatgctggcgattatatacttgccaacacttgtacagagagactcaaactttttgcagcg

SEQ ID NO: 318274 - DNA, 75 bp, Artificial Sequence
  Synthetic
attatatacttgccaacacttgtacagagagactcaaactttttgcagcggaaacgctcaaagctactgaggaga

SEQ ID NO: 318275 - DNA, 75 bp, Artificial Sequence
  Synthetic
cactgttcgtgaagtactgtcagatagagaactttacctttcgtgggaggtaggaaaacctagaccaccactgaa

SEQ ID NO: 318276 - DNA, 75 bp, Artificial Sequence
  Synthetic
ggcttccaggaaaagccaaccaacctccaggaaaagccaaccaacctcgatctcttgtagatctgttctctaaac

SEQ ID NO: 318277 - DNA, 75 bp, Artificial Sequence
  Synthetic
aggtgactatggtgatgctgttgtgtacagaggtactacaacttataaattgaatgttggtgattactttgtgtt

SEQ ID NO: 318278 - DNA, 75 bp, Artificial Sequence
  Synthetic
agtgcaccaacactagtgccacaggagcactatgtgcgaataactggcttataccctacactcaacatctctgat

SEQ ID NO: 318279 - DNA, 75 bp, Artificial Sequence
  Synthetic
gagttttctagcaatgttgcaaattaccaaaaaatcggtatgcagaagtactctacactccagggaccacctggt

SEQ ID NO: 318280 - DNA, 75 bp, Artificial Sequence
  Synthetic
agatgaccaaattggctactaccgaagagctacccgacgagttcgtggtggtgacggcaaaatgaaagagctcag

SEQ ID NO: 318281 - DNA, 75 bp, Artificial Sequence
  Synthetic
aatggccactaattatgatttgagtgttgtcaatgctagactacgtgcaaaacactacgtttacattggtgaccc

SEQ ID NO: 318282 - DNA, 75 bp, Artificial Sequence
  Synthetic
ctaaaagcacacaaggagaagtcagcgcaatgcttcaaaatgtattacaagggtgtgattacgcatgatgtgtca

SEQ ID NO: 318283 - DNA, 75 bp, Artificial Sequence
  Synthetic
caaccctgcttggagaaaagctgtttttatttcaccatataattcacagaatgcagtggcatcaaagattttagg

SEQ ID NO: 318284 - DNA, 75 bp, Artificial Sequence
  Synthetic
tcacagggttctgaatatgactatgtcatattcacacaaaccactgagactgcacactcttgtaatgtaaaccgc

SEQ ID NO: 318285 - DNA, 75 bp, Artificial Sequence
  Synthetic
tttaatgtggccatcacaagagcaaaaattggcattttgtgtataatgtctgatagagacctttatgacaagctg

SEQ ID NO: 318286 - DNA, 75 bp, Artificial Sequence
  Synthetic
gccgaaatgtggctactttacaagcagaaaatgtgactggactttttaaggactgtagcaagatcattactggtc

SEQ ID NO: 318287 - DNA, 75 bp, Artificial Sequence
  Synthetic
gcctgaaacctactttactcagagcagagacttagaggattttaagcccagatcacaaatggaaactgactttct

SEQ ID NO: 318288 - DNA, 75 bp, Artificial Sequence
  Synthetic
ttcaaaatgaattaccaagttaatggttaccctaatatgtttatcacccgtgaagaagctattcgtcacgttcgt

SEQ ID NO: 318289 - DNA, 75 bp, Artificial Sequence
  Synthetic
gttgtcatgctactagagatgctgtaggaacaaatctaccactccagttagggttttcaacaggtgttaacctag

SEQ ID NO: 318290 - DNA, 75 bp, Artificial Sequence
  Synthetic
aggaacaaatctaccactccagttagggttttcaacaggtgttaacctagtggccgtaccgactggctatgttga

SEQ ID NO: 318291 - DNA, 75 bp, Artificial Sequence
  Synthetic
agagttaatgcaaaacctcctccaggtgatcaatttaagcatcttataccacttatgtacaaaggtttgccctgg

SEQ ID NO: 318292 - DNA, 75 bp, Artificial Sequence
  Synthetic
gtgatcaatttaagcatcttataccacttatgtacaaaggtttgccctggaacgtggtgcgtattaagattgttc

SEQ ID NO: 318293 - DNA, 75 bp, Artificial Sequence
  Synthetic
atgtacagcagtggggttttacaggtaacttgcagagtaaccacgatcagcactgccaagtgcatggtaatgctc

SEQ ID NO: 318294 - DNA, 75 bp, Artificial Sequence
  Synthetic
gactagatgtctcgcagtccatgagtgcttcgttaagcgcgtcgattggtctgttgaatatccgattatcggaga

SEQ ID NO: 318295 - DNA, 75 bp, Artificial Sequence
  Synthetic
agaaaagtacagcatatggttgtcaagtctgcattgcttgctgataaatttacagttcttcatgacattggaaac

SEQ ID NO: 318296 - DNA, 75 bp, Artificial Sequence
  Synthetic
aggctgaagtagactggaaattctacgacgctcagccttgcagtgacaaagcttataaaatagaagaactcttct

SEQ ID NO: 318297 - DNA, 75 bp, Artificial Sequence
  Synthetic
cgacgctcagccttgcagtgacaaagcttataaaatagaagaactcttctactcatatgccacacatcatgacaa

SEQ ID NO: 318298 - DNA, 75 bp, Artificial Sequence
  Synthetic
gcttataaaatagaagaactcttctactcatatgccacacatcatgacaagttcacagatggtgtctgtttgttt

SEQ ID NO: 318299 - DNA, 75 bp, Artificial Sequence
  Synthetic
cagccaatgctattgtgtgtaggtttgatacccgagtgctctctaatttaaacctacctggttgtgatggtggta

SEQ ID NO: 318300 - DNA, 75 bp, Artificial Sequence
  Synthetic
tgatacccgagtgctctctaatttaaacctacctggttgtgatggtggtagtttgtatgttaataagcatgcatt

SEQ ID NO: 318301 - DNA, 75 bp, Artificial Sequence
  Synthetic
gcatttacacatttgaagcaactgcctttcttttattattctgacagtccttgtgagtctcatggtaaacaggtc

SEQ ID NO: 318302 - DNA, 75 bp, Artificial Sequence
  Synthetic
ctttcttttattattctgacagtccttgtgagtctcatggtaaacaggtcgtgtcagacattgattatgtcccac

SEQ ID NO: 318303 - DNA, 75 bp, Artificial Sequence
  Synthetic
gaattatggtgaaaatgctgttataccaaaaggaataatgatgaatgtcgcaaaatatactcaactgtgtcaata

SEQ ID NO: 318304 - DNA, 75 bp, Artificial Sequence
  Synthetic
ctgcaacttaggtggtgctgtttgtagacatcatgcaaatgagtatagacagtacttggatgcatacaatatgat

SEQ ID NO: 318305 - DNA, 75 bp, Artificial Sequence
  Synthetic
agacatcatgcaaatgagtatagacagtacttggatgcatacaatatgatgatttctgctggatttagcctttgg

SEQ ID NO: 318306 - DNA, 75 bp, Artificial Sequence
  Synthetic
acttgtggaatactttcactaagttgcagagtttagaaaatgtggcatataatgttgtcaacaagggacactttg

SEQ ID NO: 318307 - DNA, 75 bp, Artificial Sequence
  Synthetic
gcagagtttagaaaatgtggcatataatgttgtcaacaagggacactttgatggacagagtggtgaagcacctgt

SEQ ID NO: 318308 - DNA, 75 bp, Artificial Sequence
  Synthetic
gtgcagtcactcgctatgtcgacaacaatttctgtggcccagatgggtaccctcttgattgcatcaaagattttc

SEQ ID NO: 318309 - DNA, 75 bp, Artificial Sequence
  Synthetic
actaaagtagatggcattgacgtggaaattttcgagaacaagacaacacttcctgttaatgtggcgtttgagctt

SEQ ID NO: 318310 - DNA, 75 bp, Artificial Sequence
  Synthetic
tgggccaagcgtaacattaaaccagtgcctgagattaagatactcaataatttgggtgtcgacatcgtcgctaat

SEQ ID NO: 318311 - DNA, 75 bp, Artificial Sequence
  Synthetic
aagccccagcgcatgtttctacaataggtgtctgtacaatgactgacattgcaaagaaacctactgagagtgctt

SEQ ID NO: 318312 - DNA, 75 bp, Artificial Sequence
  Synthetic
cggtagagttgagggacaggtagactttttcagaaatgctcgcaatggtgttttaataacagaaggttcagttaa

SEQ ID NO: 318313 - DNA, 75 bp, Artificial Sequence
  Synthetic
ttcttacagccttttcacctgctcaagacacttggggcacgtcagctgcagcctattttgttggctatttaaagc

SEQ ID NO: 318314 - DNA, 75 bp, Artificial Sequence
  Synthetic
aaacctactttactcaaagcagagacttagaggatttcaagcccagatcacaaatggaaactgatttcctcgagc

SEQ ID NO: 318315 - DNA, 75 bp, Artificial Sequence
  Synthetic
aggattttatccctatggatagcacagtgaaaaattacttcataacagatgctcaaacaggttcatcaaaatgtg

SEQ ID NO: 318316 - DNA, 75 bp, Artificial Sequence
  Synthetic
gctcaaacaggttcatcaaaatgtgtctgctctgttattgatcttttacttgatgactttgttgaaataataaag

SEQ ID NO: 318317 - DNA, 75 bp, Artificial Sequence
  Synthetic
tctgctctgttattgatcttttacttgatgactttgttgaaataataaagtcacaagacctttcagtagtttcaa

SEQ ID NO: 318318 - DNA, 75 bp, Artificial Sequence
  Synthetic
aagtggtcaaagttacaattgactatgctgaaatatcatttatgctttggtgtaaggatggacatgttgaaacct

SEQ ID NO: 318319 - DNA, 75 bp, Artificial Sequence
  Synthetic
tgctgaaatatcatttatgctttggtgtaaggatggacatgttgaaaccttctacccaaaattacaggcaagtca

SEQ ID NO: 318320 - DNA, 75 bp, Artificial Sequence
  Synthetic
cctaacttgtataagatgcaaagaatgcttcttgaaaaatgtgaccttcagaattatggtgaaaatgctgtcata

SEQ ID NO: 318321 - DNA, 75 bp, Artificial Sequence
  Synthetic
ccttataacatgagagtgatacactttggtgcaggctctgataaaggagtagcacccggtacagctgttctcagg

SEQ ID NO: 318322 - DNA, 75 bp, Artificial Sequence
  Synthetic
ttggtgcaggctctgataaaggagtagcacccggtacagctgttctcaggcagtggttgccaactggcacactac

SEQ ID NO: 318323 - DNA, 75 bp, Artificial Sequence
  Synthetic
cgtctctgacgctgattctacattgattggagactgtgccactgtacatacagctaataaatgggatctcatcat

SEQ ID NO: 318324 - DNA, 75 bp, Artificial Sequence
  Synthetic
attggagactgtgccactgtacatacagctaataaatgggatctcatcattagcgatatgtatgaccctaagacc

SEQ ID NO: 318325 - DNA, 75 bp, Artificial Sequence
  Synthetic
catcttttggaggaacacaaaccctattcaattgtcttcctattcattatttgacatgagcaaatttcctcttaa

SEQ ID NO: 318326 - DNA, 75 bp, Artificial Sequence
  Synthetic
ttaaaagagaatcaaatcaatgacatgatttactctctgctcgaaaagggtaggcttatcattagagaaaacaat

SEQ ID NO: 318327 - DNA, 75 bp, Artificial Sequence
  Synthetic
tgatttactctctgctcgaaaagggtaggcttatcattagagaaaacaatagagttgtagtctcaagtgatattc

SEQ ID NO: 318328 - DNA, 75 bp, Artificial Sequence
  Synthetic
aattttaatttttgctttcttagctaatttagctaaagcacaggaaggatgcggtatcatcagtagaaaaccgca

SEQ ID NO: 318329 - DNA, 75 bp, Artificial Sequence
  Synthetic
aatttagctaaagcacaggaaggatgcggtatcatcagtagaaaaccgcaacctaaaatggcacaagtctcatct

SEQ ID NO: 318330 - DNA, 75 bp, Artificial Sequence
  Synthetic
atgacattttccgttctgatgtgttacacctcacacaggattacttcctgccatttgactcaaatttaactcagt

SEQ ID NO: 318331 - DNA, 75 bp, Artificial Sequence
  Synthetic
acacctcacacaggattacttcctgccatttgactcaaatttaactcagtacttttcgcttaatgtggattcaga

SEQ ID NO: 318332 - DNA, 75 bp, Artificial Sequence
  Synthetic
atactagactttggtgatggcgtttatttcgctgccactgaaaagtctaacgtaataagaggctggatttttggt

SEQ ID NO: 318333 - DNA, 75 bp, Artificial Sequence
  Synthetic
atttcgctgccactgaaaagtctaacgtaataagaggctggatttttggttcatcttttgataacaccacccagt

SEQ ID NO: 318334 - DNA, 75 bp, Artificial Sequence
  Synthetic
acacattattatacgtgtgtgtaattttaacttatgtaaagaacccatgtatactgttagtagaggtacacagca

SEQ ID NO: 318335 - DNA, 75 bp, Artificial Sequence
  Synthetic
tttaacttatgtaaagaacccatgtatactgttagtagaggtacacagcaaaatgcctgggtttatcagagtgca

SEQ ID NO: 318336 - DNA, 75 bp, Artificial Sequence
  Synthetic
aaaagagttttcaacttgacactactcctaaaactggaaattttaaagacctacgtgagtatgtctttaaaaata

SEQ ID NO: 318337 - DNA, 75 bp, Artificial Sequence
  Synthetic
gggatggctttctgtctgtctaccaaacttatactgctgttaatttacccagaggactacccacgggtttctcag

SEQ ID NO: 318338 - DNA, 75 bp, Artificial Sequence
  Synthetic
ctttggaattaatatcacttcttatagagtagttatggcaatgtttagccaaactacttctaattttttaccaga

SEQ ID NO: 318339 - DNA, 75 bp, Artificial Sequence
  Synthetic
gatttaatgaaaatgggacgatcacggatgctgtagattgttcccaaaatcctcttgctgaattaaaatgcacca

SEQ ID NO: 318340 - DNA, 75 bp, Artificial Sequence
  Synthetic
ggatgctgtagattgttcccaaaatcctcttgctgaattaaaatgcaccattaaaaatttcaatgttgacaaagg

SEQ ID NO: 318341 - DNA, 75 bp, Artificial Sequence
  Synthetic
gtttcacccactcaagaggttattagatttcctaacattacaaatcgctgtccttttgacaaggtttttaatgct

SEQ ID NO: 318342 - DNA, 75 bp, Artificial Sequence
  Synthetic
aactcaacctctttctcgacttttaaatgttatggagtgtctccatctaagttgattgacctatgctttacaagt

SEQ ID NO: 318343 - DNA, 75 bp, Artificial Sequence
  Synthetic
gtgtatgctgatacattcttgataagatcttctgaagtaagacaagttgcaccaggtgaaactggtgttattgct

SEQ ID NO: 318344 - DNA, 75 bp, Artificial Sequence
  Synthetic
gatcttctgaagtaagacaagttgcaccaggtgaaactggtgttattgctgactacaattacaagttgcctgatg

SEQ ID NO: 318345 - DNA, 75 bp, Artificial Sequence
  Synthetic
gaatactgctaaacatgatactggcaattattactacagatctcatcgcaagactaagttaaagccttttgagag

SEQ ID NO: 318346 - DNA, 75 bp, Artificial Sequence
  Synthetic
aattattactacagatctcatcgcaagactaagttaaagccttttgagagagacctgtcttctgacgatggtaat

SEQ ID NO: 318347 - DNA, 75 bp, Artificial Sequence
  Synthetic
actttaaccctaacgttccagtagcatatcaggctactagggttgttgtactctcttttgaacttcttaatgcac

SEQ ID NO: 318348 - DNA, 75 bp, Artificial Sequence
  Synthetic
ctctcttttgaacttcttaatgcacctgctacagtttgtggacctaaattatccacagaactagttaagaaccag

SEQ ID NO: 318349 - DNA, 75 bp, Artificial Sequence
  Synthetic
ttaaaggtactggtgttttgacttcttcttcaaaaagattccagtcatttcaacaatttggtcgtgacacatctg

SEQ ID NO: 318350 - DNA, 75 bp, Artificial Sequence
  Synthetic
ttcttcaaaaagattccagtcatttcaacaatttggtcgtgacacatctgactttacggattcagtacgtgaccc

SEQ ID NO: 318351 - DNA, 75 bp, Artificial Sequence
  Synthetic
tcaccttgttcctttggtggtgttagtgttatcacacctggaacgaacgcctcatcagaggtagctgttctctat

SEQ ID NO: 318352 - DNA, 75 bp, Artificial Sequence
  Synthetic
gtgttatcacacctggaacgaacgcctcatcagaggtagctgttctctatcaagatgtaaattgcactgatgtcc

SEQ ID NO: 318353 - DNA, 75 bp, Artificial Sequence
  Synthetic
aacacctgcttggcgcgtttattccactggagtaaatgtgtttcaaacacaagctggctgtcttataggagctga

SEQ ID NO: 318354 - DNA, 75 bp, Artificial Sequence
  Synthetic
gtgctagttaccatacagcttctgttctacgtagtaccggccagaaatcaattgttgcctatactatgtcactgg

SEQ ID NO: 318355 - DNA, 75 bp, Artificial Sequence
  Synthetic
taataattcaattgccatacctacaaatttttcaatcagtgtcactacagaagtgatgcctgtttcaatggctaa

SEQ ID NO: 318356 - DNA, 75 bp, Artificial Sequence
  Synthetic
aacagccgtggattgtactatgtacatctgcggtgattctttagagtgcagcaacttactattgcagtatggaag

SEQ ID NO: 318357 - DNA, 75 bp, Artificial Sequence
  Synthetic
ccaggttaaacaaatgtacaagacacctgccataaaggactttggcggtttcaatttttcacaaatattgcctga

SEQ ID NO: 318358 - DNA, 75 bp, Artificial Sequence
  Synthetic
cccttcaaagccaacgaagagatcatttattgaagacttgctcttcaataaagtgactctcgctgatgctggctt

SEQ ID NO: 318359 - DNA, 75 bp, Artificial Sequence
  Synthetic
aaatcatgagggtaagactttctttgtactacctagtgatgacacactacgtagtgaagctttcgagtactacca

SEQ ID NO: 318360 - DNA, 75 bp, Artificial Sequence
  Synthetic
tatgaaacaatatggtgactgcctaggtgatgttagtgctagagaccttatctgtgcccagaagttcaatggact

SEQ ID NO: 318361 - DNA, 75 bp, Artificial Sequence
  Synthetic
gatgagatggttgctgcatacacagctgcgctagttagtggtactgctacggcgggctggacgtttggtgcaggt

SEQ ID NO: 318362 - DNA, 75 bp, Artificial Sequence
  Synthetic
gcagctcttcaaataccatttgctatgcaaatggcttataggtttaatggcattggagttactcaaaatgttctc

SEQ ID NO: 318363 - DNA, 75 bp, Artificial Sequence
  Synthetic
cattggagttactcaaaatgttctctatgagaaccaaaagctgatagccaatcagtttaatagtgctataggcaa

SEQ ID NO: 318364 - DNA, 75 bp, Artificial Sequence
  Synthetic
aattcaagaatcattatcatctactgcaagtgcactaggaaaactgcaggatgtggttaaccaaaatgcacaagc

SEQ ID NO: 318365 - DNA, 75 bp, Artificial Sequence
  Synthetic
gcaagtgcactaggaaaactgcaggatgtggttaaccaaaatgcacaagctcttaacacgcttgttaaacaactc

SEQ ID NO: 318366 - DNA, 75 bp, Artificial Sequence
  Synthetic
gtgtgttaaatgatattctctctcgccttgataaagttgaggcagaagttcaaattgacaggttgattacaggca

SEQ ID NO: 318367 - DNA, 75 bp, Artificial Sequence
  Synthetic
aacacaacaacttatcagagctgctgaaatcagagcttctgctaatcttgctgctactaaaatgtctgagtgcgt

SEQ ID NO: 318368 - DNA, 75 bp, Artificial Sequence
  Synthetic
ctgctactaaaatgtctgagtgcgttcttggacaatcaaaaagagttgatttctgtggaaaaggctaccacctta

SEQ ID NO: 318369 - DNA, 75 bp, Artificial Sequence
  Synthetic
gtagaccctgctaaagcatataaggattacctagcaagtggaggacaaccaatcaccaaactgtgtgaagatgta

SEQ ID NO: 318370 - DNA, 75 bp, Artificial Sequence
  Synthetic
gtagaccctgctaaagcatataaggattacctagcaagtggaggacaaccaatcaccaaactgtgtgaagatgtt

SEQ ID NO: 318371 - DNA, 75 bp, Artificial Sequence
  Synthetic
gtagaccctgctaaagcatataaggattacctagcaagtggaggacaaccaatcaccaaactgtgtgaagatgtc

SEQ ID NO: 318372 - DNA, 75 bp, Artificial Sequence
  Synthetic
gtagaccctgctaaagcatataaggattacctagcaagtggaggacaaccaatcaccaaactgtgtgaagatgtg

SEQ ID NO: 318373 - DNA, 75 bp, Artificial Sequence
  Synthetic
gtagaccctgctaaagcatataaggattacctagcaagtggaggacaaccaatcaccaaactgtgtgatgatgta

SEQ ID NO: 318374 - DNA, 75 bp, Artificial Sequence
  Synthetic
gtagaccctgctaaagcatataaggattacctagcaagtggaggacaaccaatcaccaaactgtgtgatgatgtt

SEQ ID NO: 318375 - DNA, 75 bp, Artificial Sequence
  Synthetic
gtagaccctgctaaagcatataaggattacctagcaagtggaggacaaccaatcaccaaactgtgtgatgatgtc

SEQ ID NO: 318376 - DNA, 75 bp, Artificial Sequence
  Synthetic
gtagaccctgctaaagcatataaggattacctagcaagtggaggacaaccaatcaccaaactgtgtgatgatgtg

SEQ ID NO: 318377 - DNA, 75 bp, Artificial Sequence
  Synthetic
gtagaccctgctaaagcatataaggattacctagcaagtggaggacaaccaatcaccaaactgtgtgacgatgta

SEQ ID NO: 318378 - DNA, 75 bp, Artificial Sequence
  Synthetic
gtagaccctgctaaagcatataaggattacctagcaagtggaggacaaccaatcaccaaactgtgtgacgatgtt

SEQ ID NO: 318379 - DNA, 75 bp, Artificial Sequence
  Synthetic
gtagaccctgctaaagcatataaggattacctagcaagtggaggacaaccaatcaccaaactgtgtgacgatgtc

SEQ ID NO: 318380 - DNA, 75 bp, Artificial Sequence
  Synthetic
gtagaccctgctaaagcatataaggattacctagcaagtggaggacaaccaatcaccaaactgtgtgacgatgtg

SEQ ID NO: 318381 - DNA, 75 bp, Artificial Sequence
  Synthetic
gtagaccctgctaaagcatataaggattacctagcaagtggaggacaaccaatcaccaaactgtgtgaggatgta

SEQ ID NO: 318382 - DNA, 75 bp, Artificial Sequence
  Synthetic
gtagaccctgctaaagcatataaggattacctagcaagtggaggacaaccaatcaccaaactgtgtgaggatgtt

SEQ ID NO: 318383 - DNA, 75 bp, Artificial Sequence
  Synthetic
gtagaccctgctaaagcatataaggattacctagcaagtggaggacaaccaatcaccaaactgtgtgaggatgtc

SEQ ID NO: 318384 - DNA, 75 bp, Artificial Sequence
  Synthetic
gtagaccctgctaaagcatataaggattacctagcaagtggaggacaaccaatcaccaaactgtgtgaggatgtg

SEQ ID NO: 318385 - DNA, 75 bp, Artificial Sequence
  Synthetic
tatgttccatcacaagagaaaaacttcacaacagctccagctatttgtcacgaaggcaaagcttatttccctcgt

SEQ ID NO: 318386 - DNA, 75 bp, Artificial Sequence
  Synthetic
cttcttggtttattacgcagaggaatttttactctccacaattaattacaacagataatacttttgtttctggta

SEQ ID NO: 318387 - DNA, 75 bp, Artificial Sequence
  Synthetic
tttttactctccacaattaattacaacagataatacttttgtttctggtaattgtgatgtcgtgatcggcatcat

SEQ ID NO: 318388 - DNA, 75 bp, Artificial Sequence
  Synthetic
tacaagcagaaaatgtaactggacttttttaaggactgtagtaagatcattactggtcttcatcctacacaggca

SEQ ID NO: 318389 - DNA, 75 bp, Artificial Sequence
  Synthetic
tgaccgcctcaatgaggttgccaaaaacctaaatgaatcactcattgacctccaagaacttgggaaatatgagca

SEQ ID NO: 318390 - DNA, 75 bp, Artificial Sequence
  Synthetic
tggctcggctttattgctggactaattgccatcgtcatggttacaatcttgctttgttgcatgaccagctgttgc

SEQ ID NO: 318391 - DNA, 75 bp, Artificial Sequence
  Synthetic
gtaacacttgcttgctttgtgcttgctgctgtctacagaattaattgggtgactggcgggattgcgattgcaatg

SEQ ID NO: 318392 - DNA, 75 bp, Artificial Sequence
  Synthetic
ttggcgttgcacttcttgctgtttttcaaagcgcttctaaagtaattgcgcttcatagaaggtggcagctcgcct

SEQ ID NO: 318393 - DNA, 75 bp, Artificial Sequence
  Synthetic
ctattgtggcttatactatgtctttaggtgctgatagttcaaattgcttactctaataacaccattgctatacct

SEQ ID NO: 318394 - DNA, 75 bp, Artificial Sequence
  Synthetic
tcaaagcgcttctaaagtaattgcgcttcatagaaggtggcagctcgccttatataaaggcgttcaacttgtatg

SEQ ID NO: 318395 - DNA, 75 bp, Artificial Sequence
  Synthetic
ctgtataccatacaacagtgtcacagatacagttgtcatcacctcaagtgatggaacaaatcagccaaaactaaa

SEQ ID NO: 318396 - DNA, 75 bp, Artificial Sequence
  Synthetic
agaagactatcaaattggtggttattctgaggattggcattcaggtgttaaagactatgtagtaatatatggcta

SEQ ID NO: 318397 - DNA, 75 bp, Artificial Sequence
  Synthetic
gaatcgactcaattgtcgactgatactggtgctgaaaatgctacattcttcatctatagcaagcttgttaaagat

SEQ ID NO: 318398 - DNA, 75 bp, Artificial Sequence
  Synthetic
tgttttaataatgcttattatattttggttttcactcgaaatccaggatctagaagaaccttgtaccaaagtcta

SEQ ID NO: 318399 - DNA, 75 bp, Artificial Sequence
  Synthetic
gcgattgcaatggcttgtatagtaggcttgatgtggcttagctacttcgttgcttctttcaggctgtttgctcgc

SEQ ID NO: 318400 - DNA, 75 bp, Artificial Sequence
  Synthetic
atgtttggctcggcttcattgctggactaattgccatcgtcatggttacaaatcttgctttgttgatgctagttg

SEQ ID NO: 318401 - DNA, 75 bp, Artificial Sequence
  Synthetic
actaattgccatcgtcatggttacaaatcttgctttgttgatgctagttgttgcagttgcctcaaggggctgctc

SEQ ID NO: 318402 - DNA, 75 bp, Artificial Sequence
  Synthetic
actaattgccatcgtcatggttacaaatcttgctttgttgatgctagttgttgcagttgcctcatggggctgctc

SEQ ID NO: 318403 - DNA, 75 bp, Artificial Sequence
  Synthetic
actaattgccatcgtcatggttacaaatcttgctttgttgatgctagttgttgcagttgcctcacggggctgctc

SEQ ID NO: 318404 - DNA, 75 bp, Artificial Sequence
  Synthetic
actaattgccatcgtcatggttacaaatcttgctttgttgatgctagttgttgcagttgcctcagggggctgctc

SEQ ID NO: 318405 - DNA, 75 bp, Artificial Sequence
  Synthetic
gtaagtgacaacagatgtttcatctagttgacttccaggttacaatagcagagatattgattatcattatgaaaa

SEQ ID NO: 318406 - DNA, 75 bp, Artificial Sequence
  Synthetic
tctgatccagttatcaagggtgtcaaattcccttacacataaacgaaattatggatttgtttatggggttttttt

SEQ ID NO: 318407 - DNA, 75 bp, Artificial Sequence
  Synthetic
tctgatccagttatcaagggtgtcaaattcccttacacataaacgaaattatggttttgtttatggggttttttt

SEQ ID NO: 318408 - DNA, 75 bp, Artificial Sequence
  Synthetic
tctgatccagttatcaagggtgtcaaattcccttacacataaacgaaattatggctttgtttatggggttttttt

SEQ ID NO: 318409 - DNA, 75 bp, Artificial Sequence
  Synthetic
tctgatccagttatcaagggtgtcaaattcccttacacataaacgaaattatgggtttgtttatggggttttttt

SEQ ID NO: 318410 - DNA, 75 bp, Artificial Sequence
  Synthetic
tctgatccagttatcaagggtgtcaaattcccttacacataaacgaatttatggatttgtttatggggttttttt

SEQ ID NO: 318411 - DNA, 75 bp, Artificial Sequence
  Synthetic
tctgatccagttatcaagggtgtcaaattcccttacacataaacgaatttatggttttgtttatggggttttttt

SEQ ID NO: 318412 - DNA, 75 bp, Artificial Sequence
  Synthetic
tctgatccagttatcaagggtgtcaaattcccttacacataaacgaatttatggctttgtttatggggttttttt

SEQ ID NO: 318413 - DNA, 75 bp, Artificial Sequence
  Synthetic
tctgatccagttatcaagggtgtcaaattcccttacacataaacgaatttatgggtttgtttatggggttttttt

SEQ ID NO: 318414 - DNA, 75 bp, Artificial Sequence
  Synthetic
tctgatccagttatcaagggtgtcaaattcccttacacataaacgaacttatggatttgtttatggggttttttt

SEQ ID NO: 318415 - DNA, 75 bp, Artificial Sequence
  Synthetic
tctgatccagttatcaagggtgtcaaattcccttacacataaacgaacttatggttttgtttatggggttttttt

SEQ ID NO: 318416 - DNA, 75 bp, Artificial Sequence
  Synthetic
tctgatccagttatcaagggtgtcaaattcccttacacataaacgaacttatggctttgtttatggggttttttt

SEQ ID NO: 318417 - DNA, 75 bp, Artificial Sequence
  Synthetic
tctgatccagttatcaagggtgtcaaattcccttacacataaacgaacttatgggtttgtttatggggttttttt

SEQ ID NO: 318418 - DNA, 75 bp, Artificial Sequence
  Synthetic
tctgatccagttatcaagggtgtcaaattcccttacacataaacgaagttatggatttgtttatggggttttttt

SEQ ID NO: 318419 - DNA, 75 bp, Artificial Sequence
  Synthetic
tctgatccagttatcaagggtgtcaaattcccttacacataaacgaagttatggttttgtttatggggttttttt

SEQ ID NO: 318420 - DNA, 75 bp, Artificial Sequence
  Synthetic
tctgatccagttatcaagggtgtcaaattcccttacacataaacgaagttatggctttgtttatggggttttttt

SEQ ID NO: 318421 - DNA, 75 bp, Artificial Sequence
  Synthetic
tctgatccagttatcaagggtgtcaaattcccttacacataaacgaagttatgggtttgtttatggggttttttt

SEQ ID NO: 318422 - DNA, 75 bp, Artificial Sequence
  Synthetic
tctgatcctgttatcaagggtgtcaaattcccttacacataaacgaaattatggatttgtttatggggttttttt

SEQ ID NO: 318423 - DNA, 75 bp, Artificial Sequence
  Synthetic
tctgatcctgttatcaagggtgtcaaattcccttacacataaacgaaattatggttttgtttatggggttttttt

SEQ ID NO: 318424 - DNA, 75 bp, Artificial Sequence
  Synthetic
tctgatcctgttatcaagggtgtcaaattcccttacacataaacgaaattatggctttgtttatggggttttttt

SEQ ID NO: 318425 - DNA, 75 bp, Artificial Sequence
  Synthetic
tctgatcctgttatcaagggtgtcaaattcccttacacataaacgaaattatgggtttgtttatggggttttttt

SEQ ID NO: 318426 - DNA, 75 bp, Artificial Sequence
  Synthetic
tctgatcctgttatcaagggtgtcaaattcccttacacataaacgaatttatggatttgtttatggggttttttt

SEQ ID NO: 318427 - DNA, 75 bp, Artificial Sequence
  Synthetic
tctgatcctgttatcaagggtgtcaaattcccttacacataaacgaatttatggttttgtttatggggttttttt

SEQ ID NO: 318428 - DNA, 75 bp, Artificial Sequence
  Synthetic
tctgatcctgttatcaagggtgtcaaattcccttacacataaacgaatttatggctttgtttatggggttttttt

SEQ ID NO: 318429 - DNA, 75 bp, Artificial Sequence
  Synthetic
tctgatcctgttatcaagggtgtcaaattcccttacacataaacgaatttatgggtttgtttatggggttttttt

SEQ ID NO: 318430 - DNA, 75 bp, Artificial Sequence
  Synthetic
tctgatcctgttatcaagggtgtcaaattcccttacacataaacgaacttatggatttgtttatggggttttttt

SEQ ID NO: 318431 - DNA, 75 bp, Artificial Sequence
  Synthetic
tctgatcctgttatcaagggtgtcaaattcccttacacataaacgaacttatggttttgtttatggggttttttt

SEQ ID NO: 318432 - DNA, 75 bp, Artificial Sequence
  Synthetic
tctgatcctgttatcaagggtgtcaaattcccttacacataaacgaacttatggctttgtttatggggttttttt

SEQ ID NO: 318433 - DNA, 75 bp, Artificial Sequence
  Synthetic
tctgatcctgttatcaagggtgtcaaattcccttacacataaacgaacttatgggtttgtttatggggttttttt

SEQ ID NO: 318434 - DNA, 75 bp, Artificial Sequence
  Synthetic
tctgatcctgttatcaagggtgtcaaattcccttacacataaacgaagttatggatttgtttatggggttttttt

SEQ ID NO: 318435 - DNA, 75 bp, Artificial Sequence
  Synthetic
tctgatcctgttatcaagggtgtcaaattcccttacacataaacgaagttatggttttgtttatggggttttttt

SEQ ID NO: 318436 - DNA, 75 bp, Artificial Sequence
  Synthetic
tctgatcctgttatcaagggtgtcaaattcccttacacataaacgaagttatggctttgtttatggggttttttt

SEQ ID NO: 318437 - DNA, 75 bp, Artificial Sequence
  Synthetic
tctgatcctgttatcaagggtgtcaaattcccttacacataaacgaagttatgggtttgtttatggggttttttt

SEQ ID NO: 318438 - DNA, 75 bp, Artificial Sequence
  Synthetic
tctgatcccgttatcaagggtgtcaaattcccttacacataaacgaaattatggatttgtttatggggttttttt

SEQ ID NO: 318439 - DNA, 75 bp, Artificial Sequence
  Synthetic
tctgatcccgttatcaagggtgtcaaattcccttacacataaacgaaattatggttttgtttatggggttttttt

SEQ ID NO: 318440 - DNA, 75 bp, Artificial Sequence
  Synthetic
tctgatcccgttatcaagggtgtcaaattcccttacacataaacgaaattatggctttgtttatggggttttttt

SEQ ID NO: 318441 - DNA, 75 bp, Artificial Sequence
  Synthetic
tctgatcccgttatcaagggtgtcaaattcccttacacataaacgaaattatgggtttgtttatggggttttttt

SEQ ID NO: 318442 - DNA, 75 bp, Artificial Sequence
  Synthetic
tctgatcccgttatcaagggtgtcaaattcccttacacataaacgaatttatggatttgtttatggggttttttt

SEQ ID NO: 318443 - DNA, 75 bp, Artificial Sequence
  Synthetic
tctgatcccgttatcaagggtgtcaaattcccttacacataaacgaatttatggttttgtttatggggttttttt

SEQ ID NO: 318444 - DNA, 75 bp, Artificial Sequence
  Synthetic
tctgatcccgttatcaagggtgtcaaattcccttacacataaacgaatttatggctttgtttatggggttttttt

SEQ ID NO: 318445 - DNA, 75 bp, Artificial Sequence
  Synthetic
tctgatcccgttatcaagggtgtcaaattcccttacacataaacgaatttatgggtttgtttatggggttttttt

SEQ ID NO: 318446 - DNA, 75 bp, Artificial Sequence
  Synthetic
tctgatcccgttatcaagggtgtcaaattcccttacacataaacgaacttatggatttgtttatggggttttttt

SEQ ID NO: 318447 - DNA, 75 bp, Artificial Sequence
  Synthetic
tctgatcccgttatcaagggtgtcaaattcccttacacataaacgaacttatggttttgtttatggggttttttt

SEQ ID NO: 318448 - DNA, 75 bp, Artificial Sequence
  Synthetic
tctgatcccgttatcaagggtgtcaaattcccttacacataaacgaacttatggctttgtttatggggttttttt

SEQ ID NO: 318449 - DNA, 75 bp, Artificial Sequence
  Synthetic
tctgatcccgttatcaagggtgtcaaattcccttacacataaacgaacttatgggtttgtttatggggttttttt

SEQ ID NO: 318450 - DNA, 75 bp, Artificial Sequence
  Synthetic
tctgatcccgttatcaagggtgtcaaattcccttacacataaacgaagttatggatttgtttatggggttttttt

SEQ ID NO: 318451 - DNA, 75 bp, Artificial Sequence
  Synthetic
tctgatcccgttatcaagggtgtcaaattcccttacacataaacgaagttatggttttgtttatggggttttttt

SEQ ID NO: 318452 - DNA, 75 bp, Artificial Sequence
  Synthetic
tctgatcccgttatcaagggtgtcaaattcccttacacataaacgaagttatggctttgtttatggggttttttt

SEQ ID NO: 318453 - DNA, 75 bp, Artificial Sequence
  Synthetic
tctgatcccgttatcaagggtgtcaaattcccttacacataaacgaagttatgggtttgtttatggggttttttt

SEQ ID NO: 318454 - DNA, 75 bp, Artificial Sequence
  Synthetic
tctgatccggttatcaagggtgtcaaattcccttacacataaacgaaattatggatttgtttatggggttttttt

SEQ ID NO: 318455 - DNA, 75 bp, Artificial Sequence
  Synthetic
tctgatccggttatcaagggtgtcaaattcccttacacataaacgaaattatggttttgtttatggggttttttt

SEQ ID NO: 318456 - DNA, 75 bp, Artificial Sequence
  Synthetic
tctgatccggttatcaagggtgtcaaattcccttacacataaacgaaattatggctttgtttatggggttttttt

SEQ ID NO: 318457 - DNA, 75 bp, Artificial Sequence
  Synthetic
tctgatccggttatcaagggtgtcaaattcccttacacataaacgaaattatgggtttgtttatggggttttttt

SEQ ID NO: 318458 - DNA, 75 bp, Artificial Sequence
  Synthetic
tctgatccggttatcaagggtgtcaaattcccttacacataaacgaatttatggatttgtttatggggttttttt

SEQ ID NO: 318459 - DNA, 75 bp, Artificial Sequence
  Synthetic
tctgatccggttatcaagggtgtcaaattcccttacacataaacgaatttatggttttgtttatggggttttttt

SEQ ID NO: 318460 - DNA, 75 bp, Artificial Sequence
  Synthetic
tctgatccggttatcaagggtgtcaaattcccttacacataaacgaatttatggctttgtttatggggttttttt

SEQ ID NO: 318461 - DNA, 75 bp, Artificial Sequence
  Synthetic
tctgatccggttatcaagggtgtcaaattcccttacacataaacgaatttatgggtttgtttatggggttttttt

SEQ ID NO: 318462 - DNA, 75 bp, Artificial Sequence
  Synthetic
tctgatccggttatcaagggtgtcaaattcccttacacataaacgaacttatggatttgtttatggggttttttt

SEQ ID NO: 318463 - DNA, 75 bp, Artificial Sequence
  Synthetic
tctgatccggttatcaagggtgtcaaattcccttacacataaacgaacttatggttttgtttatggggttttttt

SEQ ID NO: 318464 - DNA, 75 bp, Artificial Sequence
  Synthetic
tctgatccggttatcaagggtgtcaaattcccttacacataaacgaacttatggctttgtttatggggttttttt

SEQ ID NO: 318465 - DNA, 75 bp, Artificial Sequence
  Synthetic
tctgatccggttatcaagggtgtcaaattcccttacacataaacgaacttatgggtttgtttatggggttttttt

SEQ ID NO: 318466 - DNA, 75 bp, Artificial Sequence
  Synthetic
tctgatccggttatcaagggtgtcaaattcccttacacataaacgaagttatggatttgtttatggggttttttt

SEQ ID NO: 318467 - DNA, 75 bp, Artificial Sequence
  Synthetic
tctgatccggttatcaagggtgtcaaattcccttacacataaacgaagttatggttttgtttatggggttttttt

SEQ ID NO: 318468 - DNA, 75 bp, Artificial Sequence
  Synthetic
tctgatccggttatcaagggtgtcaaattcccttacacataaacgaagttatggctttgtttatggggttttttt

SEQ ID NO: 318469 - DNA, 75 bp, Artificial Sequence
  Synthetic
tctgatccggttatcaagggtgtcaaattcccttacacataaacgaagttatgggtttgtttatggggttttttt

SEQ ID NO: 318470 - DNA, 75 bp, Artificial Sequence
  Synthetic
tctgttctctaaacgaactttaaaatctgtgtagctgtcgctcggctgcatgcctagtgcacctacgcagtataa

SEQ ID NO: 318471 - DNA, 75 bp, Artificial Sequence
  Synthetic
gcaagtactgttcatgctacagcaacgataccgctacaagcctcactccctttcggatggcttgttattggcgtt

SEQ ID NO: 318472 - DNA, 75 bp, Artificial Sequence
  Synthetic
gctctactcaccacttttcctcattgttgctgcattagtatttataatactttgcttcaccattaagagaaagac

SEQ ID NO: 318473 - DNA, 75 bp, Artificial Sequence
  Synthetic
atgcagcatacaagagtgttgtgaaaatcaaccctaccaaattgaagacccatgtccaatacattactattcgga

SEQ ID NO: 318474 - DNA, 75 bp, Artificial Sequence
  Synthetic
aatcaaccctaccaaattgaagacccatgtccaatacattactattcggactggtttataaaaattggatctaga

SEQ ID NO: 318475 - DNA, 75 bp, Artificial Sequence
  Synthetic
gcgaaggtgattacggacgaagaattccaattcattatgagatgtttggcaattacactatctcctgtgaaccac

SEQ ID NO: 318476 - DNA, 75 bp, Artificial Sequence
  Synthetic
tccaattcattatgagatgtttggcaattacactatctcctgtgaaccactagagataaattgtcaggctccacc

SEQ ID NO: 318477 - DNA, 75 bp, Artificial Sequence
  Synthetic
tcatacgattatgactttgttgagcatcatgacgttcgtgttgttctagatttcatctaaacgaacaaactaaaa

SEQ ID NO: 318478 - DNA, 75 bp, Artificial Sequence
  Synthetic
tctcattgttttgacttgtatttctctatgcagttgcatacgcactgtagtacagcgctgtgcatctaataaacc

SEQ ID NO: 318479 - DNA, 75 bp, Artificial Sequence
  Synthetic
atgcaaaattgtctgcttaggcttaaagttgatacttctaaccctaagacacccaagtataaatttgtccgtatc

SEQ ID NO: 318480 - DNA, 75 bp, Artificial Sequence
  Synthetic
ttatttctgtaacctctaactattctggtgtcgttacgactatcatgtttttagctagagctatagtgtttgtgt

SEQ ID NO: 318481 - DNA, 75 bp, Artificial Sequence
  Synthetic
aagtgcctctgcattcttcggaatgtcacgcattggcatggaagtcacaccttcgggaacatggctgacttatca

SEQ ID NO: 318482 - DNA, 75 bp, Artificial Sequence
  Synthetic
aacctttgacacaagatcatgttgacatattgggacctctttctgctcaaacaggaattgccgtcttagatatgt

SEQ ID NO: 318483 - DNA, 75 bp, Artificial Sequence
  Synthetic
taaaacacttcttctttgctcaggatggcaacgctgctatcagtgattatgactattatcgttataatctgccaa

SEQ ID NO: 318484 - DNA, 75 bp, Artificial Sequence
  Synthetic
gttcaaagtacacagtggtcactgtttttctttgtttacgagaatgctttcttgccatttactcttggtattatg

SEQ ID NO: 318485 - DNA, 75 bp, Artificial Sequence
  Synthetic
gaccgaaaggtaagatggagagccttgttcttggtgtcaacgagaaaacacacgtccaactcagtttgcctgttc

SEQ ID NO: 318486 - DNA, 75 bp, Artificial Sequence
  Synthetic
agagctggaaaaaggcgtactgccccagcttgaacagccctatgtgttcattaaacgttctgatgccttaagcac

SEQ ID NO: 318487 - DNA, 75 bp, Artificial Sequence
  Synthetic
tgcactctttctgaacaacttgattacatcgagtcgaagagaggtgtctactgctgccgtgaccatgagcatgaa

SEQ ID NO: 318488 - DNA, 75 bp, Artificial Sequence
  Synthetic
aatggtgattctgaagtcgttctcaaaaagttaaagaaatctttgaatgtggctaaatctgagtttgaccgtgat

SEQ ID NO: 318489 - DNA, 75 bp, Artificial Sequence
  Synthetic
tgctgaacaagcacattgacgcatacaaaacattcccaccaacagagcctaaaaaggacaaaaagaaaaagactg

SEQ ID NO: 318490 - DNA, 75 bp, Artificial Sequence
  Synthetic
gttgaaaagaaaaagactgaaggtttcatggggcgcatacgctctgtgtaccctgttgcatctccacaggagtgt

SEQ ID NO: 318491 - DNA, 75 bp, Artificial Sequence
  Synthetic
agagctggaaaagggcgtattgccccagcctgaacagccctatgtgttcattaaacgatctgacgctcaaggcac

SEQ ID NO: 318492 - DNA, 75 bp, Artificial Sequence
  Synthetic
cagcctgaacagccctatgtgttcattaaacgatctgacgctcaaggcactgatcatggccatagggtccgtgag

SEQ ID NO: 318493 - DNA, 75 bp, Artificial Sequence
  Synthetic
ttaaaatctgtgtggctgtcgctcggctgcatgcctagtgcacttacgcagtataaatattaataactttactgt

SEQ ID NO: 318494 - DNA, 75 bp, Artificial Sequence
  Synthetic
aggtgcactcactcgctatgtcgacaacaacttttgtggcccagatgggtaccctcttgaatgcattaaagacct

SEQ ID NO: 318495 - DNA, 75 bp, Artificial Sequence
  Synthetic
tggtttactggctacaaacaatgtctttcgcctaaaagggggtgcaccaactaaaggtgtaacctttggagaaga

SEQ ID NO: 318496 - DNA, 75 bp, Artificial Sequence
  Synthetic
ggccctatcggaggcacgtgaacatcttaaaaatggcacttgtggcttagtagagctggagaaaggcgttttgcc

SEQ ID NO: 318497 - DNA, 75 bp, Artificial Sequence
  Synthetic
atcaaacgttctgacgcccaaagtactaatcatggccacaaggtcgttgaattggttgctgaattgaatggcgtt

SEQ ID NO: 318498 - DNA, 75 bp, Artificial Sequence
  Synthetic
gccattcaggatggtgtcactcgtgacatcgtttctactgatgattgttttgcaaacaaacatgctggttttgac

SEQ ID NO: 318499 - DNA, 75 bp, Artificial Sequence
  Synthetic
attggttgctgaattgaatggcgttcagtacggtcgtagcggtacaacactgggagtcctcgtgccacatgtggg

SEQ ID NO: 318500 - DNA, 75 bp, Artificial Sequence
  Synthetic
tgaaatgtaatcattgtgatgaagtttcatggcagacgtgtgatttcttaaaagccacctgtgaacaatgtggca

SEQ ID NO: 318501 - DNA, 75 bp, Artificial Sequence
  Synthetic
gttcttcttcgtaagaacggtaataagggagctggtggccatagctacggcatcgatctaaagtcttatgactta

SEQ ID NO: 318502 - DNA, 75 bp, Artificial Sequence
  Synthetic
tcagacctgcttaccaacagtgtcatcattatggcatatgtaactggtggtcttgtacaacagacttctcagtgg

SEQ ID NO: 318503 - DNA, 75 bp, Artificial Sequence
  Synthetic
taccctcttgaatgcattaaagacctcctcgctcgcgcgggcaagtcaatgtgcactctttctgaacaacttgat

SEQ ID NO: 318504 - DNA, 75 bp, Artificial Sequence
  Synthetic
agagtggaaggacaggtagacctttttagaaatgcccgtaatggtgttttaataacagaaggttcagttaaaggt

SEQ ID NO: 318505 - DNA, 75 bp, Artificial Sequence
  Synthetic
aagggtaagcccataaaaggtgcttggaacattggacaacacagatcagttctaacaccactgtgtggttttcca

SEQ ID NO: 318506 - DNA, 75 bp, Artificial Sequence
  Synthetic
agcaagggactttaccgtcagtgtatacgtggcaaggaacagctgcaactacttatgcctcttaaggcaccaaaa

SEQ ID NO: 318507 - DNA, 75 bp, Artificial Sequence
  Synthetic
caacgacatgcatttgtctaccttgatgaaatgtaatcattgtgatgaagtttcatggcagacgtgcgactttat

SEQ ID NO: 318508 - DNA, 75 bp, Artificial Sequence
  Synthetic
actgaaaaccctgtctgtgaaggacccactacatgtgggtacctacctactaatgctgtagtaaaaatgccatgc

SEQ ID NO: 318509 - DNA, 75 bp, Artificial Sequence
  Synthetic
agcctctaactaagaataaatattcagagttagatgatgaagaacctatggagatagattatccttgataaacga

SEQ ID NO: 318510 - DNA, 75 bp, Artificial Sequence
  Synthetic
ctcatgctcttagagatcaaggacaaagaacaatactgcgcattgtctcctggtttactggctacaaacaatgtc

SEQ ID NO: 318511 - DNA, 75 bp, Artificial Sequence
  Synthetic
tgtttggtttagcatcagggtgcagcttaccacttacggttagctgccctagaggcctacctttcactctacaga

SEQ ID NO: 318512 - DNA, 75 bp, Artificial Sequence
  Synthetic
aatgttttggaggctgtgtgttttcctatgttggctgctacaacaagcgcgcctactgggttcctcgtgctagtg

SEQ ID NO: 318513 - DNA, 75 bp, Artificial Sequence
  Synthetic
cttaccacttacggttagctgccctagaggcctacctttcactctacagattaacactactagtgttactgtgga

SEQ ID NO: 318514 - DNA, 75 bp, Artificial Sequence
  Synthetic
cattactggtgataatgtggagactctgaatgaggatctcctcgagatactgagccgcgaacgtgttaacattaa

SEQ ID NO: 318515 - DNA, 75 bp, Artificial Sequence
  Synthetic
atgcaaggtcttacaaagataaatactggcagcactatttttgataacaactttagtgtagtcaataataatttg

SEQ ID NO: 318516 - DNA, 75 bp, Artificial Sequence
  Synthetic
tgatgttgttaacaaggcactcgaaatgtgcatagaccaagtcactattgctggtgcaaagttgcgatcactcaa

SEQ ID NO: 318517 - DNA, 75 bp, Artificial Sequence
  Synthetic
ctggcagcactatttttgataacaactttagtgtagtcaataataatttgtacttcaaacagtgttttggaggct

SEQ ID NO: 318518 - DNA, 75 bp, Artificial Sequence
  Synthetic
ctgaatgaggatctcctcgagatactgagccgcgaacgtgttaacattaacatcgttggcgaatttcagttgaat

SEQ ID NO: 318519 - DNA, 75 bp, Artificial Sequence
  Synthetic
ctttctctgcttctacaagtgcctttattgacacagtgaagagccttgactacaagtcttttaaagccattgttg

SEQ ID NO: 318520 - DNA, 75 bp, Artificial Sequence
  Synthetic
cagggtaagcatgacggtgctatagtagataattctcaacctgtctttgtggatgctaggaattatgtaccaact

SEQ ID NO: 318521 - DNA, 75 bp, Artificial Sequence
  Synthetic
tacattctatttgtttgatgatgctggtgaagaaaaactttcttcacgtatgtactgttccttttatcctcctga

SEQ ID NO: 318522 - DNA, 75 bp, Artificial Sequence
  Synthetic
ggtgaagaaaaactttcttcacgtatgtactgttccttttatcctcctgatgatgaggaggattgtgatgagtat

SEQ ID NO: 318523 - DNA, 75 bp, Artificial Sequence
  Synthetic
tagataattctcaacctgtctttgtggatgctaggaattatgtaccaactactgcactattagtctcatcgcagg

SEQ ID NO: 318524 - DNA, 75 bp, Artificial Sequence
  Synthetic
tggaacattggacaacagcggtcaatcctaacaccactgtgcggtttcccctcacaggctgctggtgttatcaga

SEQ ID NO: 318525 - DNA, 75 bp, Artificial Sequence
  Synthetic
tgtgttagctatagtgttacctatagcccttgttggtatttgtctttttattcttttactttggtatttgttttc

SEQ ID NO: 318526 - DNA, 75 bp, Artificial Sequence
  Synthetic
atagcttcacaaatggagctgtcgttggcacaccagtttgtataaatggcctcatgctcttagagatcaaggcca

SEQ ID NO: 318527 - DNA, 75 bp, Artificial Sequence
  Synthetic
tattgacacagtgaagagccttgactacaagtcttttaaagccattgttgagtcctgcggaaactacaaagttac

SEQ ID NO: 318528 - DNA, 75 bp, Artificial Sequence
  Synthetic
ctggaatttggtgcctcaactgaaatgcaagttgaagaagaagaagaagaggactggcttggtgatgctactgaa

SEQ ID NO: 318529 - DNA, 75 bp, Artificial Sequence
  Synthetic
gcaaagagcagctgtgaccatccttgatggcatttcagaacaatcattgcgtcttgttgatgccatggtttacac

SEQ ID NO: 318530 - DNA, 75 bp, Artificial Sequence
  Synthetic
taagcaaaacaaaatttaccaacaggccacgcaatcagtctaaacgaacatgaaaattattctcttcctgacatt

SEQ ID NO: 318531 - DNA, 75 bp, Artificial Sequence
  Synthetic
cactagtaagaaaaatatttgtagatggtgttccttttgttgtttcaactggataccattttcgtgagttaggag

SEQ ID NO: 318532 - DNA, 75 bp, Artificial Sequence
  Synthetic
tcctaacaccactgtgcggtttcccctcacaggctgctggtgttatcagatcaatcttctctcgcacactagatg

SEQ ID NO: 318533 - DNA, 75 bp, Artificial Sequence
  Synthetic
gatggcatttcagaacaatcattgcgtcttgttgatgccatggtttacacttcagacttgatcaccaacagtgtc

SEQ ID NO: 318534 - DNA, 75 bp, Artificial Sequence
  Synthetic
gtcttgtacaacaaacaactcagtggttatctaacatgttaggtaccactgttgaaaagctcaaacccgtgttta

SEQ ID NO: 318535 - DNA, 75 bp, Artificial Sequence
  Synthetic
gttatctaacatgttaggtaccactgttgaaaagctcaaacccgtgtttacatggattgagactaagcttagtgc

SEQ ID NO: 318536 - DNA, 75 bp, Artificial Sequence
  Synthetic
ggcgaagaaaagttgtcttcgcgtatgtattgctccttctaccctcctgatgaggaggaggattgtgaagagtat

SEQ ID NO: 318537 - DNA, 75 bp, Artificial Sequence
  Synthetic
tgggaaattcttaaattcttggttacaggagtgtttgacatcgttaagggtcaaatacaggtggcttcagacaat

SEQ ID NO: 318538 - DNA, 75 bp, Artificial Sequence
  Synthetic
gtggtggtgtagcaggtgcactcaacaaggcaaccaacggtgccatgcaaaaagagagcgatgattacattaagc

SEQ ID NO: 318539 - DNA, 75 bp, Artificial Sequence
  Synthetic
caggagtgtttgacatcgttaagggtcaaatacaggtggcttcagacaatctcaaggaatgtgtaaaaactttcc

SEQ ID NO: 318540 - DNA, 75 bp, Artificial Sequence
  Synthetic
ttcatgtttgctttctggacataatcttgctaagaagtgtctgcatgttgttggacctaacctaaatgcaggtga

SEQ ID NO: 318541 - DNA, 75 bp, Artificial Sequence
  Synthetic
agaggaagattataaaggtctcccactggaatttggtgcttcaactgatataattcaagttgaagagcaagaaga

SEQ ID NO: 318542 - DNA, 75 bp, Artificial Sequence
  Synthetic
aatgtgcattgatcaagtcacaattgctggcgccaagatgagatcactcaatcttggagagatcttcattgcaca

SEQ ID NO: 318543 - DNA, 75 bp, Artificial Sequence
  Synthetic
gctggcgccaagatgagatcactcaatcttggagagatcttcattgcacagagtaagggcctctatcgccaatgc

SEQ ID NO: 318544 - DNA, 75 bp, Artificial Sequence
  Synthetic
aacaatgtgtgatatcagacaactcctattcgtagttgaagttgttgataaatactttgattgttacgatggtgg

SEQ ID NO: 318545 - DNA, 75 bp, Artificial Sequence
  Synthetic
tgtattgctccttctaccctcctgatgaggaggaggattgtgaagagtatgaggaagaagaggaagtctcagaaa

SEQ ID NO: 318546 - DNA, 75 bp, Artificial Sequence
  Synthetic
tacatgaggaaccagtcaaccagcttactggctatttaaaacttactgacaacgtagccattaagtgtgtggaca

SEQ ID NO: 318547 - DNA, 75 bp, Artificial Sequence
  Synthetic
tacttatgcctcttaaggctcctaaggaagtcaccttcctcgatggtgactcacatgacacagtattgacctcag

SEQ ID NO: 318548 - DNA, 75 bp, Artificial Sequence
  Synthetic
cagttcgtacacaggtttacattgcagtcaatgacaaagctctttatgagcaggttgtcatggattaccttgata

SEQ ID NO: 318549 - DNA, 75 bp, Artificial Sequence
  Synthetic
ggaagtcaccttcctcgatggtgactcacatgacacagtattgacctcagaggaggttgttcttaaaaatggtga

SEQ ID NO: 318550 - DNA, 75 bp, Artificial Sequence
  Synthetic
ctggaatttggtgcttcaactgatataattcaagttgaagagcaagaagaggaagactggcttgatgatgctgtt

SEQ ID NO: 318551 - DNA, 75 bp, Artificial Sequence
  Synthetic
gacagcttcactaatggagcagtcgtgggcacaccagtatgtgtcaatggcctcatgcttttggagctaaaagac

SEQ ID NO: 318552 - DNA, 75 bp, Artificial Sequence
  Synthetic
gtgtagcaggtgcactcaacaaggcaactaacggtgccatgcaaaaagagagtgatcattacattaagctaaacg

SEQ ID NO: 318553 - DNA, 75 bp, Artificial Sequence
  Synthetic
tgggcacaccagtatgtgtcaatggcctcatgcttttggagctaaaagacaaggaacagtactgtgctttgtctc

SEQ ID NO: 318554 - DNA, 75 bp, Artificial Sequence
  Synthetic
cttccgtctaaaaggaggtgcaccagttaaaggtgtaacctttggagaagacactgtcttggaagttcagggcta

SEQ ID NO: 318555 - DNA, 75 bp, Artificial Sequence
  Synthetic
gttaaaggtgtaacctttggagaagacactgtcttggaagttcagggctataagaatgtgagaatcacattcgag

SEQ ID NO: 318556 - DNA, 75 bp, Artificial Sequence
  Synthetic
ttaatgagaagtgctctgtttacactgttgaatccggtactgaagttactgaattcgcatgtgttgtagcagagg

SEQ ID NO: 318557 - DNA, 75 bp, Artificial Sequence
  Synthetic
tgttgaatccggtactgaagttactgaattcgcatgtgttgtagcagaggctgttgtgaagactttacagccagt

SEQ ID NO: 318558 - DNA, 75 bp, Artificial Sequence
  Synthetic
gcacacaggtttatattgtagtcaatgacaaagttctttatgagcaggttgtcatggattatcttgatagcctga

SEQ ID NO: 318559 - DNA, 75 bp, Artificial Sequence
  Synthetic
attgatcttgatgagtggagtgtagctacattctacttgtttgatgatgctggtgaagaaaaactttcttcgcgc

SEQ ID NO: 318560 - DNA, 75 bp, Artificial Sequence
  Synthetic
agcctaaagtggaggcacctaaacaagaggtgttaccaaaggcagaatatcctaaggttgatgagaaatctgtcg

SEQ ID NO: 318561 - DNA, 75 bp, Artificial Sequence
  Synthetic
ctacattctacttgtttgatgatgctggtgaagaaaaactttcttcgcgcatgtactgctctttctatcctcctg

SEQ ID NO: 318562 - DNA, 75 bp, Artificial Sequence
  Synthetic
cttacttgcaccattgttgtcagcaggcatatttggtgctaaaccacttcagtctttacaagtgtgcgtgcagac

SEQ ID NO: 318563 - DNA, 75 bp, Artificial Sequence
  Synthetic
tgaggaagaagaagaagttcctgaacaaacctgtgaacacgaatatggcacagaggatgactataaaggccttcc

SEQ ID NO: 318564 - DNA, 75 bp, Artificial Sequence
  Synthetic
caaacctgtgaacacgaatatggcacagaggatgactataaaggccttcctcttgaatttggtgcatcaacacaa

SEQ ID NO: 318565 - DNA, 75 bp, Artificial Sequence
  Synthetic
ttagagccataatggccaccatccaacgcaagtacaaaggaattaaagttcaagaaggcattgttgactatggag

SEQ ID NO: 318566 - DNA, 75 bp, Artificial Sequence
  Synthetic
taggaactggcccagaagcttcacttccctacggcgctaacaaagaaggcatcgtatgggtcgcaactgagggag

SEQ ID NO: 318567 - DNA, 75 bp, Artificial Sequence
  Synthetic
tccgattcttcttttatactagtaaagagcctgtagcttctatcattacgaagctgaactctctaaatgagccac

SEQ ID NO: 318568 - DNA, 75 bp, Artificial Sequence
  Synthetic
actggcttgatgaagcggagcctgagccagaatctctatctgaggaaccagttaaccagtttactggttacttaa

SEQ ID NO: 318569 - DNA, 75 bp, Artificial Sequence
  Synthetic
gccagaatctctatctgaggaaccagttaaccagtttactggttacttaaaacttactgacaatgttgccattaa

SEQ ID NO: 318570 - DNA, 75 bp, Artificial Sequence
  Synthetic
cagagtgctcgtcctgaagtgattgtaaatgctgctaacatccacttgaaacatggtggtggcgtagctggtgca

SEQ ID NO: 318571 - DNA, 75 bp, Artificial Sequence
  Synthetic
taaatgctgctaacatccacttgaaacatggtggtggcgtagctggtgcactcaacaaagcaactaatggtgcta

SEQ ID NO: 318572 - DNA, 75 bp, Artificial Sequence
  Synthetic
taagcaaaatggaccacttacagtaggtggttcgtgtttgctttctggacataatcttgctaagaagtgcatgca

SEQ ID NO: 318573 - DNA, 75 bp, Artificial Sequence
  Synthetic
ggtggttcgtgtttgctttctggacataatcttgctaagaagtgcatgcatgttgttggccctaacctaaatgct

SEQ ID NO: 318574 - DNA, 75 bp, Artificial Sequence
  Synthetic
ctgcatatgagaatttcaattcacaggatgtgttgcttgcaccgctattgtcagctggcatattcggtgctaaac

SEQ ID NO: 318575 - DNA, 75 bp, Artificial Sequence
  Synthetic
ggatgtgttgcttgcaccgctattgtcagctggcatattcggtgctaaaccattgcagtcacttaaagtgtgtgt

SEQ ID NO: 318576 - DNA, 75 bp, Artificial Sequence
  Synthetic
atcgcagttaatgacaagagtctttatgatcaggttgtactagattacctggacagtctgaaacctaaagtagag

SEQ ID NO: 318577 - DNA, 75 bp, Artificial Sequence
  Synthetic
atgatcaggttgtactagattacctggacagtctgaaacctaaagtagagtctcccaagaaagaggagaacccaa

SEQ ID NO: 318578 - DNA, 75 bp, Artificial Sequence
  Synthetic
tcacttcgttgcggtgcctgtattaggagaccattcctatgttgcaagtgctgctatgaccatgtcatttcaaca

SEQ ID NO: 318579 - DNA, 75 bp, Artificial Sequence
  Synthetic
gccagctgttgagaaacctgttgatgtcaaacctaaaattaaggcttgtattgatgaggttactacaacattgga

SEQ ID NO: 318580 - DNA, 75 bp, Artificial Sequence
  Synthetic
gtcaaacctaaaattaaggcttgtattgatgaggttactacaacattggaagagactaaatttcttaccaataaa

SEQ ID NO: 318581 - DNA, 75 bp, Artificial Sequence
  Synthetic
ggagaccattcctatgttgcaagtgctgctatgaccatgtcatttcaacatcacacaaattagtgttgtctgtta

SEQ ID NO: 318582 - DNA, 75 bp, Artificial Sequence
  Synthetic
gtaaactttaccaggattctcagaacatgctaagaggtgaagacacgtctttcctagaaaaggacgcaccgtaca

SEQ ID NO: 318583 - DNA, 75 bp, Artificial Sequence
  Synthetic
catgctaagaggtgaagacacgtctttcctagaaaaggacgcaccgtacattgtgggtgatgtcatcactagtgg

SEQ ID NO: 318584 - DNA, 75 bp, Artificial Sequence
  Synthetic
ttgacggtgaggttcttccacttgacaaactaaagagtctcttatccctgcgggaggttaagactataaaagtgt

SEQ ID NO: 318585 - DNA, 75 bp, Artificial Sequence
  Synthetic
attgcaagtcacataagcctcccattagttttccattatgtgctaatggtcaggtttttggtttatacaaaaaca

SEQ ID NO: 318586 - DNA, 75 bp, Artificial Sequence
  Synthetic
aaatgcttgcaaaggcattaaagaaagtgccagttggtgagtacataaccacatatcctggacaaggatgtgctg

SEQ ID NO: 318587 - DNA, 75 bp, Artificial Sequence
  Synthetic
tgcgcttaagaaatgcaaatctgcattttatgtactaccttcagaaacacctaacgagaaagaagaaattctagg

SEQ ID NO: 318588 - DNA, 75 bp, Artificial Sequence
  Synthetic
ttttatgtactaccttcagaaacacctaacgagaaagaagaaattctaggaacagtatcctggaatttaagagag

SEQ ID NO: 318589 - DNA, 75 bp, Artificial Sequence
  Synthetic
gaaaattaatgcctgtctgcatggatgtgcgtgccataatggctaccattcagcgcaagtataaaggcattaaaa

SEQ ID NO: 318590 - DNA, 75 bp, Artificial Sequence
  Synthetic
tgtgcgtgccataatggctaccattcagcgcaagtataaaggcattaaaattcaagaaggaattgttgactatgg

SEQ ID NO: 318591 - DNA, 75 bp, Artificial Sequence
  Synthetic
tcacactgtaatgccacttagtgcacctactctagtgccacaagagcactatgtgagaattactggcttgtaccc

SEQ ID NO: 318592 - DNA, 75 bp, Artificial Sequence
  Synthetic
aaagagcctgtagcctctatcattacaaagctcaattcactaaatgagccacttgtcacaatgccaataggttat

SEQ ID NO: 318593 - DNA, 75 bp, Artificial Sequence
  Synthetic
caaagctcaattcactaaatgagccacttgtcacaatgccaataggttatgtgacacatggctttaatttggaag

SEQ ID NO: 318594 - DNA, 75 bp, Artificial Sequence
  Synthetic
taaagctcctgctgtggtttcagtgtcttcaccagacgcagtcactacatataatgggtacctcacgtcatcttc

SEQ ID NO: 318595 - DNA, 75 bp, Artificial Sequence
  Synthetic
tcttcaccagacgcagtcactacatataatgggtacctcacgtcatcttcaaagacacctgaggaacacttcata

SEQ ID NO: 318596 - DNA, 75 bp, Artificial Sequence
  Synthetic
atagggattggtcttattctggacaacgtacagaattaggtgttgaatttcttaagcgtggggataagattgttt

SEQ ID NO: 318597 - DNA, 75 bp, Artificial Sequence
  Synthetic
cctatagaccttgtaccaactcaaccactaccaaatgcgagttttgacaatttcaaactcacatgttctaataca

SEQ ID NO: 318598 - DNA, 75 bp, Artificial Sequence
  Synthetic
acgtacagaattaggtgttgaatttcttaagcgtggggataagattgtttaccacacaatcgaaagccccgtcga

SEQ ID NO: 318599 - DNA, 75 bp, Artificial Sequence
  Synthetic
ccacttgacaagctcaagagtcttttatctcttcgcgaggttaagactattaaagtgtttacgactgtagacaac

SEQ ID NO: 318600 - DNA, 75 bp, Artificial Sequence
  Synthetic
tatctcttcgcgaggttaagactattaaagtgtttacgactgtagacaacactaatctccacacacagattgtgg

SEQ ID NO: 318601 - DNA, 75 bp, Artificial Sequence
  Synthetic
cacataactgctaaggagaccctctatcgtattgatggagctcaccttacaaagatgtcagagtataaaggacca

SEQ ID NO: 318602 - DNA, 75 bp, Artificial Sequence
  Synthetic
gtttggttcaacctatttggatggcgctgatgttactaaaattaagcctcatgttaatcatgagggtaagacttt

SEQ ID NO: 318603 - DNA, 75 bp, Artificial Sequence
  Synthetic
atgttaatcatgagggtaagactttctttgtgctacccagtgatgatacactgcgtagtgaagcatttgagtact

SEQ ID NO: 318604 - DNA, 75 bp, Artificial Sequence
  Synthetic
aaattgaagtgaaatttaacgcacctgcactacaagaagcctactatagggctcgtgctggtgatgctgccaact

SEQ ID NO: 318605 - DNA, 75 bp, Artificial Sequence
  Synthetic
tgcactacaagaagcctactatagggctcgtgctggtgatgctgccaacttttgtgcactcatactcgcttacag

SEQ ID NO: 318606 - DNA, 75 bp, Artificial Sequence
  Synthetic
gatgttagagaaactatgacccatcttctacaacatgccaatttggaatctgctaagcgggttcttaatgtggtg

SEQ ID NO: 318607 - DNA, 75 bp, Artificial Sequence
  Synthetic
ttctacaacatgccaatttggaatctgctaagcgggttcttaatgtggtgtgtaaacattgcggccagaaaacta

SEQ ID NO: 318608 - DNA, 75 bp, Artificial Sequence
  Synthetic
aacatcaaattgcgctaagagattagcacaacgtgtgtttaacaattatatgccttatgtgcttacactattgtt

SEQ ID NO: 318609 - DNA, 75 bp, Artificial Sequence
  Synthetic
gggtacatttttatgtgctaatgagtacactggtaattatcagtgtggtcattacactcacataactgcaaagga

SEQ ID NO: 318610 - DNA, 75 bp, Artificial Sequence
  Synthetic
ttggatgctggcattaattatgtaaagtcacccaaattttctaaattgttcactattgcaatgtggctattattg

SEQ ID NO: 318611 - DNA, 75 bp, Artificial Sequence
  Synthetic
gttgtctttggagtacaaagccagtagatacttcaaattcatttgaagttctggcagtagaagacacacaaggaa

SEQ ID NO: 318612 - DNA, 75 bp, Artificial Sequence
  Synthetic
ggattatgtgttgacataccaggcataccaaaggacatgacctaccgtagactcatctctatgatgggtttcaaa

SEQ ID NO: 318613 - DNA, 75 bp, Artificial Sequence
  Synthetic
ttaagcatttgcttaggttcactaatctatgtaactgcagctttaggtgtattattgtccaactttggagctcct

SEQ ID NO: 318614 - DNA, 75 bp, Artificial Sequence
  Synthetic
taaggaaacatcttacactacaactattaagcctgtgtcatacaaacttgatggagttacttacacagagattga

SEQ ID NO: 318615 - DNA, 75 bp, Artificial Sequence
  Synthetic
attttggcatatgtcaaaccattcttaggacaggcagcagttacaacatcaaattgcgctaagagattggtacag

SEQ ID NO: 318616 - DNA, 75 bp, Artificial Sequence
  Synthetic
tttccttgcagtgtttgtttaagtggattagactcgcttgattcctatccagctcttgaaaccatccaggtgacg

SEQ ID NO: 318617 - DNA, 75 bp, Artificial Sequence
  Synthetic
aaggataatgcttactacacggagcagcccattgatctggtgccaactcagcccttaccgaatgcgagttttgat

SEQ ID NO: 318618 - DNA, 75 bp, Artificial Sequence
  Synthetic
agcccattgatctggtgccaactcagcccttaccgaatgcgagttttgataatttcaaactcacatgtgctaaca

SEQ ID NO: 318619 - DNA, 75 bp, Artificial Sequence
  Synthetic
aaattcttttatttactaggtctttcagctataatgcaggtgttctttggctattttgctagtcatttcatcagc

SEQ ID NO: 318620 - DNA, 75 bp, Artificial Sequence
  Synthetic
tcaattcctctaatgttactactatggatttctgtgaaggttcttttccttgcagtgtttgtttaagtggattag

SEQ ID NO: 318621 - DNA, 75 bp, Artificial Sequence
  Synthetic
agaaaccatccaggtgacgatctcatcgtacaagctagacttgacaattttaggtttagctgctgagtggttttt

SEQ ID NO: 318622 - DNA, 75 bp, Artificial Sequence
  Synthetic
ctaatgagctctcgttggccttaggtttaaaaacacttgccactcacggtgctgctgcgatcaatagtgtccctt

SEQ ID NO: 318623 - DNA, 75 bp, Artificial Sequence
  Synthetic
tttaaaaacacttgccactcacggtgctgctgcgatcaatagtgtcccttggagtaagatcttggcttatgttaa

SEQ ID NO: 318624 - DNA, 75 bp, Artificial Sequence
  Synthetic
tgctgctaggtctgcatctgtgtactacagtcagctaatgtgccaacctattctgttgcttgaccaagctctcat

SEQ ID NO: 318625 - DNA, 75 bp, Artificial Sequence
  Synthetic
ttgagtgtacaactattgttaatggcatgaagagatccttctacgtttatgcaaatggaggtcgtggcttctgta

SEQ ID NO: 318626 - DNA, 75 bp, Artificial Sequence
  Synthetic
tgatggtgtttgtttgttttggaattgtaacgttgatcgttacccagccaatgcaattgtgtgtaggtttgacac

SEQ ID NO: 318627 - DNA, 75 bp, Artificial Sequence
  Synthetic
gcactaactcgagaattagagcatcacttcctacaactattgctaaaaatagtgttaagagtgttgcaaaattat

SEQ ID NO: 318628 - DNA, 75 bp, Artificial Sequence
  Synthetic
ttgtgatacattctgtgctggtagtacattcattagcgatgaagttgctcgtgacttgtcactccagtttaaaag

SEQ ID NO: 318629 - DNA, 75 bp, Artificial Sequence
  Synthetic
atgtcgacaccttttcagcaacttttagtgtccctatggaaaaacttagggcactcgttgctacagctcatagcg

SEQ ID NO: 318630 - DNA, 75 bp, Artificial Sequence
  Synthetic
gaaatctcctaaattttctaaattgttcacaattgcaatgtggctattgttgttaagcatttgcttaggttcatt

SEQ ID NO: 318631 - DNA, 75 bp, Artificial Sequence
  Synthetic
tggtgtcctttctacatttgtgtcagctgctcgtcaaggtgttgttgatactgatgttgacacaaaggatgtcat

SEQ ID NO: 318632 - DNA, 75 bp, Artificial Sequence
  Synthetic
cttcttattgcgatggtgttagagagtcatatcttaactcttctaatgtcactattatagatttttgtgagggtt

SEQ ID NO: 318633 - DNA, 75 bp, Artificial Sequence
  Synthetic
gtcatatcttaactcttctaatgtcactattatagatttttgtgagggttctttcccttgcagtgtttgcttaaa

SEQ ID NO: 318634 - DNA, 75 bp, Artificial Sequence
  Synthetic
gttgtaacaacttcatgctcacctataacaaagttgaaaacatgacgcctagagatcttggcgcatgtattgatt

SEQ ID NO: 318635 - DNA, 75 bp, Artificial Sequence
  Synthetic
agagatcttggcgcatgtattgattgtaatgcaaggcatattaatgctcaagtagcaaaaagtcacaatgtttca

SEQ ID NO: 318636 - DNA, 75 bp, Artificial Sequence
  Synthetic
ccggctctcgaaaccattcaggttacgatttcatcgtacaagctagatctgacattcttaggcttagcagctgaa

SEQ ID NO: 318637 - DNA, 75 bp, Artificial Sequence
  Synthetic
agtcatcgtatattgttgatagtgttgctgtgaaaaatggcgcgcttcacctctactttgacaaggctggtcaaa

SEQ ID NO: 318638 - DNA, 75 bp, Artificial Sequence
  Synthetic
aaacaatttgatacttataacctgtggaatacatttaccaggttacagagtttagaaaatgtggcttataatgtt

SEQ ID NO: 318639 - DNA, 75 bp, Artificial Sequence
  Synthetic
cagttaatgtgccaacccattctgttgcttgaccaagctcttgtatcagatgttggagatagtactgaagtttct

SEQ ID NO: 318640 - DNA, 75 bp, Artificial Sequence
  Synthetic
acactttctcagcaacttttagtgttcctatggaaaaacttaaggcacttgttgctactgctcatagtgagctag

SEQ ID NO: 318641 - DNA, 75 bp, Artificial Sequence
  Synthetic
ttccgctataatgcaggtgtttttcggctactttgctagtcatttcatcagcaactcatggctcatgtggtttgt

SEQ ID NO: 318642 - DNA, 75 bp, Artificial Sequence
  Synthetic
cgatttcatcgtacaagctagatctgacattcttaggcttagcagctgaatggtttttggcatacatgttgttta

SEQ ID NO: 318643 - DNA, 75 bp, Artificial Sequence
  Synthetic
ggctactttgctagtcatttcatcagcaactcatggctcatgtggtttgtcattagcattgtacaaatggcaccc

SEQ ID NO: 318644 - DNA, 75 bp, Artificial Sequence
  Synthetic
agagctaacaacactaaaggttcactgcctattaatgtcatagtttttgatggcaagtccaaatgtgacgagtct

SEQ ID NO: 318645 - DNA, 75 bp, Artificial Sequence
  Synthetic
ggtttaaacttatgcttaaggccacattattgtgcgtcattgctacattggtctgttacatcgttatgccagtac

SEQ ID NO: 318646 - DNA, 75 bp, Artificial Sequence
  Synthetic
tcttttttgcttctttttactacgtatggaaaagttatgttcatattatggatggttgtacttcctctacgtgca

SEQ ID NO: 318647 - DNA, 75 bp, Artificial Sequence
  Synthetic
atggaaaagttatgttcatattatggatggttgtacttcctctacgtgcatgatgtgttacaagcgcaatcgtgc

SEQ ID NO: 318648 - DNA, 75 bp, Artificial Sequence
  Synthetic
cagcacatgtatctacaataggtgtctgcacaatgactgacattgccaagaaacctactgagagtgcttgttctt

SEQ ID NO: 318649 - DNA, 75 bp, Artificial Sequence
  Synthetic
gttaatggcatgaagagatctttctatgtctatgcaaatggaggccgaggcttctgtaaagctcacaattggaat

SEQ ID NO: 318650 - DNA, 75 bp, Artificial Sequence
  Synthetic
atgtctatgcaaatggaggccgaggcttctgtaaagctcacaattggaattgtcttaactgtgacacattttgtg

SEQ ID NO: 318651 - DNA, 75 bp, Artificial Sequence
  Synthetic
catacaaaaatgacaaaagctgccctgtagtagctgctatcattacaagagagattggtttcatagtgcctggct

SEQ ID NO: 318652 - DNA, 75 bp, Artificial Sequence
  Synthetic
agttgctcgtgacttgtcactccagtttaagagaccaattaaccccacggaccagtcctcttatgttgttgatag

SEQ ID NO: 318653 - DNA, 75 bp, Artificial Sequence
  Synthetic
tttaagagaccaattaaccccacggaccagtcctcttatgttgttgatagtgttgccgtcaagaatggtgcactt

SEQ ID NO: 318654 - DNA, 75 bp, Artificial Sequence
  Synthetic
agaggacttatgagagacacccgctttctcattttgttaatttagacaatctgagagctaataacaccaagggtt

SEQ ID NO: 318655 - DNA, 75 bp, Artificial Sequence
  Synthetic
aaatcatgcttaaagccacactattgtgtgtccttgctgcattggtttgttatatcgttatgccagtacatatat

SEQ ID NO: 318656 - DNA, 75 bp, Artificial Sequence
  Synthetic
ttctcattttgttaatttagacaatctgagagctaataacaccaagggttcgttacctattaatgttattgtttt

SEQ ID NO: 318657 - DNA, 75 bp, Artificial Sequence
  Synthetic
tctgctgccaagtctgcgtctgtttattacagtcagcttatgtgccaacctattctgctgcttgatcaagctctt

SEQ ID NO: 318658 - DNA, 75 bp, Artificial Sequence
  Synthetic
aaaatgataagagctgtcctgtagtagctgctatcattactagggagattggctttatagtgcctggtctaccgg

SEQ ID NO: 318659 - DNA, 75 bp, Artificial Sequence
  Synthetic
tagatgggttcttaacaatgaacattatagagctctacctggagtattttgtggtgttgatgcaatgaatcttat

SEQ ID NO: 318660 - DNA, 75 bp, Artificial Sequence
  Synthetic
acaaatgaaatcattggttacaaagccattcaggatggtgtcactcgtgacatcatttctactgatgattgtttt

SEQ ID NO: 318661 - DNA, 75 bp, Artificial Sequence
  Synthetic
gatggtgtcctatccacatttgtttcagctgcccgtcaaggtgttgttgatactgatgttgacacaaaggacgtc

SEQ ID NO: 318662 - DNA, 75 bp, Artificial Sequence
  Synthetic
cagctgcccgtcaaggtgttgttgatactgatgttgacacaaaggacgtcattgagtgtctcaaactttctcatc

SEQ ID NO: 318663 - DNA, 75 bp, Artificial Sequence
  Synthetic
ccagagatcttggtgcatgtattgattgtaatgcaaggcacatcaatgcccaagtagcaaaaagtcacaacattt

SEQ ID NO: 318664 - DNA, 75 bp, Artificial Sequence
  Synthetic
tatgtcattgtctgaacagctgcgcaagcaaattcgtagtgctgctagaaagaacaacataccctttaggcttac

SEQ ID NO: 318665 - DNA, 75 bp, Artificial Sequence
  Synthetic
aagcaaattcgtagtgctgctagaaagaacaacataccctttaggcttacttgtgctactactaggcaagttgtc

SEQ ID NO: 318666 - DNA, 75 bp, Artificial Sequence
  Synthetic
ttggtttaaattcatgctgaaagtcacacttttgtgtgttctatctgcattgatttgttacatcattatgccagt

SEQ ID NO: 318667 - DNA, 75 bp, Artificial Sequence
  Synthetic
gagttacatttagtaccttcgaggaggctgctttgtgtacctttttgctcaataaggaaatgtacctaaaattgc

SEQ ID NO: 318668 - DNA, 75 bp, Artificial Sequence
  Synthetic
tacacaaatgaaatcattggatataaggctatccaggacggtgtcactcgtgacatagtctcaactgatgattgc

SEQ ID NO: 318669 - DNA, 75 bp, Artificial Sequence
  Synthetic
tgacatagtctcaactgatgattgctttgctaacaaacacgctggatttgaatcttggtttagccagcgtggcgg

SEQ ID NO: 318670 - DNA, 75 bp, Artificial Sequence
  Synthetic
tctttcactatactctgcctggcacctgcttatagcttcttgccaggagtctattcagtcttttacttgtacttg

SEQ ID NO: 318671 - DNA, 75 bp, Artificial Sequence
  Synthetic
cctgttgtagctgctatcattactagggaaattggtttcatagtgcctggtttacctggtactgttctgagagca

SEQ ID NO: 318672 - DNA, 75 bp, Artificial Sequence
  Synthetic
ttctggataacagcaatttatgtattctgtatttctttgaagcactttcactggttctttaataattatcttagg

SEQ ID NO: 318673 - DNA, 75 bp, Artificial Sequence
  Synthetic
tacctcgcgtttttagtgctgtaggtaacatctgctacacaccatcaaaacttattgagtatagtgattttgcta

SEQ ID NO: 318674 - DNA, 75 bp, Artificial Sequence
  Synthetic
taacatctgctacacaccatcaaaacttattgagtatagtgattttgctacctctgcttgtgtcttagctgctga

SEQ ID NO: 318675 - DNA, 75 bp, Artificial Sequence
  Synthetic
gacatgcttaatcctaactatgaagatctgctcattcgcaaatccaaccatagcttccttgttcaggctggcaat

SEQ ID NO: 318676 - DNA, 75 bp, Artificial Sequence
  Synthetic
acactaacttacttgagggttctatttcttacagtgagcttcgtcctgacactcgctatgtgcttatggacggtt

SEQ ID NO: 318677 - DNA, 75 bp, Artificial Sequence
  Synthetic
gtacaactccgagttatcggccattctatgcaaaattgtctgcttaggcttaaagttgatacctctaaccctaag

SEQ ID NO: 318678 - DNA, 75 bp, Artificial Sequence
  Synthetic
tagatactactagctatcgtgaagcagcttgctgccacttagcaaaggctctaaatgacttcagcaattctggtg

SEQ ID NO: 318679 - DNA, 75 bp, Artificial Sequence
  Synthetic
ccttgaaggttctgttagagtggttacaacttttgatgcagagtactgccgtcatggcacctgcgagaggtcaga

SEQ ID NO: 318680 - DNA, 75 bp, Artificial Sequence
  Synthetic
gtcatggcacctgcgagaggtcagaagctggtatttgcttgtctactagcggtaggtgggttcttaataatgaac

SEQ ID NO: 318681 - DNA, 75 bp, Artificial Sequence
  Synthetic
ttgtctgttcatgatggttatacaaatgaaatcattggttacaaagccattcaggatggtgtcactcgtgacatt

SEQ ID NO: 318682 - DNA, 75 bp, Artificial Sequence
  Synthetic
cagagtggttttaggaaaatggcattcccatcaggtaaagttgaagggtgcatggtacaagtaacctgtggaact

SEQ ID NO: 318683 - DNA, 75 bp, Artificial Sequence
  Synthetic
ttttgatgtctttcactatactctgtctggcacctgcttacagctttctgccaggagtttactctgtcttttact

SEQ ID NO: 318684 - DNA, 75 bp, Artificial Sequence
  Synthetic
caatggtttgctatgttctctcccattgtgcctttctggataacagcaatctatgtgttctgtatttctctaaag

SEQ ID NO: 318685 - DNA, 75 bp, Artificial Sequence
  Synthetic
aaatggatcatgtggtagtgttggttttaacatagactatgattgcgtgtctttctgttatatgcatcacatgga

SEQ ID NO: 318686 - DNA, 75 bp, Artificial Sequence
  Synthetic
acgcagtacaacagataccttgctctttacaacaagtacaagtattttagtggagccttggatacaactagctat

SEQ ID NO: 318687 - DNA, 75 bp, Artificial Sequence
  Synthetic
tttacaacaagtacaagtattttagtggagccttggatacaactagctatcgtgaagcagcttgctgccacttag

SEQ ID NO: 318688 - DNA, 75 bp, Artificial Sequence
  Synthetic
ttctggtgctgacgttctttaccaaccaccacagacttcaatcacatctgcggttttacagagtggttttaggaa

SEQ ID NO: 318689 - DNA, 75 bp, Artificial Sequence
  Synthetic
ccaccacagacttcaatcacatctgcggttttacagagtggttttaggaaaatggcattcccatccggtaaagtg

SEQ ID NO: 318690 - DNA, 75 bp, Artificial Sequence
  Synthetic
gtggttagatgacacagtatattgtccaagacatgttatttgcacagcagaagacatgcttaatccaaactatga

SEQ ID NO: 318691 - DNA, 75 bp, Artificial Sequence
  Synthetic
atgtccaacttcgtgtcatcggtcattccatgcaaaattgtctgcttaggcttaaagtcgatacctctaacccta

SEQ ID NO: 318692 - DNA, 75 bp, Artificial Sequence
  Synthetic
agacaccaaagtataaatttgtccgcatccaaccgggtcagacattttcagtcctagcttgctacaatggttcac

SEQ ID NO: 318693 - DNA, 75 bp, Artificial Sequence
  Synthetic
catgcctgctagctgggtgatgcgtatcatgacatggcttgaattggctgatactagcttgtctggttatcggct

SEQ ID NO: 318694 - DNA, 75 bp, Artificial Sequence
  Synthetic
ttggccttttctgtttactcaaccgttacttcaggcttactcttggtgtttatgactatttggtctctacacaag

SEQ ID NO: 318695 - DNA, 75 bp, Artificial Sequence
  Synthetic
tgttgggtattggaggtaaaccatgtatcaaggttgctactgtacagtctaaaatgtctgacgtaaagtgcacat

SEQ ID NO: 318696 - DNA, 75 bp, Artificial Sequence
  Synthetic
caaactgcacaggctgctggcacagacacaaccattacattgaacgttttggcttggctctatgctgctgttatt

SEQ ID NO: 318697 - DNA, 75 bp, Artificial Sequence
  Synthetic
aatggtgatagatggttccttaataggtttaccactactctgaatgactttaatcttgtggctatgaagtacaat

SEQ ID NO: 318698 - DNA, 75 bp, Artificial Sequence
  Synthetic
ttgacatactaggacccctttctgcacaaacaggaattgctgtcttggatatgtgtgctgccttaaaagagcttc

SEQ ID NO: 318699 - DNA, 75 bp, Artificial Sequence
  Synthetic
acaaacaggaattgctgtcttggatatgtgtgctgccttaaaagagcttctacagaatggtatgaatggtcgtac

SEQ ID NO: 318700 - DNA, 75 bp, Artificial Sequence
  Synthetic
gatgagtttacaccctttgacgttgttaggcaatgttctggtgtcaccttccaaggtaaattcaagaaaattgtt

SEQ ID NO: 318701 - DNA, 75 bp, Artificial Sequence
  Synthetic
aaagtataaatttgtccgtatccaaccaggtcagacattttcagtcctagcttgttacaatggctcaccatcagg

SEQ ID NO: 318702 - DNA, 75 bp, Artificial Sequence
  Synthetic
caaatgtacaaacaggcaagatctgaggacaagagggcaaaagtaactagtgctatgcaaacaatgcttttcact

SEQ ID NO: 318703 - DNA, 75 bp, Artificial Sequence
  Synthetic
ggtccttttgtagatagacagactgcacaggctgctggcacagatacaactattacactgaatgttttagcttgg

SEQ ID NO: 318704 - DNA, 75 bp, Artificial Sequence
  Synthetic
tgcagggtgctgtagacattaataagttgtgtgaggaaatgctcgacaaccgtgctactcttcaggctattgctt

SEQ ID NO: 318705 - DNA, 75 bp, Artificial Sequence
  Synthetic
tatcggctcaaagactgtgttatgtatgcgtcagccttagtgttactcatcctcatgactgctcgtactgtttat

SEQ ID NO: 318706 - DNA, 75 bp, Artificial Sequence
  Synthetic
tggtacctacaagaacacttgtgatggtaacacctttacatatgcatctgcactctgggaaatccagcaagttgt

SEQ ID NO: 318707 - DNA, 75 bp, Artificial Sequence
  Synthetic
cttagtgaaattaacatggataattcaccaaatttggcttggcctcttattgttacagctctaagagccaactca

SEQ ID NO: 318708 - DNA, 75 bp, Artificial Sequence
  Synthetic
ttagatcaagctatttccatgtgggctcttgttatttctgtaacctctaactattctggtgtcgttacgactatc

SEQ ID NO: 318709 - DNA, 75 bp, Artificial Sequence
  Synthetic
cttgttcattactggcaacactttacagtgtattatgcttgtctattgtttcttaggctattgttgctgttgcta

SEQ ID NO: 318710 - DNA, 75 bp, Artificial Sequence
  Synthetic
cagtgtattatgcttgtctattgtttcttaggctattgttgctgttgctactttggtcttttttgcttactcaac

SEQ ID NO: 318711 - DNA, 75 bp, Artificial Sequence
  Synthetic
tgtattaaagttgccactgtacagtctaaaatgtctgacgtaaagtgcacatcagtagtactgctctcagtgctt

SEQ ID NO: 318712 - DNA, 75 bp, Artificial Sequence
  Synthetic
acaccagaagctaacatggaccaagagtcctttggtggtgcttcatgctgtctgtattgtagatgccacattgat

SEQ ID NO: 318713 - DNA, 75 bp, Artificial Sequence
  Synthetic
agtcctttggtggtgcttcatgctgtctgtattgtagatgccacattgatcatccaaatcctaaaggattttgtg

SEQ ID NO: 318714 - DNA, 75 bp, Artificial Sequence
  Synthetic
tcgacaaccgtgctactcttcaagctattgcttcagaattcagttctttaccatcgtatgctgcttacgccacgg

SEQ ID NO: 318715 - DNA, 75 bp, Artificial Sequence
  Synthetic
tagctagagctatagtttttgtgtgtgttgagtattacccacttttgtttattactggcaacactttacagtgta

SEQ ID NO: 318716 - DNA, 75 bp, Artificial Sequence
  Synthetic
agatgttgtgtacacacactggtacaggacaggcaattactgtaacaccagaagccaacatggaccaagagtcct

SEQ ID NO: 318717 - DNA, 75 bp, Artificial Sequence
  Synthetic
gttttgcaaagttcctaaaaactaattgctgccgcttccaggagaaggatgaggaaggcaatttattagactctt

SEQ ID NO: 318718 - DNA, 75 bp, Artificial Sequence
  Synthetic
cacttgtgctaatgacccagtgggttttacactcagaaacacagtctgtaccgtctgcggaatgtggaaaggtta

SEQ ID NO: 318719 - DNA, 75 bp, Artificial Sequence
  Synthetic
gtgggcacagtgtgtacaacttcacaatgatattcttcttgcaaaggacactactgaagcttttgaaaagatggt

SEQ ID NO: 318720 - DNA, 75 bp, Artificial Sequence
  Synthetic
atggtaacacttttacatatgcatcagctctctgggagatccagcaagttgtagatgcagacagtaaaatcgtcc

SEQ ID NO: 318721 - DNA, 75 bp, Artificial Sequence
  Synthetic
cagctgtcaaactacagaataatgaactgagtccagtagcactacgacagatgtcttgtgcggctggtactacac

SEQ ID NO: 318722 - DNA, 75 bp, Artificial Sequence
  Synthetic
tgatgatgattatttcaataagaaggattggtatgacttcgtagagaatcctgacatcttacgcgtatatgctaa

SEQ ID NO: 318723 - DNA, 75 bp, Artificial Sequence
  Synthetic
ggtatgtttggctcggcttcattgctggactaattgccatcgtcatggttacaatcttgctttgttgcatgacta

SEQ ID NO: 318724 - DNA, 75 bp, Artificial Sequence
  Synthetic
ttgctgttcatgactttttcaagtttagagtagatggtgacatggtaccacatatatcacgtcagcgtctaacta

SEQ ID NO: 318725 - DNA, 75 bp, Artificial Sequence
  Synthetic
tacttatacttcattaagggcctaaacaacctaaatagaggtatggtactgggtagtttagctgctacagtacgt

SEQ ID NO: 318726 - DNA, 75 bp, Artificial Sequence
  Synthetic
acaacctaaatagaggtatggtactgggtagtttagctgctacagtacgtcttcaggctggcaacgctacagagg

SEQ ID NO: 318727 - DNA, 75 bp, Artificial Sequence
  Synthetic
aattgtgatacattaaaagaaatactcgtcacatacaattgttgtgatgatgattatttcaataagaaggattgg

SEQ ID NO: 318728 - DNA, 75 bp, Artificial Sequence
  Synthetic
tttctgtgcttttgctgtggatccagctaaggcttacaaagattacctagcaagtggaggacaaccaatcacgaa

SEQ ID NO: 318729 - DNA, 75 bp, Artificial Sequence
  Synthetic
ttgcgtgaagatgctgtgtacacacacgggtactggacaggcaataactgtaacgccagaagccaacatggacca

SEQ ID NO: 318730 - DNA, 75 bp, Artificial Sequence
  Synthetic
agttgtacataatcaggatgtaaacttacatagctcgcgtctcagtttcaaggaacttttagtgtatgctgctga

SEQ ID NO: 318731 - DNA, 75 bp, Artificial Sequence
  Synthetic
tcttacaccgtgcggcacaggcactagcactgatgtcgtttacagggcttttgatatttacaacgaaaaagttgc

SEQ ID NO: 318732 - DNA, 75 bp, Artificial Sequence
  Synthetic
actttattaagggtcttaacaacctaaatagaggtatggtactgggtagtttagctgccacagtacgtcttcagg

SEQ ID NO: 318733 - DNA, 75 bp, Artificial Sequence
  Synthetic
atgtctaactaccaacatgaagagaccatttataacttggttaaagaatgcccagctgttgctgttcatgacttt

SEQ ID NO: 318734 - DNA, 75 bp, Artificial Sequence
  Synthetic
accattttcgtgagttaggagttgtacataatcaggatgtaaacttacatagctcgcgtctcagttttaaggaac

SEQ ID NO: 318735 - DNA, 75 bp, Artificial Sequence
  Synthetic
taaatactttgattgttacgatggtggctgtattaatgccaaccaagtaatcgttaacaatctggacaaatcagc

SEQ ID NO: 318736 - DNA, 75 bp, Artificial Sequence
  Synthetic
tcgttaacaatctggacaaatcagctggtttcccatttaataaatggggtaaggctagactttattatgactcaa

SEQ ID NO: 318737 - DNA, 75 bp, Artificial Sequence
  Synthetic
atggtgttccttttgttgtttcaactggataccattttcgtgagttaggagtcgtacataatcaggatgtaaact

SEQ ID NO: 318738 - DNA, 75 bp, Artificial Sequence
  Synthetic
acttacatagctcacgccttagctttaaggaacttttagtgtatgctgccgatcctgctatgcacgctgcatctg

SEQ ID NO: 318739 - DNA, 75 bp, Artificial Sequence
  Synthetic
tagcattaagaactttaaggcagttctttattatcaaaataatgtgttcatgtctgaggcaaaatgttggactga

SEQ ID NO: 318740 - DNA, 75 bp, Artificial Sequence
  Synthetic
gaagactgtgcaattctgcgatgctatgcgtgatgcgggtatcgtaggtgtactgacactagataatcaggatct

SEQ ID NO: 318741 - DNA, 75 bp, Artificial Sequence
  Synthetic
tcgatgatattgtcaaaacagatggtacacttatgattgagaggtttgtgtcattagctattgatgcctaccccc

SEQ ID NO: 318742 - DNA, 75 bp, Artificial Sequence
  Synthetic
aacacctcacggtattgggaacctgagttttatgaagctatgtacacaccacacacagtcttgcaggctgtaggt

SEQ ID NO: 318743 - DNA, 75 bp, Artificial Sequence
  Synthetic
aggcaaaatgctggactgagactgaccttaccaaaggacctcacgaattttgctcacagcatacaatgctagtta

SEQ ID NO: 318744 - DNA, 75 bp, Artificial Sequence
  Synthetic
attagttttccattgtgtgctaatggtcaggtttttggtttatacaagaacacatgtgtaggtagtgacaatgtc

SEQ ID NO: 318745 - DNA, 75 bp, Artificial Sequence
  Synthetic
agactcaaactctttgcagcagaaacactcaaagctactgaggaaacattcaagctgtcatatggtattgccact

SEQ ID NO: 318746 - DNA, 75 bp, Artificial Sequence
  Synthetic
aattgcatctttcatgggaggttggaaaacctagaccaccattgaatagaaattatgtctttactggttaccgtg

SEQ ID NO: 318747 - DNA, 75 bp, Artificial Sequence
  Synthetic
atctaggaggtatgagctattactgcaagtcacataagcctcccattagttttccattgtgtgctaatggtcagg

SEQ ID NO: 318748 - DNA, 75 bp, Artificial Sequence
  Synthetic
gctagcatcaagaactttaaagcagttctttattaccaaaacaatgtgtttatgtctgaggcaaaatgctggact

SEQ ID NO: 318749 - DNA, 75 bp, Artificial Sequence
  Synthetic
caagaatactaggcgcaggctgttttgttgatgatatcgtcaaaacagatggtacacttatgattgaaaggtttg

SEQ ID NO: 318750 - DNA, 75 bp, Artificial Sequence
  Synthetic
tgctctctactacccatctgctcgcatagtgtatacagcttgctcccatgcagctgttgatgccctatgcgaaaa

SEQ ID NO: 318751 - DNA, 75 bp, Artificial Sequence
  Synthetic
gattagctaatgagtgtgcacaggtattaagtgagatggtcatgtgtggcggctcattatatgtgaaaccaggtg

SEQ ID NO: 318752 - DNA, 75 bp, Artificial Sequence
  Synthetic
ccacatacagtcttgcaggctgtaggtgcatgtgtattgtgtaactcacagacttcacttcgttgcggtgcatgc

SEQ ID NO: 318753 - DNA, 75 bp, Artificial Sequence
  Synthetic
tcaatgctagacttcgtgcaaaacactacgtctatattggcgatcctgctcaattaccagccccgcgcacattgc

SEQ ID NO: 318754 - DNA, 75 bp, Artificial Sequence
  Synthetic
agtgctgctatgatcatgttatttcaacatcccataaattagtgctgtctgttaatccctatgtttgcaatgccc

SEQ ID NO: 318755 - DNA, 75 bp, Artificial Sequence
  Synthetic
aacatcccataaattagtgctgtctgttaatccctatgtttgcaatgccccaggttgtgatgttactgatgtaac

SEQ ID NO: 318756 - DNA, 75 bp, Artificial Sequence
  Synthetic
tactactgcaagtcacataaacctcccattagtttcccattgtgtgctaatggtcaggtttttggtttatataag

SEQ ID NO: 318757 - DNA, 75 bp, Artificial Sequence
  Synthetic
cagaaacaactgctgatattgtagtctttgatgaaatttctatggctactaattatgatttgagtgttgtcaatg

SEQ ID NO: 318758 - DNA, 75 bp, Artificial Sequence
  Synthetic
ggggaccaagacctaatcagacaaggaactgattacaaacattggccgcaaattgcacaatttgctccaagtgcc

SEQ ID NO: 318759 - DNA, 75 bp, Artificial Sequence
  Synthetic
cctacgcagactgtcgattcctcccagggttctgagtatgactatgtcatattcacacaaactactgaaacagca

SEQ ID NO: 318760 - DNA, 75 bp, Artificial Sequence
  Synthetic
aattgtcgacactgtgagtgctttagtttatgacaataagctaaaggcacacaaggagaagtcagctcaatgctt

SEQ ID NO: 318761 - DNA, 75 bp, Artificial Sequence
  Synthetic
tggcattttgtgcataatgtccgatagagatctttatgacaaactgcaattcacaagtctagaagtaccacgccg

SEQ ID NO: 318762 - DNA, 75 bp, Artificial Sequence
  Synthetic
tccaacacaggcacctacacacctcagcgttgatacaaaatttaagactgagggactatgtgttgacataccagg

SEQ ID NO: 318763 - DNA, 75 bp, Artificial Sequence
  Synthetic
ttcaaaaatcttaggattgcctacgcagactgttgattcctcacagggttctgagtatgactatgtcatattcac

SEQ ID NO: 318764 - DNA, 75 bp, Artificial Sequence
  Synthetic
actaacctacctctccagctaggattttctacaggtgttaacttagtagctgtaccgactggctatgttgacact

SEQ ID NO: 318765 - DNA, 75 bp, Artificial Sequence
  Synthetic
ggctacattacaggcagaaaatgtaactggactttttaaggattgtagtaagatcattactggtctacatccaac

SEQ ID NO: 318766 - DNA, 75 bp, Artificial Sequence
  Synthetic
aaaaacagtaaagtacagattggagagtacacctttgaaaaaggtgactatggtgatgctgttgtgtacagaggt

SEQ ID NO: 318767 - DNA, 75 bp, Artificial Sequence
  Synthetic
aatacagaattcaccagagttaatgcaaaacctccaccaggtgatcaatttaaacatcttataccactcatgtac

SEQ ID NO: 318768 - DNA, 75 bp, Artificial Sequence
  Synthetic
gttgtaagggagtttcttacgcgcaaccctgcttggagaaaagctgtttttatttcaccatacaattcacagaat

SEQ ID NO: 318769 - DNA, 75 bp, Artificial Sequence
  Synthetic
ttgttaagcgcgttgattggtctgttgaataccccattataggagatgaactgaagattaattccgcttgcagaa

SEQ ID NO: 318770 - DNA, 75 bp, Artificial Sequence
  Synthetic
catgcaactagagatgctgtgggtactaacctacctctccagctaggattttctacaggtgttaacttagtagct

SEQ ID NO: 318771 - DNA, 75 bp, Artificial Sequence
  Synthetic
ggaagtagaatggaagttctatgatgctcagccatgcagtgacaaagcctataaaatagaggaacttttctattc

SEQ ID NO: 318772 - DNA, 75 bp, Artificial Sequence
  Synthetic
ttgtgatgctatcatgactagatgcttggcagtccatgagtgctttgttaagcgcgttgattggtctgttgaata

SEQ ID NO: 318773 - DNA, 75 bp, Artificial Sequence
  Synthetic
catcctacacaggcaccgacacacctcagtgttgatactaaattcaaaactgaaggcctttgtgtcgacatacca

SEQ ID NO: 318774 - DNA, 75 bp, Artificial Sequence
  Synthetic
gcagactcatctctatgatgggttttaaaatgaactaccaagtaaatggttaccctaacatgtttatcacccgcg

SEQ ID NO: 318775 - DNA, 75 bp, Artificial Sequence
  Synthetic
taaaatgaactaccaagtaaatggttaccctaacatgtttatcacccgcgaggaagccattcgtcacgttcgtgc

SEQ ID NO: 318776 - DNA, 75 bp, Artificial Sequence
  Synthetic
tgtcatgcgaccagagatgctgtaggaacaaacctgccactccagttagggttttcaacaggtgttaatctagta

SEQ ID NO: 318777 - DNA, 75 bp, Artificial Sequence
  Synthetic
gttttcaacaggtgttaatctagtagcagtaccaaccggctacgttgacaccgaaaataacacagagttcaccag

SEQ ID NO: 318778 - DNA, 75 bp, Artificial Sequence
  Synthetic
gagaatttcttacgcgcaaccctgcttggagaaaagctgtttttatttcaccatataattcacagaatgcagtgg

SEQ ID NO: 318779 - DNA, 75 bp, Artificial Sequence
  Synthetic
tgacaaacgtgcaacttgcttctctacttcatctgacacttatgcttgctggaaccactctgtgggttttgacta

SEQ ID NO: 318780 - DNA, 75 bp, Artificial Sequence
  Synthetic
tacgtgtataacacgatgcaatttgggaggtgctgtttgcaggcatcatgcaaatgagtaccgccagtacttaga

SEQ ID NO: 318781 - DNA, 75 bp, Artificial Sequence
  Synthetic
agagattaagatactcaataacttgggtgtcgatatcgctgctaatactgtggtctgggactacaagagagaagc

SEQ ID NO: 318782 - DNA, 75 bp, Artificial Sequence
  Synthetic
tgatactaaattcaaaactgaaggactttgtgtcgacataccaggaataccaaaggacatgacctaccgtagact

SEQ ID NO: 318783 - DNA, 75 bp, Artificial Sequence
  Synthetic
gtctgcacaatgaccgacattgctaagaaacctactgagagtgcttgttcctcgcttactgtcttatttgatggt

SEQ ID NO: 318784 - DNA, 75 bp, Artificial Sequence
  Synthetic
ctttgttaagcgcgttgactggtctgttgaatacccgattattggagatgaactgaagatcaacgcggcatgcag

SEQ ID NO: 318785 - DNA, 75 bp, Artificial Sequence
  Synthetic
tctgcattgcttgctgacaagttcccagttcttcatgatataggaaatccaaaggctattaaatgtgtaccgcag

SEQ ID NO: 318786 - DNA, 75 bp, Artificial Sequence
  Synthetic
cagttcttcatgatataggaaatccaaaggctattaaatgtgtaccgcaggctgatgtagaatggaagttctacg

SEQ ID NO: 318787 - DNA, 75 bp, Artificial Sequence
  Synthetic
tggtgagtacaaccatgttgttgctgctaatgcacttttgtttttgatgtctttcactatactctgtctggcacc

SEQ ID NO: 318788 - DNA, 75 bp, Artificial Sequence
  Synthetic
ttacaagatagaagaactcttctattcctatgctacccaccatgataaattcactgatggtgtttgcttgttttg

SEQ ID NO: 318789 - DNA, 75 bp, Artificial Sequence
  Synthetic
tcctatgctacccaccatgataaattcactgatggtgtttgcttgttttggaactgtaacgttgatcgttaccct

SEQ ID NO: 318790 - DNA, 75 bp, Artificial Sequence
  Synthetic
atacaagagtcttatctaacttaaatctacctggttgtgatggcggtagtctgtatgttaacaaacatgcgttcc

SEQ ID NO: 318791 - DNA, 75 bp, Artificial Sequence
  Synthetic
ctttatccctatggatagcacagtgaaaaattacttcataacagatgcacaaacaggttcatcaaaatgtgtgtg

SEQ ID NO: 318792 - DNA, 75 bp, Artificial Sequence
  Synthetic
ttttgctaatcttaaacaattgccctttttctactattcggatagtccctgtgagtctcatggcaaacaggtggt

SEQ ID NO: 318793 - DNA, 75 bp, Artificial Sequence
  Synthetic
tttttctactattcggatagtccctgtgagtctcatggcaaacaggtggtgtcagacattgattatgtcccgctc

SEQ ID NO: 318794 - DNA, 75 bp, Artificial Sequence
  Synthetic
aggatttgtcagtaatttctaaggtagtcaaggttacaattgactacgctgagatttcattcatgctttggtgta

SEQ ID NO: 318795 - DNA, 75 bp, Artificial Sequence
  Synthetic
agtcaaggttacaattgactacgctgagatttcattcatgctttggtgtaaagatggacacgttgaaaccttcta

SEQ ID NO: 318796 - DNA, 75 bp, Artificial Sequence
  Synthetic
gcaacttgggtggagctgtttgcagacatcatgcaaatgagtatagacagtacttagatgcatataacatgatga

SEQ ID NO: 318797 - DNA, 75 bp, Artificial Sequence
  Synthetic
acatcatgcaaatgagtatagacagtacttagatgcatataacatgatgatttctgctggctttagcctctggat

SEQ ID NO: 318798 - DNA, 75 bp, Artificial Sequence
  Synthetic
gagggttatgccttcgaacatatcgtttatggggatttcagtcatggacaacttggcggccttcatttaatgatt

SEQ ID NO: 318799 - DNA, 75 bp, Artificial Sequence
  Synthetic
tggcaaccgggggttgcaatgcctaacttgtacaagatgcaaagaatgcttcttgaaaagtgtgaccttcagaat

SEQ ID NO: 318800 - DNA, 75 bp, Artificial Sequence
  Synthetic
tcttgaaaagtgtgaccttcagaattatggtgaaaatgctgtcataccaaaaggaataatgatgaatgtcgcaaa

SEQ ID NO: 318801 - DNA, 75 bp, Artificial Sequence
  Synthetic
ctgtggaacacgtttaccaggttacagagcttagaaaatgtggcttataatgttattaataaaggacactttgat

SEQ ID NO: 318802 - DNA, 75 bp, Artificial Sequence
  Synthetic
agagcttagaaaatgtggcttataatgttattaataaaggacactttgatggacagactggtgaaacacctgtgt

SEQ ID NO: 318803 - DNA, 75 bp, Artificial Sequence
  Synthetic
taaagtagatggcaatgatgtggaaatctttgaaaataagacaacacttcctgttaatgttgcatttgagctatg

SEQ ID NO: 318804 - DNA, 75 bp, Artificial Sequence
  Synthetic
gttgagataataaagtcacaggatttgtcagtagtctctaaggtagtcaaggttacaattgattacgctgagatt

SEQ ID NO: 318805 - DNA, 75 bp, Artificial Sequence
  Synthetic
ccaggtacagctgtactcagacaatggttgccaactggcacactacttgtcgattcagaccttaatgacttcgtc

SEQ ID NO: 318806 - DNA, 75 bp, Artificial Sequence
  Synthetic
ggttacaattgattacgctgagatttcattcatgctctggtgtaaggatggacatgttgaaaccttctacccaaa

SEQ ID NO: 318807 - DNA, 75 bp, Artificial Sequence
  Synthetic
ggttgccaactggcacactacttgtcgattcagaccttaatgacttcgtctctgacgcggattctactttaattg

SEQ ID NO: 318808 - DNA, 75 bp, Artificial Sequence
  Synthetic
atgtgacaaaagagaacgactcaaaagaagggtttttcacttacctgtgtggatttataaagcaaaagctagcct

SEQ ID NO: 318809 - DNA, 75 bp, Artificial Sequence
  Synthetic
tcatcacttactgtcttgtttgatggtagagttgagggacaggtagacctttttagaaacgcccgtaacggtgtt

SEQ ID NO: 318810 - DNA, 75 bp, Artificial Sequence
  Synthetic
gaatggaagttctacgatgctcagccatgtagtgacaaagcttacaaaatagaggaactcttctattcttatgct

SEQ ID NO: 318811 - DNA, 75 bp, Artificial Sequence
  Synthetic
ctttacaagcttatgggacacttctcatggtggacagcttttgttacaaatgtaaatgcatcatcatcagaagca

SEQ ID NO: 318812 - DNA, 75 bp, Artificial Sequence
  Synthetic
acaagctagtgtcaatggagtcacattaattggagaatcagtaaaaacacagtttaattatttcaagaaagtgga

SEQ ID NO: 318813 - DNA, 75 bp, Artificial Sequence
  Synthetic
cggcattatccaacaattgccggaaacctactttactcaaagcagggacttagaggattttaagcccaggtcaca

SEQ ID NO: 318814 - DNA, 75 bp, Artificial Sequence
  Synthetic
ggcaaccaggtgttgcgatgcctaacttgtacaagatgcaaagaatgcttcttgaaaagtgtgaccttcagaatt

SEQ ID NO: 318815 - DNA, 75 bp, Artificial Sequence
  Synthetic
caactggcacactacttgttgattcagaccttaatgacttcgtctctgacgcagattctactttaattggagact

SEQ ID NO: 318816 - DNA, 75 bp, Artificial Sequence
  Synthetic
ttttggaggaacacaaatcctattcaattgtcttcctattcactttttgacatgagcaagtttcctctcaaatta

SEQ ID NO: 318817 - DNA, 75 bp, Artificial Sequence
  Synthetic
aggagaatcagatcaatgacatgatttattctctacttgagaaaggtagacttatcattagagagagtaacaaag

SEQ ID NO: 318818 - DNA, 75 bp, Artificial Sequence
  Synthetic
gttacaattgactatgctgaaatttcattcatgctttggtgtaaggatggacatgttgaaaccttctacccaaaa

SEQ ID NO: 318819 - DNA, 75 bp, Artificial Sequence
  Synthetic
ataaaacaaaaactagccctgggtggttctgtagctgtaaagataacagagcattcttggaacgctgatctttac

SEQ ID NO: 318820 - DNA, 75 bp, Artificial Sequence
  Synthetic
ttattctctacttgagaaaggtagacttatcattagagagagtaacaaagttgtggtgtctagtgatattttagt

SEQ ID NO: 318821 - DNA, 75 bp, Artificial Sequence
  Synthetic
gattttatccctatggatagcacagtgaaaaattactttataacagacgctcgaacaggttcatcaaaatgtgtt

SEQ ID NO: 318822 - DNA, 75 bp, Artificial Sequence
  Synthetic
ttagttttagtttttgctactctagtctcctcttacactatagagaagtgccttgattttgatgaccgcactcca

SEQ ID NO: 318823 - DNA, 75 bp, Artificial Sequence
  Synthetic
tcgaacaggttcatcaaaatgtgtttgctctgttattgaccttctacttgatgactttgttgaaataataaagtc

SEQ ID NO: 318824 - DNA, 75 bp, Artificial Sequence
  Synthetic
tctcctcttacactatagagaagtgccttgattttgatgaccgcactccacctgcaaatactcaatttttatctt

SEQ ID NO: 318825 - DNA, 75 bp, Artificial Sequence
  Synthetic
caaaggaacaaattgatggctataccatgcatgctaactacatcttttggaggaacacaaatcctattcaattgt

SEQ ID NO: 318826 - DNA, 75 bp, Artificial Sequence
  Synthetic
catgcatgctaactacatcttttggaggaacacaaatcctattcaattgtcttcctattcactattcgacatgag

SEQ ID NO: 318827 - DNA, 75 bp, Artificial Sequence
  Synthetic
tgacatttttaggtctaatgtcttgcatttagtacaagatcatttcctaccttttgactctaacgtcaccaggtt

SEQ ID NO: 318828 - DNA, 75 bp, Artificial Sequence
  Synthetic
catttagtacaagatcatttcctaccttttgactctaacgtcaccaggtttataacgtttggcctaaattttgat

SEQ ID NO: 318829 - DNA, 75 bp, Artificial Sequence
  Synthetic
aggaacacaaatcctattcaattgtcttcctattcactattcgacatgagcaaattccctcttaaattaaggggg

SEQ ID NO: 318830 - DNA, 75 bp, Artificial Sequence
  Synthetic
gtatttattttgctgcgactgaaaagtctaatgttattagaggatgggtttttggttctacaatgaacaacaaat

SEQ ID NO: 318831 - DNA, 75 bp, Artificial Sequence
  Synthetic
atcaaatcaatgatatgatttattccctgctagaaaaaggtagacttatcattagggaaaacaacagagttgtgg

SEQ ID NO: 318832 - DNA, 75 bp, Artificial Sequence
  Synthetic
gtctaatgttattagaggatgggtttttggttctacaatgaacaacaaatctcaatccgttataataatgaacaa

SEQ ID NO: 318833 - DNA, 75 bp, Artificial Sequence
  Synthetic
aaatatactcaactgtgtcagtacttaaatacacttacattagctgtgccttacaacatgagagttatacacttt

SEQ ID NO: 318834 - DNA, 75 bp, Artificial Sequence
  Synthetic
tgtaattttgagttgtgtgacaatccattttttgttgtgttgaaatctaacaacactcaaataccatcttacata

SEQ ID NO: 318835 - DNA, 75 bp, Artificial Sequence
  Synthetic
cattttttgttgtgttgaaatctaacaacactcaaataccatcttacatatttaataatgcattcaattgcacat

SEQ ID NO: 318836 - DNA, 75 bp, Artificial Sequence
  Synthetic
aagcacaagaaggatgtggcattatcagtcgaaaacctcagccaaaaatggcacaagtctcttcttctcgtagag

SEQ ID NO: 318837 - DNA, 75 bp, Artificial Sequence
  Synthetic
cctagaccttggtgaaaaaccaggtaatttcaaggatctcagagagtttgttttcaggaataaagatggtttttt

SEQ ID NO: 318838 - DNA, 75 bp, Artificial Sequence
  Synthetic
tcgttctaatgtactacacctgacgcaggattatttcctgccatttgattcaaatttaacacagtacttttctct

SEQ ID NO: 318839 - DNA, 75 bp, Artificial Sequence
  Synthetic
aatttcaaggatctcagagagtttgttttcaggaataaagatggttttttgcatgtttattccggttaccaaccc

SEQ ID NO: 318840 - DNA, 75 bp, Artificial Sequence
  Synthetic
caggattatttcctgccatttgattcaaatttaacacagtacttttctcttaatgttgattcagataggtttacc

SEQ ID NO: 318841 - DNA, 75 bp, Artificial Sequence
  Synthetic
ctggttttaatgcactcaaacctattttcaagttacctctgggtattaatattactaatttcagaacacttctga

SEQ ID NO: 318842 - DNA, 75 bp, Artificial Sequence
  Synthetic
ttggtgacggcgtctacttcgctgctactgaaaagtctaatgtaattaggggctggatttttggttccactttcg

SEQ ID NO: 318843 - DNA, 75 bp, Artificial Sequence
  Synthetic
attactaatttcagaacacttctgactgcttttccgcctagacctgattattggggtacttcagctgcagcttat

SEQ ID NO: 318844 - DNA, 75 bp, Artificial Sequence
  Synthetic
tactgaaaagtctaatgtaattaggggctggatttttggttccactttcgataacacaacccagtcagctgttat

SEQ ID NO: 318845 - DNA, 75 bp, Artificial Sequence
  Synthetic
atacgtgtgtgcaacttcaacttatgtaaagaacctatgtatacagtgtctcgtggtgcacaacaatcatcttgg

SEQ ID NO: 318846 - DNA, 75 bp, Artificial Sequence
  Synthetic
atctctacaagcttatgggacatttctcatggtggactgcttttgttacaaatgttaatgcatcgtcatccgaag

SEQ ID NO: 318847 - DNA, 75 bp, Artificial Sequence
  Synthetic
gtaaagaacctatgtatacagtgtctcgtggtgcacaacaatcatcttgggtttatcagagtgcattcaattgca

SEQ ID NO: 318848 - DNA, 75 bp, Artificial Sequence
  Synthetic
tgttctcaaaatccacttgctgaactcaaatgctctgttaaaagttttgagattgacaaaggaatttatcaaacc

SEQ ID NO: 318849 - DNA, 75 bp, Artificial Sequence
  Synthetic
tggcaagccaaaagaacaaattgacggctataccatgcatgctaactacatcttctggaggaacacaaaccccat

SEQ ID NO: 318850 - DNA, 75 bp, Artificial Sequence
  Synthetic
tcagctcgacactgctcctaaaactggaaattttaaagacctacgtgagtatgtctttaagaatcgggatggctt

SEQ ID NO: 318851 - DNA, 75 bp, Artificial Sequence
  Synthetic
ggaaattttaaagacctacgtgagtatgtctttaagaatcgggatggctttctcagtgtttaccaaacttataca

SEQ ID NO: 318852 - DNA, 75 bp, Artificial Sequence
  Synthetic
aggaagttgtgaggttccctaatattacaaacctgtgtccttttggagaggtttttaatgctactacatttcctt

SEQ ID NO: 318853 - DNA, 75 bp, Artificial Sequence
  Synthetic
gacatgagcaaatttcctcttaaattaagaggaactgctgtcatgtctctaaaagagaatcaaatcaatgatatg

SEQ ID NO: 318854 - DNA, 75 bp, Artificial Sequence
  Synthetic
ctattggcttttcagttttgaggccaattctcaaactgccctttggaattaacattacatcttatagagttgtta

SEQ ID NO: 318855 - DNA, 75 bp, Artificial Sequence
  Synthetic
aatttcaaattgtgttgctgattactctgtactctacaactcaacatctttttcaacttttaagtgttacggcgt

SEQ ID NO: 318856 - DNA, 75 bp, Artificial Sequence
  Synthetic
aattctcaaactgccctttggaattaacattacatcttatagagttgttatggctatgtttagccaaactacttc

SEQ ID NO: 318857 - DNA, 75 bp, Artificial Sequence
  Synthetic
agttgtggtctcaagtgatattcttgttaataactaaacgaacatgattttacttcttcttttcctttcttccgc

SEQ ID NO: 318858 - DNA, 75 bp, Artificial Sequence
  Synthetic
tattatgttggtaatttaaaatacaccactttcatgcttagttttaatgaaaatgggactattaccaatgctatt

SEQ ID NO: 318859 - DNA, 75 bp, Artificial Sequence
  Synthetic
catttgtagtcaaaggagacgatgtaaggcaaatagcaccaggacagaccggtgttattgctgattataattaca

SEQ ID NO: 318860 - DNA, 75 bp, Artificial Sequence
  Synthetic
atctccaataagccacaacgcacatttgaccagtactcctccacttttagaggggtttactataatgatgacatt

SEQ ID NO: 318861 - DNA, 75 bp, Artificial Sequence
  Synthetic
ttgaccagtactcctccacttttagaggggtttactataatgatgacatttttaggtcagacgtgctacatttga

SEQ ID NO: 318862 - DNA, 75 bp, Artificial Sequence
  Synthetic
ccactttcatgcttagttttaatgaaaatgggactattaccaatgctattgattgtgctcaaaacccacttgctg

SEQ ID NO: 318863 - DNA, 75 bp, Artificial Sequence
  Synthetic
caatgtcagcaagggaatctaccaaacatctaacttcagagtttcgccaactcaggaagttattagattcccaaa

SEQ ID NO: 318864 - DNA, 75 bp, Artificial Sequence
  Synthetic
attgatgctactcaaactggtaattataattataaatatagatctctcagacatggcaagcttaggccttttgag

SEQ ID NO: 318865 - DNA, 75 bp, Artificial Sequence
  Synthetic
cactaatgttactaggtatttgtctctgaatgcggcacaaaatactatagtctactttgacaatcatgtaatacc

SEQ ID NO: 318866 - DNA, 75 bp, Artificial Sequence
  Synthetic
ctgaatgcggcacaaaatactatagtctactttgacaatcatgtaatacctttctacgacggtatttactttgct

SEQ ID NO: 318867 - DNA, 75 bp, Artificial Sequence
  Synthetic
acatctaacttcagagtttcgccaactcaggaagttattagattcccaaacattacaaatcgttgtccttttgac

SEQ ID NO: 318868 - DNA, 75 bp, Artificial Sequence
  Synthetic
ctaatgtgtatgcgtgggagagaactaaaatttctgattgtgttgctgactacactgttctctacaactcaactt

SEQ ID NO: 318869 - DNA, 75 bp, Artificial Sequence
  Synthetic
taaaatttctgattgtgttgctgactacactgttctctacaactcaacttctttctcaacttttaagtgctatgg

SEQ ID NO: 318870 - DNA, 75 bp, Artificial Sequence
  Synthetic
gcggctggattttcggttcaacttttgacaaccgatcacagtctgccattatagtgaacaattctacacacattt

SEQ ID NO: 318871 - DNA, 75 bp, Artificial Sequence
  Synthetic
ctaatggcataggctaccaaccttatagagttgtagttctttcttttgaacttctaaatgcacctgctacggttt

SEQ ID NO: 318872 - DNA, 75 bp, Artificial Sequence
  Synthetic
tgacaaccgatcacagtctgccattatagtgaacaattctacacacattttagttaaggtgtgtaattttgtttt

SEQ ID NO: 318873 - DNA, 75 bp, Artificial Sequence
  Synthetic
ttatgctttacaagtgtgtatgctgacacattcttgataagatcttcagaagtaagacaagttgcaccgggtgaa

SEQ ID NO: 318874 - DNA, 75 bp, Artificial Sequence
  Synthetic
acacattcttgataagatcttcagaagtaagacaagttgcaccgggtgaaactggtgtcattgctgactataatt

SEQ ID NO: 318875 - DNA, 75 bp, Artificial Sequence
  Synthetic
tctcgtaatcagcattacaaatcatgggtttatcaacatgctagaaattgcacctatgatgttgcttatcctagt

SEQ ID NO: 318876 - DNA, 75 bp, Artificial Sequence
  Synthetic
gggtttatcaacatgctagaaattgcacctatgatgttgcttatcctagttttcaattagatgtctctctaaaga

SEQ ID NO: 318877 - DNA, 75 bp, Artificial Sequence
  Synthetic
ttgcgtaatagcctggaatactgcaaagcaggatcaaggtcagtattactacaggtctcaccggaagactaaact

SEQ ID NO: 318878 - DNA, 75 bp, Artificial Sequence
  Synthetic
atttcaaccatttcaacaatttggtcgtgatgtttcggatttcactgattcagttcgagatccgaagacgtctga

SEQ ID NO: 318879 - DNA, 75 bp, Artificial Sequence
  Synthetic
ggagttcatttttaaaaatgtggatggcttcctaaagatttattcttcttatgagcccatcaatgttgttagtgg

SEQ ID NO: 318880 - DNA, 75 bp, Artificial Sequence
  Synthetic
ggcttcctaaagatttattcttcttatgagcccatcaatgttgttagtggcatacctagtggcttttcagtactt

SEQ ID NO: 318881 - DNA, 75 bp, Artificial Sequence
  Synthetic
tttggcggtgtaagtgtaatcacacctggaacaaatacttcatcagaagttgctgttctatatcaagatgttaac

SEQ ID NO: 318882 - DNA, 75 bp, Artificial Sequence
  Synthetic
ttagtacttacgacttctaccctagtgtgccggttgcttatcaggctactagggtggttgtactgtcatttgaac

SEQ ID NO: 318883 - DNA, 75 bp, Artificial Sequence
  Synthetic
tgctgttctatatcaagatgttaactgcactgatgttcctgtagcaatccatgcagaccaactcacaccttcttg

SEQ ID NO: 318884 - DNA, 75 bp, Artificial Sequence
  Synthetic
gtattaatattactggcatgcgtgttgttatgactatgtttagcaacacgcaagctaattttcttacagaaaatg

SEQ ID NO: 318885 - DNA, 75 bp, Artificial Sequence
  Synthetic
tgttatgactatgtttagcaacacgcaagctaattttcttacagaaaatgctgcatactatgtaggctatctcaa

SEQ ID NO: 318886 - DNA, 75 bp, Artificial Sequence
  Synthetic
aagcaggatcaaggtcagtattactacaggtctcaccggaagactaaacttaaaccttttgagagagacctttct

SEQ ID NO: 318887 - DNA, 75 bp, Artificial Sequence
  Synthetic
gttaagaaccagtgtgtcaattttaattttaatggactcaaaggtactggtgttttgactgaatcatcaaagaga

SEQ ID NO: 318888 - DNA, 75 bp, Artificial Sequence
  Synthetic
tgtgccggttgcttatcaggctactagggtggttgtactgtcatttgaactactaaacgcacctgcaacagtttg

SEQ ID NO: 318889 - DNA, 75 bp, Artificial Sequence
  Synthetic
aataccaatggcaccatcgttaatgccgttgattgttctcaagatccactttcggagttaaaatgcacactcaaa

SEQ ID NO: 318890 - DNA, 75 bp, Artificial Sequence
  Synthetic
tgttttgactgaatcatcaaagagatttcagtcatttcaacaatttggtcgtgacacgtctgattttactgactc

SEQ ID NO: 318891 - DNA, 75 bp, Artificial Sequence
  Synthetic
ccgttgattgttctcaagatccactttcggagttaaaatgcacactcaaaaattttaacatcactaaaggaatct

SEQ ID NO: 318892 - DNA, 75 bp, Artificial Sequence
  Synthetic
accaacgcaagaagttgttagattcccaaacattacaaaccgttgtccatttgacaaggtttttaatgctacgcg

SEQ ID NO: 318893 - DNA, 75 bp, Artificial Sequence
  Synthetic
ccaaacattacaaaccgttgtccatttgacaaggtttttaatgctacgcgctttccttctgtgtatgcgtgggag

SEQ ID NO: 318894 - DNA, 75 bp, Artificial Sequence
  Synthetic
tgcagatcaactaacaccagcttggcgtgtttattcaactggaacaaatgttttccaaacacaggctggctgtct

SEQ ID NO: 318895 - DNA, 75 bp, Artificial Sequence
  Synthetic
cggattacaccgttctctacaactctacgtctttctcaactttcaagtgttatggagtttctccttctaagttga

SEQ ID NO: 318896 - DNA, 75 bp, Artificial Sequence
  Synthetic
tacgtctttctcaactttcaagtgttatggagtttctccttctaagttgattgatctttgcttcacaagtgtgta

SEQ ID NO: 318897 - DNA, 75 bp, Artificial Sequence
  Synthetic
tcgtatgagtgtgacatccctattggtgctggcatttgtgctagctaccatacagcttctactttacgtagtgta

SEQ ID NO: 318898 - DNA, 75 bp, Artificial Sequence
  Synthetic
tcagaagtgagacaagttgcaccgggtgaaactggtgttattgctgactataattataaactgcctgatgatttt

SEQ ID NO: 318899 - DNA, 75 bp, Artificial Sequence
  Synthetic
gtgaaactggtgttattgctgactataattataaactgcctgatgattttacaggctgtgtaatagcttggaaca

SEQ ID NO: 318900 - DNA, 75 bp, Artificial Sequence
  Synthetic
ttattataggtcttctagaaaggaaaaactcaaaccttttgagagggatttgtcatcagatgaaaatggtgtgta

SEQ ID NO: 318901 - DNA, 75 bp, Artificial Sequence
  Synthetic
aaactcaaaccttttgagagggatttgtcatcagatgaaaatggtgtgtatactcttagtacttatgacttttac

SEQ ID NO: 318902 - DNA, 75 bp, Artificial Sequence
  Synthetic
ctttggagtgcagcaacctactcttgcagtatggaagtttctgcacacaactaaatcgtgcactctcaggtattg

SEQ ID NO: 318903 - DNA, 75 bp, Artificial Sequence
  Synthetic
ttattatgttggtaatcttaaatattctaccttcatgctccgatttaatgaaaatgggacgatcacggatgctgt

SEQ ID NO: 318904 - DNA, 75 bp, Artificial Sequence
  Synthetic
ctactagggtagttgtcctttcatttgagcttcttaatgcacctgcaacagtgtgtggacctaaactatccacaa

SEQ ID NO: 318905 - DNA, 75 bp, Artificial Sequence
  Synthetic
agaagtttttgcccaagttaaacaaatgtataagacaccagccataaaagattttggcggtttcaatttttcaca

SEQ ID NO: 318906 - DNA, 75 bp, Artificial Sequence
  Synthetic
tgagcttcttaatgcacctgcaacagtgtgtggacctaaactatccacaacactagtaaagaatcagtgtgttaa

SEQ ID NO: 318907 - DNA, 75 bp, Artificial Sequence
  Synthetic
actggtgtgttgactgcctcttctaagaagtttcagtcttttcaacaatttggcagagatgcgtctgacttcact

SEQ ID NO: 318908 - DNA, 75 bp, Artificial Sequence
  Synthetic
aaacaaatcgccaatcaatttaacaaggcgatcagccaaattcaagaatcactcacaacaacatccactgcattg

SEQ ID NO: 318909 - DNA, 75 bp, Artificial Sequence
  Synthetic
tactcttcaacaaggtgactcttgctgatgccggctttatgaaacaatacggcgaatgcctaggcgatattagtg

SEQ ID NO: 318910 - DNA, 75 bp, Artificial Sequence
  Synthetic
agaagtttcagtcttttcaacaatttggcagagatgcgtctgacttcactgattcagtacgcgaccctcaaacac

SEQ ID NO: 318911 - DNA, 75 bp, Artificial Sequence
  Synthetic
ttcattcggtggtgtgagtgtaattacacctggaacaaatgcttctacagaagtggctgttctataccaagatgt

SEQ ID NO: 318912 - DNA, 75 bp, Artificial Sequence
  Synthetic
caaaaatctctgattgtgttgctgactacactgttctctacaactcaacctctttctcgacttttaaatgttatg

SEQ ID NO: 318913 - DNA, 75 bp, Artificial Sequence
  Synthetic
acacctggaacaaatgcttctacagaagtggctgttctataccaagatgtaaactgcactgatgttccaacagca

SEQ ID NO: 318914 - DNA, 75 bp, Artificial Sequence
  Synthetic
cctggcgcgtttattccactggaataaatgtgtttcaaacccaagctggctgtctcataggagctgaacatgtca

SEQ ID NO: 318915 - DNA, 75 bp, Artificial Sequence
  Synthetic
aaatgtgtttcaaacccaagctggctgtctcataggagctgaacatgtcaatgcttcttatgagtgtgacattcc

SEQ ID NO: 318916 - DNA, 75 bp, Artificial Sequence
  Synthetic
aacagattgccaaccaattcaacaaggcaatcagtcaaattcaagaatcacttacgacaacatcaactgcattgg

SEQ ID NO: 318917 - DNA, 75 bp, Artificial Sequence
  Synthetic
taccatacagcttcagttttgcgcagtacaggccagaaatcaattgtggcttatactatgtcactaggtgcagaa

SEQ ID NO: 318918 - DNA, 75 bp, Artificial Sequence
  Synthetic
aattcaattgcttatgctaataactcaattgccatacctacgaatttttcaatcagcgtcacgactgaagtgatg

SEQ ID NO: 318919 - DNA, 75 bp, Artificial Sequence
  Synthetic
cattggcatggaagtcacaccttcgggaacatggctgacttatcatggagccattaaattggatgacaaagatcc

SEQ ID NO: 318920 - DNA, 75 bp, Artificial Sequence
  Synthetic
actcaagaagtttttgcccaggttaaacaaatgtacaagacaccagccataaaagattttggtggtttcaatttc

SEQ ID NO: 318921 - DNA, 75 bp, Artificial Sequence
  Synthetic
gctatcatttgatgtccttccctcaagctgctccacatggtgtcgtcttcctacatgttacttatgttccatcgc

SEQ ID NO: 318922 - DNA, 75 bp, Artificial Sequence
  Synthetic
aaaagattttggtggtttcaatttctcacaaatattgcctgatccttcaaagccaacaaagagatcgtttattga

SEQ ID NO: 318923 - DNA, 75 bp, Artificial Sequence
  Synthetic
aatacggtgaatgcctaggcgatattagtgctagagatctcatttgtgcacaaaaattcaacggactgactgtct

SEQ ID NO: 318924 - DNA, 75 bp, Artificial Sequence
  Synthetic
tatctaatggcacttcttggtttatcacacagaggaacttctattcaccacagataattacaacagacaatacat

SEQ ID NO: 318925 - DNA, 75 bp, Artificial Sequence
  Synthetic
gccttggtatgtttggctcggcttcattgctggactaattgccatcgtcatggttacaatcttgctttgttgcat

SEQ ID NO: 318926 - DNA, 75 bp, Artificial Sequence
  Synthetic
cacacagaggaacttctattcaccacagataattacaacagacaatacatttgtcgctggaagttgtgatgtcgt

SEQ ID NO: 318927 - DNA, 75 bp, Artificial Sequence
  Synthetic
gattgctgcctacactgctgcgctagttagtggtactgccactgctggctggacgtttggtgctggagctgccct

SEQ ID NO: 318928 - DNA, 75 bp, Artificial Sequence
  Synthetic
ggacgtttggtgctggagctgcccttcaaattccctttgctatgcaaatggcatacaggttcaatggcattggag

SEQ ID NO: 318929 - DNA, 75 bp, Artificial Sequence
  Synthetic
attggtgcaggcatttgtgctagttaccatacagcttctgttctacgtagtaccggccagaaatcaattgttgcc

SEQ ID NO: 318930 - DNA, 75 bp, Artificial Sequence
  Synthetic
aacaaggcaatcagtcaaattcaagaatcacttacaacaacatcgactgcattgggcaagctgcaagacgtagtc

SEQ ID NO: 318931 - DNA, 75 bp, Artificial Sequence
  Synthetic
cacttgtcaaacagcttagctccaattttggtgctatttcaagtgttttgaatgacattctttcacgacttgata

SEQ ID NO: 318932 - DNA, 75 bp, Artificial Sequence
  Synthetic
aaaataatttcgctcaataaaagatggcagctagccctttataagggcttccagttcatttgcaatttactgctg

SEQ ID NO: 318933 - DNA, 75 bp, Artificial Sequence
  Synthetic
aatgacattctttcacgacttgataaagttgaggcagaagtacaaattgataggttgataacaggcaggttacag

SEQ ID NO: 318934 - DNA, 75 bp, Artificial Sequence
  Synthetic
aaaaggctaccatctaatgtctttccctcaagctgctccgcatggtgttgtattcttacatgtcacgtatgtgcc

SEQ ID NO: 318935 - DNA, 75 bp, Artificial Sequence
  Synthetic
acactgggagttctcgtgccacatgtgggcgaaaccccaatcgcataccgtaatgttcttctccgtaagaatggt

SEQ ID NO: 318936 - DNA, 75 bp, Artificial Sequence
  Synthetic
tcttgctgtttttcaaagcgcttccaaggtgattgcgctacataagaggtggcagcttgccttgcataaaggcat

SEQ ID NO: 318937 - DNA, 75 bp, Artificial Sequence
  Synthetic
ctttttgtgacaatttactcacaccttctactgttagctgctggcatggaggcacaatttctgtacatctatgcc

SEQ ID NO: 318938 - DNA, 75 bp, Artificial Sequence
  Synthetic
caaataccatttgctatgcaaatggcttataggtttaatggcattggagttactcaaaatgttctctatgagaac

SEQ ID NO: 318939 - DNA, 75 bp, Artificial Sequence
  Synthetic
ttactacagacactggtattgaaaatgctacattcttcatctttaacaagcttgttaaagacccaccgaatgtgc

SEQ ID NO: 318940 - DNA, 75 bp, Artificial Sequence
  Synthetic
caattactgcacagccagtaaaaattgacaatgcttctcctgcaagtactgttcatgctacagcaacgataccgc

SEQ ID NO: 318941 - DNA, 75 bp, Artificial Sequence
  Synthetic
ttgataacaacttttgtggcccggatgggtatcctcttgaatgcattaaagattttctcgcccgtgcgggtaagt

SEQ ID NO: 318942 - DNA, 75 bp, Artificial Sequence
  Synthetic
aaaaatccattactttatgatgctaactactttgtatgttggcacaccaattgctttgactactgtataccatat

SEQ ID NO: 318943 - DNA, 75 bp, Artificial Sequence
  Synthetic
tgattatatcgagtcgaagagaggtgtctactgctgccgtgaacatgaacatgaaattgtttggttcactgaacg

SEQ ID NO: 318944 - DNA, 75 bp, Artificial Sequence
  Synthetic
tcacctcaggtgacggaactacccaaccaaaacttaaggaagattaccaaattggtggttattctgaggattggc

SEQ ID NO: 318945 - DNA, 75 bp, Artificial Sequence
  Synthetic
accaaaacttaaggaagattaccaaattggtggttattctgaggattggcattcaggtgtaaaagactatgtagt

SEQ ID NO: 318946 - DNA, 75 bp, Artificial Sequence
  Synthetic
tgctgcaaatttgatgaggacgactctgagccagtgctcaaaggagtcaaattacactacacataaacgaactta

SEQ ID NO: 318947 - DNA, 75 bp, Artificial Sequence
  Synthetic
ctgagccagtgctcaaaggagtcaaattacactacacataaacgaacttaatggatttgtttatgagcattttca

SEQ ID NO: 318948 - DNA, 75 bp, Artificial Sequence
  Synthetic
tggcactgaaaatttagtttgtgaaggacccactacatgtggatacctacctactaatgctgtagtaaaaatgcc

SEQ ID NO: 318949 - DNA, 75 bp, Artificial Sequence
  Synthetic
caatattgttaacgtgagtttagtaaaaccaacagtttacgtttactcacgtgttaaaaatctgaactcttctga

SEQ ID NO: 318950 - DNA, 75 bp, Artificial Sequence
  Synthetic
tgctactctttgtcacaatttattcacacctattactgttagctgctggcatggaggcacaatttttgtacatct

SEQ ID NO: 318951 - DNA, 75 bp, Artificial Sequence
  Synthetic
gatccaaaaatccattactctatgatgccaactactttgtatgttggcacacgaattgctttgattactgtatac

SEQ ID NO: 318952 - DNA, 75 bp, Artificial Sequence
  Synthetic
aatcagccaaaacttaaagaagactaccaaattggtggttattctgaggattggcattcaggtattaaagactat

SEQ ID NO: 318953 - DNA, 75 bp, Artificial Sequence
  Synthetic
agcgtgtaggcactgattcaggttttgctgcatacaaccgctaccgtattggaaactacaaattaaatacagacc

SEQ ID NO: 318954 - DNA, 75 bp, Artificial Sequence
  Synthetic
aagtctattaccagttggaaacgacacaattgtcgcctgaaactggtgttgaaaatgctacattcttcatcttta

SEQ ID NO: 318955 - DNA, 75 bp, Artificial Sequence
  Synthetic
acaattgtcgcctgaaactggtgttgaaaatgctacattcttcatctttagcaaacttgttaaagctgtagacca

SEQ ID NO: 318956 - DNA, 75 bp, Artificial Sequence
  Synthetic
agttcaatagtgagacaattatttaagcctctaactaagaagaaatattctgagttagatgatgaagaacctatg

SEQ ID NO: 318957 - DNA, 75 bp, Artificial Sequence
  Synthetic
atatcactatcaggagtgtgttagaggtacaactgtactactaaaagaaccttgcccatctggaacttacgaggg

SEQ ID NO: 318958 - DNA, 75 bp, Artificial Sequence
  Synthetic
ggtacaactgtactactaaaagaaccttgcccatctggaacttacgagggcaattcaccatttcatcctcttgct

SEQ ID NO: 318959 - DNA, 75 bp, Artificial Sequence
  Synthetic
ctggaacaatggaacctagtaataggtttcattttccttgcctggattatgctgctacagtttgcctattctaac

SEQ ID NO: 318960 - DNA, 75 bp, Artificial Sequence
  Synthetic
ctagcactcattttgcttttgcttgtgctgacggtactagacatacttatcagcttcgtgcaagatcagtttcac

SEQ ID NO: 318961 - DNA, 75 bp, Artificial Sequence
  Synthetic
ctttttctcattgttgctgctctagtatttataatactttgcttcaccattaagagaaagacagaatgaatgagc

SEQ ID NO: 318962 - DNA, 75 bp, Artificial Sequence
  Synthetic
caaaacttttcatcagacaagaggaagttcaccaagagctctattcaccgctttttctcattgttgctgctctag

SEQ ID NO: 318963 - DNA, 75 bp, Artificial Sequence
  Synthetic
gttctaataatgcttattatattttggttttcacttgaactccaggatatagaagaaccttgtaacaaagtctaa

SEQ ID NO: 318964 - DNA, 75 bp, Artificial Sequence
  Synthetic
catgcataaagaatgcagtatacaagaatgttgtgaaaatcaaccattccaacttgaagacccatgtccaataca

SEQ ID NO: 318965 - DNA, 75 bp, Artificial Sequence
  Synthetic
catgtgaaccacttgaaataaattgtcaaaacccaccagttggaagtctcattgtacgttgttcatatgatgttg

SEQ ID NO: 318966 - DNA, 75 bp, Artificial Sequence
  Synthetic
ttgtacaactgtgcgagggagactatggtaaaagaattccaattcattatcaaatgtttggcaattacaccatct

SEQ ID NO: 318967 - DNA, 75 bp, Artificial Sequence
  Synthetic
tggtaaaagaattccaattcattatcaaatgtttggcaattacaccatctcttgtgaaccactcgagataaactg

SEQ ID NO: 318968 - DNA, 75 bp, Artificial Sequence
  Synthetic
actttatggagtatcacgacgttcgtgttgttctagatttcatctaaacgaacaaactaaaatgtctgataatgg

SEQ ID NO: 318969 - DNA, 75 bp, Artificial Sequence
  Synthetic
tttaattgacttctatttgtgctttttagcctttctgctattccttgttttaataatgcttattatattttggtt

SEQ ID NO: 318970 - DNA, 75 bp, Artificial Sequence
  Synthetic
ttgcattagcacacactttgcttttgcttgcgctgacggtactagacatacctatcagttgcgtgcgagatcagt

SEQ ID NO: 318971 - DNA, 75 bp, Artificial Sequence
  Synthetic
gcacccgcaatcctaataacaatgctgccatcgtgctacaacttcctcaaggaacaacattgccaaaaggcttct

SEQ ID NO: 318972 - DNA, 75 bp, Artificial Sequence
  Synthetic
gcttgagagcaaagtttctggtaaaggccaacaacaacaaggccaaactgtcactaagaaatctgctgctgaggc

SEQ ID NO: 318973 - DNA, 75 bp, Artificial Sequence
  Synthetic
gattatggcaaaaggattccaattcattatgaaatgtttggcaattacactatctcttgcgaaccacttgagata

SEQ ID NO: 318974 - DNA, 75 bp, Artificial Sequence
  Synthetic
acctaggaactggcccagaagcttcacttccctatggtgctaacaaagaaggcatcatatgggtcgcaactgagg

SEQ ID NO: 318975 - DNA, 75 bp, Artificial Sequence
  Synthetic
attttagtagtgctatccccatgtgattttaatagcttcttaggagaatgacaaaaaaaaaaaaaaaaaaaaaaa

SEQ ID NO: 318976 - DNA, 75 bp, Artificial Sequence
  Synthetic
aggtgttaaagtaacacaagagttaggtcatgaggatcttatggctgcttatgtggaaaacacaagcattaccat

SEQ ID NO: 318977 - DNA, 75 bp, Artificial Sequence
  Synthetic
tgccgtgaacatgaacatgaaattgtttggttcactgagcgctctgagaagagctatgagcgtcagacacccttc

SEQ ID NO: 318978 - DNA, 75 bp, Artificial Sequence
  Synthetic
gtacaaaaccagttgatacttcaaactcctttgaagtcctggtggtagaagacacacaaggaatggataatcttg

SEQ ID NO: 318979 - DNA, 75 bp, Artificial Sequence
  Synthetic
cattgaaactcgactccgcaagggaggtaggactagatgttttggaggctgtgtgtttgcctatgttggctgcta

SEQ ID NO: 318980 - DNA, 75 bp, Artificial Sequence
  Synthetic
ctatgactactgtataccatataacagtgtcacagatacaattgtcgttactgcaggtgacggcatttcaacacc

SEQ ID NO: 318981 - DNA, 75 bp, Artificial Sequence
  Synthetic
tgattcacatgacacagtacttacctctgaggaggttgttctcaagaacggtgaactcgaagcactcgagacgcc

SEQ ID NO: 318982 - DNA, 75 bp, Artificial Sequence
  Synthetic
gtgcttaatgaaaagtgctctgtctacactgttgaatccggtaccgaagttactgagtttgcatgtgttgtagca

SEQ ID NO: 318983 - DNA, 75 bp, Artificial Sequence
  Synthetic
accagaacctacacctgaagaaccagttaatcagtttactggttatttaaaacttactgacaatgttgccattaa

SEQ ID NO: 318984 - DNA, 75 bp, Artificial Sequence
  Synthetic
actgtagacaatactaatctccacacgcaaattgtggacatgtccatgacatacggacagcagtttggtcctact

SEQ ID NO: 318985 - DNA, 75 bp, Artificial Sequence
  Synthetic
acatggtggtggtgtagcaggtgcactcaacaaggcaaccaatggtgccatgcaaaaggagagtgatgattacat

SEQ ID NO: 318986 - DNA, 75 bp, Artificial Sequence
  Synthetic
ttgcattttctacctcgtgtttttagtgctgttggcaacatttgctacacaccatctaaactcattgagtatagt

SEQ ID NO: 318987 - DNA, 75 bp, Artificial Sequence
  Synthetic
taagctaaatggccctcttacagtaggagggtcttgtttgctttctggacataatcttgctaagaagtgtctgca

SEQ ID NO: 318988 - DNA, 75 bp, Artificial Sequence
  Synthetic
tacgagcaccagacacccttcgaaattaagagtgccaagaaatttgacactttcaaaggggaatgcccaaagttt

SEQ ID NO: 318989 - DNA, 75 bp, Artificial Sequence
  Synthetic
agtgtactgcccaagacatgttgtttgcacggctgaagacatgcttaacccgaactatgacgacctgctcatccg

SEQ ID NO: 318990 - DNA, 75 bp, Artificial Sequence
  Synthetic
cttacagagattggtcctattcaggacagcgtacagagttaggtgttgaatttcttaagcgtggtgacaaaattg

SEQ ID NO: 318991 - DNA, 75 bp, Artificial Sequence
  Synthetic
tcatgtggtagtgttggttttaacattgattatgattgcgtgtctttctgctacatgcatcatatggagcttcca

SEQ ID NO: 318992 - DNA, 75 bp, Artificial Sequence
  Synthetic
ctacatgcatcatatggagcttccaactggagtgcacgctggtactgacttagaaggtaaattctatggtccttt

SEQ ID NO: 318993 - DNA, 75 bp, Artificial Sequence
  Synthetic
acacacaaggaatggacaatcttgcttgtgaaagtcaacaacccacctctgaagaagtagtggaaaatcctacca

SEQ ID NO: 318994 - DNA, 75 bp, Artificial Sequence
  Synthetic
agtgtgtacaacttcacaatgatattcttcttgcaaaggacactactgaagcttttgaaaagatggtttcacttt

SEQ ID NO: 318995 - DNA, 75 bp, Artificial Sequence
  Synthetic
aggtttaaaaacaattgccactcatggtattgctgcaattaatagtgttccttggagtaaaattttggcttatgt

SEQ ID NO: 318996 - DNA, 75 bp, Artificial Sequence
  Synthetic
gtaccactcaacatcataccacttacaacagcagctaaactcatggttgttgtccctgactatggaacctacaag

SEQ ID NO: 318997 - DNA, 75 bp, Artificial Sequence
  Synthetic
attgttaatggcatgaagagatctttctatgtctatgcaaatggaggccgtggcttctgcaagactcacaattgg

SEQ ID NO: 318998 - DNA, 75 bp, Artificial Sequence
  Synthetic
ttagatggtgtcctttctacattcgtgtcagctgcccgacaaggtgttgttgataccgatgttgacacaaaggat

SEQ ID NO: 318999 - DNA, 75 bp, Artificial Sequence
  Synthetic
tgttagtacttgttttaaacttatgcttaaggccacattattgtgcgttcttgctgcattggtttgttatatacg

SEQ ID NO: 319000 - DNA, 75 bp, Artificial Sequence
  Synthetic
aacttgtgctacaactagacaggttgtcaatgtcataactactaaaatctcactcaagggtggtaagattgttag

SEQ ID NO: 319001 - DNA, 75 bp, Artificial Sequence
  Synthetic
tgcaattctgcgatgctatgcgtgatgcgggtatcgtaggtgtactgacactagataatcaggatctgaatggga

SEQ ID NO: 319002 - DNA, 75 bp, Artificial Sequence
  Synthetic
accatcaagggttctttccttaatggttcatgtggtagtgttggttttaacattgattatgattgcgtgtctttc

SEQ ID NO: 319003 - DNA, 75 bp, Artificial Sequence
  Synthetic
cattgattatgattgcgtgtctttctgctacatgcaccacatggagcttccaactggagtacacgctggtactga

SEQ ID NO: 319004 - DNA, 75 bp, Artificial Sequence
  Synthetic
gcttgtgctatgcttcttgttaagcataagcatgcattcctgtgcttgtttctgttaccttctctagcaacagtt

SEQ ID NO: 319005 - DNA, 75 bp, Artificial Sequence
  Synthetic
acttgtacttgacattctatttcaccaatgatgtttcattcttggctcaccttcaatggtttgccatgttttctc

SEQ ID NO: 319006 - DNA, 75 bp, Artificial Sequence
  Synthetic
ggtttctacacaggagtttagatacatgaactctcaggggcttttgccacctaagagtagtattgacgctttcaa

SEQ ID NO: 319007 - DNA, 75 bp, Artificial Sequence
  Synthetic
caatgcttttcactatgcttaggaagcttgataatgatgcacttaacaacattatcaacaatgcacgtgatggtt

SEQ ID NO: 319008 - DNA, 75 bp, Artificial Sequence
  Synthetic
taagatgtttgatgcttatgtcgacaccttttcagcaacttttagtgttcctatggaaaaacttaaggcacttgt

SEQ ID NO: 319009 - DNA, 75 bp, Artificial Sequence
  Synthetic
tattatggcaattgctgcatgtgctatgctgcttgttaagcataagcacgcattcttgtgcttgtttctgttacc

SEQ ID NO: 319010 - DNA, 75 bp, Artificial Sequence
  Synthetic
taaagtacagattggagagtacacctttgaaaaaggtgactatggtgatgctgttgtgtacagaggtactacaac

SEQ ID NO: 319011 - DNA, 75 bp, Artificial Sequence
  Synthetic
taaagtgcacatctgtggtactgctctcggttcttcaacaacttagagtagagtcatcttctaaattgtgggcac

SEQ ID NO: 319012 - DNA, 75 bp, Artificial Sequence
  Synthetic
tgctattggacttgccctctactacccatctgctcgcatagtgtatacagcttgctctcatgctgctgttgatgc

SEQ ID NO: 319013 - DNA, 75 bp, Artificial Sequence
  Synthetic
tactgctgatatagtggtctttgatgaaatttcaatggccactaattatgatttgagtgttgtcaatgctagact

SEQ ID NO: 319014 - DNA, 75 bp, Artificial Sequence
  Synthetic
cttctaaattgtgggcacaatgtgtacaactccacaatgatattcttcttgcaaaagacacaactgaagctttcg

SEQ ID NO: 319015 - DNA, 75 bp, Artificial Sequence
  Synthetic
acactgttgccacttacacagtataacaggtatcttgctctatataacaagtacaagtatttcagtggagcctta

SEQ ID NO: 319016 - DNA, 75 bp, Artificial Sequence
  Synthetic
aagggaggtaggtttgtgctggcattactatcagaccaccaagatctcaaatgggctagattccctaagagtgat

SEQ ID NO: 319017 - DNA, 75 bp, Artificial Sequence
  Synthetic
ggattacctagcaagtggaggacaaccaatcaccaactgtgtgaagatgttgtgtacacacactggtacaggaca

SEQ ID NO: 319018 - DNA, 75 bp, Artificial Sequence
  Synthetic
ggtacaggtacaatttacacagaactggaaccaccttgtaggtttgttacagacacaccaaaagggcctaaagtg

SEQ ID NO: 319019 - DNA, 75 bp, Artificial Sequence
  Synthetic
gtggctgcactaacaaacaatgttgcttttcaaactgtcaaacccggtaattttaataaggacttttatgacttt

SEQ ID NO: 319020 - DNA, 75 bp, Artificial Sequence
  Synthetic
ctgaaaggattatcagacagagttgtgtttgtcctctgggcacatggctttgaactcacatcgatgaagtacttt

SEQ ID NO: 319021 - DNA, 75 bp, Artificial Sequence
  Synthetic
attaataagttgtgcgaagaaatgcttgacaaccgtgctactcttcaggccatcgcttcagaatttagttcttta

SEQ ID NO: 319022 - DNA, 75 bp, Artificial Sequence
  Synthetic
gttttgactatgtctacaacccgtttatgattgatgtacagcagtggggttttacaggtaacttgcagagtaacc

SEQ ID NO: 319023 - DNA, 75 bp, Artificial Sequence
  Synthetic
cttttgatatttacaacgaaaaagttgctggttttgcaaagttcctaaaaactaattgctgtcgcttccaggaga

SEQ ID NO: 319024 - DNA, 75 bp, Artificial Sequence
  Synthetic
tgcacttctttcaactgatggtaataagatagctgacaagtatgtccgcatctacaacacaggctctatgagtgt

SEQ ID NO: 319025 - DNA, 75 bp, Artificial Sequence
  Synthetic
tttttcaagtttagagtagatggtgacatggtaccacatatatcacgtcagcgtctaactaaatacacaatggct

SEQ ID NO: 319026 - DNA, 75 bp, Artificial Sequence
  Synthetic
gtttctgttaccttctcttgcaacagttgcttactttaatatggtctacatgcctgctagctgggtgatgcgtat

SEQ ID NO: 319027 - DNA, 75 bp, Artificial Sequence
  Synthetic
agtgttatggcgtttctgccactaagttgaatgatctttgcttctccaatgtctatgcagattcttttgtagtca

SEQ ID NO: 319028 - DNA, 75 bp, Artificial Sequence
  Synthetic
atacaacggtataagctagagggctatgctttcgagcatatcgtttatggagatttcagtcatggacaacttggc

SEQ ID NO: 319029 - DNA, 75 bp, Artificial Sequence
  Synthetic
atgctttcgagcatatcgtttatggagatttcagtcatggacaacttggcgggttgcatctaatgattggtctag

SEQ ID NO: 319030 - DNA, 75 bp, Artificial Sequence
  Synthetic
gaatcttaagtatgccattagtgcaaagaatagagctcgcaccgtagctggtgtctctatctgtagtactatgac

SEQ ID NO: 319031 - DNA, 75 bp, Artificial Sequence
  Synthetic
actgaggagacatttaagctatcttatggtattgccactgtacgtgaagtactgtctgatagagaactccatctg

SEQ ID NO: 319032 - DNA, 75 bp, Artificial Sequence
  Synthetic
ggatttgctcaaatatgatttcacggaagagagactatgtcttttcgaccgttattttaaatattgggatcagac

SEQ ID NO: 319033 - DNA, 75 bp, Artificial Sequence
  Synthetic
ccaagatctcaaatgggctagattccctaagagtgatggtacaggtacaatttacacagaactggaaccaccttg

SEQ ID NO: 319034 - DNA, 75 bp, Artificial Sequence
  Synthetic
taatgactcaaaagaggggtttttcacttatctatgtggatttattaaacaaaaactagccctgggaggttctgt

SEQ ID NO: 319035 - DNA, 75 bp, Artificial Sequence
  Synthetic
tacgtgtacctgccttacccagatccatcaagaatattaggcgcaggctgttttgtcgatgatattgtcaaaaca

SEQ ID NO: 319036 - DNA, 75 bp, Artificial Sequence
  Synthetic
tctctatgcagttgcatatgcactgtagtacagcgctgtgcatctaataaacctcatgtgcttgaagatccttgt

SEQ ID NO: 319037 - DNA, 75 bp, Artificial Sequence
  Synthetic
aaggtacaacactaggggtaatacttatagcactgcttggctttgtgctctaggaaaggttttaccttttcatag

SEQ ID NO: 319038 - DNA, 75 bp, Artificial Sequence
  Synthetic
atggcacactatggttcaaacatgcacacctaatgttactatcaactgtcaagatccagctggtggtgcgcttat

SEQ ID NO: 319039 - DNA, 75 bp, Artificial Sequence
  Synthetic
gccaacaacaacaaggccaaactgtcactaagaaatctgctgctgaggcatctaaaaagcctcgccaaaaacgta

SEQ ID NO: 319040 - DNA, 75 bp, Artificial Sequence
  Synthetic
ggtaatgctcatgtggctagttgtgatgctatcatgactagatgtcttgcagtccacgagtgctttgttaagcgc

SEQ ID NO: 319041 - DNA, 75 bp, Artificial Sequence
  Synthetic
ttattggagatgaactgaagattaacgctgcatgcagaaaagtacagcatatggttgttaaatctgcattgcttg

SEQ ID NO: 319042 - DNA, 75 bp, Artificial Sequence
  Synthetic
tgttgatagtgttgctgtgaaaaatggcgcgcttcacctctactttgacaaggctggtcaaaagacctatgagag

SEQ ID NO: 319043 - DNA, 75 bp, Artificial Sequence
  Synthetic
ataagtgtagtagaattatacctgcacgtgcgcgtgtagagtgttttgataaattcaaagttaattcaacattag

SEQ ID NO: 319044 - DNA, 75 bp, Artificial Sequence
  Synthetic
agaccttatctgtgcccagaagttcaatggacttactgtgctaccgccactgctcacagatgagatggttgctgc

SEQ ID NO: 319045 - DNA, 75 bp, Artificial Sequence
  Synthetic
ggagactttagtcatggacagcttggtgggcttcatctaatgattggtctagccaagcgttctcaagattcaccg

SEQ ID NO: 319046 - DNA, 75 bp, Artificial Sequence
  Synthetic
catgtggctagttgtgatgctatcatgactagatgtttagcagtccatgagtgctttgttaagcgcgttgattgg

SEQ ID NO: 319047 - DNA, 75 bp, Artificial Sequence
  Synthetic
gcacctcacggtgtcgtttttctacatgtcacatatgtgccatcacaagagaaaaacttcacaacagctccagct

SEQ ID NO: 319048 - DNA, 75 bp, Artificial Sequence
  Synthetic
agtttgtatgtgaataagcatgcattccacactccagctttcgataaaagtgcatttactaatttaaagcaattg

SEQ ID NO: 319049 - DNA, 75 bp, Artificial Sequence
  Synthetic
cgtggtgcgtattaagattgttcaaatgctcagtgatacgctgaaaggattatcagacagagttgtgtttgtcct

SEQ ID NO: 319050 - DNA, 75 bp, Artificial Sequence
  Synthetic
gtatactgtccaagacatgtcatttgcacagcagaagacatgcttaatcctaactatgaagatctgctcattcgc

SEQ ID NO: 319051 - DNA, 75 bp, Artificial Sequence
  Synthetic
caatcacgcgcaatccagcgaaaattgaaaatgcttctcctgcaagtactgttcatgctactgcaacgataccac

SEQ ID NO: 319052 - DNA, 75 bp, Artificial Sequence
  Synthetic
ttgtgacaatttactcacaccttctacttctagctgcttgcatggaagcacaattcttgtacatctatgccctga

SEQ ID NO: 319053 - DNA, 75 bp, Artificial Sequence
  Synthetic
gctgttatcaatggtgataggtggtttcttaatagattcaccactactttgaatgactttaaccttgtggcaatg

SEQ ID NO: 319054 - DNA, 75 bp, Artificial Sequence
  Synthetic
ctcaggtgatggaacaaatcagccaaaactaaaagaagactatcaaattggtggttattctgaggattggcattc

SEQ ID NO: 319055 - DNA, 75 bp, Artificial Sequence
  Synthetic
caaacatgtgacaaaagagaatgactctaaagaagggtttttcacttatctgtgtggatttataaagcaaaaact

SEQ ID NO: 319056 - DNA, 75 bp, Artificial Sequence
  Synthetic
aaatatacccaactgtgtcaatacttaaacacacttacattagctgtgccttataacatgagagtgatacacttt

SEQ ID NO: 319057 - DNA, 75 bp, Artificial Sequence
  Synthetic
acttttcatcagacaagaggaagtttatcaagagctctactcaccacttttcctcattgttgctgcattagtatt

SEQ ID NO: 319058 - DNA, 75 bp, Artificial Sequence
  Synthetic
aatgtacatctgtggtgattctttggagtgcagcaacctactcttgcagtatggaagcttctgcacacaactaaa

SEQ ID NO: 319059 - DNA, 75 bp, Artificial Sequence
  Synthetic
ttcgttgttcatacgattatgactttgttgagcatcatgacgttcgtgttgttctagatttcatctaaacgaaca

SEQ ID NO: 319060 - DNA, 75 bp, Artificial Sequence
  Synthetic
cttgttgttggcgttgcacttcttgctgtttttcaaagcgcttccaaagtgattgcgcttcataagaggtggcag

SEQ ID NO: 319061 - DNA, 75 bp, Artificial Sequence
  Synthetic
aaataccttttgctatgcaaatggcatataggttcaatggcattggagttacccaaaatgttctctatgagaacc

SEQ ID NO: 319062 - DNA, 75 bp, Artificial Sequence
  Synthetic
atggttatttcactgaaatctactaccagttagaatcgacacaactatcgaccgacactggtgctgaaaatgcta

SEQ ID NO: 319063 - DNA, 75 bp, Artificial Sequence
  Synthetic
ggtatgagctattattgcaagtcacataagcctcccattagttttccattatgtgctaatggtcaggtttttggt

SEQ ID NO: 319064 - DNA, 75 bp, Artificial Sequence
  Synthetic
agaagtaatgcctgtttctatggctaaaacctccgtagattgtaatatgtacatctgcggagattctactgaatg

SEQ ID NO: 319065 - DNA, 75 bp, Artificial Sequence
  Synthetic
gccacttagtgcacctactctagtgccacaagagcactatgtgagaattactggcttgtacccaacactcaacat

SEQ ID NO: 319066 - DNA, 75 bp, Artificial Sequence
  Synthetic
atcatgagatgctggctgtgctggaagtgcagatccaaaaatccattactctatgatgctaactattttgtatgt

SEQ ID NO: 319067 - DNA, 75 bp, Artificial Sequence
  Synthetic
cactgtaaatgcattgccagaaacaactgctgacattgtagtctttgatgaaatctctatggctactaattatga

SEQ ID NO: 319068 - DNA, 75 bp, Artificial Sequence
  Synthetic
atcactgtggctacatcacgaacgctttcttattacaaattaggagcgtcgcagcgtgtaggcactgattcaggt

SEQ ID NO: 319069 - DNA, 75 bp, Artificial Sequence
  Synthetic
tgtgctgacggtactcgacatacctatcagctgcgtgcaagatcagtttcaccaaaacttttcatcagacaagag

SEQ ID NO: 319070 - DNA, 75 bp, Artificial Sequence
  Synthetic
gctcactttaattgacttctatttgtgctttttagcctttctgctattccttgttttaataatgcttattatatt

SEQ ID NO: 319071 - DNA, 75 bp, Artificial Sequence
  Synthetic
ttgatgtggcttagctacttcgttgcttctttcaggctgtttgctcgcacccgctcaatgtggtcattcaatcca

SEQ ID NO: 319072 - DNA, 75 bp, Artificial Sequence
  Synthetic
aaagcttgttttcctctggctcttgtggccagtaacacttgcttgctttgtgcttgctgctgtctacagaattaa

SEQ ID NO: 319073 - DNA, 75 bp, Artificial Sequence
  Synthetic
ccaacgtagtgccccccgcattacatttggtggacccacagattcaactgacaataaccagaatggaggacgcaa

SEQ ID NO: 319074 - DNA, 75 bp, Artificial Sequence
  Synthetic
tgcgattgcaatggcttgtattgtaggcttgatgtggcttagctacttcgttgcttccttcaggctgtttgctcg

SEQ ID NO: 319075 - DNA, 75 bp, Artificial Sequence
  Synthetic
ggtagacctttttagaaacgcccgtaatggtgttttaataacagaaggttcagtcaaaggtctaacaccttcaaa

SEQ ID NO: 319076 - DNA, 75 bp, Artificial Sequence
  Synthetic
aaaggtaggcttatcattagagaaaacaacagagttgtggtttcaagtgatattcttgttaataactaaacgaac

SEQ ID NO: 319077 - DNA, 75 bp, Artificial Sequence
  Synthetic
aaaaacgtactgctactaaacagtacaacgtcactcaagcatttgggagacgtggtccagagcaaacccaaggaa

SEQ ID NO: 319078 - DNA, 75 bp, Artificial Sequence
  Synthetic
atgtgcaaatacacacaatcgacggctcttcaggagttgcaaatccagcaatggatccaatttatgatgagccga

SEQ ID NO: 319079 - DNA, 75 bp, Artificial Sequence
  Synthetic
tgaaatgtaatcattgcgatgaagtttcatggcagacgtgcgactttctgaaagccacttgtgaacattgtggca

SEQ ID NO: 319080 - DNA, 75 bp, Artificial Sequence
  Synthetic
tactacatgtgggtacctacctactaatgctgtagtgaaaatgccatgtcctgcctgtcaagacccagagattgg

SEQ ID NO: 319081 - DNA, 75 bp, Artificial Sequence
  Synthetic
gagccttgttcttggtgtcaacgagaaaacacacgtccaactcagtttacctgttcttcaggttagagacgtgct

SEQ ID NO: 319082 - DNA, 75 bp, Artificial Sequence
  Synthetic
agtgcgtggcttcggggactctgtggaagaggccctatcggaggcacgtgaacatcttaaaaatggcacttgtgg

SEQ ID NO: 319083 - DNA, 75 bp, Artificial Sequence
  Synthetic
atattaggtttttacctacccaggaaaagccaaccaaccctcgatctcttgtagatctgttctctaaacgaactt

SEQ ID NO: 319084 - DNA, 75 bp, Artificial Sequence
  Synthetic
gcattcagtacggtcgtagcggtataacactgggagtactcgtgccacatgtgggcgaaaccccaatcgcatacc

SEQ ID NO: 319085 - DNA, 75 bp, Artificial Sequence
  Synthetic
cctgttctccaggttagagacgtgctagtacgtggcttcggggactctgtggaagaggccctatcggaggcacgt

SEQ ID NO: 319086 - DNA, 75 bp, Artificial Sequence
  Synthetic
atgggtaccctcttgattgcattaaagattttctcgctcgcgcgggcaagtcaatgtgcactctttccgaacaac

SEQ ID NO: 319087 - DNA, 75 bp, Artificial Sequence
  Synthetic
agggcactggtcatggccacaaggtctgtgagctagttgctgaattggatggcgtgcagttcggtcgtagcggta

SEQ ID NO: 319088 - DNA, 75 bp, Artificial Sequence
  Synthetic
tgtgggtgaaaccccaattgcataccgcactgttcttcttcgtaagaatggtaataagggagccggtggccatag

SEQ ID NO: 319089 - DNA, 75 bp, Artificial Sequence
  Synthetic
gctctgataagagctatgagcatcagacacccttcgaaattaagagtgccaagaaatttgacaccttcaaagggg

SEQ ID NO: 319090 - DNA, 75 bp, Artificial Sequence
  Synthetic
gacacccttcgaaattaagagtgccaagaaatttgacaccttcaaaggggaatgcccaaagtttgtatttcctct

SEQ ID NO: 319091 - DNA, 75 bp, Artificial Sequence
  Synthetic
ctggaacactaaacatggcagtggtgcccttcgtgaactcactcgtgagctcaatggaggagtagtcactcgcta

SEQ ID NO: 319092 - DNA, 75 bp, Artificial Sequence
  Synthetic
tacgtggcaaggagcagctgcaactactcatgcctcttaaggcaccaaaagaagtaacctttcttgaaggtgatt

SEQ ID NO: 319093 - DNA, 75 bp, Artificial Sequence
  Synthetic
ctctttgtgacaatttactcacaccttttattgctagctgccggcatggaagcacaattcttgtacatctatgcc

SEQ ID NO: 319094 - DNA, 75 bp, Artificial Sequence
  Synthetic
tcaatggaggagtagtcactcgctatgtcgataacaacttttgtggcccagatggctacccccttgaatgcatca

SEQ ID NO: 319095 - DNA, 75 bp, Artificial Sequence
  Synthetic
tgtggcactgaaaatttagtctgtgaaggacccactacatgtggatacctacctactaatgctgtacttaaaatg

SEQ ID NO: 319096 - DNA, 75 bp, Artificial Sequence
  Synthetic
cctttgagagagacatatctaatgtgcctttctcccctgatggcaaaccttgcaccccacctgctcttaattgtt

SEQ ID NO: 319097 - DNA, 75 bp, Artificial Sequence
  Synthetic
acaatggaatctagtaataggtttcattttccttgcctggattatgttactacagtttgcctattccaaccggaa

SEQ ID NO: 319098 - DNA, 75 bp, Artificial Sequence
  Synthetic
gagactctaaatgaagatctcctagagatactgcatcgtgaacgtgttaatattaacattgttggcgattttcag

SEQ ID NO: 319099 - DNA, 75 bp, Artificial Sequence
  Synthetic
agatactgcatcgtgaacgtgttaatattaacattgttggcgattttcagttgactgaagaggttgctattattt

SEQ ID NO: 319100 - DNA, 75 bp, Artificial Sequence
  Synthetic
tgtctttattgacactgtaaagggccttgactacaagaccttcaaagccattgttgaatcctgtggaaactacaa

SEQ ID NO: 319101 - DNA, 75 bp, Artificial Sequence
  Synthetic
ttgttgaatcctgtggaaactacaaagttaccagaggcaagcctgtccaaggagcttggaacattggccagcaaa

SEQ ID NO: 319102 - DNA, 75 bp, Artificial Sequence
  Synthetic
gattatgaacaaaactggaacactaagcatggcagtggtgcactccgtgaactcactcgtgagctcaatggaggt

SEQ ID NO: 319103 - DNA, 75 bp, Artificial Sequence
  Synthetic
ttttccatcacaggccgccagtgtcattagagcaatcttttctcgcacacttgatgcagcaaatcattcaatacc

SEQ ID NO: 319104 - DNA, 75 bp, Artificial Sequence
  Synthetic
attagagcaatcttttctcgcacacttgatgcagcaaatcattcaataccagacttgcaaaaagcagctgttacc

SEQ ID NO: 319105 - DNA, 75 bp, Artificial Sequence
  Synthetic
cattgcgtcttgtcgatgccatgacttacacctcagatctgctcaccaacagtgtcattgttatggcatatgtta

SEQ ID NO: 319106 - DNA, 75 bp, Artificial Sequence
  Synthetic
cgtagtactagccaaaaatctattgtggcttatactatgtctttaggtgctgatagttcaattgcttactctaat

SEQ ID NO: 319107 - DNA, 75 bp, Artificial Sequence
  Synthetic
ccgttgatagcttcaaaaatggagctgtcgttggcacaccagtttgtgtgaatggcctcatgctcttagagatca

SEQ ID NO: 319108 - DNA, 75 bp, Artificial Sequence
  Synthetic
ggtgatgtacatgatactgtgctaacctctgaagaggttgttcttaagaatggtgaactcgaggcactcgagact

SEQ ID NO: 319109 - DNA, 75 bp, Artificial Sequence
  Synthetic
aaatggactcatgctcttagaactaaaagacaaggagcaatattgcgctttgtctccaggattattagcaacaaa

SEQ ID NO: 319110 - DNA, 75 bp, Artificial Sequence
  Synthetic
gatgctggtgaagaaaaactttcttcacgtatgtactgctccttctatcctcctgatgatgaggatgagtgtgat

SEQ ID NO: 319111 - DNA, 75 bp, Artificial Sequence
  Synthetic
aaagacaaggagcaatattgcgctttgtctccaggattattagcaacaaacaatgtcttccgtcttaagggaggt

SEQ ID NO: 319112 - DNA, 75 bp, Artificial Sequence
  Synthetic
gagaggacactgttgtagaagtccagggctataagaatgtgaaaatcacattcgagcttgatgagcgtgtagaca

SEQ ID NO: 319113 - DNA, 75 bp, Artificial Sequence
  Synthetic
agaagaaccttgtaacaaagtctaaacgaacatgaaacttctcattgtttttggactcttaacatcagtgtactg

SEQ ID NO: 319114 - DNA, 75 bp, Artificial Sequence
  Synthetic
ttacactgtggagtcaggtacagaagtgtctgaatttgcatgtgttgtagcggagtctgttgtgaaaacattaca

SEQ ID NO: 319115 - DNA, 75 bp, Artificial Sequence
  Synthetic
ggagttacccaaaatgttctctatgagaaccaaaaacaaatcgccaaccaatttaacaaggcgattagtcaaatt

SEQ ID NO: 319116 - DNA, 75 bp, Artificial Sequence
  Synthetic
agttaaccagtttactggttatttaaaacttactgacaatgttgccattaagtgtgtggacatcgtgaaggaggc

SEQ ID NO: 319117 - DNA, 75 bp, Artificial Sequence
  Synthetic
tggacgaagaattccaatttattatgagatgtttggcaattacactatctcttgtgaaccactagagataaattg

SEQ ID NO: 319118 - DNA, 75 bp, Artificial Sequence
  Synthetic
ctccagatgaggaagaagatgaagatgcagggtgtgaggaggaggaaatcgctgatgagacctgtgaacatgagt

SEQ ID NO: 319119 - DNA, 75 bp, Artificial Sequence
  Synthetic
tcttcctctggaatttggtgcctcaactgaagcagttcaagttgaagaagaagaagaggaagactggctggatga

SEQ ID NO: 319120 - DNA, 75 bp, Artificial Sequence
  Synthetic
ctgaaacatggtggtggtgtagcaggtgcactcaacaaggctactaatggtgccatgcagaaggagagtgatgat

SEQ ID NO: 319121 - DNA, 75 bp, Artificial Sequence
  Synthetic
ttgatagcctgaagcctagagtggaagcacctaaacaagaggagccaccaaagacagaacatcctaaaattgagg

SEQ ID NO: 319122 - DNA, 75 bp, Artificial Sequence
  Synthetic
gagtaggagggtcatgtttgctttctggacacaatcttgctaataaatgcctgcacgtcgttggacctaacctaa

SEQ ID NO: 319123 - DNA, 75 bp, Artificial Sequence
  Synthetic
tggacacaatcttgctaataaatgcctgcacgtcgttggacctaacctaaatgcaggtgaggatatccaactcct

SEQ ID NO: 319124 - DNA, 75 bp, Artificial Sequence
  Synthetic
tcacaggaaattttactcgcaccattattgtcagctggtatatttggtgctaaaccacttgattcgttaaaagtg

SEQ ID NO: 319125 - DNA, 75 bp, Artificial Sequence
  Synthetic
tattgtcagctggtatatttggtgctaaaccacttgattcgttaaaagtgtgcgtgcaaacagttcgcactcatg

SEQ ID NO: 319126 - DNA, 75 bp, Artificial Sequence
  Synthetic
gctttatgatcaggttgttatggactatctcgatagtctgaagcctacggtggaaacacctaaagaggagcaacc

SEQ ID NO: 319127 - DNA, 75 bp, Artificial Sequence
  Synthetic
tatctcgatagtctgaagcctacggtggaaacacctaaagaggagcaaccaaaaatagaggattctaacgtaaag

SEQ ID NO: 319128 - DNA, 75 bp, Artificial Sequence
  Synthetic
ttgatgtaaaacctaaaattaaggcttgcattgaagaggttactacaacactggaagagactaagtttcttacca

SEQ ID NO: 319129 - DNA, 75 bp, Artificial Sequence
  Synthetic
ttgcattgaagaggttactacaacactggaagagactaagtttcttaccaataagttgcttctttttgctgatat

SEQ ID NO: 319130 - DNA, 75 bp, Artificial Sequence
  Synthetic
acaagaaaattaatgcctatttgcatggatgttagagccataatggccaccattcaacgcaagtacaaaggaatt

SEQ ID NO: 319131 - DNA, 75 bp, Artificial Sequence
  Synthetic
cagaatatgcttagaggtgaagacgtgtcttttcttgagagagacgcgccttacatggtaggtgatgttatcaat

SEQ ID NO: 319132 - DNA, 75 bp, Artificial Sequence
  Synthetic
tgtcttttcttgagagagacgcgccttacatggtaggtgatgttatcaatagtggtgatattacctgcgttgtaa

SEQ ID NO: 319133 - DNA, 75 bp, Artificial Sequence
  Synthetic
tacggaaatgcttgcaagagcattgaagaaagtgccaattgatgagtatataaccacataccctggtcaaggttg

SEQ ID NO: 319134 - DNA, 75 bp, Artificial Sequence
  Synthetic
aagaaagtgccaattgatgagtatataaccacataccctggtcaaggttgtgctggttatacacttgatgaagct

SEQ ID NO: 319135 - DNA, 75 bp, Artificial Sequence
  Synthetic
ctgcactgtatgttctaccatcagaaacacctaatgctaaggaagaaattctaggcactgtatcctggaatttaa

SEQ ID NO: 319136 - DNA, 75 bp, Artificial Sequence
  Synthetic
aacacctaatgctaaggaagaaattctaggcactgtatcctggaatttaagagaaatgcttgcacatgctgaaga

SEQ ID NO: 319137 - DNA, 75 bp, Artificial Sequence
  Synthetic
tacctacaactattgctaaaaatagtgttaagagtgttgctaaattatgtttggatgccggcattaattatgtga

SEQ ID NO: 319138 - DNA, 75 bp, Artificial Sequence
  Synthetic
atggatgtccgggctataatggctactatccaacgcaagtacaaaggaattaaaattcaagaaggaattgttgac

SEQ ID NO: 319139 - DNA, 75 bp, Artificial Sequence
  Synthetic
ctatccaacgcaagtacaaaggaattaaaattcaagaaggaattgttgactatggtgtccgattcttcttttata

SEQ ID NO: 319140 - DNA, 75 bp, Artificial Sequence
  Synthetic
tattacgaagctgaattctttaaatgagccacttgtcacaatgccaattggttatgtgacgcatggttttaatct

SEQ ID NO: 319141 - DNA, 75 bp, Artificial Sequence
  Synthetic
gagccacttgtcacaatgccaattggttatgtgacgcatggttttaatcttgaagaagcagcgcgctgcatgcgc

SEQ ID NO: 319142 - DNA, 75 bp, Artificial Sequence
  Synthetic
cagtatcatcacctgatgccgtcactacatacaatggatacctcacttcgtcatcaaagacacctgaggagcact

SEQ ID NO: 319143 - DNA, 75 bp, Artificial Sequence
  Synthetic
tacatacaatggatacctcacttcgtcatcaaagacacctgaggagcactttgtagagacagtttctttagctgg

SEQ ID NO: 319144 - DNA, 75 bp, Artificial Sequence
  Synthetic
ggacaacgcacggagctaggtgttgaatttcttaagcgtggtgacaagattgtttaccatactctagagagcccc

SEQ ID NO: 319145 - DNA, 75 bp, Artificial Sequence
  Synthetic
ggttttggcatatatgttgttcacaaaattcttttatttattaggtctttcagctataatgcaggtgttctttgg

SEQ ID NO: 319146 - DNA, 75 bp, Artificial Sequence
  Synthetic
aatttcttaagcgtggtgacaagattgtttaccatactctagagagccccatcgagtttcatcttgatggtgagg

SEQ ID NO: 319147 - DNA, 75 bp, Artificial Sequence
  Synthetic
tcttttatctcttcgtgaggtcaagactattaaggtgttcacaacagtggataatactaatctccacactcaaat

SEQ ID NO: 319148 - DNA, 75 bp, Artificial Sequence
  Synthetic
actattaaggtgttcacaacagtggataatactaatctccacactcaaattgtggatatgtctatgacatatgga

SEQ ID NO: 319149 - DNA, 75 bp, Artificial Sequence
  Synthetic
tggtctaaacgaactaactattattattattctgtttggaactttaacattgcttatcatggcagacaacggtac

SEQ ID NO: 319150 - DNA, 75 bp, Artificial Sequence
  Synthetic
acggtgctgatgttacaaaaattaagccccatgcaaatcatgagggtaaaactttctttgtactacctagtgatg

SEQ ID NO: 319151 - DNA, 75 bp, Artificial Sequence
  Synthetic
atacactacgtagtgaagcttttgaatactaccacactctggatgagagttttcttggtaggtacatgtctgctt

SEQ ID NO: 319152 - DNA, 75 bp, Artificial Sequence
  Synthetic
gaatccgcaaagcgagttcttaatgtggtgtgtaaacattgcggccagaaaaccactaccttaatgggtgtggag

SEQ ID NO: 319153 - DNA, 75 bp, Artificial Sequence
  Synthetic
aaccatcaagcctgtgtcatataaactcgatggagttacttacacagagattgaaccaaaattggatgggtatta

SEQ ID NO: 319154 - DNA, 75 bp, Artificial Sequence
  Synthetic
cttatgataatcttaagacaggtgtttccgttccatgtgtatgtggtcgtgacgctacacaatatttagtacaac

SEQ ID NO: 319155 - DNA, 75 bp, Artificial Sequence
  Synthetic
tttcaattgtgtacttttacaaaaagtacaaattctagaattagagcttcactacctacgactattgctaaaaat

SEQ ID NO: 319156 - DNA, 75 bp, Artificial Sequence
  Synthetic
ttctataaggagacatcttacactacaactattaagcctgtgtcatacaaactcgatggagtcacttacacagag

SEQ ID NO: 319157 - DNA, 75 bp, Artificial Sequence
  Synthetic
acaaaaaggataatgcttactacacggagcagcctatagacctcgtaccgactcaaccattgccaaatgcgagtt

SEQ ID NO: 319158 - DNA, 75 bp, Artificial Sequence
  Synthetic
tcgataatttcaagctcacatgttctaatataaaatttgctgatgacttaaatcaaatgacaggcttcacaaagc

SEQ ID NO: 319159 - DNA, 75 bp, Artificial Sequence
  Synthetic
taccttgatgaaatgtaatcattgcgatgaagtttcatggcagacgtgcgactttctgaaagccacttgtgaaca

SEQ ID NO: 319160 - DNA, 75 bp, Artificial Sequence
  Synthetic
attcagcgagtttcaagaaaggtgctaaattactgcataagcccattgtctggcatattaatcaggctacaacca

SEQ ID NO: 319161 - DNA, 75 bp, Artificial Sequence
  Synthetic
atggaagagctatgttcatattatggatggttgcacctcttcgacttgcatgatgtgctataagcgcaatcgtgc

SEQ ID NO: 319162 - DNA, 75 bp, Artificial Sequence
  Synthetic
tggagggttctgttagagtagtaacaacttttgatgctgagtactgtagacatggtacatgcgaaaggtcagaag

SEQ ID NO: 319163 - DNA, 75 bp, Artificial Sequence
  Synthetic
aagtagtggaaaatcctaccgtacagaaggaagtcatagagtgtgacgtgaaaactaccgaagttgtaggcaatg

SEQ ID NO: 319164 - DNA, 75 bp, Artificial Sequence
  Synthetic
tattaaagtaacacaagagttgggtcatgaggatctcatggctgcctatgtggaaaatacaagtattaccatcaa

SEQ ID NO: 319165 - DNA, 75 bp, Artificial Sequence
  Synthetic
ctgggtctaaaaacaattgctactcatggtattgctgcagttaatagtgtcccttggagtaaaattcttgcttat

SEQ ID NO: 319166 - DNA, 75 bp, Artificial Sequence
  Synthetic
tttgaatgaagaggttgccatcattttggcatctttctctgcttctacaagtgcctttattgacactataaagag

SEQ ID NO: 319167 - DNA, 75 bp, Artificial Sequence
  Synthetic
atggtattgctgcagttaatagtgtcccttggagtaaaattcttgcttatgtcaaacctttcctaggacaagcag

SEQ ID NO: 319168 - DNA, 75 bp, Artificial Sequence
  Synthetic
gagattggtgcagcgcgtgttcaacaactacatgccttatgtgtttacattattgttccagttgtgtacttttac

SEQ ID NO: 319169 - DNA, 75 bp, Artificial Sequence
  Synthetic
ctcatataactgctaaggagaccctctatcgtattgacggagctcaccttacaaagatgtcagagtacaaaggac

SEQ ID NO: 319170 - DNA, 75 bp, Artificial Sequence
  Synthetic
gatggtgtcctttctacatttgtgtccgcagcccgtcaaggtgttgtagatactgatgttgatacaaaggatgtc

SEQ ID NO: 319171 - DNA, 75 bp, Artificial Sequence
  Synthetic
tactgatgttgatacaaaggatgtcattgaatgtctcaagctttcatatcactcagatttggaagtgacaggtga

SEQ ID NO: 319172 - DNA, 75 bp, Artificial Sequence
  Synthetic
cttatccagctcttgaaaccattcaggtgacgatttcgtcatataagctagatctcacattcttaggtttggctg

SEQ ID NO: 319173 - DNA, 75 bp, Artificial Sequence
  Synthetic
tcaaaggtggtaagattgttagtacttggtttaaactcatgcttaaagccacactattgtgtgtccttgctgcat

SEQ ID NO: 319174 - DNA, 75 bp, Artificial Sequence
  Synthetic
acactattgtgtgtccttgctgcatttgtttgttacatcgttatgccagtacatacattgtctgctcatgatggt

SEQ ID NO: 319175 - DNA, 75 bp, Artificial Sequence
  Synthetic
ttgcatgatgtgctataagcgcaaccgtgctacacgtgttgagtgtacaactattgttaatggcatgaagagatc

SEQ ID NO: 319176 - DNA, 75 bp, Artificial Sequence
  Synthetic
aaacaggaattgccgtcttagatatgtgtgctgctttgaaagagctgctgcagaatggtatgaatggtcgtacta

SEQ ID NO: 319177 - DNA, 75 bp, Artificial Sequence
  Synthetic
tggtcaaaagacttatgagagacacccactctcccaatttgtcaacttagacaacttgagagctaacaacactaa

SEQ ID NO: 319178 - DNA, 75 bp, Artificial Sequence
  Synthetic
ccactctcccaatttgtcaacttagacaacttgagagctaacaacactaaaggttcactacctattaatgtcata

SEQ ID NO: 319179 - DNA, 75 bp, Artificial Sequence
  Synthetic
atgagtcagctgctaaatctgcttctgtttactacagtcagcttatgtgccaacctattctgttactagatcaag

SEQ ID NO: 319180 - DNA, 75 bp, Artificial Sequence
  Synthetic
tactgaagtttctattaaaatgtttgatgcttatgttgacactttctcggcaacttttagtgtcccaatggaaaa

SEQ ID NO: 319181 - DNA, 75 bp, Artificial Sequence
  Synthetic
tcacctacaataaagtagaaaacatgacgcctagagatcttggcgcatgtattgattgtaatgcaaggcatatta

SEQ ID NO: 319182 - DNA, 75 bp, Artificial Sequence
  Synthetic
ctgtcgctcggctgcatgcctagtgcacctacgcagtataaacaataataaattttactgtcgttgacaagaaac

SEQ ID NO: 319183 - DNA, 75 bp, Artificial Sequence
  Synthetic
gattatatgtctctgtcagaacagctgcgtaaacaaattcgtagtgctgctaagaagaacaacataccatttaga

SEQ ID NO: 319184 - DNA, 75 bp, Artificial Sequence
  Synthetic
tgcgtaaacaaattcgtagtgctgctaagaagaacaacataccatttagactaacttgtgccacaactaggcagg

SEQ ID NO: 319185 - DNA, 75 bp, Artificial Sequence
  Synthetic
ttcacttaagggtggtaaagtcattagtacttggtttaaatttatgcttaaagccacactagtgtgtgttcttgc

SEQ ID NO: 319186 - DNA, 75 bp, Artificial Sequence
  Synthetic
agtacttggtttaaatttatgcttaaagccacactagtgtgtgttcttgctgcattggtttgttacatcgttatg

SEQ ID NO: 319187 - DNA, 75 bp, Artificial Sequence
  Synthetic
atggttacacaaatgaaatcattggctataaagccattcaagatggtgtcactcgtgacattctttccaccgatg

SEQ ID NO: 319188 - DNA, 75 bp, Artificial Sequence
  Synthetic
ttctatgcaaaattgtctgcttaggcttaaagttgacacctctaaccctaagacacccaagtataaatttgtccg

SEQ ID NO: 319189 - DNA, 75 bp, Artificial Sequence
  Synthetic
actcgtgacattctttccaccgatgattgttttgcaaacaaacacgctggttttgacacatggttcagccagcgt

SEQ ID NO: 319190 - DNA, 75 bp, Artificial Sequence
  Synthetic
gctgcccggtagtagctgctatcattactagagagattggcttcatagtgcctggtttacctggtactgttttga

SEQ ID NO: 319191 - DNA, 75 bp, Artificial Sequence
  Synthetic
gctgagtgtacaatctttaaggatgctatgggcaagcctgtgccatattgttatgacactaacttgcttgaaggt

SEQ ID NO: 319192 - DNA, 75 bp, Artificial Sequence
  Synthetic
cagacactcgttatgtgctcatggatggttccattatacaatttcctaacacttacttggaaggttctgttagag

SEQ ID NO: 319193 - DNA, 75 bp, Artificial Sequence
  Synthetic
ataaccacgtaccctggacaaggatgtgctggttatacacttgaggaagctaagactgctcttaagaaatgcaaa

SEQ ID NO: 319194 - DNA, 75 bp, Artificial Sequence
  Synthetic
tgagcattacagagctctacctggagttttctgtggagttgatgctatgaatcttatagcgaacatctttactcc

SEQ ID NO: 319195 - DNA, 75 bp, Artificial Sequence
  Synthetic
gttttctgtggagttgatgctatgaatcttatagcgaacatctttactccccttgttcagcctgtgggtgcctta

SEQ ID NO: 319196 - DNA, 75 bp, Artificial Sequence
  Synthetic
gtggtatcattgccatattggtgacttgtgctgcttactatttcatgaagtttagacgtgcttttggtgaataca

SEQ ID NO: 319197 - DNA, 75 bp, Artificial Sequence
  Synthetic
accatgttgttgctgccaatgcacttctattcttaatgtctttcactatactctgcctggcacctgcttacagct

SEQ ID NO: 319198 - DNA, 75 bp, Artificial Sequence
  Synthetic
actaatgatgtttcattcttggctcatcttcaatggtttgccatgttttctcctattgtgcctttctggataaca

SEQ ID NO: 319199 - DNA, 75 bp, Artificial Sequence
  Synthetic
tttaatggagttacatttagcacctttgaggaggcggctttatgtactttcttacttaataaggaaatgtacctg

SEQ ID NO: 319200 - DNA, 75 bp, Artificial Sequence
  Synthetic
cacttacacagtacaacaggtatcttgctctttataataagtacaagtatttcagtggagccttggatacaacta

SEQ ID NO: 319201 - DNA, 75 bp, Artificial Sequence
  Synthetic
aaattttgtttcatctatacaggaaaagccaaccaacctcgatctcttgttacccaggaaaagccaaccaacctc

SEQ ID NO: 319202 - DNA, 75 bp, Artificial Sequence
  Synthetic
gctatcgtgaagcagcttgctgccatttagctaaggctcttaatgatttcagtaactctggttctgatgttctct

SEQ ID NO: 319203 - DNA, 75 bp, Artificial Sequence
  Synthetic
attaataagttgtgcgaggaaatgctcgacaaccgtgctactcttcaggctattgcttcagaatttagttcttta

SEQ ID NO: 319204 - DNA, 75 bp, Artificial Sequence
  Synthetic
ttctgctgtcttacagagtggttttaggaaaatggcattcccatcaggtaaagttgaagggtgcatggtacaagt

SEQ ID NO: 319205 - DNA, 75 bp, Artificial Sequence
  Synthetic
acaactgcttatgctaatagtgtctttaacatttgtcaagctgttacagccaatgtaaatgcacttctttcaact

SEQ ID NO: 319206 - DNA, 75 bp, Artificial Sequence
  Synthetic
ttcaccatctggtgtttatcagtgtgctatgagacctaattatactatcaagggttctttccttaatggatcatg

SEQ ID NO: 319207 - DNA, 75 bp, Artificial Sequence
  Synthetic
tttctccatgatgattctttctgatgatgccgttgtgtgctataacagtaactatgcggctcaaggtttagtagc

SEQ ID NO: 319208 - DNA, 75 bp, Artificial Sequence
  Synthetic
tggtagtgttggttttaatattgactatgattgcgtgtctttctgttacatgcaccatatggagcttcctacagg

SEQ ID NO: 319209 - DNA, 75 bp, Artificial Sequence
  Synthetic
tatggtacctacaagaacacttgtgatggtaacacttttacatatgcatccgcactctgggaaatccagcaagtt

SEQ ID NO: 319210 - DNA, 75 bp, Artificial Sequence
  Synthetic
tagttaaacaaggagatgattacgtgtacctgccttacccagatccatcaagaatattaggcgcaggctgttttg

SEQ ID NO: 319211 - DNA, 75 bp, Artificial Sequence
  Synthetic
ggtaaattctacggtccttttgttgacagacagactgcacaggctgctggtacagatacaaccattactctaaat

SEQ ID NO: 319212 - DNA, 75 bp, Artificial Sequence
  Synthetic
ggaggtagatttgtgctagcattgttatcagaccaccaagatctcaaatgggctagattccctaagagtgatggt

SEQ ID NO: 319213 - DNA, 75 bp, Artificial Sequence
  Synthetic
cgttgttagacaatgttctggtgttacattccagggtaaattcaagaaaatagttaagggtactcatcattggat

SEQ ID NO: 319214 - DNA, 75 bp, Artificial Sequence
  Synthetic
tgtagcagaggctgttgtgaagactttacaaccagtttctgatctccttaccaacatgggtattgatcttgatga

SEQ ID NO: 319215 - DNA, 75 bp, Artificial Sequence
  Synthetic
agtctgtaccgtctgcggaatgtggaaaggttatggctgtagttgtgaccaactccgcgaacccatgatgcagtc

SEQ ID NO: 319216 - DNA, 75 bp, Artificial Sequence
  Synthetic
ccatcatgtttttagctagagctatagtgtttgtgtgtgttgagtattacccattgctgttcattactggtaata

SEQ ID NO: 319217 - DNA, 75 bp, Artificial Sequence
  Synthetic
ttgtttcttgggctattgctgctgttgctactttggccttttctgtttactcaaccgctactttagacttactct

SEQ ID NO: 319218 - DNA, 75 bp, Artificial Sequence
  Synthetic
cgaaaagatggtttctttgttgtctgtactgctatccatgcagggtgctgtagacattaacaagttgtgcgagga

SEQ ID NO: 319219 - DNA, 75 bp, Artificial Sequence
  Synthetic
gtactgctatccatgcagggtgctgtagacattaacaagttgtgcgaggaaatgctcgacaaccgtgcaaccctt

SEQ ID NO: 319220 - DNA, 75 bp, Artificial Sequence
  Synthetic
gcagctaagctcatggttgttgtccctgattatggtacctacaagaacacttgtgatggtaatacttttacatat

SEQ ID NO: 319221 - DNA, 75 bp, Artificial Sequence
  Synthetic
ttaaaaactgtttacagtgatgtagaaactccacaccttatgggttgggactatccaaaatgtgacagagccatg

SEQ ID NO: 319222 - DNA, 75 bp, Artificial Sequence
  Synthetic
caaagggaggtaggtttattctagcattattatctgaccaccaagacctcaaatgggctagattccctaagagtg

SEQ ID NO: 319223 - DNA, 75 bp, Artificial Sequence
  Synthetic
ttctatttcttatagtgagcttcgtccagacactcgttatgtgcttatggatggttccatcatacagtttcctaa

SEQ ID NO: 319224 - DNA, 75 bp, Artificial Sequence
  Synthetic
ttgttaagcgcgttgattggtctgttgaataccctattataggagatgaactgagggttaattctgcttgcagaa

SEQ ID NO: 319225 - DNA, 75 bp, Artificial Sequence
  Synthetic
tgaccctgtgggttttacacttaggaatacagtctgtaccatctgcggtatgtggaaaggttatggctgtagttg

SEQ ID NO: 319226 - DNA, 75 bp, Artificial Sequence
  Synthetic
tatgctgatgtctttcacttgtatttacaatacattaggaagttacatgatgagcttactggtcacatgctagac

SEQ ID NO: 319227 - DNA, 75 bp, Artificial Sequence
  Synthetic
tgacatggtaccacacatatcacgtcaacgtctaactaagtacacaatggctgacttagtctatgctctacgtca

SEQ ID NO: 319228 - DNA, 75 bp, Artificial Sequence
  Synthetic
caacgtctaactaagtacacaatggctgacttagtctatgctctacgtcattttgatgagggcaattgtgataca

SEQ ID NO: 319229 - DNA, 75 bp, Artificial Sequence
  Synthetic
atctgctacgtgtattacacgatgcaatttaggtggtgctgtttgcagacaccatgcaaatgagtaccgacagta

SEQ ID NO: 319230 - DNA, 75 bp, Artificial Sequence
  Synthetic
attgttgtgatgacgattatttcaataagaaggattggtatgatttcgtagagaatcctgacattttacgcgtgt

SEQ ID NO: 319231 - DNA, 75 bp, Artificial Sequence
  Synthetic
atgtgattggactaatgctggcgattacatacttgccaacacttgtactgagagactcaagctctttgcagcaga

SEQ ID NO: 319232 - DNA, 75 bp, Artificial Sequence
  Synthetic
gtgactatggtgatgctgttgtgtacagaggtactacaacatacaaattgaatgttggtgattactttgtgttaa

SEQ ID NO: 319233 - DNA, 75 bp, Artificial Sequence
  Synthetic
ggtgttgatatcgctgctaatactgtaatctgggactacaaaagagaagccccagcacatgtatctacaataggt

SEQ ID NO: 319234 - DNA, 75 bp, Artificial Sequence
  Synthetic
tcattgtgcaaactttaatgtattattttctactgtgtttccacctacaagttttggaccactagtaagaaaaat

SEQ ID NO: 319235 - DNA, 75 bp, Artificial Sequence
  Synthetic
tgttttggcatggctgtatgctgctgttatcaatggtgataggtggtttcttaatagattcaccactactttgaa

SEQ ID NO: 319236 - DNA, 75 bp, Artificial Sequence
  Synthetic
tggtaagagtcattttgccatcggacttgctctctactacccatctgctcgcatagtgtatacggcatgctctca

SEQ ID NO: 319237 - DNA, 75 bp, Artificial Sequence
  Synthetic
aagctcgagggctatgccttcgaacacatcgtttatggagatttcagtcatggacaacttggcggtcttcattta

SEQ ID NO: 319238 - DNA, 75 bp, Artificial Sequence
  Synthetic
tggctaccaattatgacttgagtgtcgtcaatgctagacttcgtgcaaaacactatgtctacattggtgatcctg

SEQ ID NO: 319239 - DNA, 75 bp, Artificial Sequence
  Synthetic
aaaaattacttcataacagatgcgcaaacaggttcatcaaaatgtgtgtgttctgtgattgatcttttacttgat

SEQ ID NO: 319240 - DNA, 75 bp, Artificial Sequence
  Synthetic
aggagctactgtggtaattggaacaagcaaattttacggtggctggcataacatgttaaaaactgtttacagtga

SEQ ID NO: 319241 - DNA, 75 bp, Artificial Sequence
  Synthetic
ccaggtacagctgtgctcagacaatggttgccaactggcacactacttgtcgattcagatcttaatgacttcgtc

SEQ ID NO: 319242 - DNA, 75 bp, Artificial Sequence
  Synthetic
aaaatgtaactggactttttaaggactgtagtaagatcattaccggtcttcatccaacacaggcacctacacacc

SEQ ID NO: 319243 - DNA, 75 bp, Artificial Sequence
  Synthetic
tgtctacaacccatttatgattgatgttcagcagtggggttttacgggtaaccttcagagtaaccacgaccaaca

SEQ ID NO: 319244 - DNA, 75 bp, Artificial Sequence
  Synthetic
atcagcaattcttggctcatgtggtttatcattagtattgtacaaatggcacccgtttctgcaatggttaggatg

SEQ ID NO: 319245 - DNA, 75 bp, Artificial Sequence
  Synthetic
atttaccaatttaaagcaattgcctttcttttattattctgatagtccttgtgagtctcatggcaaacaagtagt

SEQ ID NO: 319246 - DNA, 75 bp, Artificial Sequence
  Synthetic
gcaatttgggaggtgctgtttgcagacaccatgcaaatgagtaccgacagtacttagatgcatacaacatgatga

SEQ ID NO: 319247 - DNA, 75 bp, Artificial Sequence
  Synthetic
tttctgctggatttagcctatggatttacaaacagtttgatacttataacctgtggaatacatttaccaggttac

SEQ ID NO: 319248 - DNA, 75 bp, Artificial Sequence
  Synthetic
ttacaaacagtttgatacttataacctgtggaatacatttaccaggttacagagtttagaaaatgtggcttacaa

SEQ ID NO: 319249 - DNA, 75 bp, Artificial Sequence
  Synthetic
agagtttagaaaatgtggcttacaatgttgttaacaaaggacacttcgatggacaagctggtgaagcacctgttt

SEQ ID NO: 319250 - DNA, 75 bp, Artificial Sequence
  Synthetic
ccagagattaagatactcaacaatttgggtgtcgatatcgctgctaatactgtgatctgggactataacagagaa

SEQ ID NO: 319251 - DNA, 75 bp, Artificial Sequence
  Synthetic
ccctgctcaattaccagcccctcgcacattgctaactaaaggcacactagaacccgagtatttcaattcagtgtg

SEQ ID NO: 319252 - DNA, 75 bp, Artificial Sequence
  Synthetic
gacatgtttctcggaacatgtcgtcgttgtccagctgagattgtcgacactgtgagtgctttagtttatgataat

SEQ ID NO: 319253 - DNA, 75 bp, Artificial Sequence
  Synthetic
gcctactttactcagagccgagacttagagaatttcaagcccaggtcacaaatggaaactgactttcttgagctc

SEQ ID NO: 319254 - DNA, 75 bp, Artificial Sequence
  Synthetic
tcatctgcaatcaacaggcctcaaataggtgttgtaagagaatttcttacacgcaaccctgcatggagaaaagct

SEQ ID NO: 319255 - DNA, 75 bp, Artificial Sequence
  Synthetic
tatgctaacttaggtgagcgtgtacgccaatcattattaaagactgtacaattctgcgatgctatgcgtgatgca

SEQ ID NO: 319256 - DNA, 75 bp, Artificial Sequence
  Synthetic
agaatgctgtagctgctaaaatcttaggattgcctacacaaactgtagattcttcacagggttctgagtatgact

SEQ ID NO: 319257 - DNA, 75 bp, Artificial Sequence
  Synthetic
acgactttgttgagataataaagtcacaggatttgtcagtaatctctaaggtagtcaaggttacaattgactacg

SEQ ID NO: 319258 - DNA, 75 bp, Artificial Sequence
  Synthetic
gtctgacagagatctttatgacaaattgcaatttacaagtctagaagtaccacgtcgtaatgtggctacattaca

SEQ ID NO: 319259 - DNA, 75 bp, Artificial Sequence
  Synthetic
ctgagatttcattcatgctttggtgtaaagatggtcatgtcgaaaccttctacccaaaattacaggcaagtcaag

SEQ ID NO: 319260 - DNA, 75 bp, Artificial Sequence
  Synthetic
tttctacctcgtgtttttagtgctgttggcaacatttgctacacaccttccaaactcattgagtatagtgatttt

SEQ ID NO: 319261 - DNA, 75 bp, Artificial Sequence
  Synthetic
atggttaccctaacatgtttatcacccgtgaagaagccatccgccacgttcgtgcgtggattggctttgatgtag

SEQ ID NO: 319262 - DNA, 75 bp, Artificial Sequence
  Synthetic
gctaataaatgggatctcattattagcgatatgtatgaccctaagaccaaacatgtgacaaaagagaatgactca

SEQ ID NO: 319263 - DNA, 75 bp, Artificial Sequence
  Synthetic
acatgtgacaaaagagaatgactcaaaagaggggtttttcacttacctgtgtggatttataaagcaaaaactagc

SEQ ID NO: 319264 - DNA, 75 bp, Artificial Sequence
  Synthetic
ataacagagcattcttggaatgctgatctttacaagcttatgggacacttctcatggtggacagcttttgttaca

SEQ ID NO: 319265 - DNA, 75 bp, Artificial Sequence
  Synthetic
aggattatcagacagagttgtgtttgtcctatgggcacatggctttgaacttacatcaatgaagtactttgtcaa

SEQ ID NO: 319266 - DNA, 75 bp, Artificial Sequence
  Synthetic
ctcatggtggacagcttttgttacaaatgtaaatgcatcgtcatcagaagcatttttaattggagctaactatct

SEQ ID NO: 319267 - DNA, 75 bp, Artificial Sequence
  Synthetic
ggctataccatgcatgctaactacattttttggaggaacacaaaccctatccaattgtcttcctattcacttttt

SEQ ID NO: 319268 - DNA, 75 bp, Artificial Sequence
  Synthetic
ttttttggaggaacacaaaccctatccaattgtcttcctattcactttttgacatgagtaaatttccccttaagt

SEQ ID NO: 319269 - DNA, 75 bp, Artificial Sequence
  Synthetic
aaaagagaatcaaatcaatgacatgatttattccttgcttgaaaaaggtagactcatcattagagaaaacaacag

SEQ ID NO: 319270 - DNA, 75 bp, Artificial Sequence
  Synthetic
atttattccttgcttgaaaaaggtagactcatcattagagaaaacaacagagttgtggtctcgagtgacgtgctt

SEQ ID NO: 319271 - DNA, 75 bp, Artificial Sequence
  Synthetic
ttttgattgttcttttatgcctcggccttgttactgctcaagatggctgtgggcatattagcactaaacctcaac

SEQ ID NO: 319272 - DNA, 75 bp, Artificial Sequence
  Synthetic
ccttgttactgctcaagatggctgtgggcatattagcactaaacctcaaccattaatggataaattttcttcttc

SEQ ID NO: 319273 - DNA, 75 bp, Artificial Sequence
  Synthetic
gacatttttcgatcagatgttttacatcttactcaggattattttctaccatttgacaccaatctaacgcgttat

SEQ ID NO: 319274 - DNA, 75 bp, Artificial Sequence
  Synthetic
atcttactcaggattattttctaccatttgacaccaatctaacgcgttatttgtcttttaacatggattctgcaa

SEQ ID NO: 319275 - DNA, 75 bp, Artificial Sequence
  Synthetic
tctattcttatgctacacatcatgataaattcactgatggtgtttgtttattttggaattgtaacgttgatcgtt

SEQ ID NO: 319276 - DNA, 75 bp, Artificial Sequence
  Synthetic
attaccatttggtgacggcatttattttgcagccactgaaaaatctaatgttgttagaggctggatttttggttc

SEQ ID NO: 319277 - DNA, 75 bp, Artificial Sequence
  Synthetic
tttgcagccactgaaaaatctaatgttgttagaggctggatttttggttccactatggataacaccacgcaatct

SEQ ID NO: 319278 - DNA, 75 bp, Artificial Sequence
  Synthetic
atattattatacgtgtgtgttattttaatttatgtaaagaacccatgtatgccatctcgaatgagcagcattaca

SEQ ID NO: 319279 - DNA, 75 bp, Artificial Sequence
  Synthetic
taatttatgtaaagaacccatgtatgccatctcgaatgagcagcattacaaatcatgggtgtatcaaaatgcata

SEQ ID NO: 319280 - DNA, 75 bp, Artificial Sequence
  Synthetic
tgcctttcttttattactctgacagcccttgtgagtcacatggcaagcaggttgtttctgacattgattatgtac

SEQ ID NO: 319281 - DNA, 75 bp, Artificial Sequence
  Synthetic
ttggcatcattaacaacacagtttatgatcctctgcaacctgagcttgactcattcaaagaagagctggacaagt

SEQ ID NO: 319282 - DNA, 75 bp, Artificial Sequence
  Synthetic
cagagctttcaactcgacactgcccctcagactggaaattttaaggacttacgtgagtatgtctttaaaaataag

SEQ ID NO: 319283 - DNA, 75 bp, Artificial Sequence
  Synthetic
ctcagactggaaattttaaggacttacgtgagtatgtctttaaaaataaggatgggtttctaagtgtttataatg

SEQ ID NO: 319284 - DNA, 75 bp, Artificial Sequence
  Synthetic
gggtcttcctgttggtttttcggtgttgaaaccaattcttaaactccctataagtataaatattacctcttttaa

SEQ ID NO: 319285 - DNA, 75 bp, Artificial Sequence
  Synthetic
ttgaaaccaattcttaaactccctataagtataaatattacctcttttaaggtagttatgtccatgtttagcaga

SEQ ID NO: 319286 - DNA, 75 bp, Artificial Sequence
  Synthetic
gttacagtgtttagaaaatgtggcttacaatgttgttaacaaaggacactttgacggacaaactggtgaagcgcc

SEQ ID NO: 319287 - DNA, 75 bp, Artificial Sequence
  Synthetic
tacaatgttgttaacaaaggacactttgacggacaaactggtgaagcgcccgtttccatcattaataacgctgtt

SEQ ID NO: 319288 - DNA, 75 bp, Artificial Sequence
  Synthetic
ttgctgcttattttgttggtaacttaaaatatagtaccttcatgcttaattttaatgagaatgggactattactg

SEQ ID NO: 319289 - DNA, 75 bp, Artificial Sequence
  Synthetic
aaaatatagtaccttcatgcttaattttaatgagaatgggactattactgatgccattgattgtgcccaaaatcc

SEQ ID NO: 319290 - DNA, 75 bp, Artificial Sequence
  Synthetic
ttgagatcttcgaaaataagacaacacttcctgttaatgttgcatttgagctctgggccaaacgtaatattaaac

SEQ ID NO: 319291 - DNA, 75 bp, Artificial Sequence
  Synthetic
aaaaattttaatgtcagtaaaggaatctatcagacatctaacttcagagtatcaccaactcatgaagttattagg

SEQ ID NO: 319292 - DNA, 75 bp, Artificial Sequence
  Synthetic
tctatcagacatctaacttcagagtatcaccaactcatgaagttattaggttccctaacattacaaaccgctgtc

SEQ ID NO: 319293 - DNA, 75 bp, Artificial Sequence
  Synthetic
tcgctttcccaatgtttatgcttgggaaagaacaaaaatttctgattgtgttgctgattacactgttctctacaa

SEQ ID NO: 319294 - DNA, 75 bp, Artificial Sequence
  Synthetic
ttgctgattacactgttctctacaactcaacttcattttcaacttttaaatgttatggagtttctccctctaagt

SEQ ID NO: 319295 - DNA, 75 bp, Artificial Sequence
  Synthetic
gacctttttagaaatgcccgtaatggtgttttaataacagaaggttcagttaaaggtttgacaccctcaaaagga

SEQ ID NO: 319296 - DNA, 75 bp, Artificial Sequence
  Synthetic
tgcttgtcgctgcaggtatggaggcgcaatttttgtacctctatgccttgatatattttctacaatgcatcaacg

SEQ ID NO: 319297 - DNA, 75 bp, Artificial Sequence
  Synthetic
tcacattaattggagagtcagtaaaaacacagtttaactattttaagaaagtggatggcatcattcaacagttgc

SEQ ID NO: 319298 - DNA, 75 bp, Artificial Sequence
  Synthetic
tcttcagaagtaaggcaagttgcaccaggtgaaactggtgttattgctgactataactacaaactgcctgatgac

SEQ ID NO: 319299 - DNA, 75 bp, Artificial Sequence
  Synthetic
aacacagtttaactattttaagaaagtggatggcatcattcaacagttgcctgaaacctactttactcaaagccg

SEQ ID NO: 319300 - DNA, 75 bp, Artificial Sequence
  Synthetic
acactgctaaacaagatcagggccagtattattatagatcctccagaaaaacaaaacttaaaccttttgagaggg

SEQ ID NO: 319301 - DNA, 75 bp, Artificial Sequence
  Synthetic
tcacaaatggaaactgattttcttgagcttgcgatggatgaattcatacaacggtacaagcttgaaggctatgcc

SEQ ID NO: 319302 - DNA, 75 bp, Artificial Sequence
  Synthetic
gtattattatagatcctccagaaaaacaaaacttaaaccttttgagagggatctaacttctgacgaaaatggtgt

SEQ ID NO: 319303 - DNA, 75 bp, Artificial Sequence
  Synthetic
agcttgcgatggatgaattcatacaacggtacaagcttgaaggctatgccttcgaacacatcgtttatggagatt

SEQ ID NO: 319304 - DNA, 75 bp, Artificial Sequence
  Synthetic
tatcctaatgtgcctattgaatatcaggctactagggttgttgtgctttcattcgagcttctaaatgcacctgct

SEQ ID NO: 319305 - DNA, 75 bp, Artificial Sequence
  Synthetic
tcatctaatgattggtctagctaagcgctcacaagattcaccgcttaagttagaagattttatccctatggatag

SEQ ID NO: 319306 - DNA, 75 bp, Artificial Sequence
  Synthetic
aggctactagggttgttgtgctttcattcgagcttctaaatgcacctgctacagtttgtggacctaaattatcca

SEQ ID NO: 319307 - DNA, 75 bp, Artificial Sequence
  Synthetic
taccagcttgagtctacacaaattactacagacactggtattgaaaatgctacattcttcatctttaacaagctt

SEQ ID NO: 319308 - DNA, 75 bp, Artificial Sequence
  Synthetic
caatttcaattttaatggactcaaaggtactggtgttctgactgattcttcaaagagatttcagtcatttcaaca

SEQ ID NO: 319309 - DNA, 75 bp, Artificial Sequence
  Synthetic
gatgcgcagacgggttcatcaaaatgcgtgtgctctgttattgatctcctgcttgatgactttgtagagataata

SEQ ID NO: 319310 - DNA, 75 bp, Artificial Sequence
  Synthetic
ggtactggtgttctgactgattcttcaaagagatttcagtcatttcaacaatttggaagagacacgtcggatttc

SEQ ID NO: 319311 - DNA, 75 bp, Artificial Sequence
  Synthetic
caaaggtggtcaaagttacaattgactatgctgaaatttcattcatgttatggtgtaaggatggacatgttgaaa

SEQ ID NO: 319312 - DNA, 75 bp, Artificial Sequence
  Synthetic
cattgcagatacttgacattacaccatgttcttttggtggtgtgagtgtaataacacctggaacaaatgcttcat

SEQ ID NO: 319313 - DNA, 75 bp, Artificial Sequence
  Synthetic
atgttcttttggtggtgtgagtgtaataacacctggaacaaatgcttcatctgaagtggctgttctttaccaaga

SEQ ID NO: 319314 - DNA, 75 bp, Artificial Sequence
  Synthetic
gccatacgtgcagaccaattaacaccagcttggcgcgtttactcaaccggagtaaatgtgtttcaaacacaagct

SEQ ID NO: 319315 - DNA, 75 bp, Artificial Sequence
  Synthetic
attttggtgcaggctcagacaaaggagttgcacctggcactgctgttctcagacagtggttgccaattggcacac

SEQ ID NO: 319316 - DNA, 75 bp, Artificial Sequence
  Synthetic
atcggacttgctctctattacccatctgctcgcatagtgtatacggcatgctctcatgcagctgttgatgcccta

SEQ ID NO: 319317 - DNA, 75 bp, Artificial Sequence
  Synthetic
gtagtgtaggtcagaaatccattgtggcttacactatgtctttgggtgcagaaaattctattgcttatgctaata

SEQ ID NO: 319318 - DNA, 75 bp, Artificial Sequence
  Synthetic
ttcaatcagtgtcacaactgaagtgatgcctgtttcgatggctaagacatcagtagattgtacaatgtacatctg

SEQ ID NO: 319319 - DNA, 75 bp, Artificial Sequence
  Synthetic
accaaacatgtgacgaaggaaaatgactcaaaagaaggatttttcacttacctgtgtggatttattaaacaaaaa

SEQ ID NO: 319320 - DNA, 75 bp, Artificial Sequence
  Synthetic
ttacttctccagtatggaagtttctgcacgcaattaaatcgtgctctcacgggcgttgccttagaacaggacaaa

SEQ ID NO: 319321 - DNA, 75 bp, Artificial Sequence
  Synthetic
taaagataactgagcattcttggaatgcggatctctacaagcttatgggacatttctcatggtggacagcgtttg

SEQ ID NO: 319322 - DNA, 75 bp, Artificial Sequence
  Synthetic
ttacaaatgttaatgcatcttcatcagaagcatttttaattggagttaactatcttggcaagccaaaagaacaaa

SEQ ID NO: 319323 - DNA, 75 bp, Artificial Sequence
  Synthetic
actcttgctgatgctggctttatgaaacaatatggcgaatgcctaggcgatattagtgctagagacctcatttgt

SEQ ID NO: 319324 - DNA, 75 bp, Artificial Sequence
  Synthetic
ttacattttctggaggaacacaaacccgattcaattatcttcctattcactttttgacatgagtaaatttcctct

SEQ ID NO: 319325 - DNA, 75 bp, Artificial Sequence
  Synthetic
ccgattcaattatcttcctattcactttttgacatgagtaaatttcctcttaaattaagaggaacggctgtcatg

SEQ ID NO: 319326 - DNA, 75 bp, Artificial Sequence
  Synthetic
ggacactccctagggcgctgtgacattaaggacctgccaaaagagatcactgtggctacatcacgaacgctttct

SEQ ID NO: 319327 - DNA, 75 bp, Artificial Sequence
  Synthetic
aaatgatttattctctaattgaaaagggtagacttatcattagagaaaacaacagggttgtagtttcaagtgata

SEQ ID NO: 319328 - DNA, 75 bp, Artificial Sequence
  Synthetic
gggtagacttatcattagagaaaacaacagggttgtagtttcaagtgatattttagttaataattaaacgaacat

SEQ ID NO: 319329 - DNA, 75 bp, Artificial Sequence
  Synthetic
tttagtcttttctgtgtgtctggtgattctattgacacctgtgaaacttttgatgatgtctctcccccacaacaa

SEQ ID NO: 319330 - DNA, 75 bp, Artificial Sequence
  Synthetic
attctattgacacctgtgaaacttttgatgatgtctctcccccacaacaaaatttagtttcatcgtctaaacgtg

SEQ ID NO: 319331 - DNA, 75 bp, Artificial Sequence
  Synthetic
ccgttcagatgttcaccacttggtacaagatctttttcttccattcaactctaacgttgttggactcatgtcctt

SEQ ID NO: 319332 - DNA, 75 bp, Artificial Sequence
  Synthetic
caagatctttttcttccattcaactctaacgttgttggactcatgtccttcaactatagatttgataatcccatt

SEQ ID NO: 319333 - DNA, 75 bp, Artificial Sequence
  Synthetic
gttagatgatgaagaacctatggagttagattatccataaaacgaacatgaaaattattctcttcctgacattga

SEQ ID NO: 319334 - DNA, 75 bp, Artificial Sequence
  Synthetic
tcgcagccactgaaaagtctaatgtagtgagaggttgggtctttggttctacaatgaacaacaaatcccagtccg

SEQ ID NO: 319335 - DNA, 75 bp, Artificial Sequence
  Synthetic
agtgagaggttgggtctttggttctacaatgaacaacaaatcccagtccgttataattatgaacaactccaccaa

SEQ ID NO: 319336 - DNA, 75 bp, Artificial Sequence
  Synthetic
aactgctgacattgtagtctttgatgaaatctctatggctactaattatgacttgagtgttgtcaatgctagact

SEQ ID NO: 319337 - DNA, 75 bp, Artificial Sequence
  Synthetic
caattatgtgacaacccattttttgctgtcattagacccacttcgcagcagatagaaacgatattatttgaaaat

SEQ ID NO: 319338 - DNA, 75 bp, Artificial Sequence
  Synthetic
tggaagaggctatcatcttatgtcttttcctcaggccgctccgcatggtgttgttttcttacatgtcacatatgt

SEQ ID NO: 319339 - DNA, 75 bp, Artificial Sequence
  Synthetic
ctgtcattagacccacttcgcagcagatagaaacgatattatttgaaaatgccttcaattgcactttcgagtatg

SEQ ID NO: 319340 - DNA, 75 bp, Artificial Sequence
  Synthetic
tggtgaaaaacctggcaattttaagcacttgcgtgaatttatatttaagaataaggatggttttctcaacatcta

SEQ ID NO: 319341 - DNA, 75 bp, Artificial Sequence
  Synthetic
tgtttttgtatctaatggcacttcttggttcattacacagaggaatttttactcaccacaaataatcacaacaga

SEQ ID NO: 319342 - DNA, 75 bp, Artificial Sequence
  Synthetic
cacttgcgtgaatttatatttaagaataaggatggttttctcaacatctattctggttttcagaatatagatgta

SEQ ID NO: 319343 - DNA, 75 bp, Artificial Sequence
  Synthetic
gtcttttgaagcctttattaaaattacctttaggcctcaatattactaatttcagagtacttcttactgctttta

SEQ ID NO: 319344 - DNA, 75 bp, Artificial Sequence
  Synthetic
acctttaggcctcaatattactaatttcagagtacttcttactgcttttatacctaacataggaacatggggaac

SEQ ID NO: 319345 - DNA, 75 bp, Artificial Sequence
  Synthetic
tttcactcgaaatccaggatctagaagaaccttgtaccaaagtctaaacgaacatgaaacttctcattgttttga

SEQ ID NO: 319346 - DNA, 75 bp, Artificial Sequence
  Synthetic
tatcttaaacctactacttttatgcttaagtatgattataatggcacaattgttgatgctgtcgattgctctcaa

SEQ ID NO: 319347 - DNA, 75 bp, Artificial Sequence
  Synthetic
ttaagtatgattataatggcacaattgttgatgctgtcgattgctctcaacatccactagctgaactcaagtgct

SEQ ID NO: 319348 - DNA, 75 bp, Artificial Sequence
  Synthetic
gcctcaatgaggttgccaaaaatctaaatgaatcgctcattgaccttcaagaacttggtaagtatgagcaataca

SEQ ID NO: 319349 - DNA, 75 bp, Artificial Sequence
  Synthetic
catttcaggcattaatgcttctgtcgtcaatattcaaaaagaaattgaccgcctcaatgaggttgccaaaaatct

SEQ ID NO: 319350 - DNA, 75 bp, Artificial Sequence
  Synthetic
gaacttggtaagtatgagcaatacatcaaatggccttggtacgtttggctcggcttcattgctggactgattgct

SEQ ID NO: 319351 - DNA, 75 bp, Artificial Sequence
  Synthetic
aggtatttatcaaacctccaactttagagtttcaccctcaaaagaagttgtgaggttccctaatattacaaatct

SEQ ID NO: 319352 - DNA, 75 bp, Artificial Sequence
  Synthetic
agagtttcaccctcaaaagaagttgtgaggttccctaatattacaaatctatgtccttttggagaggtttttaat

SEQ ID NO: 319353 - DNA, 75 bp, Artificial Sequence
  Synthetic
gttgcatgaccagctgttgcagttgcctcaagggtgcatgctcttgtggttcttgctgcaaatttgatgaggatg

SEQ ID NO: 319354 - DNA, 75 bp, Artificial Sequence
  Synthetic
catgggaaaggaagagaatttccaattgtgttgctgattactctgtgctctacaactcaacatctttctcaactt

SEQ ID NO: 319355 - DNA, 75 bp, Artificial Sequence
  Synthetic
atttagagacgtacttgttgttttaaataaacgaacaaattaaaatgtctgataatggaccccaatcaaaccaac

SEQ ID NO: 319356 - DNA, 75 bp, Artificial Sequence
  Synthetic
caaattacactacacataaacgaacttaatggatttgtttatgagtattttcacgctcggatcaatcacacgtca

SEQ ID NO: 319357 - DNA, 75 bp, Artificial Sequence
  Synthetic
tcaagtgttatggcgtttctgccattaagttgaatgacctttgcttctccaatgtttacgcagattcttttgtag

SEQ ID NO: 319358 - DNA, 75 bp, Artificial Sequence
  Synthetic
gctgattataattataaattgcctgatgatttcatgggttgtgtccttgcttggaacaccaggaatattgatgct

SEQ ID NO: 319359 - DNA, 75 bp, Artificial Sequence
  Synthetic
aatatagatctctcagacatggtaagcttagaccatttgagagagacatttctaatgtgcctttttcccctgatg

SEQ ID NO: 319360 - DNA, 75 bp, Artificial Sequence
  Synthetic
gcttagaccatttgagagagacatttctaatgtgcctttttcccctgatggtaaaccttgcaccccacctgcttt

SEQ ID NO: 319361 - DNA, 75 bp, Artificial Sequence
  Synthetic
ctcacacctactacttttagctgctggcatggaggcacaatttttgtacatctatgccctgatttatattctgca

SEQ ID NO: 319362 - DNA, 75 bp, Artificial Sequence
  Synthetic
tctatgccctgatttatattctgcaagttgtgagcttctgcagatttattatgaggtgctggctttgctggaagt

SEQ ID NO: 319363 - DNA, 75 bp, Artificial Sequence
  Synthetic
tacggtttttataccactaatggcataggttaccaaccttatagagttgtagtcttgtcttttgaacttctaaac

SEQ ID NO: 319364 - DNA, 75 bp, Artificial Sequence
  Synthetic
taggttaccaaccttatagagttgtagtcttgtcttttgaacttctaaacgcacctgctacagtctgtggaccaa

SEQ ID NO: 319365 - DNA, 75 bp, Artificial Sequence
  Synthetic
ggtagtttgtatgtgaataagcatgcattccacactccagctttcgataaaagtgcatttactaatttaaagcaa

SEQ ID NO: 319366 - DNA, 75 bp, Artificial Sequence
  Synthetic
ggactcactggtactggtgttttaactccttctttaaagagatttcaaccatttcagcaatttggtcgtgatttt

SEQ ID NO: 319367 - DNA, 75 bp, Artificial Sequence
  Synthetic
atccgaagacacttgaagtattggacatctcaccctgttcttttggtggtgtgagtgtaattacacctggaacca

SEQ ID NO: 319368 - DNA, 75 bp, Artificial Sequence
  Synthetic
catctcaccctgttcttttggtggtgtgagtgtaattacacctggaaccaatatttcatctgaagtggctgttct

SEQ ID NO: 319369 - DNA, 75 bp, Artificial Sequence
  Synthetic
acgatttcggtgatttcgtacaagtagcaccaggctgcggagttcctattgtggattcatattactcattgctga

SEQ ID NO: 319370 - DNA, 75 bp, Artificial Sequence
  Synthetic
ttgaaccagcttgagagcaaagtttctggtaaaggccaacaacaacaaggccaaactgtcactaagaaatctgct

SEQ ID NO: 319371 - DNA, 75 bp, Artificial Sequence
  Synthetic
gtgcctacagctattcatgcagaccaactcacccctgcttggcgtatttactctgcaggagtaaatgtgtttcaa

SEQ ID NO: 319372 - DNA, 75 bp, Artificial Sequence
  Synthetic
aactcacccctgcttggcgtatttactctgcaggagtaaatgtgtttcaaacccaagctggctgtctaataggag

SEQ ID NO: 319373 - DNA, 75 bp, Artificial Sequence
  Synthetic
gtgtgacatccctattggtgctggcatttgtgctagttaccatacagcttctctcttacgtaatacagaccagaa

SEQ ID NO: 319374 - DNA, 75 bp, Artificial Sequence
  Synthetic
atttgtgctagttaccatacagcttctctcttacgtaatacagaccagaaatcaattgtggcctatactatgtca

SEQ ID NO: 319375 - DNA, 75 bp, Artificial Sequence
  Synthetic
ccagtgccagagattaagatactcaataatttgggtgttgatatcgctgctaatactgtaatctgggactacaaa

SEQ ID NO: 319376 - DNA, 75 bp, Artificial Sequence
  Synthetic
atgctaataattcaattgccatacctacaaatttttctataagcatcaccactgaagtgatgcctgtttcaatgg

SEQ ID NO: 319377 - DNA, 75 bp, Artificial Sequence
  Synthetic
actgaagtgatgcctgtttcaatggctaagacatccgtggattgtacaatgtacatttgcggtgactctcaggag

SEQ ID NO: 319378 - DNA, 75 bp, Artificial Sequence
  Synthetic
gatttctccagacaacttcaaaattccatgagtggagcttctgctgattcaactcaggcataaacactcatgatg

SEQ ID NO: 319379 - DNA, 75 bp, Artificial Sequence
  Synthetic
atcatttattgaggatttactcttcaataaagtgactcttgctgatgctggcttcatgaagcaatatggagaatg

SEQ ID NO: 319380 - DNA, 75 bp, Artificial Sequence
  Synthetic
ctcatttgtgcgcaaaagtttaatggacttactgtccttccacctttgctcactgacgaaatgattgctgcctac

SEQ ID NO: 319381 - DNA, 75 bp, Artificial Sequence
  Synthetic
gacttactgtccttccacctttgctcactgacgaaatgattgctgcctacacagctgcactagtcagcggtactg

SEQ ID NO: 319382 - DNA, 75 bp, Artificial Sequence
  Synthetic
gggtgctgctcttcaaataccctttgctatgcaaatggcttataggtttaatggcattggagttacccaaaacgt

SEQ ID NO: 319383 - DNA, 75 bp, Artificial Sequence
  Synthetic
gctatgcaaatggcttataggtttaatggcattggagttacccaaaacgttctctatgagaatcagaagcagatc

SEQ ID NO: 319384 - DNA, 75 bp, Artificial Sequence
  Synthetic
aaagaatagagctcgcaccgtagctggtgtctctatctgtagtactatgacaaatagacagtttcatcagaaatt

SEQ ID NO: 319385 - DNA, 75 bp, Artificial Sequence
  Synthetic
gccaaattcaagaatctcttaccacaacatcaactgctttgggcaagctgcaggacgttgtcaatcagaatgctc

SEQ ID NO: 319386 - DNA, 75 bp, Artificial Sequence
  Synthetic
aacatcaactgctttgggcaagctgcaggacgttgtcaatcagaatgctcaagcattgaatacacttgttaaaca

SEQ ID NO: 319387 - DNA, 75 bp, Artificial Sequence
  Synthetic
tgctgaaatcagagcttctgctaaccttgctgctactaaaatgtctgagtgtgttcttggacaatcaaaaagagt

SEQ ID NO: 319388 - DNA, 75 bp, Artificial Sequence
  Synthetic
ccttagcggaggcacgtgaacatcttaaaaatggcacttgtggcttagtggagctggagaagggcgttttgcctc

SEQ ID NO: 319389 - DNA, 75 bp, Artificial Sequence
  Synthetic
ctcatgtctttccctcaagcagccccgcatggtgtcgtcttcctacatgttacatatgtgccatctcaggagagg

SEQ ID NO: 319390 - DNA, 75 bp, Artificial Sequence
  Synthetic
taaacgttctgatgcccagggcaccaatcacggctataaggtcgttgaattggttgcagaattggacggcattca

SEQ ID NO: 319391 - DNA, 75 bp, Artificial Sequence
  Synthetic
gtcatgaaggcaaggcatacttccctcgtgaaggtgtctttgtatctaatggcacttcttggtttatcacacaga

SEQ ID NO: 319392 - DNA, 75 bp, Artificial Sequence
  Synthetic
tggttgcagaattggacggcattcagtacggtcgtagcggtacaacactgggagtcctcgtgccacatgtgggcg

SEQ ID NO: 319393 - DNA, 75 bp, Artificial Sequence
  Synthetic
tacaacagacaatacatttgtctcgggaaattgtgatgtcgtcattggcatcatcaacaatactgtttacgatcc

SEQ ID NO: 319394 - DNA, 75 bp, Artificial Sequence
  Synthetic
ttttaaaaattggacctcgtaagtctgctcgcctagtacaactttgtgctggtgaatatggacacagagttccaa

SEQ ID NO: 319395 - DNA, 75 bp, Artificial Sequence
  Synthetic
tgtcgagctgggcactgatcccattgaagattatgaacaaaactggaacactaagcatggtggtggtgtactccg

SEQ ID NO: 319396 - DNA, 75 bp, Artificial Sequence
  Synthetic
taaattagaggattttatccctatggacagcacagtgaaaaattacttcataacagatgcgcaaacaggttcatc

SEQ ID NO: 319397 - DNA, 75 bp, Artificial Sequence
  Synthetic
aaagaagagctggataagtacttcaaaaatcacacatcacctgatgtggatcttggcgacatttcacgcattaat

SEQ ID NO: 319398 - DNA, 75 bp, Artificial Sequence
  Synthetic
aaaatcacacatcacctgatgtggatcttggcgacatttcacgcattaatgcttcagtcgtcaacattcaaaaag

SEQ ID NO: 319399 - DNA, 75 bp, Artificial Sequence
  Synthetic
caaaaatctaaatgagtcgctcattgatctccaggaacttggaaaatatgagcaatatattaaatggccttggta

SEQ ID NO: 319400 - DNA, 75 bp, Artificial Sequence
  Synthetic
gtagtgccccccgcattacatttggtggacccacagattcaactgacaataaccaggatggaggacgcagtggtg

SEQ ID NO: 319401 - DNA, 75 bp, Artificial Sequence
  Synthetic
ctgattgctatcgttatggccactattctgctttgttgcatgaccagctgttgcagttgcctcaagggtgcttgc

SEQ ID NO: 319402 - DNA, 75 bp, Artificial Sequence
  Synthetic
ttgtttggttcactgagcgctctgagaagagctatgagcgtcagacacccttcgagatcaagagtgccaagaaat

SEQ ID NO: 319403 - DNA, 75 bp, Artificial Sequence
  Synthetic
catggggcgcattcgctctgtgtatcctgttgccactcctcaagagtgcaacgacatgcacttgtctaccttgat

SEQ ID NO: 319404 - DNA, 75 bp, Artificial Sequence
  Synthetic
ttttcagagcgctaccaaaataatcgcgctcaataagagatggcagctagccctttacaagggtttccagttcat

SEQ ID NO: 319405 - DNA, 75 bp, Artificial Sequence
  Synthetic
cctgagcatagtgttgcagactaccataaccattcaaacattgaaactcgactccgcaagggaggtaggactaaa

SEQ ID NO: 319406 - DNA, 75 bp, Artificial Sequence
  Synthetic
ataaccattcaaacattgaaactcgactccgcaagggaggtaggactaaatgttttgggggttgtgtgtttgcct

SEQ ID NO: 319407 - DNA, 75 bp, Artificial Sequence
  Synthetic
ttgctgcaggtatggaagcgcaatttttgtacctctatgccttgatatattttctgcaatgcatcaatgcgtgca

SEQ ID NO: 319408 - DNA, 75 bp, Artificial Sequence
  Synthetic
agctgtaaagataacagagcattcttggaatgctgacctttacaagcttatgggccatttctcatggtggacagc

SEQ ID NO: 319409 - DNA, 75 bp, Artificial Sequence
  Synthetic
ctggaagtgcagatccaagaatccattactttatgatgctaactactttgtttgttggcataccaattgttatga

SEQ ID NO: 319410 - DNA, 75 bp, Artificial Sequence
  Synthetic
atactgggttcctcgtgctagtgccaatataggcgcaagccatactggcattactggtgataacgtggagactct

SEQ ID NO: 319411 - DNA, 75 bp, Artificial Sequence
  Synthetic
aatataggcgcaagccatactggcattactggtgataacgtggagactctgaatgaggatcttatggagatattg

SEQ ID NO: 319412 - DNA, 75 bp, Artificial Sequence
  Synthetic
ttactttatgatgctaactactttgtttgttggcataccaattgttatgactactgtataccttacaacagtgtc

SEQ ID NO: 319413 - DNA, 75 bp, Artificial Sequence
  Synthetic
gtgacggaacaaatgtgccaaaactaaaggaagactaccaaataggtggttattctgaagactggcactcaggtg

SEQ ID NO: 319414 - DNA, 75 bp, Artificial Sequence
  Synthetic
ttgtcggcgattttcatttgaatgaggaggttgctattattttggcatccttttcagcatctacgtgtgcttttg

SEQ ID NO: 319415 - DNA, 75 bp, Artificial Sequence
  Synthetic
ggaggttgctattattttggcatccttttcagcatctacgtgtgcttttgttgacactgtgaaaggtcttgatta

SEQ ID NO: 319416 - DNA, 75 bp, Artificial Sequence
  Synthetic
ttatttcactgaaatctactaccagctcgaatcgactcaattgtcgacagacactggtgctgaaaatgctacatt

SEQ ID NO: 319417 - DNA, 75 bp, Artificial Sequence
  Synthetic
tcctgcggtaactttaaagttacgcgtggcagagctaagaaaggagcttggaacattggacaggaaaaatctatt

SEQ ID NO: 319418 - DNA, 75 bp, Artificial Sequence
  Synthetic
gtggcagagctaagaaaggagcttggaacattggacaggaaaaatctattttaacaccactgtatggtttcccct

SEQ ID NO: 319419 - DNA, 75 bp, Artificial Sequence
  Synthetic
aatttttactcgtgcacttgacacagcaaatcattccattcctgaccttcaaagagcagctattaccatccttga

SEQ ID NO: 319420 - DNA, 75 bp, Artificial Sequence
  Synthetic
tggtatttctgaacaatcattgcgtcttattgatgccatggtttacacctcagacctgctcaccaacagtgtcat

SEQ ID NO: 319421 - DNA, 75 bp, Artificial Sequence
  Synthetic
cttgtacagcaaataacacagtggttgtctaacatgttaggcactactgttgacaagctcaaacccgtatttaca

SEQ ID NO: 319422 - DNA, 75 bp, Artificial Sequence
  Synthetic
tgtctaacatgttaggcactactgttgacaagctcaaacccgtatttacatgggttgaggctaaactcagtgcag

SEQ ID NO: 319423 - DNA, 75 bp, Artificial Sequence
  Synthetic
ggaaattctaaaatttttggttacaggagtgtttgacattgttaagggtcaaatacaagtggcttcagataatct

SEQ ID NO: 319424 - DNA, 75 bp, Artificial Sequence
  Synthetic
tatggtactattactgttgaagagcttaagcagctcttggaacaatggaacctattaataggattccttttcctc

SEQ ID NO: 319425 - DNA, 75 bp, Artificial Sequence
  Synthetic
ggagtgtttgacattgttaagggtcaaatacaagtggcttcagataatctcaaggaatgtgtaaaagctttcctt

SEQ ID NO: 319426 - DNA, 75 bp, Artificial Sequence
  Synthetic
tgtgcattgaccaagtcataatcgctggtgccaagctgagaacactcaacttgggcgaggtcttcattgcacaga

SEQ ID NO: 319427 - DNA, 75 bp, Artificial Sequence
  Synthetic
tggtgccaagctgagaacactcaacttgggcgaggtcttcattgcacagagcaagggactctatcgtcagtgtat

SEQ ID NO: 319428 - DNA, 75 bp, Artificial Sequence
  Synthetic
cttagacatggcaagcttaggccctttgagagagacatatctaatgtgcctttctcccctgatggcaaaccttgc

SEQ ID NO: 319429 - DNA, 75 bp, Artificial Sequence
  Synthetic
ctcatgcctcttagggcaccaaaagaagtcaccttctttgagggagattcacatgatactgttttcacctctgaa

SEQ ID NO: 319430 - DNA, 75 bp, Artificial Sequence
  Synthetic
aagtcaccttctttgagggagattcacatgatactgttttcacctctgaagaggttgttcttaaaaatggtgaac

SEQ ID NO: 319431 - DNA, 75 bp, Artificial Sequence
  Synthetic
accagaccgctcatggaaagtgaacttgtcattggcgctgtgatcattcgtggtcacttgcgaatggctggacac

SEQ ID NO: 319432 - DNA, 75 bp, Artificial Sequence
  Synthetic
cagctttactaatggagctgtcataggcacaccagtttgtgttaatggccttatgctcttagaactcaaagacaa

SEQ ID NO: 319433 - DNA, 75 bp, Artificial Sequence
  Synthetic
ggcacaccagtttgtgttaatggccttatgctcttagaactcaaagacaaagagcagtattgtgctttgtctcct

SEQ ID NO: 319434 - DNA, 75 bp, Artificial Sequence
  Synthetic
tcagtctaaaaggaggtgcaccagttaagggtgtaacctttggagaagatactgttttggaagtgcaaggttaca

SEQ ID NO: 319435 - DNA, 75 bp, Artificial Sequence
  Synthetic
taagggtgtaacctttggagaagatactgttttggaagtgcaaggttacaagaatgttaaaattacattcgagct

SEQ ID NO: 319436 - DNA, 75 bp, Artificial Sequence
  Synthetic
aatgagaagtgttctgtctacactgttgagtctggtactgaagttactgaattcgcatgtgtcgtggcagaagct

SEQ ID NO: 319437 - DNA, 75 bp, Artificial Sequence
  Synthetic
ttgagtctggtactgaagttactgaattcgcatgtgtcgtggcagaagctgttgtaaagactttacaaccagttt

SEQ ID NO: 319438 - DNA, 75 bp, Artificial Sequence
  Synthetic
tgatcttgatgagtggagtgtagccacattttacttgtttgatgatgctggtgaagaaaaactttcttcgcgtat

SEQ ID NO: 319439 - DNA, 75 bp, Artificial Sequence
  Synthetic
tgatgaagaacctatggagattgaatatccttaaaacgaacatgaaaattattctattcctgacattggttgtac

SEQ ID NO: 319440 - DNA, 75 bp, Artificial Sequence
  Synthetic
acattttacttgtttgatgatgctggtgaagaaaaactttcttcgcgtatgtattgctccttctaccctcctgat

SEQ ID NO: 319441 - DNA, 75 bp, Artificial Sequence
  Synthetic
aggatgaggaagaaattccagaagaaacctgtgaacatgaatatggcacagaggatgactataaaggccttcctc

SEQ ID NO: 319442 - DNA, 75 bp, Artificial Sequence
  Synthetic
aacctgtgaacatgaatatggcacagaggatgactataaaggccttcctcttgaatttggtgcatcaaccgaaat

SEQ ID NO: 319443 - DNA, 75 bp, Artificial Sequence
  Synthetic
gaagactggcttgaggaagctattgcagcaaaacctgaaccagaacctctgcctgaagaaccagttaatcagttt

SEQ ID NO: 319444 - DNA, 75 bp, Artificial Sequence
  Synthetic
cagcaaaacctgaaccagaacctctgcctgaagaaccagttaatcagtttactggctacttaaaacttactgata

SEQ ID NO: 319445 - DNA, 75 bp, Artificial Sequence
  Synthetic
tgttaaagaggcacaacatgccaaaccaacggtgattgtcaacgctgctaacgtccatctgaaacatggtggtgg

SEQ ID NO: 319446 - DNA, 75 bp, Artificial Sequence
  Synthetic
ccaacggtgattgtcaacgctgctaacgtccatctgaaacatggtggtggtgtagcgggtgctcttaataaggca

SEQ ID NO: 319447 - DNA, 75 bp, Artificial Sequence
  Synthetic
gtgatgattacattaagaaaaatggaccacttacagtaggtggttcatgtttgctttctggacacaatcttgcta

SEQ ID NO: 319448 - DNA, 75 bp, Artificial Sequence
  Synthetic
accacttacagtaggtggttcatgtttgctttctggacacaatcttgctaagaaatgcatgcacgttgttggccc

SEQ ID NO: 319449 - DNA, 75 bp, Artificial Sequence
  Synthetic
caactcctcaaggctgcatatgcaaatttcaattcacaggatgtgctacttgcacccttattgtcagctggcata

SEQ ID NO: 319450 - DNA, 75 bp, Artificial Sequence
  Synthetic
atttcaattcacaggatgtgctacttgcacccttattgtcagctggcatatttggtgccaagccactccagtcat

SEQ ID NO: 319451 - DNA, 75 bp, Artificial Sequence
  Synthetic
cacacaagtgtacttcgcagtcaacgaccaggatctttacgatcatgttgttctaggttatttagacagcttgaa

SEQ ID NO: 319452 - DNA, 75 bp, Artificial Sequence
  Synthetic
actatgtctataacccatttatgattgatgttcagcagtggggctttacgggtaaccttcagagtaaccatgacc

SEQ ID NO: 319453 - DNA, 75 bp, Artificial Sequence
  Synthetic
gaccaggatctttacgatcatgttgttctaggttatttagacagcttgaaacctaaagttgagactcctacacag

SEQ ID NO: 319454 - DNA, 75 bp, Artificial Sequence
  Synthetic
cagccgtagagactcttacacaagagaatctagaactggaagagctaccggttatagaaaaacccgtagatgtga

SEQ ID NO: 319455 - DNA, 75 bp, Artificial Sequence
  Synthetic
gaatctagaactggaagagctaccggttatagaaaaacccgtagatgtgaagtttaaggctcgcattgaagaggt

SEQ ID NO: 319456 - DNA, 75 bp, Artificial Sequence
  Synthetic
aaatcaacgtagtgccccccgcattacatttggtggacccacagattcagctgacaataaccagaatggagaacg

SEQ ID NO: 319457 - DNA, 75 bp, Artificial Sequence
  Synthetic
tttcttaccagtaggttattattatttgctgatattaatggtaagttataccaagattctcagaatatgttaaga

SEQ ID NO: 319458 - DNA, 75 bp, Artificial Sequence
  Synthetic
ttgctgatattaatggtaagttataccaagattctcagaatatgttaagaggtgaagatatgttcttcctagaga

SEQ ID NO: 319459 - DNA, 75 bp, Artificial Sequence
  Synthetic
tgtcatcagtagtggtgacattacttgtgttataatacctgccaagaaggctggcggtactacagagatgcttgc

SEQ ID NO: 319460 - DNA, 75 bp, Artificial Sequence
  Synthetic
tgtgttataatacctgccaagaaggctggcggtactacagagatgcttgccaaggcattaaagaaggtgccagtt

SEQ ID NO: 319461 - DNA, 75 bp, Artificial Sequence
  Synthetic
caatcaaaaagagttgacttttgtggaaagggctaccaccttatgtccttcccacaagcagccccgcatggtgtt

SEQ ID NO: 319462 - DNA, 75 bp, Artificial Sequence
  Synthetic
gacaaggatgtgctggttatacacttgaagaggcaaagactgcgcttagaaaatgcaagtctgtgttctacgttt

SEQ ID NO: 319463 - DNA, 75 bp, Artificial Sequence
  Synthetic
tgaagaggcaaagactgcgcttagaaaatgcaagtctgtgttctacgttttgccttcaaaaacacctaatgacaa

SEQ ID NO: 319464 - DNA, 75 bp, Artificial Sequence
  Synthetic
tggaatttaagagagatgcttgcccatgcagaggagacaagaaaattaatgcttatttgtatggatgttaaagcc

SEQ ID NO: 319465 - DNA, 75 bp, Artificial Sequence
  Synthetic
atgcagaggagacaagaaaattaatgcttatttgtatggatgttaaagccttgatgtctactattcatcgtagat

SEQ ID NO: 319466 - DNA, 75 bp, Artificial Sequence
  Synthetic
aatcgttgattatggtgttcggttctttttctacactagtaaagagcctgtagcttccattatcacaaagctcaa

SEQ ID NO: 319467 - DNA, 75 bp, Artificial Sequence
  Synthetic
tttttctacactagtaaagagcctgtagcttccattatcacaaagctcaatttattgaatgaaccacttgttact

SEQ ID NO: 319468 - DNA, 75 bp, Artificial Sequence
  Synthetic
aatctgctgctgaggcttctaagaagccccgtcaaaaacgtactgccaccaaggcgtacaatgtcactcaagcat

SEQ ID NO: 319469 - DNA, 75 bp, Artificial Sequence
  Synthetic
gactcaatttggaagaggctgctcgttgtatgcgttctcttaaagctcctgctgtagtttcagtgtcttcaccag

SEQ ID NO: 319470 - DNA, 75 bp, Artificial Sequence
  Synthetic
catggtaggtgatgttatcactagtggtgatatcacttgtgttgtaataccctccaaaaaggctggtggcactac

SEQ ID NO: 319471 - DNA, 75 bp, Artificial Sequence
  Synthetic
ttgtatgcgttctcttaaagctcctgctgtagtttcagtgtcttcaccagatgcagttactacatataatggata

SEQ ID NO: 319472 - DNA, 75 bp, Artificial Sequence
  Synthetic
gaggaacattttatagagactgtttcccttgcaggtatgtatagggattggtcatactcaggacaacgtacagag

SEQ ID NO: 319473 - DNA, 75 bp, Artificial Sequence
  Synthetic
cccttgcaggtatgtatagggattggtcatactcaggacaacgtacagagttaggtgttgaatttcttaagcgtg

SEQ ID NO: 319474 - DNA, 75 bp, Artificial Sequence
  Synthetic
agggagtcctattcaattccatcttgatggagaggttctcttgcttgacaaacttaagagtcttttatctcttcg

SEQ ID NO: 319475 - DNA, 75 bp, Artificial Sequence
  Synthetic
acacgcaaattgtggacatgtccatgacatacggacagcagtttggtcctacttacttggacggtgctgatgtta

SEQ ID NO: 319476 - DNA, 75 bp, Artificial Sequence
  Synthetic
tgagggtaaaaccttctttgtactacctagtgatgacacactgcgtagtgaagcatttgaatattaccatactct

SEQ ID NO: 319477 - DNA, 75 bp, Artificial Sequence
  Synthetic
cgatgagagttttcttggtagatatatgtctgctttaaaccatacaaagaagtggaaatttcctcaaattggtgg

SEQ ID NO: 319478 - DNA, 75 bp, Artificial Sequence
  Synthetic
gaagtttaatgcacccgcactacaagaagcctattatagagctcgtgctggtgatgcagccaatttttgtgcgct

SEQ ID NO: 319479 - DNA, 75 bp, Artificial Sequence
  Synthetic
gtaggtgagttaggtgatgttagagaaactatgactcatcttttacagcacgctaatttagaatcagctaagaga

SEQ ID NO: 319480 - DNA, 75 bp, Artificial Sequence
  Synthetic
aaactatgactcatcttttacagcacgctaatttagaatcagctaagagagttcttaatgtggtgtgtaaaactt

SEQ ID NO: 319481 - DNA, 75 bp, Artificial Sequence
  Synthetic
aggtgtagaggctgtaatgtatatgggcacattgtcctatgaagaacttaagacaggtgttactattccatgtat

SEQ ID NO: 319482 - DNA, 75 bp, Artificial Sequence
  Synthetic
ggcacattgtcctatgaagaacttaagacaggtgttactattccatgtatatgtgggcgtgatgctacacaatat

SEQ ID NO: 319483 - DNA, 75 bp, Artificial Sequence
  Synthetic
ttatgatgtctgcaccaccttctgaatatacattacagcaaggtgcatttttatgtgctaatgagtacactggta

SEQ ID NO: 319484 - DNA, 75 bp, Artificial Sequence
  Synthetic
atatacattacagcaaggtgcatttttatgtgctaatgagtacactggtagttatcagtgtggtcattatacaca

SEQ ID NO: 319485 - DNA, 75 bp, Artificial Sequence
  Synthetic
cgtatagatggggcgtacctcactaaaatgtcagaatataaaggaccagtgactgatgttttctataaggaaata

SEQ ID NO: 319486 - DNA, 75 bp, Artificial Sequence
  Synthetic
aaatgtcagaatataaaggaccagtgactgatgttttctataaggaaatatcttacactacgactattaagcctg

SEQ ID NO: 319487 - DNA, 75 bp, Artificial Sequence
  Synthetic
ttacacagagattcaaccaaaattagatgagtattacaagaaggataatgcttactacacagagcaacccattga

SEQ ID NO: 319488 - DNA, 75 bp, Artificial Sequence
  Synthetic
tcttgtgccaactcagcctttaccaaatgcgagttttgacaatttcaaactcacatgctcaaacactaagtttgc

SEQ ID NO: 319489 - DNA, 75 bp, Artificial Sequence
  Synthetic
ctaccatacagaaggaagttatagagtgtgacgtgaaaactatcgaagttgtaggtaatgtcatacttaaaccat

SEQ ID NO: 319490 - DNA, 75 bp, Artificial Sequence
  Synthetic
agagttaggtcatgaagatttaatggctgcctatgtggaagaaacaagcattactattaagaaacctaatgagct

SEQ ID NO: 319491 - DNA, 75 bp, Artificial Sequence
  Synthetic
gctgcctatgtggaagaaacaagcattactattaagaaacctaatgagctgtcactagccctaggtcttagaact

SEQ ID NO: 319492 - DNA, 75 bp, Artificial Sequence
  Synthetic
taaatagtgtgccctggagtaaaattttggcatatgtcaaaccttttctaggacaagcggcagtgacaaccacaa

SEQ ID NO: 319493 - DNA, 75 bp, Artificial Sequence
  Synthetic
tttggcatatgtcaaaccttttctaggacaagcggcagtgacaaccacaaactgcattaaaagatgtgtgcagcg

SEQ ID NO: 319494 - DNA, 75 bp, Artificial Sequence
  Synthetic
gttatcacattattatttcaattgtgtacctttacaagaagtaccaattcaagaattagagcctcacttcctaca

SEQ ID NO: 319495 - DNA, 75 bp, Artificial Sequence
  Synthetic
gtacctttacaagaagtaccaattcaagaattagagcctcacttcctacaactatagctaaaaatagtgttaaga

SEQ ID NO: 319496 - DNA, 75 bp, Artificial Sequence
  Synthetic
caatgtggctattgttgttaagtatttgcctaggttcattaatctatgtaactgcagcttttggtgtactcttat

SEQ ID NO: 319497 - DNA, 75 bp, Artificial Sequence
  Synthetic
tgatggtgttagagagtcatatgttaactcttctaatgtcaccactatggatttctgcgagggttcttttctatg

SEQ ID NO: 319498 - DNA, 75 bp, Artificial Sequence
  Synthetic
aactcttctaatgtcaccactatggatttctgcgagggttcttttctatgcagtgtttgcttaaatgggttggat

SEQ ID NO: 319499 - DNA, 75 bp, Artificial Sequence
  Synthetic
agaccattcaggttacgatttcttcgtacaaactagaccttacatctttaggtttggcagctgagtggtttttgg

SEQ ID NO: 319500 - DNA, 75 bp, Artificial Sequence
  Synthetic
tggttaggatgtacattttctttgctttttgctactatgtgtggaaaagctatgttcatattatggatggttgca

SEQ ID NO: 319501 - DNA, 75 bp, Artificial Sequence
  Synthetic
taagcgcaatcgtgctacacgtgttgagtgcacaaccattgttaatggcatgaagagatccttctatgtctatgc

SEQ ID NO: 319502 - DNA, 75 bp, Artificial Sequence
  Synthetic
aaaaatttctaattgtgttgctgattactctgtgctctacaactcaacatttttttcaacctttaagtgctatgg

SEQ ID NO: 319503 - DNA, 75 bp, Artificial Sequence
  Synthetic
gtgatacattttgtgctggtagtactttcattagcgatgaagttgctcgtgatttgtcactccagtttaaaagac

SEQ ID NO: 319504 - DNA, 75 bp, Artificial Sequence
  Synthetic
ttatgttgttgatagtgttgctgtcaagaatggtgcactccatctttactttgacaaggctggtcaaaagactta

SEQ ID NO: 319505 - DNA, 75 bp, Artificial Sequence
  Synthetic
aagaatggtgcactccatctttactttgacaaggctggtcaaaagacttacgagagacacccactctctcacttc

SEQ ID NO: 319506 - DNA, 75 bp, Artificial Sequence
  Synthetic
ataacactaagggctcattacccattaatgttattgtttttgatggcaagtccaaatgtgacgagtcagctgcaa

SEQ ID NO: 319507 - DNA, 75 bp, Artificial Sequence
  Synthetic
taatgttattgtttttgatggcaagtccaaatgtgacgagtcagctgcaaagtctgcatctgtttattacagtca

SEQ ID NO: 319508 - DNA, 75 bp, Artificial Sequence
  Synthetic
cttgaccaggctctcgtttcagatgttggtgatagtactgaagtttctgttaaaatgtttgatgcttatgtcgat

SEQ ID NO: 319509 - DNA, 75 bp, Artificial Sequence
  Synthetic
ttggtgatagtactgaagtttctgttaaaatgtttgatgcttatgtcgatactttttcagcaactttcagtgttc

SEQ ID NO: 319510 - DNA, 75 bp, Artificial Sequence
  Synthetic
tgcaactgcccatagcgagttggcaaagggtgttgctctagatggtgtcctgtctacatttgtctcagccgcacg

SEQ ID NO: 319511 - DNA, 75 bp, Artificial Sequence
  Synthetic
aagggtgttgctctagatggtgtcctgtctacatttgtctcagccgcacgccaaggtgtcgttgatactgatgtc

SEQ ID NO: 319512 - DNA, 75 bp, Artificial Sequence
  Synthetic
tcaaactctcccaccattctgatttagaagtgacaggtgacagttgtaataacttcatgctcacctacaacaaag

SEQ ID NO: 319513 - DNA, 75 bp, Artificial Sequence
  Synthetic
agaagtgacaggtgacagttgtaataacttcatgctcacctacaacaaagttgagaacatgacgcctagagacct

SEQ ID NO: 319514 - DNA, 75 bp, Artificial Sequence
  Synthetic
aggcatattaatgcccaagtagcaaaaagtcacaatgtttcgctcatctggaacgtcaaagactatatgtctttg

SEQ ID NO: 319515 - DNA, 75 bp, Artificial Sequence
  Synthetic
aaagtcacaatgtttcgctcatctggaacgtcaaagactatatgtctttgtctgaacagttgcgcaagcaaattc

SEQ ID NO: 319516 - DNA, 75 bp, Artificial Sequence
  Synthetic
accttttaggttaacttgtgctactactagacaggttgtcaatgccataaccactaaaatctcacttaagggtgg

SEQ ID NO: 319517 - DNA, 75 bp, Artificial Sequence
  Synthetic
actagacaggttgtcaatgccataaccactaaaatctcacttaagggtggtaagattgttagtacttggttcaaa

SEQ ID NO: 319518 - DNA, 75 bp, Artificial Sequence
  Synthetic
gtgttctcgctgcattgttctgctacatcattatgccagtacattcattgtctgttcatgatggttacacaaatg

SEQ ID NO: 319519 - DNA, 75 bp, Artificial Sequence
  Synthetic
ggacggtgtcactcgtgatatcatggctaccgatgattgctttgctaataaacatgctggattcgactcatggtt

SEQ ID NO: 319520 - DNA, 75 bp, Artificial Sequence
  Synthetic
ccgctatcattactagagaaattggtttcatagtgcctggtttacctggtactgttctgagagcaattaatggag

SEQ ID NO: 319521 - DNA, 75 bp, Artificial Sequence
  Synthetic
atagtgattttgctacttctgcttgcgtcttggctgctgaatgtacaatctttaaggatgctatgggtaaacctg

SEQ ID NO: 319522 - DNA, 75 bp, Artificial Sequence
  Synthetic
gcttgagggttctatttcctatagtgagcttcgtcctgacactcgttatgtgcttatggacggttctattataca

SEQ ID NO: 319523 - DNA, 75 bp, Artificial Sequence
  Synthetic
gagcttcgtcctgacactcgttatgtgcttatggacggttctattatacaattccctaacacttacttggaaggt

SEQ ID NO: 319524 - DNA, 75 bp, Artificial Sequence
  Synthetic
atgcggagtactgtaggcatggtacttgtgaaaggtcagaagctggtgtttgcctgtctactagtggcagatggg

SEQ ID NO: 319525 - DNA, 75 bp, Artificial Sequence
  Synthetic
tctaccaggagtattctgtggtgtcgatgcaatgaatcttatagccaacatctttacacctcttgttcaacctgt

SEQ ID NO: 319526 - DNA, 75 bp, Artificial Sequence
  Synthetic
ggtgagtacaaccatgttgtagctgctaatgcattgctgtttttaatgtctttcactatactctgcctggcacct

SEQ ID NO: 319527 - DNA, 75 bp, Artificial Sequence
  Synthetic
tccagttcatttgcaatttactgctgctatttgttaccatctattcacatcttttgcttgtcgctgcaggtatgg

SEQ ID NO: 319528 - DNA, 75 bp, Artificial Sequence
  Synthetic
tgtatttctctaaagcactgtcattggttctttaataactatcttaggaaaagagtcatgtttaatggagttaca

SEQ ID NO: 319529 - DNA, 75 bp, Artificial Sequence
  Synthetic
ggttctttaataactatcttaggaaaagagtcatgtttaatggagttacatttagcacctttgaggaggcagctt

SEQ ID NO: 319530 - DNA, 75 bp, Artificial Sequence
  Synthetic
aagagtcatgtttaatggagttacatttagcacctttgaggaggcagctttgtgtacctttttacttaataagga

SEQ ID NO: 319531 - DNA, 75 bp, Artificial Sequence
  Synthetic
acattattgccacttacacagtacaacagatatctcgctctctataacaagtacaagtatttcagtggagcctta

SEQ ID NO: 319532 - DNA, 75 bp, Artificial Sequence
  Synthetic
cttgctgtcacttagcaaaggctcttaatgattttagcaactccggtgctgatgttctctaccaaccaccacaaa

SEQ ID NO: 319533 - DNA, 75 bp, Artificial Sequence
  Synthetic
ccatctggtaaagttgaaggatgcatggtacaagtcacctgtggaactacaaccctaaatggtttgtggctagat

SEQ ID NO: 319534 - DNA, 75 bp, Artificial Sequence
  Synthetic
tcatttgcacggcggaagacatgctcaatcctaactatgaagacttgctcattcgcaaatctaatcatagtttcc

SEQ ID NO: 319535 - DNA, 75 bp, Artificial Sequence
  Synthetic
attcgcaaatctaatcatagtttcctggttcaagctggtaatgttcaactccgtgttattggccattccatgcaa

SEQ ID NO: 319536 - DNA, 75 bp, Artificial Sequence
  Synthetic
tgacacaagatcatgttgacatactgggacccctttctgcacaaacaggaattgctgtcttggatatgtgtgctg

SEQ ID NO: 319537 - DNA, 75 bp, Artificial Sequence
  Synthetic
gggacccctttctgcacaaacaggaattgctgtcttggatatgtgtgctgctttgaaggagcttctacagaatgg

SEQ ID NO: 319538 - DNA, 75 bp, Artificial Sequence
  Synthetic
agcactattctagaggatgagtttacaccttttgacgttgttagacaatgttctggtgtcactttccaaggtaaa

SEQ ID NO: 319539 - DNA, 75 bp, Artificial Sequence
  Synthetic
caccttttgacgttgttagacaatgttctggtgtcactttccaaggtaaattcaagaaaattgttaagggtactc

SEQ ID NO: 319540 - DNA, 75 bp, Artificial Sequence
  Synthetic
gacatcacttttaattcttgttcaaagtacacagtggtcactgtttttctttgtctatgagaatgctttcttgcc

SEQ ID NO: 319541 - DNA, 75 bp, Artificial Sequence
  Synthetic
agcataagcatgcattcctgtgcttgtttctgttaccttctctagcaacagttgcttacttcaatatggtctaca

SEQ ID NO: 319542 - DNA, 75 bp, Artificial Sequence
  Synthetic
tatgacatggctcgaattggctgacactagcttatctggttatcggctcaaagactgtgttatgtatgcttcagc

SEQ ID NO: 319543 - DNA, 75 bp, Artificial Sequence
  Synthetic
cttagttttgcttgtcctcatgactgctcgtactgtctatgatgatgctgctagacgtgtgtggacattgatgaa

SEQ ID NO: 319544 - DNA, 75 bp, Artificial Sequence
  Synthetic
tgcttgtctattgtttcttaggctattgttgctgctgctactttggtctgttttgcttgctcaaccgctacttta

SEQ ID NO: 319545 - DNA, 75 bp, Artificial Sequence
  Synthetic
tacatgaactctcaggggcttttgccacctaagagtagtattgacgctttcaagcttaacattaagttgttgggc

SEQ ID NO: 319546 - DNA, 75 bp, Artificial Sequence
  Synthetic
ttgccactgtacagtccaaaatgtccgacgtaaagtgcacatcagtagtactgctttcagttcttcaacaactta

SEQ ID NO: 319547 - DNA, 75 bp, Artificial Sequence
  Synthetic
tggaaagtgaacttgtcattggtgctgtgatcattcgtggtcacttgcgaatggccggacactccctagggcgct

SEQ ID NO: 319548 - DNA, 75 bp, Artificial Sequence
  Synthetic
ggcacagtgtgtgcaactccacaatgacattcttcttgccaaggacactactgaagctttcgaaaagatggtttc

SEQ ID NO: 319549 - DNA, 75 bp, Artificial Sequence
  Synthetic
tgccacccttcaggctattgcttcagaatttagttccttaccatcatacgctgcctatgccactgcccaagaggc

SEQ ID NO: 319550 - DNA, 75 bp, Artificial Sequence
  Synthetic
taaagaaatctttgaatgtggctaaatctgagtttgaccgtgatgctgccatgcaacgtaagttggaaaagatgg

SEQ ID NO: 319551 - DNA, 75 bp, Artificial Sequence
  Synthetic
atctgagtttgaccgtgatgctgccatgcaacgtaagttggaaaagatggcagatcaggctatgacccaaatgta

SEQ ID NO: 319552 - DNA, 75 bp, Artificial Sequence
  Synthetic
gaagcttgataatgatgcacttaacaacattatcaacaatgcacgtgatggttgtgtaccactcaacatcatacc

SEQ ID NO: 319553 - DNA, 75 bp, Artificial Sequence
  Synthetic
gaaatccagcaagttgttgatgcggatagtaaaattgttcagcttagtgaaattaacatggacaactcacaaaat

SEQ ID NO: 319554 - DNA, 75 bp, Artificial Sequence
  Synthetic
gccctaatgtgtaaaattaattttagtagtgctatccccatgtgattttaatagcttcttaggagaatcacaaaa

SEQ ID NO: 319555 - DNA, 75 bp, Artificial Sequence
  Synthetic
ttcagctgtgctttctttctgcgcttttgctgttgacccagccaaggcctacaaagattatctagcaagtggagg

SEQ ID NO: 319556 - DNA, 75 bp, Artificial Sequence
  Synthetic
aaaatctgtgtggctgtcgcttggctgtatgcctagtgcacctacacagtataaataataactttactgtcgttg

SEQ ID NO: 319557 - DNA, 75 bp, Artificial Sequence
  Synthetic
tggtggtggtgtagcaggtgcactcaacaaggcaaccaatggtgccatgcaaaaggagagtgatgattacattaa

SEQ ID NO: 319558 - DNA, 75 bp, Artificial Sequence
  Synthetic
tcaacgtttttaaacgggtttgcggtgtaagtgcggcccgtcttacaccgtgcggcacaggcactagcactgatg

SEQ ID NO: 319559 - DNA, 75 bp, Artificial Sequence
  Synthetic
tagcggaagcacgtgaacatcttaaaaatggcacttgtggcctagtagagctggaaaaaggtgttttacgccagc

SEQ ID NO: 319560 - DNA, 75 bp, Artificial Sequence
  Synthetic
aaatggcacttgtggcctagtagagctggaaaaaggtgttttacgccagcttgaagagccctatgtgttcattaa

SEQ ID NO: 319561 - DNA, 75 bp, Artificial Sequence
  Synthetic
catggccataaggttgttgaattggtggctgaaatgaatggcattcagttcggtcgtagcggtacaacactggga

SEQ ID NO: 319562 - DNA, 75 bp, Artificial Sequence
  Synthetic
tggctgaaatgaatggcattcagttcggtcgtagcggtacaacactgggagttctcgtgccacatgtgggcgaaa

SEQ ID NO: 319563 - DNA, 75 bp, Artificial Sequence
  Synthetic
gctggtggtcatagctacggcatcgatctaaagtcttatgacttaggtgacgagcttaacactgatcccattgaa

SEQ ID NO: 319564 - DNA, 75 bp, Artificial Sequence
  Synthetic
agcatggcaggggtgctctccgtgaactcattcgtgagcttaatggaggtgcagtcactcgctatgttgataaca

SEQ ID NO: 319565 - DNA, 75 bp, Artificial Sequence
  Synthetic
actcattcgtgagcttaatggaggtgcagtcactcgctatgttgataacaacttctgtggccctgatgggtatcc

SEQ ID NO: 319566 - DNA, 75 bp, Artificial Sequence
  Synthetic
gctcgtgcgggtaagtcgatgtgcactctttccgaacaacttgatttcattgaatcgaagcgcggtgtctattgc

SEQ ID NO: 319567 - DNA, 75 bp, Artificial Sequence
  Synthetic
gactgtgcaattctgcgatgctatgcgcgatgcgggcatcgtaggtgtactgacattagataatcaggatctgaa

SEQ ID NO: 319568 - DNA, 75 bp, Artificial Sequence
  Synthetic
cttggtacactgagcgctcagacaagagttatgagcaccagacaccattcgaggttaagagtgccaagaaatttg

SEQ ID NO: 319569 - DNA, 75 bp, Artificial Sequence
  Synthetic
aaaagaaaaagactgaaggtttcatggggcgtatacgctctgtgtaccaagttgccactccaaatgaatgcaacg

SEQ ID NO: 319570 - DNA, 75 bp, Artificial Sequence
  Synthetic
gtgcaatcattgtgatgaagcttcttggcagacgtgtgattttctcaaagccacttgtgaatattgtggcactga

SEQ ID NO: 319571 - DNA, 75 bp, Artificial Sequence
  Synthetic
ccacttgtgaatattgtggcactgaaaatccagtgagtggaggacctactacatgtgggtacctacctactaatg

SEQ ID NO: 319572 - DNA, 75 bp, Artificial Sequence
  Synthetic
ccgcctacgagcttcggaccactagtgaggaaaatatttgtagatggtgtaccttttgttgtttcaacaggatac

SEQ ID NO: 319573 - DNA, 75 bp, Artificial Sequence
  Synthetic
aaagagcctgtagcttctattattacgaagctgaactctctaaatgagccgcttgtcacaatgccaattggttat

SEQ ID NO: 319574 - DNA, 75 bp, Artificial Sequence
  Synthetic
ataggttcaaaccatactggcattaccggtgacaatgtagaagttcttaatgaagacctccttgagatactgaat

SEQ ID NO: 319575 - DNA, 75 bp, Artificial Sequence
  Synthetic
ccggtgacaatgtagaagttcttaatgaagacctccttgagatactgaatcgtgaacgtgttaatattaacattg

SEQ ID NO: 319576 - DNA, 75 bp, Artificial Sequence
  Synthetic
aggaaggaagttctgttgaactaaaacacttcttctttgctcaggatggcaatgctgctatcagcgattatgact

SEQ ID NO: 319577 - DNA, 75 bp, Artificial Sequence
  Synthetic
gattgccatcattttagcgtctctttctgcttctacgagtgcttttgttgacactgtaaagagtcttgattacaa

SEQ ID NO: 319578 - DNA, 75 bp, Artificial Sequence
  Synthetic
tctgcttctacgagtgcttttgttgacactgtaaagagtcttgattacaagtcttttaaagccattgttgagtct

SEQ ID NO: 319579 - DNA, 75 bp, Artificial Sequence
  Synthetic
gcaagcctgtgaaaggtgcttggaacattggacaacaaaaatctattctgacaccactgtgtggatttccatcac

SEQ ID NO: 319580 - DNA, 75 bp, Artificial Sequence
  Synthetic
cattggacaacaaaaatctattctgacaccactgtgtggatttccatcacaggctgctggtgttattagatctat

SEQ ID NO: 319581 - DNA, 75 bp, Artificial Sequence
  Synthetic
catttaataaatggggtaaggctaggctttattatgattcaatgagttatgaggatcaagatgtactgttcgcat

SEQ ID NO: 319582 - DNA, 75 bp, Artificial Sequence
  Synthetic
aataattctatcccagatttacaaagagcagctgtcaccatcctcggtgacatttccgaacagtcactgcgtctt

SEQ ID NO: 319583 - DNA, 75 bp, Artificial Sequence
  Synthetic
gagcagctgtcaccatcctcggtgacatttccgaacagtcactgcgtcttgttgatgcaatggtgtgtacatcag

SEQ ID NO: 319584 - DNA, 75 bp, Artificial Sequence
  Synthetic
catggcatatgttactggtggtcttgtacagcaaacagtgcaatggttgtctaatgtgttaggcaccacagtcga

SEQ ID NO: 319585 - DNA, 75 bp, Artificial Sequence
  Synthetic
ccgccaccagaggagctactgtagtaattggaacaagcaaattttatggtggctggcataacatgttaaaaactg

SEQ ID NO: 319586 - DNA, 75 bp, Artificial Sequence
  Synthetic
gtacagcaaacagtgcaatggttgtctaatgtgttaggcaccacagtcgacaaactcaaacctgtatttacatgg

SEQ ID NO: 319587 - DNA, 75 bp, Artificial Sequence
  Synthetic
tagagtttctcaaggatgcttgggaaattcttaaattcctagttacaggtgtgtttgacattgttaaaggtcaaa

SEQ ID NO: 319588 - DNA, 75 bp, Artificial Sequence
  Synthetic
tgtgacagagccatgcctaatatgcttaggatcatggcttctcttgttcttgctcgcaaacatagcacgtgctgt

SEQ ID NO: 319589 - DNA, 75 bp, Artificial Sequence
  Synthetic
aattcttaaattcctagttacaggtgtgtttgacattgttaaaggtcaaatacgggtgttttcggacaacctcaa

SEQ ID NO: 319590 - DNA, 75 bp, Artificial Sequence
  Synthetic
gttgtcaacaaagcgcttgaaatgtgcattgaccaagtcacaatcgcaggcaccaaggtgagatcactcaacctt

SEQ ID NO: 319591 - DNA, 75 bp, Artificial Sequence
  Synthetic
aagtgagatggtcatgtgtggcggctcactatatgtgaaaccaggtggcacatcgtctggtgatgctacaactgc

SEQ ID NO: 319592 - DNA, 75 bp, Artificial Sequence
  Synthetic
gcattgaccaagtcacaatcgcaggcaccaaggtgagatcactcaaccttggggaggtttttattgcgcaaagca

SEQ ID NO: 319593 - DNA, 75 bp, Artificial Sequence
  Synthetic
tgtcaagctgtaacagctaatgtaaatgcactcctttcaactgatggcaataagattgccgacaagtacgtccgc

SEQ ID NO: 319594 - DNA, 75 bp, Artificial Sequence
  Synthetic
tggcaaggagcagctgcaactactcatgcctttgaaggcacctaaagaagtcactttccttgaaggagactcaca

SEQ ID NO: 319595 - DNA, 75 bp, Artificial Sequence
  Synthetic
taagattgccgacaagtacgtccgcaatcttcaacacagactttatgagtgtctctatagaaatagggatgtaga

SEQ ID NO: 319596 - DNA, 75 bp, Artificial Sequence
  Synthetic
atgcctttgaaggcacctaaagaagtcactttccttgaaggagactcacatgatacagtactaatctccgaagag

SEQ ID NO: 319597 - DNA, 75 bp, Artificial Sequence
  Synthetic
aagcactcgagacaccagttgacagtttcacaaatggagccgtcgtaggcactccagtttgtgtcaatggcctca

SEQ ID NO: 319598 - DNA, 75 bp, Artificial Sequence
  Synthetic
gcatatttgcgcaaacacttctccatgatgattctttctgatgatgccgttgtgtgctacaatagtaactatgcg

SEQ ID NO: 319599 - DNA, 75 bp, Artificial Sequence
  Synthetic
tttcacaaatggagccgtcgtaggcactccagtttgtgtcaatggcctcatgctcttggagctcaaagataagga

SEQ ID NO: 319600 - DNA, 75 bp, Artificial Sequence
  Synthetic
tgtgtgctacaatagtaactatgcggctcagggtttagtagctagcattaagaacttcaaagcagttcattacta

SEQ ID NO: 319601 - DNA, 75 bp, Artificial Sequence
  Synthetic
ttattagctacaaacaatgtcttccgtctaaatggaggtgcaccggttaaaggtgtaacctttggagaaaacact

SEQ ID NO: 319602 - DNA, 75 bp, Artificial Sequence
  Synthetic
gtctaaatggaggtgcaccggttaaaggtgtaacctttggagaaaacactgttttagaagttcaaggttacaaga

SEQ ID NO: 319603 - DNA, 75 bp, Artificial Sequence
  Synthetic
tgagcgtgtagacaaagtgcttaacgagaagtgttctgtctacactgttgaatccggtacagaggttactgaatt

SEQ ID NO: 319604 - DNA, 75 bp, Artificial Sequence
  Synthetic
gagaagtgttctgtctacactgttgaatccggtacagaggttactgaattcgcatgtgttgttgcagaagccgtt

SEQ ID NO: 319605 - DNA, 75 bp, Artificial Sequence
  Synthetic
aggtgcaggctgttttgtcgatgatattgtcaaaacagatggtacactcatgattgaacggtttgtgtcactcgc

SEQ ID NO: 319606 - DNA, 75 bp, Artificial Sequence
  Synthetic
attgtcaaaacagatggtacactcatgattgaacggtttgtgtcactcgcgattgacgcttacccacttacaaaa

SEQ ID NO: 319607 - DNA, 75 bp, Artificial Sequence
  Synthetic
accttcttactaagatgggtattgaccttgatgagtggagtgtagctacattctacttgtttgatgatgctggtg

SEQ ID NO: 319608 - DNA, 75 bp, Artificial Sequence
  Synthetic
ccttgatgagtggagtgtagctacattctacttgtttgatgatgctggtgaagaaaaactttcatcacgcatgta

SEQ ID NO: 319609 - DNA, 75 bp, Artificial Sequence
  Synthetic
ttttccatttgtacttacaatacattagaaaactacatgatgagcttactggtcacatgttagacatgtactctg

SEQ ID NO: 319610 - DNA, 75 bp, Artificial Sequence
  Synthetic
tagaaaactacatgatgagcttactggtcacatgttagacatgtactctgtaatgctaactaatgataacacttc

SEQ ID NO: 319611 - DNA, 75 bp, Artificial Sequence
  Synthetic
gaagaagactgcgaagagtatgaggatgaggaagaagttcctgatgaaacctgtgaacacgaatacggcacagag

SEQ ID NO: 319612 - DNA, 75 bp, Artificial Sequence
  Synthetic
gaggctatgtacacaccacacacagtcttacaggctgtaggcgcatgtgtgttatgcaattcacagacttcactt

SEQ ID NO: 319613 - DNA, 75 bp, Artificial Sequence
  Synthetic
tcttacaggctgtaggcgcatgtgtgttatgcaattcacagacttcacttcgttgtggtgcctgcattaggagac

SEQ ID NO: 319614 - DNA, 75 bp, Artificial Sequence
  Synthetic
agtttggttcgtcaacagaaatacaacaggttgaagatgaagaggaagactggcttgatgatgttggtgaagcag

SEQ ID NO: 319615 - DNA, 75 bp, Artificial Sequence
  Synthetic
cttcattgcgcaaactttaatgtgttattttctactgtgtttccacctacaagttttggaccactagtaagaaaa

SEQ ID NO: 319616 - DNA, 75 bp, Artificial Sequence
  Synthetic
tgatcatgttatttcaacatcgcataaattagtgctgtctgttaatccctatgtttgcaacgcaccaggttgtga

SEQ ID NO: 319617 - DNA, 75 bp, Artificial Sequence
  Synthetic
aaattagtgctgtctgttaatccctatgtttgcaacgcaccaggttgtgatgtcactgatgtgacacaactatac

SEQ ID NO: 319618 - DNA, 75 bp, Artificial Sequence
  Synthetic
tactttaaacttactgacaatgttgccattaaatgtgttgacatcgttaaggaagcgcaaagtgccaaacctgcg

SEQ ID NO: 319619 - DNA, 75 bp, Artificial Sequence
  Synthetic
agttacataagcctcccattagtttccctttgtgtgctaatggtcaggtttttggtttatacaagaacacatgtg

SEQ ID NO: 319620 - DNA, 75 bp, Artificial Sequence
  Synthetic
taatgcaatagcaacatgtgattggactaatgctggtgattacatacttgcaaacacctgtactgaaaggctcaa

SEQ ID NO: 319621 - DNA, 75 bp, Artificial Sequence
  Synthetic
tctggacacaatttggctaagaagtgtatgcatgttgttggcccaaacctaaatgctggtgaggatgtccaacta

SEQ ID NO: 319622 - DNA, 75 bp, Artificial Sequence
  Synthetic
gtatgcatgttgttggcccaaacctaaatgctggtgaggatgtccaactacttaaagctgcatatgacaacttta

SEQ ID NO: 319623 - DNA, 75 bp, Artificial Sequence
  Synthetic
agtactgtctgatagagaactccatctgtcgtgggaggtaggcaaaccaagaccaccattgaatagaaactatgt

SEQ ID NO: 319624 - DNA, 75 bp, Artificial Sequence
  Synthetic
actactgtcagcaggcatatttggtgctaaaccacttcagtctttaaagatgtgtgttgaagtagttcgcacaca

SEQ ID NO: 319625 - DNA, 75 bp, Artificial Sequence
  Synthetic
gctaaaccacttcagtctttaaagatgtgtgttgaagtagttcgcacacaagtttacctcgcggtcaatgatagg

SEQ ID NO: 319626 - DNA, 75 bp, Artificial Sequence
  Synthetic
attatctggacagtttgaaacctaaagtggagtctcccaaaaaggaggagaatccaaaattggaagagcataaag

SEQ ID NO: 319627 - DNA, 75 bp, Artificial Sequence
  Synthetic
agtggagtctcccaaaaaggaggagaatccaaaattggaagagcataaagcgaaacagccagctgaaaaacctgt

SEQ ID NO: 319628 - DNA, 75 bp, Artificial Sequence
  Synthetic
attactttgtgttaacatcacatacagtaatgcctctaagtgcaccaacactagtgcctcaagagcactatgtga

SEQ ID NO: 319629 - DNA, 75 bp, Artificial Sequence
  Synthetic
tgtgtcgaagaggttactacaacattggaagaaactaaacttctcacccaaaatctgcttctttttgctgatatc

SEQ ID NO: 319630 - DNA, 75 bp, Artificial Sequence
  Synthetic
agaatatgctaagaggtgaagacatgtcttttctagaaaaggacgcaccatatgtagtaggtgatgtcatcacta

SEQ ID NO: 319631 - DNA, 75 bp, Artificial Sequence
  Synthetic
actacccgtctgctcgcatagtgtatacagcttgctctcatgctgctgttgatgcattatgcgaaaaggcattga

SEQ ID NO: 319632 - DNA, 75 bp, Artificial Sequence
  Synthetic
acagaaatgcttgcaaaggcattaaagaaagtgccagtgtgtgagtatataactacatatcccggacaaggatgt

SEQ ID NO: 319633 - DNA, 75 bp, Artificial Sequence
  Synthetic
tagaatcatacccgcacgtgcccgtgtggagtgttttgataaattcaaagtgaattcaacattagaacagtatgt

SEQ ID NO: 319634 - DNA, 75 bp, Artificial Sequence
  Synthetic
gtggagtgttttgataaattcaaagtgaattcaacattagaacagtatgttttctgcactgttaatgcactgcct

SEQ ID NO: 319635 - DNA, 75 bp, Artificial Sequence
  Synthetic
agactgcgcttaaaaggtgcaaatctgcatgctatgtattaccttcaaaaacacctaatgtaaaagatgaaatcc

SEQ ID NO: 319636 - DNA, 75 bp, Artificial Sequence
  Synthetic
tgcatgctatgtattaccttcaaaaacacctaatgtaaaagatgaaatccttggaacggtgtcttggaatttaag
